United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 55

SEQ ID NO: 1962198 - RNA, 22 nt, Shigella flexneri 2a str. 301
caaucgucagcucgcugccauc

SEQ ID NO: 1962199 - RNA, 15 nt, Shigella flexneri 2a str. 301
caaucugcuugcgau

SEQ ID NO: 1962200 - RNA, 20 nt, Shigella flexneri 2a str. 301
caaucuuccucgccagcgau

SEQ ID NO: 1962201 - RNA, 16 nt, Shigella flexneri 2a str. 301
caauacuuccgcuucc

SEQ ID NO: 1962202 - RNA, 12 nt, Shigella flexneri 2a str. 301
caauacuggcag

SEQ ID NO: 1962203 - RNA, 19 nt, Shigella flexneri 2a str. 301
caauacugaucaucauuac

SEQ ID NO: 1962204 - RNA, 14 nt, Shigella flexneri 2a str. 301
caauauccauuugu

SEQ ID NO: 1962205 - RNA, 18 nt, Shigella flexneri 2a str. 301
caauaguguugccgccac

SEQ ID NO: 1962206 - RNA, 17 nt, Shigella flexneri 2a str. 301
caauacugacaucagca

SEQ ID NO: 1962207 - RNA, 13 nt, Shigella flexneri 2a str. 301
caaucgaccaggc

SEQ ID NO: 1962208 - RNA, 14 nt, Shigella flexneri 2a str. 301
caaucagcaccgcg

SEQ ID NO: 1962209 - RNA, 17 nt, Shigella flexneri 2a str. 301
caaucaccgccagcaag

SEQ ID NO: 1962210 - RNA, 15 nt, Shigella flexneri 2a str. 301
caaucaccaugccgu

SEQ ID NO: 1962211 - RNA, 16 nt, Shigella flexneri 2a str. 301
caaucaccaccagcgg

SEQ ID NO: 1962212 - RNA, 15 nt, Shigella flexneri 2a str. 301
caaucacaaauagac

SEQ ID NO: 1962213 - RNA, 20 nt, Shigella flexneri 2a str. 301
caaucacgucgcccaccgcg

SEQ ID NO: 1962214 - RNA, 14 nt, Shigella flexneri 2a str. 301
caaucacugccaga

SEQ ID NO: 1962215 - RNA, 19 nt, Shigella flexneri 2a str. 301
caaucaaauuauccacggc

SEQ ID NO: 1962216 - RNA, 18 nt, Shigella flexneri 2a str. 301
caauaucggcaccagcgc

SEQ ID NO: 1962217 - RNA, 17 nt, Shigella flexneri 2a str. 301
caauauagauaucaugc

SEQ ID NO: 1962218 - RNA, 13 nt, Shigella flexneri 2a str. 301
caaccgccaccga

SEQ ID NO: 1962219 - RNA, 18 nt, Shigella flexneri 2a str. 301
caaccgaacccagcaggu

SEQ ID NO: 1962220 - RNA, 21 nt, Shigella flexneri 2a str. 301
caaccgguggcaguagcgccu

SEQ ID NO: 1962221 - RNA, 21 nt, Shigella flexneri 2a str. 301
caaccguaaacgaucaucgac

SEQ ID NO: 1962222 - RNA, 19 nt, Shigella flexneri 2a str. 301
caacgcggagcgguaguuc

SEQ ID NO: 1962223 - RNA, 13 nt, Shigella flexneri 2a str. 301
caacgcgccgcca

SEQ ID NO: 1962224 - RNA, 16 nt, Shigella flexneri 2a str. 301
caacgcugcugccggc

SEQ ID NO: 1962225 - RNA, 18 nt, Shigella flexneri 2a str. 301
caacgccuuugucgggca

SEQ ID NO: 1962226 - RNA, 18 nt, Shigella flexneri 2a str. 301
caacgccuaaugccagcg

SEQ ID NO: 1962227 - RNA, 15 nt, Shigella flexneri 2a str. 301
caacgccgcgcgcca

SEQ ID NO: 1962228 - RNA, 16 nt, Shigella flexneri 2a str. 301
caacgacggccaguug

SEQ ID NO: 1962229 - RNA, 16 nt, Shigella flexneri 2a str. 301
caacgagagucgacac

SEQ ID NO: 1962230 - RNA, 15 nt, Shigella flexneri 2a str. 301
caacgagcugcccgc

SEQ ID NO: 1962231 - RNA, 14 nt, Shigella flexneri 2a str. 301
caacgaccagaaau

SEQ ID NO: 1962232 - RNA, 12 nt, Shigella flexneri 2a str. 301
caacgacccagc

SEQ ID NO: 1962233 - RNA, 16 nt, Shigella flexneri 2a str. 301
caacgaaggccugcau

SEQ ID NO: 1962234 - RNA, 21 nt, Shigella flexneri 2a str. 301
caaccuuuuccauugccgcag

SEQ ID NO: 1962235 - RNA, 18 nt, Shigella flexneri 2a str. 301
caacaucgaaaacgccac

SEQ ID NO: 1962236 - RNA, 12 nt, Shigella flexneri 2a str. 301
caacaugccgag

SEQ ID NO: 1962237 - RNA, 20 nt, Shigella flexneri 2a str. 301
caacauggcaaccuucgcgg

SEQ ID NO: 1962238 - RNA, 18 nt, Shigella flexneri 2a str. 301
caacaugcagcccagcau

SEQ ID NO: 1962239 - RNA, 21 nt, Shigella flexneri 2a str. 301
caaccaaggaaggucacgaug

SEQ ID NO: 1962240 - RNA, 14 nt, Shigella flexneri 2a str. 301
caaccaacgccagc

SEQ ID NO: 1962241 - RNA, 15 nt, Shigella flexneri 2a str. 301
caaccacuacgugau

SEQ ID NO: 1962242 - RNA, 18 nt, Shigella flexneri 2a str. 301
caaccagauaaccaucgc

SEQ ID NO: 1962243 - RNA, 22 nt, Shigella flexneri 2a str. 301
caaccagaaagaugcaucauua

SEQ ID NO: 1962244 - RNA, 14 nt, Shigella flexneri 2a str. 301
caaccagacgaaau

SEQ ID NO: 1962245 - RNA, 15 nt, Shigella flexneri 2a str. 301
caaccacaaccgccg

SEQ ID NO: 1962246 - RNA, 21 nt, Shigella flexneri 2a str. 301
caacaucaaauuacagcaccu

SEQ ID NO: 1962247 - RNA, 14 nt, Shigella flexneri 2a str. 301
caacauaacgcauc

SEQ ID NO: 1962248 - RNA, 19 nt, Shigella flexneri 2a str. 301
caacagugccaaucgucgu

SEQ ID NO: 1962249 - RNA, 16 nt, Shigella flexneri 2a str. 301
caacaccuaccggcug

SEQ ID NO: 1962250 - RNA, 17 nt, Shigella flexneri 2a str. 301
caacaccuguuccagug

SEQ ID NO: 1962251 - RNA, 20 nt, Shigella flexneri 2a str. 301
caacagcggcauuacgcgcc

SEQ ID NO: 1962252 - RNA, 14 nt, Shigella flexneri 2a str. 301
caacacgccuggcu

SEQ ID NO: 1962253 - RNA, 19 nt, Shigella flexneri 2a str. 301
caaagugauauccaccgcg

SEQ ID NO: 1962254 - RNA, 20 nt, Shigella flexneri 2a str. 301
caaaguggaugaucgcggca

SEQ ID NO: 1962255 - RNA, 18 nt, Shigella flexneri 2a str. 301
caaaguuaccggaagcgc

SEQ ID NO: 1962256 - RNA, 13 nt, Shigella flexneri 2a str. 301
caaagccaacagc

SEQ ID NO: 1962257 - RNA, 13 nt, Shigella flexneri 2a str. 301
caaaugucaccag

SEQ ID NO: 1962258 - RNA, 17 nt, Shigella flexneri 2a str. 301
caaaugcagcauugccu

SEQ ID NO: 1962259 - RNA, 13 nt, Shigella flexneri 2a str. 301
caaaugcaucagu

SEQ ID NO: 1962260 - RNA, 20 nt, Shigella flexneri 2a str. 301
caaaugcgacaacuggcagc

SEQ ID NO: 1962261 - RNA, 22 nt, Shigella flexneri 2a str. 301
caaaucucccuugcgggaucag

SEQ ID NO: 1962262 - RNA, 20 nt, Shigella flexneri 2a str. 301
caaaugaacaccaaacccug

SEQ ID NO: 1962263 - RNA, 20 nt, Shigella flexneri 2a str. 301
caacaaugccacgccacagc

SEQ ID NO: 1962264 - RNA, 16 nt, Shigella flexneri 2a str. 301
caacaaccuugcguuu

SEQ ID NO: 1962265 - RNA, 14 nt, Shigella flexneri 2a str. 301
caacaacuggugcg

SEQ ID NO: 1962266 - RNA, 20 nt, Shigella flexneri 2a str. 301
caacaaaauaauccgucagc

SEQ ID NO: 1962267 - RNA, 18 nt, Shigella flexneri 2a str. 301
caacaacaauuucacuug

SEQ ID NO: 1962268 - RNA, 13 nt, Shigella flexneri 2a str. 301
caccaccagcagc

SEQ ID NO: 1962269 - RNA, 13 nt, Shigella flexneri 2a str. 301
caccaccagacgc

SEQ ID NO: 1962270 - RNA, 19 nt, Shigella flexneri 2a str. 301
caccacgccggaugaaauc

SEQ ID NO: 1962271 - RNA, 20 nt, Shigella flexneri 2a str. 301
caccacggaaaguuuaauug

SEQ ID NO: 1962272 - RNA, 14 nt, Shigella flexneri 2a str. 301
cacaaaaaccgcug

SEQ ID NO: 1962273 - RNA, 17 nt, Shigella flexneri 2a str. 301
caauuuuguaggccgga

SEQ ID NO: 1962274 - RNA, 16 nt, Shigella flexneri 2a str. 301
cacaaauagccagcag

SEQ ID NO: 1962275 - RNA, 16 nt, Shigella flexneri 2a str. 301
cacaugaguugcugga

SEQ ID NO: 1962276 - RNA, 19 nt, Shigella flexneri 2a str. 301
cacaugccgcgcgguauau

SEQ ID NO: 1962277 - RNA, 19 nt, Shigella flexneri 2a str. 301
cacaugcuggaaccacagc

SEQ ID NO: 1962278 - RNA, 15 nt, Shigella flexneri 2a str. 301
cacaucaucaucgcg

SEQ ID NO: 1962279 - RNA, 15 nt, Shigella flexneri 2a str. 301
cacauccacaaugcg

SEQ ID NO: 1962280 - RNA, 22 nt, Shigella flexneri 2a str. 301
cacaucaauuugcccaccgguu

SEQ ID NO: 1962281 - RNA, 15 nt, Shigella flexneri 2a str. 301
cacauaugaucggaa

SEQ ID NO: 1962282 - RNA, 18 nt, Shigella flexneri 2a str. 301
cacaguuucagccccauc

SEQ ID NO: 1962283 - RNA, 21 nt, Shigella flexneri 2a str. 301
cacaguuucagccccaucaac

SEQ ID NO: 1962284 - RNA, 11 nt, Shigella flexneri 2a str. 301
cacaggcgcga

SEQ ID NO: 1962285 - RNA, 13 nt, Shigella flexneri 2a str. 301
caccagcgcacgc

SEQ ID NO: 1962286 - RNA, 17 nt, Shigella flexneri 2a str. 301
caccauuacgcaaugcg

SEQ ID NO: 1962287 - RNA, 19 nt, Shigella flexneri 2a str. 301
caccauguugcgcagaguu

SEQ ID NO: 1962288 - RNA, 18 nt, Shigella flexneri 2a str. 301
caccaugccgauggcaaa

SEQ ID NO: 1962289 - RNA, 16 nt, Shigella flexneri 2a str. 301
caccauuggcauuggu

SEQ ID NO: 1962290 - RNA, 13 nt, Shigella flexneri 2a str. 301
caccauucugcgc

SEQ ID NO: 1962291 - RNA, 15 nt, Shigella flexneri 2a str. 301
caccauucugcgcug

SEQ ID NO: 1962292 - RNA, 16 nt, Shigella flexneri 2a str. 301
caccauacuucgguaa

SEQ ID NO: 1962293 - RNA, 21 nt, Shigella flexneri 2a str. 301
caccguguucaugaccgugau

SEQ ID NO: 1962294 - RNA, 17 nt, Shigella flexneri 2a str. 301
caccgucaugccgguaa

SEQ ID NO: 1962295 - RNA, 17 nt, Shigella flexneri 2a str. 301
caccggcgacccgcgac

SEQ ID NO: 1962296 - RNA, 19 nt, Shigella flexneri 2a str. 301
caccgggcagacgugacca

SEQ ID NO: 1962297 - RNA, 22 nt, Shigella flexneri 2a str. 301
caccgguacaaacaucauccag

SEQ ID NO: 1962298 - RNA, 21 nt, Shigella flexneri 2a str. 301
caccgcuggcugcgaacgcaa

SEQ ID NO: 1962299 - RNA, 15 nt, Shigella flexneri 2a str. 301
cacccgguaccuuug

SEQ ID NO: 1962300 - RNA, 18 nt, Shigella flexneri 2a str. 301
caccgacaaauuucaucg

SEQ ID NO: 1962301 - RNA, 13 nt, Shigella flexneri 2a str. 301
caccgacccggua

SEQ ID NO: 1962302 - RNA, 13 nt, Shigella flexneri 2a str. 301
caccgccacgccg

SEQ ID NO: 1962303 - RNA, 21 nt, Shigella flexneri 2a str. 301
caccgacgucgauauaauuga

SEQ ID NO: 1962304 - RNA, 23 nt, Shigella flexneri 2a str. 301
caccgauucccgggcacacuuag

SEQ ID NO: 1962305 - RNA, 14 nt, Shigella flexneri 2a str. 301
caccgccaccaccg

SEQ ID NO: 1962306 - RNA, 21 nt, Shigella flexneri 2a str. 301
augaguuuggugccacgcgca

SEQ ID NO: 1962307 - RNA, 18 nt, Shigella flexneri 2a str. 301
augauaggucauaucaca

SEQ ID NO: 1962308 - RNA, 14 nt, Shigella flexneri 2a str. 301
augacguaucaccg

SEQ ID NO: 1962309 - RNA, 14 nt, Shigella flexneri 2a str. 301
augacucgccgcug

SEQ ID NO: 1962310 - RNA, 14 nt, Shigella flexneri 2a str. 301
augacuccagcgcc

SEQ ID NO: 1962311 - RNA, 15 nt, Shigella flexneri 2a str. 301
augaccguuacugau

SEQ ID NO: 1962312 - RNA, 21 nt, Shigella flexneri 2a str. 301
augaauguuuuccugcuucac

SEQ ID NO: 1962313 - RNA, 20 nt, Shigella flexneri 2a str. 301
aucugcggguuagucugcau

SEQ ID NO: 1962314 - RNA, 16 nt, Shigella flexneri 2a str. 301
aucugcgguugugccg

SEQ ID NO: 1962315 - RNA, 19 nt, Shigella flexneri 2a str. 301
aucugcggguuagucugca

SEQ ID NO: 1962316 - RNA, 15 nt, Shigella flexneri 2a str. 301
aucugcguggcgcgc

SEQ ID NO: 1962317 - RNA, 19 nt, Shigella flexneri 2a str. 301
aucugcuguucuacggcuc

SEQ ID NO: 1962318 - RNA, 21 nt, Shigella flexneri 2a str. 301
aucuguuugccagucuggcuu

SEQ ID NO: 1962319 - RNA, 13 nt, Shigella flexneri 2a str. 301
aucuguugcugcc

SEQ ID NO: 1962320 - RNA, 23 nt, Shigella flexneri 2a str. 301
aucuguuccggcguacgggcaaa

SEQ ID NO: 1962321 - RNA, 13 nt, Shigella flexneri 2a str. 301
aucugucauaaca

SEQ ID NO: 1962322 - RNA, 18 nt, Shigella flexneri 2a str. 301
aucuucacuguccgucag

SEQ ID NO: 1962323 - RNA, 23 nt, Shigella flexneri 2a str. 301
aucuuauucgggauugccagaug

SEQ ID NO: 1962324 - RNA, 15 nt, Shigella flexneri 2a str. 301
aucuucauccggcug

SEQ ID NO: 1962325 - RNA, 15 nt, Shigella flexneri 2a str. 301
aucuucccagcgcag

SEQ ID NO: 1962326 - RNA, 11 nt, Shigella flexneri 2a str. 301
aucuucccagc

SEQ ID NO: 1962327 - RNA, 15 nt, Shigella flexneri 2a str. 301
aucuuccagaucacc

SEQ ID NO: 1962328 - RNA, 20 nt, Shigella flexneri 2a str. 301
aucuucauagauagccagca

SEQ ID NO: 1962329 - RNA, 14 nt, Shigella flexneri 2a str. 301
aucuucuccacgcc

SEQ ID NO: 1962330 - RNA, 17 nt, Shigella flexneri 2a str. 301
aucuuuaucaaucaccg

SEQ ID NO: 1962331 - RNA, 16 nt, Shigella flexneri 2a str. 301
aucgggucaccgccga

SEQ ID NO: 1962332 - RNA, 14 nt, Shigella flexneri 2a str. 301
aucgggucaccgcc

SEQ ID NO: 1962333 - RNA, 22 nt, Shigella flexneri 2a str. 301
aucgguaccgccagcaggaacg

SEQ ID NO: 1962334 - RNA, 16 nt, Shigella flexneri 2a str. 301
aucgucaaugccguca

SEQ ID NO: 1962335 - RNA, 15 nt, Shigella flexneri 2a str. 301
aucgguaugcaacau

SEQ ID NO: 1962336 - RNA, 16 nt, Shigella flexneri 2a str. 301
aucgucucgauacgcc

SEQ ID NO: 1962337 - RNA, 17 nt, Shigella flexneri 2a str. 301
aucguccacgucaucaa

SEQ ID NO: 1962338 - RNA, 13 nt, Shigella flexneri 2a str. 301
aucguccgccagc

SEQ ID NO: 1962339 - RNA, 22 nt, Shigella flexneri 2a str. 301
aucgucaguagcgcaaucacca

SEQ ID NO: 1962340 - RNA, 17 nt, Shigella flexneri 2a str. 301
aucuaccguuacggcug

SEQ ID NO: 1962341 - RNA, 20 nt, Shigella flexneri 2a str. 301
aucuacaaaaccacacuucu

SEQ ID NO: 1962342 - RNA, 14 nt, Shigella flexneri 2a str. 301
aucggcaaucgccu

SEQ ID NO: 1962343 - RNA, 16 nt, Shigella flexneri 2a str. 301
aucggcaagguugaag

SEQ ID NO: 1962344 - RNA, 22 nt, Shigella flexneri 2a str. 301
aucggcaacaugacugcggcgu

SEQ ID NO: 1962345 - RNA, 20 nt, Shigella flexneri 2a str. 301
aucggcagguugcagagcau

SEQ ID NO: 1962346 - RNA, 17 nt, Shigella flexneri 2a str. 301
aucggcguacuggcaau

SEQ ID NO: 1962347 - RNA, 21 nt, Shigella flexneri 2a str. 301
aucgccuucgcaaaaaaccau

SEQ ID NO: 1962348 - RNA, 22 nt, Shigella flexneri 2a str. 301
aucgccuguggcguaaagccuu

SEQ ID NO: 1962349 - RNA, 19 nt, Shigella flexneri 2a str. 301
aucgccuggacaucaugcu

SEQ ID NO: 1962350 - RNA, 19 nt, Shigella flexneri 2a str. 301
aucgccucgccgaaacgcu

SEQ ID NO: 1962351 - RNA, 18 nt, Shigella flexneri 2a str. 301
aucgccuaccaacgacau

SEQ ID NO: 1962352 - RNA, 12 nt, Shigella flexneri 2a str. 301
aucgcgcaucag

SEQ ID NO: 1962353 - RNA, 19 nt, Shigella flexneri 2a str. 301
aucgcgccaaucagcgcag

SEQ ID NO: 1962354 - RNA, 14 nt, Shigella flexneri 2a str. 301
aucgcgcagcagau

SEQ ID NO: 1962355 - RNA, 16 nt, Shigella flexneri 2a str. 301
aucgccuuucagguca

SEQ ID NO: 1962356 - RNA, 18 nt, Shigella flexneri 2a str. 301
aucgcccugauggcgcgc

SEQ ID NO: 1962357 - RNA, 16 nt, Shigella flexneri 2a str. 301
aucgccgcuggcgcgg

SEQ ID NO: 1962358 - RNA, 14 nt, Shigella flexneri 2a str. 301
aucgccgcuggaaa

SEQ ID NO: 1962359 - RNA, 17 nt, Shigella flexneri 2a str. 301
aucgcgcuuaucgccag

SEQ ID NO: 1962360 - RNA, 23 nt, Shigella flexneri 2a str. 301
aucgcuuucggaaagaucgccac

SEQ ID NO: 1962361 - RNA, 22 nt, Shigella flexneri 2a str. 301
aucgcuuacccuaaauccgcca

SEQ ID NO: 1962362 - RNA, 23 nt, Shigella flexneri 2a str. 301
aucgcugccgcgcaggaugcaga

SEQ ID NO: 1962363 - RNA, 17 nt, Shigella flexneri 2a str. 301
aucgcuuaacagaacgg

SEQ ID NO: 1962364 - RNA, 16 nt, Shigella flexneri 2a str. 301
aucgcugaacgcaccu

SEQ ID NO: 1962365 - RNA, 17 nt, Shigella flexneri 2a str. 301
aucgcucgucgcgacga

SEQ ID NO: 1962366 - RNA, 15 nt, Shigella flexneri 2a str. 301
aucgcugaacgcacc

SEQ ID NO: 1962367 - RNA, 19 nt, Shigella flexneri 2a str. 301
aucgcugagcuccugcauu

SEQ ID NO: 1962368 - RNA, 14 nt, Shigella flexneri 2a str. 301
aucgcucagcgcau

SEQ ID NO: 1962369 - RNA, 15 nt, Shigella flexneri 2a str. 301
aucgcgugcggcauc

SEQ ID NO: 1962370 - RNA, 17 nt, Shigella flexneri 2a str. 301
aucgagauugucggcag

SEQ ID NO: 1962371 - RNA, 23 nt, Shigella flexneri 2a str. 301
aucgagcuuaauguuaaccaucu

SEQ ID NO: 1962372 - RNA, 15 nt, Shigella flexneri 2a str. 301
aucgauaaacggcac

SEQ ID NO: 1962373 - RNA, 14 nt, Shigella flexneri 2a str. 301
aucgacguucugcc

SEQ ID NO: 1962374 - RNA, 17 nt, Shigella flexneri 2a str. 301
aucgacggcguauugca

SEQ ID NO: 1962375 - RNA, 13 nt, Shigella flexneri 2a str. 301
aucgaccgcuuca

SEQ ID NO: 1962376 - RNA, 18 nt, Shigella flexneri 2a str. 301
aucgaccaaccuugcgcc

SEQ ID NO: 1962377 - RNA, 16 nt, Shigella flexneri 2a str. 301
aucgacaguaccagca

SEQ ID NO: 1962378 - RNA, 13 nt, Shigella flexneri 2a str. 301
aucaggccuacaa

SEQ ID NO: 1962379 - RNA, 15 nt, Shigella flexneri 2a str. 301
aucgcaccaaacggg

SEQ ID NO: 1962380 - RNA, 21 nt, Shigella flexneri 2a str. 301
aucgcaaugauuuugauggaa

SEQ ID NO: 1962381 - RNA, 16 nt, Shigella flexneri 2a str. 301
aucgcacagaugcgac

SEQ ID NO: 1962382 - RNA, 22 nt, Shigella flexneri 2a str. 301
aucgcacugaugugacaucacc

SEQ ID NO: 1962383 - RNA, 21 nt, Shigella flexneri 2a str. 301
aucgcagcgcaagcugaacag

SEQ ID NO: 1962384 - RNA, 18 nt, Shigella flexneri 2a str. 301
aucgcacuuaaucgcccu

SEQ ID NO: 1962385 - RNA, 18 nt, Shigella flexneri 2a str. 301
aucgccaacaaucucuuc

SEQ ID NO: 1962386 - RNA, 20 nt, Shigella flexneri 2a str. 301
aucgccaggaacaacgacaa

SEQ ID NO: 1962387 - RNA, 22 nt, Shigella flexneri 2a str. 301
aucgccagcguuggcaguucga

SEQ ID NO: 1962388 - RNA, 20 nt, Shigella flexneri 2a str. 301
aucgccagcaaaaucaccau

SEQ ID NO: 1962389 - RNA, 18 nt, Shigella flexneri 2a str. 301
aucgccauuuaacgcauc

SEQ ID NO: 1962390 - RNA, 17 nt, Shigella flexneri 2a str. 301
aucgccauugccgguga

SEQ ID NO: 1962391 - RNA, 12 nt, Shigella flexneri 2a str. 301
aucgccaucagg

SEQ ID NO: 1962392 - RNA, 12 nt, Shigella flexneri 2a str. 301
aucgccaucagu

SEQ ID NO: 1962393 - RNA, 19 nt, Shigella flexneri 2a str. 301
aucgcccgcuuccagcgca

SEQ ID NO: 1962394 - RNA, 22 nt, Shigella flexneri 2a str. 301
auugccgggcgcaucagaucgu

SEQ ID NO: 1962395 - RNA, 12 nt, Shigella flexneri 2a str. 301
auugccggaugc

SEQ ID NO: 1962396 - RNA, 15 nt, Shigella flexneri 2a str. 301
auugccggaugcggc

SEQ ID NO: 1962397 - RNA, 17 nt, Shigella flexneri 2a str. 301
auugcuguaaauugccg

SEQ ID NO: 1962398 - RNA, 18 nt, Shigella flexneri 2a str. 301
auugcuguaucacuauga

SEQ ID NO: 1962399 - RNA, 19 nt, Shigella flexneri 2a str. 301
auugauguaauuaucgcag

SEQ ID NO: 1962400 - RNA, 16 nt, Shigella flexneri 2a str. 301
auugauucaucucuuc

SEQ ID NO: 1962401 - RNA, 12 nt, Shigella flexneri 2a str. 301
auugccggaaug

SEQ ID NO: 1962402 - RNA, 14 nt, Shigella flexneri 2a str. 301
auuguuaaucacau

SEQ ID NO: 1962403 - RNA, 14 nt, Shigella flexneri 2a str. 301
auuggaguaucacc

SEQ ID NO: 1962404 - RNA, 14 nt, Shigella flexneri 2a str. 301
auugguuucgucgu

SEQ ID NO: 1962405 - RNA, 15 nt, Shigella flexneri 2a str. 301
auugguuucaaagau

SEQ ID NO: 1962406 - RNA, 14 nt, Shigella flexneri 2a str. 301
auucauuaaaacug

SEQ ID NO: 1962407 - RNA, 21 nt, Shigella flexneri 2a str. 301
auucgaaaccacccaccgcac

SEQ ID NO: 1962408 - RNA, 12 nt, Shigella flexneri 2a str. 301
auucgaaaucug

SEQ ID NO: 1962409 - RNA, 16 nt, Shigella flexneri 2a str. 301
auucugauccugcacu

SEQ ID NO: 1962410 - RNA, 17 nt, Shigella flexneri 2a str. 301
auugaguaccagcgcac

SEQ ID NO: 1962411 - RNA, 16 nt, Shigella flexneri 2a str. 301
auugagaugacgccac

SEQ ID NO: 1962412 - RNA, 17 nt, Shigella flexneri 2a str. 301
auugaacagcagaacau

SEQ ID NO: 1962413 - RNA, 22 nt, Shigella flexneri 2a str. 301
auucuugccaucaaucacuuug

SEQ ID NO: 1962414 - RNA, 13 nt, Shigella flexneri 2a str. 301
auucuucagcgac

SEQ ID NO: 1962415 - RNA, 13 nt, Shigella flexneri 2a str. 301
auucuggcguuaa

SEQ ID NO: 1962416 - RNA, 16 nt, Shigella flexneri 2a str. 301
auuauccacggcacag

SEQ ID NO: 1962417 - RNA, 17 nt, Shigella flexneri 2a str. 301
auuauugcgcacaucaa

SEQ ID NO: 1962418 - RNA, 18 nt, Shigella flexneri 2a str. 301
auucagugcaaaugccag

SEQ ID NO: 1962419 - RNA, 20 nt, Shigella flexneri 2a str. 301
auucauaauugcgaugccag

SEQ ID NO: 1962420 - RNA, 12 nt, Shigella flexneri 2a str. 301
auucauacccug

SEQ ID NO: 1962421 - RNA, 13 nt, Shigella flexneri 2a str. 301
auucaaucucuuc

SEQ ID NO: 1962422 - RNA, 16 nt, Shigella flexneri 2a str. 301
auuagcauugaugcgu

SEQ ID NO: 1962423 - RNA, 23 nt, Shigella flexneri 2a str. 301
auuaguggcaaccacaaccgccg

SEQ ID NO: 1962424 - RNA, 20 nt, Shigella flexneri 2a str. 301
auuagcuuuaauccaucgac

SEQ ID NO: 1962425 - RNA, 17 nt, Shigella flexneri 2a str. 301
auuaagcgcaaaggcca

SEQ ID NO: 1962426 - RNA, 15 nt, Shigella flexneri 2a str. 301
auuaacgauacuucu

SEQ ID NO: 1962427 - RNA, 22 nt, Shigella flexneri 2a str. 301
auuaacgguugcggcuuaccaa

SEQ ID NO: 1962428 - RNA, 15 nt, Shigella flexneri 2a str. 301
auguuccaucaccag

SEQ ID NO: 1962429 - RNA, 14 nt, Shigella flexneri 2a str. 301
auguguaaucaggc

SEQ ID NO: 1962430 - RNA, 18 nt, Shigella flexneri 2a str. 301
augugcaguuccugcaac

SEQ ID NO: 1962431 - RNA, 13 nt, Shigella flexneri 2a str. 301
augugauccauca

SEQ ID NO: 1962432 - RNA, 19 nt, Shigella flexneri 2a str. 301
auguggaucaacggccuga

SEQ ID NO: 1962433 - RNA, 13 nt, Shigella flexneri 2a str. 301
auguugagcggca

SEQ ID NO: 1962434 - RNA, 17 nt, Shigella flexneri 2a str. 301
auguucuaucuuucaga

SEQ ID NO: 1962435 - RNA, 13 nt, Shigella flexneri 2a str. 301
auguuccugccag

SEQ ID NO: 1962436 - RNA, 17 nt, Shigella flexneri 2a str. 301
auguucgacuuaacgcg

SEQ ID NO: 1962437 - RNA, 13 nt, Shigella flexneri 2a str. 301
auguugucucaga

SEQ ID NO: 1962438 - RNA, 19 nt, Shigella flexneri 2a str. 301
auguugucucagcuucaga

SEQ ID NO: 1962439 - RNA, 19 nt, Shigella flexneri 2a str. 301
auuaaacgccauccggcag

SEQ ID NO: 1962440 - RNA, 13 nt, Shigella flexneri 2a str. 301
auuaaauugauaa

SEQ ID NO: 1962441 - RNA, 23 nt, Shigella flexneri 2a str. 301
auguuuuaacacacaauuaccuu

SEQ ID NO: 1962442 - RNA, 18 nt, Shigella flexneri 2a str. 301
auggucuauugcgcuaaa

SEQ ID NO: 1962443 - RNA, 19 nt, Shigella flexneri 2a str. 301
auggucuuguaggccagau

SEQ ID NO: 1962444 - RNA, 20 nt, Shigella flexneri 2a str. 301
augguggccgccacgcguga

SEQ ID NO: 1962445 - RNA, 19 nt, Shigella flexneri 2a str. 301
augguggccgccacgcgug

SEQ ID NO: 1962446 - RNA, 13 nt, Shigella flexneri 2a str. 301
augguggaguggc

SEQ ID NO: 1962447 - RNA, 23 nt, Shigella flexneri 2a str. 301
auggcccccguuuuuugaaacag

SEQ ID NO: 1962448 - RNA, 20 nt, Shigella flexneri 2a str. 301
auggaaaucacccagcgaag

SEQ ID NO: 1962449 - RNA, 13 nt, Shigella flexneri 2a str. 301
auggaaaucaccc

SEQ ID NO: 1962450 - RNA, 16 nt, Shigella flexneri 2a str. 301
auggaaccguacagca

SEQ ID NO: 1962451 - RNA, 14 nt, Shigella flexneri 2a str. 301
auggcuaucaagau

SEQ ID NO: 1962452 - RNA, 20 nt, Shigella flexneri 2a str. 301
auggcugaaagcgccgggaa

SEQ ID NO: 1962453 - RNA, 22 nt, Shigella flexneri 2a str. 301
auggcugccaaugauaucggaa

SEQ ID NO: 1962454 - RNA, 14 nt, Shigella flexneri 2a str. 301
auggcuguccuuua

SEQ ID NO: 1962455 - RNA, 21 nt, Shigella flexneri 2a str. 301
auggcggcaguauagcggcau

SEQ ID NO: 1962456 - RNA, 19 nt, Shigella flexneri 2a str. 301
augcggggugcaucgcccu

SEQ ID NO: 1962457 - RNA, 16 nt, Shigella flexneri 2a str. 301
augcgcuuuaucgccg

SEQ ID NO: 1962458 - RNA, 22 nt, Shigella flexneri 2a str. 301
augcgcaaccguaaacgaucau

SEQ ID NO: 1962459 - RNA, 23 nt, Shigella flexneri 2a str. 301
augcgcaaccguaaacgaucauc

SEQ ID NO: 1962460 - RNA, 18 nt, Shigella flexneri 2a str. 301
augcgcuacgcucaucag

SEQ ID NO: 1962461 - RNA, 17 nt, Shigella flexneri 2a str. 301
augcuuccgccagcggc

SEQ ID NO: 1962462 - RNA, 21 nt, Shigella flexneri 2a str. 301
augcuguaaccagcgcagaca

SEQ ID NO: 1962463 - RNA, 22 nt, Shigella flexneri 2a str. 301
augcuaaaaacaucaugauuca

SEQ ID NO: 1962464 - RNA, 16 nt, Shigella flexneri 2a str. 301
augcguuuuccggcac

SEQ ID NO: 1962465 - RNA, 14 nt, Shigella flexneri 2a str. 301
augcgucucaucag

SEQ ID NO: 1962466 - RNA, 15 nt, Shigella flexneri 2a str. 301
augccgaguggcauu

SEQ ID NO: 1962467 - RNA, 14 nt, Shigella flexneri 2a str. 301
augccgcagcaccc

SEQ ID NO: 1962468 - RNA, 16 nt, Shigella flexneri 2a str. 301
augccgcacaucaccg

SEQ ID NO: 1962469 - RNA, 18 nt, Shigella flexneri 2a str. 301
augccgccauugacagaa

SEQ ID NO: 1962470 - RNA, 14 nt, Shigella flexneri 2a str. 301
augaugccggaauc

SEQ ID NO: 1962471 - RNA, 13 nt, Shigella flexneri 2a str. 301
augaugcgucuca

SEQ ID NO: 1962472 - RNA, 21 nt, Shigella flexneri 2a str. 301
augaucgucacgaucgcgcca

SEQ ID NO: 1962473 - RNA, 15 nt, Shigella flexneri 2a str. 301
augaugacgggcaag

SEQ ID NO: 1962474 - RNA, 13 nt, Shigella flexneri 2a str. 301
augaucuuaugau

SEQ ID NO: 1962475 - RNA, 16 nt, Shigella flexneri 2a str. 301
augccguuauacaucg

SEQ ID NO: 1962476 - RNA, 16 nt, Shigella flexneri 2a str. 301
augccugaugcggcgu

SEQ ID NO: 1962477 - RNA, 22 nt, Shigella flexneri 2a str. 301
augccgcggcgcggcggguuaa

SEQ ID NO: 1962478 - RNA, 21 nt, Shigella flexneri 2a str. 301
augccgcguuggugcagaaga

SEQ ID NO: 1962479 - RNA, 16 nt, Shigella flexneri 2a str. 301
augccgguggugaccu

SEQ ID NO: 1962480 - RNA, 18 nt, Shigella flexneri 2a str. 301
augccgguuccugcaucg

SEQ ID NO: 1962481 - RNA, 19 nt, Shigella flexneri 2a str. 301
aggcgaacauuccgguuau

SEQ ID NO: 1962482 - RNA, 17 nt, Shigella flexneri 2a str. 301
aggcgcaacccgugaag

SEQ ID NO: 1962483 - RNA, 21 nt, Shigella flexneri 2a str. 301
aggccuaacaccaucaguggc

SEQ ID NO: 1962484 - RNA, 19 nt, Shigella flexneri 2a str. 301
aggccuacaaguccguuga

SEQ ID NO: 1962485 - RNA, 21 nt, Shigella flexneri 2a str. 301
aggccguggaucacaucgccg

SEQ ID NO: 1962486 - RNA, 21 nt, Shigella flexneri 2a str. 301
aggcgcacugauucaugaacu

SEQ ID NO: 1962487 - RNA, 20 nt, Shigella flexneri 2a str. 301
aggcgcugaaagaagcggug

SEQ ID NO: 1962488 - RNA, 23 nt, Shigella flexneri 2a str. 301
aggcggacugaauacgcuggcgc

SEQ ID NO: 1962489 - RNA, 17 nt, Shigella flexneri 2a str. 301
aggcgcuacgcuaucag

SEQ ID NO: 1962490 - RNA, 19 nt, Shigella flexneri 2a str. 301
aggcgcugaaagaagcggu

SEQ ID NO: 1962491 - RNA, 12 nt, Shigella flexneri 2a str. 301
aggcagcauucg

SEQ ID NO: 1962492 - RNA, 18 nt, Shigella flexneri 2a str. 301
aggcagguuaaugaccca

SEQ ID NO: 1962493 - RNA, 18 nt, Shigella flexneri 2a str. 301
aggcaguuuauccagcca

SEQ ID NO: 1962494 - RNA, 20 nt, Shigella flexneri 2a str. 301
aggcaggucuuucaccugau

SEQ ID NO: 1962495 - RNA, 16 nt, Shigella flexneri 2a str. 301
aggcaucccgcaccag

SEQ ID NO: 1962496 - RNA, 20 nt, Shigella flexneri 2a str. 301
aggcaucggugcuggccuau

SEQ ID NO: 1962497 - RNA, 17 nt, Shigella flexneri 2a str. 301
aggccagcaauccccag

SEQ ID NO: 1962498 - RNA, 15 nt, Shigella flexneri 2a str. 301
aggccgacuggcaug

SEQ ID NO: 1962499 - RNA, 16 nt, Shigella flexneri 2a str. 301
aggccggauguggcgu

SEQ ID NO: 1962500 - RNA, 21 nt, Shigella flexneri 2a str. 301
aggcugugaaccgcacagguu

SEQ ID NO: 1962501 - RNA, 15 nt, Shigella flexneri 2a str. 301
agggcuuuaccuguc

SEQ ID NO: 1962502 - RNA, 16 nt, Shigella flexneri 2a str. 301
aggcucgccgccgcug

SEQ ID NO: 1962503 - RNA, 19 nt, Shigella flexneri 2a str. 301
aggcuauuccacgcaucaa

SEQ ID NO: 1962504 - RNA, 20 nt, Shigella flexneri 2a str. 301
aggcguuuucgccacaucag

SEQ ID NO: 1962505 - RNA, 22 nt, Shigella flexneri 2a str. 301
aggcguuuacgccgcauccggc

SEQ ID NO: 1962506 - RNA, 22 nt, Shigella flexneri 2a str. 301
aggcguuuucgccgcauccggc

SEQ ID NO: 1962507 - RNA, 20 nt, Shigella flexneri 2a str. 301
aggcguuuacgccgcauccg

SEQ ID NO: 1962508 - RNA, 21 nt, Shigella flexneri 2a str. 301
aggcguucuacauaaaacgcu

SEQ ID NO: 1962509 - RNA, 20 nt, Shigella flexneri 2a str. 301
aggcguucacgccgcaucug

SEQ ID NO: 1962510 - RNA, 22 nt, Shigella flexneri 2a str. 301
aggcgguaaaucggcgaagaga

SEQ ID NO: 1962511 - RNA, 14 nt, Shigella flexneri 2a str. 301
aggugaaauugucg

SEQ ID NO: 1962512 - RNA, 23 nt, Shigella flexneri 2a str. 301
aggucacgggcaauuuucgccau

SEQ ID NO: 1962513 - RNA, 20 nt, Shigella flexneri 2a str. 301
aggucacaucauaaccgagc

SEQ ID NO: 1962514 - RNA, 18 nt, Shigella flexneri 2a str. 301
aggucaugugucgccgca

SEQ ID NO: 1962515 - RNA, 17 nt, Shigella flexneri 2a str. 301
agguccggauggcaaac

SEQ ID NO: 1962516 - RNA, 18 nt, Shigella flexneri 2a str. 301
aguaaagcgcgucaccac

SEQ ID NO: 1962517 - RNA, 17 nt, Shigella flexneri 2a str. 301
agguuuauaacggugcu

SEQ ID NO: 1962518 - RNA, 16 nt, Shigella flexneri 2a str. 301
aguacgggcagcgcau

SEQ ID NO: 1962519 - RNA, 15 nt, Shigella flexneri 2a str. 301
aguaauaccagaccu

SEQ ID NO: 1962520 - RNA, 21 nt, Shigella flexneri 2a str. 301
aguaacguuugauuaacgcca

SEQ ID NO: 1962521 - RNA, 22 nt, Shigella flexneri 2a str. 301
aguagauacccggauacaacuc

SEQ ID NO: 1962522 - RNA, 20 nt, Shigella flexneri 2a str. 301
aguagugguaacgcacacau

SEQ ID NO: 1962523 - RNA, 14 nt, Shigella flexneri 2a str. 301
aguugccacccggc

SEQ ID NO: 1962524 - RNA, 13 nt, Shigella flexneri 2a str. 301
aguugaucaccag

SEQ ID NO: 1962525 - RNA, 15 nt, Shigella flexneri 2a str. 301
aguugaucaccagug

SEQ ID NO: 1962526 - RNA, 17 nt, Shigella flexneri 2a str. 301
agugagauaccaguuga

SEQ ID NO: 1962527 - RNA, 16 nt, Shigella flexneri 2a str. 301
agugacagcccggcau

SEQ ID NO: 1962528 - RNA, 20 nt, Shigella flexneri 2a str. 301
agugcggcgagcaucgccca

SEQ ID NO: 1962529 - RNA, 14 nt, Shigella flexneri 2a str. 301
aguggacggcugau

SEQ ID NO: 1962530 - RNA, 21 nt, Shigella flexneri 2a str. 301
agugcgucgcugcucuucagu

SEQ ID NO: 1962531 - RNA, 20 nt, Shigella flexneri 2a str. 301
agugacucuuuauuucauuu

SEQ ID NO: 1962532 - RNA, 23 nt, Shigella flexneri 2a str. 301
agucuccuuuauagugugcaauc

SEQ ID NO: 1962533 - RNA, 22 nt, Shigella flexneri 2a str. 301
auaacuccccgagaaauacugg

SEQ ID NO: 1962534 - RNA, 13 nt, Shigella flexneri 2a str. 301
auaacuuccugag

SEQ ID NO: 1962535 - RNA, 14 nt, Shigella flexneri 2a str. 301
auaagauacuggau

SEQ ID NO: 1962536 - RNA, 17 nt, Shigella flexneri 2a str. 301
auaagccaaauccagcg

SEQ ID NO: 1962537 - RNA, 14 nt, Shigella flexneri 2a str. 301
auaacccagcgcac

SEQ ID NO: 1962538 - RNA, 20 nt, Shigella flexneri 2a str. 301
auaaccgcaaaaccaacgcc

SEQ ID NO: 1962539 - RNA, 13 nt, Shigella flexneri 2a str. 301
auaacaucgccag

SEQ ID NO: 1962540 - RNA, 21 nt, Shigella flexneri 2a str. 301
aguuuugucuucggccauuga

SEQ ID NO: 1962541 - RNA, 17 nt, Shigella flexneri 2a str. 301
aguuuuuaggcaugaua

SEQ ID NO: 1962542 - RNA, 21 nt, Shigella flexneri 2a str. 301
aguuuucauauaccgcaucag

SEQ ID NO: 1962543 - RNA, 21 nt, Shigella flexneri 2a str. 301
aguuugaacauaucagcgcaa

SEQ ID NO: 1962544 - RNA, 13 nt, Shigella flexneri 2a str. 301
aguuucagcggcg

SEQ ID NO: 1962545 - RNA, 23 nt, Shigella flexneri 2a str. 301
aguuucagaccaauaauccccaa

SEQ ID NO: 1962546 - RNA, 19 nt, Shigella flexneri 2a str. 301
auacgccaucgccagcagc

SEQ ID NO: 1962547 - RNA, 17 nt, Shigella flexneri 2a str. 301
auaccgcaucagcaucg

SEQ ID NO: 1962548 - RNA, 16 nt, Shigella flexneri 2a str. 301
auaccggaucgcaucg

SEQ ID NO: 1962549 - RNA, 19 nt, Shigella flexneri 2a str. 301
auaccggcgucccaucggc

SEQ ID NO: 1962550 - RNA, 14 nt, Shigella flexneri 2a str. 301
auaccguaacgacu

SEQ ID NO: 1962551 - RNA, 19 nt, Shigella flexneri 2a str. 301
auaccgucagcgaucagca

SEQ ID NO: 1962552 - RNA, 16 nt, Shigella flexneri 2a str. 301
auaccgaaaucgccau

SEQ ID NO: 1962553 - RNA, 20 nt, Shigella flexneri 2a str. 301
auaccgaacauaccaccgac

SEQ ID NO: 1962554 - RNA, 13 nt, Shigella flexneri 2a str. 301
auaccgaucaccg

SEQ ID NO: 1962555 - RNA, 15 nt, Shigella flexneri 2a str. 301
auaccgaaaucgcca

SEQ ID NO: 1962556 - RNA, 16 nt, Shigella flexneri 2a str. 301
auacaggaacagccac

SEQ ID NO: 1962557 - RNA, 16 nt, Shigella flexneri 2a str. 301
auacguaggccugaua

SEQ ID NO: 1962558 - RNA, 15 nt, Shigella flexneri 2a str. 301
auacguacaaacgcu

SEQ ID NO: 1962559 - RNA, 18 nt, Shigella flexneri 2a str. 301
auacggugucacgguguc

SEQ ID NO: 1962560 - RNA, 20 nt, Shigella flexneri 2a str. 301
auacugaucgucaucaaacg

SEQ ID NO: 1962561 - RNA, 22 nt, Shigella flexneri 2a str. 301
auacugaucgucaucaaacggc

SEQ ID NO: 1962562 - RNA, 17 nt, Shigella flexneri 2a str. 301
auacucagcgccugcug

SEQ ID NO: 1962563 - RNA, 18 nt, Shigella flexneri 2a str. 301
auacuuauuaugaaugau

SEQ ID NO: 1962564 - RNA, 19 nt, Shigella flexneri 2a str. 301
auagcauuggagacugaug

SEQ ID NO: 1962565 - RNA, 20 nt, Shigella flexneri 2a str. 301
auagcacauaaaauggccgu

SEQ ID NO: 1962566 - RNA, 19 nt, Shigella flexneri 2a str. 301
auagcaccauuaaauccgg

SEQ ID NO: 1962567 - RNA, 21 nt, Shigella flexneri 2a str. 301
auagccagccucauccauacg

SEQ ID NO: 1962568 - RNA, 15 nt, Shigella flexneri 2a str. 301
auagcccaugcaucg

SEQ ID NO: 1962569 - RNA, 21 nt, Shigella flexneri 2a str. 301
auaugcgccgacggcgcuacc

SEQ ID NO: 1962570 - RNA, 18 nt, Shigella flexneri 2a str. 301
auaucggcaccagcgcag

SEQ ID NO: 1962571 - RNA, 17 nt, Shigella flexneri 2a str. 301
auaucgagaucauccau

SEQ ID NO: 1962572 - RNA, 16 nt, Shigella flexneri 2a str. 301
auauaaaaauccgccu

SEQ ID NO: 1962573 - RNA, 16 nt, Shigella flexneri 2a str. 301
auauaaaccaucggcg

SEQ ID NO: 1962574 - RNA, 18 nt, Shigella flexneri 2a str. 301
auaggaugagguuucccg

SEQ ID NO: 1962575 - RNA, 18 nt, Shigella flexneri 2a str. 301
auaggcaaaaaaaaugcc

SEQ ID NO: 1962576 - RNA, 14 nt, Shigella flexneri 2a str. 301
auaguucaacagau

SEQ ID NO: 1962577 - RNA, 15 nt, Shigella flexneri 2a str. 301
auagccuucagugcc

SEQ ID NO: 1962578 - RNA, 17 nt, Shigella flexneri 2a str. 301
auagcgcacgcgcuuca

SEQ ID NO: 1962579 - RNA, 20 nt, Shigella flexneri 2a str. 301
auagcgaccauacagcagca

SEQ ID NO: 1962580 - RNA, 19 nt, Shigella flexneri 2a str. 301
aucaaacgaagcggcugcg

SEQ ID NO: 1962581 - RNA, 15 nt, Shigella flexneri 2a str. 301
aucaaaucucgccgu

SEQ ID NO: 1962582 - RNA, 13 nt, Shigella flexneri 2a str. 301
auaugucgcgcca

SEQ ID NO: 1962583 - RNA, 20 nt, Shigella flexneri 2a str. 301
auauuauccccugcgauggu

SEQ ID NO: 1962584 - RNA, 13 nt, Shigella flexneri 2a str. 301
auauuaacgacaa

SEQ ID NO: 1962585 - RNA, 22 nt, Shigella flexneri 2a str. 301
aucaauucggaaauaaucaccu

SEQ ID NO: 1962586 - RNA, 21 nt, Shigella flexneri 2a str. 301
aucaagcccugguaacugcca

SEQ ID NO: 1962587 - RNA, 20 nt, Shigella flexneri 2a str. 301
aucaagcccugguaacugcc

SEQ ID NO: 1962588 - RNA, 12 nt, Shigella flexneri 2a str. 301
aucaaugaccug

SEQ ID NO: 1962589 - RNA, 14 nt, Shigella flexneri 2a str. 301
aucaacuccgccag

SEQ ID NO: 1962590 - RNA, 17 nt, Shigella flexneri 2a str. 301
aucaacuccgccagcaa

SEQ ID NO: 1962591 - RNA, 13 nt, Shigella flexneri 2a str. 301
aucaagccauagc

SEQ ID NO: 1962592 - RNA, 13 nt, Shigella flexneri 2a str. 301
aucaagaaaugca

SEQ ID NO: 1962593 - RNA, 23 nt, Shigella flexneri 2a str. 301
aucacaaaacgaauaauugcugg

SEQ ID NO: 1962594 - RNA, 12 nt, Shigella flexneri 2a str. 301
aucacaucgccg

SEQ ID NO: 1962595 - RNA, 17 nt, Shigella flexneri 2a str. 301
aucacaucgcgcucgua

SEQ ID NO: 1962596 - RNA, 15 nt, Shigella flexneri 2a str. 301
aucacaucagcgcau

SEQ ID NO: 1962597 - RNA, 22 nt, Shigella flexneri 2a str. 301
aucaccacaauauuauggcugu

SEQ ID NO: 1962598 - RNA, 19 nt, Shigella flexneri 2a str. 301
aucaccugauugaccgcca

SEQ ID NO: 1962599 - RNA, 13 nt, Shigella flexneri 2a str. 301
aucacgucgccuu

SEQ ID NO: 1962600 - RNA, 15 nt, Shigella flexneri 2a str. 301
aucacgacagcacca

SEQ ID NO: 1962601 - RNA, 21 nt, Shigella flexneri 2a str. 301
aucacgaccuguaccuucagc

SEQ ID NO: 1962602 - RNA, 22 nt, Shigella flexneri 2a str. 301
aucaccagaucguaauggucgu

SEQ ID NO: 1962603 - RNA, 17 nt, Shigella flexneri 2a str. 301
aucagaucgacgccgau

SEQ ID NO: 1962604 - RNA, 19 nt, Shigella flexneri 2a str. 301
aucagcacauaagucagcc

SEQ ID NO: 1962605 - RNA, 16 nt, Shigella flexneri 2a str. 301
aucacuccccgccguu

SEQ ID NO: 1962606 - RNA, 14 nt, Shigella flexneri 2a str. 301
aucacucugccgua

SEQ ID NO: 1962607 - RNA, 18 nt, Shigella flexneri 2a str. 301
aucacugacugcgggcga

SEQ ID NO: 1962608 - RNA, 15 nt, Shigella flexneri 2a str. 301
aucacugagucagcc

SEQ ID NO: 1962609 - RNA, 15 nt, Shigella flexneri 2a str. 301
agccgucauucugca

SEQ ID NO: 1962610 - RNA, 22 nt, Shigella flexneri 2a str. 301
agccgguuucacuauuaccgau

SEQ ID NO: 1962611 - RNA, 13 nt, Shigella flexneri 2a str. 301
agccgcuacggaa

SEQ ID NO: 1962612 - RNA, 14 nt, Shigella flexneri 2a str. 301
agccgcuaccagcg

SEQ ID NO: 1962613 - RNA, 21 nt, Shigella flexneri 2a str. 301
agcgacgggcgacaaacgcug

SEQ ID NO: 1962614 - RNA, 23 nt, Shigella flexneri 2a str. 301
agcgacaccucccagcgcgguga

SEQ ID NO: 1962615 - RNA, 22 nt, Shigella flexneri 2a str. 301
aaacgccagauacaucagcgac

SEQ ID NO: 1962616 - RNA, 19 nt, Shigella flexneri 2a str. 301
aaacgccacauccggccua

SEQ ID NO: 1962617 - RNA, 19 nt, Shigella flexneri 2a str. 301
aaacgccuuauccggccua

SEQ ID NO: 1962618 - RNA, 14 nt, Shigella flexneri 2a str. 301
agcgcaaucaccac

SEQ ID NO: 1962619 - RNA, 22 nt, Shigella flexneri 2a str. 301
agcgcaauucgcgucggcguca

SEQ ID NO: 1962620 - RNA, 13 nt, Shigella flexneri 2a str. 301
agcgcagcgcauc

SEQ ID NO: 1962621 - RNA, 15 nt, Shigella flexneri 2a str. 301
agcgcagcgcaucag

SEQ ID NO: 1962622 - RNA, 20 nt, Shigella flexneri 2a str. 301
agcgcgcccaacaguagaca

SEQ ID NO: 1962623 - RNA, 14 nt, Shigella flexneri 2a str. 301
agcgcgcgccgcca

SEQ ID NO: 1962624 - RNA, 19 nt, Shigella flexneri 2a str. 301
agcgcgcgcagcacgguac

SEQ ID NO: 1962625 - RNA, 15 nt, Shigella flexneri 2a str. 301
agcgcgcgcagcacg

SEQ ID NO: 1962626 - RNA, 22 nt, Shigella flexneri 2a str. 301
agcgcagcucuggcauaacgcc

SEQ ID NO: 1962627 - RNA, 13 nt, Shigella flexneri 2a str. 301
agcgcguugcgcc

SEQ ID NO: 1962628 - RNA, 14 nt, Shigella flexneri 2a str. 301
agcgcuaccgccga

SEQ ID NO: 1962629 - RNA, 15 nt, Shigella flexneri 2a str. 301
agcgcuaguccgggc

SEQ ID NO: 1962630 - RNA, 15 nt, Shigella flexneri 2a str. 301
agcgcuucacuauga

SEQ ID NO: 1962631 - RNA, 18 nt, Shigella flexneri 2a str. 301
agcggagaaacuucugcc

SEQ ID NO: 1962632 - RNA, 19 nt, Shigella flexneri 2a str. 301
agcggguuaagcgcgcuag

SEQ ID NO: 1962633 - RNA, 21 nt, Shigella flexneri 2a str. 301
agcggggaacaccucuggcga

SEQ ID NO: 1962634 - RNA, 18 nt, Shigella flexneri 2a str. 301
agcguucuuuaacugccg

SEQ ID NO: 1962635 - RNA, 14 nt, Shigella flexneri 2a str. 301
agcguugcgccuga

SEQ ID NO: 1962636 - RNA, 20 nt, Shigella flexneri 2a str. 301
agcguuccauaauggcgcga

SEQ ID NO: 1962637 - RNA, 23 nt, Shigella flexneri 2a str. 301
agcgugcucucaaauaucugccg

SEQ ID NO: 1962638 - RNA, 19 nt, Shigella flexneri 2a str. 301
agcgugccaggcgcgcuuc

SEQ ID NO: 1962639 - RNA, 21 nt, Shigella flexneri 2a str. 301
agcgugacaccagcacaucau

SEQ ID NO: 1962640 - RNA, 15 nt, Shigella flexneri 2a str. 301
agcgucccacgaccg

SEQ ID NO: 1962641 - RNA, 15 nt, Shigella flexneri 2a str. 301
agcguccggcugcca

SEQ ID NO: 1962642 - RNA, 17 nt, Shigella flexneri 2a str. 301
agcugcucccagcgcau

SEQ ID NO: 1962643 - RNA, 16 nt, Shigella flexneri 2a str. 301
agcugcuacgccguca

SEQ ID NO: 1962644 - RNA, 14 nt, Shigella flexneri 2a str. 301
agcugcucgcggug

SEQ ID NO: 1962645 - RNA, 23 nt, Shigella flexneri 2a str. 301
agcucuuuuaacuuacgcgucag

SEQ ID NO: 1962646 - RNA, 22 nt, Shigella flexneri 2a str. 301
agcucuucuucacucucaccac

SEQ ID NO: 1962647 - RNA, 15 nt, Shigella flexneri 2a str. 301
agcucugcgccgucu

SEQ ID NO: 1962648 - RNA, 23 nt, Shigella flexneri 2a str. 301
agcucaaugguguuuuccaccgu

SEQ ID NO: 1962649 - RNA, 23 nt, Shigella flexneri 2a str. 301
agcuccgggcugguuuucagcga

SEQ ID NO: 1962650 - RNA, 20 nt, Shigella flexneri 2a str. 301
agcagccuauuucgucgcua

SEQ ID NO: 1962651 - RNA, 22 nt, Shigella flexneri 2a str. 301
agcagcgaauuucucauccgca

SEQ ID NO: 1962652 - RNA, 23 nt, Shigella flexneri 2a str. 301
agcagcgaauuucucauccgcag

SEQ ID NO: 1962653 - RNA, 15 nt, Shigella flexneri 2a str. 301
agcagcgcgcccggu

SEQ ID NO: 1962654 - RNA, 18 nt, Shigella flexneri 2a str. 301
agcagcuuucagcagcgg

SEQ ID NO: 1962655 - RNA, 12 nt, Shigella flexneri 2a str. 301
agcaggcauccu

SEQ ID NO: 1962656 - RNA, 13 nt, Shigella flexneri 2a str. 301
agcaucgcaucaa

SEQ ID NO: 1962657 - RNA, 22 nt, Shigella flexneri 2a str. 301
agcaucauaguggguuucugcc

SEQ ID NO: 1962658 - RNA, 14 nt, Shigella flexneri 2a str. 301
agcauucgccgcau

SEQ ID NO: 1962659 - RNA, 15 nt, Shigella flexneri 2a str. 301
agccagauggcugcc

SEQ ID NO: 1962660 - RNA, 22 nt, Shigella flexneri 2a str. 301
agcauugccgccccggcucgcg

SEQ ID NO: 1962661 - RNA, 15 nt, Shigella flexneri 2a str. 301
agccaauugccauau

SEQ ID NO: 1962662 - RNA, 17 nt, Shigella flexneri 2a str. 301
agccacauugcugcaca

SEQ ID NO: 1962663 - RNA, 13 nt, Shigella flexneri 2a str. 301
agccacauagacg

SEQ ID NO: 1962664 - RNA, 17 nt, Shigella flexneri 2a str. 301
agccaccagguucaaca

SEQ ID NO: 1962665 - RNA, 20 nt, Shigella flexneri 2a str. 301
aaacgcaaaacugccugaug

SEQ ID NO: 1962666 - RNA, 16 nt, Shigella flexneri 2a str. 301
aaacgcauacggguaa

SEQ ID NO: 1962667 - RNA, 17 nt, Shigella flexneri 2a str. 301
aaacgacguauugauua

SEQ ID NO: 1962668 - RNA, 18 nt, Shigella flexneri 2a str. 301
aaaccguaagcgccccga

SEQ ID NO: 1962669 - RNA, 22 nt, Shigella flexneri 2a str. 301
agccgcaccaccgcauccgggc

SEQ ID NO: 1962670 - RNA, 22 nt, Shigella flexneri 2a str. 301
agccgccguuaauuucauguaa

SEQ ID NO: 1962671 - RNA, 20 nt, Shigella flexneri 2a str. 301
agcccaaucaucgcggcaca

SEQ ID NO: 1962672 - RNA, 22 nt, Shigella flexneri 2a str. 301
agcaccgcgugcgcggcagcca

SEQ ID NO: 1962673 - RNA, 20 nt, Shigella flexneri 2a str. 301
agcaaacuaucuguguaaug

SEQ ID NO: 1962674 - RNA, 13 nt, Shigella flexneri 2a str. 301
agcaaagcgugca

SEQ ID NO: 1962675 - RNA, 22 nt, Shigella flexneri 2a str. 301
agcaacaucaaaugcgcagcca

SEQ ID NO: 1962676 - RNA, 13 nt, Shigella flexneri 2a str. 301
acuuucagcgcag

SEQ ID NO: 1962677 - RNA, 16 nt, Shigella flexneri 2a str. 301
acuuucaacagguuaa

SEQ ID NO: 1962678 - RNA, 21 nt, Shigella flexneri 2a str. 301
acuuuccaugccaucugccag

SEQ ID NO: 1962679 - RNA, 17 nt, Shigella flexneri 2a str. 301
agcaacucgaugcugcc

SEQ ID NO: 1962680 - RNA, 19 nt, Shigella flexneri 2a str. 301
agcaauaaaaacuccgccg

SEQ ID NO: 1962681 - RNA, 21 nt, Shigella flexneri 2a str. 301
agcaauaaucagauggcggcu

SEQ ID NO: 1962682 - RNA, 21 nt, Shigella flexneri 2a str. 301
agcaagcgcugagacgcgcuu

SEQ ID NO: 1962683 - RNA, 14 nt, Shigella flexneri 2a str. 301
agcaauaccgcgaa

SEQ ID NO: 1962684 - RNA, 22 nt, Shigella flexneri 2a str. 301
agcaauucucucuucagcuucc

SEQ ID NO: 1962685 - RNA, 19 nt, Shigella flexneri 2a str. 301
agcagcacaaugccgguga

SEQ ID NO: 1962686 - RNA, 18 nt, Shigella flexneri 2a str. 301
agcagcccugccggaacg

SEQ ID NO: 1962687 - RNA, 16 nt, Shigella flexneri 2a str. 301
agcagccacaccaauc

SEQ ID NO: 1962688 - RNA, 16 nt, Shigella flexneri 2a str. 301
agcagccagccagacg

SEQ ID NO: 1962689 - RNA, 17 nt, Shigella flexneri 2a str. 301
aaaccgaugcagugcgg

SEQ ID NO: 1962690 - RNA, 18 nt, Shigella flexneri 2a str. 301
agcagagauacaggccac

SEQ ID NO: 1962691 - RNA, 17 nt, Shigella flexneri 2a str. 301
aaacccaccagcugaug

SEQ ID NO: 1962692 - RNA, 20 nt, Shigella flexneri 2a str. 301
agcacucugacggauaguau

SEQ ID NO: 1962693 - RNA, 23 nt, Shigella flexneri 2a str. 301
agcacuucacccaucgccagaua

SEQ ID NO: 1962694 - RNA, 16 nt, Shigella flexneri 2a str. 301
acuggcaaaaucaaaa

SEQ ID NO: 1962695 - RNA, 23 nt, Shigella flexneri 2a str. 301
acuggcaaucgccagcggcagcu

SEQ ID NO: 1962696 - RNA, 15 nt, Shigella flexneri 2a str. 301
acuggcaaucgccag

SEQ ID NO: 1962697 - RNA, 19 nt, Shigella flexneri 2a str. 301
acuggcagcaccgggccaa

SEQ ID NO: 1962698 - RNA, 22 nt, Shigella flexneri 2a str. 301
acugcuucaaaaaaauucugaa

SEQ ID NO: 1962699 - RNA, 14 nt, Shigella flexneri 2a str. 301
acugcuugaagcgc

SEQ ID NO: 1962700 - RNA, 16 nt, Shigella flexneri 2a str. 301
acuggcauuacggcau

SEQ ID NO: 1962701 - RNA, 20 nt, Shigella flexneri 2a str. 301
acuggcaggauaaacaagcc

SEQ ID NO: 1962702 - RNA, 19 nt, Shigella flexneri 2a str. 301
acuggcucugaauaaagcg

SEQ ID NO: 1962703 - RNA, 21 nt, Shigella flexneri 2a str. 301
acugcgccaucaaugccgcaa

SEQ ID NO: 1962704 - RNA, 22 nt, Shigella flexneri 2a str. 301
acugcgugucguaagccaccgc

SEQ ID NO: 1962705 - RNA, 16 nt, Shigella flexneri 2a str. 301
acugcgaaagcgucag

SEQ ID NO: 1962706 - RNA, 23 nt, Shigella flexneri 2a str. 301
acugcuccgggaauucguucaga

SEQ ID NO: 1962707 - RNA, 19 nt, Shigella flexneri 2a str. 301
acucuaccguuaaaauacg

SEQ ID NO: 1962708 - RNA, 21 nt, Shigella flexneri 2a str. 301
acucugccguaccaucgccag

SEQ ID NO: 1962709 - RNA, 22 nt, Shigella flexneri 2a str. 301
acucuuccugauacaugaauga

SEQ ID NO: 1962710 - RNA, 18 nt, Shigella flexneri 2a str. 301
acuucugccggauauuca

SEQ ID NO: 1962711 - RNA, 13 nt, Shigella flexneri 2a str. 301
acuuuaaucaccu

SEQ ID NO: 1962712 - RNA, 16 nt, Shigella flexneri 2a str. 301
acuucggucaccguca

SEQ ID NO: 1962713 - RNA, 11 nt, Shigella flexneri 2a str. 301
acuucaugacc

SEQ ID NO: 1962714 - RNA, 13 nt, Shigella flexneri 2a str. 301
acuucaucgccca

SEQ ID NO: 1962715 - RNA, 17 nt, Shigella flexneri 2a str. 301
acuucaucaucguugau

SEQ ID NO: 1962716 - RNA, 20 nt, Shigella flexneri 2a str. 301
acuucgcuuacgccugccag

SEQ ID NO: 1962717 - RNA, 15 nt, Shigella flexneri 2a str. 301
acuucacaucaccau

SEQ ID NO: 1962718 - RNA, 14 nt, Shigella flexneri 2a str. 301
acuucaaucgccac

SEQ ID NO: 1962719 - RNA, 15 nt, Shigella flexneri 2a str. 301
acuguaggccaguau

SEQ ID NO: 1962720 - RNA, 12 nt, Shigella flexneri 2a str. 301
acuguacgccga

SEQ ID NO: 1962721 - RNA, 19 nt, Shigella flexneri 2a str. 301
acucaauggcauccgccac

SEQ ID NO: 1962722 - RNA, 15 nt, Shigella flexneri 2a str. 301
acucaauggcauccg

SEQ ID NO: 1962723 - RNA, 19 nt, Shigella flexneri 2a str. 301
acucaccgaugaucgccau

SEQ ID NO: 1962724 - RNA, 22 nt, Shigella flexneri 2a str. 301
acucagccaaaucccgugaugc

SEQ ID NO: 1962725 - RNA, 19 nt, Shigella flexneri 2a str. 301
acucagcggcugccagcau

SEQ ID NO: 1962726 - RNA, 13 nt, Shigella flexneri 2a str. 301
acucagcggcugc

SEQ ID NO: 1962727 - RNA, 16 nt, Shigella flexneri 2a str. 301
acucagcgccugcugc

SEQ ID NO: 1962728 - RNA, 17 nt, Shigella flexneri 2a str. 301
acucagcgccugcugca

SEQ ID NO: 1962729 - RNA, 23 nt, Shigella flexneri 2a str. 301
acguugcugacuguaggccggau

SEQ ID NO: 1962730 - RNA, 17 nt, Shigella flexneri 2a str. 301
acguugauaaccacggc

SEQ ID NO: 1962731 - RNA, 22 nt, Shigella flexneri 2a str. 301
acguugauuuugucauggcgca

SEQ ID NO: 1962732 - RNA, 15 nt, Shigella flexneri 2a str. 301
acucaucaccaucag

SEQ ID NO: 1962733 - RNA, 12 nt, Shigella flexneri 2a str. 301
acuccagcgcca

SEQ ID NO: 1962734 - RNA, 18 nt, Shigella flexneri 2a str. 301
acuccagucccaguucau

SEQ ID NO: 1962735 - RNA, 17 nt, Shigella flexneri 2a str. 301
acucggcggcuuaaccg

SEQ ID NO: 1962736 - RNA, 18 nt, Shigella flexneri 2a str. 301
acucgugcgucgcauccg

SEQ ID NO: 1962737 - RNA, 14 nt, Shigella flexneri 2a str. 301
acucguucagcgca

SEQ ID NO: 1962738 - RNA, 18 nt, Shigella flexneri 2a str. 301
acucguaagaggcgugug

SEQ ID NO: 1962739 - RNA, 23 nt, Shigella flexneri 2a str. 301
acucgccauuaacauuaacucca

SEQ ID NO: 1962740 - RNA, 16 nt, Shigella flexneri 2a str. 301
acgugccgcagcuucu

SEQ ID NO: 1962741 - RNA, 20 nt, Shigella flexneri 2a str. 301
acgucuuugcguuccaucag

SEQ ID NO: 1962742 - RNA, 23 nt, Shigella flexneri 2a str. 301
acgucuuccauugccgcuuucca

SEQ ID NO: 1962743 - RNA, 14 nt, Shigella flexneri 2a str. 301
acgugacauucuga

SEQ ID NO: 1962744 - RNA, 17 nt, Shigella flexneri 2a str. 301
acguucuuaauaccgua

SEQ ID NO: 1962745 - RNA, 16 nt, Shigella flexneri 2a str. 301
acguggucgccagcau

SEQ ID NO: 1962746 - RNA, 17 nt, Shigella flexneri 2a str. 301
acgucgcaacuccacca

SEQ ID NO: 1962747 - RNA, 21 nt, Shigella flexneri 2a str. 301
acggugaugaucgcgcugauu

SEQ ID NO: 1962748 - RNA, 22 nt, Shigella flexneri 2a str. 301
acgucagccucgcuggucagcg

SEQ ID NO: 1962749 - RNA, 12 nt, Shigella flexneri 2a str. 301
acgucagcguca

SEQ ID NO: 1962750 - RNA, 22 nt, Shigella flexneri 2a str. 301
acguccaccccagcagaauccg

SEQ ID NO: 1962751 - RNA, 17 nt, Shigella flexneri 2a str. 301
acgucaguuuccagcau

SEQ ID NO: 1962752 - RNA, 19 nt, Shigella flexneri 2a str. 301
acggcuugcgcgcaaucag

SEQ ID NO: 1962753 - RNA, 22 nt, Shigella flexneri 2a str. 301
acggcugcugcuuucgccgcga

SEQ ID NO: 1962754 - RNA, 14 nt, Shigella flexneri 2a str. 301
acggcucgcccguu

SEQ ID NO: 1962755 - RNA, 17 nt, Shigella flexneri 2a str. 301
acggcucacgcccauca

SEQ ID NO: 1962756 - RNA, 22 nt, Shigella flexneri 2a str. 301
acggcgucgauugcucaacgcc

SEQ ID NO: 1962757 - RNA, 17 nt, Shigella flexneri 2a str. 301
acgcugguaacggcguc

SEQ ID NO: 1962758 - RNA, 22 nt, Shigella flexneri 2a str. 301
acgcuggguuucgccugccaga

SEQ ID NO: 1962759 - RNA, 14 nt, Shigella flexneri 2a str. 301
acggcgcauuugcg

SEQ ID NO: 1962760 - RNA, 22 nt, Shigella flexneri 2a str. 301
acgcuacauccgacaaaacgau

SEQ ID NO: 1962761 - RNA, 20 nt, Shigella flexneri 2a str. 301
acgcguuagugucuuaucug

SEQ ID NO: 1962762 - RNA, 22 nt, Shigella flexneri 2a str. 301
acgcucuauggcaccuguugcc

SEQ ID NO: 1962763 - RNA, 13 nt, Shigella flexneri 2a str. 301
acgcucucuucaa

SEQ ID NO: 1962764 - RNA, 23 nt, Shigella flexneri 2a str. 301
acgcuggcgcgucuuaucaggcc

SEQ ID NO: 1962765 - RNA, 22 nt, Shigella flexneri 2a str. 301
aaaccaacgcuguccggcgcac

SEQ ID NO: 1962766 - RNA, 18 nt, Shigella flexneri 2a str. 301
aaacauuuucauuugcgc

SEQ ID NO: 1962767 - RNA, 20 nt, Shigella flexneri 2a str. 301
acgcguuauccggcuaacaa

SEQ ID NO: 1962768 - RNA, 20 nt, Shigella flexneri 2a str. 301
acgcguuagcaucgcaucag

SEQ ID NO: 1962769 - RNA, 22 nt, Shigella flexneri 2a str. 301
acgcgucuuaucaugccuacag

SEQ ID NO: 1962770 - RNA, 19 nt, Shigella flexneri 2a str. 301
acgcguuagcaucgcauca

SEQ ID NO: 1962771 - RNA, 20 nt, Shigella flexneri 2a str. 301
acgcgucagcgucgcaucug

SEQ ID NO: 1962772 - RNA, 20 nt, Shigella flexneri 2a str. 301
acgcgucagugucuuaucug

SEQ ID NO: 1962773 - RNA, 20 nt, Shigella flexneri 2a str. 301
acgcgccagcgucgcaucag

SEQ ID NO: 1962774 - RNA, 14 nt, Shigella flexneri 2a str. 301
acgcgcauggccgu

SEQ ID NO: 1962775 - RNA, 20 nt, Shigella flexneri 2a str. 301
acgccuuauccggccuacga

SEQ ID NO: 1962776 - RNA, 19 nt, Shigella flexneri 2a str. 301
acgccuuauccggccuaca

SEQ ID NO: 1962777 - RNA, 19 nt, Shigella flexneri 2a str. 301
acgccuuauccagccuaca

SEQ ID NO: 1962778 - RNA, 22 nt, Shigella flexneri 2a str. 301
acgccuguaccagcggcuucca

SEQ ID NO: 1962779 - RNA, 20 nt, Shigella flexneri 2a str. 301
acgcggcagcgucgcaucag

SEQ ID NO: 1962780 - RNA, 16 nt, Shigella flexneri 2a str. 301
acgcggcaacggcuuc

SEQ ID NO: 1962781 - RNA, 21 nt, Shigella flexneri 2a str. 301
acgcggcaagcgucgcaucag

SEQ ID NO: 1962782 - RNA, 15 nt, Shigella flexneri 2a str. 301
acgccgcaucaggca

SEQ ID NO: 1962783 - RNA, 16 nt, Shigella flexneri 2a str. 301
acgccgcauccggcau

SEQ ID NO: 1962784 - RNA, 12 nt, Shigella flexneri 2a str. 301
acgccgccaguu

SEQ ID NO: 1962785 - RNA, 22 nt, Shigella flexneri 2a str. 301
acgccgccgagcgucacuucgg

SEQ ID NO: 1962786 - RNA, 22 nt, Shigella flexneri 2a str. 301
acgccgcuuuuuuuacgucugc

SEQ ID NO: 1962787 - RNA, 15 nt, Shigella flexneri 2a str. 301
acgccuaauccagcc

SEQ ID NO: 1962788 - RNA, 16 nt, Shigella flexneri 2a str. 301
acgccuaauccagccu

SEQ ID NO: 1962789 - RNA, 20 nt, Shigella flexneri 2a str. 301
acgccuaauccagccuacaa

SEQ ID NO: 1962790 - RNA, 19 nt, Shigella flexneri 2a str. 301
acgccguucuucagcgucc

SEQ ID NO: 1962791 - RNA, 22 nt, Shigella flexneri 2a str. 301
acgccgugggcaugaaacgcgu

SEQ ID NO: 1962792 - RNA, 19 nt, Shigella flexneri 2a str. 301
accugggugagcgucaucg

SEQ ID NO: 1962793 - RNA, 17 nt, Shigella flexneri 2a str. 301
accugguguucggcauu

SEQ ID NO: 1962794 - RNA, 15 nt, Shigella flexneri 2a str. 301
accugcucgucaucc

SEQ ID NO: 1962795 - RNA, 20 nt, Shigella flexneri 2a str. 301
accugcuggaaaggccgcga

SEQ ID NO: 1962796 - RNA, 23 nt, Shigella flexneri 2a str. 301
acgaucaucgacaguaccagcag

SEQ ID NO: 1962797 - RNA, 17 nt, Shigella flexneri 2a str. 301
acgagccguuccuaaca

SEQ ID NO: 1962798 - RNA, 11 nt, Shigella flexneri 2a str. 301
acgaucaccac

SEQ ID NO: 1962799 - RNA, 12 nt, Shigella flexneri 2a str. 301
accuuacggcac

SEQ ID NO: 1962800 - RNA, 14 nt, Shigella flexneri 2a str. 301
accuuacccgcgac

SEQ ID NO: 1962801 - RNA, 17 nt, Shigella flexneri 2a str. 301
accugugacagcagcgg

SEQ ID NO: 1962802 - RNA, 16 nt, Shigella flexneri 2a str. 301
accuuccgguuucaaa

SEQ ID NO: 1962803 - RNA, 21 nt, Shigella flexneri 2a str. 301
accuuccucaccguuuaagaa

SEQ ID NO: 1962804 - RNA, 21 nt, Shigella flexneri 2a str. 301
accuucgaaugccgcagcacc

SEQ ID NO: 1962805 - RNA, 17 nt, Shigella flexneri 2a str. 301
acgcagcauuggguaaa

SEQ ID NO: 1962806 - RNA, 15 nt, Shigella flexneri 2a str. 301
acgcagugauaacuc

SEQ ID NO: 1962807 - RNA, 21 nt, Shigella flexneri 2a str. 301
acgcagcgucucauaccggau

SEQ ID NO: 1962808 - RNA, 19 nt, Shigella flexneri 2a str. 301
acgcaucuucuccggccuu

SEQ ID NO: 1962809 - RNA, 14 nt, Shigella flexneri 2a str. 301
acgcauucgcgguu

SEQ ID NO: 1962810 - RNA, 14 nt, Shigella flexneri 2a str. 301
acgcaucgccggga

SEQ ID NO: 1962811 - RNA, 15 nt, Shigella flexneri 2a str. 301
acgcauaugcaucag

SEQ ID NO: 1962812 - RNA, 21 nt, Shigella flexneri 2a str. 301
acgcaucacgaaucgccgcau

SEQ ID NO: 1962813 - RNA, 20 nt, Shigella flexneri 2a str. 301
acgcaucacuacaaccggga

SEQ ID NO: 1962814 - RNA, 12 nt, Shigella flexneri 2a str. 301
acgccagucacg

SEQ ID NO: 1962815 - RNA, 19 nt, Shigella flexneri 2a str. 301
acgccagugcgccccaggu

SEQ ID NO: 1962816 - RNA, 12 nt, Shigella flexneri 2a str. 301
acgccagcagca

SEQ ID NO: 1962817 - RNA, 16 nt, Shigella flexneri 2a str. 301
acgccagaugcggcgu

SEQ ID NO: 1962818 - RNA, 18 nt, Shigella flexneri 2a str. 301
acgcccacgccagccugc

SEQ ID NO: 1962819 - RNA, 19 nt, Shigella flexneri 2a str. 301
acgcccaauccggccuaca

SEQ ID NO: 1962820 - RNA, 13 nt, Shigella flexneri 2a str. 301
acgccaucgccag

SEQ ID NO: 1962821 - RNA, 16 nt, Shigella flexneri 2a str. 301
acgccaucgccagcag

SEQ ID NO: 1962822 - RNA, 23 nt, Shigella flexneri 2a str. 301
acgccagucacggugcagcucgc

SEQ ID NO: 1962823 - RNA, 20 nt, Shigella flexneri 2a str. 301
acagccaaaucaucaguacc

SEQ ID NO: 1962824 - RNA, 14 nt, Shigella flexneri 2a str. 301
acagcaucuggaug

SEQ ID NO: 1962825 - RNA, 16 nt, Shigella flexneri 2a str. 301
acagccccugagcguu

SEQ ID NO: 1962826 - RNA, 22 nt, Shigella flexneri 2a str. 301
acagccccaggguuuugcccag

SEQ ID NO: 1962827 - RNA, 15 nt, Shigella flexneri 2a str. 301
acagccagccagcac

SEQ ID NO: 1962828 - RNA, 11 nt, Shigella flexneri 2a str. 301
acaaacgacgg

SEQ ID NO: 1962829 - RNA, 20 nt, Shigella flexneri 2a str. 301
aauuuucguaggucacuccc

SEQ ID NO: 1962830 - RNA, 16 nt, Shigella flexneri 2a str. 301
aauuuugugcagcaug

SEQ ID NO: 1962831 - RNA, 21 nt, Shigella flexneri 2a str. 301
acagccgccagacaauugccg

SEQ ID NO: 1962832 - RNA, 18 nt, Shigella flexneri 2a str. 301
acagcucagguucaacca

SEQ ID NO: 1962833 - RNA, 15 nt, Shigella flexneri 2a str. 301
acagcguuucuucga

SEQ ID NO: 1962834 - RNA, 22 nt, Shigella flexneri 2a str. 301
acagggccaggaaucgcaaacc

SEQ ID NO: 1962835 - RNA, 21 nt, Shigella flexneri 2a str. 301
acaguacgguaaagccgugcu

SEQ ID NO: 1962836 - RNA, 19 nt, Shigella flexneri 2a str. 301
acaucaucagaaaugccag

SEQ ID NO: 1962837 - RNA, 16 nt, Shigella flexneri 2a str. 301
acaucaguuggaugcu

SEQ ID NO: 1962838 - RNA, 14 nt, Shigella flexneri 2a str. 301
acaucaucacugcc

SEQ ID NO: 1962839 - RNA, 23 nt, Shigella flexneri 2a str. 301
acaucaccccgccgggcuuacca

SEQ ID NO: 1962840 - RNA, 16 nt, Shigella flexneri 2a str. 301
acagugacuuccguac

SEQ ID NO: 1962841 - RNA, 22 nt, Shigella flexneri 2a str. 301
acagugacuuccguaccagccu

SEQ ID NO: 1962842 - RNA, 21 nt, Shigella flexneri 2a str. 301
acagugacccgcagccagcac

SEQ ID NO: 1962843 - RNA, 14 nt, Shigella flexneri 2a str. 301
acauagcgcaucag

SEQ ID NO: 1962844 - RNA, 18 nt, Shigella flexneri 2a str. 301
acauaguagguccugacc

SEQ ID NO: 1962845 - RNA, 21 nt, Shigella flexneri 2a str. 301
acaugaaccgugucgccauca

SEQ ID NO: 1962846 - RNA, 16 nt, Shigella flexneri 2a str. 301
acaucuaccgccagcc

SEQ ID NO: 1962847 - RNA, 15 nt, Shigella flexneri 2a str. 301
acauccgccaucgac

SEQ ID NO: 1962848 - RNA, 20 nt, Shigella flexneri 2a str. 301
acaucaugguuugcauccac

SEQ ID NO: 1962849 - RNA, 21 nt, Shigella flexneri 2a str. 301
acaucagaggcgaaccgcugu

SEQ ID NO: 1962850 - RNA, 20 nt, Shigella flexneri 2a str. 301
acauccugcguuaaucgccg

SEQ ID NO: 1962851 - RNA, 19 nt, Shigella flexneri 2a str. 301
acauccgggcgaacuggcg

SEQ ID NO: 1962852 - RNA, 11 nt, Shigella flexneri 2a str. 301
acauccggcau

SEQ ID NO: 1962853 - RNA, 15 nt, Shigella flexneri 2a str. 301
accaaaggcgaugcu

SEQ ID NO: 1962854 - RNA, 20 nt, Shigella flexneri 2a str. 301
accaaaaucaucaauugcca

SEQ ID NO: 1962855 - RNA, 17 nt, Shigella flexneri 2a str. 301
accaaucggcagaacgg

SEQ ID NO: 1962856 - RNA, 12 nt, Shigella flexneri 2a str. 301
accaagcagcau

SEQ ID NO: 1962857 - RNA, 19 nt, Shigella flexneri 2a str. 301
accagcgucgcaucaggca

SEQ ID NO: 1962858 - RNA, 14 nt, Shigella flexneri 2a str. 301
accagcgucagcca

SEQ ID NO: 1962859 - RNA, 18 nt, Shigella flexneri 2a str. 301
accagcguuuccagcacc

SEQ ID NO: 1962860 - RNA, 18 nt, Shigella flexneri 2a str. 301
accagcgccuggcugauu

SEQ ID NO: 1962861 - RNA, 19 nt, Shigella flexneri 2a str. 301
accagccauuaaccagcca

SEQ ID NO: 1962862 - RNA, 14 nt, Shigella flexneri 2a str. 301
accagccuugccag

SEQ ID NO: 1962863 - RNA, 14 nt, Shigella flexneri 2a str. 301
accacuucggcaaa

SEQ ID NO: 1962864 - RNA, 14 nt, Shigella flexneri 2a str. 301
accagacagcacau

SEQ ID NO: 1962865 - RNA, 13 nt, Shigella flexneri 2a str. 301
accacucaccgcc

SEQ ID NO: 1962866 - RNA, 14 nt, Shigella flexneri 2a str. 301
accacucaccgccg

SEQ ID NO: 1962867 - RNA, 17 nt, Shigella flexneri 2a str. 301
accacuauuauggcgca

SEQ ID NO: 1962868 - RNA, 13 nt, Shigella flexneri 2a str. 301
accacucaccgcu

SEQ ID NO: 1962869 - RNA, 14 nt, Shigella flexneri 2a str. 301
accacugccagauu

SEQ ID NO: 1962870 - RNA, 19 nt, Shigella flexneri 2a str. 301
accagcaauaaugccaguc

SEQ ID NO: 1962871 - RNA, 11 nt, Shigella flexneri 2a str. 301
accagcaccag

SEQ ID NO: 1962872 - RNA, 22 nt, Shigella flexneri 2a str. 301
accagcaacaaauaaccgccug

SEQ ID NO: 1962873 - RNA, 19 nt, Shigella flexneri 2a str. 301
accagcaugaucagcgcau

SEQ ID NO: 1962874 - RNA, 11 nt, Shigella flexneri 2a str. 301
accacaugauu

SEQ ID NO: 1962875 - RNA, 17 nt, Shigella flexneri 2a str. 301
accacagacaaucgcca

SEQ ID NO: 1962876 - RNA, 17 nt, Shigella flexneri 2a str. 301
accacccagcagcgccg

SEQ ID NO: 1962877 - RNA, 22 nt, Shigella flexneri 2a str. 301
accacccccagacgacggcugc

SEQ ID NO: 1962878 - RNA, 18 nt, Shigella flexneri 2a str. 301
accaccggcaccacuugc

SEQ ID NO: 1962879 - RNA, 15 nt, Shigella flexneri 2a str. 301
accacguaccacggc

SEQ ID NO: 1962880 - RNA, 23 nt, Shigella flexneri 2a str. 301
accacgcgggccauccaccagug

SEQ ID NO: 1962881 - RNA, 16 nt, Shigella flexneri 2a str. 301
accaccuccacgccca

SEQ ID NO: 1962882 - RNA, 18 nt, Shigella flexneri 2a str. 301
accggcuucucgccuacc

SEQ ID NO: 1962883 - RNA, 22 nt, Shigella flexneri 2a str. 301
accggaaaaggcguucacgccg

SEQ ID NO: 1962884 - RNA, 20 nt, Shigella flexneri 2a str. 301
accgcuuuuucaauuuccag

SEQ ID NO: 1962885 - RNA, 16 nt, Shigella flexneri 2a str. 301
accggaacaucaccaa

SEQ ID NO: 1962886 - RNA, 16 nt, Shigella flexneri 2a str. 301
accgccaucauggaug

SEQ ID NO: 1962887 - RNA, 22 nt, Shigella flexneri 2a str. 301
accgcccagugcggugccgcga

SEQ ID NO: 1962888 - RNA, 11 nt, Shigella flexneri 2a str. 301
accgcccagug

SEQ ID NO: 1962889 - RNA, 16 nt, Shigella flexneri 2a str. 301
accgccacagcagccu

SEQ ID NO: 1962890 - RNA, 17 nt, Shigella flexneri 2a str. 301
accgccgccagcaacau

SEQ ID NO: 1962891 - RNA, 21 nt, Shigella flexneri 2a str. 301
accgccgauuuccugcgucgc

SEQ ID NO: 1962892 - RNA, 14 nt, Shigella flexneri 2a str. 301
accgcucagcuccu

SEQ ID NO: 1962893 - RNA, 15 nt, Shigella flexneri 2a str. 301
accgcuacuggcaau

SEQ ID NO: 1962894 - RNA, 15 nt, Shigella flexneri 2a str. 301
accgcgacaguauca

SEQ ID NO: 1962895 - RNA, 15 nt, Shigella flexneri 2a str. 301
acccgguaagcauuu

SEQ ID NO: 1962896 - RNA, 15 nt, Shigella flexneri 2a str. 301
aaaauggccagccag

SEQ ID NO: 1962897 - RNA, 17 nt, Shigella flexneri 2a str. 301
aaaaugcccgauaagca

SEQ ID NO: 1962898 - RNA, 12 nt, Shigella flexneri 2a str. 301
acccgucaccgu

SEQ ID NO: 1962899 - RNA, 17 nt, Shigella flexneri 2a str. 301
acccugaguuuucagua

SEQ ID NO: 1962900 - RNA, 18 nt, Shigella flexneri 2a str. 301
acccuugccggaugcggc

SEQ ID NO: 1962901 - RNA, 17 nt, Shigella flexneri 2a str. 301
acccugcucuuucagca

SEQ ID NO: 1962902 - RNA, 21 nt, Shigella flexneri 2a str. 301
acccuguguggugagauugcu

SEQ ID NO: 1962903 - RNA, 13 nt, Shigella flexneri 2a str. 301
accgagauaacgu

SEQ ID NO: 1962904 - RNA, 22 nt, Shigella flexneri 2a str. 301
accgaaauggcugccaaugaua

SEQ ID NO: 1962905 - RNA, 16 nt, Shigella flexneri 2a str. 301
accauuuuuaagcgcc

SEQ ID NO: 1962906 - RNA, 13 nt, Shigella flexneri 2a str. 301
acccaccgguccu

SEQ ID NO: 1962907 - RNA, 14 nt, Shigella flexneri 2a str. 301
acccaaccgguaau

SEQ ID NO: 1962908 - RNA, 17 nt, Shigella flexneri 2a str. 301
acccaaugugaccucuu

SEQ ID NO: 1962909 - RNA, 15 nt, Shigella flexneri 2a str. 301
acccacugcgcagug

SEQ ID NO: 1962910 - RNA, 20 nt, Shigella flexneri 2a str. 301
accccagaccaaucccgcca

SEQ ID NO: 1962911 - RNA, 18 nt, Shigella flexneri 2a str. 301
accccuguggaacgugcu

SEQ ID NO: 1962912 - RNA, 19 nt, Shigella flexneri 2a str. 301
accccgucaccacuucacc

SEQ ID NO: 1962913 - RNA, 21 nt, Shigella flexneri 2a str. 301
accccgccagcagaaugacau

SEQ ID NO: 1962914 - RNA, 18 nt, Shigella flexneri 2a str. 301
aagcucucuuccaguucg

SEQ ID NO: 1962915 - RNA, 17 nt, Shigella flexneri 2a str. 301
aagcucgccaccauuga

SEQ ID NO: 1962916 - RNA, 19 nt, Shigella flexneri 2a str. 301
aagcgcugagacgcgcuug

SEQ ID NO: 1962917 - RNA, 14 nt, Shigella flexneri 2a str. 301
aagcgcuaugcgca

SEQ ID NO: 1962918 - RNA, 13 nt, Shigella flexneri 2a str. 301
aagcgccgggaau

SEQ ID NO: 1962919 - RNA, 14 nt, Shigella flexneri 2a str. 301
aagcgucgcaucag

SEQ ID NO: 1962920 - RNA, 12 nt, Shigella flexneri 2a str. 301
aagcgucaccgg

SEQ ID NO: 1962921 - RNA, 20 nt, Shigella flexneri 2a str. 301
aagccuguuuagccgcuucu

SEQ ID NO: 1962922 - RNA, 22 nt, Shigella flexneri 2a str. 301
aagccuuucaggaaacugcgcc

SEQ ID NO: 1962923 - RNA, 23 nt, Shigella flexneri 2a str. 301
aagcaggucggcucagccgauga

SEQ ID NO: 1962924 - RNA, 22 nt, Shigella flexneri 2a str. 301
aagcaggucggcucagccgaug

SEQ ID NO: 1962925 - RNA, 13 nt, Shigella flexneri 2a str. 301
aagcaugauauuc

SEQ ID NO: 1962926 - RNA, 15 nt, Shigella flexneri 2a str. 301
aagcccgccaucgcc

SEQ ID NO: 1962927 - RNA, 19 nt, Shigella flexneri 2a str. 301
aagcccccgcaacauugcg

SEQ ID NO: 1962928 - RNA, 24 nt, Shigella flexneri 2a str. 301
aagcacuggcggcagcaggugcgc

SEQ ID NO: 1962929 - RNA, 12 nt, Shigella flexneri 2a str. 301
aagcagaucugg

SEQ ID NO: 1962930 - RNA, 17 nt, Shigella flexneri 2a str. 301
aagcacuuuuuguaauu

SEQ ID NO: 1962931 - RNA, 18 nt, Shigella flexneri 2a str. 301
aagcaacgcgcaccguga

SEQ ID NO: 1962932 - RNA, 14 nt, Shigella flexneri 2a str. 301
aagcaaaaacgcau

SEQ ID NO: 1962933 - RNA, 23 nt, Shigella flexneri 2a str. 301
aacuacggcuccgcaagcgaaug

SEQ ID NO: 1962934 - RNA, 16 nt, Shigella flexneri 2a str. 301
aagagcagcugauuga

SEQ ID NO: 1962935 - RNA, 17 nt, Shigella flexneri 2a str. 301
aagaguuuuaaacgcag

SEQ ID NO: 1962936 - RNA, 20 nt, Shigella flexneri 2a str. 301
aagaguaaagcccgccaucg

SEQ ID NO: 1962937 - RNA, 22 nt, Shigella flexneri 2a str. 301
aaggaaucgcaaagccgauacc

SEQ ID NO: 1962938 - RNA, 20 nt, Shigella flexneri 2a str. 301
aaggaauggucgggcugcuc

SEQ ID NO: 1962939 - RNA, 20 nt, Shigella flexneri 2a str. 301
aagcugugcgauagcaacga

SEQ ID NO: 1962940 - RNA, 22 nt, Shigella flexneri 2a str. 301
aagcugggcgguggcgauccgg

SEQ ID NO: 1962941 - RNA, 11 nt, Shigella flexneri 2a str. 301
aaggcgugauc

SEQ ID NO: 1962942 - RNA, 18 nt, Shigella flexneri 2a str. 301
aagggguuuuccaguuca

SEQ ID NO: 1962943 - RNA, 16 nt, Shigella flexneri 2a str. 301
aaggguguucauccug

SEQ ID NO: 1962944 - RNA, 14 nt, Shigella flexneri 2a str. 301
aaggguauugccga

SEQ ID NO: 1962945 - RNA, 23 nt, Shigella flexneri 2a str. 301
aaguaaugcggcaagggcgaauc

SEQ ID NO: 1962946 - RNA, 14 nt, Shigella flexneri 2a str. 301
aaguacuccugcuc

SEQ ID NO: 1962947 - RNA, 16 nt, Shigella flexneri 2a str. 301
aaguacugauugacgc

SEQ ID NO: 1962948 - RNA, 14 nt, Shigella flexneri 2a str. 301
aauacaaccugcug

SEQ ID NO: 1962949 - RNA, 21 nt, Shigella flexneri 2a str. 301
aauaccagccuucuucaucca

SEQ ID NO: 1962950 - RNA, 22 nt, Shigella flexneri 2a str. 301
aauaccagaucucaccacgaug

SEQ ID NO: 1962951 - RNA, 13 nt, Shigella flexneri 2a str. 301
aauaccugccugu

SEQ ID NO: 1962952 - RNA, 23 nt, Shigella flexneri 2a str. 301
aauaccgcugccgcuggcgguaa

SEQ ID NO: 1962953 - RNA, 18 nt, Shigella flexneri 2a str. 301
aaguuuuuaugaguuugg

SEQ ID NO: 1962954 - RNA, 17 nt, Shigella flexneri 2a str. 301
aauaaaagcauaccgga

SEQ ID NO: 1962955 - RNA, 21 nt, Shigella flexneri 2a str. 301
aauaaacgccauauucugauc

SEQ ID NO: 1962956 - RNA, 16 nt, Shigella flexneri 2a str. 301
aauaaacuggcugugc

SEQ ID NO: 1962957 - RNA, 20 nt, Shigella flexneri 2a str. 301
aauaagggugucuguuaauc

SEQ ID NO: 1962958 - RNA, 23 nt, Shigella flexneri 2a str. 301
aauaagguuaauuaccuuaucaa

SEQ ID NO: 1962959 - RNA, 13 nt, Shigella flexneri 2a str. 301
aauggccugcgcg

SEQ ID NO: 1962960 - RNA, 17 nt, Shigella flexneri 2a str. 301
aauggcaucugauaagc

SEQ ID NO: 1962961 - RNA, 14 nt, Shigella flexneri 2a str. 301
aauggcagauaauc

SEQ ID NO: 1962962 - RNA, 19 nt, Shigella flexneri 2a str. 301
aauggagcuaaacagcgcu

SEQ ID NO: 1962963 - RNA, 15 nt, Shigella flexneri 2a str. 301
aaugcgaucuacccg

SEQ ID NO: 1962964 - RNA, 14 nt, Shigella flexneri 2a str. 301
aaugccuaccgcau

SEQ ID NO: 1962965 - RNA, 19 nt, Shigella flexneri 2a str. 301
aaucuuagugcgccugauc

SEQ ID NO: 1962966 - RNA, 19 nt, Shigella flexneri 2a str. 301
aaucuguuuauuugacagc

SEQ ID NO: 1962967 - RNA, 15 nt, Shigella flexneri 2a str. 301
aaugccgcagcggcg

SEQ ID NO: 1962968 - RNA, 22 nt, Shigella flexneri 2a str. 301
aaugauugggauuaaagcgcuc

SEQ ID NO: 1962969 - RNA, 16 nt, Shigella flexneri 2a str. 301
aaugauucgggcuuuc

SEQ ID NO: 1962970 - RNA, 23 nt, Shigella flexneri 2a str. 301
aaugccgauauaaauuccacgcg

SEQ ID NO: 1962971 - RNA, 15 nt, Shigella flexneri 2a str. 301
aaugaugcggcgcuu

SEQ ID NO: 1962972 - RNA, 16 nt, Shigella flexneri 2a str. 301
aaugauauuggucacc

SEQ ID NO: 1962973 - RNA, 13 nt, Shigella flexneri 2a str. 301
aaugaguacugau

SEQ ID NO: 1962974 - RNA, 20 nt, Shigella flexneri 2a str. 301
aaugucggaugcggcgugaa

SEQ ID NO: 1962975 - RNA, 15 nt, Shigella flexneri 2a str. 301
aauguuccagugcgu

SEQ ID NO: 1962976 - RNA, 20 nt, Shigella flexneri 2a str. 301
aauuaucacaacuucgcgaa

SEQ ID NO: 1962977 - RNA, 18 nt, Shigella flexneri 2a str. 301
aauuaccuaugccgauca

SEQ ID NO: 1962978 - RNA, 20 nt, Shigella flexneri 2a str. 301
aauucaccaguuuacugaua

SEQ ID NO: 1962979 - RNA, 17 nt, Shigella flexneri 2a str. 301
aauucagccgcgcgcuu

SEQ ID NO: 1962980 - RNA, 19 nt, Shigella flexneri 2a str. 301
aauuugccaucucugcaac

SEQ ID NO: 1962981 - RNA, 15 nt, Shigella flexneri 2a str. 301
aauuucagcgccuga

SEQ ID NO: 1962982 - RNA, 13 nt, Shigella flexneri 2a str. 301
aauuucagcgccu

SEQ ID NO: 1962983 - RNA, 24 nt, Shigella flexneri 2a str. 301
aauuucacugccuuucagcgcaug

SEQ ID NO: 1962984 - RNA, 15 nt, Shigella flexneri 2a str. 301
aaucguaaucagcau

SEQ ID NO: 1962985 - RNA, 11 nt, Shigella flexneri 2a str. 301
aaucgggcaac

SEQ ID NO: 1962986 - RNA, 14 nt, Shigella flexneri 2a str. 301
aaucucacccgcuu

SEQ ID NO: 1962987 - RNA, 17 nt, Shigella flexneri 2a str. 301
aaucucaauguauuccc

SEQ ID NO: 1962988 - RNA, 22 nt, Shigella flexneri 2a str. 301
aaucgagcccagaugccggaug

SEQ ID NO: 1962989 - RNA, 20 nt, Shigella flexneri 2a str. 301
aaucgagcccagaugccgga

SEQ ID NO: 1962990 - RNA, 17 nt, Shigella flexneri 2a str. 301
aaucgcaacgccuuccg

SEQ ID NO: 1962991 - RNA, 14 nt, Shigella flexneri 2a str. 301
aaucgcccgcuucc

SEQ ID NO: 1962992 - RNA, 21 nt, Shigella flexneri 2a str. 301
aaucgcccggauauccacccg

SEQ ID NO: 1962993 - RNA, 21 nt, Shigella flexneri 2a str. 301
aaucgccagcaaaaucaccau

SEQ ID NO: 1962994 - RNA, 19 nt, Shigella flexneri 2a str. 301
aaucgccaucuuuacaccu

SEQ ID NO: 1962995 - RNA, 19 nt, Shigella flexneri 2a str. 301
aaucgcacaaaaucaugag

SEQ ID NO: 1962996 - RNA, 17 nt, Shigella flexneri 2a str. 301
aauccggugccuuaccg

SEQ ID NO: 1962997 - RNA, 19 nt, Shigella flexneri 2a str. 301
aauccggugccuuaccgcu

SEQ ID NO: 1962998 - RNA, 21 nt, Shigella flexneri 2a str. 301
aaucacuucuucuuguucauc

SEQ ID NO: 1962999 - RNA, 16 nt, Shigella flexneri 2a str. 301
aauaguuuccgcuucu

SEQ ID NO: 1963000 - RNA, 20 nt, Shigella flexneri 2a str. 301
aaucagccagaacagcggug

SEQ ID NO: 1963001 - RNA, 21 nt, Shigella flexneri 2a str. 301
aaucaguaaauugcagcacac

SEQ ID NO: 1963002 - RNA, 18 nt, Shigella flexneri 2a str. 301
aaucaguucuaccaucaa

SEQ ID NO: 1963003 - RNA, 11 nt, Shigella flexneri 2a str. 301
aaucagcgcca

SEQ ID NO: 1963004 - RNA, 14 nt, Shigella flexneri 2a str. 301
aauagcuucuucaa

SEQ ID NO: 1963005 - RNA, 19 nt, Shigella flexneri 2a str. 301
aauagcccucgccgcuucc

SEQ ID NO: 1963006 - RNA, 15 nt, Shigella flexneri 2a str. 301
aauccauucaucgcc

SEQ ID NO: 1963007 - RNA, 14 nt, Shigella flexneri 2a str. 301
aauccaucccgcuc

SEQ ID NO: 1963008 - RNA, 13 nt, Shigella flexneri 2a str. 301
aauccccagaccu

SEQ ID NO: 1963009 - RNA, 16 nt, Shigella flexneri 2a str. 301
aauccccaaugaccuu

SEQ ID NO: 1963010 - RNA, 21 nt, Shigella flexneri 2a str. 301
aauccacaucggcaucaggcc

SEQ ID NO: 1963011 - RNA, 13 nt, Shigella flexneri 2a str. 301
aaucccugcgaac

SEQ ID NO: 1963012 - RNA, 14 nt, Shigella flexneri 2a str. 301
aauccccuucucaa

SEQ ID NO: 1963013 - RNA, 15 nt, Shigella flexneri 2a str. 301
aaucaucauugcugu

SEQ ID NO: 1963014 - RNA, 14 nt, Shigella flexneri 2a str. 301
aacggcaaacgcaa

SEQ ID NO: 1963015 - RNA, 20 nt, Shigella flexneri 2a str. 301
aacgcuuucuuuggcaucaa

SEQ ID NO: 1963016 - RNA, 19 nt, Shigella flexneri 2a str. 301
aacgcuuuuuugagcagca

SEQ ID NO: 1963017 - RNA, 13 nt, Shigella flexneri 2a str. 301
aacgcgaucgcga

SEQ ID NO: 1963018 - RNA, 18 nt, Shigella flexneri 2a str. 301
aacgggcaaucucauacc

SEQ ID NO: 1963019 - RNA, 20 nt, Shigella flexneri 2a str. 301
aacggguugcgguuucaacu

SEQ ID NO: 1963020 - RNA, 13 nt, Shigella flexneri 2a str. 301
aacggucacggcu

SEQ ID NO: 1963021 - RNA, 19 nt, Shigella flexneri 2a str. 301
aacgguccggcauccagcc

SEQ ID NO: 1963022 - RNA, 14 nt, Shigella flexneri 2a str. 301
aacgugaaguucgu

SEQ ID NO: 1963023 - RNA, 13 nt, Shigella flexneri 2a str. 301
aacguccggcaau

SEQ ID NO: 1963024 - RNA, 22 nt, Shigella flexneri 2a str. 301
aacguaggcaauuggcgcauca

SEQ ID NO: 1963025 - RNA, 13 nt, Shigella flexneri 2a str. 301
aacgguuucagca

SEQ ID NO: 1963026 - RNA, 22 nt, Shigella flexneri 2a str. 301
aacguaaacgcagcaucaugcc

SEQ ID NO: 1963027 - RNA, 19 nt, Shigella flexneri 2a str. 301
aacguaaggcgcaacauau

SEQ ID NO: 1963028 - RNA, 20 nt, Shigella flexneri 2a str. 301
aaccuucacccucacgcauu

SEQ ID NO: 1963029 - RNA, 15 nt, Shigella flexneri 2a str. 301
aaccgcucgucacau

SEQ ID NO: 1963030 - RNA, 20 nt, Shigella flexneri 2a str. 301
aaccuugcacucgcagaagc

SEQ ID NO: 1963031 - RNA, 17 nt, Shigella flexneri 2a str. 301
aacgaucgcuuucaacg

SEQ ID NO: 1963032 - RNA, 19 nt, Shigella flexneri 2a str. 301
aacgacauauacaaacggc

SEQ ID NO: 1963033 - RNA, 22 nt, Shigella flexneri 2a str. 301
aacgaaucugcaaaucugcgcc

SEQ ID NO: 1963034 - RNA, 16 nt, Shigella flexneri 2a str. 301
aacgccgccaguacgc

SEQ ID NO: 1963035 - RNA, 21 nt, Shigella flexneri 2a str. 301
aacgcaccaggcgaaaacgcu

SEQ ID NO: 1963036 - RNA, 15 nt, Shigella flexneri 2a str. 301
aacgcaacaucgcaa

SEQ ID NO: 1963037 - RNA, 19 nt, Shigella flexneri 2a str. 301
aacgcaaacuguuucaggu

SEQ ID NO: 1963038 - RNA, 21 nt, Shigella flexneri 2a str. 301
aacgauggcuaauaauucuga

SEQ ID NO: 1963039 - RNA, 17 nt, Shigella flexneri 2a str. 301
aacgcaguuccgccagc

SEQ ID NO: 1963040 - RNA, 20 nt, Shigella flexneri 2a str. 301
aacgcauaccccaucagcgu

SEQ ID NO: 1963041 - RNA, 14 nt, Shigella flexneri 2a str. 301
aacgcacgcuguca

SEQ ID NO: 1963042 - RNA, 15 nt, Shigella flexneri 2a str. 301
aaccagaucggacuu

SEQ ID NO: 1963043 - RNA, 19 nt, Shigella flexneri 2a str. 301
aaccacuauuauggcgcag

SEQ ID NO: 1963044 - RNA, 14 nt, Shigella flexneri 2a str. 301
aacauugcugccag

SEQ ID NO: 1963045 - RNA, 15 nt, Shigella flexneri 2a str. 301
aacaugagaacaguu

SEQ ID NO: 1963046 - RNA, 17 nt, Shigella flexneri 2a str. 301
aacaucgggauaucgcc

SEQ ID NO: 1963047 - RNA, 17 nt, Shigella flexneri 2a str. 301
aacaucguuagcggcaa

SEQ ID NO: 1963048 - RNA, 13 nt, Shigella flexneri 2a str. 301
aacaucaggcauu

SEQ ID NO: 1963049 - RNA, 16 nt, Shigella flexneri 2a str. 301
aacaucaaaugcgcag

SEQ ID NO: 1963050 - RNA, 22 nt, Shigella flexneri 2a str. 301
aacauacugcccgagcgccauu

SEQ ID NO: 1963051 - RNA, 14 nt, Shigella flexneri 2a str. 301
aacagugcaccgga

SEQ ID NO: 1963052 - RNA, 16 nt, Shigella flexneri 2a str. 301
aacaguucugcagcgu

SEQ ID NO: 1963053 - RNA, 21 nt, Shigella flexneri 2a str. 301
aaccgcagugauuucaaccgg

SEQ ID NO: 1963054 - RNA, 23 nt, Shigella flexneri 2a str. 301
aaccgcaguguaguucuggccuu

SEQ ID NO: 1963055 - RNA, 19 nt, Shigella flexneri 2a str. 301
aaccgcauacgcagcauca

SEQ ID NO: 1963056 - RNA, 13 nt, Shigella flexneri 2a str. 301
aaccgacugccug

SEQ ID NO: 1963057 - RNA, 12 nt, Shigella flexneri 2a str. 301
aacccgcugcca

SEQ ID NO: 1963058 - RNA, 22 nt, Shigella flexneri 2a str. 301
aacccaucaacugaccgauuua

SEQ ID NO: 1963059 - RNA, 14 nt, Shigella flexneri 2a str. 301
aaccauuucugcga

SEQ ID NO: 1963060 - RNA, 22 nt, Shigella flexneri 2a str. 301
aaccaucgagaaucagcgagac

SEQ ID NO: 1963061 - RNA, 16 nt, Shigella flexneri 2a str. 301
aaccagcgcagacacc

SEQ ID NO: 1963062 - RNA, 21 nt, Shigella flexneri 2a str. 301
aaccaucgagaaucagcgaga

SEQ ID NO: 1963063 - RNA, 16 nt, Shigella flexneri 2a str. 301
aaagauccguaaugcc

SEQ ID NO: 1963064 - RNA, 17 nt, Shigella flexneri 2a str. 301
aaagagugugaauauuc

SEQ ID NO: 1963065 - RNA, 15 nt, Shigella flexneri 2a str. 301
aaagcaauauugaug

SEQ ID NO: 1963066 - RNA, 20 nt, Shigella flexneri 2a str. 301
aaagcaaaaauaagcgacgu

SEQ ID NO: 1963067 - RNA, 21 nt, Shigella flexneri 2a str. 301
aaacugccgcacuuugagcag

SEQ ID NO: 1963068 - RNA, 13 nt, Shigella flexneri 2a str. 301
aaacugccugaua

SEQ ID NO: 1963069 - RNA, 17 nt, Shigella flexneri 2a str. 301
aaacguuucaaacaggc

SEQ ID NO: 1963070 - RNA, 17 nt, Shigella flexneri 2a str. 301
aaacuaucccagccuau

SEQ ID NO: 1963071 - RNA, 22 nt, Shigella flexneri 2a str. 301
aaacuaucccagccuauaacga

SEQ ID NO: 1963072 - RNA, 22 nt, Shigella flexneri 2a str. 301
aaacucacgccagcagcgcaau

SEQ ID NO: 1963073 - RNA, 16 nt, Shigella flexneri 2a str. 301
aaacucaggcuggcaa

SEQ ID NO: 1963074 - RNA, 16 nt, Shigella flexneri 2a str. 301
aaacgcacgucugaug

SEQ ID NO: 1963075 - RNA, 20 nt, Shigella flexneri 2a str. 301
aaacgcaaaauugccugaug

SEQ ID NO: 1963076 - RNA, 20 nt, Shigella flexneri 2a str. 301
aaacgcaacauugccugaug

SEQ ID NO: 1963077 - RNA, 16 nt, Shigella flexneri 2a str. 301
aaacgugacagcauac

SEQ ID NO: 1963078 - RNA, 22 nt, Shigella flexneri 2a str. 301
aaacgucucacuaacgguguaa

SEQ ID NO: 1963079 - RNA, 20 nt, Shigella flexneri 2a str. 301
aaacgacgauaauccgucgc

SEQ ID NO: 1963080 - RNA, 21 nt, Shigella flexneri 2a str. 301
aaaaaagggcauguucaggcg

SEQ ID NO: 1963081 - RNA, 19 nt, Shigella flexneri 2a str. 301
aaaaauauugagcagaagg

SEQ ID NO: 1963082 - RNA, 16 nt, Shigella flexneri 2a str. 301
aaaaaucccacugcgc

SEQ ID NO: 1963083 - RNA, 21 nt, Shigella flexneri 2a str. 301
aaagcacccagcaauccugca

SEQ ID NO: 1963084 - RNA, 16 nt, Shigella flexneri 2a str. 301
aaagcugucaccaauc

SEQ ID NO: 1963085 - RNA, 21 nt, Shigella flexneri 2a str. 301
aaagucauggcaaacugcgcg

SEQ ID NO: 1963086 - RNA, 16 nt, Shigella flexneri 2a str. 301
aaaguuuaccagccaa

SEQ ID NO: 1963087 - RNA, 19 nt, Shigella flexneri 2a str. 301
aaauagaggaaucugauua

SEQ ID NO: 1963088 - RNA, 15 nt, Shigella flexneri 2a str. 301
aaauaucacugauua

SEQ ID NO: 1963089 - RNA, 19 nt, Shigella flexneri 2a str. 301
aacagaccagcaccggugc

SEQ ID NO: 1963090 - RNA, 19 nt, Shigella flexneri 2a str. 301
aacacuuuacgcuuuuuga

SEQ ID NO: 1963091 - RNA, 18 nt, Shigella flexneri 2a str. 301
aacaauauuugcagaggu

SEQ ID NO: 1963092 - RNA, 21 nt, Shigella flexneri 2a str. 301
aacacugcgcucuucuggcac

SEQ ID NO: 1963093 - RNA, 14 nt, Shigella flexneri 2a str. 301
aacacucuuuuuga

SEQ ID NO: 1963094 - RNA, 16 nt, Shigella flexneri 2a str. 301
aacagcaccauccgcc

SEQ ID NO: 1963095 - RNA, 21 nt, Shigella flexneri 2a str. 301
aacaacgcgcggaacugauga

SEQ ID NO: 1963096 - RNA, 17 nt, Shigella flexneri 2a str. 301
aaaagcugugcuugaua

SEQ ID NO: 1963097 - RNA, 19 nt, Shigella flexneri 2a str. 301
aaaagcucgccgaagcgag

SEQ ID NO: 1963098 - RNA, 11 nt, Shigella flexneri 2a str. 301
aacagcgcauu

SEQ ID NO: 1963099 - RNA, 17 nt, Shigella flexneri 2a str. 301
aacagcgcaaaacgcag

SEQ ID NO: 1963100 - RNA, 20 nt, Shigella flexneri 2a str. 301
aacagcgguguacccugcuc

SEQ ID NO: 1963101 - RNA, 13 nt, Shigella flexneri 2a str. 301
aacagcagcaggu

SEQ ID NO: 1963102 - RNA, 12 nt, Shigella flexneri 2a str. 301
aacaggaucugg

SEQ ID NO: 1963103 - RNA, 21 nt, Shigella flexneri 2a str. 301
aacaggccgacuggcaugcug

SEQ ID NO: 1963104 - RNA, 11 nt, Shigella flexneri 2a str. 301
aacaguaaccc

SEQ ID NO: 1963105 - RNA, 19 nt, Shigella flexneri 2a str. 301
aacagucaguuaucgcauu

SEQ ID NO: 1963106 - RNA, 15 nt, Shigella flexneri 2a str. 301
aacaguaauaaugcc

SEQ ID NO: 1963107 - RNA, 17 nt, Shigella flexneri 2a str. 301
aacaggucacgggcaau

SEQ ID NO: 1963108 - RNA, 14 nt, Shigella flexneri 2a str. 301
aaaagauggucauc

SEQ ID NO: 1963109 - RNA, 16 nt, Shigella flexneri 2a str. 301
aaauugacuacaccau

SEQ ID NO: 1963110 - RNA, 15 nt, Shigella flexneri 2a str. 301
aaauugcugacgcaa

SEQ ID NO: 1963111 - RNA, 14 nt, Shigella flexneri 2a str. 301
aaauucugcugauu

SEQ ID NO: 1963112 - RNA, 17 nt, Shigella flexneri 2a str. 301
aaaugucagcugccagu

SEQ ID NO: 1963113 - RNA, 22 nt, Shigella flexneri 2a str. 301
aaaucaacauguuccugccagu

SEQ ID NO: 1963114 - RNA, 15 nt, Shigella flexneri 2a str. 301
aaaucaacgccgcau

SEQ ID NO: 1963115 - RNA, 20 nt, Shigella flexneri 2a str. 301
aaaucagaucgacgccgaug

SEQ ID NO: 1963116 - RNA, 12 nt, Shigella flexneri 2a str. 301
aaaucuauugca

SEQ ID NO: 1963117 - RNA, 21 nt, Shigella flexneri 2a str. 301
aaaucugucagguaacaagcc

SEQ ID NO: 1963118 - RNA, 16 nt, Shigella flexneri 2a str. 301
aaaugaaaaucaccau

SEQ ID NO: 1963119 - RNA, 12 nt, Shigella flexneri 2a str. 301
uuuuuccguuuu

SEQ ID NO: 1963120 - RNA, 22 nt, Shigella flexneri 2a str. 301
uuuuucaacauauccuucacac

SEQ ID NO: 1963121 - RNA, 20 nt, Shigella flexneri 2a str. 301
uuuugcuugcgauagcgcac

SEQ ID NO: 1963122 - RNA, 15 nt, Shigella flexneri 2a str. 301
uuuuccaucgaccaa

SEQ ID NO: 1963123 - RNA, 16 nt, Shigella flexneri 2a str. 301
uuuucgccaucucaaa

SEQ ID NO: 1963124 - RNA, 23 nt, Shigella flexneri 2a str. 301
uuuucagcgagagcaaugcgcau

SEQ ID NO: 1963125 - RNA, 22 nt, Shigella flexneri 2a str. 301
uuugcgcguaacgaucgccugg

SEQ ID NO: 1963126 - RNA, 14 nt, Shigella flexneri 2a str. 301
uuucuuuugccaga

SEQ ID NO: 1963127 - RNA, 23 nt, Shigella flexneri 2a str. 301
uuugaacugggcgcggcccacuu

SEQ ID NO: 1963128 - RNA, 22 nt, Shigella flexneri 2a str. 301
uuucuuugcuuuguaaagcgcc

SEQ ID NO: 1963129 - RNA, 19 nt, Shigella flexneri 2a str. 301
uuuccgcgcaaucgcccag

SEQ ID NO: 1963130 - RNA, 21 nt, Shigella flexneri 2a str. 301
uuuccagacugaugugaucca

SEQ ID NO: 1963131 - RNA, 14 nt, Shigella flexneri 2a str. 301
uuuccagcaguucc

SEQ ID NO: 1963132 - RNA, 22 nt, Shigella flexneri 2a str. 301
uuuccagccgagccgacgguuu

SEQ ID NO: 1963133 - RNA, 14 nt, Shigella flexneri 2a str. 301
uuuccccaacgaug

SEQ ID NO: 1963134 - RNA, 15 nt, Shigella flexneri 2a str. 301
uuucuggaugauccu

SEQ ID NO: 1963135 - RNA, 14 nt, Shigella flexneri 2a str. 301
uuucuuccagcgcc

SEQ ID NO: 1963136 - RNA, 18 nt, Shigella flexneri 2a str. 301
uuucugaauuucagcgcc

SEQ ID NO: 1963137 - RNA, 19 nt, Shigella flexneri 2a str. 301
uuuacgccgcauccggcaa

SEQ ID NO: 1963138 - RNA, 19 nt, Shigella flexneri 2a str. 301
uuuacgccgcauccggcau

SEQ ID NO: 1963139 - RNA, 24 nt, Shigella flexneri 2a str. 301
uuuacuauuauuuuucauauggau

SEQ ID NO: 1963140 - RNA, 12 nt, Shigella flexneri 2a str. 301
uuuacgucugca

SEQ ID NO: 1963141 - RNA, 12 nt, Shigella flexneri 2a str. 301
uuuacaugcgcg

SEQ ID NO: 1963142 - RNA, 16 nt, Shigella flexneri 2a str. 301
uugugugaaaucagca

SEQ ID NO: 1963143 - RNA, 22 nt, Shigella flexneri 2a str. 301
uuguucucagcacauugauggc

SEQ ID NO: 1963144 - RNA, 23 nt, Shigella flexneri 2a str. 301
uuucaccugcugauuauccgcau

SEQ ID NO: 1963145 - RNA, 18 nt, Shigella flexneri 2a str. 301
uuucacuauguaauccug

SEQ ID NO: 1963146 - RNA, 15 nt, Shigella flexneri 2a str. 301
uuucagcagcggcac

SEQ ID NO: 1963147 - RNA, 22 nt, Shigella flexneri 2a str. 301
uuucacaguacgcuugauuucu

SEQ ID NO: 1963148 - RNA, 14 nt, Shigella flexneri 2a str. 301
uugggaucgccagg

SEQ ID NO: 1963149 - RNA, 18 nt, Shigella flexneri 2a str. 301
uuggcucaacaacugcgc

SEQ ID NO: 1963150 - RNA, 22 nt, Shigella flexneri 2a str. 301
uuguaccaguucgcuuuccguu

SEQ ID NO: 1963151 - RNA, 14 nt, Shigella flexneri 2a str. 301
uuguaagcugucga

SEQ ID NO: 1963152 - RNA, 18 nt, Shigella flexneri 2a str. 301
uugucggcgugaacgcgc

SEQ ID NO: 1963153 - RNA, 14 nt, Shigella flexneri 2a str. 301
uugucgcaggcggu

SEQ ID NO: 1963154 - RNA, 19 nt, Shigella flexneri 2a str. 301
uugucgauaaacaguuucg

SEQ ID NO: 1963155 - RNA, 20 nt, Shigella flexneri 2a str. 301
uuguaggccagauaagacgu

SEQ ID NO: 1963156 - RNA, 20 nt, Shigella flexneri 2a str. 301
uuguaggccggauaaggcgu

SEQ ID NO: 1963157 - RNA, 19 nt, Shigella flexneri 2a str. 301
uuguaggucugauagcgua

SEQ ID NO: 1963158 - RNA, 20 nt, Shigella flexneri 2a str. 301
uuguaggcuggauaaggcgu

SEQ ID NO: 1963159 - RNA, 20 nt, Shigella flexneri 2a str. 301
uuguaggccggauaaggcgc

SEQ ID NO: 1963160 - RNA, 21 nt, Shigella flexneri 2a str. 301
uuggcgcauaacucaccauca

SEQ ID NO: 1963161 - RNA, 23 nt, Shigella flexneri 2a str. 301
uucuuucgcccaauaaaaaacgc

SEQ ID NO: 1963162 - RNA, 13 nt, Shigella flexneri 2a str. 301
uggcucaucgccu

SEQ ID NO: 1963163 - RNA, 16 nt, Shigella flexneri 2a str. 301
uggcucaacaacugcg

SEQ ID NO: 1963164 - RNA, 20 nt, Shigella flexneri 2a str. 301
uggcuacccugguuuccgcu

SEQ ID NO: 1963165 - RNA, 17 nt, Shigella flexneri 2a str. 301
uggcgggaucaccugca

SEQ ID NO: 1963166 - RNA, 13 nt, Shigella flexneri 2a str. 301
uggguaacggcag

SEQ ID NO: 1963167 - RNA, 22 nt, Shigella flexneri 2a str. 301
uggcgacgucaguuuccagcau

SEQ ID NO: 1963168 - RNA, 22 nt, Shigella flexneri 2a str. 301
uggcgaggaacgaucccagcgu

SEQ ID NO: 1963169 - RNA, 16 nt, Shigella flexneri 2a str. 301
uggcgacuucugcuuu

SEQ ID NO: 1963170 - RNA, 20 nt, Shigella flexneri 2a str. 301
uggccguuguugaacggcaa

SEQ ID NO: 1963171 - RNA, 14 nt, Shigella flexneri 2a str. 301
uggccgucgagcag

SEQ ID NO: 1963172 - RNA, 17 nt, Shigella flexneri 2a str. 301
uggaaacgcgaucgcca

SEQ ID NO: 1963173 - RNA, 16 nt, Shigella flexneri 2a str. 301
ugcuuuugucaucaga

SEQ ID NO: 1963174 - RNA, 15 nt, Shigella flexneri 2a str. 301
uggcgauaaucagcg

SEQ ID NO: 1963175 - RNA, 21 nt, Shigella flexneri 2a str. 301
ugguuagagcacaucacucau

SEQ ID NO: 1963176 - RNA, 17 nt, Shigella flexneri 2a str. 301
uggucgguuaacuccac

SEQ ID NO: 1963177 - RNA, 23 nt, Shigella flexneri 2a str. 301
uggucguaucaccacgaaaacag

SEQ ID NO: 1963178 - RNA, 17 nt, Shigella flexneri 2a str. 301
uggucuguaccaccaga

SEQ ID NO: 1963179 - RNA, 16 nt, Shigella flexneri 2a str. 301
uggugauuucaggcuu

SEQ ID NO: 1963180 - RNA, 18 nt, Shigella flexneri 2a str. 301
uggugaugccaucgggcu

SEQ ID NO: 1963181 - RNA, 19 nt, Shigella flexneri 2a str. 301
uggucaguuguggcagaau

SEQ ID NO: 1963182 - RNA, 20 nt, Shigella flexneri 2a str. 301
uggucauugccaggcaggau

SEQ ID NO: 1963183 - RNA, 11 nt, Shigella flexneri 2a str. 301
ugguaucgaga

SEQ ID NO: 1963184 - RNA, 18 nt, Shigella flexneri 2a str. 301
uguauggcgauagcccag

SEQ ID NO: 1963185 - RNA, 20 nt, Shigella flexneri 2a str. 301
uguaggucggauaaggcguu

SEQ ID NO: 1963186 - RNA, 22 nt, Shigella flexneri 2a str. 301
uguaaagauugauuauugagcg

SEQ ID NO: 1963187 - RNA, 20 nt, Shigella flexneri 2a str. 301
uguaacuggguuuguccaua

SEQ ID NO: 1963188 - RNA, 14 nt, Shigella flexneri 2a str. 301
uguccauccauacg

SEQ ID NO: 1963189 - RNA, 15 nt, Shigella flexneri 2a str. 301
ugucgguuuguacuc

SEQ ID NO: 1963190 - RNA, 17 nt, Shigella flexneri 2a str. 301
ugucguccggcagcaga

SEQ ID NO: 1963191 - RNA, 14 nt, Shigella flexneri 2a str. 301
ugucggcgauaaua

SEQ ID NO: 1963192 - RNA, 16 nt, Shigella flexneri 2a str. 301
ugucgccgcuaacauc

SEQ ID NO: 1963193 - RNA, 16 nt, Shigella flexneri 2a str. 301
ugucuauuccgcguga

SEQ ID NO: 1963194 - RNA, 20 nt, Shigella flexneri 2a str. 301
ugucuacgcccggcaguucg

SEQ ID NO: 1963195 - RNA, 17 nt, Shigella flexneri 2a str. 301
ugucuguacggcaguga

SEQ ID NO: 1963196 - RNA, 19 nt, Shigella flexneri 2a str. 301
ugucuaacaugagguccag

SEQ ID NO: 1963197 - RNA, 13 nt, Shigella flexneri 2a str. 301
ugugccaggacuu

SEQ ID NO: 1963198 - RNA, 20 nt, Shigella flexneri 2a str. 301
ugugccgcgaugauugggcu

SEQ ID NO: 1963199 - RNA, 20 nt, Shigella flexneri 2a str. 301
ugugcgccacauccggcaua

SEQ ID NO: 1963200 - RNA, 23 nt, Shigella flexneri 2a str. 301
ugugccugucgggacacgaacgu

SEQ ID NO: 1963201 - RNA, 15 nt, Shigella flexneri 2a str. 301
uucagccccagcacu

SEQ ID NO: 1963202 - RNA, 17 nt, Shigella flexneri 2a str. 301
uucagcgauauccagcg

SEQ ID NO: 1963203 - RNA, 15 nt, Shigella flexneri 2a str. 301
uucagcguaucccag

SEQ ID NO: 1963204 - RNA, 13 nt, Shigella flexneri 2a str. 301
uucaggagcaggc

SEQ ID NO: 1963205 - RNA, 23 nt, Shigella flexneri 2a str. 301
uucaggauauagucgaacgccuu

SEQ ID NO: 1963206 - RNA, 14 nt, Shigella flexneri 2a str. 301
uucaugcuccagca

SEQ ID NO: 1963207 - RNA, 23 nt, Shigella flexneri 2a str. 301
uucaucggcggugaccagcagca

SEQ ID NO: 1963208 - RNA, 16 nt, Shigella flexneri 2a str. 301
uucaucggauacgcca

SEQ ID NO: 1963209 - RNA, 18 nt, Shigella flexneri 2a str. 301
uucaucgcuacaccaauc

SEQ ID NO: 1963210 - RNA, 12 nt, Shigella flexneri 2a str. 301
uucaucgccagc

SEQ ID NO: 1963211 - RNA, 20 nt, Shigella flexneri 2a str. 301
uucauccggcuguuccagca

SEQ ID NO: 1963212 - RNA, 19 nt, Shigella flexneri 2a str. 301
uucaggccgccgucaucac

SEQ ID NO: 1963213 - RNA, 22 nt, Shigella flexneri 2a str. 301
uuccaggcucauaccuuccacu

SEQ ID NO: 1963214 - RNA, 18 nt, Shigella flexneri 2a str. 301
uuccagugcgguaacgua

SEQ ID NO: 1963215 - RNA, 21 nt, Shigella flexneri 2a str. 301
uuccaguuccggcaucgacag

SEQ ID NO: 1963216 - RNA, 24 nt, Shigella flexneri 2a str. 301
uuccagggggaagcgcaccaauuc

SEQ ID NO: 1963217 - RNA, 14 nt, Shigella flexneri 2a str. 301
uuaucgccagcgcc

SEQ ID NO: 1963218 - RNA, 19 nt, Shigella flexneri 2a str. 301
uuaucgacugccagaguca

SEQ ID NO: 1963219 - RNA, 15 nt, Shigella flexneri 2a str. 301
uuauccgccaguuug

SEQ ID NO: 1963220 - RNA, 18 nt, Shigella flexneri 2a str. 301
uuaucgcgucaacagggc

SEQ ID NO: 1963221 - RNA, 21 nt, Shigella flexneri 2a str. 301
uuauucaggcccgccagcgcc

SEQ ID NO: 1963222 - RNA, 21 nt, Shigella flexneri 2a str. 301
uucaaacgcuucuggcgacau

SEQ ID NO: 1963223 - RNA, 20 nt, Shigella flexneri 2a str. 301
uucaaaaauaaguugccacg

SEQ ID NO: 1963224 - RNA, 14 nt, Shigella flexneri 2a str. 301
uuauuguagccugc

SEQ ID NO: 1963225 - RNA, 14 nt, Shigella flexneri 2a str. 301
uuauuucauguuug

SEQ ID NO: 1963226 - RNA, 18 nt, Shigella flexneri 2a str. 301
uucacgccgcauccggca

SEQ ID NO: 1963227 - RNA, 22 nt, Shigella flexneri 2a str. 301
uucagcaacgugcuucgcgcug

SEQ ID NO: 1963228 - RNA, 18 nt, Shigella flexneri 2a str. 301
uucagauguuccgccauu

SEQ ID NO: 1963229 - RNA, 22 nt, Shigella flexneri 2a str. 301
uucagauuguugauuaacaggc

SEQ ID NO: 1963230 - RNA, 14 nt, Shigella flexneri 2a str. 301
uucagccacgcguu

SEQ ID NO: 1963231 - RNA, 23 nt, Shigella flexneri 2a str. 301
uucaagucccguccucgguacca

SEQ ID NO: 1963232 - RNA, 21 nt, Shigella flexneri 2a str. 301
uuaaaucccgcuucaacgacc

SEQ ID NO: 1963233 - RNA, 13 nt, Shigella flexneri 2a str. 301
uguggccgccagu

SEQ ID NO: 1963234 - RNA, 16 nt, Shigella flexneri 2a str. 301
uguuguagaccggaaa

SEQ ID NO: 1963235 - RNA, 20 nt, Shigella flexneri 2a str. 301
uguuuauaacuucccgcauc

SEQ ID NO: 1963236 - RNA, 18 nt, Shigella flexneri 2a str. 301
uguuuagguugaacccuu

SEQ ID NO: 1963237 - RNA, 16 nt, Shigella flexneri 2a str. 301
uuaaaaacccgccaug

SEQ ID NO: 1963238 - RNA, 22 nt, Shigella flexneri 2a str. 301
uuagcgucaaggggucaaugcc

SEQ ID NO: 1963239 - RNA, 22 nt, Shigella flexneri 2a str. 301
uuacugaggccggaugucgcug

SEQ ID NO: 1963240 - RNA, 16 nt, Shigella flexneri 2a str. 301
uuacugcagccagcgu

SEQ ID NO: 1963241 - RNA, 17 nt, Shigella flexneri 2a str. 301
uuagccacaaagcaggg

SEQ ID NO: 1963242 - RNA, 16 nt, Shigella flexneri 2a str. 301
uuauaacggugcugca

SEQ ID NO: 1963243 - RNA, 13 nt, Shigella flexneri 2a str. 301
uuaguucaaugcg

SEQ ID NO: 1963244 - RNA, 12 nt, Shigella flexneri 2a str. 301
uuaucccauccc

SEQ ID NO: 1963245 - RNA, 23 nt, Shigella flexneri 2a str. 301
uuaucccugucuaaccagucgcc

SEQ ID NO: 1963246 - RNA, 18 nt, Shigella flexneri 2a str. 301
uuauccacgaaacggcgu

SEQ ID NO: 1963247 - RNA, 19 nt, Shigella flexneri 2a str. 301
uuacgccgcauccggcaua

SEQ ID NO: 1963248 - RNA, 21 nt, Shigella flexneri 2a str. 301
uuacgaccuacaaucaauggu

SEQ ID NO: 1963249 - RNA, 13 nt, Shigella flexneri 2a str. 301
uuacgccaccgca

SEQ ID NO: 1963250 - RNA, 22 nt, Shigella flexneri 2a str. 301
uuacgacucaaccccagccauu

SEQ ID NO: 1963251 - RNA, 19 nt, Shigella flexneri 2a str. 301
uuacuacccuguccgccau

SEQ ID NO: 1963252 - RNA, 16 nt, Shigella flexneri 2a str. 301
uuacuagccugcuccc

SEQ ID NO: 1963253 - RNA, 19 nt, Shigella flexneri 2a str. 301
uuaccggucccuucaaucu

SEQ ID NO: 1963254 - RNA, 18 nt, Shigella flexneri 2a str. 301
uuaccguaaugaucgcga

SEQ ID NO: 1963255 - RNA, 15 nt, Shigella flexneri 2a str. 301
uuaauucuuugagca

SEQ ID NO: 1963256 - RNA, 21 nt, Shigella flexneri 2a str. 301
uucugccacgccacgcugccg

SEQ ID NO: 1963257 - RNA, 21 nt, Shigella flexneri 2a str. 301
uucugccaguuguugcugaau

SEQ ID NO: 1963258 - RNA, 13 nt, Shigella flexneri 2a str. 301
uucugcgacguga

SEQ ID NO: 1963259 - RNA, 13 nt, Shigella flexneri 2a str. 301
uucugauccugca

SEQ ID NO: 1963260 - RNA, 12 nt, Shigella flexneri 2a str. 301
uucugaacugaa

SEQ ID NO: 1963261 - RNA, 15 nt, Shigella flexneri 2a str. 301
uucuccugaaguagc

SEQ ID NO: 1963262 - RNA, 17 nt, Shigella flexneri 2a str. 301
uucucaucaccauuccg

SEQ ID NO: 1963263 - RNA, 21 nt, Shigella flexneri 2a str. 301
uucuucaauuuccgucgcaug

SEQ ID NO: 1963264 - RNA, 16 nt, Shigella flexneri 2a str. 301
uucuucagcaguucag

SEQ ID NO: 1963265 - RNA, 24 nt, Shigella flexneri 2a str. 301
uucuuacuucaacacauaaccgua

SEQ ID NO: 1963266 - RNA, 14 nt, Shigella flexneri 2a str. 301
uucuuccaguuccg

SEQ ID NO: 1963267 - RNA, 19 nt, Shigella flexneri 2a str. 301
uucugugcaaucgccgcug

SEQ ID NO: 1963268 - RNA, 14 nt, Shigella flexneri 2a str. 301
uucuguugcugaaa

SEQ ID NO: 1963269 - RNA, 22 nt, Shigella flexneri 2a str. 301
uucgucaccugguagcggguga

SEQ ID NO: 1963270 - RNA, 16 nt, Shigella flexneri 2a str. 301
uucgucaauaucgaga

SEQ ID NO: 1963271 - RNA, 20 nt, Shigella flexneri 2a str. 301
uucguaggcagcauccggca

SEQ ID NO: 1963272 - RNA, 14 nt, Shigella flexneri 2a str. 301
uucguggacguuac

SEQ ID NO: 1963273 - RNA, 13 nt, Shigella flexneri 2a str. 301
uucggcaucagca

SEQ ID NO: 1963274 - RNA, 18 nt, Shigella flexneri 2a str. 301
uucggugauauacgucac

SEQ ID NO: 1963275 - RNA, 16 nt, Shigella flexneri 2a str. 301
uucgguaaugacucca

SEQ ID NO: 1963276 - RNA, 20 nt, Shigella flexneri 2a str. 301
uucgcccuggacaacauucc

SEQ ID NO: 1963277 - RNA, 19 nt, Shigella flexneri 2a str. 301
uucgccugcguacuggcau

SEQ ID NO: 1963278 - RNA, 20 nt, Shigella flexneri 2a str. 301
uucgcgaacacccgacgugc

SEQ ID NO: 1963279 - RNA, 14 nt, Shigella flexneri 2a str. 301
uucgcgaccggcga

SEQ ID NO: 1963280 - RNA, 23 nt, Shigella flexneri 2a str. 301
uucgcuaaggucaccaguucacg

SEQ ID NO: 1963281 - RNA, 18 nt, Shigella flexneri 2a str. 301
uucgcuggaauaaucgua

SEQ ID NO: 1963282 - RNA, 17 nt, Shigella flexneri 2a str. 301
uucgcuuuaucgccuac

SEQ ID NO: 1963283 - RNA, 19 nt, Shigella flexneri 2a str. 301
uucggcagaaaauccacca

SEQ ID NO: 1963284 - RNA, 19 nt, Shigella flexneri 2a str. 301
uucggcaaccgcauccaga

SEQ ID NO: 1963285 - RNA, 22 nt, Shigella flexneri 2a str. 301
uucccugcgccagcgcgaccag

SEQ ID NO: 1963286 - RNA, 21 nt, Shigella flexneri 2a str. 301
uucccucaaaauggacgcaac

SEQ ID NO: 1963287 - RNA, 16 nt, Shigella flexneri 2a str. 301
uuccgacggcgagugu

SEQ ID NO: 1963288 - RNA, 12 nt, Shigella flexneri 2a str. 301
uuccugacuccu

SEQ ID NO: 1963289 - RNA, 14 nt, Shigella flexneri 2a str. 301
uuccugcgucgcua

SEQ ID NO: 1963290 - RNA, 17 nt, Shigella flexneri 2a str. 301
uuccugccacuguuccg

SEQ ID NO: 1963291 - RNA, 20 nt, Shigella flexneri 2a str. 301
uuccuguagcguuaccagca

SEQ ID NO: 1963292 - RNA, 16 nt, Shigella flexneri 2a str. 301
uuccuguucaucgaca

SEQ ID NO: 1963293 - RNA, 15 nt, Shigella flexneri 2a str. 301
uucgaguacauccac

SEQ ID NO: 1963294 - RNA, 22 nt, Shigella flexneri 2a str. 301
uucgaaccacaaaagacgauag

SEQ ID NO: 1963295 - RNA, 20 nt, Shigella flexneri 2a str. 301
ucgcgaauggccugcgcauu

SEQ ID NO: 1963296 - RNA, 21 nt, Shigella flexneri 2a str. 301
ucgccgguuuugucuucgaua

SEQ ID NO: 1963297 - RNA, 15 nt, Shigella flexneri 2a str. 301
ucgcgauaacggauc

SEQ ID NO: 1963298 - RNA, 19 nt, Shigella flexneri 2a str. 301
ucgcgauagaacuucugca

SEQ ID NO: 1963299 - RNA, 15 nt, Shigella flexneri 2a str. 301
ucgcgccaaucagcg

SEQ ID NO: 1963300 - RNA, 18 nt, Shigella flexneri 2a str. 301
ucgcgccagaaagcagca

SEQ ID NO: 1963301 - RNA, 14 nt, Shigella flexneri 2a str. 301
ucgcgccagccagu

SEQ ID NO: 1963302 - RNA, 20 nt, Shigella flexneri 2a str. 301
ucgcggcaauuuuuaccggu

SEQ ID NO: 1963303 - RNA, 17 nt, Shigella flexneri 2a str. 301
ucgcggcagcagagaaa

SEQ ID NO: 1963304 - RNA, 16 nt, Shigella flexneri 2a str. 301
ucgcccaggcgaccag

SEQ ID NO: 1963305 - RNA, 12 nt, Shigella flexneri 2a str. 301
ucgccaucaggc

SEQ ID NO: 1963306 - RNA, 19 nt, Shigella flexneri 2a str. 301
ucgccgcgacacaacgcuu

SEQ ID NO: 1963307 - RNA, 18 nt, Shigella flexneri 2a str. 301
ucggcaagauaaaucgca

SEQ ID NO: 1963308 - RNA, 15 nt, Shigella flexneri 2a str. 301
ucggcagccaguucg

SEQ ID NO: 1963309 - RNA, 22 nt, Shigella flexneri 2a str. 301
ucggcagucacuuuuuuccgag

SEQ ID NO: 1963310 - RNA, 18 nt, Shigella flexneri 2a str. 301
ucggaacaguaaagcgca

SEQ ID NO: 1963311 - RNA, 23 nt, Shigella flexneri 2a str. 301
ucggaaaccgcuuugccacggua

SEQ ID NO: 1963312 - RNA, 19 nt, Shigella flexneri 2a str. 301
ucgcuuucaggucagcgaa

SEQ ID NO: 1963313 - RNA, 16 nt, Shigella flexneri 2a str. 301
ucgcuuucccagcgau

SEQ ID NO: 1963314 - RNA, 15 nt, Shigella flexneri 2a str. 301
ucgcuucguagcagg

SEQ ID NO: 1963315 - RNA, 23 nt, Shigella flexneri 2a str. 301
ucgcuccaugagaagcugaaauc

SEQ ID NO: 1963316 - RNA, 23 nt, Shigella flexneri 2a str. 301
ucgcugaauaucuuucucgcggc

SEQ ID NO: 1963317 - RNA, 22 nt, Shigella flexneri 2a str. 301
ucgcuggugccaagcuccagca

SEQ ID NO: 1963318 - RNA, 12 nt, Shigella flexneri 2a str. 301
ucgcuccggcua

SEQ ID NO: 1963319 - RNA, 16 nt, Shigella flexneri 2a str. 301
ucgcguaacugcugcu

SEQ ID NO: 1963320 - RNA, 16 nt, Shigella flexneri 2a str. 301
ucgcguacucaccgcu

SEQ ID NO: 1963321 - RNA, 16 nt, Shigella flexneri 2a str. 301
ucgcguaaauccagcg

SEQ ID NO: 1963322 - RNA, 19 nt, Shigella flexneri 2a str. 301
ucgcgucuuauccggccuu

SEQ ID NO: 1963323 - RNA, 22 nt, Shigella flexneri 2a str. 301
ucggcgucaucgacaucaacga

SEQ ID NO: 1963324 - RNA, 19 nt, Shigella flexneri 2a str. 301
ucggcggugaccagcagca

SEQ ID NO: 1963325 - RNA, 18 nt, Shigella flexneri 2a str. 301
ucggcgguaagccauguu

SEQ ID NO: 1963326 - RNA, 14 nt, Shigella flexneri 2a str. 301
ucgguuuucaaucg

SEQ ID NO: 1963327 - RNA, 16 nt, Shigella flexneri 2a str. 301
ucgguuuuuuuacguc

SEQ ID NO: 1963328 - RNA, 13 nt, Shigella flexneri 2a str. 301
ucguaagcaggag

SEQ ID NO: 1963329 - RNA, 22 nt, Shigella flexneri 2a str. 301
ucggugagcuaaugcaaaucac

SEQ ID NO: 1963330 - RNA, 13 nt, Shigella flexneri 2a str. 301
ucggucagagaau

SEQ ID NO: 1963331 - RNA, 19 nt, Shigella flexneri 2a str. 301
ucgguauuaaucugccagc

SEQ ID NO: 1963332 - RNA, 17 nt, Shigella flexneri 2a str. 301
ucguucagcggcccguu

SEQ ID NO: 1963333 - RNA, 21 nt, Shigella flexneri 2a str. 301
ucguuaaacucugccgcaauc

SEQ ID NO: 1963334 - RNA, 17 nt, Shigella flexneri 2a str. 301
ucguuaacgugucauaa

SEQ ID NO: 1963335 - RNA, 14 nt, Shigella flexneri 2a str. 301
ucuacugcaccgca

SEQ ID NO: 1963336 - RNA, 22 nt, Shigella flexneri 2a str. 301
ucguugauaaacguacauccau

SEQ ID NO: 1963337 - RNA, 13 nt, Shigella flexneri 2a str. 301
ucuaaugucauaa

SEQ ID NO: 1963338 - RNA, 21 nt, Shigella flexneri 2a str. 301
ucucaacguggauaccgauag

SEQ ID NO: 1963339 - RNA, 21 nt, Shigella flexneri 2a str. 301
ucucagauaaaugcaaacgca

SEQ ID NO: 1963340 - RNA, 15 nt, Shigella flexneri 2a str. 301
ucuccuccggggaag

SEQ ID NO: 1963341 - RNA, 18 nt, Shigella flexneri 2a str. 301
ucucgccuaccauccaua

SEQ ID NO: 1963342 - RNA, 16 nt, Shigella flexneri 2a str. 301
ucucgcccguuuugag

SEQ ID NO: 1963343 - RNA, 13 nt, Shigella flexneri 2a str. 301
ucucgcugauucu

SEQ ID NO: 1963344 - RNA, 15 nt, Shigella flexneri 2a str. 301
ucucgugccgccagc

SEQ ID NO: 1963345 - RNA, 16 nt, Shigella flexneri 2a str. 301
ucucguuggucaucac

SEQ ID NO: 1963346 - RNA, 16 nt, Shigella flexneri 2a str. 301
ucugagcaugaugccu

SEQ ID NO: 1963347 - RNA, 19 nt, Shigella flexneri 2a str. 301
ucugagcaugaugccugau

SEQ ID NO: 1963348 - RNA, 21 nt, Shigella flexneri 2a str. 301
ucugacguuuucucguccagu

SEQ ID NO: 1963349 - RNA, 15 nt, Shigella flexneri 2a str. 301
ucugacuguguuagc

SEQ ID NO: 1963350 - RNA, 13 nt, Shigella flexneri 2a str. 301
ucucuucaccaua

SEQ ID NO: 1963351 - RNA, 21 nt, Shigella flexneri 2a str. 301
ucugaaaucaucaauaccagc

SEQ ID NO: 1963352 - RNA, 14 nt, Shigella flexneri 2a str. 301
ucugcaugacggcu

SEQ ID NO: 1963353 - RNA, 21 nt, Shigella flexneri 2a str. 301
ucugcguuagaaaacgccugc

SEQ ID NO: 1963354 - RNA, 22 nt, Shigella flexneri 2a str. 301
ucugcguggucauuaugaccgu

SEQ ID NO: 1963355 - RNA, 22 nt, Shigella flexneri 2a str. 301
ucugcgugaucuaaaaucgcuu

SEQ ID NO: 1963356 - RNA, 17 nt, Shigella flexneri 2a str. 301
ucugcguaucgcccugc

SEQ ID NO: 1963357 - RNA, 20 nt, Shigella flexneri 2a str. 301
ucugcggguuagucugcauu

SEQ ID NO: 1963358 - RNA, 14 nt, Shigella flexneri 2a str. 301
ucugcgauagcagc

SEQ ID NO: 1963359 - RNA, 18 nt, Shigella flexneri 2a str. 301
ucuguuccauaaucgccu

SEQ ID NO: 1963360 - RNA, 14 nt, Shigella flexneri 2a str. 301
ucuguggacugauu

SEQ ID NO: 1963361 - RNA, 17 nt, Shigella flexneri 2a str. 301
ucugucuguacggcagu

SEQ ID NO: 1963362 - RNA, 23 nt, Shigella flexneri 2a str. 301
ucuguaccaccagaaucgccagc

SEQ ID NO: 1963363 - RNA, 19 nt, Shigella flexneri 2a str. 301
ucuggugguaaucgacaac

SEQ ID NO: 1963364 - RNA, 20 nt, Shigella flexneri 2a str. 301
ucugcuuguggcggaaagac

SEQ ID NO: 1963365 - RNA, 17 nt, Shigella flexneri 2a str. 301
ucuggaacgaacccgaa

SEQ ID NO: 1963366 - RNA, 18 nt, Shigella flexneri 2a str. 301
ucugcuuacgcaacugcc

SEQ ID NO: 1963367 - RNA, 15 nt, Shigella flexneri 2a str. 301
ucuggcuuaaacgca

SEQ ID NO: 1963368 - RNA, 22 nt, Shigella flexneri 2a str. 301
ucuggcgcgaacagcacaucag

SEQ ID NO: 1963369 - RNA, 14 nt, Shigella flexneri 2a str. 301
ucuggcgcgaacag

SEQ ID NO: 1963370 - RNA, 20 nt, Shigella flexneri 2a str. 301
ucuggcauaaacaaagcgca

SEQ ID NO: 1963371 - RNA, 15 nt, Shigella flexneri 2a str. 301
ucuucaaacggcaua

SEQ ID NO: 1963372 - RNA, 16 nt, Shigella flexneri 2a str. 301
ucuucaaacugaagau

SEQ ID NO: 1963373 - RNA, 15 nt, Shigella flexneri 2a str. 301
ucuucaccgguacgg

SEQ ID NO: 1963374 - RNA, 14 nt, Shigella flexneri 2a str. 301
ucuucuugcagcuu

SEQ ID NO: 1963375 - RNA, 13 nt, Shigella flexneri 2a str. 301
ucuucuccggcau

SEQ ID NO: 1963376 - RNA, 18 nt, Shigella flexneri 2a str. 301
ucuuuuggcgagagacgc

SEQ ID NO: 1963377 - RNA, 14 nt, Shigella flexneri 2a str. 301
ucuuuucgcuuuac

SEQ ID NO: 1963378 - RNA, 17 nt, Shigella flexneri 2a str. 301
ucuuuaaugcacggcag

SEQ ID NO: 1963379 - RNA, 20 nt, Shigella flexneri 2a str. 301
ugaaaaguccaggcugcaaa

SEQ ID NO: 1963380 - RNA, 16 nt, Shigella flexneri 2a str. 301
ugaaaagucauccggc

SEQ ID NO: 1963381 - RNA, 16 nt, Shigella flexneri 2a str. 301
ugaaaagcugugcuug

SEQ ID NO: 1963382 - RNA, 19 nt, Shigella flexneri 2a str. 301
ugaacaauuaacguaucaa

SEQ ID NO: 1963383 - RNA, 13 nt, Shigella flexneri 2a str. 301
ugaacagccugug

SEQ ID NO: 1963384 - RNA, 13 nt, Shigella flexneri 2a str. 301
ugaacauaucagc

SEQ ID NO: 1963385 - RNA, 14 nt, Shigella flexneri 2a str. 301
ugaacauaucagcg

SEQ ID NO: 1963386 - RNA, 20 nt, Shigella flexneri 2a str. 301
ugaacgccuuauccggccug

SEQ ID NO: 1963387 - RNA, 20 nt, Shigella flexneri 2a str. 301
ugaacgccuuaucuggccua

SEQ ID NO: 1963388 - RNA, 18 nt, Shigella flexneri 2a str. 301
ugaacaucgccgccguug

SEQ ID NO: 1963389 - RNA, 20 nt, Shigella flexneri 2a str. 301
ugaacgcaccuuccaguuug

SEQ ID NO: 1963390 - RNA, 15 nt, Shigella flexneri 2a str. 301
ugaugugauccauca

SEQ ID NO: 1963391 - RNA, 16 nt, Shigella flexneri 2a str. 301
ugauugaagaaaucag

SEQ ID NO: 1963392 - RNA, 15 nt, Shigella flexneri 2a str. 301
ugauugaccgccagc

SEQ ID NO: 1963393 - RNA, 13 nt, Shigella flexneri 2a str. 301
ugaugggcagaau

SEQ ID NO: 1963394 - RNA, 19 nt, Shigella flexneri 2a str. 301
ugaugccgguuuuacagaa

SEQ ID NO: 1963395 - RNA, 18 nt, Shigella flexneri 2a str. 301
ugaugcgaguaaucaggc

SEQ ID NO: 1963396 - RNA, 19 nt, Shigella flexneri 2a str. 301
ugaugaccagaucaggcuu

SEQ ID NO: 1963397 - RNA, 15 nt, Shigella flexneri 2a str. 301
ugaugcacaccaucg

SEQ ID NO: 1963398 - RNA, 16 nt, Shigella flexneri 2a str. 301
ugaugauaucacuggu

SEQ ID NO: 1963399 - RNA, 20 nt, Shigella flexneri 2a str. 301
ugcaacguccugcaacggcg

SEQ ID NO: 1963400 - RNA, 18 nt, Shigella flexneri 2a str. 301
ugauugccuuccaccaga

SEQ ID NO: 1963401 - RNA, 19 nt, Shigella flexneri 2a str. 301
ugcacgguuuuuccagcuc

SEQ ID NO: 1963402 - RNA, 21 nt, Shigella flexneri 2a str. 301
ugcacggcuucccacgucaga

SEQ ID NO: 1963403 - RNA, 18 nt, Shigella flexneri 2a str. 301
ugcagaccgcugacggca

SEQ ID NO: 1963404 - RNA, 17 nt, Shigella flexneri 2a str. 301
ugcacucgcauccucuu

SEQ ID NO: 1963405 - RNA, 17 nt, Shigella flexneri 2a str. 301
ugcacugaaugccggau

SEQ ID NO: 1963406 - RNA, 22 nt, Shigella flexneri 2a str. 301
ugagcaaauccgcacucaucuu

SEQ ID NO: 1963407 - RNA, 17 nt, Shigella flexneri 2a str. 301
ugagaaacucaguugau

SEQ ID NO: 1963408 - RNA, 20 nt, Shigella flexneri 2a str. 301
ugagaacaagauugccugau

SEQ ID NO: 1963409 - RNA, 14 nt, Shigella flexneri 2a str. 301
ugagaucacugcaa

SEQ ID NO: 1963410 - RNA, 22 nt, Shigella flexneri 2a str. 301
ugagaggaaaaaaauuaacgca

SEQ ID NO: 1963411 - RNA, 19 nt, Shigella flexneri 2a str. 301
ugaagccuucgccuuucag

SEQ ID NO: 1963412 - RNA, 18 nt, Shigella flexneri 2a str. 301
ugacgucgcuaagcacga

SEQ ID NO: 1963413 - RNA, 20 nt, Shigella flexneri 2a str. 301
ugacgugucuuaucaggccu

SEQ ID NO: 1963414 - RNA, 23 nt, Shigella flexneri 2a str. 301
ugacgugucuuaucaggccuaca

SEQ ID NO: 1963415 - RNA, 16 nt, Shigella flexneri 2a str. 301
ugacgugucuuaucag

SEQ ID NO: 1963416 - RNA, 20 nt, Shigella flexneri 2a str. 301
ugaagcccgcugaaaagcgg

SEQ ID NO: 1963417 - RNA, 20 nt, Shigella flexneri 2a str. 301
ugaagcccaguaccgccagu

SEQ ID NO: 1963418 - RNA, 16 nt, Shigella flexneri 2a str. 301
ugaagcagagcagacg

SEQ ID NO: 1963419 - RNA, 16 nt, Shigella flexneri 2a str. 301
ugaagcaaacuugaac

SEQ ID NO: 1963420 - RNA, 19 nt, Shigella flexneri 2a str. 301
ugaagaugccaacuggcau

SEQ ID NO: 1963421 - RNA, 18 nt, Shigella flexneri 2a str. 301
ugauaaaugagugaugau

SEQ ID NO: 1963422 - RNA, 20 nt, Shigella flexneri 2a str. 301
ugagucaauuucugcaaaau

SEQ ID NO: 1963423 - RNA, 24 nt, Shigella flexneri 2a str. 301
ugagucacuuuacgaccagccgau

SEQ ID NO: 1963424 - RNA, 22 nt, Shigella flexneri 2a str. 301
ugaggaucaccaguccaucggc

SEQ ID NO: 1963425 - RNA, 18 nt, Shigella flexneri 2a str. 301
ugauaauccaucacuuca

SEQ ID NO: 1963426 - RNA, 20 nt, Shigella flexneri 2a str. 301
ugauaagaugguuauccagc

SEQ ID NO: 1963427 - RNA, 14 nt, Shigella flexneri 2a str. 301
ugauaagcguagcg

SEQ ID NO: 1963428 - RNA, 22 nt, Shigella flexneri 2a str. 301
ugauaccgauuacucagcaacu

SEQ ID NO: 1963429 - RNA, 20 nt, Shigella flexneri 2a str. 301
ugauaccgauuacucagcaa

SEQ ID NO: 1963430 - RNA, 12 nt, Shigella flexneri 2a str. 301
ugauacgcgcca

SEQ ID NO: 1963431 - RNA, 19 nt, Shigella flexneri 2a str. 301
ugauacgggaggucaucag

SEQ ID NO: 1963432 - RNA, 15 nt, Shigella flexneri 2a str. 301
ugauagcccggauuu

SEQ ID NO: 1963433 - RNA, 21 nt, Shigella flexneri 2a str. 301
ugauagcuuacggcgcuguga

SEQ ID NO: 1963434 - RNA, 12 nt, Shigella flexneri 2a str. 301
ugauaggcguug

SEQ ID NO: 1963435 - RNA, 20 nt, Shigella flexneri 2a str. 301
ugauauacccuucaucacgc

SEQ ID NO: 1963436 - RNA, 18 nt, Shigella flexneri 2a str. 301
ugauauuggcaucgccag

SEQ ID NO: 1963437 - RNA, 23 nt, Shigella flexneri 2a str. 301
ugauauuaagcagacggcucauc

SEQ ID NO: 1963438 - RNA, 16 nt, Shigella flexneri 2a str. 301
ugauaugccugcuggc

SEQ ID NO: 1963439 - RNA, 22 nt, Shigella flexneri 2a str. 301
ugcauguuggcgauugccguug

SEQ ID NO: 1963440 - RNA, 13 nt, Shigella flexneri 2a str. 301
ugcauuuucucgc

SEQ ID NO: 1963441 - RNA, 14 nt, Shigella flexneri 2a str. 301
ugccagaaccgcuu

SEQ ID NO: 1963442 - RNA, 16 nt, Shigella flexneri 2a str. 301
ugccagaaauccaggc

SEQ ID NO: 1963443 - RNA, 20 nt, Shigella flexneri 2a str. 301
ugccauaacgggcggcguug

SEQ ID NO: 1963444 - RNA, 18 nt, Shigella flexneri 2a str. 301
ugccaguuguugcugaau

SEQ ID NO: 1963445 - RNA, 18 nt, Shigella flexneri 2a str. 301
ugccaguuaucgcaggua

SEQ ID NO: 1963446 - RNA, 16 nt, Shigella flexneri 2a str. 301
ugccaguaaucacgau

SEQ ID NO: 1963447 - RNA, 23 nt, Shigella flexneri 2a str. 301
ugcaggagcgauuaugaaacaag

SEQ ID NO: 1963448 - RNA, 15 nt, Shigella flexneri 2a str. 301
ugcaggccaccaggc

SEQ ID NO: 1963449 - RNA, 21 nt, Shigella flexneri 2a str. 301
ugcagcucaucuaaugcaggg

SEQ ID NO: 1963450 - RNA, 21 nt, Shigella flexneri 2a str. 301
ugcagcuccaccgauuuugag

SEQ ID NO: 1963451 - RNA, 14 nt, Shigella flexneri 2a str. 301
ugcagcguacuuca

SEQ ID NO: 1963452 - RNA, 13 nt, Shigella flexneri 2a str. 301
ugcagauuaagcg

SEQ ID NO: 1963453 - RNA, 16 nt, Shigella flexneri 2a str. 301
ugcccuggcgcgaaac

SEQ ID NO: 1963454 - RNA, 22 nt, Shigella flexneri 2a str. 301
ugcccuguuugucgaucaucag

SEQ ID NO: 1963455 - RNA, 19 nt, Shigella flexneri 2a str. 301
ugcccguuacuaucuagcg

SEQ ID NO: 1963456 - RNA, 19 nt, Shigella flexneri 2a str. 301
ugcccgagauacaucaccg

SEQ ID NO: 1963457 - RNA, 13 nt, Shigella flexneri 2a str. 301
ugccauuaauguc

SEQ ID NO: 1963458 - RNA, 17 nt, Shigella flexneri 2a str. 301
ugccaucaacuucucgc

SEQ ID NO: 1963459 - RNA, 19 nt, Shigella flexneri 2a str. 301
ugccaucauaaaucggaaa

SEQ ID NO: 1963460 - RNA, 19 nt, Shigella flexneri 2a str. 301
ugccaucauacagccggca

SEQ ID NO: 1963461 - RNA, 17 nt, Shigella flexneri 2a str. 301
ugccauuaaugucggau

SEQ ID NO: 1963462 - RNA, 16 nt, Shigella flexneri 2a str. 301
ugccgcauccggcaua

SEQ ID NO: 1963463 - RNA, 22 nt, Shigella flexneri 2a str. 301
ugccgcgcagggacacucgcug

SEQ ID NO: 1963464 - RNA, 20 nt, Shigella flexneri 2a str. 301
ugccgcgccucuuacgcgaa

SEQ ID NO: 1963465 - RNA, 14 nt, Shigella flexneri 2a str. 301
ugcgcugacucuac

SEQ ID NO: 1963466 - RNA, 21 nt, Shigella flexneri 2a str. 301
ugcgcuguaauauccaacgau

SEQ ID NO: 1963467 - RNA, 16 nt, Shigella flexneri 2a str. 301
ugcgcgccgugaacgu

SEQ ID NO: 1963468 - RNA, 20 nt, Shigella flexneri 2a str. 301
ugcgcccgcuuuucgccagc

SEQ ID NO: 1963469 - RNA, 13 nt, Shigella flexneri 2a str. 301
ugcgcccgccagc

SEQ ID NO: 1963470 - RNA, 18 nt, Shigella flexneri 2a str. 301
ugcgcgagcuggugccgg

SEQ ID NO: 1963471 - RNA, 22 nt, Shigella flexneri 2a str. 301
ugcgcuucucgcucgcuaucau

SEQ ID NO: 1963472 - RNA, 23 nt, Shigella flexneri 2a str. 301
ugcggaaccaucgagaaucagcg

SEQ ID NO: 1963473 - RNA, 20 nt, Shigella flexneri 2a str. 301
ugcggguggcucucgccagc

SEQ ID NO: 1963474 - RNA, 20 nt, Shigella flexneri 2a str. 301
ugcggguuuucucgcuccau

SEQ ID NO: 1963475 - RNA, 22 nt, Shigella flexneri 2a str. 301
ugcggcugcaucuccggcgcau

SEQ ID NO: 1963476 - RNA, 19 nt, Shigella flexneri 2a str. 301
ugcggcuguagagcuaccg

SEQ ID NO: 1963477 - RNA, 16 nt, Shigella flexneri 2a str. 301
ugcggcuucgcuucau

SEQ ID NO: 1963478 - RNA, 14 nt, Shigella flexneri 2a str. 301
ugccguuucuauca

SEQ ID NO: 1963479 - RNA, 14 nt, Shigella flexneri 2a str. 301
ugccuuccagcgau

SEQ ID NO: 1963480 - RNA, 13 nt, Shigella flexneri 2a str. 301
ugccguugccacg

SEQ ID NO: 1963481 - RNA, 14 nt, Shigella flexneri 2a str. 301
ugccguagcgauag

SEQ ID NO: 1963482 - RNA, 18 nt, Shigella flexneri 2a str. 301
ugccguaggcccagccgu

SEQ ID NO: 1963483 - RNA, 17 nt, Shigella flexneri 2a str. 301
ugccgcgucuuaucagg

SEQ ID NO: 1963484 - RNA, 15 nt, Shigella flexneri 2a str. 301
ugccgucaccagcau

SEQ ID NO: 1963485 - RNA, 15 nt, Shigella flexneri 2a str. 301
ugcgccaucaaugcc

SEQ ID NO: 1963486 - RNA, 17 nt, Shigella flexneri 2a str. 301
ugcgccacuaacgcauu

SEQ ID NO: 1963487 - RNA, 12 nt, Shigella flexneri 2a str. 301
ugcgcccagcgu

SEQ ID NO: 1963488 - RNA, 11 nt, Shigella flexneri 2a str. 301
ugcgcccaguu

SEQ ID NO: 1963489 - RNA, 17 nt, Shigella flexneri 2a str. 301
ugcgaagguggcggaau

SEQ ID NO: 1963490 - RNA, 15 nt, Shigella flexneri 2a str. 301
ugcuuaaggcagaaa

SEQ ID NO: 1963491 - RNA, 13 nt, Shigella flexneri 2a str. 301
ugcuuuaucgaac

SEQ ID NO: 1963492 - RNA, 18 nt, Shigella flexneri 2a str. 301
ugcugguauuuccagucc

SEQ ID NO: 1963493 - RNA, 14 nt, Shigella flexneri 2a str. 301
ugcuggcaaaucag

SEQ ID NO: 1963494 - RNA, 13 nt, Shigella flexneri 2a str. 301
ugcuggauuuccc

SEQ ID NO: 1963495 - RNA, 22 nt, Shigella flexneri 2a str. 301
ugcugcacauacugcaucagcg

SEQ ID NO: 1963496 - RNA, 19 nt, Shigella flexneri 2a str. 301
ugcugcaauaaaauaucuu

SEQ ID NO: 1963497 - RNA, 22 nt, Shigella flexneri 2a str. 301
ugcugaugcaggcgaucgacgu

SEQ ID NO: 1963498 - RNA, 14 nt, Shigella flexneri 2a str. 301
ugcugaucggcaag

SEQ ID NO: 1963499 - RNA, 15 nt, Shigella flexneri 2a str. 301
ugcugccaucuucuu

SEQ ID NO: 1963500 - RNA, 16 nt, Shigella flexneri 2a str. 301
ugcugccuucacggcu

SEQ ID NO: 1963501 - RNA, 22 nt, Shigella flexneri 2a str. 301
ugcugacauaauuggcacuuua

SEQ ID NO: 1963502 - RNA, 22 nt, Shigella flexneri 2a str. 301
ugcugaauuuuuuucucgcggc

SEQ ID NO: 1963503 - RNA, 14 nt, Shigella flexneri 2a str. 301
ugcugaaaucacag

SEQ ID NO: 1963504 - RNA, 13 nt, Shigella flexneri 2a str. 301
ugcugaaccguag

SEQ ID NO: 1963505 - RNA, 13 nt, Shigella flexneri 2a str. 301
ugcugaacucgac

SEQ ID NO: 1963506 - RNA, 14 nt, Shigella flexneri 2a str. 301
ugcucgucagccgg

SEQ ID NO: 1963507 - RNA, 18 nt, Shigella flexneri 2a str. 301
ugcucgucauccgccagu

SEQ ID NO: 1963508 - RNA, 19 nt, Shigella flexneri 2a str. 301
ugcguugucgccauccaga

SEQ ID NO: 1963509 - RNA, 15 nt, Shigella flexneri 2a str. 301
ugcguuucagccacg

SEQ ID NO: 1963510 - RNA, 12 nt, Shigella flexneri 2a str. 301
ugcgucuuccgu

SEQ ID NO: 1963511 - RNA, 13 nt, Shigella flexneri 2a str. 301
ugcgugaccgcca

SEQ ID NO: 1963512 - RNA, 18 nt, Shigella flexneri 2a str. 301
ugcgucguuucagccaga

SEQ ID NO: 1963513 - RNA, 22 nt, Shigella flexneri 2a str. 301
ugcguauggcgacaaggcguug

SEQ ID NO: 1963514 - RNA, 22 nt, Shigella flexneri 2a str. 301
ugcgucagcaucgcauccggca

SEQ ID NO: 1963515 - RNA, 23 nt, Shigella flexneri 2a str. 301
ugcucgacagcgcuaauacgaug

SEQ ID NO: 1963516 - RNA, 22 nt, Shigella flexneri 2a str. 301
ugcucccgcugcggugacgcaa

SEQ ID NO: 1963517 - RNA, 16 nt, Shigella flexneri 2a str. 301
ugcuccuccuucucac

SEQ ID NO: 1963518 - RNA, 19 nt, Shigella flexneri 2a str. 301
ugcucccggcaaugcgccg

SEQ ID NO: 1963519 - RNA, 22 nt, Shigella flexneri 2a str. 301
ugcucacucccggggcgcggug

SEQ ID NO: 1963520 - RNA, 14 nt, Shigella flexneri 2a str. 301
ugcucacuacggcu

SEQ ID NO: 1963521 - RNA, 20 nt, Shigella flexneri 2a str. 301
ugcucacaaccccggcaaau

SEQ ID NO: 1963522 - RNA, 18 nt, Shigella flexneri 2a str. 301
ugcucacaaccccggcaa

SEQ ID NO: 1963523 - RNA, 18 nt, Shigella flexneri 2a str. 301
ugcucaauugacaguuua

SEQ ID NO: 1963524 - RNA, 16 nt, Shigella flexneri 2a str. 301
ugcucaucgauaucga

SEQ ID NO: 1963525 - RNA, 16 nt, Shigella flexneri 2a str. 301
ugcuauucaccagcaa

SEQ ID NO: 1963526 - RNA, 15 nt, Shigella flexneri 2a str. 301
ugcuauugcggauga

SEQ ID NO: 1963527 - RNA, 17 nt, Shigella flexneri 2a str. 301
ugcguuuguccgccgga

SEQ ID NO: 1963528 - RNA, 20 nt, Shigella flexneri 2a str. 301
ugcuacuaugauuuuccuga

SEQ ID NO: 1963529 - RNA, 23 nt, Shigella flexneri 2a str. 301
ucagcuucagauugcaccacauc

SEQ ID NO: 1963530 - RNA, 21 nt, Shigella flexneri 2a str. 301
ucagcuuucagagaagcaccg

SEQ ID NO: 1963531 - RNA, 17 nt, Shigella flexneri 2a str. 301
ucagcuugucuacgccu

SEQ ID NO: 1963532 - RNA, 16 nt, Shigella flexneri 2a str. 301
ucaggccgaggcacag

SEQ ID NO: 1963533 - RNA, 22 nt, Shigella flexneri 2a str. 301
ucaggcccgccagcgccuggga

SEQ ID NO: 1963534 - RNA, 13 nt, Shigella flexneri 2a str. 301
ucagcucaagaau

SEQ ID NO: 1963535 - RNA, 14 nt, Shigella flexneri 2a str. 301
ucagcguugccagu

SEQ ID NO: 1963536 - RNA, 18 nt, Shigella flexneri 2a str. 301
ucagcuggcguaccggac

SEQ ID NO: 1963537 - RNA, 22 nt, Shigella flexneri 2a str. 301
ucagcgggguucuccugagaau

SEQ ID NO: 1963538 - RNA, 15 nt, Shigella flexneri 2a str. 301
ucagcgugacuggca

SEQ ID NO: 1963539 - RNA, 20 nt, Shigella flexneri 2a str. 301
ucagcgcagacaaucacauc

SEQ ID NO: 1963540 - RNA, 16 nt, Shigella flexneri 2a str. 301
ucagcgcaugauuccc

SEQ ID NO: 1963541 - RNA, 16 nt, Shigella flexneri 2a str. 301
ucagcggccaguuucg

SEQ ID NO: 1963542 - RNA, 14 nt, Shigella flexneri 2a str. 301
ucagcggcaguucg

SEQ ID NO: 1963543 - RNA, 22 nt, Shigella flexneri 2a str. 301
ucagcggcacuguuucgccagg

SEQ ID NO: 1963544 - RNA, 12 nt, Shigella flexneri 2a str. 301
ucagcgcuaccg

SEQ ID NO: 1963545 - RNA, 19 nt, Shigella flexneri 2a str. 301
ucacugauagugcugccau

SEQ ID NO: 1963546 - RNA, 16 nt, Shigella flexneri 2a str. 301
ucagaccaauccagcc

SEQ ID NO: 1963547 - RNA, 20 nt, Shigella flexneri 2a str. 301
ucagaccaaucaccacuucg

SEQ ID NO: 1963548 - RNA, 22 nt, Shigella flexneri 2a str. 301
ucagacacgccgccagaccaau

SEQ ID NO: 1963549 - RNA, 13 nt, Shigella flexneri 2a str. 301
ucacuucaggaug

SEQ ID NO: 1963550 - RNA, 16 nt, Shigella flexneri 2a str. 301
ucacuucgucagaaau

SEQ ID NO: 1963551 - RNA, 13 nt, Shigella flexneri 2a str. 301
ucagacaccgauu

SEQ ID NO: 1963552 - RNA, 18 nt, Shigella flexneri 2a str. 301
ucagcaaaggcgugaacu

SEQ ID NO: 1963553 - RNA, 18 nt, Shigella flexneri 2a str. 301
ucagcacaaaucggcaac

SEQ ID NO: 1963554 - RNA, 15 nt, Shigella flexneri 2a str. 301
ucacgcagugcugca

SEQ ID NO: 1963555 - RNA, 16 nt, Shigella flexneri 2a str. 301
ucacgcaggcgagaau

SEQ ID NO: 1963556 - RNA, 18 nt, Shigella flexneri 2a str. 301
ucacgccaucaucggcaa

SEQ ID NO: 1963557 - RNA, 20 nt, Shigella flexneri 2a str. 301
ucacgcguugcuaugcugaa

SEQ ID NO: 1963558 - RNA, 17 nt, Shigella flexneri 2a str. 301
ucacgcccaucagcauc

SEQ ID NO: 1963559 - RNA, 23 nt, Shigella flexneri 2a str. 301
ucacgcccauugagcuggucuga

SEQ ID NO: 1963560 - RNA, 13 nt, Shigella flexneri 2a str. 301
ucacgucgcccac

SEQ ID NO: 1963561 - RNA, 12 nt, Shigella flexneri 2a str. 301
ucacguaccaga

SEQ ID NO: 1963562 - RNA, 16 nt, Shigella flexneri 2a str. 301
uauuuggcauugguca

SEQ ID NO: 1963563 - RNA, 13 nt, Shigella flexneri 2a str. 301
uauuuucaaucug

SEQ ID NO: 1963564 - RNA, 16 nt, Shigella flexneri 2a str. 301
ucaccgccagcaucgg

SEQ ID NO: 1963565 - RNA, 22 nt, Shigella flexneri 2a str. 301
ucaccgcuggcguaguuucgua

SEQ ID NO: 1963566 - RNA, 18 nt, Shigella flexneri 2a str. 301
ucacgacaaagacaucaa

SEQ ID NO: 1963567 - RNA, 16 nt, Shigella flexneri 2a str. 301
ucacgacgcauccggc

SEQ ID NO: 1963568 - RNA, 15 nt, Shigella flexneri 2a str. 301
ucacgaccaccgaug

SEQ ID NO: 1963569 - RNA, 14 nt, Shigella flexneri 2a str. 301
ucacgauaucgaua

SEQ ID NO: 1963570 - RNA, 23 nt, Shigella flexneri 2a str. 301
ucauucucgcgauagaacuucug

SEQ ID NO: 1963571 - RNA, 14 nt, Shigella flexneri 2a str. 301
ucauugacgccaag

SEQ ID NO: 1963572 - RNA, 21 nt, Shigella flexneri 2a str. 301
ucauugagcgcaaauggugac

SEQ ID NO: 1963573 - RNA, 18 nt, Shigella flexneri 2a str. 301
ucauugccauucgccagu

SEQ ID NO: 1963574 - RNA, 20 nt, Shigella flexneri 2a str. 301
ucauucgccgguuccagcuu

SEQ ID NO: 1963575 - RNA, 19 nt, Shigella flexneri 2a str. 301
ucauguauauuauccauca

SEQ ID NO: 1963576 - RNA, 14 nt, Shigella flexneri 2a str. 301
ucaugugucgccgc

SEQ ID NO: 1963577 - RNA, 16 nt, Shigella flexneri 2a str. 301
ucaugguuagccugua

SEQ ID NO: 1963578 - RNA, 20 nt, Shigella flexneri 2a str. 301
ucaucgguaugcaacaucag

SEQ ID NO: 1963579 - RNA, 17 nt, Shigella flexneri 2a str. 301
ucauccaaaucgcccag

SEQ ID NO: 1963580 - RNA, 17 nt, Shigella flexneri 2a str. 301
ucaucauuugcauaccc

SEQ ID NO: 1963581 - RNA, 13 nt, Shigella flexneri 2a str. 301
ucaucaucgcggu

SEQ ID NO: 1963582 - RNA, 17 nt, Shigella flexneri 2a str. 301
ucaugaguuccacuggu

SEQ ID NO: 1963583 - RNA, 12 nt, Shigella flexneri 2a str. 301
ucaugcaucagg

SEQ ID NO: 1963584 - RNA, 13 nt, Shigella flexneri 2a str. 301
ucaugcaucagga

SEQ ID NO: 1963585 - RNA, 13 nt, Shigella flexneri 2a str. 301
ucaucaacgccau

SEQ ID NO: 1963586 - RNA, 16 nt, Shigella flexneri 2a str. 301
ucauaauacaggcuac

SEQ ID NO: 1963587 - RNA, 12 nt, Shigella flexneri 2a str. 301
ucauaacggcaa

SEQ ID NO: 1963588 - RNA, 15 nt, Shigella flexneri 2a str. 301
ucaucacgaaaauca

SEQ ID NO: 1963589 - RNA, 18 nt, Shigella flexneri 2a str. 301
ucaucacauagcgguaag

SEQ ID NO: 1963590 - RNA, 12 nt, Shigella flexneri 2a str. 301
ucaucaucacga

SEQ ID NO: 1963591 - RNA, 20 nt, Shigella flexneri 2a str. 301
ucaucagcauaaucaccagu

SEQ ID NO: 1963592 - RNA, 16 nt, Shigella flexneri 2a str. 301
ucaucagcauucucau

SEQ ID NO: 1963593 - RNA, 14 nt, Shigella flexneri 2a str. 301
ucagugagcacauc

SEQ ID NO: 1963594 - RNA, 15 nt, Shigella flexneri 2a str. 301
ucagugaucgccugc

SEQ ID NO: 1963595 - RNA, 15 nt, Shigella flexneri 2a str. 301
ucagugcgucgcugc

SEQ ID NO: 1963596 - RNA, 18 nt, Shigella flexneri 2a str. 301
ucaguggcuuaucuuccu

SEQ ID NO: 1963597 - RNA, 17 nt, Shigella flexneri 2a str. 301
ucagucgccagcgccag

SEQ ID NO: 1963598 - RNA, 21 nt, Shigella flexneri 2a str. 301
ucagguauaccgaaaucgcca

SEQ ID NO: 1963599 - RNA, 22 nt, Shigella flexneri 2a str. 301
uccagaucacgcagcaagccgu

SEQ ID NO: 1963600 - RNA, 21 nt, Shigella flexneri 2a str. 301
uccagauuuugcuuacgcgug

SEQ ID NO: 1963601 - RNA, 19 nt, Shigella flexneri 2a str. 301
uccacgcuauacagcagcc

SEQ ID NO: 1963602 - RNA, 20 nt, Shigella flexneri 2a str. 301
uccacgcuauacagcagcca

SEQ ID NO: 1963603 - RNA, 13 nt, Shigella flexneri 2a str. 301
uccacgcgcggac

SEQ ID NO: 1963604 - RNA, 18 nt, Shigella flexneri 2a str. 301
uccaccagcaccagcaau

SEQ ID NO: 1963605 - RNA, 20 nt, Shigella flexneri 2a str. 301
uccagccagucggaaccggc

SEQ ID NO: 1963606 - RNA, 15 nt, Shigella flexneri 2a str. 301
uccagcccugccagg

SEQ ID NO: 1963607 - RNA, 18 nt, Shigella flexneri 2a str. 301
uccagcggccaguggaca

SEQ ID NO: 1963608 - RNA, 19 nt, Shigella flexneri 2a str. 301
uccagcucaaccagauucg

SEQ ID NO: 1963609 - RNA, 23 nt, Shigella flexneri 2a str. 301
uccagguccuccuguaccuucac

SEQ ID NO: 1963610 - RNA, 16 nt, Shigella flexneri 2a str. 301
uccaucauaugcgcca

SEQ ID NO: 1963611 - RNA, 18 nt, Shigella flexneri 2a str. 301
ucccuuaguaacgccagc

SEQ ID NO: 1963612 - RNA, 13 nt, Shigella flexneri 2a str. 301
ucccuucaaucuc

SEQ ID NO: 1963613 - RNA, 14 nt, Shigella flexneri 2a str. 301
ucccggcagagaaa

SEQ ID NO: 1963614 - RNA, 14 nt, Shigella flexneri 2a str. 301
ucccgugaugcggu

SEQ ID NO: 1963615 - RNA, 14 nt, Shigella flexneri 2a str. 301
ucccggcugauaaa

SEQ ID NO: 1963616 - RNA, 15 nt, Shigella flexneri 2a str. 301
ucccgccagcaccag

SEQ ID NO: 1963617 - RNA, 17 nt, Shigella flexneri 2a str. 301
ucccgcagcuccagccc

SEQ ID NO: 1963618 - RNA, 22 nt, Shigella flexneri 2a str. 301
ucccgccgcuucaccaaucaga

SEQ ID NO: 1963619 - RNA, 20 nt, Shigella flexneri 2a str. 301
uccauucgcugcugcggcga

SEQ ID NO: 1963620 - RNA, 15 nt, Shigella flexneri 2a str. 301
uccauuacaucacga

SEQ ID NO: 1963621 - RNA, 17 nt, Shigella flexneri 2a str. 301
uccauucuugcgcggau

SEQ ID NO: 1963622 - RNA, 20 nt, Shigella flexneri 2a str. 301
uccaugucgguacagagcaa

SEQ ID NO: 1963623 - RNA, 20 nt, Shigella flexneri 2a str. 301
uccggcaggcgggaaagcca

SEQ ID NO: 1963624 - RNA, 13 nt, Shigella flexneri 2a str. 301
uccggcagagaaa

SEQ ID NO: 1963625 - RNA, 15 nt, Shigella flexneri 2a str. 301
uccggcauccagcgu

SEQ ID NO: 1963626 - RNA, 20 nt, Shigella flexneri 2a str. 301
uccggcaucaacaaagugca

SEQ ID NO: 1963627 - RNA, 20 nt, Shigella flexneri 2a str. 301
uccggcaucacaucgcuggu

SEQ ID NO: 1963628 - RNA, 23 nt, Shigella flexneri 2a str. 301
uccggcaugauauguaacauacc

SEQ ID NO: 1963629 - RNA, 18 nt, Shigella flexneri 2a str. 301
uccggcaugaacaaagcg

SEQ ID NO: 1963630 - RNA, 22 nt, Shigella flexneri 2a str. 301
uccggcauucagugcaaaugcc

SEQ ID NO: 1963631 - RNA, 21 nt, Shigella flexneri 2a str. 301
uccgcuuacucauccacugcc

SEQ ID NO: 1963632 - RNA, 23 nt, Shigella flexneri 2a str. 301
uccgcuggagcggggaacaccuc

SEQ ID NO: 1963633 - RNA, 18 nt, Shigella flexneri 2a str. 301
uccgcuguugcgcuaagc

SEQ ID NO: 1963634 - RNA, 20 nt, Shigella flexneri 2a str. 301
uccggcugggcgugaaucug

SEQ ID NO: 1963635 - RNA, 13 nt, Shigella flexneri 2a str. 301
uccggcugccagc

SEQ ID NO: 1963636 - RNA, 22 nt, Shigella flexneri 2a str. 301
uccgggccgcaaaccagcgcau

SEQ ID NO: 1963637 - RNA, 18 nt, Shigella flexneri 2a str. 301
uccgggaaaacgcuggca

SEQ ID NO: 1963638 - RNA, 19 nt, Shigella flexneri 2a str. 301
uccucaguuucgacgccuu

SEQ ID NO: 1963639 - RNA, 19 nt, Shigella flexneri 2a str. 301
uccuauauuugaggaguuu

SEQ ID NO: 1963640 - RNA, 12 nt, Shigella flexneri 2a str. 301
uccguguucguc

SEQ ID NO: 1963641 - RNA, 21 nt, Shigella flexneri 2a str. 301
uccguaccagccuugccagau

SEQ ID NO: 1963642 - RNA, 22 nt, Shigella flexneri 2a str. 301
uccguagugaaaaagcucccua

SEQ ID NO: 1963643 - RNA, 22 nt, Shigella flexneri 2a str. 301
uccgguuguucaaccaccggca

SEQ ID NO: 1963644 - RNA, 18 nt, Shigella flexneri 2a str. 301
uccgucaagaucggcgaa

SEQ ID NO: 1963645 - RNA, 20 nt, Shigella flexneri 2a str. 301
uccggucuaccgauccggca

SEQ ID NO: 1963646 - RNA, 17 nt, Shigella flexneri 2a str. 301
uccggugcugcgucagu

SEQ ID NO: 1963647 - RNA, 18 nt, Shigella flexneri 2a str. 301
uccgguguaucugggcga

SEQ ID NO: 1963648 - RNA, 22 nt, Shigella flexneri 2a str. 301
ucgacgaugaucaagcgcacaa

SEQ ID NO: 1963649 - RNA, 21 nt, Shigella flexneri 2a str. 301
ucgaccagccaggccgccagu

SEQ ID NO: 1963650 - RNA, 16 nt, Shigella flexneri 2a str. 301
ucgaagccguugucga

SEQ ID NO: 1963651 - RNA, 15 nt, Shigella flexneri 2a str. 301
ucgaacgccaguuca

SEQ ID NO: 1963652 - RNA, 18 nt, Shigella flexneri 2a str. 301
ucgacagacgccagcgcu

SEQ ID NO: 1963653 - RNA, 20 nt, Shigella flexneri 2a str. 301
ucgacagcgauuccaguucg

SEQ ID NO: 1963654 - RNA, 21 nt, Shigella flexneri 2a str. 301
ucgacaucaacgaugccuuau

SEQ ID NO: 1963655 - RNA, 13 nt, Shigella flexneri 2a str. 301
uccugcaacagca

SEQ ID NO: 1963656 - RNA, 23 nt, Shigella flexneri 2a str. 301
uccugacggugauacagcaaaau

SEQ ID NO: 1963657 - RNA, 19 nt, Shigella flexneri 2a str. 301
uccugauacagaccgcgca

SEQ ID NO: 1963658 - RNA, 16 nt, Shigella flexneri 2a str. 301
uccugcaucgccugau

SEQ ID NO: 1963659 - RNA, 17 nt, Shigella flexneri 2a str. 301
uccugcaauaccgccgu

SEQ ID NO: 1963660 - RNA, 14 nt, Shigella flexneri 2a str. 301
uccugcggacaguc

SEQ ID NO: 1963661 - RNA, 11 nt, Shigella flexneri 2a str. 301
uccugcggcga

SEQ ID NO: 1963662 - RNA, 13 nt, Shigella flexneri 2a str. 301
uccugcgucgcua

SEQ ID NO: 1963663 - RNA, 20 nt, Shigella flexneri 2a str. 301
uccucuucccagacccaguu

SEQ ID NO: 1963664 - RNA, 21 nt, Shigella flexneri 2a str. 301
uccugacccagcaaggcgcuu

SEQ ID NO: 1963665 - RNA, 11 nt, Shigella flexneri 2a str. 301
uccucgccguu

SEQ ID NO: 1963666 - RNA, 22 nt, Shigella flexneri 2a str. 301
ucgaaauagagaaaguaaacca

SEQ ID NO: 1963667 - RNA, 13 nt, Shigella flexneri 2a str. 301
ucgaaaugauggu

SEQ ID NO: 1963668 - RNA, 16 nt, Shigella flexneri 2a str. 301
ucgaaauaucacugau

SEQ ID NO: 1963669 - RNA, 17 nt, Shigella flexneri 2a str. 301
ucgaacagcagcagguc

SEQ ID NO: 1963670 - RNA, 18 nt, Shigella flexneri 2a str. 301
uccuuuacggugaacuca

SEQ ID NO: 1963671 - RNA, 19 nt, Shigella flexneri 2a str. 301
uccuuggucugauacuaau

SEQ ID NO: 1963672 - RNA, 23 nt, Shigella flexneri 2a str. 301
ucgaaaccaagaccaauccgcca

SEQ ID NO: 1963673 - RNA, 20 nt, Shigella flexneri 2a str. 301
uccuguugugaugcaacugu

SEQ ID NO: 1963674 - RNA, 16 nt, Shigella flexneri 2a str. 301
uccuucgggaagccuu

SEQ ID NO: 1963675 - RNA, 12 nt, Shigella flexneri 2a str. 301
uccuuccagcuc

SEQ ID NO: 1963676 - RNA, 21 nt, Shigella flexneri 2a str. 301
uccuggcugauugauauccag

SEQ ID NO: 1963677 - RNA, 21 nt, Shigella flexneri 2a str. 301
uccuggccguuguugaacggc

SEQ ID NO: 1963678 - RNA, 16 nt, Shigella flexneri 2a str. 301
uacauugagaauaucg

SEQ ID NO: 1963679 - RNA, 19 nt, Shigella flexneri 2a str. 301
uaccuaaaagcacgccaga

SEQ ID NO: 1963680 - RNA, 17 nt, Shigella flexneri 2a str. 301
uaccucagcagacugau

SEQ ID NO: 1963681 - RNA, 23 nt, Shigella flexneri 2a str. 301
uacgacgcuucaguucagcgaua

SEQ ID NO: 1963682 - RNA, 13 nt, Shigella flexneri 2a str. 301
uacgaccagccga

SEQ ID NO: 1963683 - RNA, 23 nt, Shigella flexneri 2a str. 301
uacgaaaaaagggcauguucagg

SEQ ID NO: 1963684 - RNA, 23 nt, Shigella flexneri 2a str. 301
uaccugaaugcucugaggcugau

SEQ ID NO: 1963685 - RNA, 22 nt, Shigella flexneri 2a str. 301
uaccucaucgcgcaacgucgcg

SEQ ID NO: 1963686 - RNA, 21 nt, Shigella flexneri 2a str. 301
uacgcugaggauuuucaucuu

SEQ ID NO: 1963687 - RNA, 12 nt, Shigella flexneri 2a str. 301
uacgcucggcaa

SEQ ID NO: 1963688 - RNA, 17 nt, Shigella flexneri 2a str. 301
uacgcuuaucaggccua

SEQ ID NO: 1963689 - RNA, 16 nt, Shigella flexneri 2a str. 301
uacgcuugccggacau

SEQ ID NO: 1963690 - RNA, 16 nt, Shigella flexneri 2a str. 301
uacgcucaucggcaua

SEQ ID NO: 1963691 - RNA, 14 nt, Shigella flexneri 2a str. 301
uacgcucacugcaa

SEQ ID NO: 1963692 - RNA, 17 nt, Shigella flexneri 2a str. 301
uacgcucaucaggccua

SEQ ID NO: 1963693 - RNA, 20 nt, Shigella flexneri 2a str. 301
uacgcgggucguugaucggc

SEQ ID NO: 1963694 - RNA, 17 nt, Shigella flexneri 2a str. 301
uacgguuuuuugaacag

SEQ ID NO: 1963695 - RNA, 15 nt, Shigella flexneri 2a str. 301
uacgguucgggcaca

SEQ ID NO: 1963696 - RNA, 15 nt, Shigella flexneri 2a str. 301
uacgguguaccggau

SEQ ID NO: 1963697 - RNA, 17 nt, Shigella flexneri 2a str. 301
uacggcguuaacuuguu

SEQ ID NO: 1963698 - RNA, 21 nt, Shigella flexneri 2a str. 301
uacgggcaauuucacguucac

SEQ ID NO: 1963699 - RNA, 15 nt, Shigella flexneri 2a str. 301
uacggcugcggaugu

SEQ ID NO: 1963700 - RNA, 18 nt, Shigella flexneri 2a str. 301
uacguuccuuuacgguga

SEQ ID NO: 1963701 - RNA, 16 nt, Shigella flexneri 2a str. 301
uacuucugaacccggu

SEQ ID NO: 1963702 - RNA, 20 nt, Shigella flexneri 2a str. 301
uacuucagacggucagcgag

SEQ ID NO: 1963703 - RNA, 15 nt, Shigella flexneri 2a str. 301
uacuucgcaauacgc

SEQ ID NO: 1963704 - RNA, 17 nt, Shigella flexneri 2a str. 301
uacuccugcucgccgau

SEQ ID NO: 1963705 - RNA, 16 nt, Shigella flexneri 2a str. 301
uacucuccuccagguu

SEQ ID NO: 1963706 - RNA, 16 nt, Shigella flexneri 2a str. 301
uacucucgcuccaguu

SEQ ID NO: 1963707 - RNA, 16 nt, Shigella flexneri 2a str. 301
uacucuccugcggcga

SEQ ID NO: 1963708 - RNA, 18 nt, Shigella flexneri 2a str. 301
uacucuugugccaguuca

SEQ ID NO: 1963709 - RNA, 19 nt, Shigella flexneri 2a str. 301
uacugaauguaugagguuu

SEQ ID NO: 1963710 - RNA, 13 nt, Shigella flexneri 2a str. 301
uacugucggcaau

SEQ ID NO: 1963711 - RNA, 22 nt, Shigella flexneri 2a str. 301
uaggagucacucgacagcaccg

SEQ ID NO: 1963712 - RNA, 15 nt, Shigella flexneri 2a str. 301
uagcuggugacaaag

SEQ ID NO: 1963713 - RNA, 13 nt, Shigella flexneri 2a str. 301
uaggcgucacauc

SEQ ID NO: 1963714 - RNA, 16 nt, Shigella flexneri 2a str. 301
uagcgcggugcugaaa

SEQ ID NO: 1963715 - RNA, 14 nt, Shigella flexneri 2a str. 301
uagcgcugcugcac

SEQ ID NO: 1963716 - RNA, 16 nt, Shigella flexneri 2a str. 301
uagcgugaaacgcguu

SEQ ID NO: 1963717 - RNA, 22 nt, Shigella flexneri 2a str. 301
uagccgcuuuuucugcgcacac

SEQ ID NO: 1963718 - RNA, 19 nt, Shigella flexneri 2a str. 301
uagccgguaaaucaccagc

SEQ ID NO: 1963719 - RNA, 14 nt, Shigella flexneri 2a str. 301
uagccgcuucugca

SEQ ID NO: 1963720 - RNA, 21 nt, Shigella flexneri 2a str. 301
uagccgcuuggcaagcccagc

SEQ ID NO: 1963721 - RNA, 14 nt, Shigella flexneri 2a str. 301
uauucacccgaaua

SEQ ID NO: 1963722 - RNA, 12 nt, Shigella flexneri 2a str. 301
uaugacuacauc

SEQ ID NO: 1963723 - RNA, 16 nt, Shigella flexneri 2a str. 301
uaugacguaucaccga

SEQ ID NO: 1963724 - RNA, 20 nt, Shigella flexneri 2a str. 301
uaugggguggaacggugaaa

SEQ ID NO: 1963725 - RNA, 18 nt, Shigella flexneri 2a str. 301
uauggucggguuuacgug

SEQ ID NO: 1963726 - RNA, 15 nt, Shigella flexneri 2a str. 301
uauggcauugucuga

SEQ ID NO: 1963727 - RNA, 19 nt, Shigella flexneri 2a str. 301
uauuaacagucagucucaa

SEQ ID NO: 1963728 - RNA, 21 nt, Shigella flexneri 2a str. 301
uauccacaccaagccggaauu

SEQ ID NO: 1963729 - RNA, 23 nt, Shigella flexneri 2a str. 301
uauccaccuccagcuccgccagc

SEQ ID NO: 1963730 - RNA, 22 nt, Shigella flexneri 2a str. 301
uauccagcgcggcgaaggugcc

SEQ ID NO: 1963731 - RNA, 19 nt, Shigella flexneri 2a str. 301
uauccaguuucugccucag

SEQ ID NO: 1963732 - RNA, 19 nt, Shigella flexneri 2a str. 301
uaucaugcuggauggcgca

SEQ ID NO: 1963733 - RNA, 15 nt, Shigella flexneri 2a str. 301
uaucaguauacgcca

SEQ ID NO: 1963734 - RNA, 12 nt, Shigella flexneri 2a str. 301
uaucacauccag

SEQ ID NO: 1963735 - RNA, 14 nt, Shigella flexneri 2a str. 301
uauccgacaucccg

SEQ ID NO: 1963736 - RNA, 21 nt, Shigella flexneri 2a str. 301
uaucccuucuccacaccguug

SEQ ID NO: 1963737 - RNA, 20 nt, Shigella flexneri 2a str. 301
uauccccugcgauggugaag

SEQ ID NO: 1963738 - RNA, 20 nt, Shigella flexneri 2a str. 301
uauccgguucacuucacgca

SEQ ID NO: 1963739 - RNA, 15 nt, Shigella flexneri 2a str. 301
uaucuuuccggcaga

SEQ ID NO: 1963740 - RNA, 16 nt, Shigella flexneri 2a str. 301
uauaacagucauacaa

SEQ ID NO: 1963741 - RNA, 19 nt, Shigella flexneri 2a str. 301
uaguuucguucgccguuuu

SEQ ID NO: 1963742 - RNA, 14 nt, Shigella flexneri 2a str. 301
uauacgucggguua

SEQ ID NO: 1963743 - RNA, 11 nt, Shigella flexneri 2a str. 301
uagucaccgcc

SEQ ID NO: 1963744 - RNA, 17 nt, Shigella flexneri 2a str. 301
guugacaaagugcgcgu

SEQ ID NO: 1963745 - RNA, 17 nt, Shigella flexneri 2a str. 301
guugaaucuucaugcgu

SEQ ID NO: 1963746 - RNA, 17 nt, Shigella flexneri 2a str. 301
guugaacaggcgcugau

SEQ ID NO: 1963747 - RNA, 14 nt, Shigella flexneri 2a str. 301
guugaggaucacaa

SEQ ID NO: 1963748 - RNA, 22 nt, Shigella flexneri 2a str. 301
guucguuauugggguuacgacc

SEQ ID NO: 1963749 - RNA, 22 nt, Shigella flexneri 2a str. 301
guucguugauaauaaagcuaca

SEQ ID NO: 1963750 - RNA, 18 nt, Shigella flexneri 2a str. 301
guucguguuaacagcaac

SEQ ID NO: 1963751 - RNA, 16 nt, Shigella flexneri 2a str. 301
guucugcaaggcgagc

SEQ ID NO: 1963752 - RNA, 15 nt, Shigella flexneri 2a str. 301
guucguaggccagau

SEQ ID NO: 1963753 - RNA, 21 nt, Shigella flexneri 2a str. 301
guucguaagcgauaaccgcac

SEQ ID NO: 1963754 - RNA, 21 nt, Shigella flexneri 2a str. 301
guugccugaugcgacgcuggc

SEQ ID NO: 1963755 - RNA, 19 nt, Shigella flexneri 2a str. 301
guugcugagaucaaacucu

SEQ ID NO: 1963756 - RNA, 21 nt, Shigella flexneri 2a str. 301
guuggauggcauacuccggca

SEQ ID NO: 1963757 - RNA, 19 nt, Shigella flexneri 2a str. 301
guugcacgcagacacugcu

SEQ ID NO: 1963758 - RNA, 21 nt, Shigella flexneri 2a str. 301
guugaggauggcgucgauaau

SEQ ID NO: 1963759 - RNA, 19 nt, Shigella flexneri 2a str. 301
guugaguucgucgaguuua

SEQ ID NO: 1963760 - RNA, 21 nt, Shigella flexneri 2a str. 301
guugcagauuugccaguaccg

SEQ ID NO: 1963761 - RNA, 15 nt, Shigella flexneri 2a str. 301
guugcagcgucauca

SEQ ID NO: 1963762 - RNA, 20 nt, Shigella flexneri 2a str. 301
guugucaauacuuucacaaa

SEQ ID NO: 1963763 - RNA, 13 nt, Shigella flexneri 2a str. 301
guugguuauucaa

SEQ ID NO: 1963764 - RNA, 21 nt, Shigella flexneri 2a str. 301
guugucgauaaacaguuucgc

SEQ ID NO: 1963765 - RNA, 15 nt, Shigella flexneri 2a str. 301
guuguccucgccguu

SEQ ID NO: 1963766 - RNA, 21 nt, Shigella flexneri 2a str. 301
guuuaauucugcggcaaugcg

SEQ ID NO: 1963767 - RNA, 21 nt, Shigella flexneri 2a str. 301
guugucgcacauuucaaucau

SEQ ID NO: 1963768 - RNA, 19 nt, Shigella flexneri 2a str. 301
guuuacgaauacggcggau

SEQ ID NO: 1963769 - RNA, 20 nt, Shigella flexneri 2a str. 301
guuucgcgguugguggcggu

SEQ ID NO: 1963770 - RNA, 16 nt, Shigella flexneri 2a str. 301
guuucgccagcaccgg

SEQ ID NO: 1963771 - RNA, 21 nt, Shigella flexneri 2a str. 301
guuucgccagccgaugcaggu

SEQ ID NO: 1963772 - RNA, 16 nt, Shigella flexneri 2a str. 301
guuucugcagcuccag

SEQ ID NO: 1963773 - RNA, 17 nt, Shigella flexneri 2a str. 301
guuucugcuuguggcgg

SEQ ID NO: 1963774 - RNA, 19 nt, Shigella flexneri 2a str. 301
guuucuggaugauccuggc

SEQ ID NO: 1963775 - RNA, 21 nt, Shigella flexneri 2a str. 301
guuugaaaugaugucgcuguc

SEQ ID NO: 1963776 - RNA, 22 nt, Shigella flexneri 2a str. 301
guuuguaacccaccaugccgau

SEQ ID NO: 1963777 - RNA, 16 nt, Shigella flexneri 2a str. 301
guuugguugccagcca

SEQ ID NO: 1963778 - RNA, 16 nt, Shigella flexneri 2a str. 301
guuugcaucgccauaa

SEQ ID NO: 1963779 - RNA, 18 nt, Shigella flexneri 2a str. 301
guuugcagaugcgcuuca

SEQ ID NO: 1963780 - RNA, 14 nt, Shigella flexneri 2a str. 301
guuuuuauugguca

SEQ ID NO: 1963781 - RNA, 15 nt, Shigella flexneri 2a str. 301
guuuuuacagauuuc

SEQ ID NO: 1963782 - RNA, 14 nt, Shigella flexneri 2a str. 301
guuuugaucuccag

SEQ ID NO: 1963783 - RNA, 16 nt, Shigella flexneri 2a str. 301
guuuucuaacucauuu

SEQ ID NO: 1963784 - RNA, 14 nt, Shigella flexneri 2a str. 301
guuuuccagcacca

SEQ ID NO: 1963785 - RNA, 22 nt, Shigella flexneri 2a str. 301
guuuuacucuuucucggaguaa

SEQ ID NO: 1963786 - RNA, 18 nt, Shigella flexneri 2a str. 301
guuuucagaccagacugc

SEQ ID NO: 1963787 - RNA, 16 nt, Shigella flexneri 2a str. 301
guuuuaguuucgccgu

SEQ ID NO: 1963788 - RNA, 20 nt, Shigella flexneri 2a str. 301
guuuuacaacguuaccgggu

SEQ ID NO: 1963789 - RNA, 15 nt, Shigella flexneri 2a str. 301
guuuguaggccugau

SEQ ID NO: 1963790 - RNA, 18 nt, Shigella flexneri 2a str. 301
uacaaggccaauccagcc

SEQ ID NO: 1963791 - RNA, 22 nt, Shigella flexneri 2a str. 301
uacaccguuuuacaacgcuguu

SEQ ID NO: 1963792 - RNA, 12 nt, Shigella flexneri 2a str. 301
uacaggcacaug

SEQ ID NO: 1963793 - RNA, 17 nt, Shigella flexneri 2a str. 301
uaaugcgccaagcagcg

SEQ ID NO: 1963794 - RNA, 17 nt, Shigella flexneri 2a str. 301
uaauggucgagcgacag

SEQ ID NO: 1963795 - RNA, 19 nt, Shigella flexneri 2a str. 301
uacaaaaucuauugcaaca

SEQ ID NO: 1963796 - RNA, 21 nt, Shigella flexneri 2a str. 301
uaagaacuccagcccggaaga

SEQ ID NO: 1963797 - RNA, 21 nt, Shigella flexneri 2a str. 301
uaagacagcgucacaucaggc

SEQ ID NO: 1963798 - RNA, 22 nt, Shigella flexneri 2a str. 301
uaagacgcgccagcgucgcauc

SEQ ID NO: 1963799 - RNA, 15 nt, Shigella flexneri 2a str. 301
uaagacgcgaccggc

SEQ ID NO: 1963800 - RNA, 14 nt, Shigella flexneri 2a str. 301
uaagacgcgcagcg

SEQ ID NO: 1963801 - RNA, 22 nt, Shigella flexneri 2a str. 301
uaagacgcguuagcaucgcauc

SEQ ID NO: 1963802 - RNA, 18 nt, Shigella flexneri 2a str. 301
uaagauaccccagcgcaa

SEQ ID NO: 1963803 - RNA, 19 nt, Shigella flexneri 2a str. 301
uaaggcagaaacaaacgca

SEQ ID NO: 1963804 - RNA, 18 nt, Shigella flexneri 2a str. 301
uaaucuaccguuacggcu

SEQ ID NO: 1963805 - RNA, 17 nt, Shigella flexneri 2a str. 301
uaacagaaugcgggcga

SEQ ID NO: 1963806 - RNA, 23 nt, Shigella flexneri 2a str. 301
uaaauucaauaaccuucggauug

SEQ ID NO: 1963807 - RNA, 15 nt, Shigella flexneri 2a str. 301
uaaauccaucgggcu

SEQ ID NO: 1963808 - RNA, 13 nt, Shigella flexneri 2a str. 301
uaacccagcgaug

SEQ ID NO: 1963809 - RNA, 20 nt, Shigella flexneri 2a str. 301
uaacccugcauauaaucgau

SEQ ID NO: 1963810 - RNA, 23 nt, Shigella flexneri 2a str. 301
uaacuucugaucuacagccuuau

SEQ ID NO: 1963811 - RNA, 20 nt, Shigella flexneri 2a str. 301
uaacgcgucuuaucuggccu

SEQ ID NO: 1963812 - RNA, 17 nt, Shigella flexneri 2a str. 301
uaacgcguuuucaccga

SEQ ID NO: 1963813 - RNA, 14 nt, Shigella flexneri 2a str. 301
uaacggcaacggug

SEQ ID NO: 1963814 - RNA, 16 nt, Shigella flexneri 2a str. 301
uaacggcugauaacaa

SEQ ID NO: 1963815 - RNA, 20 nt, Shigella flexneri 2a str. 301
uaacggugcaacccgccagg

SEQ ID NO: 1963816 - RNA, 12 nt, Shigella flexneri 2a str. 301
uaaacaaagcgc

SEQ ID NO: 1963817 - RNA, 20 nt, Shigella flexneri 2a str. 301
uaaacgccuuauccagccua

SEQ ID NO: 1963818 - RNA, 20 nt, Shigella flexneri 2a str. 301
uaaacgcuuuguccggccca

SEQ ID NO: 1963819 - RNA, 20 nt, Shigella flexneri 2a str. 301
uaaacgcccaauccggccua

SEQ ID NO: 1963820 - RNA, 14 nt, Shigella flexneri 2a str. 301
uaaacgccgccagu

SEQ ID NO: 1963821 - RNA, 17 nt, Shigella flexneri 2a str. 301
uaaagcccucaccgaag

SEQ ID NO: 1963822 - RNA, 20 nt, Shigella flexneri 2a str. 301
uaaaggagaggcccuggaaa

SEQ ID NO: 1963823 - RNA, 15 nt, Shigella flexneri 2a str. 301
uaaaaugauacgcuc

SEQ ID NO: 1963824 - RNA, 14 nt, Shigella flexneri 2a str. 301
uaaaacugccugau

SEQ ID NO: 1963825 - RNA, 20 nt, Shigella flexneri 2a str. 301
uaaaaccaguaaugaucggc

SEQ ID NO: 1963826 - RNA, 16 nt, Shigella flexneri 2a str. 301
guuuuuuaucuucaag

SEQ ID NO: 1963827 - RNA, 16 nt, Shigella flexneri 2a str. 301
guuuuguaggccggau

SEQ ID NO: 1963828 - RNA, 19 nt, Shigella flexneri 2a str. 301
guuuuucaguagacucaag

SEQ ID NO: 1963829 - RNA, 19 nt, Shigella flexneri 2a str. 301
guuuuugccagcaacggcc

SEQ ID NO: 1963830 - RNA, 22 nt, Shigella flexneri 2a str. 301
guuuuuucugccucugccagac

SEQ ID NO: 1963831 - RNA, 18 nt, Shigella flexneri 2a str. 301
guuuuuugaugucauuca

SEQ ID NO: 1963832 - RNA, 17 nt, Shigella flexneri 2a str. 301
guuuuuuuauaucucag

SEQ ID NO: 1963833 - RNA, 12 nt, Shigella flexneri 2a str. 301
guccgccagccu

SEQ ID NO: 1963834 - RNA, 20 nt, Shigella flexneri 2a str. 301
guccgcaauacaucaaagcg

SEQ ID NO: 1963835 - RNA, 23 nt, Shigella flexneri 2a str. 301
gucgcacacaacagacauuaccc

SEQ ID NO: 1963836 - RNA, 14 nt, Shigella flexneri 2a str. 301
gucgccaucaaagg

SEQ ID NO: 1963837 - RNA, 12 nt, Shigella flexneri 2a str. 301
gucggaugcggc

SEQ ID NO: 1963838 - RNA, 19 nt, Shigella flexneri 2a str. 301
gucggcacacacaucacgg

SEQ ID NO: 1963839 - RNA, 22 nt, Shigella flexneri 2a str. 301
gucgcuugugguacuaucagcg

SEQ ID NO: 1963840 - RNA, 18 nt, Shigella flexneri 2a str. 301
gucggaaacaugaaacgc

SEQ ID NO: 1963841 - RNA, 16 nt, Shigella flexneri 2a str. 301
gucgcuucacgcaggu

SEQ ID NO: 1963842 - RNA, 13 nt, Shigella flexneri 2a str. 301
gucggaugcgccg

SEQ ID NO: 1963843 - RNA, 20 nt, Shigella flexneri 2a str. 301
gucgcccgaccaucgccagc

SEQ ID NO: 1963844 - RNA, 16 nt, Shigella flexneri 2a str. 301
gucgcccauuuugcca

SEQ ID NO: 1963845 - RNA, 22 nt, Shigella flexneri 2a str. 301
gucguccgguacgacaaucuca

SEQ ID NO: 1963846 - RNA, 17 nt, Shigella flexneri 2a str. 301
gucguuguacaaaccau

SEQ ID NO: 1963847 - RNA, 13 nt, Shigella flexneri 2a str. 301
gucucacuaucgc

SEQ ID NO: 1963848 - RNA, 18 nt, Shigella flexneri 2a str. 301
gucuccgcugagacgcgc

SEQ ID NO: 1963849 - RNA, 17 nt, Shigella flexneri 2a str. 301
gucugccguugccacgu

SEQ ID NO: 1963850 - RNA, 18 nt, Shigella flexneri 2a str. 301
gugaaaauucuccggcgu

SEQ ID NO: 1963851 - RNA, 19 nt, Shigella flexneri 2a str. 301
gucuuaucuggcauuugca

SEQ ID NO: 1963852 - RNA, 15 nt, Shigella flexneri 2a str. 301
gucuuaucuggccua

SEQ ID NO: 1963853 - RNA, 12 nt, Shigella flexneri 2a str. 301
gucuucaauagg

SEQ ID NO: 1963854 - RNA, 21 nt, Shigella flexneri 2a str. 301
gucggcggauaauaauauccu

SEQ ID NO: 1963855 - RNA, 21 nt, Shigella flexneri 2a str. 301
gucgggcaucacuauacuccu

SEQ ID NO: 1963856 - RNA, 19 nt, Shigella flexneri 2a str. 301
guggcaaucguagcccagc

SEQ ID NO: 1963857 - RNA, 20 nt, Shigella flexneri 2a str. 301
guggagcaacacgccagcgu

SEQ ID NO: 1963858 - RNA, 21 nt, Shigella flexneri 2a str. 301
guggacucuauggcuggcaau

SEQ ID NO: 1963859 - RNA, 12 nt, Shigella flexneri 2a str. 301
gugcuucaucag

SEQ ID NO: 1963860 - RNA, 16 nt, Shigella flexneri 2a str. 301
guggccaguuccacuu

SEQ ID NO: 1963861 - RNA, 21 nt, Shigella flexneri 2a str. 301
guggcagcguuaugucccgcu

SEQ ID NO: 1963862 - RNA, 16 nt, Shigella flexneri 2a str. 301
guggcgaagugccagu

SEQ ID NO: 1963863 - RNA, 21 nt, Shigella flexneri 2a str. 301
guggcgacauugaccagccaa

SEQ ID NO: 1963864 - RNA, 16 nt, Shigella flexneri 2a str. 301
gugggaccaccgcgcu

SEQ ID NO: 1963865 - RNA, 16 nt, Shigella flexneri 2a str. 301
guggcguuuccagcag

SEQ ID NO: 1963866 - RNA, 13 nt, Shigella flexneri 2a str. 301
guggcggaauugg

SEQ ID NO: 1963867 - RNA, 22 nt, Shigella flexneri 2a str. 301
guggcggaauugguagacgcgc

SEQ ID NO: 1963868 - RNA, 16 nt, Shigella flexneri 2a str. 301
guggguaggaucaguu

SEQ ID NO: 1963869 - RNA, 12 nt, Shigella flexneri 2a str. 301
gugcccgcgugg

SEQ ID NO: 1963870 - RNA, 18 nt, Shigella flexneri 2a str. 301
gugcgccacauccggcau

SEQ ID NO: 1963871 - RNA, 16 nt, Shigella flexneri 2a str. 301
gugcgaauugccacca

SEQ ID NO: 1963872 - RNA, 13 nt, Shigella flexneri 2a str. 301
gugcucacuacgg

SEQ ID NO: 1963873 - RNA, 17 nt, Shigella flexneri 2a str. 301
gugcuacgguugacuga

SEQ ID NO: 1963874 - RNA, 11 nt, Shigella flexneri 2a str. 301
gugauccauca

SEQ ID NO: 1963875 - RNA, 22 nt, Shigella flexneri 2a str. 301
gugaugcggucgcugacgccau

SEQ ID NO: 1963876 - RNA, 17 nt, Shigella flexneri 2a str. 301
gugauacugaucgucau

SEQ ID NO: 1963877 - RNA, 19 nt, Shigella flexneri 2a str. 301
gugaacgcguuauccggcu

SEQ ID NO: 1963878 - RNA, 20 nt, Shigella flexneri 2a str. 301
gugaacgccuuaucuggccu

SEQ ID NO: 1963879 - RNA, 20 nt, Shigella flexneri 2a str. 301
gugaacgccuuauccgaccu

SEQ ID NO: 1963880 - RNA, 20 nt, Shigella flexneri 2a str. 301
gugaacgccuuauccggccu

SEQ ID NO: 1963881 - RNA, 21 nt, Shigella flexneri 2a str. 301
gugaacugccacacaggccau

SEQ ID NO: 1963882 - RNA, 22 nt, Shigella flexneri 2a str. 301
gugaacccugaaggacgccaga

SEQ ID NO: 1963883 - RNA, 14 nt, Shigella flexneri 2a str. 301
gugcacccgcuuca

SEQ ID NO: 1963884 - RNA, 16 nt, Shigella flexneri 2a str. 301
gugcaguuccugcaac

SEQ ID NO: 1963885 - RNA, 20 nt, Shigella flexneri 2a str. 301
gugcaucauggaagcaaugu

SEQ ID NO: 1963886 - RNA, 15 nt, Shigella flexneri 2a str. 301
gugcaucggugcgcu

SEQ ID NO: 1963887 - RNA, 14 nt, Shigella flexneri 2a str. 301
gugccccgagcggu

SEQ ID NO: 1963888 - RNA, 22 nt, Shigella flexneri 2a str. 301
gugcccaacugccugaugcgau

SEQ ID NO: 1963889 - RNA, 23 nt, Shigella flexneri 2a str. 301
gugccauuaaugucggaugcggc

SEQ ID NO: 1963890 - RNA, 12 nt, Shigella flexneri 2a str. 301
gucauauagccg

SEQ ID NO: 1963891 - RNA, 20 nt, Shigella flexneri 2a str. 301
gucauacgagucgccuguac

SEQ ID NO: 1963892 - RNA, 15 nt, Shigella flexneri 2a str. 301
gucaguuucagccag

SEQ ID NO: 1963893 - RNA, 23 nt, Shigella flexneri 2a str. 301
gucauacaacgcgcggugaugau

SEQ ID NO: 1963894 - RNA, 18 nt, Shigella flexneri 2a str. 301
gucaguuccgcuucgcca

SEQ ID NO: 1963895 - RNA, 14 nt, Shigella flexneri 2a str. 301
gucaucaucgccac

SEQ ID NO: 1963896 - RNA, 23 nt, Shigella flexneri 2a str. 301
gucauccaaaucgcccagcaaau

SEQ ID NO: 1963897 - RNA, 19 nt, Shigella flexneri 2a str. 301
gucaucccccaguggcagc

SEQ ID NO: 1963898 - RNA, 13 nt, Shigella flexneri 2a str. 301
gucauugacgcug

SEQ ID NO: 1963899 - RNA, 21 nt, Shigella flexneri 2a str. 301
gucauuaaagccgccaaacgg

SEQ ID NO: 1963900 - RNA, 21 nt, Shigella flexneri 2a str. 301
gucauguauauuauccaucaa

SEQ ID NO: 1963901 - RNA, 15 nt, Shigella flexneri 2a str. 301
gucaggaagccccag

SEQ ID NO: 1963902 - RNA, 16 nt, Shigella flexneri 2a str. 301
gucaggauuauguugc

SEQ ID NO: 1963903 - RNA, 19 nt, Shigella flexneri 2a str. 301
gucaggccggcauauaccu

SEQ ID NO: 1963904 - RNA, 18 nt, Shigella flexneri 2a str. 301
gucaggcgcgugaaugcc

SEQ ID NO: 1963905 - RNA, 17 nt, Shigella flexneri 2a str. 301
gucaggcuuuaaacgau

SEQ ID NO: 1963906 - RNA, 12 nt, Shigella flexneri 2a str. 301
guccagccgcca

SEQ ID NO: 1963907 - RNA, 13 nt, Shigella flexneri 2a str. 301
guccacgucauca

SEQ ID NO: 1963908 - RNA, 18 nt, Shigella flexneri 2a str. 301
gucauuguccaguugccc

SEQ ID NO: 1963909 - RNA, 14 nt, Shigella flexneri 2a str. 301
gucccaguucaugu

SEQ ID NO: 1963910 - RNA, 14 nt, Shigella flexneri 2a str. 301
guccauuucagcgc

SEQ ID NO: 1963911 - RNA, 21 nt, Shigella flexneri 2a str. 301
guaucuuugacuacgacgcca

SEQ ID NO: 1963912 - RNA, 20 nt, Shigella flexneri 2a str. 301
guaucugaaucaaaaucauc

SEQ ID NO: 1963913 - RNA, 17 nt, Shigella flexneri 2a str. 301
guauguucucuggcgaa

SEQ ID NO: 1963914 - RNA, 16 nt, Shigella flexneri 2a str. 301
guauuaguggcaacca

SEQ ID NO: 1963915 - RNA, 16 nt, Shigella flexneri 2a str. 301
guauuaccggcagagu

SEQ ID NO: 1963916 - RNA, 15 nt, Shigella flexneri 2a str. 301
guauuagcaucgcga

SEQ ID NO: 1963917 - RNA, 20 nt, Shigella flexneri 2a str. 301
guaggucggauaagacgcgg

SEQ ID NO: 1963918 - RNA, 22 nt, Shigella flexneri 2a str. 301
gucaacggugccauugaccagc

SEQ ID NO: 1963919 - RNA, 15 nt, Shigella flexneri 2a str. 301
guauucuucagcgac

SEQ ID NO: 1963920 - RNA, 20 nt, Shigella flexneri 2a str. 301
guauuguccugcaagguggu

SEQ ID NO: 1963921 - RNA, 14 nt, Shigella flexneri 2a str. 301
gucaauaaacgccu

SEQ ID NO: 1963922 - RNA, 19 nt, Shigella flexneri 2a str. 301
gucacgaucgcgccagccu

SEQ ID NO: 1963923 - RNA, 19 nt, Shigella flexneri 2a str. 301
gucagaccaaaacgcgcca

SEQ ID NO: 1963924 - RNA, 18 nt, Shigella flexneri 2a str. 301
gucagaaaucugauauac

SEQ ID NO: 1963925 - RNA, 13 nt, Shigella flexneri 2a str. 301
gucacuucaucgu

SEQ ID NO: 1963926 - RNA, 18 nt, Shigella flexneri 2a str. 301
gucacugcgcccuacucc

SEQ ID NO: 1963927 - RNA, 17 nt, Shigella flexneri 2a str. 301
guaggaucagaauucca

SEQ ID NO: 1963928 - RNA, 18 nt, Shigella flexneri 2a str. 301
guaggcggauaaggcguu

SEQ ID NO: 1963929 - RNA, 19 nt, Shigella flexneri 2a str. 301
guaggccagauaagacgcg

SEQ ID NO: 1963930 - RNA, 10 nt, Shigella flexneri 2a str. 301
guaggccgga

SEQ ID NO: 1963931 - RNA, 20 nt, Shigella flexneri 2a str. 301
guaggccugauaagcguagc

SEQ ID NO: 1963932 - RNA, 14 nt, Shigella flexneri 2a str. 301
guaggccugauaag

SEQ ID NO: 1963933 - RNA, 18 nt, Shigella flexneri 2a str. 301
guaggccugauaagcgua

SEQ ID NO: 1963934 - RNA, 13 nt, Shigella flexneri 2a str. 301
guaaguacgccau

SEQ ID NO: 1963935 - RNA, 18 nt, Shigella flexneri 2a str. 301
guaaguacgccaucacgc

SEQ ID NO: 1963936 - RNA, 18 nt, Shigella flexneri 2a str. 301
guaaucaaugcguucucc

SEQ ID NO: 1963937 - RNA, 18 nt, Shigella flexneri 2a str. 301
guaaucacgaauacguaa

SEQ ID NO: 1963938 - RNA, 18 nt, Shigella flexneri 2a str. 301
guaaucaacuccgccagc

SEQ ID NO: 1963939 - RNA, 19 nt, Shigella flexneri 2a str. 301
guagauaagcaaggcaauc

SEQ ID NO: 1963940 - RNA, 17 nt, Shigella flexneri 2a str. 301
guacuggcaaucgccag

SEQ ID NO: 1963941 - RNA, 22 nt, Shigella flexneri 2a str. 301
guacuggcaaucgccagcggca

SEQ ID NO: 1963942 - RNA, 15 nt, Shigella flexneri 2a str. 301
guacucuuccggugu

SEQ ID NO: 1963943 - RNA, 19 nt, Shigella flexneri 2a str. 301
ggugccuuauccgacauuu

SEQ ID NO: 1963944 - RNA, 13 nt, Shigella flexneri 2a str. 301
ggugccuuaccgc

SEQ ID NO: 1963945 - RNA, 20 nt, Shigella flexneri 2a str. 301
ggugccgugaagaaacuucu

SEQ ID NO: 1963946 - RNA, 18 nt, Shigella flexneri 2a str. 301
ggugcgaugccuggcaau

SEQ ID NO: 1963947 - RNA, 20 nt, Shigella flexneri 2a str. 301
ggugccgccacgaaacugcu

SEQ ID NO: 1963948 - RNA, 22 nt, Shigella flexneri 2a str. 301
ggugccggaucgguagaccgga

SEQ ID NO: 1963949 - RNA, 12 nt, Shigella flexneri 2a str. 301
guaaaacgccca

SEQ ID NO: 1963950 - RNA, 16 nt, Shigella flexneri 2a str. 301
guaaaacgugccauua

SEQ ID NO: 1963951 - RNA, 19 nt, Shigella flexneri 2a str. 301
gguuucagauuauugacaa

SEQ ID NO: 1963952 - RNA, 15 nt, Shigella flexneri 2a str. 301
gguuuauuucccaga

SEQ ID NO: 1963953 - RNA, 14 nt, Shigella flexneri 2a str. 301
guaaccacggcagc

SEQ ID NO: 1963954 - RNA, 13 nt, Shigella flexneri 2a str. 301
guaaccacgcagc

SEQ ID NO: 1963955 - RNA, 22 nt, Shigella flexneri 2a str. 301
guaaccaaacguggucgccagc

SEQ ID NO: 1963956 - RNA, 20 nt, Shigella flexneri 2a str. 301
guaacagcaauuuugucauu

SEQ ID NO: 1963957 - RNA, 17 nt, Shigella flexneri 2a str. 301
guaacaaaugugccauu

SEQ ID NO: 1963958 - RNA, 18 nt, Shigella flexneri 2a str. 301
guaaagccugcuggcagu

SEQ ID NO: 1963959 - RNA, 20 nt, Shigella flexneri 2a str. 301
guaaaauggucagccagcgg

SEQ ID NO: 1963960 - RNA, 15 nt, Shigella flexneri 2a str. 301
guaaaaucgauaacg

SEQ ID NO: 1963961 - RNA, 20 nt, Shigella flexneri 2a str. 301
guaaaaucgauaacgccuag

SEQ ID NO: 1963962 - RNA, 21 nt, Shigella flexneri 2a str. 301
guaaaccacgccaguguuucg

SEQ ID NO: 1963963 - RNA, 20 nt, Shigella flexneri 2a str. 301
guaaacgccuuauccagccu

SEQ ID NO: 1963964 - RNA, 12 nt, Shigella flexneri 2a str. 301
guaaagcaauga

SEQ ID NO: 1963965 - RNA, 21 nt, Shigella flexneri 2a str. 301
guaaagagugugaauauucau

SEQ ID NO: 1963966 - RNA, 17 nt, Shigella flexneri 2a str. 301
guaaacgaugaugcggc

SEQ ID NO: 1963967 - RNA, 15 nt, Shigella flexneri 2a str. 301
guaaacgaugaugcg

SEQ ID NO: 1963968 - RNA, 20 nt, Shigella flexneri 2a str. 301
guaaacgcccaauccggccu

SEQ ID NO: 1963969 - RNA, 15 nt, Shigella flexneri 2a str. 301
guaaacgcagcauca

SEQ ID NO: 1963970 - RNA, 21 nt, Shigella flexneri 2a str. 301
gguguuacccgcuaacuggug

SEQ ID NO: 1963971 - RNA, 20 nt, Shigella flexneri 2a str. 301
gguguucagauggccaauaa

SEQ ID NO: 1963972 - RNA, 18 nt, Shigella flexneri 2a str. 301
gguguucggcauucugcu

SEQ ID NO: 1963973 - RNA, 15 nt, Shigella flexneri 2a str. 301
gguguugaaaccgcu

SEQ ID NO: 1963974 - RNA, 14 nt, Shigella flexneri 2a str. 301
gguucugcggguua

SEQ ID NO: 1963975 - RNA, 20 nt, Shigella flexneri 2a str. 301
gguugaucccaccgggcaac

SEQ ID NO: 1963976 - RNA, 22 nt, Shigella flexneri 2a str. 301
gguugauacgagagccggaaga

SEQ ID NO: 1963977 - RNA, 17 nt, Shigella flexneri 2a str. 301
ggucugccaacuuugcc

SEQ ID NO: 1963978 - RNA, 22 nt, Shigella flexneri 2a str. 301
ggucugccauaauauugauaau

SEQ ID NO: 1963979 - RNA, 14 nt, Shigella flexneri 2a str. 301
ggucugacgcugaa

SEQ ID NO: 1963980 - RNA, 15 nt, Shigella flexneri 2a str. 301
ggucggcaaacugcu

SEQ ID NO: 1963981 - RNA, 16 nt, Shigella flexneri 2a str. 301
ggugcaagcauuagca

SEQ ID NO: 1963982 - RNA, 22 nt, Shigella flexneri 2a str. 301
ggugauuucaccugcauuugcu

SEQ ID NO: 1963983 - RNA, 23 nt, Shigella flexneri 2a str. 301
ggugaacagcauuaccauacggu

SEQ ID NO: 1963984 - RNA, 16 nt, Shigella flexneri 2a str. 301
ggucaggaaacuugcg

SEQ ID NO: 1963985 - RNA, 23 nt, Shigella flexneri 2a str. 301
gguccggauggcaaacugauuau

SEQ ID NO: 1963986 - RNA, 14 nt, Shigella flexneri 2a str. 301
ggcgagauaaugcg

SEQ ID NO: 1963987 - RNA, 14 nt, Shigella flexneri 2a str. 301
ggcgagagacgcuu

SEQ ID NO: 1963988 - RNA, 15 nt, Shigella flexneri 2a str. 301
ggcgagaaacgcuuu

SEQ ID NO: 1963989 - RNA, 18 nt, Shigella flexneri 2a str. 301
ggcgagaauauuuccagu

SEQ ID NO: 1963990 - RNA, 22 nt, Shigella flexneri 2a str. 301
ggcgauaaucagcgccagcgcg

SEQ ID NO: 1963991 - RNA, 16 nt, Shigella flexneri 2a str. 301
ggcgauaaucucaaua

SEQ ID NO: 1963992 - RNA, 20 nt, Shigella flexneri 2a str. 301
ggcgagguacgcccagcgcu

SEQ ID NO: 1963993 - RNA, 20 nt, Shigella flexneri 2a str. 301
ggccugauaaguguagcgca

SEQ ID NO: 1963994 - RNA, 20 nt, Shigella flexneri 2a str. 301
ggccugauaagacgcggcaa

SEQ ID NO: 1963995 - RNA, 15 nt, Shigella flexneri 2a str. 301
ggccuccugcagcgu

SEQ ID NO: 1963996 - RNA, 14 nt, Shigella flexneri 2a str. 301
ggccgguaacgcuu

SEQ ID NO: 1963997 - RNA, 16 nt, Shigella flexneri 2a str. 301
ggccgugaauuacugc

SEQ ID NO: 1963998 - RNA, 16 nt, Shigella flexneri 2a str. 301
ggccuaacaccaucag

SEQ ID NO: 1963999 - RNA, 14 nt, Shigella flexneri 2a str. 301
ggccuacacaugcg

SEQ ID NO: 1964000 - RNA, 19 nt, Shigella flexneri 2a str. 301
ggccuacauagucccugca

SEQ ID NO: 1964001 - RNA, 20 nt, Shigella flexneri 2a str. 301
ggccuacaucguuccugcaa

SEQ ID NO: 1964002 - RNA, 20 nt, Shigella flexneri 2a str. 301
ggccuacagcauauaaugca

SEQ ID NO: 1964003 - RNA, 20 nt, Shigella flexneri 2a str. 301
ggccuacaacuccguugaaa

SEQ ID NO: 1964004 - RNA, 13 nt, Shigella flexneri 2a str. 301
ggcaggucaucgu

SEQ ID NO: 1964005 - RNA, 20 nt, Shigella flexneri 2a str. 301
ggcaggaucugcgcggcaaa

SEQ ID NO: 1964006 - RNA, 15 nt, Shigella flexneri 2a str. 301
ggcagguuaaugacc

SEQ ID NO: 1964007 - RNA, 23 nt, Shigella flexneri 2a str. 301
ggcagguuucaccuuuuuccaga

SEQ ID NO: 1964008 - RNA, 20 nt, Shigella flexneri 2a str. 301
ggcauaacuccccgagaaau

SEQ ID NO: 1964009 - RNA, 16 nt, Shigella flexneri 2a str. 301
ggcagauugagcguca

SEQ ID NO: 1964010 - RNA, 15 nt, Shigella flexneri 2a str. 301
ggcagagcaacauac

SEQ ID NO: 1964011 - RNA, 20 nt, Shigella flexneri 2a str. 301
ggcagcauccggcagucggc

SEQ ID NO: 1964012 - RNA, 17 nt, Shigella flexneri 2a str. 301
ggccaauaacccgcugu

SEQ ID NO: 1964013 - RNA, 16 nt, Shigella flexneri 2a str. 301
ggccaauaccugucau

SEQ ID NO: 1964014 - RNA, 20 nt, Shigella flexneri 2a str. 301
ggccacaaaccuuaaauggc

SEQ ID NO: 1964015 - RNA, 13 nt, Shigella flexneri 2a str. 301
ggcauauucgcgc

SEQ ID NO: 1964016 - RNA, 18 nt, Shigella flexneri 2a str. 301
ggcaucaccaucgggccu

SEQ ID NO: 1964017 - RNA, 14 nt, Shigella flexneri 2a str. 301
ggcaucaccgcgaa

SEQ ID NO: 1964018 - RNA, 23 nt, Shigella flexneri 2a str. 301
ggcauguggcggcgcgaggcgaa

SEQ ID NO: 1964019 - RNA, 22 nt, Shigella flexneri 2a str. 301
ggcauguuuaauucugcggcaa

SEQ ID NO: 1964020 - RNA, 23 nt, Shigella flexneri 2a str. 301
ggcauguuuaauucugcggcaau

SEQ ID NO: 1964021 - RNA, 20 nt, Shigella flexneri 2a str. 301
ggccagauaagacgcgucag

SEQ ID NO: 1964022 - RNA, 19 nt, Shigella flexneri 2a str. 301
ggccagauaagacgcgcca

SEQ ID NO: 1964023 - RNA, 14 nt, Shigella flexneri 2a str. 301
ggccagagcaucag

SEQ ID NO: 1964024 - RNA, 19 nt, Shigella flexneri 2a str. 301
ggccauccgcgugacgcug

SEQ ID NO: 1964025 - RNA, 14 nt, Shigella flexneri 2a str. 301
ggccauguuuacca

SEQ ID NO: 1964026 - RNA, 24 nt, Shigella flexneri 2a str. 301
ggcccagaccccagcucuucucaa

SEQ ID NO: 1964027 - RNA, 19 nt, Shigella flexneri 2a str. 301
ggccaguuccacuucugca

SEQ ID NO: 1964028 - RNA, 18 nt, Shigella flexneri 2a str. 301
ggcggcggcaacgucacc

SEQ ID NO: 1964029 - RNA, 15 nt, Shigella flexneri 2a str. 301
ggcggaauaccgaca

SEQ ID NO: 1964030 - RNA, 14 nt, Shigella flexneri 2a str. 301
ggcggcaaucgcca

SEQ ID NO: 1964031 - RNA, 20 nt, Shigella flexneri 2a str. 301
ggcgcucugcccaugcuggu

SEQ ID NO: 1964032 - RNA, 20 nt, Shigella flexneri 2a str. 301
ggcgcaccgauaaaggucga

SEQ ID NO: 1964033 - RNA, 21 nt, Shigella flexneri 2a str. 301
ggcuaacacccgucguugcaa

SEQ ID NO: 1964034 - RNA, 21 nt, Shigella flexneri 2a str. 301
ggcgugagcugccucgcugaa

SEQ ID NO: 1964035 - RNA, 14 nt, Shigella flexneri 2a str. 301
ggcuccagcaaugu

SEQ ID NO: 1964036 - RNA, 14 nt, Shigella flexneri 2a str. 301
ggcucaucggguaa

SEQ ID NO: 1964037 - RNA, 16 nt, Shigella flexneri 2a str. 301
ggcgggcaacguucca

SEQ ID NO: 1964038 - RNA, 13 nt, Shigella flexneri 2a str. 301
ggcguccagugcc

SEQ ID NO: 1964039 - RNA, 18 nt, Shigella flexneri 2a str. 301
ggcguccuggaacuggug

SEQ ID NO: 1964040 - RNA, 21 nt, Shigella flexneri 2a str. 301
ggcgucacgccgaccagaccg

SEQ ID NO: 1964041 - RNA, 23 nt, Shigella flexneri 2a str. 301
gggcuuugcuacagccuggugaa

SEQ ID NO: 1964042 - RNA, 23 nt, Shigella flexneri 2a str. 301
ggggaagcgcaccaauucaugag

SEQ ID NO: 1964043 - RNA, 20 nt, Shigella flexneri 2a str. 301
ggggagcaacagaguugcca

SEQ ID NO: 1964044 - RNA, 21 nt, Shigella flexneri 2a str. 301
gggcugauaaacaagcguaca

SEQ ID NO: 1964045 - RNA, 18 nt, Shigella flexneri 2a str. 301
gggauauccacugucaaa

SEQ ID NO: 1964046 - RNA, 16 nt, Shigella flexneri 2a str. 301
ggcuuauccggcaugc

SEQ ID NO: 1964047 - RNA, 13 nt, Shigella flexneri 2a str. 301
ggcuucgaucagg

SEQ ID NO: 1964048 - RNA, 13 nt, Shigella flexneri 2a str. 301
ggcuugcgcgcaa

SEQ ID NO: 1964049 - RNA, 17 nt, Shigella flexneri 2a str. 301
ggcugugaaccgcacag

SEQ ID NO: 1964050 - RNA, 15 nt, Shigella flexneri 2a str. 301
ggcugucuuccugug

SEQ ID NO: 1964051 - RNA, 20 nt, Shigella flexneri 2a str. 301
gggccaauugcugugccgga

SEQ ID NO: 1964052 - RNA, 21 nt, Shigella flexneri 2a str. 301
gggcacagauuuccaagcgcg

SEQ ID NO: 1964053 - RNA, 15 nt, Shigella flexneri 2a str. 301
gggcaaucggcugca

SEQ ID NO: 1964054 - RNA, 16 nt, Shigella flexneri 2a str. 301
gggcgauuugcucccg

SEQ ID NO: 1964055 - RNA, 16 nt, Shigella flexneri 2a str. 301
gccgugcccaacugcc

SEQ ID NO: 1964056 - RNA, 19 nt, Shigella flexneri 2a str. 301
gccgugcugugugccgcga

SEQ ID NO: 1964057 - RNA, 19 nt, Shigella flexneri 2a str. 301
gccguggaucacaucgccg

SEQ ID NO: 1964058 - RNA, 13 nt, Shigella flexneri 2a str. 301
gccgugugcaaua

SEQ ID NO: 1964059 - RNA, 20 nt, Shigella flexneri 2a str. 301
gccguuauacaucgcuuucc

SEQ ID NO: 1964060 - RNA, 17 nt, Shigella flexneri 2a str. 301
gccguuaacccgucugg

SEQ ID NO: 1964061 - RNA, 20 nt, Shigella flexneri 2a str. 301
gccguuuuuacccagcagca

SEQ ID NO: 1964062 - RNA, 13 nt, Shigella flexneri 2a str. 301
gccuacaagucug

SEQ ID NO: 1964063 - RNA, 21 nt, Shigella flexneri 2a str. 301
gccuacaaaaucuauugcaac

SEQ ID NO: 1964064 - RNA, 21 nt, Shigella flexneri 2a str. 301
gccucauccauacggcagaga

SEQ ID NO: 1964065 - RNA, 23 nt, Shigella flexneri 2a str. 301
gccuacgacuuucuccgcauccg

SEQ ID NO: 1964066 - RNA, 19 nt, Shigella flexneri 2a str. 301
gccuacggcauucugcaca

SEQ ID NO: 1964067 - RNA, 16 nt, Shigella flexneri 2a str. 301
gccuaccuuaaccguu

SEQ ID NO: 1964068 - RNA, 15 nt, Shigella flexneri 2a str. 301
gccuaccauaaucag

SEQ ID NO: 1964069 - RNA, 17 nt, Shigella flexneri 2a str. 301
gccgguugucaggaagc

SEQ ID NO: 1964070 - RNA, 20 nt, Shigella flexneri 2a str. 301
gccgguuugcgccgugcgaa

SEQ ID NO: 1964071 - RNA, 12 nt, Shigella flexneri 2a str. 301
gccgguucccag

SEQ ID NO: 1964072 - RNA, 23 nt, Shigella flexneri 2a str. 301
gccgucaggguugccauacagac

SEQ ID NO: 1964073 - RNA, 21 nt, Shigella flexneri 2a str. 301
gccugaugcguugcgcuucuc

SEQ ID NO: 1964074 - RNA, 13 nt, Shigella flexneri 2a str. 301
gccugaugcguug

SEQ ID NO: 1964075 - RNA, 23 nt, Shigella flexneri 2a str. 301
gccugauggcgcuacgcuuauca

SEQ ID NO: 1964076 - RNA, 16 nt, Shigella flexneri 2a str. 301
gccugcauacguuuca

SEQ ID NO: 1964077 - RNA, 23 nt, Shigella flexneri 2a str. 301
gccugauaaguguagcgcaucag

SEQ ID NO: 1964078 - RNA, 17 nt, Shigella flexneri 2a str. 301
gccugauaaucugcuga

SEQ ID NO: 1964079 - RNA, 23 nt, Shigella flexneri 2a str. 301
gccugauaagcgcagcgcaucag

SEQ ID NO: 1964080 - RNA, 15 nt, Shigella flexneri 2a str. 301
gccugauaagcgcag

SEQ ID NO: 1964081 - RNA, 22 nt, Shigella flexneri 2a str. 301
gccugaugcgacgcuugcgcgu

SEQ ID NO: 1964082 - RNA, 23 nt, Shigella flexneri 2a str. 301
gccugaugcgacgcuugccgcgu

SEQ ID NO: 1964083 - RNA, 22 nt, Shigella flexneri 2a str. 301
gccugaugcgcuacgcuuauca

SEQ ID NO: 1964084 - RNA, 19 nt, Shigella flexneri 2a str. 301
gccugaugcgcuaugcuua

SEQ ID NO: 1964085 - RNA, 13 nt, Shigella flexneri 2a str. 301
gccugaugcgcug

SEQ ID NO: 1964086 - RNA, 16 nt, Shigella flexneri 2a str. 301
gccugaugcgcugcgc

SEQ ID NO: 1964087 - RNA, 22 nt, Shigella flexneri 2a str. 301
gccugaugcgcugcgcuuauca

SEQ ID NO: 1964088 - RNA, 18 nt, Shigella flexneri 2a str. 301
gccugaugcgcugcgcuu

SEQ ID NO: 1964089 - RNA, 18 nt, Shigella flexneri 2a str. 301
gccugaugcgacgcuugc

SEQ ID NO: 1964090 - RNA, 23 nt, Shigella flexneri 2a str. 301
gccugaugcgacgcuugcagcgu

SEQ ID NO: 1964091 - RNA, 16 nt, Shigella flexneri 2a str. 301
gccugaauauccagau

SEQ ID NO: 1964092 - RNA, 18 nt, Shigella flexneri 2a str. 301
gccugaguccaugucggu

SEQ ID NO: 1964093 - RNA, 23 nt, Shigella flexneri 2a str. 301
gccugauaaacauagcgcaucag

SEQ ID NO: 1964094 - RNA, 12 nt, Shigella flexneri 2a str. 301
gccuccaugaaa

SEQ ID NO: 1964095 - RNA, 20 nt, Shigella flexneri 2a str. 301
gccucuacccgucaccguuu

SEQ ID NO: 1964096 - RNA, 15 nt, Shigella flexneri 2a str. 301
gccuuccgucagcaa

SEQ ID NO: 1964097 - RNA, 14 nt, Shigella flexneri 2a str. 301
gccuuaccacucug

SEQ ID NO: 1964098 - RNA, 21 nt, Shigella flexneri 2a str. 301
gccuuacucaccggcguuuca

SEQ ID NO: 1964099 - RNA, 23 nt, Shigella flexneri 2a str. 301
gccuguuuagccgcuucugcagc

SEQ ID NO: 1964100 - RNA, 18 nt, Shigella flexneri 2a str. 301
gccugcucaagcguuuca

SEQ ID NO: 1964101 - RNA, 15 nt, Shigella flexneri 2a str. 301
gccugcauaaacgcc

SEQ ID NO: 1964102 - RNA, 12 nt, Shigella flexneri 2a str. 301
gccugccaucug

SEQ ID NO: 1964103 - RNA, 15 nt, Shigella flexneri 2a str. 301
gccugggaucaucag

SEQ ID NO: 1964104 - RNA, 18 nt, Shigella flexneri 2a str. 301
gccugggaucaucagcaa

SEQ ID NO: 1964105 - RNA, 22 nt, Shigella flexneri 2a str. 301
gccuggauuuuuauuccgcugg

SEQ ID NO: 1964106 - RNA, 17 nt, Shigella flexneri 2a str. 301
gccuggacaucaugcug

SEQ ID NO: 1964107 - RNA, 16 nt, Shigella flexneri 2a str. 301
gccuggaccagcgggu

SEQ ID NO: 1964108 - RNA, 16 nt, Shigella flexneri 2a str. 301
gcgaucucgucagcau

SEQ ID NO: 1964109 - RNA, 21 nt, Shigella flexneri 2a str. 301
gcgaugaucgucacgaucgcg

SEQ ID NO: 1964110 - RNA, 22 nt, Shigella flexneri 2a str. 301
gcgaugaucgucacgaucgcgc

SEQ ID NO: 1964111 - RNA, 17 nt, Shigella flexneri 2a str. 301
gcgauccugauacagac

SEQ ID NO: 1964112 - RNA, 13 nt, Shigella flexneri 2a str. 301
gcgaucaggcauu

SEQ ID NO: 1964113 - RNA, 15 nt, Shigella flexneri 2a str. 301
gcgcaaucagcaccg

SEQ ID NO: 1964114 - RNA, 16 nt, Shigella flexneri 2a str. 301
gcgcaauugccagaca

SEQ ID NO: 1964115 - RNA, 13 nt, Shigella flexneri 2a str. 301
gcgcaaugcguuu

SEQ ID NO: 1964116 - RNA, 21 nt, Shigella flexneri 2a str. 301
gcgcacaaagccgcgugcgcu

SEQ ID NO: 1964117 - RNA, 18 nt, Shigella flexneri 2a str. 301
gcgcaacauccgcuuucg

SEQ ID NO: 1964118 - RNA, 22 nt, Shigella flexneri 2a str. 301
gcgcaacccgugaagguugcgc

SEQ ID NO: 1964119 - RNA, 18 nt, Shigella flexneri 2a str. 301
gcgcaaaggccagcaauc

SEQ ID NO: 1964120 - RNA, 22 nt, Shigella flexneri 2a str. 301
gcgaugguacuucaaucgccac

SEQ ID NO: 1964121 - RNA, 14 nt, Shigella flexneri 2a str. 301
gcgauucauaugcg

SEQ ID NO: 1964122 - RNA, 19 nt, Shigella flexneri 2a str. 301
gcgauuaugccgccgacag

SEQ ID NO: 1964123 - RNA, 14 nt, Shigella flexneri 2a str. 301
gcgauucgcccugc

SEQ ID NO: 1964124 - RNA, 14 nt, Shigella flexneri 2a str. 301
gcgagacaacaaag

SEQ ID NO: 1964125 - RNA, 20 nt, Shigella flexneri 2a str. 301
gcgacgucaguuuccagcau

SEQ ID NO: 1964126 - RNA, 11 nt, Shigella flexneri 2a str. 301
gcgacgugacc

SEQ ID NO: 1964127 - RNA, 15 nt, Shigella flexneri 2a str. 301
gcgacggcuggcaaa

SEQ ID NO: 1964128 - RNA, 18 nt, Shigella flexneri 2a str. 301
gcgacgggcgacaaacgc

SEQ ID NO: 1964129 - RNA, 21 nt, Shigella flexneri 2a str. 301
gcgacgcuguccgcgucuuau

SEQ ID NO: 1964130 - RNA, 20 nt, Shigella flexneri 2a str. 301
gcgacgcuugcgcgucuuau

SEQ ID NO: 1964131 - RNA, 21 nt, Shigella flexneri 2a str. 301
gcgacgcuugccgcgucuuau

SEQ ID NO: 1964132 - RNA, 17 nt, Shigella flexneri 2a str. 301
gcgacgcuuaccgcguc

SEQ ID NO: 1964133 - RNA, 17 nt, Shigella flexneri 2a str. 301
gcgacgcuuaacgcguc

SEQ ID NO: 1964134 - RNA, 21 nt, Shigella flexneri 2a str. 301
gcgacgcuuaacgcgucuuau

SEQ ID NO: 1964135 - RNA, 17 nt, Shigella flexneri 2a str. 301
gcgacgcuugccgcguc

SEQ ID NO: 1964136 - RNA, 21 nt, Shigella flexneri 2a str. 301
gcgacgcuugcagcgucuuau

SEQ ID NO: 1964137 - RNA, 19 nt, Shigella flexneri 2a str. 301
gccuugucaucgucggccu

SEQ ID NO: 1964138 - RNA, 14 nt, Shigella flexneri 2a str. 301
gcgaauagcgucua

SEQ ID NO: 1964139 - RNA, 15 nt, Shigella flexneri 2a str. 301
gcgaaucaacuccag

SEQ ID NO: 1964140 - RNA, 17 nt, Shigella flexneri 2a str. 301
gcgaccaggccggugau

SEQ ID NO: 1964141 - RNA, 21 nt, Shigella flexneri 2a str. 301
gcgaccagcgucgcaucaggc

SEQ ID NO: 1964142 - RNA, 21 nt, Shigella flexneri 2a str. 301
gcgaccauacagcagcaacga

SEQ ID NO: 1964143 - RNA, 15 nt, Shigella flexneri 2a str. 301
gcgccuuuaccagac

SEQ ID NO: 1964144 - RNA, 22 nt, Shigella flexneri 2a str. 301
gcgccuuucgagaagcaagcau

SEQ ID NO: 1964145 - RNA, 14 nt, Shigella flexneri 2a str. 301
gcgcgaagcccuca

SEQ ID NO: 1964146 - RNA, 13 nt, Shigella flexneri 2a str. 301
gcgcgccagcgau

SEQ ID NO: 1964147 - RNA, 15 nt, Shigella flexneri 2a str. 301
gcgccgccgcugaac

SEQ ID NO: 1964148 - RNA, 17 nt, Shigella flexneri 2a str. 301
gcgccaaucagcgcagc

SEQ ID NO: 1964149 - RNA, 16 nt, Shigella flexneri 2a str. 301
gcgccacauccggcau

SEQ ID NO: 1964150 - RNA, 22 nt, Shigella flexneri 2a str. 301
gcgcauuugcggcagggcaaac

SEQ ID NO: 1964151 - RNA, 14 nt, Shigella flexneri 2a str. 301
gcgcaccagcguca

SEQ ID NO: 1964152 - RNA, 12 nt, Shigella flexneri 2a str. 301
gcgcaccagcgu

SEQ ID NO: 1964153 - RNA, 18 nt, Shigella flexneri 2a str. 301
gcgccagcggccagcgca

SEQ ID NO: 1964154 - RNA, 22 nt, Shigella flexneri 2a str. 301
gcgccagcgucgcaucaggcau

SEQ ID NO: 1964155 - RNA, 13 nt, Shigella flexneri 2a str. 301
gcgcccgccagca

SEQ ID NO: 1964156 - RNA, 16 nt, Shigella flexneri 2a str. 301
gcgccaucggcagcau

SEQ ID NO: 1964157 - RNA, 14 nt, Shigella flexneri 2a str. 301
gcgcuggcuccuga

SEQ ID NO: 1964158 - RNA, 15 nt, Shigella flexneri 2a str. 301
gcggaacccagcgcg

SEQ ID NO: 1964159 - RNA, 20 nt, Shigella flexneri 2a str. 301
gcggagcucccaggcuccgc

SEQ ID NO: 1964160 - RNA, 13 nt, Shigella flexneri 2a str. 301
gcggacugaauac

SEQ ID NO: 1964161 - RNA, 21 nt, Shigella flexneri 2a str. 301
gcggauaggaaucagcaguuc

SEQ ID NO: 1964162 - RNA, 18 nt, Shigella flexneri 2a str. 301
gcggaguaaucgccagca

SEQ ID NO: 1964163 - RNA, 17 nt, Shigella flexneri 2a str. 301
gcggaugcggcguaaac

SEQ ID NO: 1964164 - RNA, 16 nt, Shigella flexneri 2a str. 301
gcggcaaacaguuucu

SEQ ID NO: 1964165 - RNA, 20 nt, Shigella flexneri 2a str. 301
gcggcaaaaucgccggugau

SEQ ID NO: 1964166 - RNA, 22 nt, Shigella flexneri 2a str. 301
gcggcaacauggcaaccuucgc

SEQ ID NO: 1964167 - RNA, 17 nt, Shigella flexneri 2a str. 301
gcggcacagccagcgcu

SEQ ID NO: 1964168 - RNA, 20 nt, Shigella flexneri 2a str. 301
gcggcaagaucgcgaugggu

SEQ ID NO: 1964169 - RNA, 12 nt, Shigella flexneri 2a str. 301
gcggcagcggcu

SEQ ID NO: 1964170 - RNA, 14 nt, Shigella flexneri 2a str. 301
gcgcugaacaucgu

SEQ ID NO: 1964171 - RNA, 14 nt, Shigella flexneri 2a str. 301
gcgcugcauuacua

SEQ ID NO: 1964172 - RNA, 16 nt, Shigella flexneri 2a str. 301
gcgcugaauguuugca

SEQ ID NO: 1964173 - RNA, 15 nt, Shigella flexneri 2a str. 301
gcgcuacggccgcca

SEQ ID NO: 1964174 - RNA, 20 nt, Shigella flexneri 2a str. 301
gcgcuauaucgcugauauca

SEQ ID NO: 1964175 - RNA, 23 nt, Shigella flexneri 2a str. 301
gcgcgguaucaccacccagcggu

SEQ ID NO: 1964176 - RNA, 13 nt, Shigella flexneri 2a str. 301
gcgcgucaacugu

SEQ ID NO: 1964177 - RNA, 14 nt, Shigella flexneri 2a str. 301
gcgcggcggguaac

SEQ ID NO: 1964178 - RNA, 17 nt, Shigella flexneri 2a str. 301
gcgguacaccaaagcgg

SEQ ID NO: 1964179 - RNA, 14 nt, Shigella flexneri 2a str. 301
gcggugguacggca

SEQ ID NO: 1964180 - RNA, 15 nt, Shigella flexneri 2a str. 301
gcgguucacgcgcca

SEQ ID NO: 1964181 - RNA, 18 nt, Shigella flexneri 2a str. 301
gcgguuacacaugcugcc

SEQ ID NO: 1964182 - RNA, 16 nt, Shigella flexneri 2a str. 301
gcggugggcuacggca

SEQ ID NO: 1964183 - RNA, 19 nt, Shigella flexneri 2a str. 301
gcggucugugauuuccggg

SEQ ID NO: 1964184 - RNA, 17 nt, Shigella flexneri 2a str. 301
gcgguaaaccguuauca

SEQ ID NO: 1964185 - RNA, 16 nt, Shigella flexneri 2a str. 301
gcgguaacauccagau

SEQ ID NO: 1964186 - RNA, 17 nt, Shigella flexneri 2a str. 301
gcgguaaaguuuggcug

SEQ ID NO: 1964187 - RNA, 20 nt, Shigella flexneri 2a str. 301
gcggguggcucucgccagca

SEQ ID NO: 1964188 - RNA, 21 nt, Shigella flexneri 2a str. 301
gcgggucaccgcgguguauac

SEQ ID NO: 1964189 - RNA, 19 nt, Shigella flexneri 2a str. 301
gcgggaugccagucaauga

SEQ ID NO: 1964190 - RNA, 12 nt, Shigella flexneri 2a str. 301
gcggcugcgcag

SEQ ID NO: 1964191 - RNA, 14 nt, Shigella flexneri 2a str. 301
gcggcgugaacgcc

SEQ ID NO: 1964192 - RNA, 18 nt, Shigella flexneri 2a str. 301
gcggcguaaacgccuuau

SEQ ID NO: 1964193 - RNA, 14 nt, Shigella flexneri 2a str. 301
gcggcucaccugca

SEQ ID NO: 1964194 - RNA, 11 nt, Shigella flexneri 2a str. 301
gcggcggcaaa

SEQ ID NO: 1964195 - RNA, 17 nt, Shigella flexneri 2a str. 301
gcggcgaauguuccauc

SEQ ID NO: 1964196 - RNA, 18 nt, Shigella flexneri 2a str. 301
gcggcgauauccagcgcg

SEQ ID NO: 1964197 - RNA, 16 nt, Shigella flexneri 2a str. 301
gcggcgauauccagcg

SEQ ID NO: 1964198 - RNA, 21 nt, Shigella flexneri 2a str. 301
gcgugcaguggugcgaucucg

SEQ ID NO: 1964199 - RNA, 15 nt, Shigella flexneri 2a str. 301
gcguuccccagaagc

SEQ ID NO: 1964200 - RNA, 19 nt, Shigella flexneri 2a str. 301
gcguucauccaacaauagu

SEQ ID NO: 1964201 - RNA, 15 nt, Shigella flexneri 2a str. 301
gcguuacccauucaa

SEQ ID NO: 1964202 - RNA, 17 nt, Shigella flexneri 2a str. 301
gcguuaauucgcuaaca

SEQ ID NO: 1964203 - RNA, 21 nt, Shigella flexneri 2a str. 301
gcguuaacugcuuaucaucac

SEQ ID NO: 1964204 - RNA, 20 nt, Shigella flexneri 2a str. 301
gcgucguccccacagcguca

SEQ ID NO: 1964205 - RNA, 21 nt, Shigella flexneri 2a str. 301
gcgucgugaaugccuuauccg

SEQ ID NO: 1964206 - RNA, 14 nt, Shigella flexneri 2a str. 301
gcgucgcauccgac

SEQ ID NO: 1964207 - RNA, 18 nt, Shigella flexneri 2a str. 301
gcgucgcaucaggcauca

SEQ ID NO: 1964208 - RNA, 16 nt, Shigella flexneri 2a str. 301
gcguccguuuauuccg

SEQ ID NO: 1964209 - RNA, 15 nt, Shigella flexneri 2a str. 301
gcucaucaauacgcc

SEQ ID NO: 1964210 - RNA, 17 nt, Shigella flexneri 2a str. 301
gcucauacuuccacgca

SEQ ID NO: 1964211 - RNA, 13 nt, Shigella flexneri 2a str. 301
gcucauccagcgu

SEQ ID NO: 1964212 - RNA, 20 nt, Shigella flexneri 2a str. 301
gcucauaaaaucacgcgccu

SEQ ID NO: 1964213 - RNA, 15 nt, Shigella flexneri 2a str. 301
gcucauaaccgucca

SEQ ID NO: 1964214 - RNA, 13 nt, Shigella flexneri 2a str. 301
gcucaguuucgcg

SEQ ID NO: 1964215 - RNA, 17 nt, Shigella flexneri 2a str. 301
gcucaucugcugcguuu

SEQ ID NO: 1964216 - RNA, 20 nt, Shigella flexneri 2a str. 301
gcucaucgccuuccagcgau

SEQ ID NO: 1964217 - RNA, 22 nt, Shigella flexneri 2a str. 301
gcucaucggguaacggaccgca

SEQ ID NO: 1964218 - RNA, 12 nt, Shigella flexneri 2a str. 301
gcucaucgccuu

SEQ ID NO: 1964219 - RNA, 13 nt, Shigella flexneri 2a str. 301
gcucauuauuugc

SEQ ID NO: 1964220 - RNA, 17 nt, Shigella flexneri 2a str. 301
gcucauuuucucuuuca

SEQ ID NO: 1964221 - RNA, 15 nt, Shigella flexneri 2a str. 301
gcucauuuuccggga

SEQ ID NO: 1964222 - RNA, 19 nt, Shigella flexneri 2a str. 301
gcucauucuuccuccagcg

SEQ ID NO: 1964223 - RNA, 14 nt, Shigella flexneri 2a str. 301
gcuccacgccauau

SEQ ID NO: 1964224 - RNA, 15 nt, Shigella flexneri 2a str. 301
gcucaccugauacgc

SEQ ID NO: 1964225 - RNA, 22 nt, Shigella flexneri 2a str. 301
gcucaggaguaaacuuucccug

SEQ ID NO: 1964226 - RNA, 15 nt, Shigella flexneri 2a str. 301
gcucaggcgaugaaa

SEQ ID NO: 1964227 - RNA, 12 nt, Shigella flexneri 2a str. 301
gcuacggcauga

SEQ ID NO: 1964228 - RNA, 21 nt, Shigella flexneri 2a str. 301
gcuacgcuaauuuugccauca

SEQ ID NO: 1964229 - RNA, 21 nt, Shigella flexneri 2a str. 301
gcuacgcucaucaggccuaca

SEQ ID NO: 1964230 - RNA, 17 nt, Shigella flexneri 2a str. 301
gcuacgccagcaagggu

SEQ ID NO: 1964231 - RNA, 17 nt, Shigella flexneri 2a str. 301
gcuaccuugcucggcgc

SEQ ID NO: 1964232 - RNA, 12 nt, Shigella flexneri 2a str. 301
gcuagccaacuu

SEQ ID NO: 1964233 - RNA, 15 nt, Shigella flexneri 2a str. 301
gcguugauuggcgca

SEQ ID NO: 1964234 - RNA, 23 nt, Shigella flexneri 2a str. 301
gcguugcaauaugcuggcagugg

SEQ ID NO: 1964235 - RNA, 20 nt, Shigella flexneri 2a str. 301
gcguugaugauuugucgaua

SEQ ID NO: 1964236 - RNA, 15 nt, Shigella flexneri 2a str. 301
gcguugaugccggau

SEQ ID NO: 1964237 - RNA, 13 nt, Shigella flexneri 2a str. 301
gcguugcagcagg

SEQ ID NO: 1964238 - RNA, 22 nt, Shigella flexneri 2a str. 301
gcguugcacgcagacacugcug

SEQ ID NO: 1964239 - RNA, 14 nt, Shigella flexneri 2a str. 301
gcuaccggcaaacu

SEQ ID NO: 1964240 - RNA, 21 nt, Shigella flexneri 2a str. 301
gcuaccgccgcaauccgccgu

SEQ ID NO: 1964241 - RNA, 21 nt, Shigella flexneri 2a str. 301
gcuauuuaccacuacugcguc

SEQ ID NO: 1964242 - RNA, 15 nt, Shigella flexneri 2a str. 301
gcuauuuccggcgac

SEQ ID NO: 1964243 - RNA, 19 nt, Shigella flexneri 2a str. 301
gcuauugcgccagccuuuc

SEQ ID NO: 1964244 - RNA, 20 nt, Shigella flexneri 2a str. 301
gcuauuuuuugcaggccaga

SEQ ID NO: 1964245 - RNA, 16 nt, Shigella flexneri 2a str. 301
gcuauauuuugccgga

SEQ ID NO: 1964246 - RNA, 16 nt, Shigella flexneri 2a str. 301
gcuaucgaggcucuga

SEQ ID NO: 1964247 - RNA, 22 nt, Shigella flexneri 2a str. 301
gcugaagcagaaagcggaucag

SEQ ID NO: 1964248 - RNA, 14 nt, Shigella flexneri 2a str. 301
gcugaacuggcgaa

SEQ ID NO: 1964249 - RNA, 21 nt, Shigella flexneri 2a str. 301
gcugaagaaaauggccagcca

SEQ ID NO: 1964250 - RNA, 15 nt, Shigella flexneri 2a str. 301
gcucuuucagcaccg

SEQ ID NO: 1964251 - RNA, 16 nt, Shigella flexneri 2a str. 301
gcucuuucagcaccgc

SEQ ID NO: 1964252 - RNA, 22 nt, Shigella flexneri 2a str. 301
gcugaaagcgccgggaaugcca

SEQ ID NO: 1964253 - RNA, 14 nt, Shigella flexneri 2a str. 301
gcugaauaccgauu

SEQ ID NO: 1964254 - RNA, 21 nt, Shigella flexneri 2a str. 301
gcugaaucaacaggcgguaac

SEQ ID NO: 1964255 - RNA, 15 nt, Shigella flexneri 2a str. 301
gcugacggcgauaaa

SEQ ID NO: 1964256 - RNA, 15 nt, Shigella flexneri 2a str. 301
gcugacggugaugau

SEQ ID NO: 1964257 - RNA, 22 nt, Shigella flexneri 2a str. 301
gcugauuaccuuccugccagau

SEQ ID NO: 1964258 - RNA, 14 nt, Shigella flexneri 2a str. 301
gcugauuccugcaa

SEQ ID NO: 1964259 - RNA, 21 nt, Shigella flexneri 2a str. 301
gcugcaaacccugagcgguua

SEQ ID NO: 1964260 - RNA, 20 nt, Shigella flexneri 2a str. 301
gcugauuuuggucaugcuaa

SEQ ID NO: 1964261 - RNA, 15 nt, Shigella flexneri 2a str. 301
gcugccgacgccagu

SEQ ID NO: 1964262 - RNA, 22 nt, Shigella flexneri 2a str. 301
gcugcaggaauaaucagcaacg

SEQ ID NO: 1964263 - RNA, 23 nt, Shigella flexneri 2a str. 301
gcugcaggaauaaucagcaacga

SEQ ID NO: 1964264 - RNA, 19 nt, Shigella flexneri 2a str. 301
gcugcaggaauaaucagca

SEQ ID NO: 1964265 - RNA, 19 nt, Shigella flexneri 2a str. 301
gcugcacugguuuccgcca

SEQ ID NO: 1964266 - RNA, 14 nt, Shigella flexneri 2a str. 301
gcugcaucugaaac

SEQ ID NO: 1964267 - RNA, 13 nt, Shigella flexneri 2a str. 301
gcugcauccgcgc

SEQ ID NO: 1964268 - RNA, 19 nt, Shigella flexneri 2a str. 301
gcugcauggcaauuuucgu

SEQ ID NO: 1964269 - RNA, 15 nt, Shigella flexneri 2a str. 301
gcucuucaaugguca

SEQ ID NO: 1964270 - RNA, 16 nt, Shigella flexneri 2a str. 301
gcucuucuuucaucau

SEQ ID NO: 1964271 - RNA, 14 nt, Shigella flexneri 2a str. 301
gcucuugaaauggu

SEQ ID NO: 1964272 - RNA, 19 nt, Shigella flexneri 2a str. 301
gcucugcgcgugcaguggu

SEQ ID NO: 1964273 - RNA, 17 nt, Shigella flexneri 2a str. 301
gcucugcuuucucagca

SEQ ID NO: 1964274 - RNA, 18 nt, Shigella flexneri 2a str. 301
gcucugcuuucucagcaa

SEQ ID NO: 1964275 - RNA, 12 nt, Shigella flexneri 2a str. 301
gcucugccagac

SEQ ID NO: 1964276 - RNA, 19 nt, Shigella flexneri 2a str. 301
gcucucuuucaccagcgcg

SEQ ID NO: 1964277 - RNA, 15 nt, Shigella flexneri 2a str. 301
gcucggucacugaca

SEQ ID NO: 1964278 - RNA, 15 nt, Shigella flexneri 2a str. 301
gcucgucacaucacc

SEQ ID NO: 1964279 - RNA, 13 nt, Shigella flexneri 2a str. 301
gcuccagugcgcu

SEQ ID NO: 1964280 - RNA, 17 nt, Shigella flexneri 2a str. 301
gcuggauuuucugugca

SEQ ID NO: 1964281 - RNA, 18 nt, Shigella flexneri 2a str. 301
gcuggcaaaucaguggcu

SEQ ID NO: 1964282 - RNA, 21 nt, Shigella flexneri 2a str. 301
gcuggcaauacuggcagcagu

SEQ ID NO: 1964283 - RNA, 13 nt, Shigella flexneri 2a str. 301
gcuggcaucgcaa

SEQ ID NO: 1964284 - RNA, 22 nt, Shigella flexneri 2a str. 301
gcuggaugaacauaaucugcaa

SEQ ID NO: 1964285 - RNA, 20 nt, Shigella flexneri 2a str. 301
gcuggagcacccgcgcuggc

SEQ ID NO: 1964286 - RNA, 19 nt, Shigella flexneri 2a str. 301
gcuggaaagcguaaacggu

SEQ ID NO: 1964287 - RNA, 17 nt, Shigella flexneri 2a str. 301
gcuggaaauguccgcga

SEQ ID NO: 1964288 - RNA, 20 nt, Shigella flexneri 2a str. 301
gcuggaacgcuucugucgcu

SEQ ID NO: 1964289 - RNA, 22 nt, Shigella flexneri 2a str. 301
gcugcuguggauucagcaccgu

SEQ ID NO: 1964290 - RNA, 20 nt, Shigella flexneri 2a str. 301
gcugcuuuuccggucagcaa

SEQ ID NO: 1964291 - RNA, 23 nt, Shigella flexneri 2a str. 301
gcugccgcuucuucuucagcgcu

SEQ ID NO: 1964292 - RNA, 12 nt, Shigella flexneri 2a str. 301
gcugcuccagcg

SEQ ID NO: 1964293 - RNA, 16 nt, Shigella flexneri 2a str. 301
gcuggcguacccauca

SEQ ID NO: 1964294 - RNA, 13 nt, Shigella flexneri 2a str. 301
gcuggcgacgccu

SEQ ID NO: 1964295 - RNA, 14 nt, Shigella flexneri 2a str. 301
gcuggccuccagua

SEQ ID NO: 1964296 - RNA, 14 nt, Shigella flexneri 2a str. 301
gcuggugauugccg

SEQ ID NO: 1964297 - RNA, 16 nt, Shigella flexneri 2a str. 301
gcuggugaguaacgcg

SEQ ID NO: 1964298 - RNA, 17 nt, Shigella flexneri 2a str. 301
gcuggugauuucgucca

SEQ ID NO: 1964299 - RNA, 16 nt, Shigella flexneri 2a str. 301
gcugucggugccauca

SEQ ID NO: 1964300 - RNA, 14 nt, Shigella flexneri 2a str. 301
gcugucgguuucga

SEQ ID NO: 1964301 - RNA, 20 nt, Shigella flexneri 2a str. 301
gcugugccagugccacacgc

SEQ ID NO: 1964302 - RNA, 15 nt, Shigella flexneri 2a str. 301
gcugugcgauagcaa

SEQ ID NO: 1964303 - RNA, 14 nt, Shigella flexneri 2a str. 301
ggaucugaugggau

SEQ ID NO: 1964304 - RNA, 19 nt, Shigella flexneri 2a str. 301
ggaucuuugacugaaauuu

SEQ ID NO: 1964305 - RNA, 22 nt, Shigella flexneri 2a str. 301
ggaugacacaucaccuccagcg

SEQ ID NO: 1964306 - RNA, 20 nt, Shigella flexneri 2a str. 301
ggaugggcugucagcucauc

SEQ ID NO: 1964307 - RNA, 23 nt, Shigella flexneri 2a str. 301
ggaugccugaugcgacgcugaua

SEQ ID NO: 1964308 - RNA, 15 nt, Shigella flexneri 2a str. 301
ggaucagaaugcgcu

SEQ ID NO: 1964309 - RNA, 19 nt, Shigella flexneri 2a str. 301
ggaguaguugaucgccccg

SEQ ID NO: 1964310 - RNA, 13 nt, Shigella flexneri 2a str. 301
ggagugcagcaug

SEQ ID NO: 1964311 - RNA, 22 nt, Shigella flexneri 2a str. 301
ggagcagagcauucccgccauc

SEQ ID NO: 1964312 - RNA, 20 nt, Shigella flexneri 2a str. 301
ggagccaaacaugcaaacca

SEQ ID NO: 1964313 - RNA, 20 nt, Shigella flexneri 2a str. 301
ggacacucgcugacugauau

SEQ ID NO: 1964314 - RNA, 20 nt, Shigella flexneri 2a str. 301
ggaacugaaaggcgcucauu

SEQ ID NO: 1964315 - RNA, 13 nt, Shigella flexneri 2a str. 301
gcuugcgccgcuu

SEQ ID NO: 1964316 - RNA, 23 nt, Shigella flexneri 2a str. 301
gcuugcgcaguaaaucguccguu

SEQ ID NO: 1964317 - RNA, 22 nt, Shigella flexneri 2a str. 301
gcuugcaggaucagcuccggca

SEQ ID NO: 1964318 - RNA, 19 nt, Shigella flexneri 2a str. 301
gcuguuuguucaagcgcaa

SEQ ID NO: 1964319 - RNA, 13 nt, Shigella flexneri 2a str. 301
gcuugggcagaau

SEQ ID NO: 1964320 - RNA, 22 nt, Shigella flexneri 2a str. 301
gcuuguacuugauacgcuucgg

SEQ ID NO: 1964321 - RNA, 17 nt, Shigella flexneri 2a str. 301
gcuugcgucauccagca

SEQ ID NO: 1964322 - RNA, 12 nt, Shigella flexneri 2a str. 301
gcuuggcagagc

SEQ ID NO: 1964323 - RNA, 21 nt, Shigella flexneri 2a str. 301
gcuuucacucugaaaacgcug

SEQ ID NO: 1964324 - RNA, 16 nt, Shigella flexneri 2a str. 301
gcuuucacgucaggau

SEQ ID NO: 1964325 - RNA, 13 nt, Shigella flexneri 2a str. 301
gcuuucagcagcg

SEQ ID NO: 1964326 - RNA, 15 nt, Shigella flexneri 2a str. 301
gcuuuccaccaucac

SEQ ID NO: 1964327 - RNA, 12 nt, Shigella flexneri 2a str. 301
gcuuuuacgcau

SEQ ID NO: 1964328 - RNA, 21 nt, Shigella flexneri 2a str. 301
gcuuuauccugcccacuccag

SEQ ID NO: 1964329 - RNA, 23 nt, Shigella flexneri 2a str. 301
gcuuuauccugcccacuccagcu

SEQ ID NO: 1964330 - RNA, 11 nt, Shigella flexneri 2a str. 301
gcuuucaacaa

SEQ ID NO: 1964331 - RNA, 20 nt, Shigella flexneri 2a str. 301
gcuuuauagcguugcccgau

SEQ ID NO: 1964332 - RNA, 17 nt, Shigella flexneri 2a str. 301
gcuuuuacugcauucac

SEQ ID NO: 1964333 - RNA, 12 nt, Shigella flexneri 2a str. 301
gcuuuuccauau

SEQ ID NO: 1964334 - RNA, 19 nt, Shigella flexneri 2a str. 301
gcuuuuccauaucaagcau

SEQ ID NO: 1964335 - RNA, 17 nt, Shigella flexneri 2a str. 301
gcuuuuucaauuuccag

SEQ ID NO: 1964336 - RNA, 17 nt, Shigella flexneri 2a str. 301
gcuuuuguaggccugau

SEQ ID NO: 1964337 - RNA, 17 nt, Shigella flexneri 2a str. 301
ugacaaucgcugcggca

SEQ ID NO: 1964338 - RNA, 23 nt, Shigella flexneri 2a str. 301
ugacaagcguaugauugccugau

SEQ ID NO: 1964339 - RNA, 21 nt, Shigella flexneri 2a str. 301
ugacaauaauugucaacggca

SEQ ID NO: 1964340 - RNA, 20 nt, Shigella flexneri 2a str. 301
ugacaacaucuuugcggcua

SEQ ID NO: 1964341 - RNA, 23 nt, Shigella flexneri 2a str. 301
ugacaaaucagaggcuguuccgg

SEQ ID NO: 1964342 - RNA, 22 nt, Shigella flexneri 2a str. 301
ugacacuucauuaaccacgauc

SEQ ID NO: 1964343 - RNA, 18 nt, Shigella flexneri 2a str. 301
ugacagaaacuggcugau

SEQ ID NO: 1964344 - RNA, 17 nt, Shigella flexneri 2a str. 301
ugacaacuuucaucagc

SEQ ID NO: 1964345 - RNA, 16 nt, Shigella flexneri 2a str. 301
ugacaccagcacauca

SEQ ID NO: 1964346 - RNA, 19 nt, Shigella flexneri 2a str. 301
ugaaugccggaugcggcgu

SEQ ID NO: 1964347 - RNA, 12 nt, Shigella flexneri 2a str. 301
ugaaugccugau

SEQ ID NO: 1964348 - RNA, 16 nt, Shigella flexneri 2a str. 301
ugaaucuuuucaucgc

SEQ ID NO: 1964349 - RNA, 12 nt, Shigella flexneri 2a str. 301
ugaaugaggcuu

SEQ ID NO: 1964350 - RNA, 13 nt, Shigella flexneri 2a str. 301
ugaaugccggaug

SEQ ID NO: 1964351 - RNA, 20 nt, Shigella flexneri 2a str. 301
ugacauuaaguguccgccaa

SEQ ID NO: 1964352 - RNA, 18 nt, Shigella flexneri 2a str. 301
ugacauaaacaccagcaa

SEQ ID NO: 1964353 - RNA, 18 nt, Shigella flexneri 2a str. 301
ugacauaguagccagcca

SEQ ID NO: 1964354 - RNA, 20 nt, Shigella flexneri 2a str. 301
ugacauaguagccagccaga

SEQ ID NO: 1964355 - RNA, 13 nt, Shigella flexneri 2a str. 301
ugaccagcuccag

SEQ ID NO: 1964356 - RNA, 23 nt, Shigella flexneri 2a str. 301
ugaccagaucuucaucaccgaug

SEQ ID NO: 1964357 - RNA, 19 nt, Shigella flexneri 2a str. 301
ugaccaccggggacaggcg

SEQ ID NO: 1964358 - RNA, 14 nt, Shigella flexneri 2a str. 301
ugaccaccaccgau

SEQ ID NO: 1964359 - RNA, 19 nt, Shigella flexneri 2a str. 301
ugaacgcguuauccggcua

SEQ ID NO: 1964360 - RNA, 21 nt, Shigella flexneri 2a str. 301
ugaacgcuggcggcaggccua

SEQ ID NO: 1964361 - RNA, 20 nt, Shigella flexneri 2a str. 301
ugaacgccuuauccggucua

SEQ ID NO: 1964362 - RNA, 20 nt, Shigella flexneri 2a str. 301
ugaacgccuuauccggccua

SEQ ID NO: 1964363 - RNA, 20 nt, Shigella flexneri 2a str. 301
ugaacgccuuauccgaccua

SEQ ID NO: 1964364 - RNA, 20 nt, Shigella flexneri 2a str. 301
ugaacgccuuauccgcccua

SEQ ID NO: 1964365 - RNA, 17 nt, Shigella flexneri 2a str. 301
ugaacuuaucaucaggc

SEQ ID NO: 1964366 - RNA, 18 nt, Shigella flexneri 2a str. 301
ugaacucgccgcacaggc

SEQ ID NO: 1964367 - RNA, 13 nt, Shigella flexneri 2a str. 301
ugaacuucggccu

SEQ ID NO: 1964368 - RNA, 15 nt, Shigella flexneri 2a str. 301
ugaagaagcggaaau

SEQ ID NO: 1964369 - RNA, 18 nt, Shigella flexneri 2a str. 301
ugaagaaaucaguugauu

SEQ ID NO: 1964370 - RNA, 23 nt, Shigella flexneri 2a str. 301
ugaagaagcggaaaucacgcauc

SEQ ID NO: 1964371 - RNA, 21 nt, Shigella flexneri 2a str. 301
ugaagcaguuucaccagcagu

SEQ ID NO: 1964372 - RNA, 15 nt, Shigella flexneri 2a str. 301
ugaaggauaagacgu

SEQ ID NO: 1964373 - RNA, 17 nt, Shigella flexneri 2a str. 301
ugaaucaaaaucaucau

SEQ ID NO: 1964374 - RNA, 14 nt, Shigella flexneri 2a str. 301
ugaauagcggaaau

SEQ ID NO: 1964375 - RNA, 17 nt, Shigella flexneri 2a str. 301
ugaaucacgccgcccau

SEQ ID NO: 1964376 - RNA, 15 nt, Shigella flexneri 2a str. 301
ugaaucaccacaggc

SEQ ID NO: 1964377 - RNA, 21 nt, Shigella flexneri 2a str. 301
ugaauaauccccauaucaggc

SEQ ID NO: 1964378 - RNA, 16 nt, Shigella flexneri 2a str. 301
ucuuugcccgcagauc

SEQ ID NO: 1964379 - RNA, 16 nt, Shigella flexneri 2a str. 301
ucuuuucguuuugguc

SEQ ID NO: 1964380 - RNA, 11 nt, Shigella flexneri 2a str. 301
ucuuuucugag

SEQ ID NO: 1964381 - RNA, 14 nt, Shigella flexneri 2a str. 301
ugaaaaaacuggcu

SEQ ID NO: 1964382 - RNA, 13 nt, Shigella flexneri 2a str. 301
ugaaaaugcuggu

SEQ ID NO: 1964383 - RNA, 13 nt, Shigella flexneri 2a str. 301
ugaaaaucaccau

SEQ ID NO: 1964384 - RNA, 18 nt, Shigella flexneri 2a str. 301
ugaaaauaacaucgccag

SEQ ID NO: 1964385 - RNA, 18 nt, Shigella flexneri 2a str. 301
ugaaaacgcgcauccggc

SEQ ID NO: 1964386 - RNA, 22 nt, Shigella flexneri 2a str. 301
ucuuccucacacccuugccaga

SEQ ID NO: 1964387 - RNA, 11 nt, Shigella flexneri 2a str. 301
ucuuccggcag

SEQ ID NO: 1964388 - RNA, 18 nt, Shigella flexneri 2a str. 301
ucuuccugauacaugaau

SEQ ID NO: 1964389 - RNA, 23 nt, Shigella flexneri 2a str. 301
ucuuccuuaacauccaucgccag

SEQ ID NO: 1964390 - RNA, 21 nt, Shigella flexneri 2a str. 301
ucuguuuucguaauaauucac

SEQ ID NO: 1964391 - RNA, 17 nt, Shigella flexneri 2a str. 301
ucuuccgccggaucgaa

SEQ ID NO: 1964392 - RNA, 22 nt, Shigella flexneri 2a str. 301
ucuucccuuguuauuguguagc

SEQ ID NO: 1964393 - RNA, 13 nt, Shigella flexneri 2a str. 301
ucuucuucgcugc

SEQ ID NO: 1964394 - RNA, 15 nt, Shigella flexneri 2a str. 301
ucuucuucggucaga

SEQ ID NO: 1964395 - RNA, 16 nt, Shigella flexneri 2a str. 301
ucugguaucgaguggc

SEQ ID NO: 1964396 - RNA, 20 nt, Shigella flexneri 2a str. 301
aauacguaaugucggugaaa

SEQ ID NO: 1964397 - RNA, 17 nt, Shigella flexneri 2a str. 301
ucugucgauaaacucau

SEQ ID NO: 1964398 - RNA, 14 nt, Shigella flexneri 2a str. 301
ucugucuuaacgca

SEQ ID NO: 1964399 - RNA, 21 nt, Shigella flexneri 2a str. 301
aauacuguuuaucuucccagc

SEQ ID NO: 1964400 - RNA, 19 nt, Shigella flexneri 2a str. 301
ucugcggguuagucugcau

SEQ ID NO: 1964401 - RNA, 18 nt, Shigella flexneri 2a str. 301
ucugcggguuagucugca

SEQ ID NO: 1964402 - RNA, 13 nt, Shigella flexneri 2a str. 301
ucuccuucacgau

SEQ ID NO: 1964403 - RNA, 13 nt, Shigella flexneri 2a str. 301
ucgucauccgcca

SEQ ID NO: 1964404 - RNA, 22 nt, Shigella flexneri 2a str. 301
ucgucagccgggaugaaaggca

SEQ ID NO: 1964405 - RNA, 18 nt, Shigella flexneri 2a str. 301
ucguaagcgccaggaauu

SEQ ID NO: 1964406 - RNA, 20 nt, Shigella flexneri 2a str. 301
ucguaaguggcguuuacggu

SEQ ID NO: 1964407 - RNA, 15 nt, Shigella flexneri 2a str. 301
ucggugagacgcacc

SEQ ID NO: 1964408 - RNA, 18 nt, Shigella flexneri 2a str. 301
ucggugcucaucagcccg

SEQ ID NO: 1964409 - RNA, 13 nt, Shigella flexneri 2a str. 301
ucgugcaggcauu

SEQ ID NO: 1964410 - RNA, 19 nt, Shigella flexneri 2a str. 301
ucgugcgucgcauccggca

SEQ ID NO: 1964411 - RNA, 17 nt, Shigella flexneri 2a str. 301
ucgugcucgacagcgcu

SEQ ID NO: 1964412 - RNA, 16 nt, Shigella flexneri 2a str. 301
ucgugcgccuuucgag

SEQ ID NO: 1964413 - RNA, 17 nt, Shigella flexneri 2a str. 301
ucguuugcauccagcuc

SEQ ID NO: 1964414 - RNA, 21 nt, Shigella flexneri 2a str. 301
ucguugcguugaccaucugac

SEQ ID NO: 1964415 - RNA, 23 nt, Shigella flexneri 2a str. 301
ucguucacaugagagaaaaucac

SEQ ID NO: 1964416 - RNA, 22 nt, Shigella flexneri 2a str. 301
ucguucaaacgauucggcaauc

SEQ ID NO: 1964417 - RNA, 12 nt, Shigella flexneri 2a str. 301
ucguucgccguu

SEQ ID NO: 1964418 - RNA, 19 nt, Shigella flexneri 2a str. 301
ucuaacagaucauccaucg

SEQ ID NO: 1964419 - RNA, 22 nt, Shigella flexneri 2a str. 301
ucuaccagaugcucuuuucuga

SEQ ID NO: 1964420 - RNA, 23 nt, Shigella flexneri 2a str. 301
ucuaccagaugcucuuuucugaa

SEQ ID NO: 1964421 - RNA, 23 nt, Shigella flexneri 2a str. 301
ucuaugccagcuuucaccugcgc

SEQ ID NO: 1964422 - RNA, 18 nt, Shigella flexneri 2a str. 301
ucuaugucgcauccggca

SEQ ID NO: 1964423 - RNA, 17 nt, Shigella flexneri 2a str. 301
ucuauugcaacauguug

SEQ ID NO: 1964424 - RNA, 18 nt, Shigella flexneri 2a str. 301
ucuccagcuccccacgau

SEQ ID NO: 1964425 - RNA, 16 nt, Shigella flexneri 2a str. 301
ucuccagcgaauccgu

SEQ ID NO: 1964426 - RNA, 13 nt, Shigella flexneri 2a str. 301
ucuccacgccagu

SEQ ID NO: 1964427 - RNA, 14 nt, Shigella flexneri 2a str. 301
ucuccacagucagg

SEQ ID NO: 1964428 - RNA, 23 nt, Shigella flexneri 2a str. 301
ucuccauacucguugacgaccag

SEQ ID NO: 1964429 - RNA, 17 nt, Shigella flexneri 2a str. 301
ucuccguuaucacagca

SEQ ID NO: 1964430 - RNA, 13 nt, Shigella flexneri 2a str. 301
ugccgcacuuaau

SEQ ID NO: 1964431 - RNA, 20 nt, Shigella flexneri 2a str. 301
ugccgcauuucgugcgggua

SEQ ID NO: 1964432 - RNA, 16 nt, Shigella flexneri 2a str. 301
ugccgcgccagaucag

SEQ ID NO: 1964433 - RNA, 17 nt, Shigella flexneri 2a str. 301
ugcccguuccaggcgau

SEQ ID NO: 1964434 - RNA, 12 nt, Shigella flexneri 2a str. 301
ugcccuaucacg

SEQ ID NO: 1964435 - RNA, 13 nt, Shigella flexneri 2a str. 301
ugccgaaccguag

SEQ ID NO: 1964436 - RNA, 14 nt, Shigella flexneri 2a str. 301
ugcaugauccggca

SEQ ID NO: 1964437 - RNA, 16 nt, Shigella flexneri 2a str. 301
ugcaucgccugcgcga

SEQ ID NO: 1964438 - RNA, 22 nt, Shigella flexneri 2a str. 301
ugcaucgcgauuaugccgccga

SEQ ID NO: 1964439 - RNA, 14 nt, Shigella flexneri 2a str. 301
ugcaucgcgcaaag

SEQ ID NO: 1964440 - RNA, 12 nt, Shigella flexneri 2a str. 301
ugcaucgccuga

SEQ ID NO: 1964441 - RNA, 23 nt, Shigella flexneri 2a str. 301
ugccaacgcaaacgcccguccau

SEQ ID NO: 1964442 - RNA, 23 nt, Shigella flexneri 2a str. 301
ugcauuuucgucaaccaccgggc

SEQ ID NO: 1964443 - RNA, 19 nt, Shigella flexneri 2a str. 301
ugcaucccgccguaccggc

SEQ ID NO: 1964444 - RNA, 14 nt, Shigella flexneri 2a str. 301
ugcagguuaccggu

SEQ ID NO: 1964445 - RNA, 18 nt, Shigella flexneri 2a str. 301
ugcaggcuucuggcggcg

SEQ ID NO: 1964446 - RNA, 19 nt, Shigella flexneri 2a str. 301
ugcccaugcgcucgacgau

SEQ ID NO: 1964447 - RNA, 16 nt, Shigella flexneri 2a str. 301
ugcccauggcaagaau

SEQ ID NO: 1964448 - RNA, 15 nt, Shigella flexneri 2a str. 301
ugcccacgccgcauu

SEQ ID NO: 1964449 - RNA, 19 nt, Shigella flexneri 2a str. 301
ugcccccgcucuuccaggc

SEQ ID NO: 1964450 - RNA, 16 nt, Shigella flexneri 2a str. 301
ugccaucagcgccuga

SEQ ID NO: 1964451 - RNA, 20 nt, Shigella flexneri 2a str. 301
ugccaucagggcggccgcca

SEQ ID NO: 1964452 - RNA, 16 nt, Shigella flexneri 2a str. 301
ugccauuuccagcgcu

SEQ ID NO: 1964453 - RNA, 14 nt, Shigella flexneri 2a str. 301
ugccauauacgcca

SEQ ID NO: 1964454 - RNA, 15 nt, Shigella flexneri 2a str. 301
ugccaguuugcgcgu

SEQ ID NO: 1964455 - RNA, 20 nt, Shigella flexneri 2a str. 301
ugccaggacuucaucacgau

SEQ ID NO: 1964456 - RNA, 15 nt, Shigella flexneri 2a str. 301
ugccaccaccagcgu

SEQ ID NO: 1964457 - RNA, 21 nt, Shigella flexneri 2a str. 301
ugccagugcgguuuccacgcc

SEQ ID NO: 1964458 - RNA, 13 nt, Shigella flexneri 2a str. 301
ugccagucaauca

SEQ ID NO: 1964459 - RNA, 15 nt, Shigella flexneri 2a str. 301
ugccaguaaucacga

SEQ ID NO: 1964460 - RNA, 14 nt, Shigella flexneri 2a str. 301
ugccagguucgaua

SEQ ID NO: 1964461 - RNA, 18 nt, Shigella flexneri 2a str. 301
ugagaaacucauuugauu

SEQ ID NO: 1964462 - RNA, 17 nt, Shigella flexneri 2a str. 301
ugagaacaccaccugcc

SEQ ID NO: 1964463 - RNA, 19 nt, Shigella flexneri 2a str. 301
ugagaaaaagcgaagcggc

SEQ ID NO: 1964464 - RNA, 17 nt, Shigella flexneri 2a str. 301
ugagcaggagcagcagg

SEQ ID NO: 1964465 - RNA, 16 nt, Shigella flexneri 2a str. 301
ugagcaaggcauaggc

SEQ ID NO: 1964466 - RNA, 14 nt, Shigella flexneri 2a str. 301
ugagcacaucuggc

SEQ ID NO: 1964467 - RNA, 23 nt, Shigella flexneri 2a str. 301
ugaccaguaauauccccagccua

SEQ ID NO: 1964468 - RNA, 19 nt, Shigella flexneri 2a str. 301
ugacgugccugugcagcga

SEQ ID NO: 1964469 - RNA, 17 nt, Shigella flexneri 2a str. 301
ugacugaaugccacauc

SEQ ID NO: 1964470 - RNA, 18 nt, Shigella flexneri 2a str. 301
ugacguaauccgccuguu

SEQ ID NO: 1964471 - RNA, 20 nt, Shigella flexneri 2a str. 301
ugacguccagcccuucucgc

SEQ ID NO: 1964472 - RNA, 16 nt, Shigella flexneri 2a str. 301
ugauagcccggauuuc

SEQ ID NO: 1964473 - RNA, 16 nt, Shigella flexneri 2a str. 301
ugauaguucaacagau

SEQ ID NO: 1964474 - RNA, 22 nt, Shigella flexneri 2a str. 301
ugauauacgucacuucaucguc

SEQ ID NO: 1964475 - RNA, 22 nt, Shigella flexneri 2a str. 301
ugaucagcaacgccgguuccag

SEQ ID NO: 1964476 - RNA, 16 nt, Shigella flexneri 2a str. 301
ugaggcguuaacagcg

SEQ ID NO: 1964477 - RNA, 17 nt, Shigella flexneri 2a str. 301
ugagcgucgcaucuggc

SEQ ID NO: 1964478 - RNA, 15 nt, Shigella flexneri 2a str. 301
ugagcgguuaacacg

SEQ ID NO: 1964479 - RNA, 18 nt, Shigella flexneri 2a str. 301
ugcaaauuauuugcguag

SEQ ID NO: 1964480 - RNA, 22 nt, Shigella flexneri 2a str. 301
ugcaaaauagucaucucuuccg

SEQ ID NO: 1964481 - RNA, 14 nt, Shigella flexneri 2a str. 301
ugcaacagcaccag

SEQ ID NO: 1964482 - RNA, 15 nt, Shigella flexneri 2a str. 301
ugcaagaucgcgcau

SEQ ID NO: 1964483 - RNA, 17 nt, Shigella flexneri 2a str. 301
ugcaagauagcgcguug

SEQ ID NO: 1964484 - RNA, 16 nt, Shigella flexneri 2a str. 301
ugcaccggucgacgau

SEQ ID NO: 1964485 - RNA, 18 nt, Shigella flexneri 2a str. 301
ugcaaugaaaaaccgugu

SEQ ID NO: 1964486 - RNA, 14 nt, Shigella flexneri 2a str. 301
ugcacaacaaucug

SEQ ID NO: 1964487 - RNA, 23 nt, Shigella flexneri 2a str. 301
ugcacaauugccggaugcggcgu

SEQ ID NO: 1964488 - RNA, 14 nt, Shigella flexneri 2a str. 301
ugaugcauccggca

SEQ ID NO: 1964489 - RNA, 14 nt, Shigella flexneri 2a str. 301
ugaugccaucgggc

SEQ ID NO: 1964490 - RNA, 16 nt, Shigella flexneri 2a str. 301
ugaugaguugaaaacc

SEQ ID NO: 1964491 - RNA, 17 nt, Shigella flexneri 2a str. 301
ugaucgaaaaugcgcau

SEQ ID NO: 1964492 - RNA, 12 nt, Shigella flexneri 2a str. 301
ugauccggauuc

SEQ ID NO: 1964493 - RNA, 17 nt, Shigella flexneri 2a str. 301
ugauccaggagcuccag

SEQ ID NO: 1964494 - RNA, 14 nt, Shigella flexneri 2a str. 301
ugaucauccggcuu

SEQ ID NO: 1964495 - RNA, 11 nt, Shigella flexneri 2a str. 301
ugauuaacgca

SEQ ID NO: 1964496 - RNA, 18 nt, Shigella flexneri 2a str. 301
ugauguuggcgaaucgac

SEQ ID NO: 1964497 - RNA, 19 nt, Shigella flexneri 2a str. 301
ugauugcugucggcaaauc

SEQ ID NO: 1964498 - RNA, 22 nt, Shigella flexneri 2a str. 301
ugauugcugcugccgcgccaga

SEQ ID NO: 1964499 - RNA, 14 nt, Shigella flexneri 2a str. 301
ugauucgcgcguuc

SEQ ID NO: 1964500 - RNA, 15 nt, Shigella flexneri 2a str. 301
ugauucauggcauuu

SEQ ID NO: 1964501 - RNA, 13 nt, Shigella flexneri 2a str. 301
ugauuccgccagu

SEQ ID NO: 1964502 - RNA, 22 nt, Shigella flexneri 2a str. 301
ucccgccagaugauauggcaaa

SEQ ID NO: 1964503 - RNA, 16 nt, Shigella flexneri 2a str. 301
ucccgcaggagcgccg

SEQ ID NO: 1964504 - RNA, 16 nt, Shigella flexneri 2a str. 301
uccccguucugccagu

SEQ ID NO: 1964505 - RNA, 20 nt, Shigella flexneri 2a str. 301
ucccaacugacgaaugcguu

SEQ ID NO: 1964506 - RNA, 19 nt, Shigella flexneri 2a str. 301
ucccaaccuuguuucugag

SEQ ID NO: 1964507 - RNA, 18 nt, Shigella flexneri 2a str. 301
uccgccagcggcggcaaa

SEQ ID NO: 1964508 - RNA, 17 nt, Shigella flexneri 2a str. 301
uccgccaauagcuggca

SEQ ID NO: 1964509 - RNA, 19 nt, Shigella flexneri 2a str. 301
uccgccagugccaaagcca

SEQ ID NO: 1964510 - RNA, 15 nt, Shigella flexneri 2a str. 301
uccgcaccugccagc

SEQ ID NO: 1964511 - RNA, 17 nt, Shigella flexneri 2a str. 301
uccgaucgcgcaucagc

SEQ ID NO: 1964512 - RNA, 12 nt, Shigella flexneri 2a str. 301
uccgacagaaua

SEQ ID NO: 1964513 - RNA, 20 nt, Shigella flexneri 2a str. 301
uccgacuuaucacugccagu

SEQ ID NO: 1964514 - RNA, 13 nt, Shigella flexneri 2a str. 301
uccggaaagcaca

SEQ ID NO: 1964515 - RNA, 21 nt, Shigella flexneri 2a str. 301
uccggcauuaucacaucagcg

SEQ ID NO: 1964516 - RNA, 19 nt, Shigella flexneri 2a str. 301
uccggcauuaucacaucag

SEQ ID NO: 1964517 - RNA, 20 nt, Shigella flexneri 2a str. 301
uccggcaugaacaaagcgca

SEQ ID NO: 1964518 - RNA, 20 nt, Shigella flexneri 2a str. 301
uccggcgaaaaucccggcaa

SEQ ID NO: 1964519 - RNA, 23 nt, Shigella flexneri 2a str. 301
uccggcgaauuaccagccagaca

SEQ ID NO: 1964520 - RNA, 18 nt, Shigella flexneri 2a str. 301
uccggcagcagaaagcga

SEQ ID NO: 1964521 - RNA, 14 nt, Shigella flexneri 2a str. 301
uccggcauccagcc

SEQ ID NO: 1964522 - RNA, 20 nt, Shigella flexneri 2a str. 301
uccggcauaaacaaagcgca

SEQ ID NO: 1964523 - RNA, 20 nt, Shigella flexneri 2a str. 301
uccggcauaaacaaagugca

SEQ ID NO: 1964524 - RNA, 17 nt, Shigella flexneri 2a str. 301
uccggcuuuggcaaacu

SEQ ID NO: 1964525 - RNA, 15 nt, Shigella flexneri 2a str. 301
uccguuuuccagccu

SEQ ID NO: 1964526 - RNA, 18 nt, Shigella flexneri 2a str. 301
uccuaugcaacaacugaa

SEQ ID NO: 1964527 - RNA, 22 nt, Shigella flexneri 2a str. 301
uccuccgucaucuuuaacgugg

SEQ ID NO: 1964528 - RNA, 18 nt, Shigella flexneri 2a str. 301
uccgugacuuccagcgua

SEQ ID NO: 1964529 - RNA, 23 nt, Shigella flexneri 2a str. 301
uccgggaaaacgcuggcagcauu

SEQ ID NO: 1964530 - RNA, 23 nt, Shigella flexneri 2a str. 301
uccgggaacaacgcaagcggcau

SEQ ID NO: 1964531 - RNA, 15 nt, Shigella flexneri 2a str. 301
uccgggaucaccaga

SEQ ID NO: 1964532 - RNA, 14 nt, Shigella flexneri 2a str. 301
uccgucagcggcaa

SEQ ID NO: 1964533 - RNA, 13 nt, Shigella flexneri 2a str. 301
ucgagcagagaaa

SEQ ID NO: 1964534 - RNA, 15 nt, Shigella flexneri 2a str. 301
ucgagcgcgagcagg

SEQ ID NO: 1964535 - RNA, 18 nt, Shigella flexneri 2a str. 301
ucgagcgcgagcaggccg

SEQ ID NO: 1964536 - RNA, 22 nt, Shigella flexneri 2a str. 301
ucgauaugucuuuuuuccagca

SEQ ID NO: 1964537 - RNA, 13 nt, Shigella flexneri 2a str. 301
ucgaucacuucgc

SEQ ID NO: 1964538 - RNA, 14 nt, Shigella flexneri 2a str. 301
ucgauaaucaucag

SEQ ID NO: 1964539 - RNA, 17 nt, Shigella flexneri 2a str. 301
ucgaggcaaccagcacg

SEQ ID NO: 1964540 - RNA, 22 nt, Shigella flexneri 2a str. 301
ucgcaaaaaaccaucccuggca

SEQ ID NO: 1964541 - RNA, 14 nt, Shigella flexneri 2a str. 301
ucgcacccgccauc

SEQ ID NO: 1964542 - RNA, 13 nt, Shigella flexneri 2a str. 301
ucgaaaaugcgca

SEQ ID NO: 1964543 - RNA, 12 nt, Shigella flexneri 2a str. 301
uccuuccagcug

SEQ ID NO: 1964544 - RNA, 15 nt, Shigella flexneri 2a str. 301
uccuguuucggacuu

SEQ ID NO: 1964545 - RNA, 19 nt, Shigella flexneri 2a str. 301
ucgaacucauacaccagcg

SEQ ID NO: 1964546 - RNA, 22 nt, Shigella flexneri 2a str. 301
ucgaacgguaacaggaagcagc

SEQ ID NO: 1964547 - RNA, 12 nt, Shigella flexneri 2a str. 301
ucgacagcagcc

SEQ ID NO: 1964548 - RNA, 13 nt, Shigella flexneri 2a str. 301
ucgacagcagccc

SEQ ID NO: 1964549 - RNA, 13 nt, Shigella flexneri 2a str. 301
ucgacagcaggau

SEQ ID NO: 1964550 - RNA, 13 nt, Shigella flexneri 2a str. 301
ucgacagccaguu

SEQ ID NO: 1964551 - RNA, 23 nt, Shigella flexneri 2a str. 301
ucgacaaacaccgaaccagagau

SEQ ID NO: 1964552 - RNA, 18 nt, Shigella flexneri 2a str. 301
ucgacaauaaucaacgcg

SEQ ID NO: 1964553 - RNA, 22 nt, Shigella flexneri 2a str. 301
ucgacaaugucguccgguacga

SEQ ID NO: 1964554 - RNA, 14 nt, Shigella flexneri 2a str. 301
ucgaccgcugccgu

SEQ ID NO: 1964555 - RNA, 18 nt, Shigella flexneri 2a str. 301
ucgacgccacaaucugau

SEQ ID NO: 1964556 - RNA, 14 nt, Shigella flexneri 2a str. 301
ucgccaguccuuca

SEQ ID NO: 1964557 - RNA, 21 nt, Shigella flexneri 2a str. 301
ucgccaguucgcgauccugau

SEQ ID NO: 1964558 - RNA, 22 nt, Shigella flexneri 2a str. 301
ucgccaucgcuuuuaccagcau

SEQ ID NO: 1964559 - RNA, 19 nt, Shigella flexneri 2a str. 301
ucgccagucccuuucaggu

SEQ ID NO: 1964560 - RNA, 15 nt, Shigella flexneri 2a str. 301
ucgcagaguuuugag

SEQ ID NO: 1964561 - RNA, 17 nt, Shigella flexneri 2a str. 301
ucgccgggcuaaccgcu

SEQ ID NO: 1964562 - RNA, 19 nt, Shigella flexneri 2a str. 301
ucgcgccgcauccggcauu

SEQ ID NO: 1964563 - RNA, 22 nt, Shigella flexneri 2a str. 301
ucgcgcacaggcugcccaguug

SEQ ID NO: 1964564 - RNA, 15 nt, Shigella flexneri 2a str. 301
ucgccgguuccagcu

SEQ ID NO: 1964565 - RNA, 13 nt, Shigella flexneri 2a str. 301
ucgcgacggcauc

SEQ ID NO: 1964566 - RNA, 19 nt, Shigella flexneri 2a str. 301
ucgcggcggccugggcauu

SEQ ID NO: 1964567 - RNA, 18 nt, Shigella flexneri 2a str. 301
ucggauaaccaaucacgu

SEQ ID NO: 1964568 - RNA, 22 nt, Shigella flexneri 2a str. 301
ucggaguggcagccccaggauu

SEQ ID NO: 1964569 - RNA, 21 nt, Shigella flexneri 2a str. 301
ucggauaaccaaucacgucgc

SEQ ID NO: 1964570 - RNA, 20 nt, Shigella flexneri 2a str. 301
ucgcugcagcucugcgccgu

SEQ ID NO: 1964571 - RNA, 17 nt, Shigella flexneri 2a str. 301
ucggcagugaaaacgca

SEQ ID NO: 1964572 - RNA, 16 nt, Shigella flexneri 2a str. 301
ucggcaaacugcugau

SEQ ID NO: 1964573 - RNA, 15 nt, Shigella flexneri 2a str. 301
ucggauuuaccggga

SEQ ID NO: 1964574 - RNA, 22 nt, Shigella flexneri 2a str. 301
ucggaugcggcgugaacgccuu

SEQ ID NO: 1964575 - RNA, 15 nt, Shigella flexneri 2a str. 301
uaggaagccggaauu

SEQ ID NO: 1964576 - RNA, 15 nt, Shigella flexneri 2a str. 301
uaggcaauuggcgca

SEQ ID NO: 1964577 - RNA, 13 nt, Shigella flexneri 2a str. 301
aauaaaaacggcg

SEQ ID NO: 1964578 - RNA, 18 nt, Shigella flexneri 2a str. 301
uaggccagauaagacgcg

SEQ ID NO: 1964579 - RNA, 21 nt, Shigella flexneri 2a str. 301
uaggcuuuacuuaaucccauc

SEQ ID NO: 1964580 - RNA, 18 nt, Shigella flexneri 2a str. 301
aaguugcagcgucaucaa

SEQ ID NO: 1964581 - RNA, 21 nt, Shigella flexneri 2a str. 301
aaguugcacgccaggcaccgc

SEQ ID NO: 1964582 - RNA, 15 nt, Shigella flexneri 2a str. 301
uagcagcuuucagca

SEQ ID NO: 1964583 - RNA, 18 nt, Shigella flexneri 2a str. 301
uagcagcuuucagcagcg

SEQ ID NO: 1964584 - RNA, 17 nt, Shigella flexneri 2a str. 301
uagcgaauaaucccggc

SEQ ID NO: 1964585 - RNA, 19 nt, Shigella flexneri 2a str. 301
uagcgaccauacagcagca

SEQ ID NO: 1964586 - RNA, 12 nt, Shigella flexneri 2a str. 301
uagccugccaga

SEQ ID NO: 1964587 - RNA, 18 nt, Shigella flexneri 2a str. 301
uacuuuccagccacaguu

SEQ ID NO: 1964588 - RNA, 20 nt, Shigella flexneri 2a str. 301
uagacgcguuuacagagccg

SEQ ID NO: 1964589 - RNA, 12 nt, Shigella flexneri 2a str. 301
uacgucgagaau

SEQ ID NO: 1964590 - RNA, 23 nt, Shigella flexneri 2a str. 301
uacgucggcaucgggcagcaucg

SEQ ID NO: 1964591 - RNA, 15 nt, Shigella flexneri 2a str. 301
uacguccaccccagc

SEQ ID NO: 1964592 - RNA, 18 nt, Shigella flexneri 2a str. 301
uacgguucgggcacagau

SEQ ID NO: 1964593 - RNA, 23 nt, Shigella flexneri 2a str. 301
uacguggguaggaucaguauggg

SEQ ID NO: 1964594 - RNA, 20 nt, Shigella flexneri 2a str. 301
uacuacguucaaucaccgca

SEQ ID NO: 1964595 - RNA, 12 nt, Shigella flexneri 2a str. 301
uacuacguucaa

SEQ ID NO: 1964596 - RNA, 14 nt, Shigella flexneri 2a str. 301
uacugaaccacgga

SEQ ID NO: 1964597 - RNA, 15 nt, Shigella flexneri 2a str. 301
uacugaaggcgcauu

SEQ ID NO: 1964598 - RNA, 22 nt, Shigella flexneri 2a str. 301
uacugccgaacagaaugcacgu

SEQ ID NO: 1964599 - RNA, 16 nt, Shigella flexneri 2a str. 301
uacugcauucaccagu

SEQ ID NO: 1964600 - RNA, 15 nt, Shigella flexneri 2a str. 301
uacgcgcucaccgcu

SEQ ID NO: 1964601 - RNA, 21 nt, Shigella flexneri 2a str. 301
uacgcggcaauccccgccagc

SEQ ID NO: 1964602 - RNA, 11 nt, Shigella flexneri 2a str. 301
uacgcuaccau

SEQ ID NO: 1964603 - RNA, 14 nt, Shigella flexneri 2a str. 301
uacgcuaccggaca

SEQ ID NO: 1964604 - RNA, 20 nt, Shigella flexneri 2a str. 301
uacgcguaaaacagccagcg

SEQ ID NO: 1964605 - RNA, 20 nt, Shigella flexneri 2a str. 301
uacggugaacucacacagcg

SEQ ID NO: 1964606 - RNA, 20 nt, Shigella flexneri 2a str. 301
uacggcugauggcgccaguu

SEQ ID NO: 1964607 - RNA, 14 nt, Shigella flexneri 2a str. 301
uaccagcccgucuc

SEQ ID NO: 1964608 - RNA, 11 nt, Shigella flexneri 2a str. 301
uaccagcagcg

SEQ ID NO: 1964609 - RNA, 15 nt, Shigella flexneri 2a str. 301
uaccagaaucaccuu

SEQ ID NO: 1964610 - RNA, 16 nt, Shigella flexneri 2a str. 301
uacgaccgcaugcggu

SEQ ID NO: 1964611 - RNA, 15 nt, Shigella flexneri 2a str. 301
uacgcaaaaccucuu

SEQ ID NO: 1964612 - RNA, 23 nt, Shigella flexneri 2a str. 301
uacgauuaacguaaggcgcaaca

SEQ ID NO: 1964613 - RNA, 18 nt, Shigella flexneri 2a str. 301
uacgcagaaccagaagcg

SEQ ID NO: 1964614 - RNA, 15 nt, Shigella flexneri 2a str. 301
ucaacuuuguucuga

SEQ ID NO: 1964615 - RNA, 15 nt, Shigella flexneri 2a str. 301
ucaaccgucaccagc

SEQ ID NO: 1964616 - RNA, 17 nt, Shigella flexneri 2a str. 301
ucaaccaugguuucgaa

SEQ ID NO: 1964617 - RNA, 14 nt, Shigella flexneri 2a str. 301
ucaaaugaaugcca

SEQ ID NO: 1964618 - RNA, 21 nt, Shigella flexneri 2a str. 301
ucaaaugaccgcgcuggcaau

SEQ ID NO: 1964619 - RNA, 12 nt, Shigella flexneri 2a str. 301
ucaaacucuuca

SEQ ID NO: 1964620 - RNA, 17 nt, Shigella flexneri 2a str. 301
uauugcugaaauaacgu

SEQ ID NO: 1964621 - RNA, 20 nt, Shigella flexneri 2a str. 301
uauugaucgugggccggaga

SEQ ID NO: 1964622 - RNA, 22 nt, Shigella flexneri 2a str. 301
uauugcaccccgagcuuaugca

SEQ ID NO: 1964623 - RNA, 13 nt, Shigella flexneri 2a str. 301
ucaaguuaccggu

SEQ ID NO: 1964624 - RNA, 13 nt, Shigella flexneri 2a str. 301
ucaauaaaagcau

SEQ ID NO: 1964625 - RNA, 19 nt, Shigella flexneri 2a str. 301
ucaauacaacccaccgggc

SEQ ID NO: 1964626 - RNA, 20 nt, Shigella flexneri 2a str. 301
ucaauacucgcacuaucgaa

SEQ ID NO: 1964627 - RNA, 18 nt, Shigella flexneri 2a str. 301
ucaagcgucgcaucaggc

SEQ ID NO: 1964628 - RNA, 16 nt, Shigella flexneri 2a str. 301
ucaagccauagcgccg

SEQ ID NO: 1964629 - RNA, 22 nt, Shigella flexneri 2a str. 301
ucaagcccugguaacugccagg

SEQ ID NO: 1964630 - RNA, 18 nt, Shigella flexneri 2a str. 301
ucaagcaucgcaacgccu

SEQ ID NO: 1964631 - RNA, 19 nt, Shigella flexneri 2a str. 301
ucaagauauuucaccagcg

SEQ ID NO: 1964632 - RNA, 20 nt, Shigella flexneri 2a str. 301
ucaauuugagcgaagcgcau

SEQ ID NO: 1964633 - RNA, 17 nt, Shigella flexneri 2a str. 301
ucacaaacagcgccugu

SEQ ID NO: 1964634 - RNA, 20 nt, Shigella flexneri 2a str. 301
ucaauuuucacuuucggcag

SEQ ID NO: 1964635 - RNA, 13 nt, Shigella flexneri 2a str. 301
ucaaucuggccug

SEQ ID NO: 1964636 - RNA, 23 nt, Shigella flexneri 2a str. 301
ucaaugcccaucacuaucgccau

SEQ ID NO: 1964637 - RNA, 15 nt, Shigella flexneri 2a str. 301
ucaauauuaaugcug

SEQ ID NO: 1964638 - RNA, 22 nt, Shigella flexneri 2a str. 301
ucaaucgccucgccgaaacgcu

SEQ ID NO: 1964639 - RNA, 20 nt, Shigella flexneri 2a str. 301
ucaaugaguucgcgcgcugc

SEQ ID NO: 1964640 - RNA, 14 nt, Shigella flexneri 2a str. 301
uaucagcaacucug

SEQ ID NO: 1964641 - RNA, 13 nt, Shigella flexneri 2a str. 301
uaucagacaccag

SEQ ID NO: 1964642 - RNA, 22 nt, Shigella flexneri 2a str. 301
uaucacgggggaggacguucac

SEQ ID NO: 1964643 - RNA, 14 nt, Shigella flexneri 2a str. 301
uaucagauucgaua

SEQ ID NO: 1964644 - RNA, 19 nt, Shigella flexneri 2a str. 301
uauccgaugaaucaccaca

SEQ ID NO: 1964645 - RNA, 13 nt, Shigella flexneri 2a str. 301
uauccaugcgcau

SEQ ID NO: 1964646 - RNA, 17 nt, Shigella flexneri 2a str. 301
uauacgucccggugaag

SEQ ID NO: 1964647 - RNA, 16 nt, Shigella flexneri 2a str. 301
uauuaaaauucaucaa

SEQ ID NO: 1964648 - RNA, 13 nt, Shigella flexneri 2a str. 301
uaugauugccuga

SEQ ID NO: 1964649 - RNA, 12 nt, Shigella flexneri 2a str. 301
uaugaucgccac

SEQ ID NO: 1964650 - RNA, 21 nt, Shigella flexneri 2a str. 301
uaugccagccccagcgucagc

SEQ ID NO: 1964651 - RNA, 15 nt, Shigella flexneri 2a str. 301
uaucguucugccaga

SEQ ID NO: 1964652 - RNA, 18 nt, Shigella flexneri 2a str. 301
uaucuccagcuauaacgu

SEQ ID NO: 1964653 - RNA, 18 nt, Shigella flexneri 2a str. 301
uaugacguaucaccgaga

SEQ ID NO: 1964654 - RNA, 13 nt, Shigella flexneri 2a str. 301
uaugacuccagcg

SEQ ID NO: 1964655 - RNA, 23 nt, Shigella flexneri 2a str. 301
ucacuaccagcgccaccgguuua

SEQ ID NO: 1964656 - RNA, 20 nt, Shigella flexneri 2a str. 301
ucacguugccguaugcgcca

SEQ ID NO: 1964657 - RNA, 20 nt, Shigella flexneri 2a str. 301
ucacuuucaaauccggccag

SEQ ID NO: 1964658 - RNA, 20 nt, Shigella flexneri 2a str. 301
ucacuuaguagccagacaau

SEQ ID NO: 1964659 - RNA, 17 nt, Shigella flexneri 2a str. 301
aauaaucaacgcggcaa

SEQ ID NO: 1964660 - RNA, 20 nt, Shigella flexneri 2a str. 301
aauaaucaacgcaccgacaa

SEQ ID NO: 1964661 - RNA, 22 nt, Shigella flexneri 2a str. 301
aauaaucaacgcgaaaaugccc

SEQ ID NO: 1964662 - RNA, 16 nt, Shigella flexneri 2a str. 301
ucagaacguaaacgca

SEQ ID NO: 1964663 - RNA, 18 nt, Shigella flexneri 2a str. 301
aauaacuuccugagugaa

SEQ ID NO: 1964664 - RNA, 20 nt, Shigella flexneri 2a str. 301
aauaaccauuccacgggcaa

SEQ ID NO: 1964665 - RNA, 22 nt, Shigella flexneri 2a str. 301
aauaacguaaaaacccgcuucg

SEQ ID NO: 1964666 - RNA, 24 nt, Shigella flexneri 2a str. 301
aauaacugguguaagucggucaca

SEQ ID NO: 1964667 - RNA, 15 nt, Shigella flexneri 2a str. 301
ucacggcacucgcug

SEQ ID NO: 1964668 - RNA, 20 nt, Shigella flexneri 2a str. 301
ucacggcuguagccagcucg

SEQ ID NO: 1964669 - RNA, 15 nt, Shigella flexneri 2a str. 301
aauaacaccagccag

SEQ ID NO: 1964670 - RNA, 19 nt, Shigella flexneri 2a str. 301
ucaccgauguuguugucua

SEQ ID NO: 1964671 - RNA, 20 nt, Shigella flexneri 2a str. 301
ucacaauggcacaaauggca

SEQ ID NO: 1964672 - RNA, 14 nt, Shigella flexneri 2a str. 301
ucacaccagcgaug

SEQ ID NO: 1964673 - RNA, 14 nt, Shigella flexneri 2a str. 301
ucaccgaacucgau

SEQ ID NO: 1964674 - RNA, 19 nt, Shigella flexneri 2a str. 301
ucacgccaauaauggccuu

SEQ ID NO: 1964675 - RNA, 21 nt, Shigella flexneri 2a str. 301
ucacgcagggugugcuccagu

SEQ ID NO: 1964676 - RNA, 15 nt, Shigella flexneri 2a str. 301
ucacgcagcaagccg

SEQ ID NO: 1964677 - RNA, 12 nt, Shigella flexneri 2a str. 301
ucacgaugcuaa

SEQ ID NO: 1964678 - RNA, 17 nt, Shigella flexneri 2a str. 301
ucaccuggagccaguug

SEQ ID NO: 1964679 - RNA, 15 nt, Shigella flexneri 2a str. 301
ucagcuggcguaccg

SEQ ID NO: 1964680 - RNA, 15 nt, Shigella flexneri 2a str. 301
ucagcuggaucgaga

SEQ ID NO: 1964681 - RNA, 12 nt, Shigella flexneri 2a str. 301
ucagcugccagu

SEQ ID NO: 1964682 - RNA, 19 nt, Shigella flexneri 2a str. 301
ucagcucgcuaaagccguu

SEQ ID NO: 1964683 - RNA, 15 nt, Shigella flexneri 2a str. 301
ucagcucgcugccau

SEQ ID NO: 1964684 - RNA, 17 nt, Shigella flexneri 2a str. 301
ucaggaaacccgccagu

SEQ ID NO: 1964685 - RNA, 14 nt, Shigella flexneri 2a str. 301
ucaggaaacugcgc

SEQ ID NO: 1964686 - RNA, 13 nt, Shigella flexneri 2a str. 301
ucaggcacguucc

SEQ ID NO: 1964687 - RNA, 18 nt, Shigella flexneri 2a str. 301
ucaggcaacccagaagaa

SEQ ID NO: 1964688 - RNA, 14 nt, Shigella flexneri 2a str. 301
ucaggauaaacucc

SEQ ID NO: 1964689 - RNA, 15 nt, Shigella flexneri 2a str. 301
ucagcucauccagcg

SEQ ID NO: 1964690 - RNA, 19 nt, Shigella flexneri 2a str. 301
ucagcuaaacagcccaauc

SEQ ID NO: 1964691 - RNA, 22 nt, Shigella flexneri 2a str. 301
ucagcgucuguuuuaucacauc

SEQ ID NO: 1964692 - RNA, 18 nt, Shigella flexneri 2a str. 301
ucagcguuccacgugcgg

SEQ ID NO: 1964693 - RNA, 23 nt, Shigella flexneri 2a str. 301
ucagaucgguuuuuuucgaaccg

SEQ ID NO: 1964694 - RNA, 20 nt, Shigella flexneri 2a str. 301
ucagauaaaugcaaacgcau

SEQ ID NO: 1964695 - RNA, 16 nt, Shigella flexneri 2a str. 301
ucagauaaugcccgau

SEQ ID NO: 1964696 - RNA, 19 nt, Shigella flexneri 2a str. 301
ucagauaaaugcaaacgca

SEQ ID NO: 1964697 - RNA, 13 nt, Shigella flexneri 2a str. 301
ucagcaucucauc

SEQ ID NO: 1964698 - RNA, 19 nt, Shigella flexneri 2a str. 301
ucagcauccauaucgccau

SEQ ID NO: 1964699 - RNA, 22 nt, Shigella flexneri 2a str. 301
ucagaugcggcgugaacgccuu

SEQ ID NO: 1964700 - RNA, 18 nt, Shigella flexneri 2a str. 301
ucagccaucauccauucg

SEQ ID NO: 1964701 - RNA, 15 nt, Shigella flexneri 2a str. 301
ucagcccacccggua

SEQ ID NO: 1964702 - RNA, 14 nt, Shigella flexneri 2a str. 301
ucagccaacgcauu

SEQ ID NO: 1964703 - RNA, 22 nt, Shigella flexneri 2a str. 301
ucagcauuucgcgauauugcug

SEQ ID NO: 1964704 - RNA, 19 nt, Shigella flexneri 2a str. 301
ucagcauuacccagauaau

SEQ ID NO: 1964705 - RNA, 22 nt, Shigella flexneri 2a str. 301
ucagcccgcgauacaccugaug

SEQ ID NO: 1964706 - RNA, 20 nt, Shigella flexneri 2a str. 301
aauaauuuacagccugccag

SEQ ID NO: 1964707 - RNA, 16 nt, Shigella flexneri 2a str. 301
uccagcaacaacagcg

SEQ ID NO: 1964708 - RNA, 22 nt, Shigella flexneri 2a str. 301
uccagauugaucucuaaggcau

SEQ ID NO: 1964709 - RNA, 16 nt, Shigella flexneri 2a str. 301
uccagacucaacaggc

SEQ ID NO: 1964710 - RNA, 20 nt, Shigella flexneri 2a str. 301
uccagccgaccauugccagu

SEQ ID NO: 1964711 - RNA, 15 nt, Shigella flexneri 2a str. 301
uccagcgacuccagu

SEQ ID NO: 1964712 - RNA, 16 nt, Shigella flexneri 2a str. 301
uccacagcaaugcauu

SEQ ID NO: 1964713 - RNA, 19 nt, Shigella flexneri 2a str. 301
uccacuuccaccagcggcu

SEQ ID NO: 1964714 - RNA, 20 nt, Shigella flexneri 2a str. 301
uccacuuccgcgucaaucug

SEQ ID NO: 1964715 - RNA, 14 nt, Shigella flexneri 2a str. 301
uccagguuacgcac

SEQ ID NO: 1964716 - RNA, 12 nt, Shigella flexneri 2a str. 301
uccagcgucagu

SEQ ID NO: 1964717 - RNA, 13 nt, Shigella flexneri 2a str. 301
uccagcgcaaagg

SEQ ID NO: 1964718 - RNA, 13 nt, Shigella flexneri 2a str. 301
uccagugauucca

SEQ ID NO: 1964719 - RNA, 16 nt, Shigella flexneri 2a str. 301
uccauaacggaggcuu

SEQ ID NO: 1964720 - RNA, 16 nt, Shigella flexneri 2a str. 301
uccagucugcuggcga

SEQ ID NO: 1964721 - RNA, 21 nt, Shigella flexneri 2a str. 301
uccagugaaacgcuuuacguu

SEQ ID NO: 1964722 - RNA, 14 nt, Shigella flexneri 2a str. 301
uccauguccagcuu

SEQ ID NO: 1964723 - RNA, 22 nt, Shigella flexneri 2a str. 301
uccaugccgaguggcauuucgc

SEQ ID NO: 1964724 - RNA, 19 nt, Shigella flexneri 2a str. 301
uccaugcacugcaacgccu

SEQ ID NO: 1964725 - RNA, 12 nt, Shigella flexneri 2a str. 301
uccaucaccaga

SEQ ID NO: 1964726 - RNA, 17 nt, Shigella flexneri 2a str. 301
ucaggcauuugcuccag

SEQ ID NO: 1964727 - RNA, 21 nt, Shigella flexneri 2a str. 301
ucaggcaucggugcuggccua

SEQ ID NO: 1964728 - RNA, 21 nt, Shigella flexneri 2a str. 301
ucaggccaggauuacgcucac

SEQ ID NO: 1964729 - RNA, 20 nt, Shigella flexneri 2a str. 301
ucaguuuuucacccgcaauc

SEQ ID NO: 1964730 - RNA, 14 nt, Shigella flexneri 2a str. 301
ucauagugccugau

SEQ ID NO: 1964731 - RNA, 22 nt, Shigella flexneri 2a str. 301
ucaucgcaucgaugguugcccu

SEQ ID NO: 1964732 - RNA, 13 nt, Shigella flexneri 2a str. 301
ucaucgcauccag

SEQ ID NO: 1964733 - RNA, 22 nt, Shigella flexneri 2a str. 301
ucaucgacaaaaacccugccgu

SEQ ID NO: 1964734 - RNA, 17 nt, Shigella flexneri 2a str. 301
ucaucagcgucgguuuc

SEQ ID NO: 1964735 - RNA, 14 nt, Shigella flexneri 2a str. 301
ucaucacugccagg

SEQ ID NO: 1964736 - RNA, 16 nt, Shigella flexneri 2a str. 301
ucauccugcaccgguc

SEQ ID NO: 1964737 - RNA, 22 nt, Shigella flexneri 2a str. 301
ucaucuguugugccacauccag

SEQ ID NO: 1964738 - RNA, 20 nt, Shigella flexneri 2a str. 301
ucaucugauaucucaccaga

SEQ ID NO: 1964739 - RNA, 19 nt, Shigella flexneri 2a str. 301
ucaugguuuauuucccaga

SEQ ID NO: 1964740 - RNA, 14 nt, Shigella flexneri 2a str. 301
ucauuaccagcgag

SEQ ID NO: 1964741 - RNA, 14 nt, Shigella flexneri 2a str. 301
ucauucauccgccg

SEQ ID NO: 1964742 - RNA, 12 nt, Shigella flexneri 2a str. 301
ucauucaccagc

SEQ ID NO: 1964743 - RNA, 12 nt, Shigella flexneri 2a str. 301
ucauucaccagu

SEQ ID NO: 1964744 - RNA, 13 nt, Shigella flexneri 2a str. 301
ucauuucgccuga

SEQ ID NO: 1964745 - RNA, 21 nt, Shigella flexneri 2a str. 301
ucauuggccggaauaccacuu

SEQ ID NO: 1964746 - RNA, 13 nt, Shigella flexneri 2a str. 301
ucauugccgcauc

SEQ ID NO: 1964747 - RNA, 16 nt, Shigella flexneri 2a str. 301
uccaagauuaaaggca

SEQ ID NO: 1964748 - RNA, 20 nt, Shigella flexneri 2a str. 301
uaaaccccuuaucuggccua

SEQ ID NO: 1964749 - RNA, 19 nt, Shigella flexneri 2a str. 301
uaaaccaaucaccgccacu

SEQ ID NO: 1964750 - RNA, 12 nt, Shigella flexneri 2a str. 301
uaaaccaucggc

SEQ ID NO: 1964751 - RNA, 20 nt, Shigella flexneri 2a str. 301
uaaacgccuuauccggcuua

SEQ ID NO: 1964752 - RNA, 20 nt, Shigella flexneri 2a str. 301
uaaacgccuuauccggccua

SEQ ID NO: 1964753 - RNA, 20 nt, Shigella flexneri 2a str. 301
uaaacgccuuauccguccua

SEQ ID NO: 1964754 - RNA, 20 nt, Shigella flexneri 2a str. 301
uaaacgccuuauccgcccua

SEQ ID NO: 1964755 - RNA, 18 nt, Shigella flexneri 2a str. 301
uaaccaguugucgcacau

SEQ ID NO: 1964756 - RNA, 23 nt, Shigella flexneri 2a str. 301
uaaccacgcaaaaucccacugcc

SEQ ID NO: 1964757 - RNA, 14 nt, Shigella flexneri 2a str. 301
uaaccagccuggcg

SEQ ID NO: 1964758 - RNA, 16 nt, Shigella flexneri 2a str. 301
uaacgcuucuggcgua

SEQ ID NO: 1964759 - RNA, 19 nt, Shigella flexneri 2a str. 301
uaacgcguacccagcagcg

SEQ ID NO: 1964760 - RNA, 21 nt, Shigella flexneri 2a str. 301
uaacgcgucuuaucuggccua

SEQ ID NO: 1964761 - RNA, 13 nt, Shigella flexneri 2a str. 301
uaacguaaugcuu

SEQ ID NO: 1964762 - RNA, 21 nt, Shigella flexneri 2a str. 301
uaacgucuaguaaagcagacg

SEQ ID NO: 1964763 - RNA, 14 nt, Shigella flexneri 2a str. 301
uaacgucccccaga

SEQ ID NO: 1964764 - RNA, 20 nt, Shigella flexneri 2a str. 301
uaaccgcgcucagccagccg

SEQ ID NO: 1964765 - RNA, 14 nt, Shigella flexneri 2a str. 301
uaacgccuggcagu

SEQ ID NO: 1964766 - RNA, 19 nt, Shigella flexneri 2a str. 301
uaacgccuuauccggccua

SEQ ID NO: 1964767 - RNA, 16 nt, Shigella flexneri 2a str. 301
uaacgccugcuccagu

SEQ ID NO: 1964768 - RNA, 14 nt, Shigella flexneri 2a str. 301
uaacgccagccugu

SEQ ID NO: 1964769 - RNA, 16 nt, Shigella flexneri 2a str. 301
uaacgccauauugcug

SEQ ID NO: 1964770 - RNA, 22 nt, Shigella flexneri 2a str. 301
uaagcgcacuuugucaucaguc

SEQ ID NO: 1964771 - RNA, 18 nt, Shigella flexneri 2a str. 301
uaagcgauaacgcuggca

SEQ ID NO: 1964772 - RNA, 14 nt, Shigella flexneri 2a str. 301
uaagcgcauccggc

SEQ ID NO: 1964773 - RNA, 14 nt, Shigella flexneri 2a str. 301
uaacugcugcucaa

SEQ ID NO: 1964774 - RNA, 18 nt, Shigella flexneri 2a str. 301
uaacugcuauucaccagc

SEQ ID NO: 1964775 - RNA, 17 nt, Shigella flexneri 2a str. 301
uaacugccggaugcggc

SEQ ID NO: 1964776 - RNA, 21 nt, Shigella flexneri 2a str. 301
uaacucaaaaauaaucaucuc

SEQ ID NO: 1964777 - RNA, 16 nt, Shigella flexneri 2a str. 301
uaacuuacgcgucaga

SEQ ID NO: 1964778 - RNA, 22 nt, Shigella flexneri 2a str. 301
uaagccagaccacccguaaucc

SEQ ID NO: 1964779 - RNA, 19 nt, Shigella flexneri 2a str. 301
uaagcccgguccgcgcagc

SEQ ID NO: 1964780 - RNA, 16 nt, Shigella flexneri 2a str. 301
uaaggucaccaguuca

SEQ ID NO: 1964781 - RNA, 15 nt, Shigella flexneri 2a str. 301
uaauaucuccagcua

SEQ ID NO: 1964782 - RNA, 17 nt, Shigella flexneri 2a str. 301
uaauauccugccguuuu

SEQ ID NO: 1964783 - RNA, 24 nt, Shigella flexneri 2a str. 301
uaaguugccacgcuucaaucugau

SEQ ID NO: 1964784 - RNA, 12 nt, Shigella flexneri 2a str. 301
uaauuuaugccu

SEQ ID NO: 1964785 - RNA, 18 nt, Shigella flexneri 2a str. 301
uaaucaccaucagcagca

SEQ ID NO: 1964786 - RNA, 17 nt, Shigella flexneri 2a str. 301
uaaucaggaacuggaag

SEQ ID NO: 1964787 - RNA, 14 nt, Shigella flexneri 2a str. 301
uaaucagacuggcg

SEQ ID NO: 1964788 - RNA, 22 nt, Shigella flexneri 2a str. 301
uaauguuguaagcuugacauau

SEQ ID NO: 1964789 - RNA, 15 nt, Shigella flexneri 2a str. 301
uacaacgcgcgguga

SEQ ID NO: 1964790 - RNA, 13 nt, Shigella flexneri 2a str. 301
uacaagcggaaac

SEQ ID NO: 1964791 - RNA, 20 nt, Shigella flexneri 2a str. 301
uacaaauuuaucgauaacag

SEQ ID NO: 1964792 - RNA, 23 nt, Shigella flexneri 2a str. 301
uacaauauccagcgcgcgcagca

SEQ ID NO: 1964793 - RNA, 16 nt, Shigella flexneri 2a str. 301
uacaccucucgcccgc

SEQ ID NO: 1964794 - RNA, 18 nt, Shigella flexneri 2a str. 301
uacaccaugccggugaug

SEQ ID NO: 1964795 - RNA, 19 nt, Shigella flexneri 2a str. 301
uacaguauaaguaaugaac

SEQ ID NO: 1964796 - RNA, 22 nt, Shigella flexneri 2a str. 301
uacagcuuagcgccuucuacag

SEQ ID NO: 1964797 - RNA, 15 nt, Shigella flexneri 2a str. 301
uacagauccgccauu

SEQ ID NO: 1964798 - RNA, 20 nt, Shigella flexneri 2a str. 301
uaccacaucaacccgcccag

SEQ ID NO: 1964799 - RNA, 14 nt, Shigella flexneri 2a str. 301
uaccaccgacgugg

SEQ ID NO: 1964800 - RNA, 16 nt, Shigella flexneri 2a str. 301
uaccacucucgggaag

SEQ ID NO: 1964801 - RNA, 14 nt, Shigella flexneri 2a str. 301
uaccaacauacugc

SEQ ID NO: 1964802 - RNA, 12 nt, Shigella flexneri 2a str. 301
uacaucaccgcc

SEQ ID NO: 1964803 - RNA, 20 nt, Shigella flexneri 2a str. 301
uacaucgcgcuuaucgccag

SEQ ID NO: 1964804 - RNA, 21 nt, Shigella flexneri 2a str. 301
uacauugccgggcgcaucaga

SEQ ID NO: 1964805 - RNA, 18 nt, Shigella flexneri 2a str. 301
uacaugaagcacugcauc

SEQ ID NO: 1964806 - RNA, 17 nt, Shigella flexneri 2a str. 301
guugauuuuauaaucaa

SEQ ID NO: 1964807 - RNA, 14 nt, Shigella flexneri 2a str. 301
guugaugcguaccu

SEQ ID NO: 1964808 - RNA, 18 nt, Shigella flexneri 2a str. 301
guugcagcaagccaucgu

SEQ ID NO: 1964809 - RNA, 14 nt, Shigella flexneri 2a str. 301
guugaucgcuuuca

SEQ ID NO: 1964810 - RNA, 14 nt, Shigella flexneri 2a str. 301
guucugucgcucug

SEQ ID NO: 1964811 - RNA, 15 nt, Shigella flexneri 2a str. 301
guucuguugcugaaa

SEQ ID NO: 1964812 - RNA, 22 nt, Shigella flexneri 2a str. 301
guucuuaccggugacagcggug

SEQ ID NO: 1964813 - RNA, 22 nt, Shigella flexneri 2a str. 301
guugcggcuuauucauuacuca

SEQ ID NO: 1964814 - RNA, 18 nt, Shigella flexneri 2a str. 301
guugcauaauuucuucgu

SEQ ID NO: 1964815 - RNA, 12 nt, Shigella flexneri 2a str. 301
guugccagcgcc

SEQ ID NO: 1964816 - RNA, 17 nt, Shigella flexneri 2a str. 301
guugcccagcgcaucag

SEQ ID NO: 1964817 - RNA, 16 nt, Shigella flexneri 2a str. 301
guugccauuucugcug

SEQ ID NO: 1964818 - RNA, 21 nt, Shigella flexneri 2a str. 301
guugcggcugcccaucaucgu

SEQ ID NO: 1964819 - RNA, 20 nt, Shigella flexneri 2a str. 301
guugccgaacguaggcugga

SEQ ID NO: 1964820 - RNA, 15 nt, Shigella flexneri 2a str. 301
uaaaaauccgccaga

SEQ ID NO: 1964821 - RNA, 22 nt, Shigella flexneri 2a str. 301
uaaaaaugaagccuaccgggau

SEQ ID NO: 1964822 - RNA, 20 nt, Shigella flexneri 2a str. 301
uaaaacaggcagcugccaga

SEQ ID NO: 1964823 - RNA, 13 nt, Shigella flexneri 2a str. 301
guuuuccaguuca

SEQ ID NO: 1964824 - RNA, 17 nt, Shigella flexneri 2a str. 301
guuuucgcgcgcaguua

SEQ ID NO: 1964825 - RNA, 13 nt, Shigella flexneri 2a str. 301
guuuucggauuua

SEQ ID NO: 1964826 - RNA, 20 nt, Shigella flexneri 2a str. 301
guuuucaaagguaaugguca

SEQ ID NO: 1964827 - RNA, 20 nt, Shigella flexneri 2a str. 301
guuuucaaugauaaagguca

SEQ ID NO: 1964828 - RNA, 13 nt, Shigella flexneri 2a str. 301
guuuucaagacgc

SEQ ID NO: 1964829 - RNA, 14 nt, Shigella flexneri 2a str. 301
guuuuauauaacgc

SEQ ID NO: 1964830 - RNA, 15 nt, Shigella flexneri 2a str. 301
guuuuacguaaugcu

SEQ ID NO: 1964831 - RNA, 13 nt, Shigella flexneri 2a str. 301
guuuuaauuccua

SEQ ID NO: 1964832 - RNA, 22 nt, Shigella flexneri 2a str. 301
guuuuuguccccucaucaguga

SEQ ID NO: 1964833 - RNA, 23 nt, Shigella flexneri 2a str. 301
guuuuuguuucugaaucucuaag

SEQ ID NO: 1964834 - RNA, 18 nt, Shigella flexneri 2a str. 301
guuuuuccccugccagau

SEQ ID NO: 1964835 - RNA, 16 nt, Shigella flexneri 2a str. 301
guuuugccgccaucau

SEQ ID NO: 1964836 - RNA, 17 nt, Shigella flexneri 2a str. 301
guuugauuauucacaau

SEQ ID NO: 1964837 - RNA, 15 nt, Shigella flexneri 2a str. 301
guuugcaggccugau

SEQ ID NO: 1964838 - RNA, 20 nt, Shigella flexneri 2a str. 301
guuucuggugugcagcguga

SEQ ID NO: 1964839 - RNA, 19 nt, Shigella flexneri 2a str. 301
guuucugauacugcuccgg

SEQ ID NO: 1964840 - RNA, 21 nt, Shigella flexneri 2a str. 301
guuugccuucacaggccgcca

SEQ ID NO: 1964841 - RNA, 14 nt, Shigella flexneri 2a str. 301
guuugucuauuccg

SEQ ID NO: 1964842 - RNA, 21 nt, Shigella flexneri 2a str. 301
guuguaaaaaaccccgcuccg

SEQ ID NO: 1964843 - RNA, 19 nt, Shigella flexneri 2a str. 301
guuucgcuauagacaccuu

SEQ ID NO: 1964844 - RNA, 14 nt, Shigella flexneri 2a str. 301
guuucguucgccgu

SEQ ID NO: 1964845 - RNA, 19 nt, Shigella flexneri 2a str. 301
guucaucugcauuccggug

SEQ ID NO: 1964846 - RNA, 19 nt, Shigella flexneri 2a str. 301
guucauggcgcgacauggc

SEQ ID NO: 1964847 - RNA, 12 nt, Shigella flexneri 2a str. 301
guuccacccagc

SEQ ID NO: 1964848 - RNA, 22 nt, Shigella flexneri 2a str. 301
guuccacaucuaccgccagcca

SEQ ID NO: 1964849 - RNA, 14 nt, Shigella flexneri 2a str. 301
guucaggcgcugca

SEQ ID NO: 1964850 - RNA, 22 nt, Shigella flexneri 2a str. 301
guucaucacaccaguccagcgc

SEQ ID NO: 1964851 - RNA, 17 nt, Shigella flexneri 2a str. 301
guuccugcuuggcgcga

SEQ ID NO: 1964852 - RNA, 11 nt, Shigella flexneri 2a str. 301
guuccgccagc

SEQ ID NO: 1964853 - RNA, 16 nt, Shigella flexneri 2a str. 301
guuccgcgacuaucga

SEQ ID NO: 1964854 - RNA, 13 nt, Shigella flexneri 2a str. 301
guuccgcugcuga

SEQ ID NO: 1964855 - RNA, 19 nt, Shigella flexneri 2a str. 301
guuccagugcguacccagc

SEQ ID NO: 1964856 - RNA, 22 nt, Shigella flexneri 2a str. 301
guuccauaccgucgccagacgc

SEQ ID NO: 1964857 - RNA, 18 nt, Shigella flexneri 2a str. 301
guuccaucagauucagca

SEQ ID NO: 1964858 - RNA, 21 nt, Shigella flexneri 2a str. 301
guucccccugccagaccauuu

SEQ ID NO: 1964859 - RNA, 22 nt, Shigella flexneri 2a str. 301
guuccccuguugugccagacca

SEQ ID NO: 1964860 - RNA, 15 nt, Shigella flexneri 2a str. 301
guguugauuuccaac

SEQ ID NO: 1964861 - RNA, 22 nt, Shigella flexneri 2a str. 301
guguguuugaucacuuccagca

SEQ ID NO: 1964862 - RNA, 21 nt, Shigella flexneri 2a str. 301
guguugcaggaaaagguaggc

SEQ ID NO: 1964863 - RNA, 16 nt, Shigella flexneri 2a str. 301
guguuggcaaucagcg

SEQ ID NO: 1964864 - RNA, 15 nt, Shigella flexneri 2a str. 301
guguuggcgucagac

SEQ ID NO: 1964865 - RNA, 23 nt, Shigella flexneri 2a str. 301
guguuuuccaccgugauccgccg

SEQ ID NO: 1964866 - RNA, 15 nt, Shigella flexneri 2a str. 301
guuagucaucaucag

SEQ ID NO: 1964867 - RNA, 14 nt, Shigella flexneri 2a str. 301
guuaguccacacgc

SEQ ID NO: 1964868 - RNA, 14 nt, Shigella flexneri 2a str. 301
guuaggcacaucaa

SEQ ID NO: 1964869 - RNA, 20 nt, Shigella flexneri 2a str. 301
guucagcgucggcgucaucg

SEQ ID NO: 1964870 - RNA, 18 nt, Shigella flexneri 2a str. 301
guucagccugacagcacg

SEQ ID NO: 1964871 - RNA, 18 nt, Shigella flexneri 2a str. 301
guucacuugcuaccgcga

SEQ ID NO: 1964872 - RNA, 13 nt, Shigella flexneri 2a str. 301
guucagaauggcg

SEQ ID NO: 1964873 - RNA, 18 nt, Shigella flexneri 2a str. 301
guucacgcagcuucucgu

SEQ ID NO: 1964874 - RNA, 20 nt, Shigella flexneri 2a str. 301
guucacgccgcauccggcau

SEQ ID NO: 1964875 - RNA, 15 nt, Shigella flexneri 2a str. 301
gugggcgaaggcgca

SEQ ID NO: 1964876 - RNA, 16 nt, Shigella flexneri 2a str. 301
guggcagggcagcgau

SEQ ID NO: 1964877 - RNA, 14 nt, Shigella flexneri 2a str. 301
guggcagccagcca

SEQ ID NO: 1964878 - RNA, 15 nt, Shigella flexneri 2a str. 301
guggguggucagcgu

SEQ ID NO: 1964879 - RNA, 17 nt, Shigella flexneri 2a str. 301
guggucauaucaauagu

SEQ ID NO: 1964880 - RNA, 23 nt, Shigella flexneri 2a str. 301
guggucaaacggcgcuuccagca

SEQ ID NO: 1964881 - RNA, 15 nt, Shigella flexneri 2a str. 301
gugucaucaucgcgc

SEQ ID NO: 1964882 - RNA, 18 nt, Shigella flexneri 2a str. 301
guggucuuuagacugcca

SEQ ID NO: 1964883 - RNA, 16 nt, Shigella flexneri 2a str. 301
guguggcugcacaccu

SEQ ID NO: 1964884 - RNA, 15 nt, Shigella flexneri 2a str. 301
guguguauacggcaa

SEQ ID NO: 1964885 - RNA, 18 nt, Shigella flexneri 2a str. 301
guggcaaagaaauccaca

SEQ ID NO: 1964886 - RNA, 22 nt, Shigella flexneri 2a str. 301
guggcaaccacaaccgccguug

SEQ ID NO: 1964887 - RNA, 23 nt, Shigella flexneri 2a str. 301
guggcaaagguggccauccgcgu

SEQ ID NO: 1964888 - RNA, 21 nt, Shigella flexneri 2a str. 301
guggacgaacaguucaacgcc

SEQ ID NO: 1964889 - RNA, 17 nt, Shigella flexneri 2a str. 301
guggaauaugcgccaca

SEQ ID NO: 1964890 - RNA, 20 nt, Shigella flexneri 2a str. 301
guggaagcaccuuuacgcca

SEQ ID NO: 1964891 - RNA, 19 nt, Shigella flexneri 2a str. 301
guggaagacguugauucac

SEQ ID NO: 1964892 - RNA, 18 nt, Shigella flexneri 2a str. 301
gugcuuucauuucagcgu

SEQ ID NO: 1964893 - RNA, 13 nt, Shigella flexneri 2a str. 301
gugcuucaccgau

SEQ ID NO: 1964894 - RNA, 13 nt, Shigella flexneri 2a str. 301
gugcgccagcgau

SEQ ID NO: 1964895 - RNA, 22 nt, Shigella flexneri 2a str. 301
gugcguccgguuuacuuccggg

SEQ ID NO: 1964896 - RNA, 14 nt, Shigella flexneri 2a str. 301
gugccugucgggac

SEQ ID NO: 1964897 - RNA, 13 nt, Shigella flexneri 2a str. 301
gugccgucagcag

SEQ ID NO: 1964898 - RNA, 15 nt, Shigella flexneri 2a str. 301
gugccgguuucacgu

SEQ ID NO: 1964899 - RNA, 18 nt, Shigella flexneri 2a str. 301
gugccgguaaagcaauga

SEQ ID NO: 1964900 - RNA, 18 nt, Shigella flexneri 2a str. 301
gugccgcacauagcacca

SEQ ID NO: 1964901 - RNA, 22 nt, Shigella flexneri 2a str. 301
gugcacaauugccggaugcggc

SEQ ID NO: 1964902 - RNA, 14 nt, Shigella flexneri 2a str. 301
gugauaaaacgcag

SEQ ID NO: 1964903 - RNA, 17 nt, Shigella flexneri 2a str. 301
gugauauccaccgcguu

SEQ ID NO: 1964904 - RNA, 20 nt, Shigella flexneri 2a str. 301
gugccagcgauuuugccagc

SEQ ID NO: 1964905 - RNA, 18 nt, Shigella flexneri 2a str. 301
gugccagguaaacaccuu

SEQ ID NO: 1964906 - RNA, 17 nt, Shigella flexneri 2a str. 301
gugccaucauacagccg

SEQ ID NO: 1964907 - RNA, 13 nt, Shigella flexneri 2a str. 301
gugccaucgauaa

SEQ ID NO: 1964908 - RNA, 19 nt, Shigella flexneri 2a str. 301
gugccaugccaaucagcag

SEQ ID NO: 1964909 - RNA, 16 nt, Shigella flexneri 2a str. 301
uggcggagcucccagg

SEQ ID NO: 1964910 - RNA, 20 nt, Shigella flexneri 2a str. 301
uggcaugcuguccagcaggc

SEQ ID NO: 1964911 - RNA, 13 nt, Shigella flexneri 2a str. 301
uggcaucggcaaa

SEQ ID NO: 1964912 - RNA, 14 nt, Shigella flexneri 2a str. 301
uggcaguaucggca

SEQ ID NO: 1964913 - RNA, 22 nt, Shigella flexneri 2a str. 301
uggccuuuuugugcuuaucgcg

SEQ ID NO: 1964914 - RNA, 14 nt, Shigella flexneri 2a str. 301
uggcguuugccacc

SEQ ID NO: 1964915 - RNA, 22 nt, Shigella flexneri 2a str. 301
aauaugcccauguucgcggcuu

SEQ ID NO: 1964916 - RNA, 14 nt, Shigella flexneri 2a str. 301
uggcguugcaccga

SEQ ID NO: 1964917 - RNA, 17 nt, Shigella flexneri 2a str. 301
uggcguuaggcacauca

SEQ ID NO: 1964918 - RNA, 15 nt, Shigella flexneri 2a str. 301
uggcuauguaggcuu

SEQ ID NO: 1964919 - RNA, 18 nt, Shigella flexneri 2a str. 301
uggcucugauugauucag

SEQ ID NO: 1964920 - RNA, 15 nt, Shigella flexneri 2a str. 301
uggcguacccaucaa

SEQ ID NO: 1964921 - RNA, 16 nt, Shigella flexneri 2a str. 301
uggcgugagaucgcgc

SEQ ID NO: 1964922 - RNA, 13 nt, Shigella flexneri 2a str. 301
ugggaacaccgua

SEQ ID NO: 1964923 - RNA, 13 nt, Shigella flexneri 2a str. 301
ugggaauagcggc

SEQ ID NO: 1964924 - RNA, 23 nt, Shigella flexneri 2a str. 301
ugggauucaccaaucggcagaac

SEQ ID NO: 1964925 - RNA, 12 nt, Shigella flexneri 2a str. 301
uggguuuccgga

SEQ ID NO: 1964926 - RNA, 21 nt, Shigella flexneri 2a str. 301
ugguaacagugcaccggacac

SEQ ID NO: 1964927 - RNA, 13 nt, Shigella flexneri 2a str. 301
uggguaacgcacg

SEQ ID NO: 1964928 - RNA, 12 nt, Shigella flexneri 2a str. 301
uggguaacggca

SEQ ID NO: 1964929 - RNA, 16 nt, Shigella flexneri 2a str. 301
ugggccugaaagcuca

SEQ ID NO: 1964930 - RNA, 22 nt, Shigella flexneri 2a str. 301
ugguguuggcaaucagcggcag

SEQ ID NO: 1964931 - RNA, 22 nt, Shigella flexneri 2a str. 301
ugguguaacuuuagucgcccau

SEQ ID NO: 1964932 - RNA, 21 nt, Shigella flexneri 2a str. 301
aaucaaccgcgccugaccauu

SEQ ID NO: 1964933 - RNA, 14 nt, Shigella flexneri 2a str. 301
aaucaacgccgcau

SEQ ID NO: 1964934 - RNA, 19 nt, Shigella flexneri 2a str. 301
aaucaaauagccugccaga

SEQ ID NO: 1964935 - RNA, 21 nt, Shigella flexneri 2a str. 301
aaucaaccauacggucugcca

SEQ ID NO: 1964936 - RNA, 22 nt, Shigella flexneri 2a str. 301
aaucaaauaccaccagcgaaag

SEQ ID NO: 1964937 - RNA, 17 nt, Shigella flexneri 2a str. 301
uggugaugccaucgggc

SEQ ID NO: 1964938 - RNA, 19 nt, Shigella flexneri 2a str. 301
ugucgccacaaacgccaga

SEQ ID NO: 1964939 - RNA, 15 nt, Shigella flexneri 2a str. 301
ugucgaaaccgacag

SEQ ID NO: 1964940 - RNA, 18 nt, Shigella flexneri 2a str. 301
aaucacaauggucaacau

SEQ ID NO: 1964941 - RNA, 18 nt, Shigella flexneri 2a str. 301
aaucacaagaccgcuucc

SEQ ID NO: 1964942 - RNA, 16 nt, Shigella flexneri 2a str. 301
aaucacaauggucaac

SEQ ID NO: 1964943 - RNA, 15 nt, Shigella flexneri 2a str. 301
aaucaccacugccag

SEQ ID NO: 1964944 - RNA, 15 nt, Shigella flexneri 2a str. 301
aaucaaucgccccuu

SEQ ID NO: 1964945 - RNA, 19 nt, Shigella flexneri 2a str. 301
uguaggccugauaagcgua

SEQ ID NO: 1964946 - RNA, 23 nt, Shigella flexneri 2a str. 301
uguaggccggauaaggcguucac

SEQ ID NO: 1964947 - RNA, 19 nt, Shigella flexneri 2a str. 301
uguaggccugauaagacgc

SEQ ID NO: 1964948 - RNA, 20 nt, Shigella flexneri 2a str. 301
aaucaccauauucagcagca

SEQ ID NO: 1964949 - RNA, 16 nt, Shigella flexneri 2a str. 301
aaucaccaucagcagc

SEQ ID NO: 1964950 - RNA, 23 nt, Shigella flexneri 2a str. 301
uguagugcucccaaaacugcuug

SEQ ID NO: 1964951 - RNA, 13 nt, Shigella flexneri 2a str. 301
uguauacggcaac

SEQ ID NO: 1964952 - RNA, 14 nt, Shigella flexneri 2a str. 301
uguauucaugcccu

SEQ ID NO: 1964953 - RNA, 15 nt, Shigella flexneri 2a str. 301
uguauugugcggcgg

SEQ ID NO: 1964954 - RNA, 20 nt, Shigella flexneri 2a str. 301
ugucauaaaucagcgugaug

SEQ ID NO: 1964955 - RNA, 13 nt, Shigella flexneri 2a str. 301
ugucagugcgcga

SEQ ID NO: 1964956 - RNA, 21 nt, Shigella flexneri 2a str. 301
ugucaucgaauaaauugagcu

SEQ ID NO: 1964957 - RNA, 13 nt, Shigella flexneri 2a str. 301
ugucaugauuccg

SEQ ID NO: 1964958 - RNA, 18 nt, Shigella flexneri 2a str. 301
ugucauuaaagccgccaa

SEQ ID NO: 1964959 - RNA, 22 nt, Shigella flexneri 2a str. 301
uguccacgccgcugucuaccag

SEQ ID NO: 1964960 - RNA, 14 nt, Shigella flexneri 2a str. 301
ugcgcgaccacgau

SEQ ID NO: 1964961 - RNA, 18 nt, Shigella flexneri 2a str. 301
ugcgcgacuucauucaga

SEQ ID NO: 1964962 - RNA, 14 nt, Shigella flexneri 2a str. 301
ugcgcauccagcgu

SEQ ID NO: 1964963 - RNA, 20 nt, Shigella flexneri 2a str. 301
ugcgcuacgcuuaucaggcc

SEQ ID NO: 1964964 - RNA, 14 nt, Shigella flexneri 2a str. 301
ugcgcuacgcucau

SEQ ID NO: 1964965 - RNA, 20 nt, Shigella flexneri 2a str. 301
ugcgcuacgcucaucaggcc

SEQ ID NO: 1964966 - RNA, 22 nt, Shigella flexneri 2a str. 301
ugcgcuccgcuuaucaggccua

SEQ ID NO: 1964967 - RNA, 13 nt, Shigella flexneri 2a str. 301
ugcgcggcuccag

SEQ ID NO: 1964968 - RNA, 22 nt, Shigella flexneri 2a str. 301
ugcggaagcaaccggugucauc

SEQ ID NO: 1964969 - RNA, 13 nt, Shigella flexneri 2a str. 301
ugcggcaucgggc

SEQ ID NO: 1964970 - RNA, 22 nt, Shigella flexneri 2a str. 301
ugcggcaggucaucgugcguca

SEQ ID NO: 1964971 - RNA, 20 nt, Shigella flexneri 2a str. 301
ugcggauaaaucauauaucg

SEQ ID NO: 1964972 - RNA, 16 nt, Shigella flexneri 2a str. 301
ugcggauccugcggau

SEQ ID NO: 1964973 - RNA, 19 nt, Shigella flexneri 2a str. 301
ugccguaggcccagccgug

SEQ ID NO: 1964974 - RNA, 15 nt, Shigella flexneri 2a str. 301
ugccgucugggcaaa

SEQ ID NO: 1964975 - RNA, 16 nt, Shigella flexneri 2a str. 301
ugccgugcagcacgga

SEQ ID NO: 1964976 - RNA, 14 nt, Shigella flexneri 2a str. 301
ugccguuggcggcg

SEQ ID NO: 1964977 - RNA, 15 nt, Shigella flexneri 2a str. 301
ugccugaugcggcgu

SEQ ID NO: 1964978 - RNA, 23 nt, Shigella flexneri 2a str. 301
ugccucguuggucagcucaaagc

SEQ ID NO: 1964979 - RNA, 15 nt, Shigella flexneri 2a str. 301
ugcgcaucaaagcca

SEQ ID NO: 1964980 - RNA, 14 nt, Shigella flexneri 2a str. 301
ugcgcagccagcgu

SEQ ID NO: 1964981 - RNA, 17 nt, Shigella flexneri 2a str. 301
ugccuguacggcaguga

SEQ ID NO: 1964982 - RNA, 21 nt, Shigella flexneri 2a str. 301
ugccuguauuccuggccguga

SEQ ID NO: 1964983 - RNA, 13 nt, Shigella flexneri 2a str. 301
ugccugcacucag

SEQ ID NO: 1964984 - RNA, 14 nt, Shigella flexneri 2a str. 301
ugcgagcuuucgac

SEQ ID NO: 1964985 - RNA, 19 nt, Shigella flexneri 2a str. 301
ugcgauaaagcauaccgug

SEQ ID NO: 1964986 - RNA, 15 nt, Shigella flexneri 2a str. 301
uggcaggccagcaau

SEQ ID NO: 1964987 - RNA, 14 nt, Shigella flexneri 2a str. 301
uggcagccagccau

SEQ ID NO: 1964988 - RNA, 19 nt, Shigella flexneri 2a str. 301
uggcagccagccaugcggc

SEQ ID NO: 1964989 - RNA, 19 nt, Shigella flexneri 2a str. 301
uggcacguugcugcggcgu

SEQ ID NO: 1964990 - RNA, 18 nt, Shigella flexneri 2a str. 301
uggcacugggaucagcuu

SEQ ID NO: 1964991 - RNA, 13 nt, Shigella flexneri 2a str. 301
uggcaaucgcggu

SEQ ID NO: 1964992 - RNA, 23 nt, Shigella flexneri 2a str. 301
uggcacauuuuguaggccugaua

SEQ ID NO: 1964993 - RNA, 22 nt, Shigella flexneri 2a str. 301
uggaugcccggauuuggcaaau

SEQ ID NO: 1964994 - RNA, 17 nt, Shigella flexneri 2a str. 301
uggcaaacugaguggag

SEQ ID NO: 1964995 - RNA, 22 nt, Shigella flexneri 2a str. 301
uggcaaagugcaucucaccguu

SEQ ID NO: 1964996 - RNA, 15 nt, Shigella flexneri 2a str. 301
uggcaaccagcagau

SEQ ID NO: 1964997 - RNA, 20 nt, Shigella flexneri 2a str. 301
uggauucucgcaagagcagg

SEQ ID NO: 1964998 - RNA, 22 nt, Shigella flexneri 2a str. 301
uggaugaacuucgcagccguga

SEQ ID NO: 1964999 - RNA, 16 nt, Shigella flexneri 2a str. 301
uggagauaucgccagg

SEQ ID NO: 1965000 - RNA, 12 nt, Shigella flexneri 2a str. 301
uggagugcagca

SEQ ID NO: 1965001 - RNA, 17 nt, Shigella flexneri 2a str. 301
uggagcuaaacagcgcu

SEQ ID NO: 1965002 - RNA, 15 nt, Shigella flexneri 2a str. 301
uggaagacguugauu

SEQ ID NO: 1965003 - RNA, 15 nt, Shigella flexneri 2a str. 301
uggaccagcggguug

SEQ ID NO: 1965004 - RNA, 22 nt, Shigella flexneri 2a str. 301
uggaaucaauaauuaaucuggu

SEQ ID NO: 1965005 - RNA, 11 nt, Shigella flexneri 2a str. 301
uggaaucaccg

SEQ ID NO: 1965006 - RNA, 23 nt, Shigella flexneri 2a str. 301
uggaauaauuccgggcguugauu

SEQ ID NO: 1965007 - RNA, 19 nt, Shigella flexneri 2a str. 301
ugcgucaccacauccagcu

SEQ ID NO: 1965008 - RNA, 14 nt, Shigella flexneri 2a str. 301
ugcgucaguauugg

SEQ ID NO: 1965009 - RNA, 18 nt, Shigella flexneri 2a str. 301
ugcguccaaauagcucaa

SEQ ID NO: 1965010 - RNA, 20 nt, Shigella flexneri 2a str. 301
ugcgugcggcaaauaccgga

SEQ ID NO: 1965011 - RNA, 15 nt, Shigella flexneri 2a str. 301
ugcgugcggcggugg

SEQ ID NO: 1965012 - RNA, 19 nt, Shigella flexneri 2a str. 301
ugcguaccauuaucaccaa

SEQ ID NO: 1965013 - RNA, 15 nt, Shigella flexneri 2a str. 301
ugcguuuguccgccg

SEQ ID NO: 1965014 - RNA, 13 nt, Shigella flexneri 2a str. 301
ugcguuuuccggc

SEQ ID NO: 1965015 - RNA, 19 nt, Shigella flexneri 2a str. 301
ugcguuucauguaacgaug

SEQ ID NO: 1965016 - RNA, 21 nt, Shigella flexneri 2a str. 301
aauauccggcucuuugcgcac

SEQ ID NO: 1965017 - RNA, 15 nt, Shigella flexneri 2a str. 301
ugcugaaccguaggc

SEQ ID NO: 1965018 - RNA, 19 nt, Shigella flexneri 2a str. 301
ugcucaaugccugaugcgc

SEQ ID NO: 1965019 - RNA, 16 nt, Shigella flexneri 2a str. 301
ugcuggcuuacgcuga

SEQ ID NO: 1965020 - RNA, 22 nt, Shigella flexneri 2a str. 301
ugcuggcgcucaccauuuccgg

SEQ ID NO: 1965021 - RNA, 22 nt, Shigella flexneri 2a str. 301
ugcuggcgcaucuuauccggcc

SEQ ID NO: 1965022 - RNA, 19 nt, Shigella flexneri 2a str. 301
ugcugguaauccgagaauc

SEQ ID NO: 1965023 - RNA, 14 nt, Shigella flexneri 2a str. 301
ugcugacgcaaaac

SEQ ID NO: 1965024 - RNA, 13 nt, Shigella flexneri 2a str. 301
ugcugccgccagu

SEQ ID NO: 1965025 - RNA, 18 nt, Shigella flexneri 2a str. 301
uuuuaucugaggcagugc

SEQ ID NO: 1965026 - RNA, 22 nt, Shigella flexneri 2a str. 301
uuucuaucaaggcgauguuccu

SEQ ID NO: 1965027 - RNA, 14 nt, Shigella flexneri 2a str. 301
uuucucauccgcag

SEQ ID NO: 1965028 - RNA, 17 nt, Shigella flexneri 2a str. 301
uuucucauuacagcgac

SEQ ID NO: 1965029 - RNA, 17 nt, Shigella flexneri 2a str. 301
uuuguugcccagcgcau

SEQ ID NO: 1965030 - RNA, 17 nt, Shigella flexneri 2a str. 301
uuuugcagaucgccaau

SEQ ID NO: 1965031 - RNA, 14 nt, Shigella flexneri 2a str. 301
uuuugagcgguaca

SEQ ID NO: 1965032 - RNA, 15 nt, Shigella flexneri 2a str. 301
uuuucagcaccagau

SEQ ID NO: 1965033 - RNA, 17 nt, Shigella flexneri 2a str. 301
uuuucaguccacgguug

SEQ ID NO: 1965034 - RNA, 22 nt, Shigella flexneri 2a str. 301
uuuucaauucucuaaucaggaa

SEQ ID NO: 1965035 - RNA, 19 nt, Shigella flexneri 2a str. 301
uuuucaauuaauugugaag

SEQ ID NO: 1965036 - RNA, 21 nt, Shigella flexneri 2a str. 301
uuuucaagugacauacucuuu

SEQ ID NO: 1965037 - RNA, 21 nt, Shigella flexneri 2a str. 301
uuuucauugaaugcggcaggc

SEQ ID NO: 1965038 - RNA, 15 nt, Shigella flexneri 2a str. 301
uuuucgcuggcagac

SEQ ID NO: 1965039 - RNA, 11 nt, Shigella flexneri 2a str. 301
uuuucgcuggc

SEQ ID NO: 1965040 - RNA, 15 nt, Shigella flexneri 2a str. 301
aaugcaaaaugccgu

SEQ ID NO: 1965041 - RNA, 11 nt, Shigella flexneri 2a str. 301
aaucugccagc

SEQ ID NO: 1965042 - RNA, 15 nt, Shigella flexneri 2a str. 301
aaugcagcggguuaa

SEQ ID NO: 1965043 - RNA, 22 nt, Shigella flexneri 2a str. 301
aaugccaaucuucacaucauca

SEQ ID NO: 1965044 - RNA, 22 nt, Shigella flexneri 2a str. 301
aaugccaguuccgcuaccggau

SEQ ID NO: 1965045 - RNA, 13 nt, Shigella flexneri 2a str. 301
uuuuucgaaccga

SEQ ID NO: 1965046 - RNA, 12 nt, Shigella flexneri 2a str. 301
uuuuuccagcug

SEQ ID NO: 1965047 - RNA, 23 nt, Shigella flexneri 2a str. 301
uuuuuccaacaggcgagaaacgc

SEQ ID NO: 1965048 - RNA, 15 nt, Shigella flexneri 2a str. 301
uuuuguaggccugau

SEQ ID NO: 1965049 - RNA, 16 nt, Shigella flexneri 2a str. 301
aaucucagcccgauga

SEQ ID NO: 1965050 - RNA, 11 nt, Shigella flexneri 2a str. 301
aaucugcaaau

SEQ ID NO: 1965051 - RNA, 17 nt, Shigella flexneri 2a str. 301
aaucugauauuuagcca

SEQ ID NO: 1965052 - RNA, 19 nt, Shigella flexneri 2a str. 301
aaucgccgaaccagugcuc

SEQ ID NO: 1965053 - RNA, 12 nt, Shigella flexneri 2a str. 301
aaucucacuccg

SEQ ID NO: 1965054 - RNA, 15 nt, Shigella flexneri 2a str. 301
aaucucagcccgaug

SEQ ID NO: 1965055 - RNA, 13 nt, Shigella flexneri 2a str. 301
aaugccgucacca

SEQ ID NO: 1965056 - RNA, 19 nt, Shigella flexneri 2a str. 301
aaugccggaugcggcguaa

SEQ ID NO: 1965057 - RNA, 23 nt, Shigella flexneri 2a str. 301
aaugcucugcacguuuugcugau

SEQ ID NO: 1965058 - RNA, 17 nt, Shigella flexneri 2a str. 301
aaugcguuuugagccug

SEQ ID NO: 1965059 - RNA, 14 nt, Shigella flexneri 2a str. 301
aauuaccgcaaagc

SEQ ID NO: 1965060 - RNA, 22 nt, Shigella flexneri 2a str. 301
aauuaccagccagacacuguua

SEQ ID NO: 1965061 - RNA, 18 nt, Shigella flexneri 2a str. 301
aauuccucccguuaugau

SEQ ID NO: 1965062 - RNA, 23 nt, Shigella flexneri 2a str. 301
aauuccggcuuguucaucaccau

SEQ ID NO: 1965063 - RNA, 21 nt, Shigella flexneri 2a str. 301
aauucccgcagcuccagcccg

SEQ ID NO: 1965064 - RNA, 16 nt, Shigella flexneri 2a str. 301
aauucaucaucagcau

SEQ ID NO: 1965065 - RNA, 23 nt, Shigella flexneri 2a str. 301
aauuccaccccuuuacugacugu

SEQ ID NO: 1965066 - RNA, 18 nt, Shigella flexneri 2a str. 301
aauucauacaucgcgcuu

SEQ ID NO: 1965067 - RNA, 14 nt, Shigella flexneri 2a str. 301
aauucacgccgcau

SEQ ID NO: 1965068 - RNA, 20 nt, Shigella flexneri 2a str. 301
aauuaucuuuacugauaauu

SEQ ID NO: 1965069 - RNA, 12 nt, Shigella flexneri 2a str. 301
aauuaugaagug

SEQ ID NO: 1965070 - RNA, 20 nt, Shigella flexneri 2a str. 301
aauugugagaagcgguuaaa

SEQ ID NO: 1965071 - RNA, 14 nt, Shigella flexneri 2a str. 301
aauuguucugcgcu

SEQ ID NO: 1965072 - RNA, 19 nt, Shigella flexneri 2a str. 301
aauuucagguucugaccgg

SEQ ID NO: 1965073 - RNA, 16 nt, Shigella flexneri 2a str. 301
aauuucacaccaucaa

SEQ ID NO: 1965074 - RNA, 19 nt, Shigella flexneri 2a str. 301
aauucgcugaauaccgauu

SEQ ID NO: 1965075 - RNA, 18 nt, Shigella flexneri 2a str. 301
aauucuccagcgccgcau

SEQ ID NO: 1965076 - RNA, 18 nt, Shigella flexneri 2a str. 301
aauucucuauuucacccg

SEQ ID NO: 1965077 - RNA, 22 nt, Shigella flexneri 2a str. 301
aauugaagaguuugaucauggc

SEQ ID NO: 1965078 - RNA, 14 nt, Shigella flexneri 2a str. 301
aauugaaucacgac

SEQ ID NO: 1965079 - RNA, 19 nt, Shigella flexneri 2a str. 301
aauugauucacauccggcc

SEQ ID NO: 1965080 - RNA, 21 nt, Shigella flexneri 2a str. 301
aauugccauuucuggcgucaa

SEQ ID NO: 1965081 - RNA, 19 nt, Shigella flexneri 2a str. 301
aauugccccccauaacgca

SEQ ID NO: 1965082 - RNA, 19 nt, Shigella flexneri 2a str. 301
aauugccaccauccgcuca

SEQ ID NO: 1965083 - RNA, 14 nt, Shigella flexneri 2a str. 301
aauugcgucaguau

SEQ ID NO: 1965084 - RNA, 17 nt, Shigella flexneri 2a str. 301
aauuggaguaucaccau

SEQ ID NO: 1965085 - RNA, 21 nt, Shigella flexneri 2a str. 301
uugcugccuucacggcuuugu

SEQ ID NO: 1965086 - RNA, 21 nt, Shigella flexneri 2a str. 301
uugcugcgacgcaaacgacga

SEQ ID NO: 1965087 - RNA, 15 nt, Shigella flexneri 2a str. 301
uugcuggacuugaac

SEQ ID NO: 1965088 - RNA, 23 nt, Shigella flexneri 2a str. 301
uugcggcuuuugaagcugaacgu

SEQ ID NO: 1965089 - RNA, 19 nt, Shigella flexneri 2a str. 301
uugcgugguuuuugcugac

SEQ ID NO: 1965090 - RNA, 13 nt, Shigella flexneri 2a str. 301
uugcguuucugac

SEQ ID NO: 1965091 - RNA, 18 nt, Shigella flexneri 2a str. 301
uugcgcuuuucuaccacc

SEQ ID NO: 1965092 - RNA, 15 nt, Shigella flexneri 2a str. 301
uugcgcugaaguaau

SEQ ID NO: 1965093 - RNA, 16 nt, Shigella flexneri 2a str. 301
uugaucacuuccagca

SEQ ID NO: 1965094 - RNA, 21 nt, Shigella flexneri 2a str. 301
uugaucacuuccagcaguucg

SEQ ID NO: 1965095 - RNA, 19 nt, Shigella flexneri 2a str. 301
uugcgcaacggugcggcuc

SEQ ID NO: 1965096 - RNA, 17 nt, Shigella flexneri 2a str. 301
uuggaucugauccaaca

SEQ ID NO: 1965097 - RNA, 13 nt, Shigella flexneri 2a str. 301
uugcuucgccagu

SEQ ID NO: 1965098 - RNA, 16 nt, Shigella flexneri 2a str. 301
aauccgggucuguaaa

SEQ ID NO: 1965099 - RNA, 16 nt, Shigella flexneri 2a str. 301
aauccggugccuuacc

SEQ ID NO: 1965100 - RNA, 18 nt, Shigella flexneri 2a str. 301
uugggauucagugguagc

SEQ ID NO: 1965101 - RNA, 20 nt, Shigella flexneri 2a str. 301
uuguuaaugugacagagcca

SEQ ID NO: 1965102 - RNA, 14 nt, Shigella flexneri 2a str. 301
uuguuaucccucaa

SEQ ID NO: 1965103 - RNA, 12 nt, Shigella flexneri 2a str. 301
uuguucuuccgg

SEQ ID NO: 1965104 - RNA, 22 nt, Shigella flexneri 2a str. 301
uuguuucaacacaggauacgca

SEQ ID NO: 1965105 - RNA, 14 nt, Shigella flexneri 2a str. 301
uuuaaccguggugc

SEQ ID NO: 1965106 - RNA, 23 nt, Shigella flexneri 2a str. 301
uuuaacucaccgaugaucgccau

SEQ ID NO: 1965107 - RNA, 19 nt, Shigella flexneri 2a str. 301
uuguaggcggauaaggcgu

SEQ ID NO: 1965108 - RNA, 20 nt, Shigella flexneri 2a str. 301
uuguaggucggauaaggcgu

SEQ ID NO: 1965109 - RNA, 19 nt, Shigella flexneri 2a str. 301
uuguaggccugauaagcgu

SEQ ID NO: 1965110 - RNA, 19 nt, Shigella flexneri 2a str. 301
uuguaggccggauaagcgu

SEQ ID NO: 1965111 - RNA, 20 nt, Shigella flexneri 2a str. 301
uuguaggcaggauaaggcgu

SEQ ID NO: 1965112 - RNA, 15 nt, Shigella flexneri 2a str. 301
aauccugccagcgug

SEQ ID NO: 1965113 - RNA, 19 nt, Shigella flexneri 2a str. 301
uuuaggcacaguagcccac

SEQ ID NO: 1965114 - RNA, 18 nt, Shigella flexneri 2a str. 301
uuuacguucuuacauucc

SEQ ID NO: 1965115 - RNA, 20 nt, Shigella flexneri 2a str. 301
uuuacgggccggauacgcca

SEQ ID NO: 1965116 - RNA, 14 nt, Shigella flexneri 2a str. 301
uuuacgccgcaucc

SEQ ID NO: 1965117 - RNA, 21 nt, Shigella flexneri 2a str. 301
uuuaauguccuggcgggaaua

SEQ ID NO: 1965118 - RNA, 18 nt, Shigella flexneri 2a str. 301
uuuccaagcgcggcaggc

SEQ ID NO: 1965119 - RNA, 15 nt, Shigella flexneri 2a str. 301
uuuccuuccuuggau

SEQ ID NO: 1965120 - RNA, 18 nt, Shigella flexneri 2a str. 301
uuuccuuaacuccucgcc

SEQ ID NO: 1965121 - RNA, 15 nt, Shigella flexneri 2a str. 301
uuucgccagcucaac

SEQ ID NO: 1965122 - RNA, 23 nt, Shigella flexneri 2a str. 301
uuucguagacugcagcggucaca

SEQ ID NO: 1965123 - RNA, 17 nt, Shigella flexneri 2a str. 301
uuucaggaacaccgcac

SEQ ID NO: 1965124 - RNA, 17 nt, Shigella flexneri 2a str. 301
uuucaugccauccgcau

SEQ ID NO: 1965125 - RNA, 17 nt, Shigella flexneri 2a str. 301
uuucauuguccgucuga

SEQ ID NO: 1965126 - RNA, 21 nt, Shigella flexneri 2a str. 301
uuucaucagcacaaaucggca

SEQ ID NO: 1965127 - RNA, 18 nt, Shigella flexneri 2a str. 301
uuucaauuaucaccgcac

SEQ ID NO: 1965128 - RNA, 15 nt, Shigella flexneri 2a str. 301
uuucaaugcucugca

SEQ ID NO: 1965129 - RNA, 20 nt, Shigella flexneri 2a str. 301
uuuaucugucuguacggcag

SEQ ID NO: 1965130 - RNA, 13 nt, Shigella flexneri 2a str. 301
uuuaucgagaaua

SEQ ID NO: 1965131 - RNA, 12 nt, Shigella flexneri 2a str. 301
uuuauccagcca

SEQ ID NO: 1965132 - RNA, 18 nt, Shigella flexneri 2a str. 301
uuuaucuucccagcgcag

SEQ ID NO: 1965133 - RNA, 17 nt, Shigella flexneri 2a str. 301
uuccuuaacauccaucg

SEQ ID NO: 1965134 - RNA, 23 nt, Shigella flexneri 2a str. 301
uucgccaccguguucaugaccgu

SEQ ID NO: 1965135 - RNA, 17 nt, Shigella flexneri 2a str. 301
uucggccauauccagcc

SEQ ID NO: 1965136 - RNA, 20 nt, Shigella flexneri 2a str. 301
uucggcaucacgaauccgca

SEQ ID NO: 1965137 - RNA, 15 nt, Shigella flexneri 2a str. 301
uucgcgaaucgccac

SEQ ID NO: 1965138 - RNA, 23 nt, Shigella flexneri 2a str. 301
uucgcuaagauaccccagcgcaa

SEQ ID NO: 1965139 - RNA, 18 nt, Shigella flexneri 2a str. 301
uucgcuaaaaaaugacgu

SEQ ID NO: 1965140 - RNA, 19 nt, Shigella flexneri 2a str. 301
uucauauaauuccacgcca

SEQ ID NO: 1965141 - RNA, 17 nt, Shigella flexneri 2a str. 301
uucauagauagccagca

SEQ ID NO: 1965142 - RNA, 14 nt, Shigella flexneri 2a str. 301
uucaguacguucac

SEQ ID NO: 1965143 - RNA, 17 nt, Shigella flexneri 2a str. 301
uucagugccucguucac

SEQ ID NO: 1965144 - RNA, 12 nt, Shigella flexneri 2a str. 301
uuccccagacga

SEQ ID NO: 1965145 - RNA, 14 nt, Shigella flexneri 2a str. 301
uuccggacguucag

SEQ ID NO: 1965146 - RNA, 15 nt, Shigella flexneri 2a str. 301
uucccgcagcuccag

SEQ ID NO: 1965147 - RNA, 19 nt, Shigella flexneri 2a str. 301
uuccggcaucacaucgcug

SEQ ID NO: 1965148 - RNA, 17 nt, Shigella flexneri 2a str. 301
uuccuggucggcaaacu

SEQ ID NO: 1965149 - RNA, 22 nt, Shigella flexneri 2a str. 301
uuccugcggcagacgcucgcca

SEQ ID NO: 1965150 - RNA, 15 nt, Shigella flexneri 2a str. 301
uuccgucagcaaagu

SEQ ID NO: 1965151 - RNA, 13 nt, Shigella flexneri 2a str. 301
uuccguaccagcc

SEQ ID NO: 1965152 - RNA, 14 nt, Shigella flexneri 2a str. 301
uuccguaccagccu

SEQ ID NO: 1965153 - RNA, 18 nt, Shigella flexneri 2a str. 301
uuccgugacuuccagcgu

SEQ ID NO: 1965154 - RNA, 14 nt, Shigella flexneri 2a str. 301
uuccgucccagccu

SEQ ID NO: 1965155 - RNA, 24 nt, Shigella flexneri 2a str. 301
uuccuaucgaugaaccguucgcug

SEQ ID NO: 1965156 - RNA, 23 nt, Shigella flexneri 2a str. 301
uucuuugcgcccccgauccagcg

SEQ ID NO: 1965157 - RNA, 13 nt, Shigella flexneri 2a str. 301
uucuuucgcccaa

SEQ ID NO: 1965158 - RNA, 18 nt, Shigella flexneri 2a str. 301
uugaaaaaccagacgaua

SEQ ID NO: 1965159 - RNA, 23 nt, Shigella flexneri 2a str. 301
uugaaacgauggugccgguacgc

SEQ ID NO: 1965160 - RNA, 14 nt, Shigella flexneri 2a str. 301
uucugccagcugcu

SEQ ID NO: 1965161 - RNA, 18 nt, Shigella flexneri 2a str. 301
uucgguaaccauccauuc

SEQ ID NO: 1965162 - RNA, 17 nt, Shigella flexneri 2a str. 301
aaucagcuuuggugaaa

SEQ ID NO: 1965163 - RNA, 21 nt, Shigella flexneri 2a str. 301
uugagaacgacagugacuucc

SEQ ID NO: 1965164 - RNA, 15 nt, Shigella flexneri 2a str. 301
uugacuggaugccag

SEQ ID NO: 1965165 - RNA, 15 nt, Shigella flexneri 2a str. 301
uugacuacaccauua

SEQ ID NO: 1965166 - RNA, 16 nt, Shigella flexneri 2a str. 301
uugagauagccuucgg

SEQ ID NO: 1965167 - RNA, 17 nt, Shigella flexneri 2a str. 301
uugagguguacuggcaa

SEQ ID NO: 1965168 - RNA, 12 nt, Shigella flexneri 2a str. 301
uugauauccgca

SEQ ID NO: 1965169 - RNA, 16 nt, Shigella flexneri 2a str. 301
uugauaaccacggcgc

SEQ ID NO: 1965170 - RNA, 19 nt, Shigella flexneri 2a str. 301
uugacaagcucaccucuuu

SEQ ID NO: 1965171 - RNA, 21 nt, Shigella flexneri 2a str. 301
uugacgagauagcgaaguaga

SEQ ID NO: 1965172 - RNA, 16 nt, Shigella flexneri 2a str. 301
uugaagaguuugauca

SEQ ID NO: 1965173 - RNA, 20 nt, Shigella flexneri 2a str. 301
uugaagcaauccauaccagc

SEQ ID NO: 1965174 - RNA, 21 nt, Shigella flexneri 2a str. 301
uugaagcccaguaccgccagu

SEQ ID NO: 1965175 - RNA, 21 nt, Shigella flexneri 2a str. 301
uugaagcaauccauaccagca

SEQ ID NO: 1965176 - RNA, 19 nt, Shigella flexneri 2a str. 301
uugacaacucaucacugua

SEQ ID NO: 1965177 - RNA, 15 nt, Shigella flexneri 2a str. 301
uucaacagucgccac

SEQ ID NO: 1965178 - RNA, 13 nt, Shigella flexneri 2a str. 301
uucaaccagccga

SEQ ID NO: 1965179 - RNA, 15 nt, Shigella flexneri 2a str. 301
uucaaauuacgaucc

SEQ ID NO: 1965180 - RNA, 19 nt, Shigella flexneri 2a str. 301
uucaacguacucugccacu

SEQ ID NO: 1965181 - RNA, 16 nt, Shigella flexneri 2a str. 301
uuauuuacucuccugc

SEQ ID NO: 1965182 - RNA, 12 nt, Shigella flexneri 2a str. 301
uuauuucgcugc

SEQ ID NO: 1965183 - RNA, 18 nt, Shigella flexneri 2a str. 301
uucaccauaaaacgcgcu

SEQ ID NO: 1965184 - RNA, 18 nt, Shigella flexneri 2a str. 301
uucaccgcaucgucacug

SEQ ID NO: 1965185 - RNA, 13 nt, Shigella flexneri 2a str. 301
uucaccgacguga

SEQ ID NO: 1965186 - RNA, 16 nt, Shigella flexneri 2a str. 301
uucaccgauauccgcc

SEQ ID NO: 1965187 - RNA, 12 nt, Shigella flexneri 2a str. 301
uucaccggugag

SEQ ID NO: 1965188 - RNA, 15 nt, Shigella flexneri 2a str. 301
uucagccaacgcauu

SEQ ID NO: 1965189 - RNA, 21 nt, Shigella flexneri 2a str. 301
uucagccccagcacuucgcug

SEQ ID NO: 1965190 - RNA, 23 nt, Shigella flexneri 2a str. 301
uucagccccagcacuucgcuggu

SEQ ID NO: 1965191 - RNA, 16 nt, Shigella flexneri 2a str. 301
uucagccugaccgcac

SEQ ID NO: 1965192 - RNA, 15 nt, Shigella flexneri 2a str. 301
uucagcgcgacgcuc

SEQ ID NO: 1965193 - RNA, 14 nt, Shigella flexneri 2a str. 301
uucagcggcacugu

SEQ ID NO: 1965194 - RNA, 19 nt, Shigella flexneri 2a str. 301
uuauuaaccuggucgcuga

SEQ ID NO: 1965195 - RNA, 19 nt, Shigella flexneri 2a str. 301
uuaugcagugcauccagca

SEQ ID NO: 1965196 - RNA, 18 nt, Shigella flexneri 2a str. 301
uuaugcaauagcgccugc

SEQ ID NO: 1965197 - RNA, 22 nt, Shigella flexneri 2a str. 301
uuaugccgaucaucauccagca

SEQ ID NO: 1965198 - RNA, 17 nt, Shigella flexneri 2a str. 301
uuaucguaaugcucgac

SEQ ID NO: 1965199 - RNA, 11 nt, Shigella flexneri 2a str. 301
uuauccggcua

SEQ ID NO: 1965200 - RNA, 15 nt, Shigella flexneri 2a str. 301
uuauccgccagcgcc

SEQ ID NO: 1965201 - RNA, 22 nt, Shigella flexneri 2a str. 301
uuaucgcccugcuccagcaacu

SEQ ID NO: 1965202 - RNA, 15 nt, Shigella flexneri 2a str. 301
uuaccgaucgccagc

SEQ ID NO: 1965203 - RNA, 20 nt, Shigella flexneri 2a str. 301
uuaccgcaccaccagcagcu

SEQ ID NO: 1965204 - RNA, 21 nt, Shigella flexneri 2a str. 301
uuaccgcgccauguugccugg

SEQ ID NO: 1965205 - RNA, 12 nt, Shigella flexneri 2a str. 301
uuaccggucagg

SEQ ID NO: 1965206 - RNA, 18 nt, Shigella flexneri 2a str. 301
uuauauauuaaucaucau

SEQ ID NO: 1965207 - RNA, 16 nt, Shigella flexneri 2a str. 301
uuacuguacagauccg

SEQ ID NO: 1965208 - RNA, 12 nt, Shigella flexneri 2a str. 301
uguuccgccagc

SEQ ID NO: 1965209 - RNA, 15 nt, Shigella flexneri 2a str. 301
uguuccggcggcagg

SEQ ID NO: 1965210 - RNA, 15 nt, Shigella flexneri 2a str. 301
uguuuaaccgcuuca

SEQ ID NO: 1965211 - RNA, 21 nt, Shigella flexneri 2a str. 301
uguuaaaugauaccgggcugu

SEQ ID NO: 1965212 - RNA, 16 nt, Shigella flexneri 2a str. 301
uguguaggccagcgau

SEQ ID NO: 1965213 - RNA, 15 nt, Shigella flexneri 2a str. 301
ugugucagcgccaga

SEQ ID NO: 1965214 - RNA, 20 nt, Shigella flexneri 2a str. 301
uguguugcugaacuuaugca

SEQ ID NO: 1965215 - RNA, 15 nt, Shigella flexneri 2a str. 301
ugucggaugcggcgu

SEQ ID NO: 1965216 - RNA, 11 nt, Shigella flexneri 2a str. 301
uuaaaagcgcg

SEQ ID NO: 1965217 - RNA, 14 nt, Shigella flexneri 2a str. 301
uuaacgaaagcgcc

SEQ ID NO: 1965218 - RNA, 21 nt, Shigella flexneri 2a str. 301
uuaacgguaucuuuccagccc

SEQ ID NO: 1965219 - RNA, 19 nt, Shigella flexneri 2a str. 301
uuaacguaaguuagaggca

SEQ ID NO: 1965220 - RNA, 18 nt, Shigella flexneri 2a str. 301
uguuuauuuauacaguga

SEQ ID NO: 1965221 - RNA, 11 nt, Shigella flexneri 2a str. 301
uguuuaugccc

SEQ ID NO: 1965222 - RNA, 22 nt, Shigella flexneri 2a str. 301
uuaagcacuggcggcagcaggu

SEQ ID NO: 1965223 - RNA, 20 nt, Shigella flexneri 2a str. 301
uuaagcccaguucagcggcu

SEQ ID NO: 1965224 - RNA, 22 nt, Shigella flexneri 2a str. 301
uuaagauaacguugaugcaggc

SEQ ID NO: 1965225 - RNA, 20 nt, Shigella flexneri 2a str. 301
uuaauggcagauaauccaga

SEQ ID NO: 1965226 - RNA, 14 nt, Shigella flexneri 2a str. 301
uuaauuaacgcguu

SEQ ID NO: 1965227 - RNA, 20 nt, Shigella flexneri 2a str. 301
uuaaugcgcuuccugcagcu

SEQ ID NO: 1965228 - RNA, 15 nt, Shigella flexneri 2a str. 301
acgcgggcagcagaa

SEQ ID NO: 1965229 - RNA, 20 nt, Shigella flexneri 2a str. 301
acgcggguaaguacgccauc

SEQ ID NO: 1965230 - RNA, 22 nt, Shigella flexneri 2a str. 301
acgcggucaauggucagcgcca

SEQ ID NO: 1965231 - RNA, 20 nt, Shigella flexneri 2a str. 301
acgcgguauggucacgguga

SEQ ID NO: 1965232 - RNA, 23 nt, Shigella flexneri 2a str. 301
acgcggaaaagguuaaaccgcca

SEQ ID NO: 1965233 - RNA, 13 nt, Shigella flexneri 2a str. 301
acgcgaccgccgc

SEQ ID NO: 1965234 - RNA, 23 nt, Shigella flexneri 2a str. 301
acgccuuguuccugcuuggcgcg

SEQ ID NO: 1965235 - RNA, 24 nt, Shigella flexneri 2a str. 301
acgccugcauccgccauccaccag

SEQ ID NO: 1965236 - RNA, 15 nt, Shigella flexneri 2a str. 301
acgccggugaccauc

SEQ ID NO: 1965237 - RNA, 20 nt, Shigella flexneri 2a str. 301
acgccgccggaaguauuuca

SEQ ID NO: 1965238 - RNA, 21 nt, Shigella flexneri 2a str. 301
acgcguaaagcgucgcaucag

SEQ ID NO: 1965239 - RNA, 15 nt, Shigella flexneri 2a str. 301
acgcgguugccagau

SEQ ID NO: 1965240 - RNA, 21 nt, Shigella flexneri 2a str. 301
acgcgucaagcgucgcaucag

SEQ ID NO: 1965241 - RNA, 22 nt, Shigella flexneri 2a str. 301
acgcgucuuaucaggccuacaa

SEQ ID NO: 1965242 - RNA, 22 nt, Shigella flexneri 2a str. 301
acgcgucuuaucaggccuacag

SEQ ID NO: 1965243 - RNA, 14 nt, Shigella flexneri 2a str. 301
acgcgucuuaucug

SEQ ID NO: 1965244 - RNA, 17 nt, Shigella flexneri 2a str. 301
acgcgucuuaucaggcc

SEQ ID NO: 1965245 - RNA, 14 nt, Shigella flexneri 2a str. 301
acgcguuaauaccu

SEQ ID NO: 1965246 - RNA, 23 nt, Shigella flexneri 2a str. 301
acgcguucgcaaagguuuuaccg

SEQ ID NO: 1965247 - RNA, 15 nt, Shigella flexneri 2a str. 301
acgcucacugcaaaa

SEQ ID NO: 1965248 - RNA, 15 nt, Shigella flexneri 2a str. 301
acgcucacgcgcugc

SEQ ID NO: 1965249 - RNA, 15 nt, Shigella flexneri 2a str. 301
acgcuacuggacauu

SEQ ID NO: 1965250 - RNA, 16 nt, Shigella flexneri 2a str. 301
acgcuaccggacaguu

SEQ ID NO: 1965251 - RNA, 15 nt, Shigella flexneri 2a str. 301
acgcguuuuucagaa

SEQ ID NO: 1965252 - RNA, 19 nt, Shigella flexneri 2a str. 301
acgcuaauuuugccaucag

SEQ ID NO: 1965253 - RNA, 22 nt, Shigella flexneri 2a str. 301
acgcucggcaacaccucagcca

SEQ ID NO: 1965254 - RNA, 19 nt, Shigella flexneri 2a str. 301
acgcucgccauuuuucaga

SEQ ID NO: 1965255 - RNA, 15 nt, Shigella flexneri 2a str. 301
acggaauaaccagcg

SEQ ID NO: 1965256 - RNA, 13 nt, Shigella flexneri 2a str. 301
acggacgaccgau

SEQ ID NO: 1965257 - RNA, 17 nt, Shigella flexneri 2a str. 301
acgcuuugcugauugcu

SEQ ID NO: 1965258 - RNA, 18 nt, Shigella flexneri 2a str. 301
acgcuguagccgccgucg

SEQ ID NO: 1965259 - RNA, 19 nt, Shigella flexneri 2a str. 301
acgcugggcgaucgccuga

SEQ ID NO: 1965260 - RNA, 19 nt, Shigella flexneri 2a str. 301
acgcugauauuucggcauu

SEQ ID NO: 1965261 - RNA, 20 nt, Shigella flexneri 2a str. 301
acgcugauuaaagacggcgg

SEQ ID NO: 1965262 - RNA, 15 nt, Shigella flexneri 2a str. 301
acgcugcaucgccaa

SEQ ID NO: 1965263 - RNA, 21 nt, Shigella flexneri 2a str. 301
acgcucggcuguuucuggaug

SEQ ID NO: 1965264 - RNA, 14 nt, Shigella flexneri 2a str. 301
acgcagcgguauaa

SEQ ID NO: 1965265 - RNA, 18 nt, Shigella flexneri 2a str. 301
acgcagcgguauaaucug

SEQ ID NO: 1965266 - RNA, 19 nt, Shigella flexneri 2a str. 301
acgcacuuccggugccggu

SEQ ID NO: 1965267 - RNA, 12 nt, Shigella flexneri 2a str. 301
acgcacggcgua

SEQ ID NO: 1965268 - RNA, 19 nt, Shigella flexneri 2a str. 301
acgcaaacaccagcgaaug

SEQ ID NO: 1965269 - RNA, 22 nt, Shigella flexneri 2a str. 301
acgauauuuuuccggcaguucu

SEQ ID NO: 1965270 - RNA, 22 nt, Shigella flexneri 2a str. 301
acgauagauagagaaguaaccg

SEQ ID NO: 1965271 - RNA, 17 nt, Shigella flexneri 2a str. 301
acgaucccagcguggag

SEQ ID NO: 1965272 - RNA, 16 nt, Shigella flexneri 2a str. 301
acgaucagccauaccg

SEQ ID NO: 1965273 - RNA, 18 nt, Shigella flexneri 2a str. 301
acgaugccugcaaugccg

SEQ ID NO: 1965274 - RNA, 16 nt, Shigella flexneri 2a str. 301
acgaucgcccagacca

SEQ ID NO: 1965275 - RNA, 23 nt, Shigella flexneri 2a str. 301
acgaucgccugguaccagcaccg

SEQ ID NO: 1965276 - RNA, 14 nt, Shigella flexneri 2a str. 301
acgccccagauugc

SEQ ID NO: 1965277 - RNA, 13 nt, Shigella flexneri 2a str. 301
acgccccggccuu

SEQ ID NO: 1965278 - RNA, 18 nt, Shigella flexneri 2a str. 301
acgcccuacaaggaacgg

SEQ ID NO: 1965279 - RNA, 17 nt, Shigella flexneri 2a str. 301
acgccauaccugcacaa

SEQ ID NO: 1965280 - RNA, 12 nt, Shigella flexneri 2a str. 301
acgccaguuuaa

SEQ ID NO: 1965281 - RNA, 17 nt, Shigella flexneri 2a str. 301
acgcccagcgcuuaccc

SEQ ID NO: 1965282 - RNA, 18 nt, Shigella flexneri 2a str. 301
acgcaggccacgaaucag

SEQ ID NO: 1965283 - RNA, 17 nt, Shigella flexneri 2a str. 301
acgcagcgucagcacca

SEQ ID NO: 1965284 - RNA, 21 nt, Shigella flexneri 2a str. 301
acgcagggaguuaccgugugc

SEQ ID NO: 1965285 - RNA, 17 nt, Shigella flexneri 2a str. 301
acgcaucuucuccggcc

SEQ ID NO: 1965286 - RNA, 21 nt, Shigella flexneri 2a str. 301
acgaaacgccggugaccauca

SEQ ID NO: 1965287 - RNA, 15 nt, Shigella flexneri 2a str. 301
acgaaaacagcgcag

SEQ ID NO: 1965288 - RNA, 15 nt, Shigella flexneri 2a str. 301
accuuugaacugcug

SEQ ID NO: 1965289 - RNA, 22 nt, Shigella flexneri 2a str. 301
accuugccagugaaaguuuuca

SEQ ID NO: 1965290 - RNA, 14 nt, Shigella flexneri 2a str. 301
accugucgcgucga

SEQ ID NO: 1965291 - RNA, 16 nt, Shigella flexneri 2a str. 301
accuucccgucuacaa

SEQ ID NO: 1965292 - RNA, 20 nt, Shigella flexneri 2a str. 301
accuucguuauauccaggca

SEQ ID NO: 1965293 - RNA, 16 nt, Shigella flexneri 2a str. 301
accuggugcagcggcu

SEQ ID NO: 1965294 - RNA, 12 nt, Shigella flexneri 2a str. 301
accuggucgcug

SEQ ID NO: 1965295 - RNA, 22 nt, Shigella flexneri 2a str. 301
accguuugccccggcugcgcga

SEQ ID NO: 1965296 - RNA, 17 nt, Shigella flexneri 2a str. 301
accguuucgcagucgcc

SEQ ID NO: 1965297 - RNA, 12 nt, Shigella flexneri 2a str. 301
accguugccaac

SEQ ID NO: 1965298 - RNA, 12 nt, Shigella flexneri 2a str. 301
accguuggcgcu

SEQ ID NO: 1965299 - RNA, 14 nt, Shigella flexneri 2a str. 301
accguuggccugau

SEQ ID NO: 1965300 - RNA, 15 nt, Shigella flexneri 2a str. 301
accguuggccugaua

SEQ ID NO: 1965301 - RNA, 21 nt, Shigella flexneri 2a str. 301
acgagaaaugucggcccgcau

SEQ ID NO: 1965302 - RNA, 12 nt, Shigella flexneri 2a str. 301
acgauaccgccg

SEQ ID NO: 1965303 - RNA, 18 nt, Shigella flexneri 2a str. 301
acgauacagaagcaccgu

SEQ ID NO: 1965304 - RNA, 18 nt, Shigella flexneri 2a str. 301
acgauacggcccagaccc

SEQ ID NO: 1965305 - RNA, 20 nt, Shigella flexneri 2a str. 301
acgauaauuaggauacuuau

SEQ ID NO: 1965306 - RNA, 19 nt, Shigella flexneri 2a str. 301
acgagguccuuuugccgcc

SEQ ID NO: 1965307 - RNA, 23 nt, Shigella flexneri 2a str. 301
acgaaggucgaggcaauccguaa

SEQ ID NO: 1965308 - RNA, 14 nt, Shigella flexneri 2a str. 301
acgaaggccugcau

SEQ ID NO: 1965309 - RNA, 14 nt, Shigella flexneri 2a str. 301
acgacaccacggua

SEQ ID NO: 1965310 - RNA, 13 nt, Shigella flexneri 2a str. 301
acgaagcggcugc

SEQ ID NO: 1965311 - RNA, 19 nt, Shigella flexneri 2a str. 301
acgacaugugccagcgauu

SEQ ID NO: 1965312 - RNA, 17 nt, Shigella flexneri 2a str. 301
acgacguaacggaucaa

SEQ ID NO: 1965313 - RNA, 16 nt, Shigella flexneri 2a str. 301
acggugcaccgcaucg

SEQ ID NO: 1965314 - RNA, 23 nt, Shigella flexneri 2a str. 301
acggugcgcguugcuuauugccg

SEQ ID NO: 1965315 - RNA, 18 nt, Shigella flexneri 2a str. 301
acggugaugaucgcgcug

SEQ ID NO: 1965316 - RNA, 21 nt, Shigella flexneri 2a str. 301
acggucaggcuaauaccgucg

SEQ ID NO: 1965317 - RNA, 22 nt, Shigella flexneri 2a str. 301
acggugguuaucgucaaccugu

SEQ ID NO: 1965318 - RNA, 15 nt, Shigella flexneri 2a str. 301
acggugugcggcagg

SEQ ID NO: 1965319 - RNA, 18 nt, Shigella flexneri 2a str. 301
acggugucacggugucgg

SEQ ID NO: 1965320 - RNA, 14 nt, Shigella flexneri 2a str. 301
acgguucagcgucg

SEQ ID NO: 1965321 - RNA, 21 nt, Shigella flexneri 2a str. 301
acgguuaaaaacagccagcag

SEQ ID NO: 1965322 - RNA, 17 nt, Shigella flexneri 2a str. 301
acgguugcggcuuacca

SEQ ID NO: 1965323 - RNA, 15 nt, Shigella flexneri 2a str. 301
acgguugcgaagucg

SEQ ID NO: 1965324 - RNA, 16 nt, Shigella flexneri 2a str. 301
acgggcaccaguaacg

SEQ ID NO: 1965325 - RNA, 15 nt, Shigella flexneri 2a str. 301
acggcugcauuauga

SEQ ID NO: 1965326 - RNA, 14 nt, Shigella flexneri 2a str. 301
acggcuggccacaa

SEQ ID NO: 1965327 - RNA, 17 nt, Shigella flexneri 2a str. 301
acggcuaucuacgcgua

SEQ ID NO: 1965328 - RNA, 20 nt, Shigella flexneri 2a str. 301
acggcgugcugaugcacgau

SEQ ID NO: 1965329 - RNA, 20 nt, Shigella flexneri 2a str. 301
acggagcugccaggccgcau

SEQ ID NO: 1965330 - RNA, 17 nt, Shigella flexneri 2a str. 301
acgugucuuaucaggcc

SEQ ID NO: 1965331 - RNA, 22 nt, Shigella flexneri 2a str. 301
acguuaguucgcguaacugcug

SEQ ID NO: 1965332 - RNA, 16 nt, Shigella flexneri 2a str. 301
acgugcaccgucacuu

SEQ ID NO: 1965333 - RNA, 17 nt, Shigella flexneri 2a str. 301
acuaccacguaacgacu

SEQ ID NO: 1965334 - RNA, 13 nt, Shigella flexneri 2a str. 301
acuauucagcucu

SEQ ID NO: 1965335 - RNA, 14 nt, Shigella flexneri 2a str. 301
acguugcgcuuccc

SEQ ID NO: 1965336 - RNA, 17 nt, Shigella flexneri 2a str. 301
acuaauugagcgugaag

SEQ ID NO: 1965337 - RNA, 20 nt, Shigella flexneri 2a str. 301
acguugcauaaaugccgcaa

SEQ ID NO: 1965338 - RNA, 16 nt, Shigella flexneri 2a str. 301
acguaaugucggugaa

SEQ ID NO: 1965339 - RNA, 15 nt, Shigella flexneri 2a str. 301
acguaccagcgucgg

SEQ ID NO: 1965340 - RNA, 17 nt, Shigella flexneri 2a str. 301
acgugacaaaaauugcg

SEQ ID NO: 1965341 - RNA, 23 nt, Shigella flexneri 2a str. 301
acgugaucgucuucaaccgcagu

SEQ ID NO: 1965342 - RNA, 23 nt, Shigella flexneri 2a str. 301
acgucuuucggcagacgggcaac

SEQ ID NO: 1965343 - RNA, 19 nt, Shigella flexneri 2a str. 301
acugcgccggaaugcgggc

SEQ ID NO: 1965344 - RNA, 12 nt, Shigella flexneri 2a str. 301
acugcaucagca

SEQ ID NO: 1965345 - RNA, 19 nt, Shigella flexneri 2a str. 301
acugcacgaugccucauca

SEQ ID NO: 1965346 - RNA, 16 nt, Shigella flexneri 2a str. 301
acugcaggccggaaug

SEQ ID NO: 1965347 - RNA, 22 nt, Shigella flexneri 2a str. 301
acugguccagccccugaagcgu

SEQ ID NO: 1965348 - RNA, 19 nt, Shigella flexneri 2a str. 301
acugguguugaaaccgcug

SEQ ID NO: 1965349 - RNA, 23 nt, Shigella flexneri 2a str. 301
acuggcgauugucauucgccuga

SEQ ID NO: 1965350 - RNA, 17 nt, Shigella flexneri 2a str. 301
acuggcgcgaauugccg

SEQ ID NO: 1965351 - RNA, 15 nt, Shigella flexneri 2a str. 301
acuggcgcuacggcu

SEQ ID NO: 1965352 - RNA, 15 nt, Shigella flexneri 2a str. 301
acuggcuaugggaua

SEQ ID NO: 1965353 - RNA, 13 nt, Shigella flexneri 2a str. 301
acuggcugccagc

SEQ ID NO: 1965354 - RNA, 16 nt, Shigella flexneri 2a str. 301
acucugguauuaaccg

SEQ ID NO: 1965355 - RNA, 19 nt, Shigella flexneri 2a str. 301
acucugccguaccaucgcc

SEQ ID NO: 1965356 - RNA, 18 nt, Shigella flexneri 2a str. 301
acugacuaugguguaacg

SEQ ID NO: 1965357 - RNA, 15 nt, Shigella flexneri 2a str. 301
acugaccgaaaccgu

SEQ ID NO: 1965358 - RNA, 12 nt, Shigella flexneri 2a str. 301
acugaguugcag

SEQ ID NO: 1965359 - RNA, 17 nt, Shigella flexneri 2a str. 301
acugcaacugacggcau

SEQ ID NO: 1965360 - RNA, 14 nt, Shigella flexneri 2a str. 301
acucggcaguauca

SEQ ID NO: 1965361 - RNA, 14 nt, Shigella flexneri 2a str. 301
acucggcgcggaug

SEQ ID NO: 1965362 - RNA, 20 nt, Shigella flexneri 2a str. 301
acucggugaccgaucgcccg

SEQ ID NO: 1965363 - RNA, 22 nt, Shigella flexneri 2a str. 301
acuauuggucuggaacuggcug

SEQ ID NO: 1965364 - RNA, 14 nt, Shigella flexneri 2a str. 301
acucaccgaugauc

SEQ ID NO: 1965365 - RNA, 12 nt, Shigella flexneri 2a str. 301
acucaaucaggc

SEQ ID NO: 1965366 - RNA, 16 nt, Shigella flexneri 2a str. 301
acucacuguggcgcgu

SEQ ID NO: 1965367 - RNA, 19 nt, Shigella flexneri 2a str. 301
acuuaaucaucaaugccag

SEQ ID NO: 1965368 - RNA, 22 nt, Shigella flexneri 2a str. 301
acuuaaucaucaaugccagcau

SEQ ID NO: 1965369 - RNA, 17 nt, Shigella flexneri 2a str. 301
acugugcacccgcuuca

SEQ ID NO: 1965370 - RNA, 16 nt, Shigella flexneri 2a str. 301
acuguggcgcgaccaa

SEQ ID NO: 1965371 - RNA, 13 nt, Shigella flexneri 2a str. 301
acugugccagcgu

SEQ ID NO: 1965372 - RNA, 19 nt, Shigella flexneri 2a str. 301
acuguugaccauuugugca

SEQ ID NO: 1965373 - RNA, 19 nt, Shigella flexneri 2a str. 301
acugucaauaaacgccugc

SEQ ID NO: 1965374 - RNA, 18 nt, Shigella flexneri 2a str. 301
acuucggccugcgcgaug

SEQ ID NO: 1965375 - RNA, 18 nt, Shigella flexneri 2a str. 301
acuuccguaccagccuug

SEQ ID NO: 1965376 - RNA, 19 nt, Shigella flexneri 2a str. 301
acuuccggacguucagcca

SEQ ID NO: 1965377 - RNA, 15 nt, Shigella flexneri 2a str. 301
acuucccgcauccag

SEQ ID NO: 1965378 - RNA, 15 nt, Shigella flexneri 2a str. 301
acuuccgcccaucgc

SEQ ID NO: 1965379 - RNA, 17 nt, Shigella flexneri 2a str. 301
acuuccaugccuaagcg

SEQ ID NO: 1965380 - RNA, 17 nt, Shigella flexneri 2a str. 301
acuucacccaucgccag

SEQ ID NO: 1965381 - RNA, 16 nt, Shigella flexneri 2a str. 301
acuucauaugcgccag

SEQ ID NO: 1965382 - RNA, 14 nt, Shigella flexneri 2a str. 301
acuucaucgccguu

SEQ ID NO: 1965383 - RNA, 13 nt, Shigella flexneri 2a str. 301
acuucugcgucga

SEQ ID NO: 1965384 - RNA, 23 nt, Shigella flexneri 2a str. 301
acuuucgccugcggcgcaugcau

SEQ ID NO: 1965385 - RNA, 11 nt, Shigella flexneri 2a str. 301
acuuugccugg

SEQ ID NO: 1965386 - RNA, 19 nt, Shigella flexneri 2a str. 301
acuuugacauguugcugac

SEQ ID NO: 1965387 - RNA, 22 nt, Shigella flexneri 2a str. 301
acuuuaagcugaaaauggcgcu

SEQ ID NO: 1965388 - RNA, 16 nt, Shigella flexneri 2a str. 301
acuuuaaucaccugcc

SEQ ID NO: 1965389 - RNA, 22 nt, Shigella flexneri 2a str. 301
acuuuucggcaaccgcauccag

SEQ ID NO: 1965390 - RNA, 22 nt, Shigella flexneri 2a str. 301
acuuuugagccaaaaugccuga

SEQ ID NO: 1965391 - RNA, 14 nt, Shigella flexneri 2a str. 301
accgggcaguacca

SEQ ID NO: 1965392 - RNA, 14 nt, Shigella flexneri 2a str. 301
accgggaugcugau

SEQ ID NO: 1965393 - RNA, 18 nt, Shigella flexneri 2a str. 301
accggugcggcagcccau

SEQ ID NO: 1965394 - RNA, 15 nt, Shigella flexneri 2a str. 301
accguaguccauacc

SEQ ID NO: 1965395 - RNA, 12 nt, Shigella flexneri 2a str. 301
accguaggccgg

SEQ ID NO: 1965396 - RNA, 21 nt, Shigella flexneri 2a str. 301
accguaggccguauccggcau

SEQ ID NO: 1965397 - RNA, 16 nt, Shigella flexneri 2a str. 301
accgucagauccgcca

SEQ ID NO: 1965398 - RNA, 14 nt, Shigella flexneri 2a str. 301
accgucagcaccag

SEQ ID NO: 1965399 - RNA, 12 nt, Shigella flexneri 2a str. 301
accguacgcauc

SEQ ID NO: 1965400 - RNA, 19 nt, Shigella flexneri 2a str. 301
accgguuacggaucucccg

SEQ ID NO: 1965401 - RNA, 12 nt, Shigella flexneri 2a str. 301
accgucuguaac

SEQ ID NO: 1965402 - RNA, 14 nt, Shigella flexneri 2a str. 301
accgugauccgccg

SEQ ID NO: 1965403 - RNA, 20 nt, Shigella flexneri 2a str. 301
accgucuggcagauccugaa

SEQ ID NO: 1965404 - RNA, 17 nt, Shigella flexneri 2a str. 301
accguccucuucccaga

SEQ ID NO: 1965405 - RNA, 15 nt, Shigella flexneri 2a str. 301
accguuccauucaaa

SEQ ID NO: 1965406 - RNA, 18 nt, Shigella flexneri 2a str. 301
accggagccaaacaugca

SEQ ID NO: 1965407 - RNA, 21 nt, Shigella flexneri 2a str. 301
accgcguaugcccagcgcaga

SEQ ID NO: 1965408 - RNA, 12 nt, Shigella flexneri 2a str. 301
accgcgucgauc

SEQ ID NO: 1965409 - RNA, 21 nt, Shigella flexneri 2a str. 301
accgcuguccagucgcaaacc

SEQ ID NO: 1965410 - RNA, 16 nt, Shigella flexneri 2a str. 301
accggacgacggcauc

SEQ ID NO: 1965411 - RNA, 17 nt, Shigella flexneri 2a str. 301
accgccacuaccaucag

SEQ ID NO: 1965412 - RNA, 20 nt, Shigella flexneri 2a str. 301
accgccaguguggcggcuaa

SEQ ID NO: 1965413 - RNA, 19 nt, Shigella flexneri 2a str. 301
accgcacgcagaaucucug

SEQ ID NO: 1965414 - RNA, 15 nt, Shigella flexneri 2a str. 301
accgccgccgcuucu

SEQ ID NO: 1965415 - RNA, 22 nt, Shigella flexneri 2a str. 301
accgcccgcgcgguaucaccac

SEQ ID NO: 1965416 - RNA, 17 nt, Shigella flexneri 2a str. 301
accgaggcauucagcca

SEQ ID NO: 1965417 - RNA, 22 nt, Shigella flexneri 2a str. 301
accgaggcauucagccaguucu

SEQ ID NO: 1965418 - RNA, 22 nt, Shigella flexneri 2a str. 301
accgaggcucaacaccguuacc

SEQ ID NO: 1965419 - RNA, 12 nt, Shigella flexneri 2a str. 301
accgaucgccag

SEQ ID NO: 1965420 - RNA, 15 nt, Shigella flexneri 2a str. 301
accgaucgccagcag

SEQ ID NO: 1965421 - RNA, 13 nt, Shigella flexneri 2a str. 301
accgaucaucacg

SEQ ID NO: 1965422 - RNA, 12 nt, Shigella flexneri 2a str. 301
accgaucaccac

SEQ ID NO: 1965423 - RNA, 21 nt, Shigella flexneri 2a str. 301
accgaugaucaacagcaucau

SEQ ID NO: 1965424 - RNA, 20 nt, Shigella flexneri 2a str. 301
acccaccgauuuucagccau

SEQ ID NO: 1965425 - RNA, 17 nt, Shigella flexneri 2a str. 301
acccaacucucgucggu

SEQ ID NO: 1965426 - RNA, 21 nt, Shigella flexneri 2a str. 301
acccaaugaccacuccggcau

SEQ ID NO: 1965427 - RNA, 13 nt, Shigella flexneri 2a str. 301
acccgaucgcuca

SEQ ID NO: 1965428 - RNA, 18 nt, Shigella flexneri 2a str. 301
acccgcgaggcgcauaag

SEQ ID NO: 1965429 - RNA, 16 nt, Shigella flexneri 2a str. 301
acccgcgacgcgcuuu

SEQ ID NO: 1965430 - RNA, 23 nt, Shigella flexneri 2a str. 301
acccgcagugauugccgcaacgg

SEQ ID NO: 1965431 - RNA, 13 nt, Shigella flexneri 2a str. 301
acccuugcagaua

SEQ ID NO: 1965432 - RNA, 14 nt, Shigella flexneri 2a str. 301
acccuguccgccau

SEQ ID NO: 1965433 - RNA, 17 nt, Shigella flexneri 2a str. 301
acccugguucgcaacgg

SEQ ID NO: 1965434 - RNA, 14 nt, Shigella flexneri 2a str. 301
acccgcuuccagaa

SEQ ID NO: 1965435 - RNA, 13 nt, Shigella flexneri 2a str. 301
acaucaucgcccc

SEQ ID NO: 1965436 - RNA, 15 nt, Shigella flexneri 2a str. 301
acaucaaccagaucg

SEQ ID NO: 1965437 - RNA, 12 nt, Shigella flexneri 2a str. 301
acaggucuguau

SEQ ID NO: 1965438 - RNA, 19 nt, Shigella flexneri 2a str. 301
acaggucgagaacaacggc

SEQ ID NO: 1965439 - RNA, 16 nt, Shigella flexneri 2a str. 301
acagguuucaaugcac

SEQ ID NO: 1965440 - RNA, 17 nt, Shigella flexneri 2a str. 301
acagguggcguuugcca

SEQ ID NO: 1965441 - RNA, 19 nt, Shigella flexneri 2a str. 301
acaucgcugauuucaccau

SEQ ID NO: 1965442 - RNA, 22 nt, Shigella flexneri 2a str. 301
acaucgcauaaaccacagaccg

SEQ ID NO: 1965443 - RNA, 20 nt, Shigella flexneri 2a str. 301
acaugcgaucccacgccgaa

SEQ ID NO: 1965444 - RNA, 17 nt, Shigella flexneri 2a str. 301
acaugcuuagcacacgg

SEQ ID NO: 1965445 - RNA, 22 nt, Shigella flexneri 2a str. 301
acaugugccagcgauuuugcca

SEQ ID NO: 1965446 - RNA, 20 nt, Shigella flexneri 2a str. 301
acaggccggagccagccguu

SEQ ID NO: 1965447 - RNA, 18 nt, Shigella flexneri 2a str. 301
acagcaucaucgcaauga

SEQ ID NO: 1965448 - RNA, 22 nt, Shigella flexneri 2a str. 301
acagacuuaauauugccguccg

SEQ ID NO: 1965449 - RNA, 14 nt, Shigella flexneri 2a str. 301
acagagcaucggua

SEQ ID NO: 1965450 - RNA, 15 nt, Shigella flexneri 2a str. 301
acagaugcucgccag

SEQ ID NO: 1965451 - RNA, 14 nt, Shigella flexneri 2a str. 301
acagaccauaaccg

SEQ ID NO: 1965452 - RNA, 23 nt, Shigella flexneri 2a str. 301
acagaacagugccaugccaauca

SEQ ID NO: 1965453 - RNA, 22 nt, Shigella flexneri 2a str. 301
acagaacaauaauaacucucuu

SEQ ID NO: 1965454 - RNA, 23 nt, Shigella flexneri 2a str. 301
acacguuaacaauguuguggcca

SEQ ID NO: 1965455 - RNA, 20 nt, Shigella flexneri 2a str. 301
acacuuuccaguuccggcau

SEQ ID NO: 1965456 - RNA, 21 nt, Shigella flexneri 2a str. 301
acaccaccaauggcuggccug

SEQ ID NO: 1965457 - RNA, 17 nt, Shigella flexneri 2a str. 301
aauuugguccugaggau

SEQ ID NO: 1965458 - RNA, 13 nt, Shigella flexneri 2a str. 301
aauuugcgcucaa

SEQ ID NO: 1965459 - RNA, 17 nt, Shigella flexneri 2a str. 301
acaccagcccucauucg

SEQ ID NO: 1965460 - RNA, 19 nt, Shigella flexneri 2a str. 301
acaccaggcucuuuaaaca

SEQ ID NO: 1965461 - RNA, 19 nt, Shigella flexneri 2a str. 301
acaccuaccggcuggcgca

SEQ ID NO: 1965462 - RNA, 20 nt, Shigella flexneri 2a str. 301
accaggccguaaaucaccau

SEQ ID NO: 1965463 - RNA, 18 nt, Shigella flexneri 2a str. 301
accaggcguucugccugg

SEQ ID NO: 1965464 - RNA, 19 nt, Shigella flexneri 2a str. 301
accaggcguuuacccuucg

SEQ ID NO: 1965465 - RNA, 20 nt, Shigella flexneri 2a str. 301
accaggcucuuuaaacaguu

SEQ ID NO: 1965466 - RNA, 22 nt, Shigella flexneri 2a str. 301
accagcgcggcgauaaugccca

SEQ ID NO: 1965467 - RNA, 13 nt, Shigella flexneri 2a str. 301
accaguaaggcau

SEQ ID NO: 1965468 - RNA, 16 nt, Shigella flexneri 2a str. 301
accaguaaagugcgcu

SEQ ID NO: 1965469 - RNA, 17 nt, Shigella flexneri 2a str. 301
accagggcgucaccuug

SEQ ID NO: 1965470 - RNA, 16 nt, Shigella flexneri 2a str. 301
accaucggcagcgcca

SEQ ID NO: 1965471 - RNA, 19 nt, Shigella flexneri 2a str. 301
accaucgguuguuuucaga

SEQ ID NO: 1965472 - RNA, 14 nt, Shigella flexneri 2a str. 301
accaucguccagca

SEQ ID NO: 1965473 - RNA, 21 nt, Shigella flexneri 2a str. 301
accauugcugccgccaguucu

SEQ ID NO: 1965474 - RNA, 18 nt, Shigella flexneri 2a str. 301
accauuuuuuaauucaaa

SEQ ID NO: 1965475 - RNA, 13 nt, Shigella flexneri 2a str. 301
accauugccagua

SEQ ID NO: 1965476 - RNA, 16 nt, Shigella flexneri 2a str. 301
accauuaaauccggcg

SEQ ID NO: 1965477 - RNA, 18 nt, Shigella flexneri 2a str. 301
accauaaucucaucagcg

SEQ ID NO: 1965478 - RNA, 21 nt, Shigella flexneri 2a str. 301
accaguugguagguccagccg

SEQ ID NO: 1965479 - RNA, 13 nt, Shigella flexneri 2a str. 301
accaucagcagca

SEQ ID NO: 1965480 - RNA, 23 nt, Shigella flexneri 2a str. 301
accaucgccauuuaacgcaucac

SEQ ID NO: 1965481 - RNA, 16 nt, Shigella flexneri 2a str. 301
accaauguaggccuga

SEQ ID NO: 1965482 - RNA, 21 nt, Shigella flexneri 2a str. 301
accaauucuccaaugccguuc

SEQ ID NO: 1965483 - RNA, 23 nt, Shigella flexneri 2a str. 301
accaauguggguguuaagcgcag

SEQ ID NO: 1965484 - RNA, 19 nt, Shigella flexneri 2a str. 301
acauuaaaguaggccagau

SEQ ID NO: 1965485 - RNA, 13 nt, Shigella flexneri 2a str. 301
acauuauuaagaa

SEQ ID NO: 1965486 - RNA, 14 nt, Shigella flexneri 2a str. 301
accacaaccgccgu

SEQ ID NO: 1965487 - RNA, 16 nt, Shigella flexneri 2a str. 301
accaccgcaguaaucg

SEQ ID NO: 1965488 - RNA, 16 nt, Shigella flexneri 2a str. 301
accaccgcaaucgcca

SEQ ID NO: 1965489 - RNA, 17 nt, Shigella flexneri 2a str. 301
accacgacgaagcgccu

SEQ ID NO: 1965490 - RNA, 14 nt, Shigella flexneri 2a str. 301
accacgcagcgccg

SEQ ID NO: 1965491 - RNA, 24 nt, Shigella flexneri 2a str. 301
accacgccgauaaucaacgcgccg

SEQ ID NO: 1965492 - RNA, 21 nt, Shigella flexneri 2a str. 301
accagcaaccaacgccagcag

SEQ ID NO: 1965493 - RNA, 19 nt, Shigella flexneri 2a str. 301
accagauuaaucagcagau

SEQ ID NO: 1965494 - RNA, 18 nt, Shigella flexneri 2a str. 301
accacguaccacggcauu

SEQ ID NO: 1965495 - RNA, 20 nt, Shigella flexneri 2a str. 301
accagaaucgccagcaucgg

SEQ ID NO: 1965496 - RNA, 15 nt, Shigella flexneri 2a str. 301
accagcccgacgaua

SEQ ID NO: 1965497 - RNA, 19 nt, Shigella flexneri 2a str. 301
caccgacuggcuccgggaa

SEQ ID NO: 1965498 - RNA, 18 nt, Shigella flexneri 2a str. 301
caccgaaguuaugccagu

SEQ ID NO: 1965499 - RNA, 16 nt, Shigella flexneri 2a str. 301
cacccgcuucagugac

SEQ ID NO: 1965500 - RNA, 19 nt, Shigella flexneri 2a str. 301
cacccgugagaacugcugc

SEQ ID NO: 1965501 - RNA, 20 nt, Shigella flexneri 2a str. 301
cacccuuuucugccgcuuca

SEQ ID NO: 1965502 - RNA, 13 nt, Shigella flexneri 2a str. 301
caccgaaaucgcc

SEQ ID NO: 1965503 - RNA, 21 nt, Shigella flexneri 2a str. 301
cacccaguacgggcagcgcau

SEQ ID NO: 1965504 - RNA, 21 nt, Shigella flexneri 2a str. 301
cacccauaaaaaaacccgccg

SEQ ID NO: 1965505 - RNA, 13 nt, Shigella flexneri 2a str. 301
caccaccagcacc

SEQ ID NO: 1965506 - RNA, 15 nt, Shigella flexneri 2a str. 301
caccacccagcgccc

SEQ ID NO: 1965507 - RNA, 19 nt, Shigella flexneri 2a str. 301
cacacugcuuaacugcgcu

SEQ ID NO: 1965508 - RNA, 19 nt, Shigella flexneri 2a str. 301
caccacagacaaucgccag

SEQ ID NO: 1965509 - RNA, 20 nt, Shigella flexneri 2a str. 301
caccacagacaaucgccagu

SEQ ID NO: 1965510 - RNA, 22 nt, Shigella flexneri 2a str. 301
caccaccugggugagcgucauc

SEQ ID NO: 1965511 - RNA, 14 nt, Shigella flexneri 2a str. 301
caccaccugccaga

SEQ ID NO: 1965512 - RNA, 23 nt, Shigella flexneri 2a str. 301
caccagacgugauaaacauccac

SEQ ID NO: 1965513 - RNA, 14 nt, Shigella flexneri 2a str. 301
caccagaucguaau

SEQ ID NO: 1965514 - RNA, 18 nt, Shigella flexneri 2a str. 301
caccagcucagugaccga

SEQ ID NO: 1965515 - RNA, 22 nt, Shigella flexneri 2a str. 301
caccagcggaaugcagucacgc

SEQ ID NO: 1965516 - RNA, 13 nt, Shigella flexneri 2a str. 301
caccagcggaaug

SEQ ID NO: 1965517 - RNA, 14 nt, Shigella flexneri 2a str. 301
caccagcggcacgc

SEQ ID NO: 1965518 - RNA, 20 nt, Shigella flexneri 2a str. 301
caccagcaauaacaacacgc

SEQ ID NO: 1965519 - RNA, 22 nt, Shigella flexneri 2a str. 301
caccagcaauaacaacacgccg

SEQ ID NO: 1965520 - RNA, 11 nt, Shigella flexneri 2a str. 301
caccagcaucg

SEQ ID NO: 1965521 - RNA, 19 nt, Shigella flexneri 2a str. 301
caccagccaucuguuccgg

SEQ ID NO: 1965522 - RNA, 15 nt, Shigella flexneri 2a str. 301
caccagcgaaaguaa

SEQ ID NO: 1965523 - RNA, 23 nt, Shigella flexneri 2a str. 301
caccggaugcguucgcaccaccg

SEQ ID NO: 1965524 - RNA, 23 nt, Shigella flexneri 2a str. 301
caccggcaaugaucgcacccgcg

SEQ ID NO: 1965525 - RNA, 21 nt, Shigella flexneri 2a str. 301
caccgcgugagaacaccaccu

SEQ ID NO: 1965526 - RNA, 15 nt, Shigella flexneri 2a str. 301
caccgcguaugccca

SEQ ID NO: 1965527 - RNA, 19 nt, Shigella flexneri 2a str. 301
caccgaugaucaacagcau

SEQ ID NO: 1965528 - RNA, 18 nt, Shigella flexneri 2a str. 301
caccgaucguaacgcguu

SEQ ID NO: 1965529 - RNA, 16 nt, Shigella flexneri 2a str. 301
caccgauauugccacc

SEQ ID NO: 1965530 - RNA, 22 nt, Shigella flexneri 2a str. 301
caccguguucaugaccgugauc

SEQ ID NO: 1965531 - RNA, 16 nt, Shigella flexneri 2a str. 301
caccuauguggaaaca

SEQ ID NO: 1965532 - RNA, 15 nt, Shigella flexneri 2a str. 301
caccguuucugccgu

SEQ ID NO: 1965533 - RNA, 17 nt, Shigella flexneri 2a str. 301
caccgugauucacguuc

SEQ ID NO: 1965534 - RNA, 13 nt, Shigella flexneri 2a str. 301
caccgguuuaccg

SEQ ID NO: 1965535 - RNA, 15 nt, Shigella flexneri 2a str. 301
cacaccccgcgcagc

SEQ ID NO: 1965536 - RNA, 23 nt, Shigella flexneri 2a str. 301
cacaaugccugaugcgacgcuug

SEQ ID NO: 1965537 - RNA, 20 nt, Shigella flexneri 2a str. 301
cacaaugcuguaaccagcgc

SEQ ID NO: 1965538 - RNA, 16 nt, Shigella flexneri 2a str. 301
cacaauugccagcccu

SEQ ID NO: 1965539 - RNA, 19 nt, Shigella flexneri 2a str. 301
cacaaucucacccgcuuca

SEQ ID NO: 1965540 - RNA, 18 nt, Shigella flexneri 2a str. 301
cacaaucguguggcauca

SEQ ID NO: 1965541 - RNA, 14 nt, Shigella flexneri 2a str. 301
cacaacgugggccu

SEQ ID NO: 1965542 - RNA, 15 nt, Shigella flexneri 2a str. 301
cacaagaccgcuucc

SEQ ID NO: 1965543 - RNA, 20 nt, Shigella flexneri 2a str. 301
caaugugaaaacccugcgca

SEQ ID NO: 1965544 - RNA, 17 nt, Shigella flexneri 2a str. 301
caaugucagggccaucg

SEQ ID NO: 1965545 - RNA, 20 nt, Shigella flexneri 2a str. 301
caaugugcugagaacaagau

SEQ ID NO: 1965546 - RNA, 20 nt, Shigella flexneri 2a str. 301
cacaaccggaaccagcgccu

SEQ ID NO: 1965547 - RNA, 16 nt, Shigella flexneri 2a str. 301
cacaaccggaaccagc

SEQ ID NO: 1965548 - RNA, 14 nt, Shigella flexneri 2a str. 301
caauuuuaccgcaa

SEQ ID NO: 1965549 - RNA, 18 nt, Shigella flexneri 2a str. 301
caauugccgccagcucac

SEQ ID NO: 1965550 - RNA, 14 nt, Shigella flexneri 2a str. 301
caauugccggaugc

SEQ ID NO: 1965551 - RNA, 18 nt, Shigella flexneri 2a str. 301
caaucgcaaucuggcagc

SEQ ID NO: 1965552 - RNA, 14 nt, Shigella flexneri 2a str. 301
caaucgccuccagc

SEQ ID NO: 1965553 - RNA, 20 nt, Shigella flexneri 2a str. 301
caaucccuuaguaacgccag

SEQ ID NO: 1965554 - RNA, 15 nt, Shigella flexneri 2a str. 301
caauccacgguuuau

SEQ ID NO: 1965555 - RNA, 21 nt, Shigella flexneri 2a str. 301
caaucaccaugccgugaugcg

SEQ ID NO: 1965556 - RNA, 20 nt, Shigella flexneri 2a str. 301
caaucaucuuguaggccuga

SEQ ID NO: 1965557 - RNA, 16 nt, Shigella flexneri 2a str. 301
caaucaucgaugcgau

SEQ ID NO: 1965558 - RNA, 14 nt, Shigella flexneri 2a str. 301
caaugccacgccac

SEQ ID NO: 1965559 - RNA, 20 nt, Shigella flexneri 2a str. 301
caaucguaugaucauccgcc

SEQ ID NO: 1965560 - RNA, 15 nt, Shigella flexneri 2a str. 301
caaucgcgccagccg

SEQ ID NO: 1965561 - RNA, 12 nt, Shigella flexneri 2a str. 301
caauaaacgccu

SEQ ID NO: 1965562 - RNA, 14 nt, Shigella flexneri 2a str. 301
caauaaauugcgau

SEQ ID NO: 1965563 - RNA, 18 nt, Shigella flexneri 2a str. 301
caaguguggccgccagug

SEQ ID NO: 1965564 - RNA, 22 nt, Shigella flexneri 2a str. 301
caauaaucucuuuacccagcgg

SEQ ID NO: 1965565 - RNA, 14 nt, Shigella flexneri 2a str. 301
caauaauggccuuu

SEQ ID NO: 1965566 - RNA, 17 nt, Shigella flexneri 2a str. 301
caauacagccagccagc

SEQ ID NO: 1965567 - RNA, 21 nt, Shigella flexneri 2a str. 301
caauauccugcgcuuccugca

SEQ ID NO: 1965568 - RNA, 19 nt, Shigella flexneri 2a str. 301
caauauucauuaaaacuga

SEQ ID NO: 1965569 - RNA, 13 nt, Shigella flexneri 2a str. 301
caauauccugacc

SEQ ID NO: 1965570 - RNA, 23 nt, Shigella flexneri 2a str. 301
caauaggaagccggaauuuuccu

SEQ ID NO: 1965571 - RNA, 22 nt, Shigella flexneri 2a str. 301
caauaccgcccaccaccagcga

SEQ ID NO: 1965572 - RNA, 22 nt, Shigella flexneri 2a str. 301
caauaccauggcucaccagcag

SEQ ID NO: 1965573 - RNA, 17 nt, Shigella flexneri 2a str. 301
caauacccacugcgcag

SEQ ID NO: 1965574 - RNA, 17 nt, Shigella flexneri 2a str. 301
caauacgcgaggcgcua

SEQ ID NO: 1965575 - RNA, 18 nt, Shigella flexneri 2a str. 301
caauagagacacaacaau

SEQ ID NO: 1965576 - RNA, 22 nt, Shigella flexneri 2a str. 301
caauacuuaaccccagaccaau

SEQ ID NO: 1965577 - RNA, 20 nt, Shigella flexneri 2a str. 301
caauacuuauaaaccacgca

SEQ ID NO: 1965578 - RNA, 20 nt, Shigella flexneri 2a str. 301
caagcucgcagagaucauac

SEQ ID NO: 1965579 - RNA, 19 nt, Shigella flexneri 2a str. 301
caacuacuccaacccggca

SEQ ID NO: 1965580 - RNA, 14 nt, Shigella flexneri 2a str. 301
caacuccaccagca

SEQ ID NO: 1965581 - RNA, 17 nt, Shigella flexneri 2a str. 301
caacgugguuugcggca

SEQ ID NO: 1965582 - RNA, 21 nt, Shigella flexneri 2a str. 301
caacgugacucaauggcaucc

SEQ ID NO: 1965583 - RNA, 22 nt, Shigella flexneri 2a str. 301
caacgugacucaauggcauccg

SEQ ID NO: 1965584 - RNA, 14 nt, Shigella flexneri 2a str. 301
caacguuaccgggu

SEQ ID NO: 1965585 - RNA, 18 nt, Shigella flexneri 2a str. 301
caacggcggcuuguacgc

SEQ ID NO: 1965586 - RNA, 22 nt, Shigella flexneri 2a str. 301
caacgucuucccgagacauucc

SEQ ID NO: 1965587 - RNA, 13 nt, Shigella flexneri 2a str. 301
caacgucaaacgc

SEQ ID NO: 1965588 - RNA, 17 nt, Shigella flexneri 2a str. 301
caacgcugaauggcgau

SEQ ID NO: 1965589 - RNA, 23 nt, Shigella flexneri 2a str. 301
caacgcaaaaaggccauccugac

SEQ ID NO: 1965590 - RNA, 13 nt, Shigella flexneri 2a str. 301
caacgcuggcaug

SEQ ID NO: 1965591 - RNA, 13 nt, Shigella flexneri 2a str. 301
caacgcugccagc

SEQ ID NO: 1965592 - RNA, 15 nt, Shigella flexneri 2a str. 301
caacgcugccagccg

SEQ ID NO: 1965593 - RNA, 20 nt, Shigella flexneri 2a str. 301
caacgagcugcccgcugcga

SEQ ID NO: 1965594 - RNA, 14 nt, Shigella flexneri 2a str. 301
caacgacugcgagc

SEQ ID NO: 1965595 - RNA, 20 nt, Shigella flexneri 2a str. 301
caaccgucguggucgugauc

SEQ ID NO: 1965596 - RNA, 19 nt, Shigella flexneri 2a str. 301
caaccguccuccguauccu

SEQ ID NO: 1965597 - RNA, 16 nt, Shigella flexneri 2a str. 301
caaccgcccugcggcu

SEQ ID NO: 1965598 - RNA, 15 nt, Shigella flexneri 2a str. 301
caaccgccauccgcg

SEQ ID NO: 1965599 - RNA, 16 nt, Shigella flexneri 2a str. 301
caacaccucagccagc

SEQ ID NO: 1965600 - RNA, 20 nt, Shigella flexneri 2a str. 301
caacaccuguugcgcgucgc

SEQ ID NO: 1965601 - RNA, 11 nt, Shigella flexneri 2a str. 301
caacauucaga

SEQ ID NO: 1965602 - RNA, 22 nt, Shigella flexneri 2a str. 301
caacauucccugcaccggugca

SEQ ID NO: 1965603 - RNA, 16 nt, Shigella flexneri 2a str. 301
caacauggcaaccuuc

SEQ ID NO: 1965604 - RNA, 20 nt, Shigella flexneri 2a str. 301
caacaugcuauugcgccagc

SEQ ID NO: 1965605 - RNA, 12 nt, Shigella flexneri 2a str. 301
caacaugccgaa

SEQ ID NO: 1965606 - RNA, 20 nt, Shigella flexneri 2a str. 301
caacaugcagcccagcauca

SEQ ID NO: 1965607 - RNA, 16 nt, Shigella flexneri 2a str. 301
caaccaacgccagcag

SEQ ID NO: 1965608 - RNA, 13 nt, Shigella flexneri 2a str. 301
caaccccaucgcg

SEQ ID NO: 1965609 - RNA, 14 nt, Shigella flexneri 2a str. 301
caacaacacccaug

SEQ ID NO: 1965610 - RNA, 23 nt, Shigella flexneri 2a str. 301
caacaacaucacaccugcucagc

SEQ ID NO: 1965611 - RNA, 20 nt, Shigella flexneri 2a str. 301
caaauuuaauuugcugcgga

SEQ ID NO: 1965612 - RNA, 15 nt, Shigella flexneri 2a str. 301
caaauuauccacggc

SEQ ID NO: 1965613 - RNA, 14 nt, Shigella flexneri 2a str. 301
caacaaugcucucu

SEQ ID NO: 1965614 - RNA, 17 nt, Shigella flexneri 2a str. 301
caacaaucugcaaaucg

SEQ ID NO: 1965615 - RNA, 16 nt, Shigella flexneri 2a str. 301
caaaucguauccggca

SEQ ID NO: 1965616 - RNA, 20 nt, Shigella flexneri 2a str. 301
caaaucugucguaacugcgc

SEQ ID NO: 1965617 - RNA, 20 nt, Shigella flexneri 2a str. 301
caaaucgcaguagcgggcgu

SEQ ID NO: 1965618 - RNA, 16 nt, Shigella flexneri 2a str. 301
caaaugucaccagccg

SEQ ID NO: 1965619 - RNA, 22 nt, Shigella flexneri 2a str. 301
caaauaauuacuucgccggaau

SEQ ID NO: 1965620 - RNA, 13 nt, Shigella flexneri 2a str. 301
caaauacaugaug

SEQ ID NO: 1965621 - RNA, 15 nt, Shigella flexneri 2a str. 301
caaauagccagcaga

SEQ ID NO: 1965622 - RNA, 16 nt, Shigella flexneri 2a str. 301
caaauagccugccaga

SEQ ID NO: 1965623 - RNA, 16 nt, Shigella flexneri 2a str. 301
caaauagagcgccgga

SEQ ID NO: 1965624 - RNA, 19 nt, Shigella flexneri 2a str. 301
caaauagagcgccggaaau

SEQ ID NO: 1965625 - RNA, 20 nt, Shigella flexneri 2a str. 301
caaaucauccagaccgcuca

SEQ ID NO: 1965626 - RNA, 16 nt, Shigella flexneri 2a str. 301
caaauccagcgccaca

SEQ ID NO: 1965627 - RNA, 21 nt, Shigella flexneri 2a str. 301
caaaucgacgccacaaucuga

SEQ ID NO: 1965628 - RNA, 14 nt, Shigella flexneri 2a str. 301
caaauccagcgcca

SEQ ID NO: 1965629 - RNA, 16 nt, Shigella flexneri 2a str. 301
caaauccacguuccag

SEQ ID NO: 1965630 - RNA, 14 nt, Shigella flexneri 2a str. 301
caaaccacugcgcc

SEQ ID NO: 1965631 - RNA, 14 nt, Shigella flexneri 2a str. 301
caaaauuucaggcg

SEQ ID NO: 1965632 - RNA, 17 nt, Shigella flexneri 2a str. 301
caaaauuuaacaccauc

SEQ ID NO: 1965633 - RNA, 15 nt, Shigella flexneri 2a str. 301
caaaauuagcucgga

SEQ ID NO: 1965634 - RNA, 19 nt, Shigella flexneri 2a str. 301
auuguugcccgcgccucaa

SEQ ID NO: 1965635 - RNA, 15 nt, Shigella flexneri 2a str. 301
auuguuuaaucaacu

SEQ ID NO: 1965636 - RNA, 14 nt, Shigella flexneri 2a str. 301
auugugucaacucc

SEQ ID NO: 1965637 - RNA, 21 nt, Shigella flexneri 2a str. 301
auuguuaacgccgcgccgugc

SEQ ID NO: 1965638 - RNA, 21 nt, Shigella flexneri 2a str. 301
caaacugauuuagcaucagcg

SEQ ID NO: 1965639 - RNA, 22 nt, Shigella flexneri 2a str. 301
caaacugauuaucgaucaugac

SEQ ID NO: 1965640 - RNA, 21 nt, Shigella flexneri 2a str. 301
caaacuaucuguguaaugaau

SEQ ID NO: 1965641 - RNA, 19 nt, Shigella flexneri 2a str. 301
caaacguggucgccagcau

SEQ ID NO: 1965642 - RNA, 17 nt, Shigella flexneri 2a str. 301
caaagcguuuugccagu

SEQ ID NO: 1965643 - RNA, 19 nt, Shigella flexneri 2a str. 301
caaagcgcacuuugccaga

SEQ ID NO: 1965644 - RNA, 13 nt, Shigella flexneri 2a str. 301
caaaggccagcaa

SEQ ID NO: 1965645 - RNA, 21 nt, Shigella flexneri 2a str. 301
caaaggcguuauacugcggca

SEQ ID NO: 1965646 - RNA, 14 nt, Shigella flexneri 2a str. 301
caaaggcuccaggu

SEQ ID NO: 1965647 - RNA, 21 nt, Shigella flexneri 2a str. 301
caaagggcgucgcuuaauuga

SEQ ID NO: 1965648 - RNA, 14 nt, Shigella flexneri 2a str. 301
augugauaaugccg

SEQ ID NO: 1965649 - RNA, 20 nt, Shigella flexneri 2a str. 301
augugccgaagcagucaaca

SEQ ID NO: 1965650 - RNA, 19 nt, Shigella flexneri 2a str. 301
auguggcgugaacgccuua

SEQ ID NO: 1965651 - RNA, 21 nt, Shigella flexneri 2a str. 301
auguguuauucagcuggcagu

SEQ ID NO: 1965652 - RNA, 17 nt, Shigella flexneri 2a str. 301
auguuaccgaucgccag

SEQ ID NO: 1965653 - RNA, 15 nt, Shigella flexneri 2a str. 301
auguugaacgcggau

SEQ ID NO: 1965654 - RNA, 16 nt, Shigella flexneri 2a str. 301
auguugagcauugccg

SEQ ID NO: 1965655 - RNA, 12 nt, Shigella flexneri 2a str. 301
auguugagcggc

SEQ ID NO: 1965656 - RNA, 16 nt, Shigella flexneri 2a str. 301
augucagaugcggcgu

SEQ ID NO: 1965657 - RNA, 17 nt, Shigella flexneri 2a str. 301
augucggaugcggcgug

SEQ ID NO: 1965658 - RNA, 16 nt, Shigella flexneri 2a str. 301
augucaucaucgccac

SEQ ID NO: 1965659 - RNA, 20 nt, Shigella flexneri 2a str. 301
augucagggccaucgcgguu

SEQ ID NO: 1965660 - RNA, 16 nt, Shigella flexneri 2a str. 301
auguaauuaagcgcaa

SEQ ID NO: 1965661 - RNA, 16 nt, Shigella flexneri 2a str. 301
augguuugggcguuac

SEQ ID NO: 1965662 - RNA, 14 nt, Shigella flexneri 2a str. 301
auguaaauaacaga

SEQ ID NO: 1965663 - RNA, 22 nt, Shigella flexneri 2a str. 301
auguaaucaacuccgccagcaa

SEQ ID NO: 1965664 - RNA, 15 nt, Shigella flexneri 2a str. 301
augggucggcgauaa

SEQ ID NO: 1965665 - RNA, 19 nt, Shigella flexneri 2a str. 301
augggugacaucgcccuga

SEQ ID NO: 1965666 - RNA, 23 nt, Shigella flexneri 2a str. 301
auggggucaggugggaccaccgc

SEQ ID NO: 1965667 - RNA, 17 nt, Shigella flexneri 2a str. 301
auggcauauuccgccac

SEQ ID NO: 1965668 - RNA, 22 nt, Shigella flexneri 2a str. 301
auggcauauuccgccaccugcg

SEQ ID NO: 1965669 - RNA, 18 nt, Shigella flexneri 2a str. 301
auggcagucuuaaucgcu

SEQ ID NO: 1965670 - RNA, 20 nt, Shigella flexneri 2a str. 301
auggcacguugcugcggcgu

SEQ ID NO: 1965671 - RNA, 14 nt, Shigella flexneri 2a str. 301
auggcaaagugcau

SEQ ID NO: 1965672 - RNA, 15 nt, Shigella flexneri 2a str. 301
auggcaaacugauua

SEQ ID NO: 1965673 - RNA, 17 nt, Shigella flexneri 2a str. 301
auggcaaacugauuauc

SEQ ID NO: 1965674 - RNA, 17 nt, Shigella flexneri 2a str. 301
auggcauucucacucca

SEQ ID NO: 1965675 - RNA, 14 nt, Shigella flexneri 2a str. 301
auggcauucgucgu

SEQ ID NO: 1965676 - RNA, 15 nt, Shigella flexneri 2a str. 301
auggccucugccagc

SEQ ID NO: 1965677 - RNA, 21 nt, Shigella flexneri 2a str. 301
augcugguaauccgagaaucg

SEQ ID NO: 1965678 - RNA, 22 nt, Shigella flexneri 2a str. 301
augcuuuccaacuguaccagca

SEQ ID NO: 1965679 - RNA, 16 nt, Shigella flexneri 2a str. 301
augcuuugcaucccag

SEQ ID NO: 1965680 - RNA, 15 nt, Shigella flexneri 2a str. 301
auggacacaggccua

SEQ ID NO: 1965681 - RNA, 15 nt, Shigella flexneri 2a str. 301
augcgccagguaacg

SEQ ID NO: 1965682 - RNA, 12 nt, Shigella flexneri 2a str. 301
augcgccagacu

SEQ ID NO: 1965683 - RNA, 19 nt, Shigella flexneri 2a str. 301
augcuggaaccacagcgcc

SEQ ID NO: 1965684 - RNA, 20 nt, Shigella flexneri 2a str. 301
augcugcuuuaucagaucac

SEQ ID NO: 1965685 - RNA, 19 nt, Shigella flexneri 2a str. 301
augcugcaauugcggcagg

SEQ ID NO: 1965686 - RNA, 13 nt, Shigella flexneri 2a str. 301
augcgggcgguaa

SEQ ID NO: 1965687 - RNA, 15 nt, Shigella flexneri 2a str. 301
augcggggugcaucg

SEQ ID NO: 1965688 - RNA, 20 nt, Shigella flexneri 2a str. 301
augcgguacugcgacgacgu

SEQ ID NO: 1965689 - RNA, 15 nt, Shigella flexneri 2a str. 301
auucgagaagcccau

SEQ ID NO: 1965690 - RNA, 13 nt, Shigella flexneri 2a str. 301
auuccucauggau

SEQ ID NO: 1965691 - RNA, 22 nt, Shigella flexneri 2a str. 301
auucgaaccucggaaugccgga

SEQ ID NO: 1965692 - RNA, 17 nt, Shigella flexneri 2a str. 301
auucgccgcgacacaac

SEQ ID NO: 1965693 - RNA, 22 nt, Shigella flexneri 2a str. 301
auucgggauugccagaugcgac

SEQ ID NO: 1965694 - RNA, 15 nt, Shigella flexneri 2a str. 301
auucgcuuucacuca

SEQ ID NO: 1965695 - RNA, 21 nt, Shigella flexneri 2a str. 301
auucggaaauaaucaccugau

SEQ ID NO: 1965696 - RNA, 23 nt, Shigella flexneri 2a str. 301
auucuauacaaacuuaccgccgc

SEQ ID NO: 1965697 - RNA, 21 nt, Shigella flexneri 2a str. 301
auucguucagacgcucugcgg

SEQ ID NO: 1965698 - RNA, 14 nt, Shigella flexneri 2a str. 301
auucgugagcuggu

SEQ ID NO: 1965699 - RNA, 20 nt, Shigella flexneri 2a str. 301
auucuggcaccaccuggcuu

SEQ ID NO: 1965700 - RNA, 17 nt, Shigella flexneri 2a str. 301
auucuguuuuaucagac

SEQ ID NO: 1965701 - RNA, 20 nt, Shigella flexneri 2a str. 301
auucaggccaaagccgccga

SEQ ID NO: 1965702 - RNA, 19 nt, Shigella flexneri 2a str. 301
auucagcaaauguggcggu

SEQ ID NO: 1965703 - RNA, 19 nt, Shigella flexneri 2a str. 301
auucauaucaaacgccuga

SEQ ID NO: 1965704 - RNA, 15 nt, Shigella flexneri 2a str. 301
auucauaugcgccag

SEQ ID NO: 1965705 - RNA, 16 nt, Shigella flexneri 2a str. 301
auucauacagcggcca

SEQ ID NO: 1965706 - RNA, 17 nt, Shigella flexneri 2a str. 301
auucagugcaaaugcca

SEQ ID NO: 1965707 - RNA, 20 nt, Shigella flexneri 2a str. 301
auucaggucagcggccaguu

SEQ ID NO: 1965708 - RNA, 19 nt, Shigella flexneri 2a str. 301
auuccgcgugaaaugccaa

SEQ ID NO: 1965709 - RNA, 22 nt, Shigella flexneri 2a str. 301
auuccggcuuguucaucaccau

SEQ ID NO: 1965710 - RNA, 21 nt, Shigella flexneri 2a str. 301
auuaaaauucaucaaauggca

SEQ ID NO: 1965711 - RNA, 17 nt, Shigella flexneri 2a str. 301
auuaacaguccgccguu

SEQ ID NO: 1965712 - RNA, 18 nt, Shigella flexneri 2a str. 301
auuaugacuccagcgcca

SEQ ID NO: 1965713 - RNA, 17 nt, Shigella flexneri 2a str. 301
auuaugacuccagcgcc

SEQ ID NO: 1965714 - RNA, 21 nt, Shigella flexneri 2a str. 301
auucacgccgcauccggcauc

SEQ ID NO: 1965715 - RNA, 16 nt, Shigella flexneri 2a str. 301
auuggaguaucaccau

SEQ ID NO: 1965716 - RNA, 18 nt, Shigella flexneri 2a str. 301
auugcuuugguggucacc

SEQ ID NO: 1965717 - RNA, 18 nt, Shigella flexneri 2a str. 301
auuggcaucaucagcgga

SEQ ID NO: 1965718 - RNA, 13 nt, Shigella flexneri 2a str. 301
auuggcacgccga

SEQ ID NO: 1965719 - RNA, 22 nt, Shigella flexneri 2a str. 301
auuggucuggaacuggcugcca

SEQ ID NO: 1965720 - RNA, 16 nt, Shigella flexneri 2a str. 301
auuggugaauugcacg

SEQ ID NO: 1965721 - RNA, 23 nt, Shigella flexneri 2a str. 301
auuguagacaacgugggcuuugu

SEQ ID NO: 1965722 - RNA, 24 nt, Shigella flexneri 2a str. 301
auugucgguggcgggcaagcggcg

SEQ ID NO: 1965723 - RNA, 23 nt, Shigella flexneri 2a str. 301
auugucgccgcuaacaucgucgg

SEQ ID NO: 1965724 - RNA, 23 nt, Shigella flexneri 2a str. 301
auugcgccagagcgcggcgugaa

SEQ ID NO: 1965725 - RNA, 15 nt, Shigella flexneri 2a str. 301
auugccugauggccu

SEQ ID NO: 1965726 - RNA, 20 nt, Shigella flexneri 2a str. 301
auugccguaagcaacgccaa

SEQ ID NO: 1965727 - RNA, 17 nt, Shigella flexneri 2a str. 301
auugccguccggcaucg

SEQ ID NO: 1965728 - RNA, 22 nt, Shigella flexneri 2a str. 301
auugccguggauuuaaugccaa

SEQ ID NO: 1965729 - RNA, 19 nt, Shigella flexneri 2a str. 301
auugccggaugcggcguaa

SEQ ID NO: 1965730 - RNA, 14 nt, Shigella flexneri 2a str. 301
auugcugacgcaaa

SEQ ID NO: 1965731 - RNA, 12 nt, Shigella flexneri 2a str. 301
auugcuucucag

SEQ ID NO: 1965732 - RNA, 15 nt, Shigella flexneri 2a str. 301
auugcuucugcuuca

SEQ ID NO: 1965733 - RNA, 22 nt, Shigella flexneri 2a str. 301
auugcguaaccagacggcguaa

SEQ ID NO: 1965734 - RNA, 15 nt, Shigella flexneri 2a str. 301
auugcggcaggucau

SEQ ID NO: 1965735 - RNA, 15 nt, Shigella flexneri 2a str. 301
auugcuaccgcuucg

SEQ ID NO: 1965736 - RNA, 13 nt, Shigella flexneri 2a str. 301
auugaccagaucu

SEQ ID NO: 1965737 - RNA, 15 nt, Shigella flexneri 2a str. 301
auugacgaaaagcug

SEQ ID NO: 1965738 - RNA, 22 nt, Shigella flexneri 2a str. 301
auugaacucuuaagguucacuu

SEQ ID NO: 1965739 - RNA, 16 nt, Shigella flexneri 2a str. 301
auugaacgguuaaucu

SEQ ID NO: 1965740 - RNA, 23 nt, Shigella flexneri 2a str. 301
auugaaucacgacaaacacaaua

SEQ ID NO: 1965741 - RNA, 17 nt, Shigella flexneri 2a str. 301
auugccgaugaacggcg

SEQ ID NO: 1965742 - RNA, 16 nt, Shigella flexneri 2a str. 301
auugccgccagcucac

SEQ ID NO: 1965743 - RNA, 23 nt, Shigella flexneri 2a str. 301
auugccgccagacguccggcgcu

SEQ ID NO: 1965744 - RNA, 21 nt, Shigella flexneri 2a str. 301
auugcccgaagccaauuugcg

SEQ ID NO: 1965745 - RNA, 22 nt, Shigella flexneri 2a str. 301
auugcccggucaggauggccgg

SEQ ID NO: 1965746 - RNA, 19 nt, Shigella flexneri 2a str. 301
auugcauccuuuaccggau

SEQ ID NO: 1965747 - RNA, 20 nt, Shigella flexneri 2a str. 301
auugccacccugcggcugcu

SEQ ID NO: 1965748 - RNA, 17 nt, Shigella flexneri 2a str. 301
auugccccacaccgcga

SEQ ID NO: 1965749 - RNA, 19 nt, Shigella flexneri 2a str. 301
auugcaacauguugaaucu

SEQ ID NO: 1965750 - RNA, 16 nt, Shigella flexneri 2a str. 301
auugcaacgcccauca

SEQ ID NO: 1965751 - RNA, 14 nt, Shigella flexneri 2a str. 301
auugcaaucaucuu

SEQ ID NO: 1965752 - RNA, 19 nt, Shigella flexneri 2a str. 301
auugaugcacaccaucgcg

SEQ ID NO: 1965753 - RNA, 14 nt, Shigella flexneri 2a str. 301
auugaugacgccau

SEQ ID NO: 1965754 - RNA, 14 nt, Shigella flexneri 2a str. 301
augaaaacgccgga

SEQ ID NO: 1965755 - RNA, 17 nt, Shigella flexneri 2a str. 301
aucuuucugcgcaucuu

SEQ ID NO: 1965756 - RNA, 15 nt, Shigella flexneri 2a str. 301
augaaaaccguauuc

SEQ ID NO: 1965757 - RNA, 14 nt, Shigella flexneri 2a str. 301
augaaguccacgcg

SEQ ID NO: 1965758 - RNA, 19 nt, Shigella flexneri 2a str. 301
augaauaaaauucuccagc

SEQ ID NO: 1965759 - RNA, 21 nt, Shigella flexneri 2a str. 301
augaauuacacgaugcaagag

SEQ ID NO: 1965760 - RNA, 12 nt, Shigella flexneri 2a str. 301
augacauugaug

SEQ ID NO: 1965761 - RNA, 20 nt, Shigella flexneri 2a str. 301
augaccaaaaacauugccgu

SEQ ID NO: 1965762 - RNA, 14 nt, Shigella flexneri 2a str. 301
augaucauccgccu

SEQ ID NO: 1965763 - RNA, 23 nt, Shigella flexneri 2a str. 301
augauccugcaauaccgccguua

SEQ ID NO: 1965764 - RNA, 12 nt, Shigella flexneri 2a str. 301
augaucgccgga

SEQ ID NO: 1965765 - RNA, 12 nt, Shigella flexneri 2a str. 301
augaucgccgua

SEQ ID NO: 1965766 - RNA, 17 nt, Shigella flexneri 2a str. 301
augaucgcgaucgccaa

SEQ ID NO: 1965767 - RNA, 20 nt, Shigella flexneri 2a str. 301
augacgcccuacaaggaacg

SEQ ID NO: 1965768 - RNA, 17 nt, Shigella flexneri 2a str. 301
augacgcguaacggcgg

SEQ ID NO: 1965769 - RNA, 15 nt, Shigella flexneri 2a str. 301
augauaaauccaucg

SEQ ID NO: 1965770 - RNA, 18 nt, Shigella flexneri 2a str. 301
augcacugcaacgccuuu

SEQ ID NO: 1965771 - RNA, 15 nt, Shigella flexneri 2a str. 301
augcauaauccgccg

SEQ ID NO: 1965772 - RNA, 14 nt, Shigella flexneri 2a str. 301
augcaucgccgguu

SEQ ID NO: 1965773 - RNA, 16 nt, Shigella flexneri 2a str. 301
augcaugauccggcau

SEQ ID NO: 1965774 - RNA, 16 nt, Shigella flexneri 2a str. 301
augcagcguuuccagc

SEQ ID NO: 1965775 - RNA, 16 nt, Shigella flexneri 2a str. 301
augcagcuccaccgau

SEQ ID NO: 1965776 - RNA, 11 nt, Shigella flexneri 2a str. 301
augcagcgaug

SEQ ID NO: 1965777 - RNA, 15 nt, Shigella flexneri 2a str. 301
augcagccaggccau

SEQ ID NO: 1965778 - RNA, 14 nt, Shigella flexneri 2a str. 301
augcagcggguuaa

SEQ ID NO: 1965779 - RNA, 20 nt, Shigella flexneri 2a str. 301
aucuaugucgcauccggcaa

SEQ ID NO: 1965780 - RNA, 17 nt, Shigella flexneri 2a str. 301
aucuccgcacagcgguu

SEQ ID NO: 1965781 - RNA, 12 nt, Shigella flexneri 2a str. 301
aucuaaaugcca

SEQ ID NO: 1965782 - RNA, 16 nt, Shigella flexneri 2a str. 301
aucgugcgcgccguga

SEQ ID NO: 1965783 - RNA, 18 nt, Shigella flexneri 2a str. 301
aucgugauacaacugccg

SEQ ID NO: 1965784 - RNA, 20 nt, Shigella flexneri 2a str. 301
aucgucuucaaccgcaguga

SEQ ID NO: 1965785 - RNA, 21 nt, Shigella flexneri 2a str. 301
aucggcgucauuuuuucgaca

SEQ ID NO: 1965786 - RNA, 18 nt, Shigella flexneri 2a str. 301
aucuuaucacgaugcuaa

SEQ ID NO: 1965787 - RNA, 18 nt, Shigella flexneri 2a str. 301
aucuucacuaaaaucauu

SEQ ID NO: 1965788 - RNA, 17 nt, Shigella flexneri 2a str. 301
aucuuccagcaucagca

SEQ ID NO: 1965789 - RNA, 20 nt, Shigella flexneri 2a str. 301
aucuucgcgccaauccagaa

SEQ ID NO: 1965790 - RNA, 19 nt, Shigella flexneri 2a str. 301
aucugucuguacggcagug

SEQ ID NO: 1965791 - RNA, 20 nt, Shigella flexneri 2a str. 301
aucuggcauaaacaaagcgc

SEQ ID NO: 1965792 - RNA, 16 nt, Shigella flexneri 2a str. 301
aucuggcgagucacca

SEQ ID NO: 1965793 - RNA, 19 nt, Shigella flexneri 2a str. 301
aucugcucggcgagcaacg

SEQ ID NO: 1965794 - RNA, 23 nt, Shigella flexneri 2a str. 301
auccggcguuuucaaccagccga

SEQ ID NO: 1965795 - RNA, 18 nt, Shigella flexneri 2a str. 301
auccggcaauaagcaacg

SEQ ID NO: 1965796 - RNA, 19 nt, Shigella flexneri 2a str. 301
auccgcgucauugacgcug

SEQ ID NO: 1965797 - RNA, 18 nt, Shigella flexneri 2a str. 301
auccgcgguaucgccguc

SEQ ID NO: 1965798 - RNA, 17 nt, Shigella flexneri 2a str. 301
auccgccgauguugcau

SEQ ID NO: 1965799 - RNA, 22 nt, Shigella flexneri 2a str. 301
auccgagaaucguacucaccag

SEQ ID NO: 1965800 - RNA, 20 nt, Shigella flexneri 2a str. 301
auccgaucgcgcaucagcag

SEQ ID NO: 1965801 - RNA, 19 nt, Shigella flexneri 2a str. 301
auccgaccuacaaaaccug

SEQ ID NO: 1965802 - RNA, 10 nt, Shigella flexneri 2a str. 301
aucccuucgu

SEQ ID NO: 1965803 - RNA, 14 nt, Shigella flexneri 2a str. 301
aucagcguuaucag

SEQ ID NO: 1965804 - RNA, 20 nt, Shigella flexneri 2a str. 301
auccugcguuaaucgccgua

SEQ ID NO: 1965805 - RNA, 20 nt, Shigella flexneri 2a str. 301
auccugaucaagcacaugcu

SEQ ID NO: 1965806 - RNA, 15 nt, Shigella flexneri 2a str. 301
aucgaaaaugcgcau

SEQ ID NO: 1965807 - RNA, 20 nt, Shigella flexneri 2a str. 301
auccuucuguggacugauuu

SEQ ID NO: 1965808 - RNA, 20 nt, Shigella flexneri 2a str. 301
auccuguugcguuaagccau

SEQ ID NO: 1965809 - RNA, 18 nt, Shigella flexneri 2a str. 301
auccuggugguacgcgua

SEQ ID NO: 1965810 - RNA, 17 nt, Shigella flexneri 2a str. 301
auccuguuaagaagggc

SEQ ID NO: 1965811 - RNA, 11 nt, Shigella flexneri 2a str. 301
aucgacgauga

SEQ ID NO: 1965812 - RNA, 16 nt, Shigella flexneri 2a str. 301
aucgacaguugcugcg

SEQ ID NO: 1965813 - RNA, 18 nt, Shigella flexneri 2a str. 301
aucgacagaacggauauc

SEQ ID NO: 1965814 - RNA, 15 nt, Shigella flexneri 2a str. 301
aucgacaaucaccag

SEQ ID NO: 1965815 - RNA, 19 nt, Shigella flexneri 2a str. 301
aucgaacuucccgccgugg

SEQ ID NO: 1965816 - RNA, 18 nt, Shigella flexneri 2a str. 301
aucgcgcuaauuccaguc

SEQ ID NO: 1965817 - RNA, 15 nt, Shigella flexneri 2a str. 301
aucgcucagcgcauc

SEQ ID NO: 1965818 - RNA, 21 nt, Shigella flexneri 2a str. 301
aucgcucaucagcuccgguau

SEQ ID NO: 1965819 - RNA, 19 nt, Shigella flexneri 2a str. 301
aucgcugaacgcaccuucc

SEQ ID NO: 1965820 - RNA, 23 nt, Shigella flexneri 2a str. 301
aucggaugacgccacagcauucu

SEQ ID NO: 1965821 - RNA, 18 nt, Shigella flexneri 2a str. 301
aucggcaauuucgcugcc

SEQ ID NO: 1965822 - RNA, 20 nt, Shigella flexneri 2a str. 301
aucggcaaucacaucaccau

SEQ ID NO: 1965823 - RNA, 19 nt, Shigella flexneri 2a str. 301
aucggcgcggaaucgcccu

SEQ ID NO: 1965824 - RNA, 13 nt, Shigella flexneri 2a str. 301
aucgagcgccguu

SEQ ID NO: 1965825 - RNA, 13 nt, Shigella flexneri 2a str. 301
aucgacugcaaac

SEQ ID NO: 1965826 - RNA, 20 nt, Shigella flexneri 2a str. 301
aucgcccaguugaucaccag

SEQ ID NO: 1965827 - RNA, 14 nt, Shigella flexneri 2a str. 301
aucgccaugaacgc

SEQ ID NO: 1965828 - RNA, 20 nt, Shigella flexneri 2a str. 301
aucgcgaugggucgccgcaa

SEQ ID NO: 1965829 - RNA, 14 nt, Shigella flexneri 2a str. 301
aucgcgcaacgucg

SEQ ID NO: 1965830 - RNA, 19 nt, Shigella flexneri 2a str. 301
aucgcgauggcaagcggug

SEQ ID NO: 1965831 - RNA, 14 nt, Shigella flexneri 2a str. 301
aucgcgaucgccaa

SEQ ID NO: 1965832 - RNA, 22 nt, Shigella flexneri 2a str. 301
aucgccgggaacagaauaacgu

SEQ ID NO: 1965833 - RNA, 18 nt, Shigella flexneri 2a str. 301
agcguuucaacaaacgau

SEQ ID NO: 1965834 - RNA, 13 nt, Shigella flexneri 2a str. 301
agcuauaacguug

SEQ ID NO: 1965835 - RNA, 13 nt, Shigella flexneri 2a str. 301
agcucaacgcgug

SEQ ID NO: 1965836 - RNA, 19 nt, Shigella flexneri 2a str. 301
agcucauaaccguccaguu

SEQ ID NO: 1965837 - RNA, 24 nt, Shigella flexneri 2a str. 301
agcuccgggcugguuuucagcgaa

SEQ ID NO: 1965838 - RNA, 22 nt, Shigella flexneri 2a str. 301
agcuccguccagccaccgcgug

SEQ ID NO: 1965839 - RNA, 18 nt, Shigella flexneri 2a str. 301
agcugaaaauggcgcugu

SEQ ID NO: 1965840 - RNA, 22 nt, Shigella flexneri 2a str. 301
agcucuuuuaacuuacgcguca

SEQ ID NO: 1965841 - RNA, 16 nt, Shigella flexneri 2a str. 301
agcugacuuccagccg

SEQ ID NO: 1965842 - RNA, 14 nt, Shigella flexneri 2a str. 301
agcggaugacccag

SEQ ID NO: 1965843 - RNA, 21 nt, Shigella flexneri 2a str. 301
agcggcuuccaccgccggaua

SEQ ID NO: 1965844 - RNA, 17 nt, Shigella flexneri 2a str. 301
agcggcucaugcaucag

SEQ ID NO: 1965845 - RNA, 17 nt, Shigella flexneri 2a str. 301
agcguggagagcagcau

SEQ ID NO: 1965846 - RNA, 20 nt, Shigella flexneri 2a str. 301
agcguguuaaugcccaucag

SEQ ID NO: 1965847 - RNA, 19 nt, Shigella flexneri 2a str. 301
agcguccggcugccagcca

SEQ ID NO: 1965848 - RNA, 18 nt, Shigella flexneri 2a str. 301
agcgucgcgguugcuguc

SEQ ID NO: 1965849 - RNA, 22 nt, Shigella flexneri 2a str. 301
agcgguggugaaaagagcggua

SEQ ID NO: 1965850 - RNA, 21 nt, Shigella flexneri 2a str. 301
agcggugcgaugccuggcaau

SEQ ID NO: 1965851 - RNA, 16 nt, Shigella flexneri 2a str. 301
agcgcuuuuggcgcgu

SEQ ID NO: 1965852 - RNA, 15 nt, Shigella flexneri 2a str. 301
agcggaaaucuccag

SEQ ID NO: 1965853 - RNA, 21 nt, Shigella flexneri 2a str. 301
agcgcguaaauaccuuccggc

SEQ ID NO: 1965854 - RNA, 22 nt, Shigella flexneri 2a str. 301
agcgcgucacuuaauccggagc

SEQ ID NO: 1965855 - RNA, 20 nt, Shigella flexneri 2a str. 301
agcgcguuuuauaacggcug

SEQ ID NO: 1965856 - RNA, 16 nt, Shigella flexneri 2a str. 301
agcgccaacggugaaa

SEQ ID NO: 1965857 - RNA, 19 nt, Shigella flexneri 2a str. 301
agcgcauggcguccgucau

SEQ ID NO: 1965858 - RNA, 15 nt, Shigella flexneri 2a str. 301
agcgccagccagaug

SEQ ID NO: 1965859 - RNA, 17 nt, Shigella flexneri 2a str. 301
agcgccugauacagcca

SEQ ID NO: 1965860 - RNA, 19 nt, Shigella flexneri 2a str. 301
agccuugccguuugcugcu

SEQ ID NO: 1965861 - RNA, 12 nt, Shigella flexneri 2a str. 301
agccuuucgcaa

SEQ ID NO: 1965862 - RNA, 22 nt, Shigella flexneri 2a str. 301
agccuuucacuucggucaccgu

SEQ ID NO: 1965863 - RNA, 16 nt, Shigella flexneri 2a str. 301
agcgaaugugccguaa

SEQ ID NO: 1965864 - RNA, 12 nt, Shigella flexneri 2a str. 301
agcgcaucacuu

SEQ ID NO: 1965865 - RNA, 13 nt, Shigella flexneri 2a str. 301
agcgcauccggca

SEQ ID NO: 1965866 - RNA, 23 nt, Shigella flexneri 2a str. 301
agcgcauaaaccgggcguggauc

SEQ ID NO: 1965867 - RNA, 22 nt, Shigella flexneri 2a str. 301
agcgcaauccaccauuggcgca

SEQ ID NO: 1965868 - RNA, 15 nt, Shigella flexneri 2a str. 301
agcgauaacguguuc

SEQ ID NO: 1965869 - RNA, 18 nt, Shigella flexneri 2a str. 301
agcgagcuggcgcugaua

SEQ ID NO: 1965870 - RNA, 16 nt, Shigella flexneri 2a str. 301
agcgagcuggcgcuga

SEQ ID NO: 1965871 - RNA, 18 nt, Shigella flexneri 2a str. 301
agcgagagcaaugcgcau

SEQ ID NO: 1965872 - RNA, 14 nt, Shigella flexneri 2a str. 301
agccgccaucucuu

SEQ ID NO: 1965873 - RNA, 20 nt, Shigella flexneri 2a str. 301
agcccuucguaggccagaua

SEQ ID NO: 1965874 - RNA, 19 nt, Shigella flexneri 2a str. 301
agcccacgagcaaaacgcu

SEQ ID NO: 1965875 - RNA, 23 nt, Shigella flexneri 2a str. 301
agcccgaguaacaguauccgggc

SEQ ID NO: 1965876 - RNA, 16 nt, Shigella flexneri 2a str. 301
agccacggcuccagca

SEQ ID NO: 1965877 - RNA, 17 nt, Shigella flexneri 2a str. 301
agccaacuuaccgccgg

SEQ ID NO: 1965878 - RNA, 22 nt, Shigella flexneri 2a str. 301
agccaagcgccgccucagccag

SEQ ID NO: 1965879 - RNA, 20 nt, Shigella flexneri 2a str. 301
agccaacggcucaacgucuu

SEQ ID NO: 1965880 - RNA, 12 nt, Shigella flexneri 2a str. 301
agccaucaccac

SEQ ID NO: 1965881 - RNA, 15 nt, Shigella flexneri 2a str. 301
agcagcccuugugcc

SEQ ID NO: 1965882 - RNA, 16 nt, Shigella flexneri 2a str. 301
agcaugaugccugaug

SEQ ID NO: 1965883 - RNA, 21 nt, Shigella flexneri 2a str. 301
agcaugauuucauaacugaug

SEQ ID NO: 1965884 - RNA, 18 nt, Shigella flexneri 2a str. 301
agcauuuucauccauuac

SEQ ID NO: 1965885 - RNA, 22 nt, Shigella flexneri 2a str. 301
agcauauguuuacgcuggcgga

SEQ ID NO: 1965886 - RNA, 13 nt, Shigella flexneri 2a str. 301
agcaucagcgcca

SEQ ID NO: 1965887 - RNA, 21 nt, Shigella flexneri 2a str. 301
agcaucaucauaauggcugcc

SEQ ID NO: 1965888 - RNA, 12 nt, Shigella flexneri 2a str. 301
agcauccggcag

SEQ ID NO: 1965889 - RNA, 19 nt, Shigella flexneri 2a str. 301
agagcugaauaucacgggc

SEQ ID NO: 1965890 - RNA, 13 nt, Shigella flexneri 2a str. 301
agagcgucuggaa

SEQ ID NO: 1965891 - RNA, 11 nt, Shigella flexneri 2a str. 301
agagcagcacg

SEQ ID NO: 1965892 - RNA, 15 nt, Shigella flexneri 2a str. 301
agagcagcaucaaua

SEQ ID NO: 1965893 - RNA, 17 nt, Shigella flexneri 2a str. 301
agaggagccaucaccau

SEQ ID NO: 1965894 - RNA, 13 nt, Shigella flexneri 2a str. 301
agaggagccauca

SEQ ID NO: 1965895 - RNA, 19 nt, Shigella flexneri 2a str. 301
agaggcguguggugaggug

SEQ ID NO: 1965896 - RNA, 20 nt, Shigella flexneri 2a str. 301
agaguaaagcccgccaucgc

SEQ ID NO: 1965897 - RNA, 15 nt, Shigella flexneri 2a str. 301
agagauagccugauc

SEQ ID NO: 1965898 - RNA, 22 nt, Shigella flexneri 2a str. 301
agagagcagucagguucagcgu

SEQ ID NO: 1965899 - RNA, 22 nt, Shigella flexneri 2a str. 301
agacucauauaaaaaccggugc

SEQ ID NO: 1965900 - RNA, 16 nt, Shigella flexneri 2a str. 301
agacuaauugagcgug

SEQ ID NO: 1965901 - RNA, 17 nt, Shigella flexneri 2a str. 301
agaaacacugucaaucg

SEQ ID NO: 1965902 - RNA, 21 nt, Shigella flexneri 2a str. 301
agaaaauggccagccagcaga

SEQ ID NO: 1965903 - RNA, 14 nt, Shigella flexneri 2a str. 301
agaucacgcaucac

SEQ ID NO: 1965904 - RNA, 16 nt, Shigella flexneri 2a str. 301
agaucgaacacgguga

SEQ ID NO: 1965905 - RNA, 20 nt, Shigella flexneri 2a str. 301
agauaucccgccagcaccag

SEQ ID NO: 1965906 - RNA, 12 nt, Shigella flexneri 2a str. 301
agaucgccgcug

SEQ ID NO: 1965907 - RNA, 18 nt, Shigella flexneri 2a str. 301
agaucgguuuuuuucgaa

SEQ ID NO: 1965908 - RNA, 15 nt, Shigella flexneri 2a str. 301
agaugccauuggcau

SEQ ID NO: 1965909 - RNA, 16 nt, Shigella flexneri 2a str. 301
agaugaaaacgccgga

SEQ ID NO: 1965910 - RNA, 14 nt, Shigella flexneri 2a str. 301
agaugcgacgcuga

SEQ ID NO: 1965911 - RNA, 16 nt, Shigella flexneri 2a str. 301
agauggcuucaucccg

SEQ ID NO: 1965912 - RNA, 13 nt, Shigella flexneri 2a str. 301
agcagagcagacg

SEQ ID NO: 1965913 - RNA, 21 nt, Shigella flexneri 2a str. 301
agcacguuuagcuuuggugcc

SEQ ID NO: 1965914 - RNA, 13 nt, Shigella flexneri 2a str. 301
agcacggcagcaa

SEQ ID NO: 1965915 - RNA, 16 nt, Shigella flexneri 2a str. 301
agcaacuccaucaagc

SEQ ID NO: 1965916 - RNA, 15 nt, Shigella flexneri 2a str. 301
agcaacgccuaaacu

SEQ ID NO: 1965917 - RNA, 17 nt, Shigella flexneri 2a str. 301
agcaacaugcggugauu

SEQ ID NO: 1965918 - RNA, 15 nt, Shigella flexneri 2a str. 301
agcaacgaaacgccg

SEQ ID NO: 1965919 - RNA, 18 nt, Shigella flexneri 2a str. 301
agcaaccggcgcggcagc

SEQ ID NO: 1965920 - RNA, 17 nt, Shigella flexneri 2a str. 301
agaugucuuuacccgga

SEQ ID NO: 1965921 - RNA, 15 nt, Shigella flexneri 2a str. 301
agcaauuuacgcuuu

SEQ ID NO: 1965922 - RNA, 12 nt, Shigella flexneri 2a str. 301
agcaaugagcua

SEQ ID NO: 1965923 - RNA, 21 nt, Shigella flexneri 2a str. 301
aggccuacaacuccguugaaa

SEQ ID NO: 1965924 - RNA, 19 nt, Shigella flexneri 2a str. 301
aggccuacaacuccguuga

SEQ ID NO: 1965925 - RNA, 14 nt, Shigella flexneri 2a str. 301
aggccguauccggc

SEQ ID NO: 1965926 - RNA, 21 nt, Shigella flexneri 2a str. 301
aggccuacaaaaucuauugca

SEQ ID NO: 1965927 - RNA, 16 nt, Shigella flexneri 2a str. 301
aggccuauugacgcug

SEQ ID NO: 1965928 - RNA, 23 nt, Shigella flexneri 2a str. 301
aggcgcuggcgcauguuggcgcg

SEQ ID NO: 1965929 - RNA, 12 nt, Shigella flexneri 2a str. 301
aggcgcuggcgc

SEQ ID NO: 1965930 - RNA, 21 nt, Shigella flexneri 2a str. 301
agggaaggguaguguccauaa

SEQ ID NO: 1965931 - RNA, 19 nt, Shigella flexneri 2a str. 301
aggcuuuaauauccggugc

SEQ ID NO: 1965932 - RNA, 20 nt, Shigella flexneri 2a str. 301
aggcguucacgccgcauccg

SEQ ID NO: 1965933 - RNA, 22 nt, Shigella flexneri 2a str. 301
aggcguucacgccgcauccggc

SEQ ID NO: 1965934 - RNA, 22 nt, Shigella flexneri 2a str. 301
aggcguucacgccacauccggc

SEQ ID NO: 1965935 - RNA, 17 nt, Shigella flexneri 2a str. 301
aggcguuaacagcgcau

SEQ ID NO: 1965936 - RNA, 17 nt, Shigella flexneri 2a str. 301
aggcguugauuggcgca

SEQ ID NO: 1965937 - RNA, 22 nt, Shigella flexneri 2a str. 301
aggcuaaagaaaacgaauugca

SEQ ID NO: 1965938 - RNA, 20 nt, Shigella flexneri 2a str. 301
aggcguuuacgccgcaucag

SEQ ID NO: 1965939 - RNA, 18 nt, Shigella flexneri 2a str. 301
aggcggacugaauacgcu

SEQ ID NO: 1965940 - RNA, 19 nt, Shigella flexneri 2a str. 301
aggcggggccaauugcugu

SEQ ID NO: 1965941 - RNA, 13 nt, Shigella flexneri 2a str. 301
aggcgugauucau

SEQ ID NO: 1965942 - RNA, 18 nt, Shigella flexneri 2a str. 301
agcugccuguacggcagu

SEQ ID NO: 1965943 - RNA, 13 nt, Shigella flexneri 2a str. 301
aggauggucgcuu

SEQ ID NO: 1965944 - RNA, 14 nt, Shigella flexneri 2a str. 301
aggauuagccggau

SEQ ID NO: 1965945 - RNA, 23 nt, Shigella flexneri 2a str. 301
aggauggcuggccgugcagaccg

SEQ ID NO: 1965946 - RNA, 15 nt, Shigella flexneri 2a str. 301
agcugcaaccauuug

SEQ ID NO: 1965947 - RNA, 16 nt, Shigella flexneri 2a str. 301
agcugauuucuggcgg

SEQ ID NO: 1965948 - RNA, 13 nt, Shigella flexneri 2a str. 301
aggccaacggccc

SEQ ID NO: 1965949 - RNA, 19 nt, Shigella flexneri 2a str. 301
aggcauucagauaauaggu

SEQ ID NO: 1965950 - RNA, 19 nt, Shigella flexneri 2a str. 301
aggccgcguaccgcagcaa

SEQ ID NO: 1965951 - RNA, 14 nt, Shigella flexneri 2a str. 301
aggccggagccagc

SEQ ID NO: 1965952 - RNA, 23 nt, Shigella flexneri 2a str. 301
aggugauuugcgccugcuuaaca

SEQ ID NO: 1965953 - RNA, 18 nt, Shigella flexneri 2a str. 301
aggugagucgcaaaacuc

SEQ ID NO: 1965954 - RNA, 16 nt, Shigella flexneri 2a str. 301
aggucauuaaaccgcu

SEQ ID NO: 1965955 - RNA, 16 nt, Shigella flexneri 2a str. 301
aggggcuucuuccggc

SEQ ID NO: 1965956 - RNA, 17 nt, Shigella flexneri 2a str. 301
agggcaucgcaggccag

SEQ ID NO: 1965957 - RNA, 23 nt, Shigella flexneri 2a str. 301
agggcauguugagcauugccgcc

SEQ ID NO: 1965958 - RNA, 22 nt, Shigella flexneri 2a str. 301
agggcauucuuaccgggucgca

SEQ ID NO: 1965959 - RNA, 23 nt, Shigella flexneri 2a str. 301
agggcaaacagacuggcaacgac

SEQ ID NO: 1965960 - RNA, 15 nt, Shigella flexneri 2a str. 301
agguacuguaacgcu

SEQ ID NO: 1965961 - RNA, 23 nt, Shigella flexneri 2a str. 301
agguacgguacugaaaccugaac

SEQ ID NO: 1965962 - RNA, 16 nt, Shigella flexneri 2a str. 301
agucauccggcucgua

SEQ ID NO: 1965963 - RNA, 19 nt, Shigella flexneri 2a str. 301
agucaucacuuucagaccg

SEQ ID NO: 1965964 - RNA, 16 nt, Shigella flexneri 2a str. 301
agucaggcgcgcggug

SEQ ID NO: 1965965 - RNA, 14 nt, Shigella flexneri 2a str. 301
aguccgccuucaac

SEQ ID NO: 1965966 - RNA, 19 nt, Shigella flexneri 2a str. 301
aguaaucgggcaacugcug

SEQ ID NO: 1965967 - RNA, 21 nt, Shigella flexneri 2a str. 301
aguaaucuacugcaccgcagg

SEQ ID NO: 1965968 - RNA, 14 nt, Shigella flexneri 2a str. 301
aguaacguuugauu

SEQ ID NO: 1965969 - RNA, 22 nt, Shigella flexneri 2a str. 301
aguaacguuugauuaacgccag

SEQ ID NO: 1965970 - RNA, 20 nt, Shigella flexneri 2a str. 301
aguaagaauaaaacgccuga

SEQ ID NO: 1965971 - RNA, 15 nt, Shigella flexneri 2a str. 301
aguaagaauugauaa

SEQ ID NO: 1965972 - RNA, 16 nt, Shigella flexneri 2a str. 301
aguaagccagcaccau

SEQ ID NO: 1965973 - RNA, 20 nt, Shigella flexneri 2a str. 301
aguacccggccuguuuaucc

SEQ ID NO: 1965974 - RNA, 21 nt, Shigella flexneri 2a str. 301
aguaccuccuggaucacaauc

SEQ ID NO: 1965975 - RNA, 14 nt, Shigella flexneri 2a str. 301
aguaccgcgucgau

SEQ ID NO: 1965976 - RNA, 14 nt, Shigella flexneri 2a str. 301
aguaccaucgucca

SEQ ID NO: 1965977 - RNA, 21 nt, Shigella flexneri 2a str. 301
aguaccgccagugcagcgaag

SEQ ID NO: 1965978 - RNA, 12 nt, Shigella flexneri 2a str. 301
aguaucggcaag

SEQ ID NO: 1965979 - RNA, 20 nt, Shigella flexneri 2a str. 301
aggugcucauuugauugccg

SEQ ID NO: 1965980 - RNA, 22 nt, Shigella flexneri 2a str. 301
agguguuacccgcuaacuggug

SEQ ID NO: 1965981 - RNA, 12 nt, Shigella flexneri 2a str. 301
agguuaacugug

SEQ ID NO: 1965982 - RNA, 19 nt, Shigella flexneri 2a str. 301
agguucuuugcugccguua

SEQ ID NO: 1965983 - RNA, 18 nt, Shigella flexneri 2a str. 301
aguaaaccgucagcacca

SEQ ID NO: 1965984 - RNA, 18 nt, Shigella flexneri 2a str. 301
aguaaaugacagcgaaug

SEQ ID NO: 1965985 - RNA, 22 nt, Shigella flexneri 2a str. 301
agguuuuguugcccagcgcauc

SEQ ID NO: 1965986 - RNA, 14 nt, Shigella flexneri 2a str. 301
agguugugaucauc

SEQ ID NO: 1965987 - RNA, 18 nt, Shigella flexneri 2a str. 301
agugucuuaucuggcauu

SEQ ID NO: 1965988 - RNA, 16 nt, Shigella flexneri 2a str. 301
agugucauucagaucu

SEQ ID NO: 1965989 - RNA, 16 nt, Shigella flexneri 2a str. 301
aguucagucagcagug

SEQ ID NO: 1965990 - RNA, 18 nt, Shigella flexneri 2a str. 301
agugugaauaccgcugcc

SEQ ID NO: 1965991 - RNA, 23 nt, Shigella flexneri 2a str. 301
agucgauaacgaccuugcaauaa

SEQ ID NO: 1965992 - RNA, 21 nt, Shigella flexneri 2a str. 301
aguuccgcaaagcccaucacc

SEQ ID NO: 1965993 - RNA, 15 nt, Shigella flexneri 2a str. 301
aguuccgugagcgga

SEQ ID NO: 1965994 - RNA, 13 nt, Shigella flexneri 2a str. 301
aguugaucgccaa

SEQ ID NO: 1965995 - RNA, 13 nt, Shigella flexneri 2a str. 301
aguugaucaaaua

SEQ ID NO: 1965996 - RNA, 20 nt, Shigella flexneri 2a str. 301
aguugaucagccaggcgaug

SEQ ID NO: 1965997 - RNA, 22 nt, Shigella flexneri 2a str. 301
aguucugcagcccgaacgguca

SEQ ID NO: 1965998 - RNA, 18 nt, Shigella flexneri 2a str. 301
auaaaccugcuggcgcac

SEQ ID NO: 1965999 - RNA, 20 nt, Shigella flexneri 2a str. 301
auaaaccgcucgugggcauc

SEQ ID NO: 1966000 - RNA, 17 nt, Shigella flexneri 2a str. 301
auaaacucaaucaggcu

SEQ ID NO: 1966001 - RNA, 19 nt, Shigella flexneri 2a str. 301
auaaaaucaauaugcauaa

SEQ ID NO: 1966002 - RNA, 21 nt, Shigella flexneri 2a str. 301
auaaagaugccauuggcauaa

SEQ ID NO: 1966003 - RNA, 18 nt, Shigella flexneri 2a str. 301
aguuuguguguggcgcgc

SEQ ID NO: 1966004 - RNA, 16 nt, Shigella flexneri 2a str. 301
aguuucagaauauccg

SEQ ID NO: 1966005 - RNA, 18 nt, Shigella flexneri 2a str. 301
aguuguugcauaggaauu

SEQ ID NO: 1966006 - RNA, 16 nt, Shigella flexneri 2a str. 301
aguuuuucccgcuucg

SEQ ID NO: 1966007 - RNA, 18 nt, Shigella flexneri 2a str. 301
auaauccccaaugaccuu

SEQ ID NO: 1966008 - RNA, 22 nt, Shigella flexneri 2a str. 301
auaauccaucccgcucuguaag

SEQ ID NO: 1966009 - RNA, 18 nt, Shigella flexneri 2a str. 301
auaaucgggaauacagaa

SEQ ID NO: 1966010 - RNA, 15 nt, Shigella flexneri 2a str. 301
auaaucgggaacgcu

SEQ ID NO: 1966011 - RNA, 16 nt, Shigella flexneri 2a str. 301
auaaucaccaucagca

SEQ ID NO: 1966012 - RNA, 23 nt, Shigella flexneri 2a str. 301
auaaucagauugugguugcgcag

SEQ ID NO: 1966013 - RNA, 17 nt, Shigella flexneri 2a str. 301
auaaggcguuacgcagc

SEQ ID NO: 1966014 - RNA, 15 nt, Shigella flexneri 2a str. 301
auaauugcgaugcca

SEQ ID NO: 1966015 - RNA, 21 nt, Shigella flexneri 2a str. 301
auaauuuaugccugauacgca

SEQ ID NO: 1966016 - RNA, 15 nt, Shigella flexneri 2a str. 301
auacaggaagcgaau

SEQ ID NO: 1966017 - RNA, 14 nt, Shigella flexneri 2a str. 301
auaaugcucgaacg

SEQ ID NO: 1966018 - RNA, 13 nt, Shigella flexneri 2a str. 301
auaauggcuguug

SEQ ID NO: 1966019 - RNA, 22 nt, Shigella flexneri 2a str. 301
auaauguuucaguguuaaacgc

SEQ ID NO: 1966020 - RNA, 12 nt, Shigella flexneri 2a str. 301
auaaugcaacau

SEQ ID NO: 1966021 - RNA, 18 nt, Shigella flexneri 2a str. 301
auaaugcccgaugaccuu

SEQ ID NO: 1966022 - RNA, 12 nt, Shigella flexneri 2a str. 301
auaaugccugau

SEQ ID NO: 1966023 - RNA, 20 nt, Shigella flexneri 2a str. 301
auaaucucgccuuaucagaa

SEQ ID NO: 1966024 - RNA, 21 nt, Shigella flexneri 2a str. 301
auacaucgcgcuuaucgccag

SEQ ID NO: 1966025 - RNA, 14 nt, Shigella flexneri 2a str. 301
auacaggugcagcc

SEQ ID NO: 1966026 - RNA, 21 nt, Shigella flexneri 2a str. 301
auacaggggccaguuccgccg

SEQ ID NO: 1966027 - RNA, 17 nt, Shigella flexneri 2a str. 301
auaccauggcucaccag

SEQ ID NO: 1966028 - RNA, 15 nt, Shigella flexneri 2a str. 301
auaccgauaucgcca

SEQ ID NO: 1966029 - RNA, 17 nt, Shigella flexneri 2a str. 301
auaccgauuacucagca

SEQ ID NO: 1966030 - RNA, 16 nt, Shigella flexneri 2a str. 301
auaccgauaucgccau

SEQ ID NO: 1966031 - RNA, 20 nt, Shigella flexneri 2a str. 301
auacguccaccccagcagaa

SEQ ID NO: 1966032 - RNA, 18 nt, Shigella flexneri 2a str. 301
auagcaucuuccagcgug

SEQ ID NO: 1966033 - RNA, 22 nt, Shigella flexneri 2a str. 301
auagaucuaaaugccacugaau

SEQ ID NO: 1966034 - RNA, 20 nt, Shigella flexneri 2a str. 301
auagagcgcggcgcaggcaa

SEQ ID NO: 1966035 - RNA, 16 nt, Shigella flexneri 2a str. 301
auacugauccgcuucg

SEQ ID NO: 1966036 - RNA, 18 nt, Shigella flexneri 2a str. 301
auacuggcuaagaagccu

SEQ ID NO: 1966037 - RNA, 16 nt, Shigella flexneri 2a str. 301
auagagauagccugau

SEQ ID NO: 1966038 - RNA, 13 nt, Shigella flexneri 2a str. 301
auacuuccacgca

SEQ ID NO: 1966039 - RNA, 15 nt, Shigella flexneri 2a str. 301
auacugacagcgcgc

SEQ ID NO: 1966040 - RNA, 19 nt, Shigella flexneri 2a str. 301
auacugcgcguggucagca

SEQ ID NO: 1966041 - RNA, 19 nt, Shigella flexneri 2a str. 301
aucaacaguuuguugcauu

SEQ ID NO: 1966042 - RNA, 22 nt, Shigella flexneri 2a str. 301
aucaacaaaccaaaaccgcucg

SEQ ID NO: 1966043 - RNA, 15 nt, Shigella flexneri 2a str. 301
aucaaaugaaugcca

SEQ ID NO: 1966044 - RNA, 16 nt, Shigella flexneri 2a str. 301
aucaaauaccaccagc

SEQ ID NO: 1966045 - RNA, 12 nt, Shigella flexneri 2a str. 301
aucaacaugaug

SEQ ID NO: 1966046 - RNA, 19 nt, Shigella flexneri 2a str. 301
aucaacgacaaaaauacca

SEQ ID NO: 1966047 - RNA, 17 nt, Shigella flexneri 2a str. 301
aucaaacgugacauucu

SEQ ID NO: 1966048 - RNA, 13 nt, Shigella flexneri 2a str. 301
aucaaagaugaug

SEQ ID NO: 1966049 - RNA, 13 nt, Shigella flexneri 2a str. 301
aucaauaccagcc

SEQ ID NO: 1966050 - RNA, 22 nt, Shigella flexneri 2a str. 301
aucaaugugcugagaacaagau

SEQ ID NO: 1966051 - RNA, 14 nt, Shigella flexneri 2a str. 301
aucacacagcgguu

SEQ ID NO: 1966052 - RNA, 16 nt, Shigella flexneri 2a str. 301
aucaauaacagcgcaa

SEQ ID NO: 1966053 - RNA, 19 nt, Shigella flexneri 2a str. 301
aucaagccccagcaggaug

SEQ ID NO: 1966054 - RNA, 21 nt, Shigella flexneri 2a str. 301
auagcgcacaugcaacuucgc

SEQ ID NO: 1966055 - RNA, 19 nt, Shigella flexneri 2a str. 301
auauccggugcaacugcuu

SEQ ID NO: 1966056 - RNA, 11 nt, Shigella flexneri 2a str. 301
auauccagcca

SEQ ID NO: 1966057 - RNA, 15 nt, Shigella flexneri 2a str. 301
auagccacuucaucg

SEQ ID NO: 1966058 - RNA, 17 nt, Shigella flexneri 2a str. 301
auagccagccucaucca

SEQ ID NO: 1966059 - RNA, 13 nt, Shigella flexneri 2a str. 301
auagccaggcgga

SEQ ID NO: 1966060 - RNA, 21 nt, Shigella flexneri 2a str. 301
auagccagguuuaccagcagc

SEQ ID NO: 1966061 - RNA, 14 nt, Shigella flexneri 2a str. 301
auagccugccagag

SEQ ID NO: 1966062 - RNA, 16 nt, Shigella flexneri 2a str. 301
auauggcucugcggcg

SEQ ID NO: 1966063 - RNA, 14 nt, Shigella flexneri 2a str. 301
auaugcauaaaccg

SEQ ID NO: 1966064 - RNA, 13 nt, Shigella flexneri 2a str. 301
auaugauaaaccu

SEQ ID NO: 1966065 - RNA, 15 nt, Shigella flexneri 2a str. 301
auauuuagccagcaa

SEQ ID NO: 1966066 - RNA, 17 nt, Shigella flexneri 2a str. 301
aucagcauaaucaccag

SEQ ID NO: 1966067 - RNA, 15 nt, Shigella flexneri 2a str. 301
aucagcgcagcaccc

SEQ ID NO: 1966068 - RNA, 14 nt, Shigella flexneri 2a str. 301
aucacuuccagcag

SEQ ID NO: 1966069 - RNA, 15 nt, Shigella flexneri 2a str. 301
aucacuuccagcagu

SEQ ID NO: 1966070 - RNA, 16 nt, Shigella flexneri 2a str. 301
aucacuuguucagcga

SEQ ID NO: 1966071 - RNA, 23 nt, Shigella flexneri 2a str. 301
aucacugccagaauagccgcagc

SEQ ID NO: 1966072 - RNA, 14 nt, Shigella flexneri 2a str. 301
aucacuaacgacau

SEQ ID NO: 1966073 - RNA, 20 nt, Shigella flexneri 2a str. 301
aucagacaaaugucacugcu

SEQ ID NO: 1966074 - RNA, 19 nt, Shigella flexneri 2a str. 301
aucagaccuucgcuaucaa

SEQ ID NO: 1966075 - RNA, 23 nt, Shigella flexneri 2a str. 301
aucagaggcgaaccgcugucacc

SEQ ID NO: 1966076 - RNA, 14 nt, Shigella flexneri 2a str. 301
aucagaucgcgacc

SEQ ID NO: 1966077 - RNA, 16 nt, Shigella flexneri 2a str. 301
aucagcaacgaaguaa

SEQ ID NO: 1966078 - RNA, 16 nt, Shigella flexneri 2a str. 301
aucagcaaacuauccc

SEQ ID NO: 1966079 - RNA, 17 nt, Shigella flexneri 2a str. 301
aucacgcgaccaucgcg

SEQ ID NO: 1966080 - RNA, 12 nt, Shigella flexneri 2a str. 301
aucacgcaucac

SEQ ID NO: 1966081 - RNA, 16 nt, Shigella flexneri 2a str. 301
aucacgaucucgccag

SEQ ID NO: 1966082 - RNA, 15 nt, Shigella flexneri 2a str. 301
aucaccuuacggcac

SEQ ID NO: 1966083 - RNA, 21 nt, Shigella flexneri 2a str. 301
aucacgaagcccauuucagua

SEQ ID NO: 1966084 - RNA, 16 nt, Shigella flexneri 2a str. 301
aucaccugaugcccgu

SEQ ID NO: 1966085 - RNA, 14 nt, Shigella flexneri 2a str. 301
aucaccuccagccu

SEQ ID NO: 1966086 - RNA, 13 nt, Shigella flexneri 2a str. 301
aucaccauccacg

SEQ ID NO: 1966087 - RNA, 17 nt, Shigella flexneri 2a str. 301
aucaccaguccaucggc

SEQ ID NO: 1966088 - RNA, 23 nt, Shigella flexneri 2a str. 301
aucacccgugagaacugcugcau

SEQ ID NO: 1966089 - RNA, 18 nt, Shigella flexneri 2a str. 301
aucacaccugcucagccc

SEQ ID NO: 1966090 - RNA, 12 nt, Shigella flexneri 2a str. 301
aucacaccgcga

SEQ ID NO: 1966091 - RNA, 15 nt, Shigella flexneri 2a str. 301
aucacacuaccggaa

SEQ ID NO: 1966092 - RNA, 19 nt, Shigella flexneri 2a str. 301
cccuucuucuacugcgcgc

SEQ ID NO: 1966093 - RNA, 19 nt, Shigella flexneri 2a str. 301
cccuugcuucgccaguucg

SEQ ID NO: 1966094 - RNA, 14 nt, Shigella flexneri 2a str. 301
cccuuccagcacga

SEQ ID NO: 1966095 - RNA, 16 nt, Shigella flexneri 2a str. 301
cccguuuuccgggcaa

SEQ ID NO: 1966096 - RNA, 15 nt, Shigella flexneri 2a str. 301
cccugcagcuggucg

SEQ ID NO: 1966097 - RNA, 15 nt, Shigella flexneri 2a str. 301
cccugcggcugcuga

SEQ ID NO: 1966098 - RNA, 22 nt, Shigella flexneri 2a str. 301
ccgaccgcaaggaagccugaca

SEQ ID NO: 1966099 - RNA, 15 nt, Shigella flexneri 2a str. 301
ccgaccaucgccagc

SEQ ID NO: 1966100 - RNA, 12 nt, Shigella flexneri 2a str. 301
ccgaccgcuuca

SEQ ID NO: 1966101 - RNA, 20 nt, Shigella flexneri 2a str. 301
ccgaccuacaaaaccugcac

SEQ ID NO: 1966102 - RNA, 14 nt, Shigella flexneri 2a str. 301
ccgacauugccagc

SEQ ID NO: 1966103 - RNA, 13 nt, Shigella flexneri 2a str. 301
cccgcagcaaccg

SEQ ID NO: 1966104 - RNA, 20 nt, Shigella flexneri 2a str. 301
cccgcucaaacaccgucgca

SEQ ID NO: 1966105 - RNA, 20 nt, Shigella flexneri 2a str. 301
cccgcugaaaagcgggcuga

SEQ ID NO: 1966106 - RNA, 23 nt, Shigella flexneri 2a str. 301
cccggcauucaccucugcggcaa

SEQ ID NO: 1966107 - RNA, 15 nt, Shigella flexneri 2a str. 301
cccggcaucgcauuc

SEQ ID NO: 1966108 - RNA, 18 nt, Shigella flexneri 2a str. 301
cccggcaaaugucggggu

SEQ ID NO: 1966109 - RNA, 17 nt, Shigella flexneri 2a str. 301
cccggccugugucacuu

SEQ ID NO: 1966110 - RNA, 22 nt, Shigella flexneri 2a str. 301
cccagugguuucgccagcaccg

SEQ ID NO: 1966111 - RNA, 21 nt, Shigella flexneri 2a str. 301
cccagugguuucgccagcacc

SEQ ID NO: 1966112 - RNA, 17 nt, Shigella flexneri 2a str. 301
cccaucacaauggcaca

SEQ ID NO: 1966113 - RNA, 14 nt, Shigella flexneri 2a str. 301
cccagucauccggc

SEQ ID NO: 1966114 - RNA, 19 nt, Shigella flexneri 2a str. 301
cccagcgcggugacgcaca

SEQ ID NO: 1966115 - RNA, 15 nt, Shigella flexneri 2a str. 301
cccagcgcgaucgca

SEQ ID NO: 1966116 - RNA, 17 nt, Shigella flexneri 2a str. 301
ccauuccguuucuccac

SEQ ID NO: 1966117 - RNA, 19 nt, Shigella flexneri 2a str. 301
ccauuccggccaucgccug

SEQ ID NO: 1966118 - RNA, 12 nt, Shigella flexneri 2a str. 301
ccauucccugcu

SEQ ID NO: 1966119 - RNA, 19 nt, Shigella flexneri 2a str. 301
cccacgauugaucucguug

SEQ ID NO: 1966120 - RNA, 11 nt, Shigella flexneri 2a str. 301
ccccaaugacc

SEQ ID NO: 1966121 - RNA, 15 nt, Shigella flexneri 2a str. 301
ccccagcgucagcau

SEQ ID NO: 1966122 - RNA, 16 nt, Shigella flexneri 2a str. 301
ccccggcaugauugag

SEQ ID NO: 1966123 - RNA, 19 nt, Shigella flexneri 2a str. 301
ccaucgcaccaaacgggca

SEQ ID NO: 1966124 - RNA, 12 nt, Shigella flexneri 2a str. 301
ccaucaucggca

SEQ ID NO: 1966125 - RNA, 13 nt, Shigella flexneri 2a str. 301
ccaucaugcgcca

SEQ ID NO: 1966126 - RNA, 14 nt, Shigella flexneri 2a str. 301
ccauccacagggug

SEQ ID NO: 1966127 - RNA, 13 nt, Shigella flexneri 2a str. 301
ccauacagcagca

SEQ ID NO: 1966128 - RNA, 22 nt, Shigella flexneri 2a str. 301
ccauaccugcacaaauagccag

SEQ ID NO: 1966129 - RNA, 23 nt, Shigella flexneri 2a str. 301
ccaucagguaauaggcaggcauc

SEQ ID NO: 1966130 - RNA, 18 nt, Shigella flexneri 2a str. 301
ccaucagggcggccgcca

SEQ ID NO: 1966131 - RNA, 17 nt, Shigella flexneri 2a str. 301
ccaugcaauuaccgcca

SEQ ID NO: 1966132 - RNA, 11 nt, Shigella flexneri 2a str. 301
ccaugauuucg

SEQ ID NO: 1966133 - RNA, 16 nt, Shigella flexneri 2a str. 301
ccaugacaaauaacgg

SEQ ID NO: 1966134 - RNA, 21 nt, Shigella flexneri 2a str. 301
ccaugauauuggcaucgccag

SEQ ID NO: 1966135 - RNA, 23 nt, Shigella flexneri 2a str. 301
ccaugccgcccagaagcacugcc

SEQ ID NO: 1966136 - RNA, 16 nt, Shigella flexneri 2a str. 301
ccaugccaucugccag

SEQ ID NO: 1966137 - RNA, 18 nt, Shigella flexneri 2a str. 301
ccaugcaggaucgcucca

SEQ ID NO: 1966138 - RNA, 19 nt, Shigella flexneri 2a str. 301
ccauuaaacgcaguaagcg

SEQ ID NO: 1966139 - RNA, 17 nt, Shigella flexneri 2a str. 301
ccauucauaauugcgau

SEQ ID NO: 1966140 - RNA, 22 nt, Shigella flexneri 2a str. 301
ccauucauaauugcgaugccag

SEQ ID NO: 1966141 - RNA, 18 nt, Shigella flexneri 2a str. 301
ccaugcuuugcaucccag

SEQ ID NO: 1966142 - RNA, 17 nt, Shigella flexneri 2a str. 301
ccaggugagauccggga

SEQ ID NO: 1966143 - RNA, 18 nt, Shigella flexneri 2a str. 301
ccaguucuacaaucugcc

SEQ ID NO: 1966144 - RNA, 21 nt, Shigella flexneri 2a str. 301
ccaguucaacgcccgcuuuca

SEQ ID NO: 1966145 - RNA, 20 nt, Shigella flexneri 2a str. 301
ccaguucaacgcggcgcugc

SEQ ID NO: 1966146 - RNA, 18 nt, Shigella flexneri 2a str. 301
ccaguuacugccaccauc

SEQ ID NO: 1966147 - RNA, 16 nt, Shigella flexneri 2a str. 301
ccagucgucaucccag

SEQ ID NO: 1966148 - RNA, 22 nt, Shigella flexneri 2a str. 301
ccagugguuucgccagcaccgg

SEQ ID NO: 1966149 - RNA, 18 nt, Shigella flexneri 2a str. 301
ccaggaucggugcugcca

SEQ ID NO: 1966150 - RNA, 15 nt, Shigella flexneri 2a str. 301
ccaggaucagaaugc

SEQ ID NO: 1966151 - RNA, 21 nt, Shigella flexneri 2a str. 301
ccaggucaucauugcagucau

SEQ ID NO: 1966152 - RNA, 21 nt, Shigella flexneri 2a str. 301
ccagauugaucucuaaggcau

SEQ ID NO: 1966153 - RNA, 16 nt, Shigella flexneri 2a str. 301
ccagauuaaucagcag

SEQ ID NO: 1966154 - RNA, 20 nt, Shigella flexneri 2a str. 301
ccagaggaugcacucgcauc

SEQ ID NO: 1966155 - RNA, 13 nt, Shigella flexneri 2a str. 301
ccagcaagcgcac

SEQ ID NO: 1966156 - RNA, 13 nt, Shigella flexneri 2a str. 301
ccagcaagccacu

SEQ ID NO: 1966157 - RNA, 19 nt, Shigella flexneri 2a str. 301
ccagcaaccaaugccacca

SEQ ID NO: 1966158 - RNA, 17 nt, Shigella flexneri 2a str. 301
ccagcaauaacaacacg

SEQ ID NO: 1966159 - RNA, 14 nt, Shigella flexneri 2a str. 301
ccagcaauccugca

SEQ ID NO: 1966160 - RNA, 20 nt, Shigella flexneri 2a str. 301
ccagcacaucaucaaagcca

SEQ ID NO: 1966161 - RNA, 20 nt, Shigella flexneri 2a str. 301
ccagcagcugcguggcgcuu

SEQ ID NO: 1966162 - RNA, 19 nt, Shigella flexneri 2a str. 301
ccagcaggauguuccggca

SEQ ID NO: 1966163 - RNA, 12 nt, Shigella flexneri 2a str. 301
ccagcaucggca

SEQ ID NO: 1966164 - RNA, 14 nt, Shigella flexneri 2a str. 301
ccagcaucccggca

SEQ ID NO: 1966165 - RNA, 14 nt, Shigella flexneri 2a str. 301
ccagcagcagccgg

SEQ ID NO: 1966166 - RNA, 13 nt, Shigella flexneri 2a str. 301
ccagcagcagcgg

SEQ ID NO: 1966167 - RNA, 11 nt, Shigella flexneri 2a str. 301
ccagcaccgca

SEQ ID NO: 1966168 - RNA, 18 nt, Shigella flexneri 2a str. 301
ccacgucaucagcaauuu

SEQ ID NO: 1966169 - RNA, 17 nt, Shigella flexneri 2a str. 301
ccacgcugcaucgccaa

SEQ ID NO: 1966170 - RNA, 15 nt, Shigella flexneri 2a str. 301
ccacuuccgcgucaa

SEQ ID NO: 1966171 - RNA, 16 nt, Shigella flexneri 2a str. 301
ccacuuccaccagcgg

SEQ ID NO: 1966172 - RNA, 21 nt, Shigella flexneri 2a str. 301
ccacuuaauaagaagaaaccg

SEQ ID NO: 1966173 - RNA, 20 nt, Shigella flexneri 2a str. 301
ccacugacuucucugggaga

SEQ ID NO: 1966174 - RNA, 17 nt, Shigella flexneri 2a str. 301
ccacucugaccugacaa

SEQ ID NO: 1966175 - RNA, 13 nt, Shigella flexneri 2a str. 301
ccagaaccgcgua

SEQ ID NO: 1966176 - RNA, 23 nt, Shigella flexneri 2a str. 301
ccagaacacuguuaccgcugcug

SEQ ID NO: 1966177 - RNA, 16 nt, Shigella flexneri 2a str. 301
ccagaaaugcagcugu

SEQ ID NO: 1966178 - RNA, 19 nt, Shigella flexneri 2a str. 301
ccagaaacucugcggcauc

SEQ ID NO: 1966179 - RNA, 19 nt, Shigella flexneri 2a str. 301
ccagaagcacugccagaau

SEQ ID NO: 1966180 - RNA, 19 nt, Shigella flexneri 2a str. 301
ccagaagaaagccggauga

SEQ ID NO: 1966181 - RNA, 21 nt, Shigella flexneri 2a str. 301
ccagacucgccagacgcaucg

SEQ ID NO: 1966182 - RNA, 21 nt, Shigella flexneri 2a str. 301
ccagacuccgagaaucauaaa

SEQ ID NO: 1966183 - RNA, 14 nt, Shigella flexneri 2a str. 301
ccagacgggcauuu

SEQ ID NO: 1966184 - RNA, 13 nt, Shigella flexneri 2a str. 301
ccagaaugcccca

SEQ ID NO: 1966185 - RNA, 12 nt, Shigella flexneri 2a str. 301
ccagcuccagcc

SEQ ID NO: 1966186 - RNA, 13 nt, Shigella flexneri 2a str. 301
ccagcucgcgcca

SEQ ID NO: 1966187 - RNA, 18 nt, Shigella flexneri 2a str. 301
ccagcucggcaaucuguu

SEQ ID NO: 1966188 - RNA, 14 nt, Shigella flexneri 2a str. 301
ccagcucagugacc

SEQ ID NO: 1966189 - RNA, 23 nt, Shigella flexneri 2a str. 301
ccagcucagugaccgaaccuguu

SEQ ID NO: 1966190 - RNA, 18 nt, Shigella flexneri 2a str. 301
ccagcucaaggcgguaaa

SEQ ID NO: 1966191 - RNA, 13 nt, Shigella flexneri 2a str. 301
ccagcguggucau

SEQ ID NO: 1966192 - RNA, 17 nt, Shigella flexneri 2a str. 301
ccagcuugcuuuccagc

SEQ ID NO: 1966193 - RNA, 17 nt, Shigella flexneri 2a str. 301
ccagcgauuuaucggca

SEQ ID NO: 1966194 - RNA, 19 nt, Shigella flexneri 2a str. 301
ccagcaucuccugcaacag

SEQ ID NO: 1966195 - RNA, 17 nt, Shigella flexneri 2a str. 301
ccagcaugaucagcgca

SEQ ID NO: 1966196 - RNA, 23 nt, Shigella flexneri 2a str. 301
ccagcaucugcauggugccgcca

SEQ ID NO: 1966197 - RNA, 14 nt, Shigella flexneri 2a str. 301
ccagccugcaaacg

SEQ ID NO: 1966198 - RNA, 17 nt, Shigella flexneri 2a str. 301
ccagcgauaccggugca

SEQ ID NO: 1966199 - RNA, 19 nt, Shigella flexneri 2a str. 301
ccagcgaugcccagugacc

SEQ ID NO: 1966200 - RNA, 15 nt, Shigella flexneri 2a str. 301
ccagcgaagccagcu

SEQ ID NO: 1966201 - RNA, 15 nt, Shigella flexneri 2a str. 301
ccagcgaauccagca

SEQ ID NO: 1966202 - RNA, 22 nt, Shigella flexneri 2a str. 301
ccagcgaaccuuccaucgcauc

SEQ ID NO: 1966203 - RNA, 18 nt, Shigella flexneri 2a str. 301
cauucaccgacgugauga

SEQ ID NO: 1966204 - RNA, 12 nt, Shigella flexneri 2a str. 301
cauucaccaguu

SEQ ID NO: 1966205 - RNA, 16 nt, Shigella flexneri 2a str. 301
cauucgcaguugcagu

SEQ ID NO: 1966206 - RNA, 17 nt, Shigella flexneri 2a str. 301
cauuaucaugacgccac

SEQ ID NO: 1966207 - RNA, 18 nt, Shigella flexneri 2a str. 301
cauuauauaaugccaggc

SEQ ID NO: 1966208 - RNA, 18 nt, Shigella flexneri 2a str. 301
cauuagugauuaacgcuu

SEQ ID NO: 1966209 - RNA, 14 nt, Shigella flexneri 2a str. 301
cauuaugcuggaau

SEQ ID NO: 1966210 - RNA, 12 nt, Shigella flexneri 2a str. 301
cauucaaacaug

SEQ ID NO: 1966211 - RNA, 19 nt, Shigella flexneri 2a str. 301
cauguugauuaccugucgc

SEQ ID NO: 1966212 - RNA, 22 nt, Shigella flexneri 2a str. 301
cauguugcgcagaguuuccagg

SEQ ID NO: 1966213 - RNA, 19 nt, Shigella flexneri 2a str. 301
cauguuucaacggaccaau

SEQ ID NO: 1966214 - RNA, 22 nt, Shigella flexneri 2a str. 301
cauuaaccagccacugcgccau

SEQ ID NO: 1966215 - RNA, 11 nt, Shigella flexneri 2a str. 301
cauuaccgcga

SEQ ID NO: 1966216 - RNA, 22 nt, Shigella flexneri 2a str. 301
cauuacccaggaagaccugcag

SEQ ID NO: 1966217 - RNA, 14 nt, Shigella flexneri 2a str. 301
cauuacgcgccccu

SEQ ID NO: 1966218 - RNA, 18 nt, Shigella flexneri 2a str. 301
cauuacggcauaacgccg

SEQ ID NO: 1966219 - RNA, 15 nt, Shigella flexneri 2a str. 301
cauuagccauugaga

SEQ ID NO: 1966220 - RNA, 22 nt, Shigella flexneri 2a str. 301
cauuaaugcgcccagcgucagc

SEQ ID NO: 1966221 - RNA, 17 nt, Shigella flexneri 2a str. 301
ccaacaauagugccgca

SEQ ID NO: 1966222 - RNA, 14 nt, Shigella flexneri 2a str. 301
ccaaaacagcgaca

SEQ ID NO: 1966223 - RNA, 15 nt, Shigella flexneri 2a str. 301
cauuuuuacugcgcg

SEQ ID NO: 1966224 - RNA, 13 nt, Shigella flexneri 2a str. 301
cauuuauuaccuu

SEQ ID NO: 1966225 - RNA, 17 nt, Shigella flexneri 2a str. 301
cauuuacgccgcauccg

SEQ ID NO: 1966226 - RNA, 13 nt, Shigella flexneri 2a str. 301
cauuuccccaauc

SEQ ID NO: 1966227 - RNA, 19 nt, Shigella flexneri 2a str. 301
cauuguuguuggauccccu

SEQ ID NO: 1966228 - RNA, 14 nt, Shigella flexneri 2a str. 301
cauuguuuuccaga

SEQ ID NO: 1966229 - RNA, 19 nt, Shigella flexneri 2a str. 301
cauuguuuuuuuacgcaac

SEQ ID NO: 1966230 - RNA, 16 nt, Shigella flexneri 2a str. 301
cauugaccagaucagu

SEQ ID NO: 1966231 - RNA, 18 nt, Shigella flexneri 2a str. 301
cauugagcuggucugaau

SEQ ID NO: 1966232 - RNA, 15 nt, Shigella flexneri 2a str. 301
caugcuggauggcgc

SEQ ID NO: 1966233 - RNA, 14 nt, Shigella flexneri 2a str. 301
caugcugccgggca

SEQ ID NO: 1966234 - RNA, 14 nt, Shigella flexneri 2a str. 301
cauggcucaccagc

SEQ ID NO: 1966235 - RNA, 15 nt, Shigella flexneri 2a str. 301
cauguaacgaugcau

SEQ ID NO: 1966236 - RNA, 20 nt, Shigella flexneri 2a str. 301
cauguaccguugcugccagu

SEQ ID NO: 1966237 - RNA, 18 nt, Shigella flexneri 2a str. 301
caugguuuauuucccaga

SEQ ID NO: 1966238 - RNA, 19 nt, Shigella flexneri 2a str. 301
caugugauuuaaaucaaac

SEQ ID NO: 1966239 - RNA, 17 nt, Shigella flexneri 2a str. 301
caugucgguacagagca

SEQ ID NO: 1966240 - RNA, 12 nt, Shigella flexneri 2a str. 301
cauguucaucaa

SEQ ID NO: 1966241 - RNA, 15 nt, Shigella flexneri 2a str. 301
caugcucacagagua

SEQ ID NO: 1966242 - RNA, 21 nt, Shigella flexneri 2a str. 301
caugcgguucacgcgccagag

SEQ ID NO: 1966243 - RNA, 17 nt, Shigella flexneri 2a str. 301
caugccggccagcgcca

SEQ ID NO: 1966244 - RNA, 17 nt, Shigella flexneri 2a str. 301
caugccggaugcggcgu

SEQ ID NO: 1966245 - RNA, 23 nt, Shigella flexneri 2a str. 301
caugccgggcaaaagucaccagu

SEQ ID NO: 1966246 - RNA, 19 nt, Shigella flexneri 2a str. 301
caucggcuaaaccaucagg

SEQ ID NO: 1966247 - RNA, 14 nt, Shigella flexneri 2a str. 301
caugauguggugca

SEQ ID NO: 1966248 - RNA, 14 nt, Shigella flexneri 2a str. 301
ccaaccaccgccag

SEQ ID NO: 1966249 - RNA, 15 nt, Shigella flexneri 2a str. 301
ccaacaucaugccag

SEQ ID NO: 1966250 - RNA, 21 nt, Shigella flexneri 2a str. 301
ccaacauauaaguggcgcucu

SEQ ID NO: 1966251 - RNA, 23 nt, Shigella flexneri 2a str. 301
ccaaccacggaguugaccagcuc

SEQ ID NO: 1966252 - RNA, 15 nt, Shigella flexneri 2a str. 301
ccaaucaucgcggca

SEQ ID NO: 1966253 - RNA, 22 nt, Shigella flexneri 2a str. 301
ccaaucacgcccauugagcugg

SEQ ID NO: 1966254 - RNA, 18 nt, Shigella flexneri 2a str. 301
ccaaucgcaauaccggca

SEQ ID NO: 1966255 - RNA, 18 nt, Shigella flexneri 2a str. 301
ccaaucccggaagccacc

SEQ ID NO: 1966256 - RNA, 19 nt, Shigella flexneri 2a str. 301
ccaaugaaagccccaccag

SEQ ID NO: 1966257 - RNA, 15 nt, Shigella flexneri 2a str. 301
ccaaucugugccgcu

SEQ ID NO: 1966258 - RNA, 14 nt, Shigella flexneri 2a str. 301
ccaccacccagcgc

SEQ ID NO: 1966259 - RNA, 19 nt, Shigella flexneri 2a str. 301
ccaccacaacauucccauc

SEQ ID NO: 1966260 - RNA, 18 nt, Shigella flexneri 2a str. 301
ccacaguugaucagccag

SEQ ID NO: 1966261 - RNA, 18 nt, Shigella flexneri 2a str. 301
ccacagggugaucaccag

SEQ ID NO: 1966262 - RNA, 21 nt, Shigella flexneri 2a str. 301
ccacaccaccgcaaucgccag

SEQ ID NO: 1966263 - RNA, 17 nt, Shigella flexneri 2a str. 301
ccacacacgauccugca

SEQ ID NO: 1966264 - RNA, 20 nt, Shigella flexneri 2a str. 301
ccacagccgagcgccaccau

SEQ ID NO: 1966265 - RNA, 13 nt, Shigella flexneri 2a str. 301
ccacagacccagg

SEQ ID NO: 1966266 - RNA, 20 nt, Shigella flexneri 2a str. 301
ccacccauguugaucgccac

SEQ ID NO: 1966267 - RNA, 18 nt, Shigella flexneri 2a str. 301
ccaccccagacuuccccg

SEQ ID NO: 1966268 - RNA, 20 nt, Shigella flexneri 2a str. 301
ccaccaggaacgcgccaaga

SEQ ID NO: 1966269 - RNA, 14 nt, Shigella flexneri 2a str. 301
ccacccaccagcgc

SEQ ID NO: 1966270 - RNA, 19 nt, Shigella flexneri 2a str. 301
ccaccagcggaauaucaga

SEQ ID NO: 1966271 - RNA, 22 nt, Shigella flexneri 2a str. 301
caggcccgccagcgccugggaa

SEQ ID NO: 1966272 - RNA, 21 nt, Shigella flexneri 2a str. 301
caggcuguuaccccugcggcc

SEQ ID NO: 1966273 - RNA, 21 nt, Shigella flexneri 2a str. 301
caggcuucaacacaggccggc

SEQ ID NO: 1966274 - RNA, 16 nt, Shigella flexneri 2a str. 301
caggcuuaauugcgca

SEQ ID NO: 1966275 - RNA, 13 nt, Shigella flexneri 2a str. 301
caggcuuuccguc

SEQ ID NO: 1966276 - RNA, 23 nt, Shigella flexneri 2a str. 301
cagggacgagucgucgauaucga

SEQ ID NO: 1966277 - RNA, 23 nt, Shigella flexneri 2a str. 301
cagggccucuccuuuaccacucu

SEQ ID NO: 1966278 - RNA, 21 nt, Shigella flexneri 2a str. 301
cagggcguacuggcgguuuuc

SEQ ID NO: 1966279 - RNA, 17 nt, Shigella flexneri 2a str. 301
caggcucagaagacgcu

SEQ ID NO: 1966280 - RNA, 13 nt, Shigella flexneri 2a str. 301
caggcuccggaaa

SEQ ID NO: 1966281 - RNA, 20 nt, Shigella flexneri 2a str. 301
caggcuccuguagcuggaaa

SEQ ID NO: 1966282 - RNA, 21 nt, Shigella flexneri 2a str. 301
caggcucgccgccgcuggcgu

SEQ ID NO: 1966283 - RNA, 11 nt, Shigella flexneri 2a str. 301
caggcgugauu

SEQ ID NO: 1966284 - RNA, 18 nt, Shigella flexneri 2a str. 301
cagcugccagacccggca

SEQ ID NO: 1966285 - RNA, 14 nt, Shigella flexneri 2a str. 301
cagcuucgcuuccc

SEQ ID NO: 1966286 - RNA, 12 nt, Shigella flexneri 2a str. 301
cagcucugcugu

SEQ ID NO: 1966287 - RNA, 16 nt, Shigella flexneri 2a str. 301
cagcucgugucgggaa

SEQ ID NO: 1966288 - RNA, 19 nt, Shigella flexneri 2a str. 301
caggcaauguugcguuugu

SEQ ID NO: 1966289 - RNA, 21 nt, Shigella flexneri 2a str. 301
caggcaacuacguuuuuauug

SEQ ID NO: 1966290 - RNA, 20 nt, Shigella flexneri 2a str. 301
caggauuugcgguagcgggc

SEQ ID NO: 1966291 - RNA, 16 nt, Shigella flexneri 2a str. 301
cagcuugcuuuccagc

SEQ ID NO: 1966292 - RNA, 20 nt, Shigella flexneri 2a str. 301
caggaaucacguaggccuga

SEQ ID NO: 1966293 - RNA, 18 nt, Shigella flexneri 2a str. 301
caggaaugcagucgcugu

SEQ ID NO: 1966294 - RNA, 18 nt, Shigella flexneri 2a str. 301
cagcggugccgcgauacc

SEQ ID NO: 1966295 - RNA, 18 nt, Shigella flexneri 2a str. 301
cagcggugagccaggacg

SEQ ID NO: 1966296 - RNA, 17 nt, Shigella flexneri 2a str. 301
cagcgguuuugccagcg

SEQ ID NO: 1966297 - RNA, 15 nt, Shigella flexneri 2a str. 301
cagcgguuugcgcau

SEQ ID NO: 1966298 - RNA, 17 nt, Shigella flexneri 2a str. 301
cagcgguuugcgcaucc

SEQ ID NO: 1966299 - RNA, 14 nt, Shigella flexneri 2a str. 301
cagcguaacggcuc

SEQ ID NO: 1966300 - RNA, 20 nt, Shigella flexneri 2a str. 301
cagcguaacgauggcaauuu

SEQ ID NO: 1966301 - RNA, 15 nt, Shigella flexneri 2a str. 301
cagcguaccugccgc

SEQ ID NO: 1966302 - RNA, 16 nt, Shigella flexneri 2a str. 301
cagcgucgcauccgac

SEQ ID NO: 1966303 - RNA, 20 nt, Shigella flexneri 2a str. 301
cagcgugaacugggccugca

SEQ ID NO: 1966304 - RNA, 17 nt, Shigella flexneri 2a str. 301
cagcgucgcaucaggca

SEQ ID NO: 1966305 - RNA, 13 nt, Shigella flexneri 2a str. 301
cagcguccgggaa

SEQ ID NO: 1966306 - RNA, 14 nt, Shigella flexneri 2a str. 301
cagcguccgggaaa

SEQ ID NO: 1966307 - RNA, 21 nt, Shigella flexneri 2a str. 301
cagcgguaacuuaucuguaau

SEQ ID NO: 1966308 - RNA, 17 nt, Shigella flexneri 2a str. 301
cagcgggcagggcauca

SEQ ID NO: 1966309 - RNA, 17 nt, Shigella flexneri 2a str. 301
cagcguuuccagcacca

SEQ ID NO: 1966310 - RNA, 19 nt, Shigella flexneri 2a str. 301
cagcguuuccagccagucg

SEQ ID NO: 1966311 - RNA, 13 nt, Shigella flexneri 2a str. 301
cagcguuuccagc

SEQ ID NO: 1966312 - RNA, 20 nt, Shigella flexneri 2a str. 301
cagcguugcccccugaagca

SEQ ID NO: 1966313 - RNA, 13 nt, Shigella flexneri 2a str. 301
cagcuccagcaga

SEQ ID NO: 1966314 - RNA, 14 nt, Shigella flexneri 2a str. 301
cagcuacuggugcc

SEQ ID NO: 1966315 - RNA, 14 nt, Shigella flexneri 2a str. 301
cagcuccauccacc

SEQ ID NO: 1966316 - RNA, 18 nt, Shigella flexneri 2a str. 301
cagcucggauaaggcuuc

SEQ ID NO: 1966317 - RNA, 22 nt, Shigella flexneri 2a str. 301
caguuaagcaauaccgcgaauc

SEQ ID NO: 1966318 - RNA, 20 nt, Shigella flexneri 2a str. 301
caguguuucgacaauaauca

SEQ ID NO: 1966319 - RNA, 12 nt, Shigella flexneri 2a str. 301
cagugaucgccu

SEQ ID NO: 1966320 - RNA, 17 nt, Shigella flexneri 2a str. 301
cagugcaaaugccagau

SEQ ID NO: 1966321 - RNA, 19 nt, Shigella flexneri 2a str. 301
cagugauuucuucauuaaa

SEQ ID NO: 1966322 - RNA, 17 nt, Shigella flexneri 2a str. 301
cagugcauccagcagcc

SEQ ID NO: 1966323 - RNA, 17 nt, Shigella flexneri 2a str. 301
cagugccgcaccgacac

SEQ ID NO: 1966324 - RNA, 20 nt, Shigella flexneri 2a str. 301
cauaaugccugaugcgacgc

SEQ ID NO: 1966325 - RNA, 21 nt, Shigella flexneri 2a str. 301
cauaaugccugaugcgacgcu

SEQ ID NO: 1966326 - RNA, 19 nt, Shigella flexneri 2a str. 301
cauaaugugcgcacauugc

SEQ ID NO: 1966327 - RNA, 20 nt, Shigella flexneri 2a str. 301
cauaccuaaaagcacgccag

SEQ ID NO: 1966328 - RNA, 23 nt, Shigella flexneri 2a str. 301
cauaccuaaaagcacgccagaca

SEQ ID NO: 1966329 - RNA, 22 nt, Shigella flexneri 2a str. 301
cauacagaucgugcaucuccug

SEQ ID NO: 1966330 - RNA, 20 nt, Shigella flexneri 2a str. 301
cauacggcacuuucaucgcg

SEQ ID NO: 1966331 - RNA, 20 nt, Shigella flexneri 2a str. 301
cauaaaaggcaccuggaaau

SEQ ID NO: 1966332 - RNA, 22 nt, Shigella flexneri 2a str. 301
cauaaagcugcggauccugagc

SEQ ID NO: 1966333 - RNA, 13 nt, Shigella flexneri 2a str. 301
cauaaacaacgag

SEQ ID NO: 1966334 - RNA, 18 nt, Shigella flexneri 2a str. 301
caguucuggcaccggacg

SEQ ID NO: 1966335 - RNA, 22 nt, Shigella flexneri 2a str. 301
caguugaucaccagugcggaua

SEQ ID NO: 1966336 - RNA, 23 nt, Shigella flexneri 2a str. 301
caguuuugcguuugcccgcaauc

SEQ ID NO: 1966337 - RNA, 18 nt, Shigella flexneri 2a str. 301
caguucuacuggaauuuc

SEQ ID NO: 1966338 - RNA, 18 nt, Shigella flexneri 2a str. 301
cagugacccgcagccagc

SEQ ID NO: 1966339 - RNA, 23 nt, Shigella flexneri 2a str. 301
cagucgguauaaauagcggcugu

SEQ ID NO: 1966340 - RNA, 21 nt, Shigella flexneri 2a str. 301
cagguuuugacgugucugaua

SEQ ID NO: 1966341 - RNA, 13 nt, Shigella flexneri 2a str. 301
caguaaagcagcg

SEQ ID NO: 1966342 - RNA, 15 nt, Shigella flexneri 2a str. 301
caguaaagcagcgaa

SEQ ID NO: 1966343 - RNA, 17 nt, Shigella flexneri 2a str. 301
caguaacucauugccag

SEQ ID NO: 1966344 - RNA, 23 nt, Shigella flexneri 2a str. 301
caguaagcaguccagcgccugac

SEQ ID NO: 1966345 - RNA, 13 nt, Shigella flexneri 2a str. 301
caguauagcggca

SEQ ID NO: 1966346 - RNA, 18 nt, Shigella flexneri 2a str. 301
cagguuccccccacaauc

SEQ ID NO: 1966347 - RNA, 14 nt, Shigella flexneri 2a str. 301
cagguucguaagcg

SEQ ID NO: 1966348 - RNA, 19 nt, Shigella flexneri 2a str. 301
cagguguuauagcgcugaa

SEQ ID NO: 1966349 - RNA, 21 nt, Shigella flexneri 2a str. 301
caggugaccuguccuguaggc

SEQ ID NO: 1966350 - RNA, 17 nt, Shigella flexneri 2a str. 301
cauccgcgcgcguaagc

SEQ ID NO: 1966351 - RNA, 17 nt, Shigella flexneri 2a str. 301
cauccgcgguaucgccg

SEQ ID NO: 1966352 - RNA, 22 nt, Shigella flexneri 2a str. 301
cauccgcucccuggcccaucgc

SEQ ID NO: 1966353 - RNA, 16 nt, Shigella flexneri 2a str. 301
cauccggcaaccaccg

SEQ ID NO: 1966354 - RNA, 17 nt, Shigella flexneri 2a str. 301
cauccggcagccgugcc

SEQ ID NO: 1966355 - RNA, 19 nt, Shigella flexneri 2a str. 301
cauccugcguuaaucgccg

SEQ ID NO: 1966356 - RNA, 15 nt, Shigella flexneri 2a str. 301
cauccugcuggugcc

SEQ ID NO: 1966357 - RNA, 14 nt, Shigella flexneri 2a str. 301
cauccugcggcagc

SEQ ID NO: 1966358 - RNA, 11 nt, Shigella flexneri 2a str. 301
cauccagcagu

SEQ ID NO: 1966359 - RNA, 23 nt, Shigella flexneri 2a str. 301
caucagcugccagggcacugaua

SEQ ID NO: 1966360 - RNA, 21 nt, Shigella flexneri 2a str. 301
caucaggaguuucucgccaga

SEQ ID NO: 1966361 - RNA, 18 nt, Shigella flexneri 2a str. 301
caucagcuggaucgagau

SEQ ID NO: 1966362 - RNA, 12 nt, Shigella flexneri 2a str. 301
caucaggcaaug

SEQ ID NO: 1966363 - RNA, 22 nt, Shigella flexneri 2a str. 301
cauccagcuuuuuaaucgccau

SEQ ID NO: 1966364 - RNA, 14 nt, Shigella flexneri 2a str. 301
cauccauucagugc

SEQ ID NO: 1966365 - RNA, 17 nt, Shigella flexneri 2a str. 301
cauccauaccacgaccu

SEQ ID NO: 1966366 - RNA, 11 nt, Shigella flexneri 2a str. 301
caucagcagca

SEQ ID NO: 1966367 - RNA, 14 nt, Shigella flexneri 2a str. 301
caucagcaacacgc

SEQ ID NO: 1966368 - RNA, 13 nt, Shigella flexneri 2a str. 301
caucagcgccacc

SEQ ID NO: 1966369 - RNA, 17 nt, Shigella flexneri 2a str. 301
caucacgcagcgucagc

SEQ ID NO: 1966370 - RNA, 12 nt, Shigella flexneri 2a str. 301
caucaaugccag

SEQ ID NO: 1966371 - RNA, 22 nt, Shigella flexneri 2a str. 301
caucaaugccagcauaccgccg

SEQ ID NO: 1966372 - RNA, 18 nt, Shigella flexneri 2a str. 301
caucacgaaaaucauucg

SEQ ID NO: 1966373 - RNA, 19 nt, Shigella flexneri 2a str. 301
caucaacugcgcuauaucg

SEQ ID NO: 1966374 - RNA, 15 nt, Shigella flexneri 2a str. 301
caucaauaaacaaug

SEQ ID NO: 1966375 - RNA, 15 nt, Shigella flexneri 2a str. 301
caucaaguagcaggu

SEQ ID NO: 1966376 - RNA, 22 nt, Shigella flexneri 2a str. 301
cauagaucuaaaugccacugaa

SEQ ID NO: 1966377 - RNA, 14 nt, Shigella flexneri 2a str. 301
cauagcacacuuuc

SEQ ID NO: 1966378 - RNA, 22 nt, Shigella flexneri 2a str. 301
caucggcauacagcgacagacg

SEQ ID NO: 1966379 - RNA, 14 nt, Shigella flexneri 2a str. 301
caucgcuuuccagg

SEQ ID NO: 1966380 - RNA, 15 nt, Shigella flexneri 2a str. 301
caucgcuuuccaggu

SEQ ID NO: 1966381 - RNA, 20 nt, Shigella flexneri 2a str. 301
caucggcaaucauucccaga

SEQ ID NO: 1966382 - RNA, 18 nt, Shigella flexneri 2a str. 301
caucgccugaucgcgcag

SEQ ID NO: 1966383 - RNA, 15 nt, Shigella flexneri 2a str. 301
caucgccuguggcgu

SEQ ID NO: 1966384 - RNA, 18 nt, Shigella flexneri 2a str. 301
caucgcgcuuaucgccag

SEQ ID NO: 1966385 - RNA, 23 nt, Shigella flexneri 2a str. 301
caucgcgcuuaucgccagcgcca

SEQ ID NO: 1966386 - RNA, 21 nt, Shigella flexneri 2a str. 301
caucgccgccguugcgggaag

SEQ ID NO: 1966387 - RNA, 23 nt, Shigella flexneri 2a str. 301
caucgccagaacuacccgguucg

SEQ ID NO: 1966388 - RNA, 23 nt, Shigella flexneri 2a str. 301
caucgcccaguugaucaccagug

SEQ ID NO: 1966389 - RNA, 18 nt, Shigella flexneri 2a str. 301
caucgacguccaaucagc

SEQ ID NO: 1966390 - RNA, 14 nt, Shigella flexneri 2a str. 301
caucgacucaagcg

SEQ ID NO: 1966391 - RNA, 15 nt, Shigella flexneri 2a str. 301
caucgagaaucagcg

SEQ ID NO: 1966392 - RNA, 16 nt, Shigella flexneri 2a str. 301
caucgcaaaccagacg

SEQ ID NO: 1966393 - RNA, 15 nt, Shigella flexneri 2a str. 301
caucgauaccaucgc

SEQ ID NO: 1966394 - RNA, 16 nt, Shigella flexneri 2a str. 301
cagcaguaaaccgcuc

SEQ ID NO: 1966395 - RNA, 15 nt, Shigella flexneri 2a str. 301
cagcaguccagcgcg

SEQ ID NO: 1966396 - RNA, 22 nt, Shigella flexneri 2a str. 301
cagcaguauuaacgccauauca

SEQ ID NO: 1966397 - RNA, 18 nt, Shigella flexneri 2a str. 301
cagcaguucgcccgcuuc

SEQ ID NO: 1966398 - RNA, 13 nt, Shigella flexneri 2a str. 301
cagcacggucagg

SEQ ID NO: 1966399 - RNA, 20 nt, Shigella flexneri 2a str. 301
cagcaagucggcaucgccac

SEQ ID NO: 1966400 - RNA, 18 nt, Shigella flexneri 2a str. 301
cagcaagggcaucguaau

SEQ ID NO: 1966401 - RNA, 20 nt, Shigella flexneri 2a str. 301
cagcaaccaaugccaccagg

SEQ ID NO: 1966402 - RNA, 15 nt, Shigella flexneri 2a str. 301
cagcacuuccagcuc

SEQ ID NO: 1966403 - RNA, 17 nt, Shigella flexneri 2a str. 301
cagcacuccugccacca

SEQ ID NO: 1966404 - RNA, 14 nt, Shigella flexneri 2a str. 301
cagcccggcaaugg

SEQ ID NO: 1966405 - RNA, 17 nt, Shigella flexneri 2a str. 301
cagccgaccauugccag

SEQ ID NO: 1966406 - RNA, 14 nt, Shigella flexneri 2a str. 301
cagccaucauccau

SEQ ID NO: 1966407 - RNA, 13 nt, Shigella flexneri 2a str. 301
cagccauccguca

SEQ ID NO: 1966408 - RNA, 17 nt, Shigella flexneri 2a str. 301
cagccagugauuaacgc

SEQ ID NO: 1966409 - RNA, 16 nt, Shigella flexneri 2a str. 301
cagccaguuuuucagc

SEQ ID NO: 1966410 - RNA, 16 nt, Shigella flexneri 2a str. 301
cagccaggcgcgaaug

SEQ ID NO: 1966411 - RNA, 21 nt, Shigella flexneri 2a str. 301
cagccaguauugccaugcacg

SEQ ID NO: 1966412 - RNA, 16 nt, Shigella flexneri 2a str. 301
cagccacggcuccagc

SEQ ID NO: 1966413 - RNA, 18 nt, Shigella flexneri 2a str. 301
cagccacacaccgcaaac

SEQ ID NO: 1966414 - RNA, 23 nt, Shigella flexneri 2a str. 301
cagccacagggugaucaccagua

SEQ ID NO: 1966415 - RNA, 19 nt, Shigella flexneri 2a str. 301
cagccaacuggagaacgcg

SEQ ID NO: 1966416 - RNA, 14 nt, Shigella flexneri 2a str. 301
cagcaucuggauga

SEQ ID NO: 1966417 - RNA, 15 nt, Shigella flexneri 2a str. 301
cagcaucguccgcca

SEQ ID NO: 1966418 - RNA, 20 nt, Shigella flexneri 2a str. 301
cagcaucggcggcguaucga

SEQ ID NO: 1966419 - RNA, 19 nt, Shigella flexneri 2a str. 301
cagcaguucgcccgcuuca

SEQ ID NO: 1966420 - RNA, 18 nt, Shigella flexneri 2a str. 301
cagcaguugugugccagu

SEQ ID NO: 1966421 - RNA, 14 nt, Shigella flexneri 2a str. 301
cagcaguuuccgcg

SEQ ID NO: 1966422 - RNA, 22 nt, Shigella flexneri 2a str. 301
cagcaguuuuuccccugccaga

SEQ ID NO: 1966423 - RNA, 17 nt, Shigella flexneri 2a str. 301
cagcauaaucaccagua

SEQ ID NO: 1966424 - RNA, 12 nt, Shigella flexneri 2a str. 301
cagcauccggca

SEQ ID NO: 1966425 - RNA, 16 nt, Shigella flexneri 2a str. 301
cagcgcagcucuggca

SEQ ID NO: 1966426 - RNA, 18 nt, Shigella flexneri 2a str. 301
cagcgcaccagcgucauc

SEQ ID NO: 1966427 - RNA, 23 nt, Shigella flexneri 2a str. 301
cagcgcacaguuauaaaaugaua

SEQ ID NO: 1966428 - RNA, 14 nt, Shigella flexneri 2a str. 301
cagcgauuccaguu

SEQ ID NO: 1966429 - RNA, 16 nt, Shigella flexneri 2a str. 301
cagcgcaagcugaaca

SEQ ID NO: 1966430 - RNA, 14 nt, Shigella flexneri 2a str. 301
cagcgaucagcauu

SEQ ID NO: 1966431 - RNA, 19 nt, Shigella flexneri 2a str. 301
cagcgaugcccagugacca

SEQ ID NO: 1966432 - RNA, 19 nt, Shigella flexneri 2a str. 301
cagcgauggacgcagacca

SEQ ID NO: 1966433 - RNA, 15 nt, Shigella flexneri 2a str. 301
cagccuaccagaccg

SEQ ID NO: 1966434 - RNA, 14 nt, Shigella flexneri 2a str. 301
cagccuuuccugca

SEQ ID NO: 1966435 - RNA, 13 nt, Shigella flexneri 2a str. 301
cagcgccugcugc

SEQ ID NO: 1966436 - RNA, 12 nt, Shigella flexneri 2a str. 301
cagcgccuggcu

SEQ ID NO: 1966437 - RNA, 22 nt, Shigella flexneri 2a str. 301
cagcgcccgacaagauccugau

SEQ ID NO: 1966438 - RNA, 19 nt, Shigella flexneri 2a str. 301
cagcgcccgccagcaccgg

SEQ ID NO: 1966439 - RNA, 20 nt, Shigella flexneri 2a str. 301
cagcgcaggcagguuaauga

SEQ ID NO: 1966440 - RNA, 20 nt, Shigella flexneri 2a str. 301
cagcgcauagcuaauccccu

SEQ ID NO: 1966441 - RNA, 23 nt, Shigella flexneri 2a str. 301
cagcgcauagagacuuuuccagc

SEQ ID NO: 1966442 - RNA, 18 nt, Shigella flexneri 2a str. 301
cagcgcauccauuacauc

SEQ ID NO: 1966443 - RNA, 15 nt, Shigella flexneri 2a str. 301
cagcgcauucguaau

SEQ ID NO: 1966444 - RNA, 14 nt, Shigella flexneri 2a str. 301
cagcgcauucggca

SEQ ID NO: 1966445 - RNA, 19 nt, Shigella flexneri 2a str. 301
cagcgccagacacuggaaa

SEQ ID NO: 1966446 - RNA, 16 nt, Shigella flexneri 2a str. 301
cacgccugcauccgcc

SEQ ID NO: 1966447 - RNA, 12 nt, Shigella flexneri 2a str. 301
cacgccugccgc

SEQ ID NO: 1966448 - RNA, 22 nt, Shigella flexneri 2a str. 301
cacgcgggagagccccugccgc

SEQ ID NO: 1966449 - RNA, 23 nt, Shigella flexneri 2a str. 301
cacgccaucuggcugacggugau

SEQ ID NO: 1966450 - RNA, 18 nt, Shigella flexneri 2a str. 301
cacgccgaaugccgggua

SEQ ID NO: 1966451 - RNA, 22 nt, Shigella flexneri 2a str. 301
cacgcuuaaccccgggcuggau

SEQ ID NO: 1966452 - RNA, 19 nt, Shigella flexneri 2a str. 301
cacgcuguagccgccgucg

SEQ ID NO: 1966453 - RNA, 17 nt, Shigella flexneri 2a str. 301
cacggaaagcagcauac

SEQ ID NO: 1966454 - RNA, 19 nt, Shigella flexneri 2a str. 301
cacgcuuaauugaaccuaa

SEQ ID NO: 1966455 - RNA, 16 nt, Shigella flexneri 2a str. 301
cacggccacagccagc

SEQ ID NO: 1966456 - RNA, 16 nt, Shigella flexneri 2a str. 301
cacgcucaaagacgcg

SEQ ID NO: 1966457 - RNA, 16 nt, Shigella flexneri 2a str. 301
cacgcucccagcagag

SEQ ID NO: 1966458 - RNA, 16 nt, Shigella flexneri 2a str. 301
cacuaccggaacccac

SEQ ID NO: 1966459 - RNA, 14 nt, Shigella flexneri 2a str. 301
cacucacccgcuag

SEQ ID NO: 1966460 - RNA, 17 nt, Shigella flexneri 2a str. 301
cacucaggccaaaugac

SEQ ID NO: 1966461 - RNA, 15 nt, Shigella flexneri 2a str. 301
cacuauuauauucug

SEQ ID NO: 1966462 - RNA, 11 nt, Shigella flexneri 2a str. 301
cacuaacgaca

SEQ ID NO: 1966463 - RNA, 12 nt, Shigella flexneri 2a str. 301
cacuaacgcguc

SEQ ID NO: 1966464 - RNA, 15 nt, Shigella flexneri 2a str. 301
cacguuuugcggaug

SEQ ID NO: 1966465 - RNA, 19 nt, Shigella flexneri 2a str. 301
cacguuguuaaugcgcuga

SEQ ID NO: 1966466 - RNA, 15 nt, Shigella flexneri 2a str. 301
cacguuucacugccg

SEQ ID NO: 1966467 - RNA, 19 nt, Shigella flexneri 2a str. 301
cacguuccagaaugcuacg

SEQ ID NO: 1966468 - RNA, 13 nt, Shigella flexneri 2a str. 301
cacguaggccuga

SEQ ID NO: 1966469 - RNA, 14 nt, Shigella flexneri 2a str. 301
cacguaggccugau

SEQ ID NO: 1966470 - RNA, 22 nt, Shigella flexneri 2a str. 301
cacguaccaugcgcaucaucga

SEQ ID NO: 1966471 - RNA, 19 nt, Shigella flexneri 2a str. 301
cacgguuuaucggcgacca

SEQ ID NO: 1966472 - RNA, 22 nt, Shigella flexneri 2a str. 301
cagacgcuuacguuuacgcauc

SEQ ID NO: 1966473 - RNA, 22 nt, Shigella flexneri 2a str. 301
cagacuaauuuuucccucuuca

SEQ ID NO: 1966474 - RNA, 23 nt, Shigella flexneri 2a str. 301
cagacugggcaagaucuggcgaa

SEQ ID NO: 1966475 - RNA, 15 nt, Shigella flexneri 2a str. 301
cagacguuucgccag

SEQ ID NO: 1966476 - RNA, 16 nt, Shigella flexneri 2a str. 301
cagacguuucgccagc

SEQ ID NO: 1966477 - RNA, 14 nt, Shigella flexneri 2a str. 301
cagagcaucgguau

SEQ ID NO: 1966478 - RNA, 23 nt, Shigella flexneri 2a str. 301
cagagcaucgguaucuucccagc

SEQ ID NO: 1966479 - RNA, 22 nt, Shigella flexneri 2a str. 301
cagagacgcacugcuugaagcg

SEQ ID NO: 1966480 - RNA, 15 nt, Shigella flexneri 2a str. 301
cagagagacaaucgc

SEQ ID NO: 1966481 - RNA, 18 nt, Shigella flexneri 2a str. 301
cagagaaagaaacgccau

SEQ ID NO: 1966482 - RNA, 14 nt, Shigella flexneri 2a str. 301
cagaggagccauca

SEQ ID NO: 1966483 - RNA, 14 nt, Shigella flexneri 2a str. 301
cagaguaucgccau

SEQ ID NO: 1966484 - RNA, 11 nt, Shigella flexneri 2a str. 301
cagcaacauag

SEQ ID NO: 1966485 - RNA, 17 nt, Shigella flexneri 2a str. 301
cagcaaauccagcgguu

SEQ ID NO: 1966486 - RNA, 16 nt, Shigella flexneri 2a str. 301
cagcaaauccagcggu

SEQ ID NO: 1966487 - RNA, 17 nt, Shigella flexneri 2a str. 301
cagcaaauauugcauug

SEQ ID NO: 1966488 - RNA, 22 nt, Shigella flexneri 2a str. 301
cagauuguugauuaacaggcug

SEQ ID NO: 1966489 - RNA, 16 nt, Shigella flexneri 2a str. 301
cagauuuauaaaagaa

SEQ ID NO: 1966490 - RNA, 16 nt, Shigella flexneri 2a str. 301
cagauuuugccagcau

SEQ ID NO: 1966491 - RNA, 14 nt, Shigella flexneri 2a str. 301
cagcaaacgcaguu

SEQ ID NO: 1966492 - RNA, 21 nt, Shigella flexneri 2a str. 301
cagauuguugauuaacaggcu

SEQ ID NO: 1966493 - RNA, 16 nt, Shigella flexneri 2a str. 301
cagauuguggugccga

SEQ ID NO: 1966494 - RNA, 20 nt, Shigella flexneri 2a str. 301
cagaguuguaccagcaauuu

SEQ ID NO: 1966495 - RNA, 18 nt, Shigella flexneri 2a str. 301
cagaguuguaccagcaau

SEQ ID NO: 1966496 - RNA, 15 nt, Shigella flexneri 2a str. 301
cagauaaaucacgcu

SEQ ID NO: 1966497 - RNA, 21 nt, Shigella flexneri 2a str. 301
cagaucgcucaucugcugcgu

SEQ ID NO: 1966498 - RNA, 13 nt, Shigella flexneri 2a str. 301
cagaccugcguca

SEQ ID NO: 1966499 - RNA, 17 nt, Shigella flexneri 2a str. 301
cagacgccagccacagg

SEQ ID NO: 1966500 - RNA, 20 nt, Shigella flexneri 2a str. 301
cagaccuucgcuaucaaacu

SEQ ID NO: 1966501 - RNA, 16 nt, Shigella flexneri 2a str. 301
cagacaguaauacggu

SEQ ID NO: 1966502 - RNA, 14 nt, Shigella flexneri 2a str. 301
cagacacugcugau

SEQ ID NO: 1966503 - RNA, 23 nt, Shigella flexneri 2a str. 301
cagacaggcgaaacccgcugcca

SEQ ID NO: 1966504 - RNA, 14 nt, Shigella flexneri 2a str. 301
cagaccagcaccgg

SEQ ID NO: 1966505 - RNA, 22 nt, Shigella flexneri 2a str. 301
cagacccaguuucggcaucagc

SEQ ID NO: 1966506 - RNA, 12 nt, Shigella flexneri 2a str. 301
cagaccgauaca

SEQ ID NO: 1966507 - RNA, 15 nt, Shigella flexneri 2a str. 301
cacucugacggcgca

SEQ ID NO: 1966508 - RNA, 19 nt, Shigella flexneri 2a str. 301
cacuucuccgguuugcgga

SEQ ID NO: 1966509 - RNA, 15 nt, Shigella flexneri 2a str. 301
cacuuuugccagacg

SEQ ID NO: 1966510 - RNA, 16 nt, Shigella flexneri 2a str. 301
cagacaccagccaggu

SEQ ID NO: 1966511 - RNA, 15 nt, Shigella flexneri 2a str. 301
cagaagcgcagaucg

SEQ ID NO: 1966512 - RNA, 18 nt, Shigella flexneri 2a str. 301
cagaacgccgaauaacgc

SEQ ID NO: 1966513 - RNA, 20 nt, Shigella flexneri 2a str. 301
cagaaagcccgaaucaguaa

SEQ ID NO: 1966514 - RNA, 20 nt, Shigella flexneri 2a str. 301
cagaaaauuuucaucaguaa

SEQ ID NO: 1966515 - RNA, 13 nt, Shigella flexneri 2a str. 301
gauaucuuuccgg

SEQ ID NO: 1966516 - RNA, 15 nt, Shigella flexneri 2a str. 301
gauaugccggcauca

SEQ ID NO: 1966517 - RNA, 13 nt, Shigella flexneri 2a str. 301
gauauacagcccg

SEQ ID NO: 1966518 - RNA, 20 nt, Shigella flexneri 2a str. 301
gauauaauuaaacaccguug

SEQ ID NO: 1966519 - RNA, 21 nt, Shigella flexneri 2a str. 301
gauauuauccccugcgauggu

SEQ ID NO: 1966520 - RNA, 23 nt, Shigella flexneri 2a str. 301
gauauuaucuucaucgauacugc

SEQ ID NO: 1966521 - RNA, 16 nt, Shigella flexneri 2a str. 301
gauauuccccagacga

SEQ ID NO: 1966522 - RNA, 16 nt, Shigella flexneri 2a str. 301
gauauucgacaccauc

SEQ ID NO: 1966523 - RNA, 11 nt, Shigella flexneri 2a str. 301
gaucagcaucc

SEQ ID NO: 1966524 - RNA, 20 nt, Shigella flexneri 2a str. 301
gaucagcauccauaucgcca

SEQ ID NO: 1966525 - RNA, 20 nt, Shigella flexneri 2a str. 301
gauaguucgcgaucgcgcca

SEQ ID NO: 1966526 - RNA, 22 nt, Shigella flexneri 2a str. 301
gauaguucgcgaucgcgccaga

SEQ ID NO: 1966527 - RNA, 12 nt, Shigella flexneri 2a str. 301
gauacgcaguac

SEQ ID NO: 1966528 - RNA, 15 nt, Shigella flexneri 2a str. 301
gauaaaccuccagca

SEQ ID NO: 1966529 - RNA, 15 nt, Shigella flexneri 2a str. 301
gauacagaagcaccg

SEQ ID NO: 1966530 - RNA, 12 nt, Shigella flexneri 2a str. 301
gauaaauuacug

SEQ ID NO: 1966531 - RNA, 17 nt, Shigella flexneri 2a str. 301
gauaccacccgcaguga

SEQ ID NO: 1966532 - RNA, 20 nt, Shigella flexneri 2a str. 301
gauacccgcgaggcgcauaa

SEQ ID NO: 1966533 - RNA, 20 nt, Shigella flexneri 2a str. 301
gauaccaaaauggcgcagga

SEQ ID NO: 1966534 - RNA, 18 nt, Shigella flexneri 2a str. 301
gauaccaaaaucggcaac

SEQ ID NO: 1966535 - RNA, 11 nt, Shigella flexneri 2a str. 301
gauacaugaau

SEQ ID NO: 1966536 - RNA, 18 nt, Shigella flexneri 2a str. 301
gauaccgacacaggucga

SEQ ID NO: 1966537 - RNA, 12 nt, Shigella flexneri 2a str. 301
gauaaaaccuuc

SEQ ID NO: 1966538 - RNA, 16 nt, Shigella flexneri 2a str. 301
gaguuuucaguaccgc

SEQ ID NO: 1966539 - RNA, 19 nt, Shigella flexneri 2a str. 301
gaguuaaauuaauaaucac

SEQ ID NO: 1966540 - RNA, 19 nt, Shigella flexneri 2a str. 301
gaguuaccagcggccggau

SEQ ID NO: 1966541 - RNA, 20 nt, Shigella flexneri 2a str. 301
gagugccuugcugaccgcca

SEQ ID NO: 1966542 - RNA, 16 nt, Shigella flexneri 2a str. 301
gagugcggaugacgau

SEQ ID NO: 1966543 - RNA, 23 nt, Shigella flexneri 2a str. 301
gaguaaagcccgccaucgcccau

SEQ ID NO: 1966544 - RNA, 14 nt, Shigella flexneri 2a str. 301
gagucgggucgccg

SEQ ID NO: 1966545 - RNA, 20 nt, Shigella flexneri 2a str. 301
gagucgggucgccguaagca

SEQ ID NO: 1966546 - RNA, 19 nt, Shigella flexneri 2a str. 301
gagguuaauauuuucgcca

SEQ ID NO: 1966547 - RNA, 12 nt, Shigella flexneri 2a str. 301
gagguguucaua

SEQ ID NO: 1966548 - RNA, 16 nt, Shigella flexneri 2a str. 301
gagcagcacgcaguga

SEQ ID NO: 1966549 - RNA, 16 nt, Shigella flexneri 2a str. 301
gaugaacuacggcaaa

SEQ ID NO: 1966550 - RNA, 14 nt, Shigella flexneri 2a str. 301
gaucuuccgcguca

SEQ ID NO: 1966551 - RNA, 14 nt, Shigella flexneri 2a str. 301
gaucucgucagcau

SEQ ID NO: 1966552 - RNA, 13 nt, Shigella flexneri 2a str. 301
gaucuccgccuga

SEQ ID NO: 1966553 - RNA, 17 nt, Shigella flexneri 2a str. 301
gaucggaggcagcgucu

SEQ ID NO: 1966554 - RNA, 23 nt, Shigella flexneri 2a str. 301
gaucggcaaucacgcccgccaga

SEQ ID NO: 1966555 - RNA, 13 nt, Shigella flexneri 2a str. 301
gaucgccgccgga

SEQ ID NO: 1966556 - RNA, 11 nt, Shigella flexneri 2a str. 301
gaucgccauau

SEQ ID NO: 1966557 - RNA, 18 nt, Shigella flexneri 2a str. 301
gauccgcacccgcacgcu

SEQ ID NO: 1966558 - RNA, 16 nt, Shigella flexneri 2a str. 301
gauccagccauugcca

SEQ ID NO: 1966559 - RNA, 20 nt, Shigella flexneri 2a str. 301
gauccggaucccaccagacg

SEQ ID NO: 1966560 - RNA, 11 nt, Shigella flexneri 2a str. 301
gaucaguucca

SEQ ID NO: 1966561 - RNA, 20 nt, Shigella flexneri 2a str. 301
gaucaguugaccgauccagu

SEQ ID NO: 1966562 - RNA, 14 nt, Shigella flexneri 2a str. 301
gaucauuuccgguu

SEQ ID NO: 1966563 - RNA, 14 nt, Shigella flexneri 2a str. 301
gauccacaguugcu

SEQ ID NO: 1966564 - RNA, 16 nt, Shigella flexneri 2a str. 301
gaugccgugcagcacg

SEQ ID NO: 1966565 - RNA, 15 nt, Shigella flexneri 2a str. 301
gaugacauuaucugg

SEQ ID NO: 1966566 - RNA, 20 nt, Shigella flexneri 2a str. 301
gaugcggcgaaaacgccuua

SEQ ID NO: 1966567 - RNA, 15 nt, Shigella flexneri 2a str. 301
gaugcggcgugaacg

SEQ ID NO: 1966568 - RNA, 17 nt, Shigella flexneri 2a str. 301
gaugcggcgugaaugcc

SEQ ID NO: 1966569 - RNA, 20 nt, Shigella flexneri 2a str. 301
gaugcggcguuaacgccuua

SEQ ID NO: 1966570 - RNA, 19 nt, Shigella flexneri 2a str. 301
gaugcggcgugaacgccua

SEQ ID NO: 1966571 - RNA, 14 nt, Shigella flexneri 2a str. 301
gaugcgggcgguaa

SEQ ID NO: 1966572 - RNA, 20 nt, Shigella flexneri 2a str. 301
gauggucugguuuacugcug

SEQ ID NO: 1966573 - RNA, 16 nt, Shigella flexneri 2a str. 301
gauggcgcgcggcagg

SEQ ID NO: 1966574 - RNA, 22 nt, Shigella flexneri 2a str. 301
gauggcuguuuucagcaccaga

SEQ ID NO: 1966575 - RNA, 11 nt, Shigella flexneri 2a str. 301
gauggcagagu

SEQ ID NO: 1966576 - RNA, 18 nt, Shigella flexneri 2a str. 301
gauggcagugcgccauau

SEQ ID NO: 1966577 - RNA, 16 nt, Shigella flexneri 2a str. 301
gauggcauacaacgcc

SEQ ID NO: 1966578 - RNA, 20 nt, Shigella flexneri 2a str. 301
gauggcauaccauccggcau

SEQ ID NO: 1966579 - RNA, 13 nt, Shigella flexneri 2a str. 301
gauggcauuaccg

SEQ ID NO: 1966580 - RNA, 13 nt, Shigella flexneri 2a str. 301
gaugcucucauca

SEQ ID NO: 1966581 - RNA, 17 nt, Shigella flexneri 2a str. 301
gauggcaaaugcagcau

SEQ ID NO: 1966582 - RNA, 15 nt, Shigella flexneri 2a str. 301
gauucggcaaucacc

SEQ ID NO: 1966583 - RNA, 13 nt, Shigella flexneri 2a str. 301
gauucgcucacga

SEQ ID NO: 1966584 - RNA, 18 nt, Shigella flexneri 2a str. 301
gauugugacacgcgcgca

SEQ ID NO: 1966585 - RNA, 14 nt, Shigella flexneri 2a str. 301
gauuguucgcaccg

SEQ ID NO: 1966586 - RNA, 17 nt, Shigella flexneri 2a str. 301
gauuuaaaaaauggcca

SEQ ID NO: 1966587 - RNA, 17 nt, Shigella flexneri 2a str. 301
gauugucauucgccuga

SEQ ID NO: 1966588 - RNA, 22 nt, Shigella flexneri 2a str. 301
gauucugagaaacucaguugau

SEQ ID NO: 1966589 - RNA, 13 nt, Shigella flexneri 2a str. 301
gauuauuucgcug

SEQ ID NO: 1966590 - RNA, 22 nt, Shigella flexneri 2a str. 301
gauuaguauugcggaacggcag

SEQ ID NO: 1966591 - RNA, 21 nt, Shigella flexneri 2a str. 301
gauuacucguuaucagaaccg

SEQ ID NO: 1966592 - RNA, 19 nt, Shigella flexneri 2a str. 301
gauuacucgccuuucacac

SEQ ID NO: 1966593 - RNA, 18 nt, Shigella flexneri 2a str. 301
gauguucccccagccaga

SEQ ID NO: 1966594 - RNA, 17 nt, Shigella flexneri 2a str. 301
gaugugcaguuccugca

SEQ ID NO: 1966595 - RNA, 21 nt, Shigella flexneri 2a str. 301
gauuugcuucaauacgcucca

SEQ ID NO: 1966596 - RNA, 18 nt, Shigella flexneri 2a str. 301
gauuugcucccgcaguga

SEQ ID NO: 1966597 - RNA, 14 nt, Shigella flexneri 2a str. 301
gauuucaugaagcu

SEQ ID NO: 1966598 - RNA, 17 nt, Shigella flexneri 2a str. 301
gauuuccaucuccagcu

SEQ ID NO: 1966599 - RNA, 23 nt, Shigella flexneri 2a str. 301
gauuucgcaacgacaccguuaaa

SEQ ID NO: 1966600 - RNA, 20 nt, Shigella flexneri 2a str. 301
gauuuauguaccgucaucgc

SEQ ID NO: 1966601 - RNA, 19 nt, Shigella flexneri 2a str. 301
gcaaacucgcgcaggcuga

SEQ ID NO: 1966602 - RNA, 16 nt, Shigella flexneri 2a str. 301
gcaaacugaguggagu

SEQ ID NO: 1966603 - RNA, 11 nt, Shigella flexneri 2a str. 301
gcaaacugcug

SEQ ID NO: 1966604 - RNA, 18 nt, Shigella flexneri 2a str. 301
gcaaacaguaacccggca

SEQ ID NO: 1966605 - RNA, 17 nt, Shigella flexneri 2a str. 301
gcaaaccagacgcgcgu

SEQ ID NO: 1966606 - RNA, 19 nt, Shigella flexneri 2a str. 301
gcaaacauggaaaccauca

SEQ ID NO: 1966607 - RNA, 14 nt, Shigella flexneri 2a str. 301
gcaaacaucgggau

SEQ ID NO: 1966608 - RNA, 18 nt, Shigella flexneri 2a str. 301
gcaaaccaggccgguaac

SEQ ID NO: 1966609 - RNA, 18 nt, Shigella flexneri 2a str. 301
gcaaaugauuagugccag

SEQ ID NO: 1966610 - RNA, 14 nt, Shigella flexneri 2a str. 301
gcaaaugccagaua

SEQ ID NO: 1966611 - RNA, 19 nt, Shigella flexneri 2a str. 301
gcaaauugaggaucugcgc

SEQ ID NO: 1966612 - RNA, 13 nt, Shigella flexneri 2a str. 301
gcaacaacagcgc

SEQ ID NO: 1966613 - RNA, 20 nt, Shigella flexneri 2a str. 301
gcaaauaaucccgcgcaaca

SEQ ID NO: 1966614 - RNA, 14 nt, Shigella flexneri 2a str. 301
gcaaagugccgaac

SEQ ID NO: 1966615 - RNA, 21 nt, Shigella flexneri 2a str. 301
gcaaauaccggacacacuuca

SEQ ID NO: 1966616 - RNA, 19 nt, Shigella flexneri 2a str. 301
gcaaauacugacuggcaag

SEQ ID NO: 1966617 - RNA, 21 nt, Shigella flexneri 2a str. 301
gcaaagcaaauuuugugggca

SEQ ID NO: 1966618 - RNA, 18 nt, Shigella flexneri 2a str. 301
gcaaagccgauaccuucc

SEQ ID NO: 1966619 - RNA, 15 nt, Shigella flexneri 2a str. 301
gcaaaggaauggucg

SEQ ID NO: 1966620 - RNA, 19 nt, Shigella flexneri 2a str. 301
gcaagaauaauaccgucca

SEQ ID NO: 1966621 - RNA, 18 nt, Shigella flexneri 2a str. 301
gcaagccacaauaaacgc

SEQ ID NO: 1966622 - RNA, 21 nt, Shigella flexneri 2a str. 301
gcaagcaccaggguaaaugca

SEQ ID NO: 1966623 - RNA, 18 nt, Shigella flexneri 2a str. 301
gcaacuucucuuucggca

SEQ ID NO: 1966624 - RNA, 13 nt, Shigella flexneri 2a str. 301
gcaacugacggca

SEQ ID NO: 1966625 - RNA, 21 nt, Shigella flexneri 2a str. 301
gcaacugauggcccaucguca

SEQ ID NO: 1966626 - RNA, 16 nt, Shigella flexneri 2a str. 301
gcaagggcaucguaau

SEQ ID NO: 1966627 - RNA, 18 nt, Shigella flexneri 2a str. 301
gcaaggaaagccacugug

SEQ ID NO: 1966628 - RNA, 18 nt, Shigella flexneri 2a str. 301
gcaagcggcggcaauggc

SEQ ID NO: 1966629 - RNA, 18 nt, Shigella flexneri 2a str. 301
gcaagcgcugagacgcgc

SEQ ID NO: 1966630 - RNA, 15 nt, Shigella flexneri 2a str. 301
gcaagcgggguaaau

SEQ ID NO: 1966631 - RNA, 22 nt, Shigella flexneri 2a str. 301
gcaagcgggguaaaugccauca

SEQ ID NO: 1966632 - RNA, 21 nt, Shigella flexneri 2a str. 301
gcaagcguuugagcaugguaa

SEQ ID NO: 1966633 - RNA, 23 nt, Shigella flexneri 2a str. 301
gcaagccaucguuaauuaacgcg

SEQ ID NO: 1966634 - RNA, 15 nt, Shigella flexneri 2a str. 301
gcaauuuccauugcu

SEQ ID NO: 1966635 - RNA, 13 nt, Shigella flexneri 2a str. 301
gcacacacugcuu

SEQ ID NO: 1966636 - RNA, 15 nt, Shigella flexneri 2a str. 301
gcacaauugccggau

SEQ ID NO: 1966637 - RNA, 23 nt, Shigella flexneri 2a str. 301
gcacaaugccugaugcgacgcuu

SEQ ID NO: 1966638 - RNA, 16 nt, Shigella flexneri 2a str. 301
gcaauuaacagugaca

SEQ ID NO: 1966639 - RNA, 14 nt, Shigella flexneri 2a str. 301
gcaauuaacaguga

SEQ ID NO: 1966640 - RNA, 14 nt, Shigella flexneri 2a str. 301
gcaauuacaugcug

SEQ ID NO: 1966641 - RNA, 16 nt, Shigella flexneri 2a str. 301
gcaauucaccguaaua

SEQ ID NO: 1966642 - RNA, 22 nt, Shigella flexneri 2a str. 301
gcaauaauagccccaaccgaac

SEQ ID NO: 1966643 - RNA, 19 nt, Shigella flexneri 2a str. 301
gcaauaaagacauccgcca

SEQ ID NO: 1966644 - RNA, 16 nt, Shigella flexneri 2a str. 301
gcaaggugaaagcaau

SEQ ID NO: 1966645 - RNA, 14 nt, Shigella flexneri 2a str. 301
gcaaggugugggca

SEQ ID NO: 1966646 - RNA, 18 nt, Shigella flexneri 2a str. 301
gcaagucggcaucgccac

SEQ ID NO: 1966647 - RNA, 21 nt, Shigella flexneri 2a str. 301
gcaaucaucuuguaggccuga

SEQ ID NO: 1966648 - RNA, 14 nt, Shigella flexneri 2a str. 301
gcaaugaagaaccg

SEQ ID NO: 1966649 - RNA, 18 nt, Shigella flexneri 2a str. 301
gcaaugaaauucauuuga

SEQ ID NO: 1966650 - RNA, 13 nt, Shigella flexneri 2a str. 301
gcaaccaacggcc

SEQ ID NO: 1966651 - RNA, 13 nt, Shigella flexneri 2a str. 301
gcaaccaccguuu

SEQ ID NO: 1966652 - RNA, 13 nt, Shigella flexneri 2a str. 301
gcaaccagcaccg

SEQ ID NO: 1966653 - RNA, 23 nt, Shigella flexneri 2a str. 301
gcaaccgguaaagaagagcggca

SEQ ID NO: 1966654 - RNA, 23 nt, Shigella flexneri 2a str. 301
gcaacauauuccgcaccugccag

SEQ ID NO: 1966655 - RNA, 17 nt, Shigella flexneri 2a str. 301
gcaacacaaucagacgc

SEQ ID NO: 1966656 - RNA, 20 nt, Shigella flexneri 2a str. 301
gcaaccgucguggucgugau

SEQ ID NO: 1966657 - RNA, 23 nt, Shigella flexneri 2a str. 301
gcaaccuuuuccauugccgcaga

SEQ ID NO: 1966658 - RNA, 21 nt, Shigella flexneri 2a str. 301
gcaacgaaaggugaaguggug

SEQ ID NO: 1966659 - RNA, 14 nt, Shigella flexneri 2a str. 301
gcaacgaaagguga

SEQ ID NO: 1966660 - RNA, 22 nt, Shigella flexneri 2a str. 301
gcaacgacgguaaaccacgcca

SEQ ID NO: 1966661 - RNA, 17 nt, Shigella flexneri 2a str. 301
gcaacgccgccggaagu

SEQ ID NO: 1966662 - RNA, 15 nt, Shigella flexneri 2a str. 301
gcaacgcggcgguga

SEQ ID NO: 1966663 - RNA, 17 nt, Shigella flexneri 2a str. 301
gcaacggacgaccgauu

SEQ ID NO: 1966664 - RNA, 18 nt, Shigella flexneri 2a str. 301
gcaacgugguuugcggca

SEQ ID NO: 1966665 - RNA, 22 nt, Shigella flexneri 2a str. 301
gcaacggcuucgccaaaucgcu

SEQ ID NO: 1966666 - RNA, 16 nt, Shigella flexneri 2a str. 301
gcacgaaaccacugca

SEQ ID NO: 1966667 - RNA, 14 nt, Shigella flexneri 2a str. 301
gcaccuacagccau

SEQ ID NO: 1966668 - RNA, 21 nt, Shigella flexneri 2a str. 301
gcaccgauugccggaugcggc

SEQ ID NO: 1966669 - RNA, 16 nt, Shigella flexneri 2a str. 301
gcaccgauugccggau

SEQ ID NO: 1966670 - RNA, 20 nt, Shigella flexneri 2a str. 301
gcacccucaacaacagcgau

SEQ ID NO: 1966671 - RNA, 23 nt, Shigella flexneri 2a str. 301
gcaccgcgcguuuaggcgcagga

SEQ ID NO: 1966672 - RNA, 17 nt, Shigella flexneri 2a str. 301
gcacaccgccgccgcca

SEQ ID NO: 1966673 - RNA, 23 nt, Shigella flexneri 2a str. 301
gcacggcaggaucugcgcggcaa

SEQ ID NO: 1966674 - RNA, 13 nt, Shigella flexneri 2a str. 301
gcacggcauacuu

SEQ ID NO: 1966675 - RNA, 20 nt, Shigella flexneri 2a str. 301
gcacgcucuucaucgcuaaa

SEQ ID NO: 1966676 - RNA, 14 nt, Shigella flexneri 2a str. 301
gcacguugucagca

SEQ ID NO: 1966677 - RNA, 19 nt, Shigella flexneri 2a str. 301
gcacuguuacugucggcaa

SEQ ID NO: 1966678 - RNA, 18 nt, Shigella flexneri 2a str. 301
gcacugggcgaagguggc

SEQ ID NO: 1966679 - RNA, 23 nt, Shigella flexneri 2a str. 301
gcacuuccgcccaucgcauaaca

SEQ ID NO: 1966680 - RNA, 18 nt, Shigella flexneri 2a str. 301
gcacuggcggcagcaggu

SEQ ID NO: 1966681 - RNA, 20 nt, Shigella flexneri 2a str. 301
gcacuggcagccaggcgcga

SEQ ID NO: 1966682 - RNA, 17 nt, Shigella flexneri 2a str. 301
gcacugcgcccgccagc

SEQ ID NO: 1966683 - RNA, 14 nt, Shigella flexneri 2a str. 301
gcacugccgcaucg

SEQ ID NO: 1966684 - RNA, 16 nt, Shigella flexneri 2a str. 301
gcacugaaugccggau

SEQ ID NO: 1966685 - RNA, 21 nt, Shigella flexneri 2a str. 301
gcagcaaggcuauucagcagu

SEQ ID NO: 1966686 - RNA, 16 nt, Shigella flexneri 2a str. 301
gcagcaagucggcauc

SEQ ID NO: 1966687 - RNA, 23 nt, Shigella flexneri 2a str. 301
gcagcagccaguuguugauaagc

SEQ ID NO: 1966688 - RNA, 15 nt, Shigella flexneri 2a str. 301
gcagcagccugcgcu

SEQ ID NO: 1966689 - RNA, 15 nt, Shigella flexneri 2a str. 301
gcagcaacggcaguu

SEQ ID NO: 1966690 - RNA, 15 nt, Shigella flexneri 2a str. 301
gcagcaaccgcuucc

SEQ ID NO: 1966691 - RNA, 21 nt, Shigella flexneri 2a str. 301
gcagcaacgaacuaaccgcgc

SEQ ID NO: 1966692 - RNA, 13 nt, Shigella flexneri 2a str. 301
gcagacugaauac

SEQ ID NO: 1966693 - RNA, 22 nt, Shigella flexneri 2a str. 301
gcagagcaaaaaucgacagcag

SEQ ID NO: 1966694 - RNA, 16 nt, Shigella flexneri 2a str. 301
gcagacagccuaccag

SEQ ID NO: 1966695 - RNA, 16 nt, Shigella flexneri 2a str. 301
gcagaaacaaacgcaa

SEQ ID NO: 1966696 - RNA, 22 nt, Shigella flexneri 2a str. 301
gcacuuugugucagcgccagaa

SEQ ID NO: 1966697 - RNA, 16 nt, Shigella flexneri 2a str. 301
gcacuuugccagaaau

SEQ ID NO: 1966698 - RNA, 20 nt, Shigella flexneri 2a str. 301
gcagacccguuaagcguuca

SEQ ID NO: 1966699 - RNA, 19 nt, Shigella flexneri 2a str. 301
gcagaccaauguuacgacc

SEQ ID NO: 1966700 - RNA, 23 nt, Shigella flexneri 2a str. 301
gcagaccaaacucuucgacaauc

SEQ ID NO: 1966701 - RNA, 17 nt, Shigella flexneri 2a str. 301
gcagacagccuaccaga

SEQ ID NO: 1966702 - RNA, 18 nt, Shigella flexneri 2a str. 301
gcagcgaaggguauacgc

SEQ ID NO: 1966703 - RNA, 16 nt, Shigella flexneri 2a str. 301
gcagcggcgaucguga

SEQ ID NO: 1966704 - RNA, 13 nt, Shigella flexneri 2a str. 301
gcagcggcgagau

SEQ ID NO: 1966705 - RNA, 16 nt, Shigella flexneri 2a str. 301
gcagcggcggcaccga

SEQ ID NO: 1966706 - RNA, 20 nt, Shigella flexneri 2a str. 301
gcagcgugaguaugauacgu

SEQ ID NO: 1966707 - RNA, 19 nt, Shigella flexneri 2a str. 301
gcagcgggcauuuucaggu

SEQ ID NO: 1966708 - RNA, 15 nt, Shigella flexneri 2a str. 301
gcaggcauucagcaa

SEQ ID NO: 1966709 - RNA, 14 nt, Shigella flexneri 2a str. 301
gcaggccagcaauu

SEQ ID NO: 1966710 - RNA, 14 nt, Shigella flexneri 2a str. 301
gcagguauaccgga

SEQ ID NO: 1966711 - RNA, 15 nt, Shigella flexneri 2a str. 301
gcaggcucagacuga

SEQ ID NO: 1966712 - RNA, 22 nt, Shigella flexneri 2a str. 301
gcaggcucagaagacgcuccag

SEQ ID NO: 1966713 - RNA, 12 nt, Shigella flexneri 2a str. 301
gcaucaaucuuu

SEQ ID NO: 1966714 - RNA, 14 nt, Shigella flexneri 2a str. 301
gcaucccgcaccag

SEQ ID NO: 1966715 - RNA, 18 nt, Shigella flexneri 2a str. 301
gcauccggcaauugugau

SEQ ID NO: 1966716 - RNA, 21 nt, Shigella flexneri 2a str. 301
gcaucgaugguugcccugcug

SEQ ID NO: 1966717 - RNA, 14 nt, Shigella flexneri 2a str. 301
gcaucgcagcauca

SEQ ID NO: 1966718 - RNA, 14 nt, Shigella flexneri 2a str. 301
gcagugcauccagc

SEQ ID NO: 1966719 - RNA, 23 nt, Shigella flexneri 2a str. 301
gcagugccucacgaucacagcag

SEQ ID NO: 1966720 - RNA, 17 nt, Shigella flexneri 2a str. 301
gcaguucuggcaccgga

SEQ ID NO: 1966721 - RNA, 13 nt, Shigella flexneri 2a str. 301
gcauaaacgccgu

SEQ ID NO: 1966722 - RNA, 22 nt, Shigella flexneri 2a str. 301
gcauaacguugcagcguuucgc

SEQ ID NO: 1966723 - RNA, 15 nt, Shigella flexneri 2a str. 301
gcauaaucgacauuu

SEQ ID NO: 1966724 - RNA, 17 nt, Shigella flexneri 2a str. 301
gcauaaucgcaacgccu

SEQ ID NO: 1966725 - RNA, 23 nt, Shigella flexneri 2a str. 301
gcauaaugccugaugcgacgcuu

SEQ ID NO: 1966726 - RNA, 15 nt, Shigella flexneri 2a str. 301
gcauacaacgccaug

SEQ ID NO: 1966727 - RNA, 13 nt, Shigella flexneri 2a str. 301
gcauuuccauaaa

SEQ ID NO: 1966728 - RNA, 11 nt, Shigella flexneri 2a str. 301
gcauuuacucu

SEQ ID NO: 1966729 - RNA, 22 nt, Shigella flexneri 2a str. 301
gcauuugcaccgauugccggau

SEQ ID NO: 1966730 - RNA, 16 nt, Shigella flexneri 2a str. 301
gcauuugcaccgauug

SEQ ID NO: 1966731 - RNA, 22 nt, Shigella flexneri 2a str. 301
gcauuugcacugaaugccggau

SEQ ID NO: 1966732 - RNA, 23 nt, Shigella flexneri 2a str. 301
gcauuuggacacccuugccggau

SEQ ID NO: 1966733 - RNA, 17 nt, Shigella flexneri 2a str. 301
gcauuugcuccagacgc

SEQ ID NO: 1966734 - RNA, 19 nt, Shigella flexneri 2a str. 301
gcauuuucucgcggacugc

SEQ ID NO: 1966735 - RNA, 16 nt, Shigella flexneri 2a str. 301
gccaaaaaucgcaaau

SEQ ID NO: 1966736 - RNA, 19 nt, Shigella flexneri 2a str. 301
gccaaacgcucccugccag

SEQ ID NO: 1966737 - RNA, 17 nt, Shigella flexneri 2a str. 301
gccaaacucaccaucgg

SEQ ID NO: 1966738 - RNA, 13 nt, Shigella flexneri 2a str. 301
gccaaagcguuca

SEQ ID NO: 1966739 - RNA, 15 nt, Shigella flexneri 2a str. 301
gccaaauccagcgcc

SEQ ID NO: 1966740 - RNA, 15 nt, Shigella flexneri 2a str. 301
gccaaauccagcgca

SEQ ID NO: 1966741 - RNA, 18 nt, Shigella flexneri 2a str. 301
gccaaauccagcgccaca

SEQ ID NO: 1966742 - RNA, 17 nt, Shigella flexneri 2a str. 301
gcauuacgcucacugca

SEQ ID NO: 1966743 - RNA, 22 nt, Shigella flexneri 2a str. 301
gcauuaggugcucaaugccuga

SEQ ID NO: 1966744 - RNA, 17 nt, Shigella flexneri 2a str. 301
gcauuaauacaccgcug

SEQ ID NO: 1966745 - RNA, 13 nt, Shigella flexneri 2a str. 301
gcauuaaacgcau

SEQ ID NO: 1966746 - RNA, 15 nt, Shigella flexneri 2a str. 301
gcauucacgccgcau

SEQ ID NO: 1966747 - RNA, 23 nt, Shigella flexneri 2a str. 301
gcauucacgggcggcggcuuuca

SEQ ID NO: 1966748 - RNA, 20 nt, Shigella flexneri 2a str. 301
gcauugaacucuucuuccgg

SEQ ID NO: 1966749 - RNA, 12 nt, Shigella flexneri 2a str. 301
gcauguguaacc

SEQ ID NO: 1966750 - RNA, 19 nt, Shigella flexneri 2a str. 301
gcauguuccaguucgcgca

SEQ ID NO: 1966751 - RNA, 22 nt, Shigella flexneri 2a str. 301
gcaugguuccggcuuaaugcau

SEQ ID NO: 1966752 - RNA, 17 nt, Shigella flexneri 2a str. 301
gcauggcguccgucauc

SEQ ID NO: 1966753 - RNA, 17 nt, Shigella flexneri 2a str. 301
gcaugauuucgucaucc

SEQ ID NO: 1966754 - RNA, 20 nt, Shigella flexneri 2a str. 301
gcaugauuuuguaggccgga

SEQ ID NO: 1966755 - RNA, 20 nt, Shigella flexneri 2a str. 301
gcaugacuuuguaggccgga

SEQ ID NO: 1966756 - RNA, 15 nt, Shigella flexneri 2a str. 301
gcaugaucagcgcau

SEQ ID NO: 1966757 - RNA, 15 nt, Shigella flexneri 2a str. 301
gcaugacacacucug

SEQ ID NO: 1966758 - RNA, 19 nt, Shigella flexneri 2a str. 301
gcaugcucccaaaaacgcg

SEQ ID NO: 1966759 - RNA, 13 nt, Shigella flexneri 2a str. 301
gcauggcgcggaa

SEQ ID NO: 1966760 - RNA, 16 nt, Shigella flexneri 2a str. 301
gcaucggcaaaucgcu

SEQ ID NO: 1966761 - RNA, 15 nt, Shigella flexneri 2a str. 301
gcaucucaaucgcac

SEQ ID NO: 1966762 - RNA, 20 nt, Shigella flexneri 2a str. 301
gcaucuguuucgaucagcaa

SEQ ID NO: 1966763 - RNA, 16 nt, Shigella flexneri 2a str. 301
gcaucuguugguaacu

SEQ ID NO: 1966764 - RNA, 18 nt, Shigella flexneri 2a str. 301
gcaucuucgcccacggcu

SEQ ID NO: 1966765 - RNA, 20 nt, Shigella flexneri 2a str. 301
gcaucuucgcccacggcuac

SEQ ID NO: 1966766 - RNA, 22 nt, Shigella flexneri 2a str. 301
gcaucuggcacuauuggcggau

SEQ ID NO: 1966767 - RNA, 17 nt, Shigella flexneri 2a str. 301
gcaucuucuccacgcca

SEQ ID NO: 1966768 - RNA, 22 nt, Shigella flexneri 2a str. 301
gcaucuuguucauagugccuga

SEQ ID NO: 1966769 - RNA, 18 nt, Shigella flexneri 2a str. 301
gccggaauaccacuuuca

SEQ ID NO: 1966770 - RNA, 22 nt, Shigella flexneri 2a str. 301
gccggaauaccacuuucagcaa

SEQ ID NO: 1966771 - RNA, 14 nt, Shigella flexneri 2a str. 301
gccggagccagccg

SEQ ID NO: 1966772 - RNA, 24 nt, Shigella flexneri 2a str. 301
gccggauaaggcguuuucgccgca

SEQ ID NO: 1966773 - RNA, 22 nt, Shigella flexneri 2a str. 301
gccggauaaggcguucacgacg

SEQ ID NO: 1966774 - RNA, 14 nt, Shigella flexneri 2a str. 301
gccggauaaggcau

SEQ ID NO: 1966775 - RNA, 12 nt, Shigella flexneri 2a str. 301
gccgcugcgcgu

SEQ ID NO: 1966776 - RNA, 20 nt, Shigella flexneri 2a str. 301
gccggauguuugcauccggc

SEQ ID NO: 1966777 - RNA, 21 nt, Shigella flexneri 2a str. 301
gccggauuacccgcgcuucga

SEQ ID NO: 1966778 - RNA, 14 nt, Shigella flexneri 2a str. 301
gccggauuaugugg

SEQ ID NO: 1966779 - RNA, 23 nt, Shigella flexneri 2a str. 301
gccggauaugaaauccggcaccu

SEQ ID NO: 1966780 - RNA, 22 nt, Shigella flexneri 2a str. 301
gccgcuccaaggucuccgccca

SEQ ID NO: 1966781 - RNA, 16 nt, Shigella flexneri 2a str. 301
gccgcucccuucgggg

SEQ ID NO: 1966782 - RNA, 18 nt, Shigella flexneri 2a str. 301
gccgcgauagcaagcgcu

SEQ ID NO: 1966783 - RNA, 13 nt, Shigella flexneri 2a str. 301
gccgcgauagcaa

SEQ ID NO: 1966784 - RNA, 15 nt, Shigella flexneri 2a str. 301
gccgggaacuggcaa

SEQ ID NO: 1966785 - RNA, 15 nt, Shigella flexneri 2a str. 301
gccgcauccggcauc

SEQ ID NO: 1966786 - RNA, 12 nt, Shigella flexneri 2a str. 301
gccgcaguuucu

SEQ ID NO: 1966787 - RNA, 13 nt, Shigella flexneri 2a str. 301
gccgccagcaucu

SEQ ID NO: 1966788 - RNA, 11 nt, Shigella flexneri 2a str. 301
gccgccggaaa

SEQ ID NO: 1966789 - RNA, 20 nt, Shigella flexneri 2a str. 301
gccgauuaaaaucagaaucg

SEQ ID NO: 1966790 - RNA, 13 nt, Shigella flexneri 2a str. 301
gccgauuguauac

SEQ ID NO: 1966791 - RNA, 16 nt, Shigella flexneri 2a str. 301
gccgcacuuaauauac

SEQ ID NO: 1966792 - RNA, 15 nt, Shigella flexneri 2a str. 301
gccgcaacuuuagcc

SEQ ID NO: 1966793 - RNA, 16 nt, Shigella flexneri 2a str. 301
gccgaggauacagccg

SEQ ID NO: 1966794 - RNA, 23 nt, Shigella flexneri 2a str. 301
gccgaucucaccgaucaucacga

SEQ ID NO: 1966795 - RNA, 15 nt, Shigella flexneri 2a str. 301
gccgagcgccagcca

SEQ ID NO: 1966796 - RNA, 20 nt, Shigella flexneri 2a str. 301
gccgaauaccguaacgacug

SEQ ID NO: 1966797 - RNA, 20 nt, Shigella flexneri 2a str. 301
gccaucgcguugucauacga

SEQ ID NO: 1966798 - RNA, 18 nt, Shigella flexneri 2a str. 301
gccaucgccacaccagua

SEQ ID NO: 1966799 - RNA, 12 nt, Shigella flexneri 2a str. 301
gccaucauacga

SEQ ID NO: 1966800 - RNA, 15 nt, Shigella flexneri 2a str. 301
gccaucauccauucg

SEQ ID NO: 1966801 - RNA, 17 nt, Shigella flexneri 2a str. 301
gccauccagugaaacgc

SEQ ID NO: 1966802 - RNA, 14 nt, Shigella flexneri 2a str. 301
gccaucacugacug

SEQ ID NO: 1966803 - RNA, 16 nt, Shigella flexneri 2a str. 301
gccauaucauucgaca

SEQ ID NO: 1966804 - RNA, 16 nt, Shigella flexneri 2a str. 301
gccauauucgcuuuca

SEQ ID NO: 1966805 - RNA, 17 nt, Shigella flexneri 2a str. 301
gccaguauuaccggcag

SEQ ID NO: 1966806 - RNA, 17 nt, Shigella flexneri 2a str. 301
gccauguuuaccaucug

SEQ ID NO: 1966807 - RNA, 20 nt, Shigella flexneri 2a str. 301
gccauguuuaccaucugcgc

SEQ ID NO: 1966808 - RNA, 14 nt, Shigella flexneri 2a str. 301
gccauguuccagug

SEQ ID NO: 1966809 - RNA, 16 nt, Shigella flexneri 2a str. 301
gccaucuuucgcagau

SEQ ID NO: 1966810 - RNA, 19 nt, Shigella flexneri 2a str. 301
gccauuuaacgcaucacga

SEQ ID NO: 1966811 - RNA, 12 nt, Shigella flexneri 2a str. 301
gccauuuccagc

SEQ ID NO: 1966812 - RNA, 18 nt, Shigella flexneri 2a str. 301
gccauuuccagcgcuuuc

SEQ ID NO: 1966813 - RNA, 13 nt, Shigella flexneri 2a str. 301
gccauuuuaauca

SEQ ID NO: 1966814 - RNA, 17 nt, Shigella flexneri 2a str. 301
gccauuuugcaacgcuu

SEQ ID NO: 1966815 - RNA, 20 nt, Shigella flexneri 2a str. 301
gcccaaaccacccagcagcg

SEQ ID NO: 1966816 - RNA, 19 nt, Shigella flexneri 2a str. 301
gccaggcagaacgcuuucg

SEQ ID NO: 1966817 - RNA, 19 nt, Shigella flexneri 2a str. 301
gccaggaugauuccggcaa

SEQ ID NO: 1966818 - RNA, 24 nt, Shigella flexneri 2a str. 301
gccaggauucauuugcaucaacga

SEQ ID NO: 1966819 - RNA, 20 nt, Shigella flexneri 2a str. 301
gccaggcuuuccgucagcgg

SEQ ID NO: 1966820 - RNA, 19 nt, Shigella flexneri 2a str. 301
gccagguguugauccacgg

SEQ ID NO: 1966821 - RNA, 18 nt, Shigella flexneri 2a str. 301
gccagcguaaauccugac

SEQ ID NO: 1966822 - RNA, 22 nt, Shigella flexneri 2a str. 301
gccagcgucaucauagacuucc

SEQ ID NO: 1966823 - RNA, 16 nt, Shigella flexneri 2a str. 301
gccagccccagcguca

SEQ ID NO: 1966824 - RNA, 23 nt, Shigella flexneri 2a str. 301
gccagcagggcaaacagcacggu

SEQ ID NO: 1966825 - RNA, 22 nt, Shigella flexneri 2a str. 301
gccagcauaaucaccaucagca

SEQ ID NO: 1966826 - RNA, 12 nt, Shigella flexneri 2a str. 301
gccagaugcgac

SEQ ID NO: 1966827 - RNA, 14 nt, Shigella flexneri 2a str. 301
gccagaugcagcgg

SEQ ID NO: 1966828 - RNA, 22 nt, Shigella flexneri 2a str. 301
gccagacgguagccccgcuuca

SEQ ID NO: 1966829 - RNA, 23 nt, Shigella flexneri 2a str. 301
gccagacgguagccccgcuucag

SEQ ID NO: 1966830 - RNA, 23 nt, Shigella flexneri 2a str. 301
gccagaacugauaacgcauuuca

SEQ ID NO: 1966831 - RNA, 18 nt, Shigella flexneri 2a str. 301
gccagaaaaccuggcgca

SEQ ID NO: 1966832 - RNA, 18 nt, Shigella flexneri 2a str. 301
gccagaaauccaggcccg

SEQ ID NO: 1966833 - RNA, 16 nt, Shigella flexneri 2a str. 301
gccagaaaaaacguug

SEQ ID NO: 1966834 - RNA, 14 nt, Shigella flexneri 2a str. 301
gccagaccacugcg

SEQ ID NO: 1966835 - RNA, 20 nt, Shigella flexneri 2a str. 301
gcccgauggcaucaccaucg

SEQ ID NO: 1966836 - RNA, 17 nt, Shigella flexneri 2a str. 301
gcccgaaugcagcucca

SEQ ID NO: 1966837 - RNA, 21 nt, Shigella flexneri 2a str. 301
gcccgaaugcagcuccaccga

SEQ ID NO: 1966838 - RNA, 23 nt, Shigella flexneri 2a str. 301
gccccgcuguuugaaauugugau

SEQ ID NO: 1966839 - RNA, 18 nt, Shigella flexneri 2a str. 301
gccccagcgucagcauca

SEQ ID NO: 1966840 - RNA, 20 nt, Shigella flexneri 2a str. 301
gccccagcuugucauacgga

SEQ ID NO: 1966841 - RNA, 21 nt, Shigella flexneri 2a str. 301
gcccaguuagacgugcgaaug

SEQ ID NO: 1966842 - RNA, 20 nt, Shigella flexneri 2a str. 301
gcccagugcggugccgcgaa

SEQ ID NO: 1966843 - RNA, 22 nt, Shigella flexneri 2a str. 301
gccccacaaacccgccagacca

SEQ ID NO: 1966844 - RNA, 22 nt, Shigella flexneri 2a str. 301
gcccagcgcaucaggcaaucuu

SEQ ID NO: 1966845 - RNA, 14 nt, Shigella flexneri 2a str. 301
gcccagcgcaucag

SEQ ID NO: 1966846 - RNA, 16 nt, Shigella flexneri 2a str. 301
gcccggagcagcaguc

SEQ ID NO: 1966847 - RNA, 16 nt, Shigella flexneri 2a str. 301
gcccggcaauggguaa

SEQ ID NO: 1966848 - RNA, 17 nt, Shigella flexneri 2a str. 301
gcccgcuucaucgugcu

SEQ ID NO: 1966849 - RNA, 18 nt, Shigella flexneri 2a str. 301
gcccgcuuccagcgcauc

SEQ ID NO: 1966850 - RNA, 17 nt, Shigella flexneri 2a str. 301
gcccgcuuucaccaucg

SEQ ID NO: 1966851 - RNA, 21 nt, Shigella flexneri 2a str. 301
gcccgcuuucaccaucgcgau

SEQ ID NO: 1966852 - RNA, 16 nt, Shigella flexneri 2a str. 301
gcccgcguuaccggca

SEQ ID NO: 1966853 - RNA, 20 nt, Shigella flexneri 2a str. 301
gcccgcgucguucaucgcaa

SEQ ID NO: 1966854 - RNA, 19 nt, Shigella flexneri 2a str. 301
gcccgcgcgguaucaccac

SEQ ID NO: 1966855 - RNA, 12 nt, Shigella flexneri 2a str. 301
gcccggcgaugg

SEQ ID NO: 1966856 - RNA, 22 nt, Shigella flexneri 2a str. 301
gcccggucaggugguccagcgu

SEQ ID NO: 1966857 - RNA, 16 nt, Shigella flexneri 2a str. 301
gcccgguaaacguggu

SEQ ID NO: 1966858 - RNA, 15 nt, Shigella flexneri 2a str. 301
cgucauugacgcugg

SEQ ID NO: 1966859 - RNA, 16 nt, Shigella flexneri 2a str. 301
cgucauuaucugcaga

SEQ ID NO: 1966860 - RNA, 21 nt, Shigella flexneri 2a str. 301
cgucauuucgaagaaaccgau

SEQ ID NO: 1966861 - RNA, 15 nt, Shigella flexneri 2a str. 301
cgucagccugcucag

SEQ ID NO: 1966862 - RNA, 20 nt, Shigella flexneri 2a str. 301
cguccagcccuccgcgcugu

SEQ ID NO: 1966863 - RNA, 22 nt, Shigella flexneri 2a str. 301
cguccagcgaaccuuccaucgc

SEQ ID NO: 1966864 - RNA, 18 nt, Shigella flexneri 2a str. 301
cgucgauugcucaacgcc

SEQ ID NO: 1966865 - RNA, 21 nt, Shigella flexneri 2a str. 301
cguccgguuuacuuccgggaa

SEQ ID NO: 1966866 - RNA, 15 nt, Shigella flexneri 2a str. 301
cguccgguggcaucc

SEQ ID NO: 1966867 - RNA, 19 nt, Shigella flexneri 2a str. 301
cguaggucggauaagacgc

SEQ ID NO: 1966868 - RNA, 15 nt, Shigella flexneri 2a str. 301
cguaugcccagcgca

SEQ ID NO: 1966869 - RNA, 12 nt, Shigella flexneri 2a str. 301
cguaugcgucag

SEQ ID NO: 1966870 - RNA, 22 nt, Shigella flexneri 2a str. 301
cguauugcgcagagaugcccau

SEQ ID NO: 1966871 - RNA, 18 nt, Shigella flexneri 2a str. 301
cgucaaacgcacgucuga

SEQ ID NO: 1966872 - RNA, 22 nt, Shigella flexneri 2a str. 301
cguauugagaucaccugcugga

SEQ ID NO: 1966873 - RNA, 17 nt, Shigella flexneri 2a str. 301
cguauguggugggcgaa

SEQ ID NO: 1966874 - RNA, 21 nt, Shigella flexneri 2a str. 301
cgucagcaguucacgcagcuu

SEQ ID NO: 1966875 - RNA, 17 nt, Shigella flexneri 2a str. 301
cgucagagcaccaucgc

SEQ ID NO: 1966876 - RNA, 21 nt, Shigella flexneri 2a str. 301
cguaauaagguucauugagcg

SEQ ID NO: 1966877 - RNA, 16 nt, Shigella flexneri 2a str. 301
cguaauaaaaucuauu

SEQ ID NO: 1966878 - RNA, 22 nt, Shigella flexneri 2a str. 301
cguaccgcagcaauggccggaa

SEQ ID NO: 1966879 - RNA, 19 nt, Shigella flexneri 2a str. 301
cguacgcgccccacuggau

SEQ ID NO: 1966880 - RNA, 21 nt, Shigella flexneri 2a str. 301
cguacucaccagacaucccag

SEQ ID NO: 1966881 - RNA, 15 nt, Shigella flexneri 2a str. 301
cguagacugcagcgg

SEQ ID NO: 1966882 - RNA, 23 nt, Shigella flexneri 2a str. 301
cguagcugguucucgcuucugag

SEQ ID NO: 1966883 - RNA, 23 nt, Shigella flexneri 2a str. 301
cguagcgccucagguaccagcau

SEQ ID NO: 1966884 - RNA, 20 nt, Shigella flexneri 2a str. 301
cguagcgacgcaaugccagu

SEQ ID NO: 1966885 - RNA, 15 nt, Shigella flexneri 2a str. 301
cguaacgacugacuu

SEQ ID NO: 1966886 - RNA, 14 nt, Shigella flexneri 2a str. 301
cguaaccgagcaga

SEQ ID NO: 1966887 - RNA, 16 nt, Shigella flexneri 2a str. 301
cguaaaucccgccauu

SEQ ID NO: 1966888 - RNA, 16 nt, Shigella flexneri 2a str. 301
cguaacucauccaacu

SEQ ID NO: 1966889 - RNA, 20 nt, Shigella flexneri 2a str. 301
cguaacguuucuuucaucag

SEQ ID NO: 1966890 - RNA, 18 nt, Shigella flexneri 2a str. 301
cguaagaugacauugaca

SEQ ID NO: 1966891 - RNA, 21 nt, Shigella flexneri 2a str. 301
cguaagcaaaaguagcaaagu

SEQ ID NO: 1966892 - RNA, 13 nt, Shigella flexneri 2a str. 301
cguaaacgugcgg

SEQ ID NO: 1966893 - RNA, 13 nt, Shigella flexneri 2a str. 301
cguaaaguuaccu

SEQ ID NO: 1966894 - RNA, 16 nt, Shigella flexneri 2a str. 301
cgguucaauuuccagu

SEQ ID NO: 1966895 - RNA, 18 nt, Shigella flexneri 2a str. 301
cgguucauggucgccaag

SEQ ID NO: 1966896 - RNA, 14 nt, Shigella flexneri 2a str. 301
cgguucaucacgaa

SEQ ID NO: 1966897 - RNA, 20 nt, Shigella flexneri 2a str. 301
cgguugcggaacccagcgcg

SEQ ID NO: 1966898 - RNA, 14 nt, Shigella flexneri 2a str. 301
cggugaccagcagc

SEQ ID NO: 1966899 - RNA, 20 nt, Shigella flexneri 2a str. 301
cguggcagggaaucagauuc

SEQ ID NO: 1966900 - RNA, 12 nt, Shigella flexneri 2a str. 301
cgugggcgcugu

SEQ ID NO: 1966901 - RNA, 13 nt, Shigella flexneri 2a str. 301
cguguaggccuga

SEQ ID NO: 1966902 - RNA, 16 nt, Shigella flexneri 2a str. 301
cguucacgccgcaucc

SEQ ID NO: 1966903 - RNA, 18 nt, Shigella flexneri 2a str. 301
cguucaucaguuccaguu

SEQ ID NO: 1966904 - RNA, 23 nt, Shigella flexneri 2a str. 301
cguucauggcgcgacauggcgaa

SEQ ID NO: 1966905 - RNA, 23 nt, Shigella flexneri 2a str. 301
cguuccaccgcucccagcaugac

SEQ ID NO: 1966906 - RNA, 21 nt, Shigella flexneri 2a str. 301
cguucgcgccgcauccggcau

SEQ ID NO: 1966907 - RNA, 12 nt, Shigella flexneri 2a str. 301
cguucgccguuu

SEQ ID NO: 1966908 - RNA, 15 nt, Shigella flexneri 2a str. 301
cguucggcacccgua

SEQ ID NO: 1966909 - RNA, 22 nt, Shigella flexneri 2a str. 301
cgugucggugcucaucagcccg

SEQ ID NO: 1966910 - RNA, 15 nt, Shigella flexneri 2a str. 301
cguguuaauuaccua

SEQ ID NO: 1966911 - RNA, 19 nt, Shigella flexneri 2a str. 301
cguuaaagcacgauuugua

SEQ ID NO: 1966912 - RNA, 23 nt, Shigella flexneri 2a str. 301
cguuaacguuuuucgcugucggu

SEQ ID NO: 1966913 - RNA, 21 nt, Shigella flexneri 2a str. 301
cguuaauauugcccgggcgag

SEQ ID NO: 1966914 - RNA, 13 nt, Shigella flexneri 2a str. 301
cguuaccuucggc

SEQ ID NO: 1966915 - RNA, 16 nt, Shigella flexneri 2a str. 301
cguuauucagccugac

SEQ ID NO: 1966916 - RNA, 16 nt, Shigella flexneri 2a str. 301
cguuaugcacggcaug

SEQ ID NO: 1966917 - RNA, 12 nt, Shigella flexneri 2a str. 301
cguuaugucucc

SEQ ID NO: 1966918 - RNA, 23 nt, Shigella flexneri 2a str. 301
cguuaucagggagucuugcugga

SEQ ID NO: 1966919 - RNA, 17 nt, Shigella flexneri 2a str. 301
cgucggcgucagcgcca

SEQ ID NO: 1966920 - RNA, 15 nt, Shigella flexneri 2a str. 301
cgucguagccaccau

SEQ ID NO: 1966921 - RNA, 19 nt, Shigella flexneri 2a str. 301
cgucuuaucaggccagcca

SEQ ID NO: 1966922 - RNA, 19 nt, Shigella flexneri 2a str. 301
cgucuuaucaugccuacag

SEQ ID NO: 1966923 - RNA, 22 nt, Shigella flexneri 2a str. 301
cgucgugaagcagagcagacgc

SEQ ID NO: 1966924 - RNA, 16 nt, Shigella flexneri 2a str. 301
cgugauuuagcaccga

SEQ ID NO: 1966925 - RNA, 15 nt, Shigella flexneri 2a str. 301
cgugauuccagacgg

SEQ ID NO: 1966926 - RNA, 22 nt, Shigella flexneri 2a str. 301
cgugagcggaacggcaggaaua

SEQ ID NO: 1966927 - RNA, 14 nt, Shigella flexneri 2a str. 301
cgugcgcgccguga

SEQ ID NO: 1966928 - RNA, 13 nt, Shigella flexneri 2a str. 301
cgugcugccagcg

SEQ ID NO: 1966929 - RNA, 15 nt, Shigella flexneri 2a str. 301
cgugcugcgcagacg

SEQ ID NO: 1966930 - RNA, 16 nt, Shigella flexneri 2a str. 301
cguggagagcagcauc

SEQ ID NO: 1966931 - RNA, 15 nt, Shigella flexneri 2a str. 301
cugaaugccacaucc

SEQ ID NO: 1966932 - RNA, 23 nt, Shigella flexneri 2a str. 301
cugacagccaaagggcuggcaau

SEQ ID NO: 1966933 - RNA, 17 nt, Shigella flexneri 2a str. 301
cugaauaucacgggcgc

SEQ ID NO: 1966934 - RNA, 14 nt, Shigella flexneri 2a str. 301
cugaauauccagau

SEQ ID NO: 1966935 - RNA, 14 nt, Shigella flexneri 2a str. 301
cugaauacgcaccg

SEQ ID NO: 1966936 - RNA, 17 nt, Shigella flexneri 2a str. 301
cugaauaauacacacag

SEQ ID NO: 1966937 - RNA, 23 nt, Shigella flexneri 2a str. 301
cugaacuaaagccuuuugccagu

SEQ ID NO: 1966938 - RNA, 23 nt, Shigella flexneri 2a str. 301
cugaacgccacgcucacucauca

SEQ ID NO: 1966939 - RNA, 13 nt, Shigella flexneri 2a str. 301
cucucuuccaguu

SEQ ID NO: 1966940 - RNA, 14 nt, Shigella flexneri 2a str. 301
cucuauacaggaua

SEQ ID NO: 1966941 - RNA, 12 nt, Shigella flexneri 2a str. 301
cucugccagcaa

SEQ ID NO: 1966942 - RNA, 15 nt, Shigella flexneri 2a str. 301
cucugccgcaauggc

SEQ ID NO: 1966943 - RNA, 22 nt, Shigella flexneri 2a str. 301
cucuugcuccacaagcuccggc

SEQ ID NO: 1966944 - RNA, 16 nt, Shigella flexneri 2a str. 301
cucuuugcuuccugag

SEQ ID NO: 1966945 - RNA, 20 nt, Shigella flexneri 2a str. 301
cugaacaguacuggccucca

SEQ ID NO: 1966946 - RNA, 16 nt, Shigella flexneri 2a str. 301
cucuuuuuuguucagu

SEQ ID NO: 1966947 - RNA, 14 nt, Shigella flexneri 2a str. 301
cucgucgaacucau

SEQ ID NO: 1966948 - RNA, 23 nt, Shigella flexneri 2a str. 301
cucguugaucacccacaucagcg

SEQ ID NO: 1966949 - RNA, 22 nt, Shigella flexneri 2a str. 301
cucgucgguaauuucacaaguu

SEQ ID NO: 1966950 - RNA, 19 nt, Shigella flexneri 2a str. 301
cucguuguuuuugccggau

SEQ ID NO: 1966951 - RNA, 15 nt, Shigella flexneri 2a str. 301
cugaucgugccagga

SEQ ID NO: 1966952 - RNA, 15 nt, Shigella flexneri 2a str. 301
cugcaacgucuccgg

SEQ ID NO: 1966953 - RNA, 16 nt, Shigella flexneri 2a str. 301
cugaugcaggcgaucg

SEQ ID NO: 1966954 - RNA, 15 nt, Shigella flexneri 2a str. 301
cugcaaacgacguau

SEQ ID NO: 1966955 - RNA, 12 nt, Shigella flexneri 2a str. 301
cugcaaccagau

SEQ ID NO: 1966956 - RNA, 16 nt, Shigella flexneri 2a str. 301
cugcacuggcuuccag

SEQ ID NO: 1966957 - RNA, 23 nt, Shigella flexneri 2a str. 301
cugcacggagauauccagcgccg

SEQ ID NO: 1966958 - RNA, 20 nt, Shigella flexneri 2a str. 301
cugaucaaucacuucuccgg

SEQ ID NO: 1966959 - RNA, 11 nt, Shigella flexneri 2a str. 301
cugauccugca

SEQ ID NO: 1966960 - RNA, 18 nt, Shigella flexneri 2a str. 301
cugagcgguuaacacggc

SEQ ID NO: 1966961 - RNA, 21 nt, Shigella flexneri 2a str. 301
cugauaguguuuuauguucag

SEQ ID NO: 1966962 - RNA, 20 nt, Shigella flexneri 2a str. 301
cugacgugauuuagcaccga

SEQ ID NO: 1966963 - RNA, 20 nt, Shigella flexneri 2a str. 301
cugaccacggccacagccag

SEQ ID NO: 1966964 - RNA, 23 nt, Shigella flexneri 2a str. 301
cugacgcuggguuucgccugcca

SEQ ID NO: 1966965 - RNA, 17 nt, Shigella flexneri 2a str. 301
cugaccgguugcuggau

SEQ ID NO: 1966966 - RNA, 19 nt, Shigella flexneri 2a str. 301
cugacggccuucggugcga

SEQ ID NO: 1966967 - RNA, 21 nt, Shigella flexneri 2a str. 301
cugacggauagccuuucgcuu

SEQ ID NO: 1966968 - RNA, 22 nt, Shigella flexneri 2a str. 301
cugacggaaaucaugcaacacg

SEQ ID NO: 1966969 - RNA, 21 nt, Shigella flexneri 2a str. 301
cugccucucuucgcugcuggu

SEQ ID NO: 1966970 - RNA, 13 nt, Shigella flexneri 2a str. 301
cugccugaugcgc

SEQ ID NO: 1966971 - RNA, 18 nt, Shigella flexneri 2a str. 301
cugccuucacuuccggca

SEQ ID NO: 1966972 - RNA, 16 nt, Shigella flexneri 2a str. 301
cugccuguacggcagu

SEQ ID NO: 1966973 - RNA, 23 nt, Shigella flexneri 2a str. 301
cugcgacgcaaacgacgagcgcu

SEQ ID NO: 1966974 - RNA, 22 nt, Shigella flexneri 2a str. 301
cugcgacagggaucucuuccag

SEQ ID NO: 1966975 - RNA, 13 nt, Shigella flexneri 2a str. 301
cugcgaaucgcuu

SEQ ID NO: 1966976 - RNA, 12 nt, Shigella flexneri 2a str. 301
cugccgccagca

SEQ ID NO: 1966977 - RNA, 13 nt, Shigella flexneri 2a str. 301
cugccgcacuuug

SEQ ID NO: 1966978 - RNA, 16 nt, Shigella flexneri 2a str. 301
cugccgcagauauuga

SEQ ID NO: 1966979 - RNA, 16 nt, Shigella flexneri 2a str. 301
cugcccguuaaccaua

SEQ ID NO: 1966980 - RNA, 23 nt, Shigella flexneri 2a str. 301
cugccggaugcaucgcauccgac

SEQ ID NO: 1966981 - RNA, 20 nt, Shigella flexneri 2a str. 301
cugccggaaccagccaggaa

SEQ ID NO: 1966982 - RNA, 15 nt, Shigella flexneri 2a str. 301
cugccgcgccuucgu

SEQ ID NO: 1966983 - RNA, 19 nt, Shigella flexneri 2a str. 301
cugcaucaaccaacaccug

SEQ ID NO: 1966984 - RNA, 17 nt, Shigella flexneri 2a str. 301
cugccagaacaaccaga

SEQ ID NO: 1966985 - RNA, 18 nt, Shigella flexneri 2a str. 301
cugccagaacaaccagag

SEQ ID NO: 1966986 - RNA, 16 nt, Shigella flexneri 2a str. 301
cugccacuucuucgaa

SEQ ID NO: 1966987 - RNA, 19 nt, Shigella flexneri 2a str. 301
cugcauuugccccuguuga

SEQ ID NO: 1966988 - RNA, 15 nt, Shigella flexneri 2a str. 301
cugcagggcaucgca

SEQ ID NO: 1966989 - RNA, 13 nt, Shigella flexneri 2a str. 301
cugcagccagcgu

SEQ ID NO: 1966990 - RNA, 20 nt, Shigella flexneri 2a str. 301
cugccaguuauagcgcagac

SEQ ID NO: 1966991 - RNA, 19 nt, Shigella flexneri 2a str. 301
cugccaguuauagcgcaga

SEQ ID NO: 1966992 - RNA, 17 nt, Shigella flexneri 2a str. 301
cugccaguuauagcgca

SEQ ID NO: 1966993 - RNA, 13 nt, Shigella flexneri 2a str. 301
cugccagaucggc

SEQ ID NO: 1966994 - RNA, 16 nt, Shigella flexneri 2a str. 301
cugccagaugcagcgg

SEQ ID NO: 1966995 - RNA, 20 nt, Shigella flexneri 2a str. 301
cugccagcguaaauccugac

SEQ ID NO: 1966996 - RNA, 21 nt, Shigella flexneri 2a str. 301
cugccagcuugcgauccugca

SEQ ID NO: 1966997 - RNA, 19 nt, Shigella flexneri 2a str. 301
cucgccaucaaauagcccc

SEQ ID NO: 1966998 - RNA, 10 nt, Shigella flexneri 2a str. 301
cuccgcaaug

SEQ ID NO: 1966999 - RNA, 14 nt, Shigella flexneri 2a str. 301
cucccugccuccau

SEQ ID NO: 1967000 - RNA, 21 nt, Shigella flexneri 2a str. 301
cuccggcuuuuuacuucucag

SEQ ID NO: 1967001 - RNA, 21 nt, Shigella flexneri 2a str. 301
cuccggcguuuuggccgugaa

SEQ ID NO: 1967002 - RNA, 15 nt, Shigella flexneri 2a str. 301
cuaucuucgauaaac

SEQ ID NO: 1967003 - RNA, 14 nt, Shigella flexneri 2a str. 301
cucaacaaccagaa

SEQ ID NO: 1967004 - RNA, 21 nt, Shigella flexneri 2a str. 301
cucaaucuucacgucuuucgg

SEQ ID NO: 1967005 - RNA, 17 nt, Shigella flexneri 2a str. 301
cuacagaggaaucgcug

SEQ ID NO: 1967006 - RNA, 23 nt, Shigella flexneri 2a str. 301
cuacagaggaaucgcuguugagg

SEQ ID NO: 1967007 - RNA, 14 nt, Shigella flexneri 2a str. 301
cuacagguaaggua

SEQ ID NO: 1967008 - RNA, 20 nt, Shigella flexneri 2a str. 301
cuacacuaaacgucucacua

SEQ ID NO: 1967009 - RNA, 16 nt, Shigella flexneri 2a str. 301
cguugagggcgcaauu

SEQ ID NO: 1967010 - RNA, 22 nt, Shigella flexneri 2a str. 301
cguugagcaaucgacgccguuu

SEQ ID NO: 1967011 - RNA, 15 nt, Shigella flexneri 2a str. 301
cguucuucggcacug

SEQ ID NO: 1967012 - RNA, 20 nt, Shigella flexneri 2a str. 301
cuacuucuucuucgcugcag

SEQ ID NO: 1967013 - RNA, 22 nt, Shigella flexneri 2a str. 301
cuacuuugcgagucugcuccag

SEQ ID NO: 1967014 - RNA, 19 nt, Shigella flexneri 2a str. 301
cuaccgcaggggcggggaa

SEQ ID NO: 1967015 - RNA, 18 nt, Shigella flexneri 2a str. 301
cuacgugaggcaucagac

SEQ ID NO: 1967016 - RNA, 15 nt, Shigella flexneri 2a str. 301
cuccagcccgcgucg

SEQ ID NO: 1967017 - RNA, 17 nt, Shigella flexneri 2a str. 301
cuccagcgccagcgcgc

SEQ ID NO: 1967018 - RNA, 13 nt, Shigella flexneri 2a str. 301
cucaccagccgcg

SEQ ID NO: 1967019 - RNA, 15 nt, Shigella flexneri 2a str. 301
cucacgcccaucagc

SEQ ID NO: 1967020 - RNA, 14 nt, Shigella flexneri 2a str. 301
cucaguuaaucgcg

SEQ ID NO: 1967021 - RNA, 16 nt, Shigella flexneri 2a str. 301
cucaucuggcguacca

SEQ ID NO: 1967022 - RNA, 15 nt, Shigella flexneri 2a str. 301
cucaucgcugcgcuc

SEQ ID NO: 1967023 - RNA, 18 nt, Shigella flexneri 2a str. 301
gacagcagguugcgugca

SEQ ID NO: 1967024 - RNA, 14 nt, Shigella flexneri 2a str. 301
gacagggaucucuu

SEQ ID NO: 1967025 - RNA, 13 nt, Shigella flexneri 2a str. 301
gacagccuaccag

SEQ ID NO: 1967026 - RNA, 14 nt, Shigella flexneri 2a str. 301
gacagcgccgcuuu

SEQ ID NO: 1967027 - RNA, 20 nt, Shigella flexneri 2a str. 301
gacagcgcgcgccgccaauc

SEQ ID NO: 1967028 - RNA, 19 nt, Shigella flexneri 2a str. 301
gaccagaaacgccaccauu

SEQ ID NO: 1967029 - RNA, 22 nt, Shigella flexneri 2a str. 301
gaccacuucgguacccagacgc

SEQ ID NO: 1967030 - RNA, 17 nt, Shigella flexneri 2a str. 301
gaccagagcugauacgg

SEQ ID NO: 1967031 - RNA, 16 nt, Shigella flexneri 2a str. 301
gaccacggacaugaac

SEQ ID NO: 1967032 - RNA, 14 nt, Shigella flexneri 2a str. 301
gaccaccagcacgc

SEQ ID NO: 1967033 - RNA, 15 nt, Shigella flexneri 2a str. 301
gacaucgccacggca

SEQ ID NO: 1967034 - RNA, 15 nt, Shigella flexneri 2a str. 301
gacaguccccucgcc

SEQ ID NO: 1967035 - RNA, 22 nt, Shigella flexneri 2a str. 301
gaauccggugccuuaccgcuug

SEQ ID NO: 1967036 - RNA, 19 nt, Shigella flexneri 2a str. 301
gaaugacgacguaccagcg

SEQ ID NO: 1967037 - RNA, 15 nt, Shigella flexneri 2a str. 301
gaaucuucaugcguu

SEQ ID NO: 1967038 - RNA, 23 nt, Shigella flexneri 2a str. 301
gaaucaggaaccacaaccacuuu

SEQ ID NO: 1967039 - RNA, 18 nt, Shigella flexneri 2a str. 301
gaaucagaugugcuucug

SEQ ID NO: 1967040 - RNA, 21 nt, Shigella flexneri 2a str. 301
gaauacgcuggcgcgccgccu

SEQ ID NO: 1967041 - RNA, 13 nt, Shigella flexneri 2a str. 301
gaauacagaacag

SEQ ID NO: 1967042 - RNA, 19 nt, Shigella flexneri 2a str. 301
gaauaagacuggcaaauga

SEQ ID NO: 1967043 - RNA, 13 nt, Shigella flexneri 2a str. 301
gaauaacggcaga

SEQ ID NO: 1967044 - RNA, 20 nt, Shigella flexneri 2a str. 301
gaacucgcugcgcggcagcu

SEQ ID NO: 1967045 - RNA, 22 nt, Shigella flexneri 2a str. 301
gaacucuuucaaaccguagucc

SEQ ID NO: 1967046 - RNA, 19 nt, Shigella flexneri 2a str. 301
gaacugaccgugcgggcga

SEQ ID NO: 1967047 - RNA, 16 nt, Shigella flexneri 2a str. 301
gaauuuguaggccgga

SEQ ID NO: 1967048 - RNA, 14 nt, Shigella flexneri 2a str. 301
gaauuugcgccguu

SEQ ID NO: 1967049 - RNA, 16 nt, Shigella flexneri 2a str. 301
gaaucuucgugcguuu

SEQ ID NO: 1967050 - RNA, 13 nt, Shigella flexneri 2a str. 301
gacaaucgccagu

SEQ ID NO: 1967051 - RNA, 17 nt, Shigella flexneri 2a str. 301
gaccguucgccagguca

SEQ ID NO: 1967052 - RNA, 17 nt, Shigella flexneri 2a str. 301
gaccuucugaauaauga

SEQ ID NO: 1967053 - RNA, 17 nt, Shigella flexneri 2a str. 301
gaccuucuucagcaaua

SEQ ID NO: 1967054 - RNA, 18 nt, Shigella flexneri 2a str. 301
gaccauacagcagcaacg

SEQ ID NO: 1967055 - RNA, 15 nt, Shigella flexneri 2a str. 301
gaccaguaccaccgc

SEQ ID NO: 1967056 - RNA, 13 nt, Shigella flexneri 2a str. 301
gaccagcauucca

SEQ ID NO: 1967057 - RNA, 21 nt, Shigella flexneri 2a str. 301
gaccaucuuccaguugcacgc

SEQ ID NO: 1967058 - RNA, 14 nt, Shigella flexneri 2a str. 301
gacccgcagccagc

SEQ ID NO: 1967059 - RNA, 19 nt, Shigella flexneri 2a str. 301
gacggacguccggugauau

SEQ ID NO: 1967060 - RNA, 19 nt, Shigella flexneri 2a str. 301
gacggaauauugaugacgc

SEQ ID NO: 1967061 - RNA, 14 nt, Shigella flexneri 2a str. 301
gacgcuugcagcgu

SEQ ID NO: 1967062 - RNA, 18 nt, Shigella flexneri 2a str. 301
gacgcuucaguucagcga

SEQ ID NO: 1967063 - RNA, 20 nt, Shigella flexneri 2a str. 301
gacgcuguuccggcggcagg

SEQ ID NO: 1967064 - RNA, 16 nt, Shigella flexneri 2a str. 301
gacgcugucaccugcg

SEQ ID NO: 1967065 - RNA, 22 nt, Shigella flexneri 2a str. 301
gacgcugaugucagcacuucca

SEQ ID NO: 1967066 - RNA, 19 nt, Shigella flexneri 2a str. 301
gacgcuggcuuugcccugg

SEQ ID NO: 1967067 - RNA, 17 nt, Shigella flexneri 2a str. 301
gacgcgguauuggugaa

SEQ ID NO: 1967068 - RNA, 13 nt, Shigella flexneri 2a str. 301
gacgcgcaucacg

SEQ ID NO: 1967069 - RNA, 14 nt, Shigella flexneri 2a str. 301
gacgcgcagcuuca

SEQ ID NO: 1967070 - RNA, 17 nt, Shigella flexneri 2a str. 301
gacgcgcagcgucgcau

SEQ ID NO: 1967071 - RNA, 18 nt, Shigella flexneri 2a str. 301
gacgccaguuacugcuga

SEQ ID NO: 1967072 - RNA, 18 nt, Shigella flexneri 2a str. 301
gacgcccugcgcugguga

SEQ ID NO: 1967073 - RNA, 14 nt, Shigella flexneri 2a str. 301
gacggcugauaugc

SEQ ID NO: 1967074 - RNA, 16 nt, Shigella flexneri 2a str. 301
gacggcuacgcucauu

SEQ ID NO: 1967075 - RNA, 19 nt, Shigella flexneri 2a str. 301
gacguaacgaccaccaccg

SEQ ID NO: 1967076 - RNA, 22 nt, Shigella flexneri 2a str. 301
gacguucuucgcugacaguacc

SEQ ID NO: 1967077 - RNA, 15 nt, Shigella flexneri 2a str. 301
gacguucaccgucac

SEQ ID NO: 1967078 - RNA, 21 nt, Shigella flexneri 2a str. 301
gacgugcgcaaacuucuucag

SEQ ID NO: 1967079 - RNA, 17 nt, Shigella flexneri 2a str. 301
gacguguugucagcuca

SEQ ID NO: 1967080 - RNA, 18 nt, Shigella flexneri 2a str. 301
gacguguuuucaccggcg

SEQ ID NO: 1967081 - RNA, 18 nt, Shigella flexneri 2a str. 301
gacguuaacuacaaucac

SEQ ID NO: 1967082 - RNA, 21 nt, Shigella flexneri 2a str. 301
gagcacgcaagguuucaguaa

SEQ ID NO: 1967083 - RNA, 19 nt, Shigella flexneri 2a str. 301
gagcacuguuacugucggc

SEQ ID NO: 1967084 - RNA, 16 nt, Shigella flexneri 2a str. 301
gagaucgagcgccguu

SEQ ID NO: 1967085 - RNA, 18 nt, Shigella flexneri 2a str. 301
gagaucgccgcuguaaua

SEQ ID NO: 1967086 - RNA, 20 nt, Shigella flexneri 2a str. 301
gagauuuaugacaaacgcaa

SEQ ID NO: 1967087 - RNA, 15 nt, Shigella flexneri 2a str. 301
gagcaacagaguugc

SEQ ID NO: 1967088 - RNA, 13 nt, Shigella flexneri 2a str. 301
gagcaaccaccug

SEQ ID NO: 1967089 - RNA, 17 nt, Shigella flexneri 2a str. 301
gagauacaucaccgcca

SEQ ID NO: 1967090 - RNA, 17 nt, Shigella flexneri 2a str. 301
gagaagccaccgcgcca

SEQ ID NO: 1967091 - RNA, 17 nt, Shigella flexneri 2a str. 301
gagaaccuuuacgcaga

SEQ ID NO: 1967092 - RNA, 13 nt, Shigella flexneri 2a str. 301
gagaaucacgucg

SEQ ID NO: 1967093 - RNA, 16 nt, Shigella flexneri 2a str. 301
gagaauggacaccagc

SEQ ID NO: 1967094 - RNA, 15 nt, Shigella flexneri 2a str. 301
gagaauaagcgcagc

SEQ ID NO: 1967095 - RNA, 20 nt, Shigella flexneri 2a str. 301
gagacacaacaauucccagu

SEQ ID NO: 1967096 - RNA, 11 nt, Shigella flexneri 2a str. 301
gacugacuccg

SEQ ID NO: 1967097 - RNA, 15 nt, Shigella flexneri 2a str. 301
gacugacgugaugau

SEQ ID NO: 1967098 - RNA, 19 nt, Shigella flexneri 2a str. 301
gacugauaacgcggcagca

SEQ ID NO: 1967099 - RNA, 13 nt, Shigella flexneri 2a str. 301
gacuggcggcaaa

SEQ ID NO: 1967100 - RNA, 20 nt, Shigella flexneri 2a str. 301
gacugguuuugaacagcggu

SEQ ID NO: 1967101 - RNA, 20 nt, Shigella flexneri 2a str. 301
gacuguaaauaaaccaccug

SEQ ID NO: 1967102 - RNA, 13 nt, Shigella flexneri 2a str. 301
gacuggaaaucaa

SEQ ID NO: 1967103 - RNA, 12 nt, Shigella flexneri 2a str. 301
gacugcuccugu

SEQ ID NO: 1967104 - RNA, 18 nt, Shigella flexneri 2a str. 301
gagaaagucguaggccug

SEQ ID NO: 1967105 - RNA, 21 nt, Shigella flexneri 2a str. 301
gagaaaaauaucguaggccug

SEQ ID NO: 1967106 - RNA, 17 nt, Shigella flexneri 2a str. 301
gacuuuaaucaccugcc

SEQ ID NO: 1967107 - RNA, 13 nt, Shigella flexneri 2a str. 301
gacuuccagcgua

SEQ ID NO: 1967108 - RNA, 15 nt, Shigella flexneri 2a str. 301
gacuugaaccagcga

SEQ ID NO: 1967109 - RNA, 14 nt, Shigella flexneri 2a str. 301
cuguuacugucggc

SEQ ID NO: 1967110 - RNA, 17 nt, Shigella flexneri 2a str. 301
cugucgggaacacuuua

SEQ ID NO: 1967111 - RNA, 14 nt, Shigella flexneri 2a str. 301
cugucgggcagcgu

SEQ ID NO: 1967112 - RNA, 21 nt, Shigella flexneri 2a str. 301
cugugcagcgacgucugccgg

SEQ ID NO: 1967113 - RNA, 15 nt, Shigella flexneri 2a str. 301
cugucggcgguaagc

SEQ ID NO: 1967114 - RNA, 12 nt, Shigella flexneri 2a str. 301
cuguuugccagu

SEQ ID NO: 1967115 - RNA, 20 nt, Shigella flexneri 2a str. 301
cuguucgucccgauucagca

SEQ ID NO: 1967116 - RNA, 22 nt, Shigella flexneri 2a str. 301
cuguuugaaaugaugucgcugu

SEQ ID NO: 1967117 - RNA, 14 nt, Shigella flexneri 2a str. 301
cugucgaucuccgg

SEQ ID NO: 1967118 - RNA, 13 nt, Shigella flexneri 2a str. 301
cugucgcagccag

SEQ ID NO: 1967119 - RNA, 14 nt, Shigella flexneri 2a str. 301
cuguaaaaggcgcc

SEQ ID NO: 1967120 - RNA, 14 nt, Shigella flexneri 2a str. 301
cuguacauugagcu

SEQ ID NO: 1967121 - RNA, 15 nt, Shigella flexneri 2a str. 301
cuguaccacaaccug

SEQ ID NO: 1967122 - RNA, 21 nt, Shigella flexneri 2a str. 301
cuguaccaccagaaucgccag

SEQ ID NO: 1967123 - RNA, 15 nt, Shigella flexneri 2a str. 301
cuguaaccagcgcag

SEQ ID NO: 1967124 - RNA, 19 nt, Shigella flexneri 2a str. 301
cuguaacgccuuuuccagc

SEQ ID NO: 1967125 - RNA, 18 nt, Shigella flexneri 2a str. 301
cuuccauuucaucgccag

SEQ ID NO: 1967126 - RNA, 20 nt, Shigella flexneri 2a str. 301
cuucgccugccugcagcugc

SEQ ID NO: 1967127 - RNA, 16 nt, Shigella flexneri 2a str. 301
cuucgcuggcaacaca

SEQ ID NO: 1967128 - RNA, 14 nt, Shigella flexneri 2a str. 301
cuucgcgguaauga

SEQ ID NO: 1967129 - RNA, 22 nt, Shigella flexneri 2a str. 301
cuucgcggacaucguccagcuu

SEQ ID NO: 1967130 - RNA, 13 nt, Shigella flexneri 2a str. 301
cuucgcgacggca

SEQ ID NO: 1967131 - RNA, 20 nt, Shigella flexneri 2a str. 301
cuucgcgaacacccgacgug

SEQ ID NO: 1967132 - RNA, 16 nt, Shigella flexneri 2a str. 301
cuucacuuuugccaga

SEQ ID NO: 1967133 - RNA, 21 nt, Shigella flexneri 2a str. 301
cuucagcaacaaaauggcaaa

SEQ ID NO: 1967134 - RNA, 14 nt, Shigella flexneri 2a str. 301
cuucagcagcccau

SEQ ID NO: 1967135 - RNA, 17 nt, Shigella flexneri 2a str. 301
cuucagccgcaaaccug

SEQ ID NO: 1967136 - RNA, 12 nt, Shigella flexneri 2a str. 301
cuuauccggcau

SEQ ID NO: 1967137 - RNA, 23 nt, Shigella flexneri 2a str. 301
cuuaucaggccuguggugauuca

SEQ ID NO: 1967138 - RNA, 17 nt, Shigella flexneri 2a str. 301
cuuaucaggccagccag

SEQ ID NO: 1967139 - RNA, 15 nt, Shigella flexneri 2a str. 301
cuucacgcccagauc

SEQ ID NO: 1967140 - RNA, 21 nt, Shigella flexneri 2a str. 301
cuucacgauagccacgcucau

SEQ ID NO: 1967141 - RNA, 20 nt, Shigella flexneri 2a str. 301
cuucaguuuuucccgcuucg

SEQ ID NO: 1967142 - RNA, 16 nt, Shigella flexneri 2a str. 301
cuucaucacgcagcgu

SEQ ID NO: 1967143 - RNA, 13 nt, Shigella flexneri 2a str. 301
cuucaucgcccac

SEQ ID NO: 1967144 - RNA, 21 nt, Shigella flexneri 2a str. 301
cuucaucacgcagcgucagca

SEQ ID NO: 1967145 - RNA, 21 nt, Shigella flexneri 2a str. 301
cuucaucgugcucgcuuucca

SEQ ID NO: 1967146 - RNA, 17 nt, Shigella flexneri 2a str. 301
cuuccagcuccagccgc

SEQ ID NO: 1967147 - RNA, 22 nt, Shigella flexneri 2a str. 301
cuuccaggucaaccuagccuuc

SEQ ID NO: 1967148 - RNA, 15 nt, Shigella flexneri 2a str. 301
cuggcagaugcgucu

SEQ ID NO: 1967149 - RNA, 18 nt, Shigella flexneri 2a str. 301
cuggcagaaaguucgcga

SEQ ID NO: 1967150 - RNA, 14 nt, Shigella flexneri 2a str. 301
cuggcacgaccugg

SEQ ID NO: 1967151 - RNA, 15 nt, Shigella flexneri 2a str. 301
cuggcagauccugaa

SEQ ID NO: 1967152 - RNA, 19 nt, Shigella flexneri 2a str. 301
cugcgagauuccgccgcca

SEQ ID NO: 1967153 - RNA, 23 nt, Shigella flexneri 2a str. 301
cugcgagguuauccgccagcgcc

SEQ ID NO: 1967154 - RNA, 22 nt, Shigella flexneri 2a str. 301
cuggacguugcguugcagcagg

SEQ ID NO: 1967155 - RNA, 22 nt, Shigella flexneri 2a str. 301
cuggaucagacgcagccagcgu

SEQ ID NO: 1967156 - RNA, 16 nt, Shigella flexneri 2a str. 301
cuggauauugcggaac

SEQ ID NO: 1967157 - RNA, 17 nt, Shigella flexneri 2a str. 301
cuggcgaacucuuccgg

SEQ ID NO: 1967158 - RNA, 19 nt, Shigella flexneri 2a str. 301
cuggcgaacauccagcagc

SEQ ID NO: 1967159 - RNA, 22 nt, Shigella flexneri 2a str. 301
cuggcgcgaacagcacaucagc

SEQ ID NO: 1967160 - RNA, 14 nt, Shigella flexneri 2a str. 301
cuggcgauugucau

SEQ ID NO: 1967161 - RNA, 23 nt, Shigella flexneri 2a str. 301
cugggcggucuuguuacuggcua

SEQ ID NO: 1967162 - RNA, 18 nt, Shigella flexneri 2a str. 301
cuggcguacccaucaaca

SEQ ID NO: 1967163 - RNA, 15 nt, Shigella flexneri 2a str. 301
cuggcguaacagcaa

SEQ ID NO: 1967164 - RNA, 22 nt, Shigella flexneri 2a str. 301
cugguggcgagguaggcaguca

SEQ ID NO: 1967165 - RNA, 16 nt, Shigella flexneri 2a str. 301
cugguguaucugcugu

SEQ ID NO: 1967166 - RNA, 14 nt, Shigella flexneri 2a str. 301
cuggugggcggcgu

SEQ ID NO: 1967167 - RNA, 22 nt, Shigella flexneri 2a str. 301
cuggucugacgcugaauacgca

SEQ ID NO: 1967168 - RNA, 17 nt, Shigella flexneri 2a str. 301
cuggugaccugggaaau

SEQ ID NO: 1967169 - RNA, 15 nt, Shigella flexneri 2a str. 301
cuggugcaaaaccug

SEQ ID NO: 1967170 - RNA, 20 nt, Shigella flexneri 2a str. 301
cuggugcaaaaccugguugg

SEQ ID NO: 1967171 - RNA, 15 nt, Shigella flexneri 2a str. 301
cuggugcagcggcuc

SEQ ID NO: 1967172 - RNA, 16 nt, Shigella flexneri 2a str. 301
cugguaccagcaccgu

SEQ ID NO: 1967173 - RNA, 20 nt, Shigella flexneri 2a str. 301
cuggucugaaucaacaccgg

SEQ ID NO: 1967174 - RNA, 14 nt, Shigella flexneri 2a str. 301
gaacucaacgccuu

SEQ ID NO: 1967175 - RNA, 20 nt, Shigella flexneri 2a str. 301
gaacucauacaccagcggca

SEQ ID NO: 1967176 - RNA, 15 nt, Shigella flexneri 2a str. 301
gaacggauucaguga

SEQ ID NO: 1967177 - RNA, 21 nt, Shigella flexneri 2a str. 301
gaacggcgcaccagaauaccu

SEQ ID NO: 1967178 - RNA, 18 nt, Shigella flexneri 2a str. 301
gaaccugugacagcagcg

SEQ ID NO: 1967179 - RNA, 20 nt, Shigella flexneri 2a str. 301
gaacgccuguguccuguuga

SEQ ID NO: 1967180 - RNA, 22 nt, Shigella flexneri 2a str. 301
gaaccgcuuugccacugccggu

SEQ ID NO: 1967181 - RNA, 13 nt, Shigella flexneri 2a str. 301
gaaccaggcgcga

SEQ ID NO: 1967182 - RNA, 21 nt, Shigella flexneri 2a str. 301
gaaccaucgagaaucagcgag

SEQ ID NO: 1967183 - RNA, 19 nt, Shigella flexneri 2a str. 301
gaacccacgguacucauca

SEQ ID NO: 1967184 - RNA, 17 nt, Shigella flexneri 2a str. 301
gaacagccagaagcccg

SEQ ID NO: 1967185 - RNA, 21 nt, Shigella flexneri 2a str. 301
gaacagccacuggugagcggu

SEQ ID NO: 1967186 - RNA, 13 nt, Shigella flexneri 2a str. 301
gaacagcagcggu

SEQ ID NO: 1967187 - RNA, 14 nt, Shigella flexneri 2a str. 301
gaacagaacuggcg

SEQ ID NO: 1967188 - RNA, 23 nt, Shigella flexneri 2a str. 301
gaacagcucaguuaacggcauaa

SEQ ID NO: 1967189 - RNA, 12 nt, Shigella flexneri 2a str. 301
gaacaucugccc

SEQ ID NO: 1967190 - RNA, 16 nt, Shigella flexneri 2a str. 301
gaaccaaagaaaucag

SEQ ID NO: 1967191 - RNA, 19 nt, Shigella flexneri 2a str. 301
gaaccaacgcugccagccg

SEQ ID NO: 1967192 - RNA, 16 nt, Shigella flexneri 2a str. 301
gaacaguucagcagca

SEQ ID NO: 1967193 - RNA, 22 nt, Shigella flexneri 2a str. 301
gaacaucaauccaaacauggca

SEQ ID NO: 1967194 - RNA, 15 nt, Shigella flexneri 2a str. 301
gaacaguucagcagc

SEQ ID NO: 1967195 - RNA, 21 nt, Shigella flexneri 2a str. 301
gaacaggucgagaacaacggc

SEQ ID NO: 1967196 - RNA, 14 nt, Shigella flexneri 2a str. 301
gaacaguaaagcgc

SEQ ID NO: 1967197 - RNA, 13 nt, Shigella flexneri 2a str. 301
gaacacgaucuca

SEQ ID NO: 1967198 - RNA, 19 nt, Shigella flexneri 2a str. 301
gaacacggaucaggcggcu

SEQ ID NO: 1967199 - RNA, 18 nt, Shigella flexneri 2a str. 301
gaacaacguaucuugcgu

SEQ ID NO: 1967200 - RNA, 20 nt, Shigella flexneri 2a str. 301
gaacaacagucccaggcaga

SEQ ID NO: 1967201 - RNA, 19 nt, Shigella flexneri 2a str. 301
gaacaaccacgacauuggc

SEQ ID NO: 1967202 - RNA, 22 nt, Shigella flexneri 2a str. 301
gaaauccgguucauggucgcca

SEQ ID NO: 1967203 - RNA, 15 nt, Shigella flexneri 2a str. 301
gaaaucauucaauac

SEQ ID NO: 1967204 - RNA, 14 nt, Shigella flexneri 2a str. 301
gaaauucagcgucg

SEQ ID NO: 1967205 - RNA, 15 nt, Shigella flexneri 2a str. 301
gaaauuccagcggca

SEQ ID NO: 1967206 - RNA, 20 nt, Shigella flexneri 2a str. 301
gaaauugaaaaaccagacga

SEQ ID NO: 1967207 - RNA, 23 nt, Shigella flexneri 2a str. 301
gaaauguugaauugccgggugca

SEQ ID NO: 1967208 - RNA, 13 nt, Shigella flexneri 2a str. 301
gaaauggcguuag

SEQ ID NO: 1967209 - RNA, 15 nt, Shigella flexneri 2a str. 301
cuuuaauuuugugca

SEQ ID NO: 1967210 - RNA, 14 nt, Shigella flexneri 2a str. 301
cuuuacccagcgga

SEQ ID NO: 1967211 - RNA, 16 nt, Shigella flexneri 2a str. 301
cuuguuaccugaugca

SEQ ID NO: 1967212 - RNA, 14 nt, Shigella flexneri 2a str. 301
cuucguuaucccag

SEQ ID NO: 1967213 - RNA, 14 nt, Shigella flexneri 2a str. 301
cuugcucauccgga

SEQ ID NO: 1967214 - RNA, 20 nt, Shigella flexneri 2a str. 301
cuugcucaaugaguucgcgc

SEQ ID NO: 1967215 - RNA, 23 nt, Shigella flexneri 2a str. 301
cuugcugcauugagguaaacaga

SEQ ID NO: 1967216 - RNA, 15 nt, Shigella flexneri 2a str. 301
gaaauaaucaccuga

SEQ ID NO: 1967217 - RNA, 14 nt, Shigella flexneri 2a str. 301
gaaauaaaccgcgc

SEQ ID NO: 1967218 - RNA, 16 nt, Shigella flexneri 2a str. 301
gaaaguuuuucaacac

SEQ ID NO: 1967219 - RNA, 16 nt, Shigella flexneri 2a str. 301
gaaagcuugcgucgcc

SEQ ID NO: 1967220 - RNA, 18 nt, Shigella flexneri 2a str. 301
gaaaguaaaccaccaguc

SEQ ID NO: 1967221 - RNA, 20 nt, Shigella flexneri 2a str. 301
gaaaucaucaauaccagccc

SEQ ID NO: 1967222 - RNA, 19 nt, Shigella flexneri 2a str. 301
gaaaucaccaccagcaccg

SEQ ID NO: 1967223 - RNA, 20 nt, Shigella flexneri 2a str. 301
gaaaucaccaccagcaccgc

SEQ ID NO: 1967224 - RNA, 20 nt, Shigella flexneri 2a str. 301
gaaaucaccgccaccagcgu

SEQ ID NO: 1967225 - RNA, 17 nt, Shigella flexneri 2a str. 301
gaaauacguaggccuga

SEQ ID NO: 1967226 - RNA, 24 nt, Shigella flexneri 2a str. 301
gaaacugucaauaaacgccugcuu

SEQ ID NO: 1967227 - RNA, 14 nt, Shigella flexneri 2a str. 301
gaaacugccggaag

SEQ ID NO: 1967228 - RNA, 21 nt, Shigella flexneri 2a str. 301
gaaacugucaauaaacgccug

SEQ ID NO: 1967229 - RNA, 13 nt, Shigella flexneri 2a str. 301
gaaacucgcguaa

SEQ ID NO: 1967230 - RNA, 19 nt, Shigella flexneri 2a str. 301
gaaagcgggugaaggugcc

SEQ ID NO: 1967231 - RNA, 18 nt, Shigella flexneri 2a str. 301
gaaagaucgccacugcug

SEQ ID NO: 1967232 - RNA, 16 nt, Shigella flexneri 2a str. 301
gaaagcccuugccgau

SEQ ID NO: 1967233 - RNA, 22 nt, Shigella flexneri 2a str. 301
gaaagcagcauacccaccgguc

SEQ ID NO: 1967234 - RNA, 18 nt, Shigella flexneri 2a str. 301
gaaaauucuccggcguuu

SEQ ID NO: 1967235 - RNA, 14 nt, Shigella flexneri 2a str. 301
gaaaacgcccggca

SEQ ID NO: 1967236 - RNA, 15 nt, Shigella flexneri 2a str. 301
gaaaacgcauaccag

SEQ ID NO: 1967237 - RNA, 18 nt, Shigella flexneri 2a str. 301
gaaaacgccacauccggc

SEQ ID NO: 1967238 - RNA, 18 nt, Shigella flexneri 2a str. 301
gaaaacgcuggcagcauu

SEQ ID NO: 1967239 - RNA, 13 nt, Shigella flexneri 2a str. 301
gaaaagccggaau

SEQ ID NO: 1967240 - RNA, 22 nt, Shigella flexneri 2a str. 301
gaaaacuaaccuuacaaguaag

SEQ ID NO: 1967241 - RNA, 15 nt, Shigella flexneri 2a str. 301
gaaaaccgaugcagu

SEQ ID NO: 1967242 - RNA, 15 nt, Shigella flexneri 2a str. 301
gaaaacgaauacugg

SEQ ID NO: 1967243 - RNA, 14 nt, Shigella flexneri 2a str. 301
gaaaacgaaagcgc

SEQ ID NO: 1967244 - RNA, 21 nt, Shigella flexneri 2a str. 301
cuuuuuucaugggugccagau

SEQ ID NO: 1967245 - RNA, 13 nt, Shigella flexneri 2a str. 301
cuuuaugcugaag

SEQ ID NO: 1967246 - RNA, 19 nt, Shigella flexneri 2a str. 301
cuuuaucgccgcuggaaau

SEQ ID NO: 1967247 - RNA, 21 nt, Shigella flexneri 2a str. 301
cuuuucaacaaauucuggcac

SEQ ID NO: 1967248 - RNA, 16 nt, Shigella flexneri 2a str. 301
cuuuucgucaggauua

SEQ ID NO: 1967249 - RNA, 13 nt, Shigella flexneri 2a str. 301
cuuuucucaauca

SEQ ID NO: 1967250 - RNA, 12 nt, Shigella flexneri 2a str. 301
cuuuugccagaa

SEQ ID NO: 1967251 - RNA, 15 nt, Shigella flexneri 2a str. 301
cuuuuuaaucgccau

SEQ ID NO: 1967252 - RNA, 15 nt, Shigella flexneri 2a str. 301
cgacaugcaucacgc

SEQ ID NO: 1967253 - RNA, 16 nt, Shigella flexneri 2a str. 301
cgacagugacuuccgu

SEQ ID NO: 1967254 - RNA, 15 nt, Shigella flexneri 2a str. 301
cgacauuucugcugc

SEQ ID NO: 1967255 - RNA, 15 nt, Shigella flexneri 2a str. 301
cgacauugaccagcc

SEQ ID NO: 1967256 - RNA, 16 nt, Shigella flexneri 2a str. 301
cgacauugaccagcca

SEQ ID NO: 1967257 - RNA, 14 nt, Shigella flexneri 2a str. 301
cgacaugcuuacca

SEQ ID NO: 1967258 - RNA, 13 nt, Shigella flexneri 2a str. 301
cgaccaccagcgu

SEQ ID NO: 1967259 - RNA, 22 nt, Shigella flexneri 2a str. 301
cgaccagcggaauucccgcuuc

SEQ ID NO: 1967260 - RNA, 17 nt, Shigella flexneri 2a str. 301
cgaccaggccaucagca

SEQ ID NO: 1967261 - RNA, 12 nt, Shigella flexneri 2a str. 301
cgaagugccagu

SEQ ID NO: 1967262 - RNA, 20 nt, Shigella flexneri 2a str. 301
cgaaugacccgagccacguc

SEQ ID NO: 1967263 - RNA, 18 nt, Shigella flexneri 2a str. 301
cgaagcauucagacacgc

SEQ ID NO: 1967264 - RNA, 23 nt, Shigella flexneri 2a str. 301
cgaagcauucagacacgccgcca

SEQ ID NO: 1967265 - RNA, 14 nt, Shigella flexneri 2a str. 301
cgaagcaagcggag

SEQ ID NO: 1967266 - RNA, 21 nt, Shigella flexneri 2a str. 301
cgaaguauggaaaucacccag

SEQ ID NO: 1967267 - RNA, 14 nt, Shigella flexneri 2a str. 301
cgacaccagccauc

SEQ ID NO: 1967268 - RNA, 17 nt, Shigella flexneri 2a str. 301
cgacagcgauuccaguu

SEQ ID NO: 1967269 - RNA, 19 nt, Shigella flexneri 2a str. 301
cgacagcgaaaucccuucg

SEQ ID NO: 1967270 - RNA, 15 nt, Shigella flexneri 2a str. 301
ccuucgaaucccgca

SEQ ID NO: 1967271 - RNA, 20 nt, Shigella flexneri 2a str. 301
ccuucuaccuuaacgguauc

SEQ ID NO: 1967272 - RNA, 22 nt, Shigella flexneri 2a str. 301
ccuuccaucgcaucuucgccca

SEQ ID NO: 1967273 - RNA, 21 nt, Shigella flexneri 2a str. 301
ccuuauccggccuaccguuca

SEQ ID NO: 1967274 - RNA, 17 nt, Shigella flexneri 2a str. 301
ccuuagcaacaggccag

SEQ ID NO: 1967275 - RNA, 13 nt, Shigella flexneri 2a str. 301
ccuggcagcaccg

SEQ ID NO: 1967276 - RNA, 21 nt, Shigella flexneri 2a str. 301
ccuugcgcgcagugccggugg

SEQ ID NO: 1967277 - RNA, 22 nt, Shigella flexneri 2a str. 301
ccuuugaacaaccagaaagaug

SEQ ID NO: 1967278 - RNA, 15 nt, Shigella flexneri 2a str. 301
ccuuugcuggcauga

SEQ ID NO: 1967279 - RNA, 23 nt, Shigella flexneri 2a str. 301
ccuuuuggcaaagguucaagcag

SEQ ID NO: 1967280 - RNA, 12 nt, Shigella flexneri 2a str. 301
cgaaacguucca

SEQ ID NO: 1967281 - RNA, 21 nt, Shigella flexneri 2a str. 301
cgaaagaggcgcagaugaagc

SEQ ID NO: 1967282 - RNA, 16 nt, Shigella flexneri 2a str. 301
cgaaagagcuggcgaa

SEQ ID NO: 1967283 - RNA, 13 nt, Shigella flexneri 2a str. 301
cgaaagcccauca

SEQ ID NO: 1967284 - RNA, 14 nt, Shigella flexneri 2a str. 301
cgaacagcacauca

SEQ ID NO: 1967285 - RNA, 18 nt, Shigella flexneri 2a str. 301
cgaacaggccgacuggca

SEQ ID NO: 1967286 - RNA, 20 nt, Shigella flexneri 2a str. 301
cgaacaggccgacuggcaug

SEQ ID NO: 1967287 - RNA, 14 nt, Shigella flexneri 2a str. 301
cgaacagcagcagg

SEQ ID NO: 1967288 - RNA, 22 nt, Shigella flexneri 2a str. 301
cgaaccaucaccucuucagcgu

SEQ ID NO: 1967289 - RNA, 18 nt, Shigella flexneri 2a str. 301
cgaaccaccaaacugcgc

SEQ ID NO: 1967290 - RNA, 15 nt, Shigella flexneri 2a str. 301
cgaaccaaacagcgc

SEQ ID NO: 1967291 - RNA, 22 nt, Shigella flexneri 2a str. 301
cgaacaguucaacgccgcuauc

SEQ ID NO: 1967292 - RNA, 19 nt, Shigella flexneri 2a str. 301
cgaacagguugcccagcgc

SEQ ID NO: 1967293 - RNA, 13 nt, Shigella flexneri 2a str. 301
cgaacauccggcu

SEQ ID NO: 1967294 - RNA, 17 nt, Shigella flexneri 2a str. 301
cgaagagaucgauguuu

SEQ ID NO: 1967295 - RNA, 18 nt, Shigella flexneri 2a str. 301
cgaagagagcgccagaag

SEQ ID NO: 1967296 - RNA, 17 nt, Shigella flexneri 2a str. 301
cgaagaaagcgggugaa

SEQ ID NO: 1967297 - RNA, 15 nt, Shigella flexneri 2a str. 301
cgaacuguaaugaau

SEQ ID NO: 1967298 - RNA, 21 nt, Shigella flexneri 2a str. 301
cgaaccgccuggcgcugcuca

SEQ ID NO: 1967299 - RNA, 23 nt, Shigella flexneri 2a str. 301
cgagcaauagacaguucuuccug

SEQ ID NO: 1967300 - RNA, 14 nt, Shigella flexneri 2a str. 301
cgagcauugccagc

SEQ ID NO: 1967301 - RNA, 18 nt, Shigella flexneri 2a str. 301
cgagcagcugacuuccag

SEQ ID NO: 1967302 - RNA, 18 nt, Shigella flexneri 2a str. 301
cgagcuuucgaccagcca

SEQ ID NO: 1967303 - RNA, 12 nt, Shigella flexneri 2a str. 301
cgagcuggugcc

SEQ ID NO: 1967304 - RNA, 17 nt, Shigella flexneri 2a str. 301
cgaggcaaccagcacgc

SEQ ID NO: 1967305 - RNA, 22 nt, Shigella flexneri 2a str. 301
cgaggccaaucagcaauaaacg

SEQ ID NO: 1967306 - RNA, 15 nt, Shigella flexneri 2a str. 301
cgaggauucgaaccu

SEQ ID NO: 1967307 - RNA, 18 nt, Shigella flexneri 2a str. 301
cgacguccaaucagcaca

SEQ ID NO: 1967308 - RNA, 17 nt, Shigella flexneri 2a str. 301
cgacgucaguuuccagc

SEQ ID NO: 1967309 - RNA, 11 nt, Shigella flexneri 2a str. 301
cgacgugcugg

SEQ ID NO: 1967310 - RNA, 16 nt, Shigella flexneri 2a str. 301
cgacggcaccacauuc

SEQ ID NO: 1967311 - RNA, 14 nt, Shigella flexneri 2a str. 301
cgacggccagucau

SEQ ID NO: 1967312 - RNA, 13 nt, Shigella flexneri 2a str. 301
cgacgaccaccga

SEQ ID NO: 1967313 - RNA, 20 nt, Shigella flexneri 2a str. 301
cgaccguuccauucaaacgu

SEQ ID NO: 1967314 - RNA, 17 nt, Shigella flexneri 2a str. 301
cgaccccaggccgcgua

SEQ ID NO: 1967315 - RNA, 21 nt, Shigella flexneri 2a str. 301
cgacgagcgcuggugacaucg

SEQ ID NO: 1967316 - RNA, 15 nt, Shigella flexneri 2a str. 301
cgacgcauacgaucc

SEQ ID NO: 1967317 - RNA, 18 nt, Shigella flexneri 2a str. 301
cgccaucggcagcaucgc

SEQ ID NO: 1967318 - RNA, 15 nt, Shigella flexneri 2a str. 301
cgccaucucuuccag

SEQ ID NO: 1967319 - RNA, 14 nt, Shigella flexneri 2a str. 301
cgccaucuggcuga

SEQ ID NO: 1967320 - RNA, 23 nt, Shigella flexneri 2a str. 301
cgccauccugauagcuuacggcg

SEQ ID NO: 1967321 - RNA, 12 nt, Shigella flexneri 2a str. 301
cgccauccggca

SEQ ID NO: 1967322 - RNA, 22 nt, Shigella flexneri 2a str. 301
cgccaggucagagagccagccc

SEQ ID NO: 1967323 - RNA, 14 nt, Shigella flexneri 2a str. 301
cgccagugccgccc

SEQ ID NO: 1967324 - RNA, 20 nt, Shigella flexneri 2a str. 301
cgccaguuacugccaccauc

SEQ ID NO: 1967325 - RNA, 16 nt, Shigella flexneri 2a str. 301
cgccagguuguucacg

SEQ ID NO: 1967326 - RNA, 17 nt, Shigella flexneri 2a str. 301
cgccacgcggagcgccu

SEQ ID NO: 1967327 - RNA, 13 nt, Shigella flexneri 2a str. 301
cgccacgcucacu

SEQ ID NO: 1967328 - RNA, 23 nt, Shigella flexneri 2a str. 301
cgccaccuuucucggcaucacgc

SEQ ID NO: 1967329 - RNA, 13 nt, Shigella flexneri 2a str. 301
cgccacgaaacug

SEQ ID NO: 1967330 - RNA, 16 nt, Shigella flexneri 2a str. 301
cgccacuaccaucagg

SEQ ID NO: 1967331 - RNA, 16 nt, Shigella flexneri 2a str. 301
cgccagacccagacgc

SEQ ID NO: 1967332 - RNA, 18 nt, Shigella flexneri 2a str. 301
cgccagagagcgaauauc

SEQ ID NO: 1967333 - RNA, 14 nt, Shigella flexneri 2a str. 301
cgccaggccagccu

SEQ ID NO: 1967334 - RNA, 13 nt, Shigella flexneri 2a str. 301
cgccagcguugau

SEQ ID NO: 1967335 - RNA, 13 nt, Shigella flexneri 2a str. 301
cgccagcucacgg

SEQ ID NO: 1967336 - RNA, 19 nt, Shigella flexneri 2a str. 301
cgccagcacgaccgccauu

SEQ ID NO: 1967337 - RNA, 13 nt, Shigella flexneri 2a str. 301
cgccagcagaguu

SEQ ID NO: 1967338 - RNA, 21 nt, Shigella flexneri 2a str. 301
cgccagccaccacaauugacc

SEQ ID NO: 1967339 - RNA, 19 nt, Shigella flexneri 2a str. 301
cgccagcauucccgccagc

SEQ ID NO: 1967340 - RNA, 20 nt, Shigella flexneri 2a str. 301
cgcauuaaaaacccgccaug

SEQ ID NO: 1967341 - RNA, 18 nt, Shigella flexneri 2a str. 301
cgccaaaugucaccagcc

SEQ ID NO: 1967342 - RNA, 14 nt, Shigella flexneri 2a str. 301
cgccaaccagacga

SEQ ID NO: 1967343 - RNA, 21 nt, Shigella flexneri 2a str. 301
cgccaacccuucugcacgcca

SEQ ID NO: 1967344 - RNA, 18 nt, Shigella flexneri 2a str. 301
cgccaaccaguugcgcaa

SEQ ID NO: 1967345 - RNA, 22 nt, Shigella flexneri 2a str. 301
cgccaaccaguugcgcaauacc

SEQ ID NO: 1967346 - RNA, 22 nt, Shigella flexneri 2a str. 301
cgccaaccgauaucuuuccggc

SEQ ID NO: 1967347 - RNA, 11 nt, Shigella flexneri 2a str. 301
cgcauccagaa

SEQ ID NO: 1967348 - RNA, 23 nt, Shigella flexneri 2a str. 301
cgcauccagccaacguuucugga

SEQ ID NO: 1967349 - RNA, 15 nt, Shigella flexneri 2a str. 301
cgcaucagcuccggu

SEQ ID NO: 1967350 - RNA, 14 nt, Shigella flexneri 2a str. 301
cgcaucaggcaugg

SEQ ID NO: 1967351 - RNA, 16 nt, Shigella flexneri 2a str. 301
cgcaucagggcgcugg

SEQ ID NO: 1967352 - RNA, 22 nt, Shigella flexneri 2a str. 301
cgcaugcucacagaguauuucc

SEQ ID NO: 1967353 - RNA, 11 nt, Shigella flexneri 2a str. 301
cgcauccgcug

SEQ ID NO: 1967354 - RNA, 17 nt, Shigella flexneri 2a str. 301
cgcauccgacauuugca

SEQ ID NO: 1967355 - RNA, 13 nt, Shigella flexneri 2a str. 301
cgcauaagccacc

SEQ ID NO: 1967356 - RNA, 15 nt, Shigella flexneri 2a str. 301
cgcauaaugccugau

SEQ ID NO: 1967357 - RNA, 16 nt, Shigella flexneri 2a str. 301
cgcauaaugccugaug

SEQ ID NO: 1967358 - RNA, 21 nt, Shigella flexneri 2a str. 301
cgcaguuuaucgaccgcuuca

SEQ ID NO: 1967359 - RNA, 19 nt, Shigella flexneri 2a str. 301
cgcauaugcuuugccguca

SEQ ID NO: 1967360 - RNA, 20 nt, Shigella flexneri 2a str. 301
cgcagggcuguuuaucguga

SEQ ID NO: 1967361 - RNA, 16 nt, Shigella flexneri 2a str. 301
cgcaguagccaugcau

SEQ ID NO: 1967362 - RNA, 20 nt, Shigella flexneri 2a str. 301
cgcagugaagucgggcagaa

SEQ ID NO: 1967363 - RNA, 18 nt, Shigella flexneri 2a str. 301
cgcaguuacagcaggugu

SEQ ID NO: 1967364 - RNA, 21 nt, Shigella flexneri 2a str. 301
cgcagcugagaaaaagcgaag

SEQ ID NO: 1967365 - RNA, 15 nt, Shigella flexneri 2a str. 301
cgcagcucuggcaua

SEQ ID NO: 1967366 - RNA, 12 nt, Shigella flexneri 2a str. 301
cgcagcugaccu

SEQ ID NO: 1967367 - RNA, 23 nt, Shigella flexneri 2a str. 301
cgcagaucagaccaauccagccg

SEQ ID NO: 1967368 - RNA, 13 nt, Shigella flexneri 2a str. 301
cgcacccgccauc

SEQ ID NO: 1967369 - RNA, 15 nt, Shigella flexneri 2a str. 301
cgcaccaccagcagc

SEQ ID NO: 1967370 - RNA, 16 nt, Shigella flexneri 2a str. 301
cgcaccaccagcagcu

SEQ ID NO: 1967371 - RNA, 18 nt, Shigella flexneri 2a str. 301
cgcaccaccagcagcugc

SEQ ID NO: 1967372 - RNA, 19 nt, Shigella flexneri 2a str. 301
cgcacagcccgccgccauc

SEQ ID NO: 1967373 - RNA, 23 nt, Shigella flexneri 2a str. 301
cgcacaccgagauaaugguuucc

SEQ ID NO: 1967374 - RNA, 16 nt, Shigella flexneri 2a str. 301
cgcacaaugccugaug

SEQ ID NO: 1967375 - RNA, 22 nt, Shigella flexneri 2a str. 301
cgcaauugccggaugcgaguuu

SEQ ID NO: 1967376 - RNA, 22 nt, Shigella flexneri 2a str. 301
cgcaauuuauacugcgauggga

SEQ ID NO: 1967377 - RNA, 14 nt, Shigella flexneri 2a str. 301
cgcaauuuccauug

SEQ ID NO: 1967378 - RNA, 18 nt, Shigella flexneri 2a str. 301
cgcaaugauuuugaugga

SEQ ID NO: 1967379 - RNA, 14 nt, Shigella flexneri 2a str. 301
cgcaaucgccucca

SEQ ID NO: 1967380 - RNA, 15 nt, Shigella flexneri 2a str. 301
cgcaaucagcaccgc

SEQ ID NO: 1967381 - RNA, 20 nt, Shigella flexneri 2a str. 301
cgcaauauccugcgcuuccu

SEQ ID NO: 1967382 - RNA, 23 nt, Shigella flexneri 2a str. 301
cgcaauagcacugcuuuccgcug

SEQ ID NO: 1967383 - RNA, 19 nt, Shigella flexneri 2a str. 301
cgcaauacccugacccaga

SEQ ID NO: 1967384 - RNA, 18 nt, Shigella flexneri 2a str. 301
cgcaauaccggcaaagaa

SEQ ID NO: 1967385 - RNA, 19 nt, Shigella flexneri 2a str. 301
cgcaacuuauuggcaaucg

SEQ ID NO: 1967386 - RNA, 21 nt, Shigella flexneri 2a str. 301
cgcaacuuguugucuucucaa

SEQ ID NO: 1967387 - RNA, 15 nt, Shigella flexneri 2a str. 301
cgcaauaaacaugau

SEQ ID NO: 1967388 - RNA, 23 nt, Shigella flexneri 2a str. 301
cgcaacauauuccgcaccugcca

SEQ ID NO: 1967389 - RNA, 18 nt, Shigella flexneri 2a str. 301
cgcaacaugucagcaauc

SEQ ID NO: 1967390 - RNA, 13 nt, Shigella flexneri 2a str. 301
cgcaaacuugcgu

SEQ ID NO: 1967391 - RNA, 14 nt, Shigella flexneri 2a str. 301
cgcaaacaggcgca

SEQ ID NO: 1967392 - RNA, 14 nt, Shigella flexneri 2a str. 301
cgauuuuuuccagc

SEQ ID NO: 1967393 - RNA, 16 nt, Shigella flexneri 2a str. 301
cgauuuuuuccagcgc

SEQ ID NO: 1967394 - RNA, 20 nt, Shigella flexneri 2a str. 301
cgauugugcuggugauugcc

SEQ ID NO: 1967395 - RNA, 17 nt, Shigella flexneri 2a str. 301
cgcaaaaccucuuccag

SEQ ID NO: 1967396 - RNA, 21 nt, Shigella flexneri 2a str. 301
cgcaaaaccucuuccagcaga

SEQ ID NO: 1967397 - RNA, 20 nt, Shigella flexneri 2a str. 301
cgauugucauucgccugacg

SEQ ID NO: 1967398 - RNA, 21 nt, Shigella flexneri 2a str. 301
cgaugcuaaaaacaucaugau

SEQ ID NO: 1967399 - RNA, 14 nt, Shigella flexneri 2a str. 301
cgauacaacgcuuu

SEQ ID NO: 1967400 - RNA, 15 nt, Shigella flexneri 2a str. 301
cgauaaucuuuugua

SEQ ID NO: 1967401 - RNA, 15 nt, Shigella flexneri 2a str. 301
cgaggcgcuggcgca

SEQ ID NO: 1967402 - RNA, 15 nt, Shigella flexneri 2a str. 301
cgauaaaaauaccga

SEQ ID NO: 1967403 - RNA, 20 nt, Shigella flexneri 2a str. 301
cgauaaccgucacguucucc

SEQ ID NO: 1967404 - RNA, 21 nt, Shigella flexneri 2a str. 301
cgauaaaggucgacagcagcc

SEQ ID NO: 1967405 - RNA, 21 nt, Shigella flexneri 2a str. 301
cgauaacgccccaauccacgc

SEQ ID NO: 1967406 - RNA, 20 nt, Shigella flexneri 2a str. 301
cgauccagcgcaauaccgau

SEQ ID NO: 1967407 - RNA, 15 nt, Shigella flexneri 2a str. 301
cgaucauaucgacaa

SEQ ID NO: 1967408 - RNA, 16 nt, Shigella flexneri 2a str. 301
cgaucccauuacgucc

SEQ ID NO: 1967409 - RNA, 20 nt, Shigella flexneri 2a str. 301
cgaucgcgccaaucagcgca

SEQ ID NO: 1967410 - RNA, 20 nt, Shigella flexneri 2a str. 301
cgaucgcgccaucugccgau

SEQ ID NO: 1967411 - RNA, 14 nt, Shigella flexneri 2a str. 301
cgaucgccagcagg

SEQ ID NO: 1967412 - RNA, 16 nt, Shigella flexneri 2a str. 301
cgaucgccagcagggc

SEQ ID NO: 1967413 - RNA, 17 nt, Shigella flexneri 2a str. 301
cgaucgggcauuuccau

SEQ ID NO: 1967414 - RNA, 13 nt, Shigella flexneri 2a str. 301
cgaucgguuaaac

SEQ ID NO: 1967415 - RNA, 13 nt, Shigella flexneri 2a str. 301
cgaugacggaaau

SEQ ID NO: 1967416 - RNA, 13 nt, Shigella flexneri 2a str. 301
cgaugaucgccau

SEQ ID NO: 1967417 - RNA, 14 nt, Shigella flexneri 2a str. 301
cgaugauucccagu

SEQ ID NO: 1967418 - RNA, 21 nt, Shigella flexneri 2a str. 301
cgaugaauagcauguuccagu

SEQ ID NO: 1967419 - RNA, 13 nt, Shigella flexneri 2a str. 301
ccgcuggugcguc

SEQ ID NO: 1967420 - RNA, 20 nt, Shigella flexneri 2a str. 301
ccgcuguaaagaggcguuga

SEQ ID NO: 1967421 - RNA, 21 nt, Shigella flexneri 2a str. 301
ccgcuguccagucgcaaaccu

SEQ ID NO: 1967422 - RNA, 16 nt, Shigella flexneri 2a str. 301
ccgcugucacccggca

SEQ ID NO: 1967423 - RNA, 17 nt, Shigella flexneri 2a str. 301
ccgcuucauaaccguug

SEQ ID NO: 1967424 - RNA, 16 nt, Shigella flexneri 2a str. 301
ccgcuucaaaguucug

SEQ ID NO: 1967425 - RNA, 12 nt, Shigella flexneri 2a str. 301
ccgcuuuccagg

SEQ ID NO: 1967426 - RNA, 15 nt, Shigella flexneri 2a str. 301
ccgcuuggcgauacc

SEQ ID NO: 1967427 - RNA, 17 nt, Shigella flexneri 2a str. 301
ccgcuuccggucugcga

SEQ ID NO: 1967428 - RNA, 16 nt, Shigella flexneri 2a str. 301
ccgcuucugcguucug

SEQ ID NO: 1967429 - RNA, 14 nt, Shigella flexneri 2a str. 301
ccgcuaucggcaag

SEQ ID NO: 1967430 - RNA, 19 nt, Shigella flexneri 2a str. 301
ccgcgcuuucuggcgcaga

SEQ ID NO: 1967431 - RNA, 20 nt, Shigella flexneri 2a str. 301
ccgcgcccgugcaucuccug

SEQ ID NO: 1967432 - RNA, 14 nt, Shigella flexneri 2a str. 301
ccggcaaauaacgc

SEQ ID NO: 1967433 - RNA, 12 nt, Shigella flexneri 2a str. 301
ccggcaaagcca

SEQ ID NO: 1967434 - RNA, 18 nt, Shigella flexneri 2a str. 301
ccggcaaagaaccaacgc

SEQ ID NO: 1967435 - RNA, 16 nt, Shigella flexneri 2a str. 301
ccggcaaucgccagau

SEQ ID NO: 1967436 - RNA, 14 nt, Shigella flexneri 2a str. 301
ccggcaauaagcaa

SEQ ID NO: 1967437 - RNA, 23 nt, Shigella flexneri 2a str. 301
ccggcaauguuaccgaucgccag

SEQ ID NO: 1967438 - RNA, 21 nt, Shigella flexneri 2a str. 301
ccggcaauucucucugauuac

SEQ ID NO: 1967439 - RNA, 18 nt, Shigella flexneri 2a str. 301
ccggcacauuucacucac

SEQ ID NO: 1967440 - RNA, 18 nt, Shigella flexneri 2a str. 301
ccggcaccuuuucaucag

SEQ ID NO: 1967441 - RNA, 21 nt, Shigella flexneri 2a str. 301
ccggaugcgggugaacgcguu

SEQ ID NO: 1967442 - RNA, 16 nt, Shigella flexneri 2a str. 301
ccggaugcggcguaaa

SEQ ID NO: 1967443 - RNA, 15 nt, Shigella flexneri 2a str. 301
ccggauguuuccauc

SEQ ID NO: 1967444 - RNA, 18 nt, Shigella flexneri 2a str. 301
ccggaugaucauccggcu

SEQ ID NO: 1967445 - RNA, 19 nt, Shigella flexneri 2a str. 301
ccggaugcaugauccggca

SEQ ID NO: 1967446 - RNA, 20 nt, Shigella flexneri 2a str. 301
ccggaugacguuucgcgcca

SEQ ID NO: 1967447 - RNA, 22 nt, Shigella flexneri 2a str. 301
ccggacccuggucaguuucagc

SEQ ID NO: 1967448 - RNA, 17 nt, Shigella flexneri 2a str. 301
ccggaggcaaguuuccu

SEQ ID NO: 1967449 - RNA, 20 nt, Shigella flexneri 2a str. 301
ccggagccaaacaugcaaac

SEQ ID NO: 1967450 - RNA, 18 nt, Shigella flexneri 2a str. 301
ccggacguguuuucaccg

SEQ ID NO: 1967451 - RNA, 22 nt, Shigella flexneri 2a str. 301
ccggacgcguugagugcgacau

SEQ ID NO: 1967452 - RNA, 21 nt, Shigella flexneri 2a str. 301
ccggacuguaaacgaugaugc

SEQ ID NO: 1967453 - RNA, 21 nt, Shigella flexneri 2a str. 301
ccgauuguaaucacauucgau

SEQ ID NO: 1967454 - RNA, 13 nt, Shigella flexneri 2a str. 301
ccgauugccggau

SEQ ID NO: 1967455 - RNA, 16 nt, Shigella flexneri 2a str. 301
ccgauggucagcuuca

SEQ ID NO: 1967456 - RNA, 13 nt, Shigella flexneri 2a str. 301
ccgaugcgcgaac

SEQ ID NO: 1967457 - RNA, 21 nt, Shigella flexneri 2a str. 301
ccgcagagauagaacugcauu

SEQ ID NO: 1967458 - RNA, 21 nt, Shigella flexneri 2a str. 301
ccgcagagaucgccccggcaa

SEQ ID NO: 1967459 - RNA, 16 nt, Shigella flexneri 2a str. 301
ccgcagagauagaacu

SEQ ID NO: 1967460 - RNA, 16 nt, Shigella flexneri 2a str. 301
ccgcagaaaaagagca

SEQ ID NO: 1967461 - RNA, 23 nt, Shigella flexneri 2a str. 301
ccgcagaaaaagagcaucagcag

SEQ ID NO: 1967462 - RNA, 14 nt, Shigella flexneri 2a str. 301
ccgccaaccagcgc

SEQ ID NO: 1967463 - RNA, 15 nt, Shigella flexneri 2a str. 301
ccgcaugcucacaga

SEQ ID NO: 1967464 - RNA, 14 nt, Shigella flexneri 2a str. 301
ccgccaaccaccgc

SEQ ID NO: 1967465 - RNA, 16 nt, Shigella flexneri 2a str. 301
ccgccaauuucaucac

SEQ ID NO: 1967466 - RNA, 17 nt, Shigella flexneri 2a str. 301
ccgccaauaaucagcgc

SEQ ID NO: 1967467 - RNA, 13 nt, Shigella flexneri 2a str. 301
ccgccaccagcgu

SEQ ID NO: 1967468 - RNA, 17 nt, Shigella flexneri 2a str. 301
ccgcccaccaccagcga

SEQ ID NO: 1967469 - RNA, 12 nt, Shigella flexneri 2a str. 301
ccgccaguucuu

SEQ ID NO: 1967470 - RNA, 20 nt, Shigella flexneri 2a str. 301
ccgccaguuacugccaccau

SEQ ID NO: 1967471 - RNA, 13 nt, Shigella flexneri 2a str. 301
ccgccaucucuuc

SEQ ID NO: 1967472 - RNA, 19 nt, Shigella flexneri 2a str. 301
ccgccaucucuuccagcga

SEQ ID NO: 1967473 - RNA, 17 nt, Shigella flexneri 2a str. 301
ccgccguguucuucggu

SEQ ID NO: 1967474 - RNA, 16 nt, Shigella flexneri 2a str. 301
ccgccgugcugccagc

SEQ ID NO: 1967475 - RNA, 16 nt, Shigella flexneri 2a str. 301
ccgccguugccgcagc

SEQ ID NO: 1967476 - RNA, 18 nt, Shigella flexneri 2a str. 301
ccgcgacgacgacaggca

SEQ ID NO: 1967477 - RNA, 15 nt, Shigella flexneri 2a str. 301
ccgccuguuccagca

SEQ ID NO: 1967478 - RNA, 20 nt, Shigella flexneri 2a str. 301
ccgcgauccagcgcaauacc

SEQ ID NO: 1967479 - RNA, 13 nt, Shigella flexneri 2a str. 301
ccgccccggcgau

SEQ ID NO: 1967480 - RNA, 23 nt, Shigella flexneri 2a str. 301
ccgcccuguuugguugccagcca

SEQ ID NO: 1967481 - RNA, 15 nt, Shigella flexneri 2a str. 301
ccguccggcgggcaa

SEQ ID NO: 1967482 - RNA, 17 nt, Shigella flexneri 2a str. 301
ccgucacgguaauaaca

SEQ ID NO: 1967483 - RNA, 12 nt, Shigella flexneri 2a str. 301
ccguauccggca

SEQ ID NO: 1967484 - RNA, 13 nt, Shigella flexneri 2a str. 301
ccguaggccggau

SEQ ID NO: 1967485 - RNA, 15 nt, Shigella flexneri 2a str. 301
ccguaguggccacag

SEQ ID NO: 1967486 - RNA, 12 nt, Shigella flexneri 2a str. 301
ccgguucaucac

SEQ ID NO: 1967487 - RNA, 18 nt, Shigella flexneri 2a str. 301
ccggucuuuucucauuac

SEQ ID NO: 1967488 - RNA, 20 nt, Shigella flexneri 2a str. 301
ccgguuaaaucgacguucug

SEQ ID NO: 1967489 - RNA, 22 nt, Shigella flexneri 2a str. 301
ccggucagccauugcuaccgcu

SEQ ID NO: 1967490 - RNA, 18 nt, Shigella flexneri 2a str. 301
ccgguagucaccgcccag

SEQ ID NO: 1967491 - RNA, 21 nt, Shigella flexneri 2a str. 301
ccggguuugccacaucacugu

SEQ ID NO: 1967492 - RNA, 18 nt, Shigella flexneri 2a str. 301
ccgguaaaucaccagcgu

SEQ ID NO: 1967493 - RNA, 17 nt, Shigella flexneri 2a str. 301
ccgguacaaacaucauc

SEQ ID NO: 1967494 - RNA, 22 nt, Shigella flexneri 2a str. 301
ccgguaaugcugaaauuacgcg

SEQ ID NO: 1967495 - RNA, 14 nt, Shigella flexneri 2a str. 301
ccggcuguuccagc

SEQ ID NO: 1967496 - RNA, 14 nt, Shigella flexneri 2a str. 301
ccggcugggcguga

SEQ ID NO: 1967497 - RNA, 11 nt, Shigella flexneri 2a str. 301
ccggcgugacg

SEQ ID NO: 1967498 - RNA, 18 nt, Shigella flexneri 2a str. 301
ccggcgugacgaucacca

SEQ ID NO: 1967499 - RNA, 18 nt, Shigella flexneri 2a str. 301
ccgggcaucagcagcacg

SEQ ID NO: 1967500 - RNA, 23 nt, Shigella flexneri 2a str. 301
ccggccagcgccaccaccagcac

SEQ ID NO: 1967501 - RNA, 11 nt, Shigella flexneri 2a str. 301
ccggcgcuaau

SEQ ID NO: 1967502 - RNA, 22 nt, Shigella flexneri 2a str. 301
ccggcggcgcgccaggcgcuga

SEQ ID NO: 1967503 - RNA, 20 nt, Shigella flexneri 2a str. 301
ccugacucggacgcguuuca

SEQ ID NO: 1967504 - RNA, 15 nt, Shigella flexneri 2a str. 301
ccugacgguuuaccu

SEQ ID NO: 1967505 - RNA, 12 nt, Shigella flexneri 2a str. 301
ccugcaacgcuu

SEQ ID NO: 1967506 - RNA, 13 nt, Shigella flexneri 2a str. 301
ccugcaacgcuuu

SEQ ID NO: 1967507 - RNA, 18 nt, Shigella flexneri 2a str. 301
ccugcaauaccgccguua

SEQ ID NO: 1967508 - RNA, 12 nt, Shigella flexneri 2a str. 301
ccugcaccauug

SEQ ID NO: 1967509 - RNA, 22 nt, Shigella flexneri 2a str. 301
ccucggcauggaucgccgcggu

SEQ ID NO: 1967510 - RNA, 21 nt, Shigella flexneri 2a str. 301
ccugcuccagugcauccagca

SEQ ID NO: 1967511 - RNA, 13 nt, Shigella flexneri 2a str. 301
ccugcucagcccg

SEQ ID NO: 1967512 - RNA, 18 nt, Shigella flexneri 2a str. 301
ccugcucgccacgucacu

SEQ ID NO: 1967513 - RNA, 18 nt, Shigella flexneri 2a str. 301
ccugcucgucauccgcca

SEQ ID NO: 1967514 - RNA, 17 nt, Shigella flexneri 2a str. 301
ccugcuggacgcgccaa

SEQ ID NO: 1967515 - RNA, 15 nt, Shigella flexneri 2a str. 301
ccugcucgucggcaa

SEQ ID NO: 1967516 - RNA, 17 nt, Shigella flexneri 2a str. 301
ccugcugauuaucggca

SEQ ID NO: 1967517 - RNA, 17 nt, Shigella flexneri 2a str. 301
ccuggaaccaggcgcga

SEQ ID NO: 1967518 - RNA, 17 nt, Shigella flexneri 2a str. 301
ccugcgaacuguaauga

SEQ ID NO: 1967519 - RNA, 20 nt, Shigella flexneri 2a str. 301
ccugcauacgacgugccgca

SEQ ID NO: 1967520 - RNA, 18 nt, Shigella flexneri 2a str. 301
ccugcauaaacgccguca

SEQ ID NO: 1967521 - RNA, 12 nt, Shigella flexneri 2a str. 301
ccugcgcgauga

SEQ ID NO: 1967522 - RNA, 22 nt, Shigella flexneri 2a str. 301
ccugcgccagcgcgcguugcug

SEQ ID NO: 1967523 - RNA, 21 nt, Shigella flexneri 2a str. 301
ccugcgcccgcguuaccggca

SEQ ID NO: 1967524 - RNA, 20 nt, Shigella flexneri 2a str. 301
ccugcgugacuaaaacccuu

SEQ ID NO: 1967525 - RNA, 19 nt, Shigella flexneri 2a str. 301
ccugcgucuuucgcggcaa

SEQ ID NO: 1967526 - RNA, 18 nt, Shigella flexneri 2a str. 301
ccguugcgcccaucauca

SEQ ID NO: 1967527 - RNA, 16 nt, Shigella flexneri 2a str. 301
ccguugcuguuccauc

SEQ ID NO: 1967528 - RNA, 15 nt, Shigella flexneri 2a str. 301
ccguuggcggcguga

SEQ ID NO: 1967529 - RNA, 23 nt, Shigella flexneri 2a str. 301
ccguuugccccggcugcgcgacg

SEQ ID NO: 1967530 - RNA, 19 nt, Shigella flexneri 2a str. 301
ccguuuacgucauuaccgc

SEQ ID NO: 1967531 - RNA, 18 nt, Shigella flexneri 2a str. 301
ccguuuacgcuuuccagc

SEQ ID NO: 1967532 - RNA, 16 nt, Shigella flexneri 2a str. 301
ccguuuacgucauuac

SEQ ID NO: 1967533 - RNA, 23 nt, Shigella flexneri 2a str. 301
ccguugccgaacguaggcuggau

SEQ ID NO: 1967534 - RNA, 18 nt, Shigella flexneri 2a str. 301
ccguugaaauugcugguu

SEQ ID NO: 1967535 - RNA, 18 nt, Shigella flexneri 2a str. 301
ccguugaaaaugcugguu

SEQ ID NO: 1967536 - RNA, 17 nt, Shigella flexneri 2a str. 301
ccuacaaacguugcuga

SEQ ID NO: 1967537 - RNA, 17 nt, Shigella flexneri 2a str. 301
ccuaaucgacgcggacg

SEQ ID NO: 1967538 - RNA, 15 nt, Shigella flexneri 2a str. 301
ccuaauccagccuac

SEQ ID NO: 1967539 - RNA, 16 nt, Shigella flexneri 2a str. 301
ccuaacaauucgccag

SEQ ID NO: 1967540 - RNA, 19 nt, Shigella flexneri 2a str. 301
ccucaacgccuaaugccag

SEQ ID NO: 1967541 - RNA, 18 nt, Shigella flexneri 2a str. 301
ccucaauaauaauccgcu

SEQ ID NO: 1967542 - RNA, 21 nt, Shigella flexneri 2a str. 301
ccucaauaauaauccgcugca

SEQ ID NO: 1967543 - RNA, 15 nt, Shigella flexneri 2a str. 301
ccuccccaacauaua

SEQ ID NO: 1967544 - RNA, 14 nt, Shigella flexneri 2a str. 301
ccuccauguccagc

SEQ ID NO: 1967545 - RNA, 19 nt, Shigella flexneri 2a str. 301
ccuccagcuccgccagcgu

SEQ ID NO: 1967546 - RNA, 12 nt, Shigella flexneri 2a str. 301
ccuccagcagca

SEQ ID NO: 1967547 - RNA, 16 nt, Shigella flexneri 2a str. 301
ccgucguggucgugau

SEQ ID NO: 1967548 - RNA, 18 nt, Shigella flexneri 2a str. 301
ccgugaugcggucgcuga

SEQ ID NO: 1967549 - RNA, 23 nt, Shigella flexneri 2a str. 301
ccgugcgggcaucaucuuccggu

SEQ ID NO: 1967550 - RNA, 23 nt, Shigella flexneri 2a str. 301
ccguggucuguuuaaccgcuuca

SEQ ID NO: 1967551 - RNA, 23 nt, Shigella flexneri 2a str. 301
ccguggcuguugacguccagccc

SEQ ID NO: 1967552 - RNA, 21 nt, Shigella flexneri 2a str. 301
ccgucgcauggggaucgugau

SEQ ID NO: 1967553 - RNA, 18 nt, Shigella flexneri 2a str. 301
cgcccuggguaccgagaa

SEQ ID NO: 1967554 - RNA, 14 nt, Shigella flexneri 2a str. 301
cgcccgccgccauu

SEQ ID NO: 1967555 - RNA, 11 nt, Shigella flexneri 2a str. 301
cgcccuacucc

SEQ ID NO: 1967556 - RNA, 21 nt, Shigella flexneri 2a str. 301
cgcccguuuucuccagcgccg

SEQ ID NO: 1967557 - RNA, 22 nt, Shigella flexneri 2a str. 301
cgcccggaauuucaaugcgcgu

SEQ ID NO: 1967558 - RNA, 20 nt, Shigella flexneri 2a str. 301
cgccggacgucaggccgcca

SEQ ID NO: 1967559 - RNA, 20 nt, Shigella flexneri 2a str. 301
cgccgcugucuaccagcacc

SEQ ID NO: 1967560 - RNA, 16 nt, Shigella flexneri 2a str. 301
cgccgcuauuauaucg

SEQ ID NO: 1967561 - RNA, 15 nt, Shigella flexneri 2a str. 301
cgccgcaucgccagu

SEQ ID NO: 1967562 - RNA, 15 nt, Shigella flexneri 2a str. 301
cgccgccagcaacau

SEQ ID NO: 1967563 - RNA, 16 nt, Shigella flexneri 2a str. 301
cgcgauuaugccgccg

SEQ ID NO: 1967564 - RNA, 23 nt, Shigella flexneri 2a str. 301
cgcgauucgcccugcauauuggu

SEQ ID NO: 1967565 - RNA, 17 nt, Shigella flexneri 2a str. 301
cgcgaucgccugcaggg

SEQ ID NO: 1967566 - RNA, 13 nt, Shigella flexneri 2a str. 301
cgcgaggcgcaua

SEQ ID NO: 1967567 - RNA, 21 nt, Shigella flexneri 2a str. 301
cgcgaggaugcguuuuccggc

SEQ ID NO: 1967568 - RNA, 15 nt, Shigella flexneri 2a str. 301
cgcgagcuggugccg

SEQ ID NO: 1967569 - RNA, 22 nt, Shigella flexneri 2a str. 301
cgcgauaaaagacgccgacauc

SEQ ID NO: 1967570 - RNA, 19 nt, Shigella flexneri 2a str. 301
cgcgauacuuuuucaagaa

SEQ ID NO: 1967571 - RNA, 17 nt, Shigella flexneri 2a str. 301
cgccuuuuacgcauucg

SEQ ID NO: 1967572 - RNA, 23 nt, Shigella flexneri 2a str. 301
cgccuuucugcaaugcugcgauc

SEQ ID NO: 1967573 - RNA, 15 nt, Shigella flexneri 2a str. 301
cgcgaaaaccgguaa

SEQ ID NO: 1967574 - RNA, 22 nt, Shigella flexneri 2a str. 301
cgcgaaaugcagcguuuccagc

SEQ ID NO: 1967575 - RNA, 15 nt, Shigella flexneri 2a str. 301
cgccuggaccagcgg

SEQ ID NO: 1967576 - RNA, 19 nt, Shigella flexneri 2a str. 301
cgcgacaguaucaucauua

SEQ ID NO: 1967577 - RNA, 14 nt, Shigella flexneri 2a str. 301
cgcgaacuggauga

SEQ ID NO: 1967578 - RNA, 14 nt, Shigella flexneri 2a str. 301
cgcgaaguuccgau

SEQ ID NO: 1967579 - RNA, 16 nt, Shigella flexneri 2a str. 301
cgcgacuuuuuccugc

SEQ ID NO: 1967580 - RNA, 23 nt, Shigella flexneri 2a str. 301
cgcgacuuuaaucaccugccagg

SEQ ID NO: 1967581 - RNA, 12 nt, Shigella flexneri 2a str. 301
cgcgacuaucga

SEQ ID NO: 1967582 - RNA, 18 nt, Shigella flexneri 2a str. 301
cgcgaccggcgucgcauc

SEQ ID NO: 1967583 - RNA, 17 nt, Shigella flexneri 2a str. 301
cgccuccuguucugugc

SEQ ID NO: 1967584 - RNA, 15 nt, Shigella flexneri 2a str. 301
cgccugccgccagca

SEQ ID NO: 1967585 - RNA, 14 nt, Shigella flexneri 2a str. 301
cgccgugcacaccg

SEQ ID NO: 1967586 - RNA, 22 nt, Shigella flexneri 2a str. 301
cgccguuagcuucagccgggaa

SEQ ID NO: 1967587 - RNA, 23 nt, Shigella flexneri 2a str. 301
cgccggugauuacaucgcgaaga

SEQ ID NO: 1967588 - RNA, 14 nt, Shigella flexneri 2a str. 301
cgccguaagcgcgg

SEQ ID NO: 1967589 - RNA, 20 nt, Shigella flexneri 2a str. 301
cgccguaccgggugcagcgg

SEQ ID NO: 1967590 - RNA, 19 nt, Shigella flexneri 2a str. 301
cgccgguugccccgcacgc

SEQ ID NO: 1967591 - RNA, 17 nt, Shigella flexneri 2a str. 301
cgccguaaaucccgcca

SEQ ID NO: 1967592 - RNA, 16 nt, Shigella flexneri 2a str. 301
cgcgccuucgugcggc

SEQ ID NO: 1967593 - RNA, 18 nt, Shigella flexneri 2a str. 301
cgcgccuuguuaccugau

SEQ ID NO: 1967594 - RNA, 14 nt, Shigella flexneri 2a str. 301
cgcgcuauugccgu

SEQ ID NO: 1967595 - RNA, 13 nt, Shigella flexneri 2a str. 301
cgcgcuaucagca

SEQ ID NO: 1967596 - RNA, 16 nt, Shigella flexneri 2a str. 301
cgcgcuaauuccaguc

SEQ ID NO: 1967597 - RNA, 17 nt, Shigella flexneri 2a str. 301
cgcggacuccgcuguua

SEQ ID NO: 1967598 - RNA, 12 nt, Shigella flexneri 2a str. 301
cgcggcucgugg

SEQ ID NO: 1967599 - RNA, 16 nt, Shigella flexneri 2a str. 301
cgcggcguaaccgccc

SEQ ID NO: 1967600 - RNA, 19 nt, Shigella flexneri 2a str. 301
cgcggcuuugucauaacca

SEQ ID NO: 1967601 - RNA, 14 nt, Shigella flexneri 2a str. 301
cgcggugauugacg

SEQ ID NO: 1967602 - RNA, 15 nt, Shigella flexneri 2a str. 301
cgcugacagcgcguc

SEQ ID NO: 1967603 - RNA, 22 nt, Shigella flexneri 2a str. 301
cgcugcaaggcucuauacgcau

SEQ ID NO: 1967604 - RNA, 13 nt, Shigella flexneri 2a str. 301
cgcugcagcucug

SEQ ID NO: 1967605 - RNA, 14 nt, Shigella flexneri 2a str. 301
cgcugcaucgccaa

SEQ ID NO: 1967606 - RNA, 17 nt, Shigella flexneri 2a str. 301
cgcugcauugcccaaua

SEQ ID NO: 1967607 - RNA, 20 nt, Shigella flexneri 2a str. 301
cgcugcacaauugccagccc

SEQ ID NO: 1967608 - RNA, 20 nt, Shigella flexneri 2a str. 301
cgcucgcgccgcauccgaca

SEQ ID NO: 1967609 - RNA, 13 nt, Shigella flexneri 2a str. 301
cgcucucagcugg

SEQ ID NO: 1967610 - RNA, 22 nt, Shigella flexneri 2a str. 301
cgcucguuaaaacgcgcggcgu

SEQ ID NO: 1967611 - RNA, 13 nt, Shigella flexneri 2a str. 301
cgcugaauacgca

SEQ ID NO: 1967612 - RNA, 23 nt, Shigella flexneri 2a str. 301
cgcugaauacggaagcgaaacug

SEQ ID NO: 1967613 - RNA, 13 nt, Shigella flexneri 2a str. 301
cgcugacagcgcg

SEQ ID NO: 1967614 - RNA, 22 nt, Shigella flexneri 2a str. 301
cgcugaagaaaauggccagcca

SEQ ID NO: 1967615 - RNA, 19 nt, Shigella flexneri 2a str. 301
cgcucuuguucuuccggca

SEQ ID NO: 1967616 - RNA, 19 nt, Shigella flexneri 2a str. 301
cgcugaaaggauuucgcaa

SEQ ID NO: 1967617 - RNA, 13 nt, Shigella flexneri 2a str. 301
cgcguucuguugc

SEQ ID NO: 1967618 - RNA, 17 nt, Shigella flexneri 2a str. 301
cgcuaaccgccugaaau

SEQ ID NO: 1967619 - RNA, 23 nt, Shigella flexneri 2a str. 301
cgcgguguugauacaggcgcugu

SEQ ID NO: 1967620 - RNA, 15 nt, Shigella flexneri 2a str. 301
cgcucaaugcgcuga

SEQ ID NO: 1967621 - RNA, 13 nt, Shigella flexneri 2a str. 301
cgcucaaugcgcu

SEQ ID NO: 1967622 - RNA, 17 nt, Shigella flexneri 2a str. 301
cgcucaauaaucaaucu

SEQ ID NO: 1967623 - RNA, 17 nt, Shigella flexneri 2a str. 301
cgcucaaaaauccagau

SEQ ID NO: 1967624 - RNA, 15 nt, Shigella flexneri 2a str. 301
cgcucagcaauugca

SEQ ID NO: 1967625 - RNA, 20 nt, Shigella flexneri 2a str. 301
cgcuaguacccgaucacaac

SEQ ID NO: 1967626 - RNA, 20 nt, Shigella flexneri 2a str. 301
cgcuaucaauacuuuccagc

SEQ ID NO: 1967627 - RNA, 14 nt, Shigella flexneri 2a str. 301
cgcuaucagcgcca

SEQ ID NO: 1967628 - RNA, 18 nt, Shigella flexneri 2a str. 301
cgcuagcgucguggcaaa

SEQ ID NO: 1967629 - RNA, 13 nt, Shigella flexneri 2a str. 301
cgcuacgacguuc

SEQ ID NO: 1967630 - RNA, 19 nt, Shigella flexneri 2a str. 301
cgcuucugguuauauuucc

SEQ ID NO: 1967631 - RNA, 20 nt, Shigella flexneri 2a str. 301
cgcuucuucugccgcuucca

SEQ ID NO: 1967632 - RNA, 13 nt, Shigella flexneri 2a str. 301
cgcuugacgcguc

SEQ ID NO: 1967633 - RNA, 21 nt, Shigella flexneri 2a str. 301
cgcuucgucgucaccugcguc

SEQ ID NO: 1967634 - RNA, 21 nt, Shigella flexneri 2a str. 301
cgcuugagcaggagcagcagg

SEQ ID NO: 1967635 - RNA, 20 nt, Shigella flexneri 2a str. 301
cgcuugaguauuuaccagaa

SEQ ID NO: 1967636 - RNA, 17 nt, Shigella flexneri 2a str. 301
cgcuuuucgccagcuca

SEQ ID NO: 1967637 - RNA, 19 nt, Shigella flexneri 2a str. 301
cgcuuuguuuaugccggau

SEQ ID NO: 1967638 - RNA, 16 nt, Shigella flexneri 2a str. 301
cgcuuuuucugcgcac

SEQ ID NO: 1967639 - RNA, 22 nt, Shigella flexneri 2a str. 301
cgcuuuuucaauuuccaguuug

SEQ ID NO: 1967640 - RNA, 17 nt, Shigella flexneri 2a str. 301
cgcuuucucugcaagaa

SEQ ID NO: 1967641 - RNA, 12 nt, Shigella flexneri 2a str. 301
cgcuuucccagc

SEQ ID NO: 1967642 - RNA, 17 nt, Shigella flexneri 2a str. 301
cgcuuuaucgccuacca

SEQ ID NO: 1967643 - RNA, 19 nt, Shigella flexneri 2a str. 301
cggaauaacgcgaucgcga

SEQ ID NO: 1967644 - RNA, 18 nt, Shigella flexneri 2a str. 301
cggaaguaccaauggcaa

SEQ ID NO: 1967645 - RNA, 17 nt, Shigella flexneri 2a str. 301
cggaaguaguucaucaa

SEQ ID NO: 1967646 - RNA, 21 nt, Shigella flexneri 2a str. 301
cggaagucgcagcugccugca

SEQ ID NO: 1967647 - RNA, 19 nt, Shigella flexneri 2a str. 301
cggaaggggcggaaaucac

SEQ ID NO: 1967648 - RNA, 15 nt, Shigella flexneri 2a str. 301
cggaagacacauugc

SEQ ID NO: 1967649 - RNA, 20 nt, Shigella flexneri 2a str. 301
cggaacccaccgcaauaacc

SEQ ID NO: 1967650 - RNA, 14 nt, Shigella flexneri 2a str. 301
cggaacaacccagc

SEQ ID NO: 1967651 - RNA, 13 nt, Shigella flexneri 2a str. 301
cggaaaucacgca

SEQ ID NO: 1967652 - RNA, 15 nt, Shigella flexneri 2a str. 301
cggaaagaucgccac

SEQ ID NO: 1967653 - RNA, 19 nt, Shigella flexneri 2a str. 301
cgcugucuuuugaucaaau

SEQ ID NO: 1967654 - RNA, 19 nt, Shigella flexneri 2a str. 301
cgcuguguguaggccagcg

SEQ ID NO: 1967655 - RNA, 20 nt, Shigella flexneri 2a str. 301
cgcugugugugcugauuucg

SEQ ID NO: 1967656 - RNA, 23 nt, Shigella flexneri 2a str. 301
cgcuguguaaacccagccgcguc

SEQ ID NO: 1967657 - RNA, 19 nt, Shigella flexneri 2a str. 301
cgcuuaucaggccuacgcg

SEQ ID NO: 1967658 - RNA, 22 nt, Shigella flexneri 2a str. 301
cgcuuaucaggccugcaaacga

SEQ ID NO: 1967659 - RNA, 15 nt, Shigella flexneri 2a str. 301
cgcuuaucccagcca

SEQ ID NO: 1967660 - RNA, 20 nt, Shigella flexneri 2a str. 301
cgcuuaaccccgggcuggau

SEQ ID NO: 1967661 - RNA, 17 nt, Shigella flexneri 2a str. 301
cgcuucgagauugcgga

SEQ ID NO: 1967662 - RNA, 11 nt, Shigella flexneri 2a str. 301
cgcuuccugca

SEQ ID NO: 1967663 - RNA, 19 nt, Shigella flexneri 2a str. 301
cgcuucacucccugcccca

SEQ ID NO: 1967664 - RNA, 19 nt, Shigella flexneri 2a str. 301
cgcuucaaggugcgcgaug

SEQ ID NO: 1967665 - RNA, 15 nt, Shigella flexneri 2a str. 301
cgcuuccagcgcauc

SEQ ID NO: 1967666 - RNA, 16 nt, Shigella flexneri 2a str. 301
cgcuuccagcuccgcu

SEQ ID NO: 1967667 - RNA, 18 nt, Shigella flexneri 2a str. 301
cgcuucccucuacaggaa

SEQ ID NO: 1967668 - RNA, 15 nt, Shigella flexneri 2a str. 301
cggcgcaacauccgc

SEQ ID NO: 1967669 - RNA, 16 nt, Shigella flexneri 2a str. 301
cggcgcaacauccgcu

SEQ ID NO: 1967670 - RNA, 22 nt, Shigella flexneri 2a str. 301
cggcgcaauucccggaccguca

SEQ ID NO: 1967671 - RNA, 14 nt, Shigella flexneri 2a str. 301
cggcgcgccaggcg

SEQ ID NO: 1967672 - RNA, 14 nt, Shigella flexneri 2a str. 301
cggcgcgauaucga

SEQ ID NO: 1967673 - RNA, 17 nt, Shigella flexneri 2a str. 301
cggccggaugacagacu

SEQ ID NO: 1967674 - RNA, 21 nt, Shigella flexneri 2a str. 301
cggcgaaagcuggcacuggga

SEQ ID NO: 1967675 - RNA, 19 nt, Shigella flexneri 2a str. 301
cggcgacgacgguuuccac

SEQ ID NO: 1967676 - RNA, 22 nt, Shigella flexneri 2a str. 301
cggcaucgggcgaguuuccauc

SEQ ID NO: 1967677 - RNA, 17 nt, Shigella flexneri 2a str. 301
cggcaucgcaaaccaga

SEQ ID NO: 1967678 - RNA, 17 nt, Shigella flexneri 2a str. 301
cggcaucgccgcuaucg

SEQ ID NO: 1967679 - RNA, 13 nt, Shigella flexneri 2a str. 301
cggcaucgcucca

SEQ ID NO: 1967680 - RNA, 17 nt, Shigella flexneri 2a str. 301
cggcaacguacuuacuc

SEQ ID NO: 1967681 - RNA, 13 nt, Shigella flexneri 2a str. 301
cggcaacgucacc

SEQ ID NO: 1967682 - RNA, 21 nt, Shigella flexneri 2a str. 301
cggcagcauguguaaccgcuu

SEQ ID NO: 1967683 - RNA, 15 nt, Shigella flexneri 2a str. 301
cggcaggaucugcgc

SEQ ID NO: 1967684 - RNA, 15 nt, Shigella flexneri 2a str. 301
cggcagcaaccgcuu

SEQ ID NO: 1967685 - RNA, 22 nt, Shigella flexneri 2a str. 301
cggcagagugaagguuucugca

SEQ ID NO: 1967686 - RNA, 14 nt, Shigella flexneri 2a str. 301
cggcagacgggcaa

SEQ ID NO: 1967687 - RNA, 18 nt, Shigella flexneri 2a str. 301
cggcacggcaaucaugau

SEQ ID NO: 1967688 - RNA, 20 nt, Shigella flexneri 2a str. 301
cggaauagcguacggcaugc

SEQ ID NO: 1967689 - RNA, 22 nt, Shigella flexneri 2a str. 301
cggaguugaccagcuccagcag

SEQ ID NO: 1967690 - RNA, 19 nt, Shigella flexneri 2a str. 301
cggauaccaccagugccau

SEQ ID NO: 1967691 - RNA, 17 nt, Shigella flexneri 2a str. 301
cggauagcguucggcaa

SEQ ID NO: 1967692 - RNA, 23 nt, Shigella flexneri 2a str. 301
cggcaaaaucaauucaucgcucu

SEQ ID NO: 1967693 - RNA, 15 nt, Shigella flexneri 2a str. 301
cggcaaaaucuucca

SEQ ID NO: 1967694 - RNA, 13 nt, Shigella flexneri 2a str. 301
cggcaaacacgcc

SEQ ID NO: 1967695 - RNA, 17 nt, Shigella flexneri 2a str. 301
cggauuucauauccggc

SEQ ID NO: 1967696 - RNA, 13 nt, Shigella flexneri 2a str. 301
cggcaaaaccguu

SEQ ID NO: 1967697 - RNA, 21 nt, Shigella flexneri 2a str. 301
cggauuuuauucagcagacca

SEQ ID NO: 1967698 - RNA, 14 nt, Shigella flexneri 2a str. 301
cggauuacccgcgc

SEQ ID NO: 1967699 - RNA, 20 nt, Shigella flexneri 2a str. 301
cggauucacgccaaccagcu

SEQ ID NO: 1967700 - RNA, 17 nt, Shigella flexneri 2a str. 301
cggauguugcugcacca

SEQ ID NO: 1967701 - RNA, 17 nt, Shigella flexneri 2a str. 301
cggggaucacuggcaga

SEQ ID NO: 1967702 - RNA, 12 nt, Shigella flexneri 2a str. 301
cggggcauucau

SEQ ID NO: 1967703 - RNA, 16 nt, Shigella flexneri 2a str. 301
cgguaauccgggugaa

SEQ ID NO: 1967704 - RNA, 17 nt, Shigella flexneri 2a str. 301
cgguaaagcgcggcagu

SEQ ID NO: 1967705 - RNA, 12 nt, Shigella flexneri 2a str. 301
cggucagcagca

SEQ ID NO: 1967706 - RNA, 22 nt, Shigella flexneri 2a str. 301
cgguacaucaauaccauuauca

SEQ ID NO: 1967707 - RNA, 22 nt, Shigella flexneri 2a str. 301
cggucauuuucuucagcaguuc

SEQ ID NO: 1967708 - RNA, 13 nt, Shigella flexneri 2a str. 301
cggucauugccug

SEQ ID NO: 1967709 - RNA, 23 nt, Shigella flexneri 2a str. 301
cgguccgccguagccgguaaugg

SEQ ID NO: 1967710 - RNA, 20 nt, Shigella flexneri 2a str. 301
cgggaucagguauaccgaaa

SEQ ID NO: 1967711 - RNA, 19 nt, Shigella flexneri 2a str. 301
cgggaggcgaaggugccuc

SEQ ID NO: 1967712 - RNA, 17 nt, Shigella flexneri 2a str. 301
cgggaguugaucgccaa

SEQ ID NO: 1967713 - RNA, 21 nt, Shigella flexneri 2a str. 301
cgggagaaacccggccacagc

SEQ ID NO: 1967714 - RNA, 16 nt, Shigella flexneri 2a str. 301
cgggcaacguuccagc

SEQ ID NO: 1967715 - RNA, 22 nt, Shigella flexneri 2a str. 301
cgggauucccccaggccgugau

SEQ ID NO: 1967716 - RNA, 16 nt, Shigella flexneri 2a str. 301
cgggaucugcguaccc

SEQ ID NO: 1967717 - RNA, 21 nt, Shigella flexneri 2a str. 301
cggcucaguaaaaucgacauc

SEQ ID NO: 1967718 - RNA, 16 nt, Shigella flexneri 2a str. 301
cggcucaggcgcacgc

SEQ ID NO: 1967719 - RNA, 21 nt, Shigella flexneri 2a str. 301
cggcuacuacggcgugcaggg

SEQ ID NO: 1967720 - RNA, 15 nt, Shigella flexneri 2a str. 301
cggcguuccaccgcu

SEQ ID NO: 1967721 - RNA, 19 nt, Shigella flexneri 2a str. 301
cggcuacacuauuuccuug

SEQ ID NO: 1967722 - RNA, 15 nt, Shigella flexneri 2a str. 301
cggcucaugcaucag

SEQ ID NO: 1967723 - RNA, 13 nt, Shigella flexneri 2a str. 301
cggcgugccgucg

SEQ ID NO: 1967724 - RNA, 18 nt, Shigella flexneri 2a str. 301
cggcguauauugcaccgg

SEQ ID NO: 1967725 - RNA, 14 nt, Shigella flexneri 2a str. 301
cggcgggcgauauc

SEQ ID NO: 1967726 - RNA, 16 nt, Shigella flexneri 2a str. 301
cggcguaaccgcccag

SEQ ID NO: 1967727 - RNA, 22 nt, Shigella flexneri 2a str. 301
cggcguaccuuugccuuccagc

SEQ ID NO: 1967728 - RNA, 22 nt, Shigella flexneri 2a str. 301
cggcguaaacgccuuauccgcc

SEQ ID NO: 1967729 - RNA, 22 nt, Shigella flexneri 2a str. 301
aaaagccgcuuaacgguguuua

SEQ ID NO: 1967730 - RNA, 13 nt, Shigella flexneri 2a str. 301
aaaaugccugaug

SEQ ID NO: 1967731 - RNA, 13 nt, Shigella flexneri 2a str. 301
aaaaucgugccag

SEQ ID NO: 1967732 - RNA, 18 nt, Shigella flexneri 2a str. 301
aaaaucuucguuauccca

SEQ ID NO: 1967733 - RNA, 16 nt, Shigella flexneri 2a str. 301
aaaaacucauaaauuc

SEQ ID NO: 1967734 - RNA, 17 nt, Shigella flexneri 2a str. 301
aaaaacccugcagaaac

SEQ ID NO: 1967735 - RNA, 16 nt, Shigella flexneri 2a str. 301
aaaaacccgccgaagc

SEQ ID NO: 1967736 - RNA, 22 nt, Shigella flexneri 2a str. 301
aaaaacccgccccugacaggcg

SEQ ID NO: 1967737 - RNA, 13 nt, Shigella flexneri 2a str. 301
aaaaaaaaugccc

SEQ ID NO: 1967738 - RNA, 13 nt, Shigella flexneri 2a str. 301
aaaacccgcuucg

SEQ ID NO: 1967739 - RNA, 23 nt, Shigella flexneri 2a str. 301
aaaacccggccugcucccgaacc

SEQ ID NO: 1967740 - RNA, 19 nt, Shigella flexneri 2a str. 301
aaaacagcacuccugccac

SEQ ID NO: 1967741 - RNA, 13 nt, Shigella flexneri 2a str. 301
aaaaauggcgcac

SEQ ID NO: 1967742 - RNA, 23 nt, Shigella flexneri 2a str. 301
aaaacuaaacguuagcacgaacc

SEQ ID NO: 1967743 - RNA, 12 nt, Shigella flexneri 2a str. 301
aaaaacccugca

SEQ ID NO: 1967744 - RNA, 21 nt, Shigella flexneri 2a str. 301
aaaaagcgccggacauugcgu

SEQ ID NO: 1967745 - RNA, 19 nt, Shigella flexneri 2a str. 301
aaacgguaauuauugauga

SEQ ID NO: 1967746 - RNA, 17 nt, Shigella flexneri 2a str. 301
aaacggauggccugaug

SEQ ID NO: 1967747 - RNA, 18 nt, Shigella flexneri 2a str. 301
aaacgcccuuaccuuuac

SEQ ID NO: 1967748 - RNA, 15 nt, Shigella flexneri 2a str. 301
aaacgccgcgccaua

SEQ ID NO: 1967749 - RNA, 17 nt, Shigella flexneri 2a str. 301
aaacgccuuauccgucc

SEQ ID NO: 1967750 - RNA, 13 nt, Shigella flexneri 2a str. 301
aaacgcgcggcgu

SEQ ID NO: 1967751 - RNA, 22 nt, Shigella flexneri 2a str. 301
aaagcagcauguagaugccggu

SEQ ID NO: 1967752 - RNA, 18 nt, Shigella flexneri 2a str. 301
aaagaggcguuugcaggu

SEQ ID NO: 1967753 - RNA, 23 nt, Shigella flexneri 2a str. 301
aaagccacggauauauccguggc

SEQ ID NO: 1967754 - RNA, 13 nt, Shigella flexneri 2a str. 301
aaagaaaucccau

SEQ ID NO: 1967755 - RNA, 18 nt, Shigella flexneri 2a str. 301
aaagcggcucauugccau

SEQ ID NO: 1967756 - RNA, 18 nt, Shigella flexneri 2a str. 301
aaaguaagauugccugau

SEQ ID NO: 1967757 - RNA, 16 nt, Shigella flexneri 2a str. 301
aaagccgccaucucuu

SEQ ID NO: 1967758 - RNA, 13 nt, Shigella flexneri 2a str. 301
aaagcccgccauc

SEQ ID NO: 1967759 - RNA, 20 nt, Shigella flexneri 2a str. 301
aaagcccccgcaacauugcg

SEQ ID NO: 1967760 - RNA, 22 nt, Shigella flexneri 2a str. 301
aaagcccccgcaacauugcgcc

SEQ ID NO: 1967761 - RNA, 16 nt, Shigella flexneri 2a str. 301
aaagcgacgcgcagua

SEQ ID NO: 1967762 - RNA, 13 nt, Shigella flexneri 2a str. 301
aaagccugcuuca

SEQ ID NO: 1967763 - RNA, 14 nt, Shigella flexneri 2a str. 301
aaagcgcaccugau

SEQ ID NO: 1967764 - RNA, 13 nt, Shigella flexneri 2a str. 301
aaagcgagcagua

SEQ ID NO: 1967765 - RNA, 16 nt, Shigella flexneri 2a str. 301
aaacauuucagggaug

SEQ ID NO: 1967766 - RNA, 13 nt, Shigella flexneri 2a str. 301
aaacaggaucugg

SEQ ID NO: 1967767 - RNA, 21 nt, Shigella flexneri 2a str. 301
aaacagcagaacgaccagcgc

SEQ ID NO: 1967768 - RNA, 14 nt, Shigella flexneri 2a str. 301
aaacagccagcagc

SEQ ID NO: 1967769 - RNA, 17 nt, Shigella flexneri 2a str. 301
aaacagcgcaaaacgca

SEQ ID NO: 1967770 - RNA, 14 nt, Shigella flexneri 2a str. 301
aaacaccgucgcaa

SEQ ID NO: 1967771 - RNA, 23 nt, Shigella flexneri 2a str. 301
aaacaauguucaucugcauuccg

SEQ ID NO: 1967772 - RNA, 20 nt, Shigella flexneri 2a str. 301
aaacacaaaacugccugaug

SEQ ID NO: 1967773 - RNA, 17 nt, Shigella flexneri 2a str. 301
aaacacaauauucauag

SEQ ID NO: 1967774 - RNA, 18 nt, Shigella flexneri 2a str. 301
aaaccgagaagcagcaac

SEQ ID NO: 1967775 - RNA, 15 nt, Shigella flexneri 2a str. 301
aaacccugcgucagg

SEQ ID NO: 1967776 - RNA, 12 nt, Shigella flexneri 2a str. 301
aaaccgcgcagc

SEQ ID NO: 1967777 - RNA, 15 nt, Shigella flexneri 2a str. 301
aaaccacuccugacg

SEQ ID NO: 1967778 - RNA, 14 nt, Shigella flexneri 2a str. 301
aaacccgcaggcgc

SEQ ID NO: 1967779 - RNA, 17 nt, Shigella flexneri 2a str. 301
aaaccauuccagcauac

SEQ ID NO: 1967780 - RNA, 18 nt, Shigella flexneri 2a str. 301
aaaccucuuccagcagau

SEQ ID NO: 1967781 - RNA, 21 nt, Shigella flexneri 2a str. 301
aaaccuugugcacgcgcuuca

SEQ ID NO: 1967782 - RNA, 23 nt, Shigella flexneri 2a str. 301
aaaccgucguuacugucgcgcag

SEQ ID NO: 1967783 - RNA, 16 nt, Shigella flexneri 2a str. 301
aaaacggucacggcug

SEQ ID NO: 1967784 - RNA, 23 nt, Shigella flexneri 2a str. 301
aaaacgguccggcauccagccaa

SEQ ID NO: 1967785 - RNA, 23 nt, Shigella flexneri 2a str. 301
aaaacgucgcaacuccaccagca

SEQ ID NO: 1967786 - RNA, 13 nt, Shigella flexneri 2a str. 301
aaauuuauucgcc

SEQ ID NO: 1967787 - RNA, 19 nt, Shigella flexneri 2a str. 301
aaauuuaaaacugccugau

SEQ ID NO: 1967788 - RNA, 19 nt, Shigella flexneri 2a str. 301
aaaagggcgaucuugcgac

SEQ ID NO: 1967789 - RNA, 22 nt, Shigella flexneri 2a str. 301
aacaacagucccaggcagaagc

SEQ ID NO: 1967790 - RNA, 18 nt, Shigella flexneri 2a str. 301
aacaauguuauccggcua

SEQ ID NO: 1967791 - RNA, 13 nt, Shigella flexneri 2a str. 301
aacacaacgcuuu

SEQ ID NO: 1967792 - RNA, 20 nt, Shigella flexneri 2a str. 301
aacacaauaccuucugcgcc

SEQ ID NO: 1967793 - RNA, 13 nt, Shigella flexneri 2a str. 301
aacacauaacgcc

SEQ ID NO: 1967794 - RNA, 19 nt, Shigella flexneri 2a str. 301
aaaugcagcauugccugau

SEQ ID NO: 1967795 - RNA, 14 nt, Shigella flexneri 2a str. 301
aaaugcaucaguga

SEQ ID NO: 1967796 - RNA, 14 nt, Shigella flexneri 2a str. 301
aaauccugccgcag

SEQ ID NO: 1967797 - RNA, 20 nt, Shigella flexneri 2a str. 301
aaauccuucacuuuugccag

SEQ ID NO: 1967798 - RNA, 20 nt, Shigella flexneri 2a str. 301
aaauccagcgguugggcauc

SEQ ID NO: 1967799 - RNA, 13 nt, Shigella flexneri 2a str. 301
aaauccgccacuu

SEQ ID NO: 1967800 - RNA, 13 nt, Shigella flexneri 2a str. 301
aaaucccgccgcu

SEQ ID NO: 1967801 - RNA, 17 nt, Shigella flexneri 2a str. 301
aaaucccagugccugca

SEQ ID NO: 1967802 - RNA, 12 nt, Shigella flexneri 2a str. 301
aaaucauccgcu

SEQ ID NO: 1967803 - RNA, 12 nt, Shigella flexneri 2a str. 301
aaaacaaacggc

SEQ ID NO: 1967804 - RNA, 13 nt, Shigella flexneri 2a str. 301
aaaaccgcugauu

SEQ ID NO: 1967805 - RNA, 22 nt, Shigella flexneri 2a str. 301
aaaaccgcaccguauugcgccg

SEQ ID NO: 1967806 - RNA, 23 nt, Shigella flexneri 2a str. 301
aaaaccguauucgcggugcuuca

SEQ ID NO: 1967807 - RNA, 16 nt, Shigella flexneri 2a str. 301
aaauaaccacaacggc

SEQ ID NO: 1967808 - RNA, 14 nt, Shigella flexneri 2a str. 301
aaaucagcgugaug

SEQ ID NO: 1967809 - RNA, 12 nt, Shigella flexneri 2a str. 301
aaaucaucaauc

SEQ ID NO: 1967810 - RNA, 16 nt, Shigella flexneri 2a str. 301
acaaaaaagccaauca

SEQ ID NO: 1967811 - RNA, 17 nt, Shigella flexneri 2a str. 301
acaaaaaugcccgaucc

SEQ ID NO: 1967812 - RNA, 19 nt, Shigella flexneri 2a str. 301
aauuuuuuugcaccauaaa

SEQ ID NO: 1967813 - RNA, 18 nt, Shigella flexneri 2a str. 301
aauuucguuaagcucaga

SEQ ID NO: 1967814 - RNA, 14 nt, Shigella flexneri 2a str. 301
aauuuccgucgcau

SEQ ID NO: 1967815 - RNA, 15 nt, Shigella flexneri 2a str. 301
acaaauagccagcag

SEQ ID NO: 1967816 - RNA, 15 nt, Shigella flexneri 2a str. 301
acaaaguuugcaacu

SEQ ID NO: 1967817 - RNA, 15 nt, Shigella flexneri 2a str. 301
acaaauacaugaugu

SEQ ID NO: 1967818 - RNA, 15 nt, Shigella flexneri 2a str. 301
acaacacccggucag

SEQ ID NO: 1967819 - RNA, 16 nt, Shigella flexneri 2a str. 301
acaacgugguuauacg

SEQ ID NO: 1967820 - RNA, 21 nt, Shigella flexneri 2a str. 301
acaacgugugcuuuguucaug

SEQ ID NO: 1967821 - RNA, 23 nt, Shigella flexneri 2a str. 301
acaacgagcgcaaugaaaaccgu

SEQ ID NO: 1967822 - RNA, 19 nt, Shigella flexneri 2a str. 301
acaacgaagccgugccaca

SEQ ID NO: 1967823 - RNA, 18 nt, Shigella flexneri 2a str. 301
acaagaaauauacaggcg

SEQ ID NO: 1967824 - RNA, 21 nt, Shigella flexneri 2a str. 301
acaaguaaaaggagauaaacc

SEQ ID NO: 1967825 - RNA, 22 nt, Shigella flexneri 2a str. 301
acaaggaauguggcaaugagug

SEQ ID NO: 1967826 - RNA, 15 nt, Shigella flexneri 2a str. 301
acaauacaaaugccu

SEQ ID NO: 1967827 - RNA, 17 nt, Shigella flexneri 2a str. 301
acaauaugcucuccacc

SEQ ID NO: 1967828 - RNA, 12 nt, Shigella flexneri 2a str. 301
acaaucagccag

SEQ ID NO: 1967829 - RNA, 20 nt, Shigella flexneri 2a str. 301
acaaucccgcccgcagaggc

SEQ ID NO: 1967830 - RNA, 15 nt, Shigella flexneri 2a str. 301
acacaaugccugaug

SEQ ID NO: 1967831 - RNA, 23 nt, Shigella flexneri 2a str. 301
acaauuugcccauguaguacccg

SEQ ID NO: 1967832 - RNA, 20 nt, Shigella flexneri 2a str. 301
acaauugccccccauaacgc

SEQ ID NO: 1967833 - RNA, 20 nt, Shigella flexneri 2a str. 301
acaauguguaggcguugaug

SEQ ID NO: 1967834 - RNA, 22 nt, Shigella flexneri 2a str. 301
acaaugucauggcagucuuaau

SEQ ID NO: 1967835 - RNA, 20 nt, Shigella flexneri 2a str. 301
acaauggagcuaaacagcgc

SEQ ID NO: 1967836 - RNA, 20 nt, Shigella flexneri 2a str. 301
acaaucccugcauaucggua

SEQ ID NO: 1967837 - RNA, 19 nt, Shigella flexneri 2a str. 301
acaaucccuuaguaacgcc

SEQ ID NO: 1967838 - RNA, 17 nt, Shigella flexneri 2a str. 301
acaaucucaaccgcuuc

SEQ ID NO: 1967839 - RNA, 13 nt, Shigella flexneri 2a str. 301
aaugcgcgagcca

SEQ ID NO: 1967840 - RNA, 20 nt, Shigella flexneri 2a str. 301
aaugcgcuguuuagcgcggc

SEQ ID NO: 1967841 - RNA, 15 nt, Shigella flexneri 2a str. 301
aaugcugcagccagg

SEQ ID NO: 1967842 - RNA, 21 nt, Shigella flexneri 2a str. 301
aaugcucaugaucguggcaau

SEQ ID NO: 1967843 - RNA, 19 nt, Shigella flexneri 2a str. 301
aaugcaggcgcgccuggug

SEQ ID NO: 1967844 - RNA, 20 nt, Shigella flexneri 2a str. 301
aaugacuccaacuuacugau

SEQ ID NO: 1967845 - RNA, 21 nt, Shigella flexneri 2a str. 301
aaugacuccaacuuacugaua

SEQ ID NO: 1967846 - RNA, 17 nt, Shigella flexneri 2a str. 301
aaugagauauuucagag

SEQ ID NO: 1967847 - RNA, 22 nt, Shigella flexneri 2a str. 301
aaugcauccgcuuacucaucca

SEQ ID NO: 1967848 - RNA, 17 nt, Shigella flexneri 2a str. 301
aaugacuaucauugcgu

SEQ ID NO: 1967849 - RNA, 15 nt, Shigella flexneri 2a str. 301
aaucacccagcgaag

SEQ ID NO: 1967850 - RNA, 17 nt, Shigella flexneri 2a str. 301
aaucacagcggcgaaug

SEQ ID NO: 1967851 - RNA, 14 nt, Shigella flexneri 2a str. 301
aaucacaucaccau

SEQ ID NO: 1967852 - RNA, 14 nt, Shigella flexneri 2a str. 301
aaucacauccggau

SEQ ID NO: 1967853 - RNA, 19 nt, Shigella flexneri 2a str. 301
aaucaccaggucaccagac

SEQ ID NO: 1967854 - RNA, 20 nt, Shigella flexneri 2a str. 301
aaucuuguucucagcacauu

SEQ ID NO: 1967855 - RNA, 14 nt, Shigella flexneri 2a str. 301
aaugaccggccagc

SEQ ID NO: 1967856 - RNA, 16 nt, Shigella flexneri 2a str. 301
aauuccccgcaggaug

SEQ ID NO: 1967857 - RNA, 23 nt, Shigella flexneri 2a str. 301
aauuccacgccauagcggagcaa

SEQ ID NO: 1967858 - RNA, 13 nt, Shigella flexneri 2a str. 301
aauucccgcuucu

SEQ ID NO: 1967859 - RNA, 20 nt, Shigella flexneri 2a str. 301
aauuccuaaccgaauucaaa

SEQ ID NO: 1967860 - RNA, 13 nt, Shigella flexneri 2a str. 301
aauggcugcgggc

SEQ ID NO: 1967861 - RNA, 22 nt, Shigella flexneri 2a str. 301
aauggcugcgggcgaccaauca

SEQ ID NO: 1967862 - RNA, 13 nt, Shigella flexneri 2a str. 301
aauugcagcagcu

SEQ ID NO: 1967863 - RNA, 23 nt, Shigella flexneri 2a str. 301
aauugaggaugcuaaggcuguug

SEQ ID NO: 1967864 - RNA, 23 nt, Shigella flexneri 2a str. 301
aauugcagacccguuaagcguuc

SEQ ID NO: 1967865 - RNA, 16 nt, Shigella flexneri 2a str. 301
aauugccgcuccaccg

SEQ ID NO: 1967866 - RNA, 18 nt, Shigella flexneri 2a str. 301
aauugguagaccagagcu

SEQ ID NO: 1967867 - RNA, 20 nt, Shigella flexneri 2a str. 301
aauuggcuucguuauugaag

SEQ ID NO: 1967868 - RNA, 14 nt, Shigella flexneri 2a str. 301
aauuguucgacagu

SEQ ID NO: 1967869 - RNA, 17 nt, Shigella flexneri 2a str. 301
aauuucagcgccugaua

SEQ ID NO: 1967870 - RNA, 22 nt, Shigella flexneri 2a str. 301
acacccgacgugcagcaucgau

SEQ ID NO: 1967871 - RNA, 14 nt, Shigella flexneri 2a str. 301
acaccaucaguggc

SEQ ID NO: 1967872 - RNA, 15 nt, Shigella flexneri 2a str. 301
acaccaugccgguga

SEQ ID NO: 1967873 - RNA, 20 nt, Shigella flexneri 2a str. 301
acacauugcgguucguugau

SEQ ID NO: 1967874 - RNA, 16 nt, Shigella flexneri 2a str. 301
acacaucaccuccagc

SEQ ID NO: 1967875 - RNA, 23 nt, Shigella flexneri 2a str. 301
acacagugguuuuaacgaugucg

SEQ ID NO: 1967876 - RNA, 14 nt, Shigella flexneri 2a str. 301
acacaggauacgca

SEQ ID NO: 1967877 - RNA, 15 nt, Shigella flexneri 2a str. 301
acaccacaucgccga

SEQ ID NO: 1967878 - RNA, 23 nt, Shigella flexneri 2a str. 301
aaaauaacagcggcaaccagccc

SEQ ID NO: 1967879 - RNA, 11 nt, Shigella flexneri 2a str. 301
acacgccgugc

SEQ ID NO: 1967880 - RNA, 13 nt, Shigella flexneri 2a str. 301
acacgccgauauc

SEQ ID NO: 1967881 - RNA, 17 nt, Shigella flexneri 2a str. 301
acaccugacgauguggu

SEQ ID NO: 1967882 - RNA, 21 nt, Shigella flexneri 2a str. 301
acaccuguugcgcgucgccca

SEQ ID NO: 1967883 - RNA, 20 nt, Shigella flexneri 2a str. 301
acaccuucucaggccuacaa

SEQ ID NO: 1967884 - RNA, 16 nt, Shigella flexneri 2a str. 301
acaccgucgcaauacc

SEQ ID NO: 1967885 - RNA, 19 nt, Shigella flexneri 2a str. 301
acagguggcguuugccacc

SEQ ID NO: 1967886 - RNA, 20 nt, Shigella flexneri 2a str. 301
acaggucgagaacaacggcg

SEQ ID NO: 1967887 - RNA, 15 nt, Shigella flexneri 2a str. 301
acagcuuagcgccuu

SEQ ID NO: 1967888 - RNA, 15 nt, Shigella flexneri 2a str. 301
acagcgcauucggca

SEQ ID NO: 1967889 - RNA, 15 nt, Shigella flexneri 2a str. 301
acagccuugcgugcc

SEQ ID NO: 1967890 - RNA, 22 nt, Shigella flexneri 2a str. 301
acagccucuuuuuucagugcac

SEQ ID NO: 1967891 - RNA, 19 nt, Shigella flexneri 2a str. 301
acacucgugcgucgcaucc

SEQ ID NO: 1967892 - RNA, 21 nt, Shigella flexneri 2a str. 301
acacucggcgucaaacggcua

SEQ ID NO: 1967893 - RNA, 19 nt, Shigella flexneri 2a str. 301
acacuuugccgucagccac

SEQ ID NO: 1967894 - RNA, 18 nt, Shigella flexneri 2a str. 301
acagaauggcaucugaua

SEQ ID NO: 1967895 - RNA, 13 nt, Shigella flexneri 2a str. 301
acacuucuucagc

SEQ ID NO: 1967896 - RNA, 19 nt, Shigella flexneri 2a str. 301
acagcacgcuuuucagugc

SEQ ID NO: 1967897 - RNA, 17 nt, Shigella flexneri 2a str. 301
acagcagaacucgaacc

SEQ ID NO: 1967898 - RNA, 18 nt, Shigella flexneri 2a str. 301
acagcagcccuugugccg

SEQ ID NO: 1967899 - RNA, 16 nt, Shigella flexneri 2a str. 301
acagcagcaacgauga

SEQ ID NO: 1967900 - RNA, 12 nt, Shigella flexneri 2a str. 301
acagcagcagcg

SEQ ID NO: 1967901 - RNA, 19 nt, Shigella flexneri 2a str. 301
acagcaccauccgcccaca

SEQ ID NO: 1967902 - RNA, 16 nt, Shigella flexneri 2a str. 301
acagacuaauugagcg

SEQ ID NO: 1967903 - RNA, 22 nt, Shigella flexneri 2a str. 301
aaggcuucguaaguggcguuua

SEQ ID NO: 1967904 - RNA, 13 nt, Shigella flexneri 2a str. 301
aaggcuguuccca

SEQ ID NO: 1967905 - RNA, 17 nt, Shigella flexneri 2a str. 301
aaggcuuucgugaagcu

SEQ ID NO: 1967906 - RNA, 13 nt, Shigella flexneri 2a str. 301
aaggucauugcga

SEQ ID NO: 1967907 - RNA, 14 nt, Shigella flexneri 2a str. 301
aaggcgaaacgccu

SEQ ID NO: 1967908 - RNA, 23 nt, Shigella flexneri 2a str. 301
aaggcguuggugauaaaacgcag

SEQ ID NO: 1967909 - RNA, 22 nt, Shigella flexneri 2a str. 301
aaggcgagcaaucacuugcgca

SEQ ID NO: 1967910 - RNA, 18 nt, Shigella flexneri 2a str. 301
aaggcguuuacgccgcau

SEQ ID NO: 1967911 - RNA, 23 nt, Shigella flexneri 2a str. 301
aaggcguuuucgccacaucaggu

SEQ ID NO: 1967912 - RNA, 18 nt, Shigella flexneri 2a str. 301
aaggcguuuucgccgcau

SEQ ID NO: 1967913 - RNA, 23 nt, Shigella flexneri 2a str. 301
aaggcaacgccccuucugccgca

SEQ ID NO: 1967914 - RNA, 19 nt, Shigella flexneri 2a str. 301
aaggcauuaaacgcauaca

SEQ ID NO: 1967915 - RNA, 16 nt, Shigella flexneri 2a str. 301
aaggcauuaaacgcau

SEQ ID NO: 1967916 - RNA, 18 nt, Shigella flexneri 2a str. 301
aaggcauuuacgccgcau

SEQ ID NO: 1967917 - RNA, 11 nt, Shigella flexneri 2a str. 301
aaggccagcaa

SEQ ID NO: 1967918 - RNA, 15 nt, Shigella flexneri 2a str. 301
aagcggugcgaugcc

SEQ ID NO: 1967919 - RNA, 22 nt, Shigella flexneri 2a str. 301
aagcguaaaaccucacgcaucc

SEQ ID NO: 1967920 - RNA, 14 nt, Shigella flexneri 2a str. 301
aagcguagcgcauc

SEQ ID NO: 1967921 - RNA, 21 nt, Shigella flexneri 2a str. 301
aagcguagcgcaucaggcaau

SEQ ID NO: 1967922 - RNA, 14 nt, Shigella flexneri 2a str. 301
aagcgaugcugaug

SEQ ID NO: 1967923 - RNA, 16 nt, Shigella flexneri 2a str. 301
aagcgcaaaauaccag

SEQ ID NO: 1967924 - RNA, 13 nt, Shigella flexneri 2a str. 301
aagccaugcccgu

SEQ ID NO: 1967925 - RNA, 16 nt, Shigella flexneri 2a str. 301
aagccaagcgccgccu

SEQ ID NO: 1967926 - RNA, 19 nt, Shigella flexneri 2a str. 301
aagccauaucguucugcca

SEQ ID NO: 1967927 - RNA, 21 nt, Shigella flexneri 2a str. 301
aagccauaucguucugccaga

SEQ ID NO: 1967928 - RNA, 14 nt, Shigella flexneri 2a str. 301
aagccaccgccgcu

SEQ ID NO: 1967929 - RNA, 19 nt, Shigella flexneri 2a str. 301
aagccacaaucgcagcgca

SEQ ID NO: 1967930 - RNA, 19 nt, Shigella flexneri 2a str. 301
aagacgcgcagcgucgcau

SEQ ID NO: 1967931 - RNA, 21 nt, Shigella flexneri 2a str. 301
aagacgcggcaagcgucgcau

SEQ ID NO: 1967932 - RNA, 13 nt, Shigella flexneri 2a str. 301
aagacgcgccagc

SEQ ID NO: 1967933 - RNA, 20 nt, Shigella flexneri 2a str. 301
aagacgcggcagcgucgcau

SEQ ID NO: 1967934 - RNA, 21 nt, Shigella flexneri 2a str. 301
aagacgcguaaagcgucgcau

SEQ ID NO: 1967935 - RNA, 21 nt, Shigella flexneri 2a str. 301
aagacgcgaccagcgucgcau

SEQ ID NO: 1967936 - RNA, 20 nt, Shigella flexneri 2a str. 301
aagacgcgucagcgucgcau

SEQ ID NO: 1967937 - RNA, 20 nt, Shigella flexneri 2a str. 301
aagacgcguuagcaucgcau

SEQ ID NO: 1967938 - RNA, 21 nt, Shigella flexneri 2a str. 301
aagacgcgucaagcgucgcau

SEQ ID NO: 1967939 - RNA, 23 nt, Shigella flexneri 2a str. 301
aagacguucacgucgcauccggc

SEQ ID NO: 1967940 - RNA, 21 nt, Shigella flexneri 2a str. 301
aagguggcgaagugccagucg

SEQ ID NO: 1967941 - RNA, 19 nt, Shigella flexneri 2a str. 301
aaguuaauccacagcaaug

SEQ ID NO: 1967942 - RNA, 21 nt, Shigella flexneri 2a str. 301
aaguguguaucuucauccgcc

SEQ ID NO: 1967943 - RNA, 24 nt, Shigella flexneri 2a str. 301
aauaaucucuuuacccagcggaug

SEQ ID NO: 1967944 - RNA, 20 nt, Shigella flexneri 2a str. 301
aauaauccccaauacgauua

SEQ ID NO: 1967945 - RNA, 14 nt, Shigella flexneri 2a str. 301
aauaauccgcugca

SEQ ID NO: 1967946 - RNA, 18 nt, Shigella flexneri 2a str. 301
aauaaccauggcagaagc

SEQ ID NO: 1967947 - RNA, 15 nt, Shigella flexneri 2a str. 301
aauaacacgcggcuu

SEQ ID NO: 1967948 - RNA, 15 nt, Shigella flexneri 2a str. 301
aauacguaggccuga

SEQ ID NO: 1967949 - RNA, 17 nt, Shigella flexneri 2a str. 301
aauacgcgaggcgcuaa

SEQ ID NO: 1967950 - RNA, 11 nt, Shigella flexneri 2a str. 301
aauacuggcag

SEQ ID NO: 1967951 - RNA, 13 nt, Shigella flexneri 2a str. 301
aauaucuccagcu

SEQ ID NO: 1967952 - RNA, 15 nt, Shigella flexneri 2a str. 301
aauacuuccgcuucc

SEQ ID NO: 1967953 - RNA, 22 nt, Shigella flexneri 2a str. 301
aaucaagcgccgccagucgaau

SEQ ID NO: 1967954 - RNA, 15 nt, Shigella flexneri 2a str. 301
aaucaacaaacgcug

SEQ ID NO: 1967955 - RNA, 19 nt, Shigella flexneri 2a str. 301
aauauugaugcacaccauc

SEQ ID NO: 1967956 - RNA, 22 nt, Shigella flexneri 2a str. 301
aacacucgugcgucgcauccgg

SEQ ID NO: 1967957 - RNA, 16 nt, Shigella flexneri 2a str. 301
aaccgcuguugucuga

SEQ ID NO: 1967958 - RNA, 15 nt, Shigella flexneri 2a str. 301
aacaccuaccggcug

SEQ ID NO: 1967959 - RNA, 16 nt, Shigella flexneri 2a str. 301
aacaccuggcaccagu

SEQ ID NO: 1967960 - RNA, 15 nt, Shigella flexneri 2a str. 301
aacaccuguugcgcg

SEQ ID NO: 1967961 - RNA, 20 nt, Shigella flexneri 2a str. 301
aacacgaucucacgcugaaa

SEQ ID NO: 1967962 - RNA, 20 nt, Shigella flexneri 2a str. 301
aacacggcagcaaccgcuuc

SEQ ID NO: 1967963 - RNA, 20 nt, Shigella flexneri 2a str. 301
aaccuaaagccuguaacgcc

SEQ ID NO: 1967964 - RNA, 19 nt, Shigella flexneri 2a str. 301
aaccugauuacgcaccggg

SEQ ID NO: 1967965 - RNA, 14 nt, Shigella flexneri 2a str. 301
aaccguacgcauca

SEQ ID NO: 1967966 - RNA, 21 nt, Shigella flexneri 2a str. 301
aacgcguccaucacuaccagc

SEQ ID NO: 1967967 - RNA, 21 nt, Shigella flexneri 2a str. 301
aacgccuuauccggccuaccg

SEQ ID NO: 1967968 - RNA, 22 nt, Shigella flexneri 2a str. 301
aacgccuuauccggccuggaug

SEQ ID NO: 1967969 - RNA, 17 nt, Shigella flexneri 2a str. 301
aacgccugcucuuauua

SEQ ID NO: 1967970 - RNA, 22 nt, Shigella flexneri 2a str. 301
aacggcagagaaaccacaucaa

SEQ ID NO: 1967971 - RNA, 13 nt, Shigella flexneri 2a str. 301
aacggcagagaaa

SEQ ID NO: 1967972 - RNA, 18 nt, Shigella flexneri 2a str. 301
aacggcacgacacugcug

SEQ ID NO: 1967973 - RNA, 18 nt, Shigella flexneri 2a str. 301
aacgcuucugucgcuuca

SEQ ID NO: 1967974 - RNA, 14 nt, Shigella flexneri 2a str. 301
aacgcuggucgcga

SEQ ID NO: 1967975 - RNA, 16 nt, Shigella flexneri 2a str. 301
aacgcucccugccagu

SEQ ID NO: 1967976 - RNA, 19 nt, Shigella flexneri 2a str. 301
aacgcgucuuaucuggccu

SEQ ID NO: 1967977 - RNA, 15 nt, Shigella flexneri 2a str. 301
aacgcguucacugcc

SEQ ID NO: 1967978 - RNA, 15 nt, Shigella flexneri 2a str. 301
aacgcccguccauca

SEQ ID NO: 1967979 - RNA, 14 nt, Shigella flexneri 2a str. 301
aacgccauccagcc

SEQ ID NO: 1967980 - RNA, 20 nt, Shigella flexneri 2a str. 301
aacgccagauccgggcuaau

SEQ ID NO: 1967981 - RNA, 20 nt, Shigella flexneri 2a str. 301
aacgccgucaucacaccgcg

SEQ ID NO: 1967982 - RNA, 16 nt, Shigella flexneri 2a str. 301
aacgccgaauaacgcg

SEQ ID NO: 1967983 - RNA, 16 nt, Shigella flexneri 2a str. 301
aacgccuaauccagcc

SEQ ID NO: 1967984 - RNA, 24 nt, Shigella flexneri 2a str. 301
aacgccucaugcaggcggugcaau

SEQ ID NO: 1967985 - RNA, 14 nt, Shigella flexneri 2a str. 301
aacgccacauccgg

SEQ ID NO: 1967986 - RNA, 17 nt, Shigella flexneri 2a str. 301
aacgacauuuucugccc

SEQ ID NO: 1967987 - RNA, 18 nt, Shigella flexneri 2a str. 301
aacggccaaauauccgcg

SEQ ID NO: 1967988 - RNA, 17 nt, Shigella flexneri 2a str. 301
aacggccaaaguacgga

SEQ ID NO: 1967989 - RNA, 22 nt, Shigella flexneri 2a str. 301
aacucaccgaugaucgccauca

SEQ ID NO: 1967990 - RNA, 21 nt, Shigella flexneri 2a str. 301
aacuaucccagccuauaacga

SEQ ID NO: 1967991 - RNA, 15 nt, Shigella flexneri 2a str. 301
aacggcgcuuccagc

SEQ ID NO: 1967992 - RNA, 20 nt, Shigella flexneri 2a str. 301
aacuccacgcgcggacgaga

SEQ ID NO: 1967993 - RNA, 22 nt, Shigella flexneri 2a str. 301
aacuccgccgcaucuucccagg

SEQ ID NO: 1967994 - RNA, 21 nt, Shigella flexneri 2a str. 301
aacucgcuuaagccaucauca

SEQ ID NO: 1967995 - RNA, 14 nt, Shigella flexneri 2a str. 301
aacucgcugccagc

SEQ ID NO: 1967996 - RNA, 18 nt, Shigella flexneri 2a str. 301
aacugagcgccgucgcga

SEQ ID NO: 1967997 - RNA, 14 nt, Shigella flexneri 2a str. 301
aacugcacaccgcg

SEQ ID NO: 1967998 - RNA, 12 nt, Shigella flexneri 2a str. 301
aacugccugaug

SEQ ID NO: 1967999 - RNA, 21 nt, Shigella flexneri 2a str. 301
aacugcgccacucgauaccag

SEQ ID NO: 1968000 - RNA, 13 nt, Shigella flexneri 2a str. 301
aacugcgccucaa

SEQ ID NO: 1968001 - RNA, 21 nt, Shigella flexneri 2a str. 301
aacugcgcuauaucgcugaua

SEQ ID NO: 1968002 - RNA, 16 nt, Shigella flexneri 2a str. 301
aacuucacuaaucaau

SEQ ID NO: 1968003 - RNA, 13 nt, Shigella flexneri 2a str. 301
aacuguugaccau

SEQ ID NO: 1968004 - RNA, 16 nt, Shigella flexneri 2a str. 301
aacuggagcaggaacu

SEQ ID NO: 1968005 - RNA, 20 nt, Shigella flexneri 2a str. 301
aacuggcggucaugacgaua

SEQ ID NO: 1968006 - RNA, 20 nt, Shigella flexneri 2a str. 301
aacuuugaagcccaguaccg

SEQ ID NO: 1968007 - RNA, 13 nt, Shigella flexneri 2a str. 301
aagaaaccgauga

SEQ ID NO: 1968008 - RNA, 16 nt, Shigella flexneri 2a str. 301
aagaaauaacgccgga

SEQ ID NO: 1968009 - RNA, 14 nt, Shigella flexneri 2a str. 301
aagaauagagaaug

SEQ ID NO: 1968010 - RNA, 15 nt, Shigella flexneri 2a str. 301
aagaauuucaucgcc

SEQ ID NO: 1968011 - RNA, 14 nt, Shigella flexneri 2a str. 301
aagaauugcagaua

SEQ ID NO: 1968012 - RNA, 16 nt, Shigella flexneri 2a str. 301
aagacaucgcccgauu

SEQ ID NO: 1968013 - RNA, 14 nt, Shigella flexneri 2a str. 301
acgacguaccagcg

SEQ ID NO: 1968014 - RNA, 17 nt, Shigella flexneri 2a str. 301
acgacgguaaaccacgc

SEQ ID NO: 1968015 - RNA, 19 nt, Shigella flexneri 2a str. 301
acgacgcugacgauuguag

SEQ ID NO: 1968016 - RNA, 17 nt, Shigella flexneri 2a str. 301
acgagucaacgcuucag

SEQ ID NO: 1968017 - RNA, 18 nt, Shigella flexneri 2a str. 301
acgaguggugucgucaaa

SEQ ID NO: 1968018 - RNA, 15 nt, Shigella flexneri 2a str. 301
acgaucgaagccguc

SEQ ID NO: 1968019 - RNA, 13 nt, Shigella flexneri 2a str. 301
acgagucgucgau

SEQ ID NO: 1968020 - RNA, 15 nt, Shigella flexneri 2a str. 301
acgauguaggccuga

SEQ ID NO: 1968021 - RNA, 15 nt, Shigella flexneri 2a str. 301
acgaucgcgccagcc

SEQ ID NO: 1968022 - RNA, 21 nt, Shigella flexneri 2a str. 301
acgcacccguaacauggcggu

SEQ ID NO: 1968023 - RNA, 15 nt, Shigella flexneri 2a str. 301
acgauguuugcugcg

SEQ ID NO: 1968024 - RNA, 14 nt, Shigella flexneri 2a str. 301
acgcaaaaccucuu

SEQ ID NO: 1968025 - RNA, 20 nt, Shigella flexneri 2a str. 301
acgcaauccccucuucagcc

SEQ ID NO: 1968026 - RNA, 16 nt, Shigella flexneri 2a str. 301
acgaaucgccgcauag

SEQ ID NO: 1968027 - RNA, 14 nt, Shigella flexneri 2a str. 301
acgaaucgccgcau

SEQ ID NO: 1968028 - RNA, 19 nt, Shigella flexneri 2a str. 301
acgaauaguuucagccucu

SEQ ID NO: 1968029 - RNA, 23 nt, Shigella flexneri 2a str. 301
acgaauauagcgccacgcuguuc

SEQ ID NO: 1968030 - RNA, 14 nt, Shigella flexneri 2a str. 301
acgaagcgccuucg

SEQ ID NO: 1968031 - RNA, 22 nt, Shigella flexneri 2a str. 301
acgaauugcugcgcccgcagcg

SEQ ID NO: 1968032 - RNA, 12 nt, Shigella flexneri 2a str. 301
acgaccaccgaa

SEQ ID NO: 1968033 - RNA, 18 nt, Shigella flexneri 2a str. 301
acgaccuccacucucgaa

SEQ ID NO: 1968034 - RNA, 18 nt, Shigella flexneri 2a str. 301
acgaccuccaucgcacca

SEQ ID NO: 1968035 - RNA, 22 nt, Shigella flexneri 2a str. 301
accuuugccuuccagcgaugcc

SEQ ID NO: 1968036 - RNA, 14 nt, Shigella flexneri 2a str. 301
accuuugccuucca

SEQ ID NO: 1968037 - RNA, 20 nt, Shigella flexneri 2a str. 301
accuuuuuccagauugcuua

SEQ ID NO: 1968038 - RNA, 24 nt, Shigella flexneri 2a str. 301
acgaaagcagggcggcaggcagcg

SEQ ID NO: 1968039 - RNA, 23 nt, Shigella flexneri 2a str. 301
acgaacuaccgugcuguacagca

SEQ ID NO: 1968040 - RNA, 12 nt, Shigella flexneri 2a str. 301
acgaaccauuuc

SEQ ID NO: 1968041 - RNA, 15 nt, Shigella flexneri 2a str. 301
accuuuaaucaggcu

SEQ ID NO: 1968042 - RNA, 14 nt, Shigella flexneri 2a str. 301
accuuugaacugcu

SEQ ID NO: 1968043 - RNA, 22 nt, Shigella flexneri 2a str. 301
accuuuccuuguaacgcaucaa

SEQ ID NO: 1968044 - RNA, 23 nt, Shigella flexneri 2a str. 301
accugccagcgccgacagcagcc

SEQ ID NO: 1968045 - RNA, 17 nt, Shigella flexneri 2a str. 301
accuugcauagcuucga

SEQ ID NO: 1968046 - RNA, 16 nt, Shigella flexneri 2a str. 301
accugcauuugcugca

SEQ ID NO: 1968047 - RNA, 17 nt, Shigella flexneri 2a str. 301
accugcacgaaaccacu

SEQ ID NO: 1968048 - RNA, 16 nt, Shigella flexneri 2a str. 301
accugauuacgcaccg

SEQ ID NO: 1968049 - RNA, 23 nt, Shigella flexneri 2a str. 301
accugauuaaacgggucaucaaa

SEQ ID NO: 1968050 - RNA, 23 nt, Shigella flexneri 2a str. 301
accugauuaccgugaaucaccac

SEQ ID NO: 1968051 - RNA, 18 nt, Shigella flexneri 2a str. 301
accguuaagaugguuacg

SEQ ID NO: 1968052 - RNA, 15 nt, Shigella flexneri 2a str. 301
accgugcaucuguug

SEQ ID NO: 1968053 - RNA, 18 nt, Shigella flexneri 2a str. 301
accuccggcguuucagau

SEQ ID NO: 1968054 - RNA, 21 nt, Shigella flexneri 2a str. 301
accguuuacgucauuaccgcg

SEQ ID NO: 1968055 - RNA, 19 nt, Shigella flexneri 2a str. 301
accguuuacgucauuaccg

SEQ ID NO: 1968056 - RNA, 21 nt, Shigella flexneri 2a str. 301
accguugguuaauuuuucaaa

SEQ ID NO: 1968057 - RNA, 23 nt, Shigella flexneri 2a str. 301
accguugguuaauuuuucaaacu

SEQ ID NO: 1968058 - RNA, 21 nt, Shigella flexneri 2a str. 301
accuaccaucuccugcaacga

SEQ ID NO: 1968059 - RNA, 23 nt, Shigella flexneri 2a str. 301
accuccuggaucacaauccgcuc

SEQ ID NO: 1968060 - RNA, 21 nt, Shigella flexneri 2a str. 301
accucuucuaccacaugauua

SEQ ID NO: 1968061 - RNA, 12 nt, Shigella flexneri 2a str. 301
accucucaacgu

SEQ ID NO: 1968062 - RNA, 12 nt, Shigella flexneri 2a str. 301
accguaggccgu

SEQ ID NO: 1968063 - RNA, 17 nt, Shigella flexneri 2a str. 301
accguacgcaucaccag

SEQ ID NO: 1968064 - RNA, 15 nt, Shigella flexneri 2a str. 301
accgucaucgacaaa

SEQ ID NO: 1968065 - RNA, 18 nt, Shigella flexneri 2a str. 301
accgucagauccgccagu

SEQ ID NO: 1968066 - RNA, 12 nt, Shigella flexneri 2a str. 301
accgucagccug

SEQ ID NO: 1968067 - RNA, 17 nt, Shigella flexneri 2a str. 301
accgucguuacugucgc

SEQ ID NO: 1968068 - RNA, 16 nt, Shigella flexneri 2a str. 301
accguccggcgggcaa

SEQ ID NO: 1968069 - RNA, 14 nt, Shigella flexneri 2a str. 301
accgguugcuggau

SEQ ID NO: 1968070 - RNA, 16 nt, Shigella flexneri 2a str. 301
accggcaaagaaccaa

SEQ ID NO: 1968071 - RNA, 15 nt, Shigella flexneri 2a str. 301
accgcugacggcagc

SEQ ID NO: 1968072 - RNA, 14 nt, Shigella flexneri 2a str. 301
accgcgcucagcca

SEQ ID NO: 1968073 - RNA, 22 nt, Shigella flexneri 2a str. 301
accggacgaaauccccccggug

SEQ ID NO: 1968074 - RNA, 16 nt, Shigella flexneri 2a str. 301
accgcuuggcgauacc

SEQ ID NO: 1968075 - RNA, 23 nt, Shigella flexneri 2a str. 301
accgcuguccacgccuuaugcca

SEQ ID NO: 1968076 - RNA, 21 nt, Shigella flexneri 2a str. 301
accgcugggcaccacgccgga

SEQ ID NO: 1968077 - RNA, 14 nt, Shigella flexneri 2a str. 301
accgccugaucauu

SEQ ID NO: 1968078 - RNA, 20 nt, Shigella flexneri 2a str. 301
accgcgaguaaucacaucaa

SEQ ID NO: 1968079 - RNA, 17 nt, Shigella flexneri 2a str. 301
accgcgcagcgggcauu

SEQ ID NO: 1968080 - RNA, 18 nt, Shigella flexneri 2a str. 301
accgcccugagcaucaau

SEQ ID NO: 1968081 - RNA, 20 nt, Shigella flexneri 2a str. 301
accgcccuccgguccgccgu

SEQ ID NO: 1968082 - RNA, 13 nt, Shigella flexneri 2a str. 301
accgcagcccaga

SEQ ID NO: 1968083 - RNA, 16 nt, Shigella flexneri 2a str. 301
accgcaucagcaucgg

SEQ ID NO: 1968084 - RNA, 22 nt, Shigella flexneri 2a str. 301
accgcaucggcaucaaaccauu

SEQ ID NO: 1968085 - RNA, 13 nt, Shigella flexneri 2a str. 301
accgccagcggcg

SEQ ID NO: 1968086 - RNA, 21 nt, Shigella flexneri 2a str. 301
accgauggcaaacaaacugcg

SEQ ID NO: 1968087 - RNA, 14 nt, Shigella flexneri 2a str. 301
accgcacaccgaga

SEQ ID NO: 1968088 - RNA, 14 nt, Shigella flexneri 2a str. 301
accgcaaucgccag

SEQ ID NO: 1968089 - RNA, 14 nt, Shigella flexneri 2a str. 301
accgcaaaauaggu

SEQ ID NO: 1968090 - RNA, 17 nt, Shigella flexneri 2a str. 301
accgauauucgccgcga

SEQ ID NO: 1968091 - RNA, 18 nt, Shigella flexneri 2a str. 301
acauaaggaaacuccagc

SEQ ID NO: 1968092 - RNA, 19 nt, Shigella flexneri 2a str. 301
acaguuucugcagcuccag

SEQ ID NO: 1968093 - RNA, 17 nt, Shigella flexneri 2a str. 301
accaguccuacacacgc

SEQ ID NO: 1968094 - RNA, 14 nt, Shigella flexneri 2a str. 301
accaguaccauuuu

SEQ ID NO: 1968095 - RNA, 23 nt, Shigella flexneri 2a str. 301
accaucaauggcugcaaagcauu

SEQ ID NO: 1968096 - RNA, 12 nt, Shigella flexneri 2a str. 301
accauccggcau

SEQ ID NO: 1968097 - RNA, 14 nt, Shigella flexneri 2a str. 301
accaugacgccgaa

SEQ ID NO: 1968098 - RNA, 13 nt, Shigella flexneri 2a str. 301
accaugacgccga

SEQ ID NO: 1968099 - RNA, 15 nt, Shigella flexneri 2a str. 301
accauaaauuucacg

SEQ ID NO: 1968100 - RNA, 22 nt, Shigella flexneri 2a str. 301
accaguuuuuacgcccgugaug

SEQ ID NO: 1968101 - RNA, 21 nt, Shigella flexneri 2a str. 301
accccaacugggugcacuuac

SEQ ID NO: 1968102 - RNA, 23 nt, Shigella flexneri 2a str. 301
accccaauuaauugccagccguc

SEQ ID NO: 1968103 - RNA, 15 nt, Shigella flexneri 2a str. 301
acccccgaacgggua

SEQ ID NO: 1968104 - RNA, 22 nt, Shigella flexneri 2a str. 301
accccgagcuuaugcaauagcg

SEQ ID NO: 1968105 - RNA, 14 nt, Shigella flexneri 2a str. 301
accauuaucaccaa

SEQ ID NO: 1968106 - RNA, 21 nt, Shigella flexneri 2a str. 301
accauuagacaguuugccuuc

SEQ ID NO: 1968107 - RNA, 18 nt, Shigella flexneri 2a str. 301
accaugcgcaucaucgau

SEQ ID NO: 1968108 - RNA, 23 nt, Shigella flexneri 2a str. 301
acccagcgguaaaauggucagcc

SEQ ID NO: 1968109 - RNA, 23 nt, Shigella flexneri 2a str. 301
acccgcgugguuuuugugccggg

SEQ ID NO: 1968110 - RNA, 13 nt, Shigella flexneri 2a str. 301
aaaauuauucgcc

SEQ ID NO: 1968111 - RNA, 13 nt, Shigella flexneri 2a str. 301
acccgccagacca

SEQ ID NO: 1968112 - RNA, 19 nt, Shigella flexneri 2a str. 301
acgggugagggcguagaga

SEQ ID NO: 1968113 - RNA, 16 nt, Shigella flexneri 2a str. 301
acgguaauaaaugccg

SEQ ID NO: 1968114 - RNA, 18 nt, Shigella flexneri 2a str. 301
acgguaacccagguauuc

SEQ ID NO: 1968115 - RNA, 17 nt, Shigella flexneri 2a str. 301
acgggucauaaucagau

SEQ ID NO: 1968116 - RNA, 21 nt, Shigella flexneri 2a str. 301
acggguacaguuuuccaucag

SEQ ID NO: 1968117 - RNA, 20 nt, Shigella flexneri 2a str. 301
acgguacgccagaguggauu

SEQ ID NO: 1968118 - RNA, 18 nt, Shigella flexneri 2a str. 301
acgguagccccgcuucag

SEQ ID NO: 1968119 - RNA, 23 nt, Shigella flexneri 2a str. 301
acgguccgguugcagaguaucca

SEQ ID NO: 1968120 - RNA, 19 nt, Shigella flexneri 2a str. 301
acgguguuaguaaacgcgu

SEQ ID NO: 1968121 - RNA, 16 nt, Shigella flexneri 2a str. 301
acgguugaugccguuc

SEQ ID NO: 1968122 - RNA, 14 nt, Shigella flexneri 2a str. 301
acggcguauugcau

SEQ ID NO: 1968123 - RNA, 14 nt, Shigella flexneri 2a str. 301
acggcgucaacacc

SEQ ID NO: 1968124 - RNA, 16 nt, Shigella flexneri 2a str. 301
acgggcaagccagcau

SEQ ID NO: 1968125 - RNA, 20 nt, Shigella flexneri 2a str. 301
acggcggaaagggccgcagu

SEQ ID NO: 1968126 - RNA, 16 nt, Shigella flexneri 2a str. 301
acggcggcaacauggc

SEQ ID NO: 1968127 - RNA, 15 nt, Shigella flexneri 2a str. 301
acuacgacauugaag

SEQ ID NO: 1968128 - RNA, 20 nt, Shigella flexneri 2a str. 301
acuacagaggaaucgcuguu

SEQ ID NO: 1968129 - RNA, 24 nt, Shigella flexneri 2a str. 301
acguuauucgcuuccucaaccacu

SEQ ID NO: 1968130 - RNA, 13 nt, Shigella flexneri 2a str. 301
acguucuaccgua

SEQ ID NO: 1968131 - RNA, 19 nt, Shigella flexneri 2a str. 301
acguuucaccagcacuucu

SEQ ID NO: 1968132 - RNA, 23 nt, Shigella flexneri 2a str. 301
acguuguuccggcgcaauucccg

SEQ ID NO: 1968133 - RNA, 19 nt, Shigella flexneri 2a str. 301
acguuuuaaaccuacgugc

SEQ ID NO: 1968134 - RNA, 18 nt, Shigella flexneri 2a str. 301
acguuuuacgcgucacgc

SEQ ID NO: 1968135 - RNA, 14 nt, Shigella flexneri 2a str. 301
acguaggccugaua

SEQ ID NO: 1968136 - RNA, 21 nt, Shigella flexneri 2a str. 301
acgguugcgaagucguucaga

SEQ ID NO: 1968137 - RNA, 18 nt, Shigella flexneri 2a str. 301
acgucgccuuuuacggcu

SEQ ID NO: 1968138 - RNA, 20 nt, Shigella flexneri 2a str. 301
acgucggcaucgggcagcau

SEQ ID NO: 1968139 - RNA, 13 nt, Shigella flexneri 2a str. 301
acgucuccaucaa

SEQ ID NO: 1968140 - RNA, 20 nt, Shigella flexneri 2a str. 301
acguggggugaauaaucgca

SEQ ID NO: 1968141 - RNA, 19 nt, Shigella flexneri 2a str. 301
acguggcagggaaucagau

SEQ ID NO: 1968142 - RNA, 21 nt, Shigella flexneri 2a str. 301
acguggauaccgauagauuca

SEQ ID NO: 1968143 - RNA, 19 nt, Shigella flexneri 2a str. 301
acgcucaucaggccuacaa

SEQ ID NO: 1968144 - RNA, 14 nt, Shigella flexneri 2a str. 301
acgcucaucaggcc

SEQ ID NO: 1968145 - RNA, 15 nt, Shigella flexneri 2a str. 301
acgcucccugccagu

SEQ ID NO: 1968146 - RNA, 19 nt, Shigella flexneri 2a str. 301
acgcgguguuuuaaccguu

SEQ ID NO: 1968147 - RNA, 14 nt, Shigella flexneri 2a str. 301
acgcucaguauggu

SEQ ID NO: 1968148 - RNA, 11 nt, Shigella flexneri 2a str. 301
acgcucggcaa

SEQ ID NO: 1968149 - RNA, 18 nt, Shigella flexneri 2a str. 301
acgcgggcaaucggcugc

SEQ ID NO: 1968150 - RNA, 14 nt, Shigella flexneri 2a str. 301
acgcgggcagcaga

SEQ ID NO: 1968151 - RNA, 14 nt, Shigella flexneri 2a str. 301
aaacagagcgggcu

SEQ ID NO: 1968152 - RNA, 14 nt, Shigella flexneri 2a str. 301
aaacagggcuuuac

SEQ ID NO: 1968153 - RNA, 22 nt, Shigella flexneri 2a str. 301
aaacagcugcugguaauccgug

SEQ ID NO: 1968154 - RNA, 21 nt, Shigella flexneri 2a str. 301
acgcgaauaguuuccgcuucu

SEQ ID NO: 1968155 - RNA, 21 nt, Shigella flexneri 2a str. 301
acgcgacaagcgucgcaucag

SEQ ID NO: 1968156 - RNA, 22 nt, Shigella flexneri 2a str. 301
aaacacgacaugacccggcgua

SEQ ID NO: 1968157 - RNA, 17 nt, Shigella flexneri 2a str. 301
acgccuuguuucuucaa

SEQ ID NO: 1968158 - RNA, 21 nt, Shigella flexneri 2a str. 301
acgcagacacugcugauaauc

SEQ ID NO: 1968159 - RNA, 20 nt, Shigella flexneri 2a str. 301
acgccuucuccggcuuacaa

SEQ ID NO: 1968160 - RNA, 17 nt, Shigella flexneri 2a str. 301
acgcgauuucucaucaa

SEQ ID NO: 1968161 - RNA, 19 nt, Shigella flexneri 2a str. 301
acgcgaccggcgucgcauc

SEQ ID NO: 1968162 - RNA, 20 nt, Shigella flexneri 2a str. 301
acgcgaccaucgcggaucag

SEQ ID NO: 1968163 - RNA, 13 nt, Shigella flexneri 2a str. 301
acgcgaccggcgu

SEQ ID NO: 1968164 - RNA, 21 nt, Shigella flexneri 2a str. 301
acgcgaccagcgucgcaucag

SEQ ID NO: 1968165 - RNA, 18 nt, Shigella flexneri 2a str. 301
acgcgcuagccucaggug

SEQ ID NO: 1968166 - RNA, 20 nt, Shigella flexneri 2a str. 301
acgcgcuagccucagguguu

SEQ ID NO: 1968167 - RNA, 13 nt, Shigella flexneri 2a str. 301
acgcgcuagcguc

SEQ ID NO: 1968168 - RNA, 20 nt, Shigella flexneri 2a str. 301
acgcgcuagcgucgcaucag

SEQ ID NO: 1968169 - RNA, 18 nt, Shigella flexneri 2a str. 301
acgcgcuagcuucaggug

SEQ ID NO: 1968170 - RNA, 14 nt, Shigella flexneri 2a str. 301
acgcgcagcguuca

SEQ ID NO: 1968171 - RNA, 20 nt, Shigella flexneri 2a str. 301
acgcuuuacguuccuggcuu

SEQ ID NO: 1968172 - RNA, 15 nt, Shigella flexneri 2a str. 301
acgcuuuucaucaga

SEQ ID NO: 1968173 - RNA, 13 nt, Shigella flexneri 2a str. 301
acgcuucuggcga

SEQ ID NO: 1968174 - RNA, 23 nt, Shigella flexneri 2a str. 301
acgcugcugccggcacaggcauc

SEQ ID NO: 1968175 - RNA, 17 nt, Shigella flexneri 2a str. 301
acgcugcacaauugcca

SEQ ID NO: 1968176 - RNA, 20 nt, Shigella flexneri 2a str. 301
acgcugauuuuuuuucaacc

SEQ ID NO: 1968177 - RNA, 14 nt, Shigella flexneri 2a str. 301
acgcugccgcuucu

SEQ ID NO: 1968178 - RNA, 20 nt, Shigella flexneri 2a str. 301
acgcugucggcaagauacug

SEQ ID NO: 1968179 - RNA, 22 nt, Shigella flexneri 2a str. 301
acgcuguccggcgcacuggugc

SEQ ID NO: 1968180 - RNA, 13 nt, Shigella flexneri 2a str. 301
acgcuggcccagu

SEQ ID NO: 1968181 - RNA, 15 nt, Shigella flexneri 2a str. 301
acgcuguaauuacca

SEQ ID NO: 1968182 - RNA, 14 nt, Shigella flexneri 2a str. 301
acgcuuaucaggcc

SEQ ID NO: 1968183 - RNA, 16 nt, Shigella flexneri 2a str. 301
acgcuuaacgcgucuu

SEQ ID NO: 1968184 - RNA, 19 nt, Shigella flexneri 2a str. 301
acgcuuaucaggccuacaa

SEQ ID NO: 1968185 - RNA, 15 nt, Shigella flexneri 2a str. 301
acgcuuaucccagcc

SEQ ID NO: 1968186 - RNA, 22 nt, Shigella flexneri 2a str. 301
acggcauuuccgccaaucaaga

SEQ ID NO: 1968187 - RNA, 13 nt, Shigella flexneri 2a str. 301
acggcaucgccau

SEQ ID NO: 1968188 - RNA, 16 nt, Shigella flexneri 2a str. 301
acggcauacguugcag

SEQ ID NO: 1968189 - RNA, 21 nt, Shigella flexneri 2a str. 301
acggcaccacauucugcaucg

SEQ ID NO: 1968190 - RNA, 21 nt, Shigella flexneri 2a str. 301
acggcagaaguaguugcuguc

SEQ ID NO: 1968191 - RNA, 16 nt, Shigella flexneri 2a str. 301
acggcaacacgccugg

SEQ ID NO: 1968192 - RNA, 14 nt, Shigella flexneri 2a str. 301
acggaugccaauca

SEQ ID NO: 1968193 - RNA, 13 nt, Shigella flexneri 2a str. 301
agaccgcagaagc

SEQ ID NO: 1968194 - RNA, 15 nt, Shigella flexneri 2a str. 301
agaccgcuucugcgu

SEQ ID NO: 1968195 - RNA, 22 nt, Shigella flexneri 2a str. 301
agaccuuuacggcuugcgcgca

SEQ ID NO: 1968196 - RNA, 13 nt, Shigella flexneri 2a str. 301
agacacauugcgg

SEQ ID NO: 1968197 - RNA, 14 nt, Shigella flexneri 2a str. 301
agaccaaucaccac

SEQ ID NO: 1968198 - RNA, 17 nt, Shigella flexneri 2a str. 301
agacaucaccaguaccg

SEQ ID NO: 1968199 - RNA, 16 nt, Shigella flexneri 2a str. 301
agacacugacgcgucu

SEQ ID NO: 1968200 - RNA, 14 nt, Shigella flexneri 2a str. 301
agaccaauccagcc

SEQ ID NO: 1968201 - RNA, 19 nt, Shigella flexneri 2a str. 301
agaccagacugcuccugua

SEQ ID NO: 1968202 - RNA, 14 nt, Shigella flexneri 2a str. 301
agacgcgucagcgu

SEQ ID NO: 1968203 - RNA, 15 nt, Shigella flexneri 2a str. 301
agacgguacccgcug

SEQ ID NO: 1968204 - RNA, 20 nt, Shigella flexneri 2a str. 301
agacggcgcaacauccgcuu

SEQ ID NO: 1968205 - RNA, 20 nt, Shigella flexneri 2a str. 301
agacuauuuuuuugauaauc

SEQ ID NO: 1968206 - RNA, 18 nt, Shigella flexneri 2a str. 301
agagaucuugcgcgacca

SEQ ID NO: 1968207 - RNA, 20 nt, Shigella flexneri 2a str. 301
agacuuaauccgggcaugau

SEQ ID NO: 1968208 - RNA, 14 nt, Shigella flexneri 2a str. 301
agacugggcaagau

SEQ ID NO: 1968209 - RNA, 13 nt, Shigella flexneri 2a str. 301
agacuuugcugcc

SEQ ID NO: 1968210 - RNA, 15 nt, Shigella flexneri 2a str. 301
agacuuaauccgggc

SEQ ID NO: 1968211 - RNA, 22 nt, Shigella flexneri 2a str. 301
agagacuauuucuucaucggua

SEQ ID NO: 1968212 - RNA, 17 nt, Shigella flexneri 2a str. 301
agagaagcacguucauc

SEQ ID NO: 1968213 - RNA, 13 nt, Shigella flexneri 2a str. 301
agaugcagcggua

SEQ ID NO: 1968214 - RNA, 21 nt, Shigella flexneri 2a str. 301
agaugcggcgugaacgccuua

SEQ ID NO: 1968215 - RNA, 21 nt, Shigella flexneri 2a str. 301
agauguacgccagugcucccg

SEQ ID NO: 1968216 - RNA, 12 nt, Shigella flexneri 2a str. 301
agauggcuucau

SEQ ID NO: 1968217 - RNA, 15 nt, Shigella flexneri 2a str. 301
agaugaaaacgcuga

SEQ ID NO: 1968218 - RNA, 21 nt, Shigella flexneri 2a str. 301
agaucguugccgaagcggcgu

SEQ ID NO: 1968219 - RNA, 20 nt, Shigella flexneri 2a str. 301
agagugguuagagcacagau

SEQ ID NO: 1968220 - RNA, 14 nt, Shigella flexneri 2a str. 301
agaguugagcaguc

SEQ ID NO: 1968221 - RNA, 23 nt, Shigella flexneri 2a str. 301
agaguucuacuccaguuccggac

SEQ ID NO: 1968222 - RNA, 14 nt, Shigella flexneri 2a str. 301
agauaaaucacgcu

SEQ ID NO: 1968223 - RNA, 16 nt, Shigella flexneri 2a str. 301
agagcuugugcaccag

SEQ ID NO: 1968224 - RNA, 23 nt, Shigella flexneri 2a str. 301
agauccauaagguccuccagcuc

SEQ ID NO: 1968225 - RNA, 17 nt, Shigella flexneri 2a str. 301
agauccagcaccuuuug

SEQ ID NO: 1968226 - RNA, 18 nt, Shigella flexneri 2a str. 301
agauaauagauuugcgaa

SEQ ID NO: 1968227 - RNA, 14 nt, Shigella flexneri 2a str. 301
agauagaacugcau

SEQ ID NO: 1968228 - RNA, 14 nt, Shigella flexneri 2a str. 301
agauacggcgcauc

SEQ ID NO: 1968229 - RNA, 21 nt, Shigella flexneri 2a str. 301
agauauaggucacaucaccgc

SEQ ID NO: 1968230 - RNA, 16 nt, Shigella flexneri 2a str. 301
agauauuucaccagcg

SEQ ID NO: 1968231 - RNA, 13 nt, Shigella flexneri 2a str. 301
agauagccagcaa

SEQ ID NO: 1968232 - RNA, 16 nt, Shigella flexneri 2a str. 301
acuuuuggaccacgga

SEQ ID NO: 1968233 - RNA, 22 nt, Shigella flexneri 2a str. 301
acuuuuggggugcaguucagaa

SEQ ID NO: 1968234 - RNA, 22 nt, Shigella flexneri 2a str. 301
acuuuugaaugaguacugauga

SEQ ID NO: 1968235 - RNA, 21 nt, Shigella flexneri 2a str. 301
acuuugucgaucuccgccuga

SEQ ID NO: 1968236 - RNA, 20 nt, Shigella flexneri 2a str. 301
acuuccggacguucagccau

SEQ ID NO: 1968237 - RNA, 16 nt, Shigella flexneri 2a str. 301
acuuccaccagcggcu

SEQ ID NO: 1968238 - RNA, 23 nt, Shigella flexneri 2a str. 301
acuuccugcggagcaaccugcac

SEQ ID NO: 1968239 - RNA, 13 nt, Shigella flexneri 2a str. 301
agaaaccgcuauu

SEQ ID NO: 1968240 - RNA, 15 nt, Shigella flexneri 2a str. 301
agaaacaaccugagc

SEQ ID NO: 1968241 - RNA, 14 nt, Shigella flexneri 2a str. 301
agaaacagccauaa

SEQ ID NO: 1968242 - RNA, 24 nt, Shigella flexneri 2a str. 301
agaaagcugcugaccaccagcacg

SEQ ID NO: 1968243 - RNA, 13 nt, Shigella flexneri 2a str. 301
agaaacucaguug

SEQ ID NO: 1968244 - RNA, 18 nt, Shigella flexneri 2a str. 301
agaaauccggggcuguuu

SEQ ID NO: 1968245 - RNA, 15 nt, Shigella flexneri 2a str. 301
agaaauaacgccgga

SEQ ID NO: 1968246 - RNA, 19 nt, Shigella flexneri 2a str. 301
agaaauaccccgccagcag

SEQ ID NO: 1968247 - RNA, 18 nt, Shigella flexneri 2a str. 301
agaacaagauugccugau

SEQ ID NO: 1968248 - RNA, 12 nt, Shigella flexneri 2a str. 301
agaagcuuaccg

SEQ ID NO: 1968249 - RNA, 22 nt, Shigella flexneri 2a str. 301
agaagcauuuuacauccugaua

SEQ ID NO: 1968250 - RNA, 20 nt, Shigella flexneri 2a str. 301
agaagagaggcgugccaggu

SEQ ID NO: 1968251 - RNA, 21 nt, Shigella flexneri 2a str. 301
agaagcaugaacauugcugcu

SEQ ID NO: 1968252 - RNA, 15 nt, Shigella flexneri 2a str. 301
agaacuucugcaacg

SEQ ID NO: 1968253 - RNA, 20 nt, Shigella flexneri 2a str. 301
agaagaaagcaaugaaauuc

SEQ ID NO: 1968254 - RNA, 21 nt, Shigella flexneri 2a str. 301
agaacuuuaucgaucacaucc

SEQ ID NO: 1968255 - RNA, 15 nt, Shigella flexneri 2a str. 301
agaaccugaacgccg

SEQ ID NO: 1968256 - RNA, 13 nt, Shigella flexneri 2a str. 301
agaaccacaauga

SEQ ID NO: 1968257 - RNA, 19 nt, Shigella flexneri 2a str. 301
agaauaguuugauuaacgc

SEQ ID NO: 1968258 - RNA, 13 nt, Shigella flexneri 2a str. 301
agaagguugccau

SEQ ID NO: 1968259 - RNA, 16 nt, Shigella flexneri 2a str. 301
agaauccggugccuua

SEQ ID NO: 1968260 - RNA, 16 nt, Shigella flexneri 2a str. 301
agaauccccacugcau

SEQ ID NO: 1968261 - RNA, 14 nt, Shigella flexneri 2a str. 301
agaaucgccagcau

SEQ ID NO: 1968262 - RNA, 17 nt, Shigella flexneri 2a str. 301
agaauuuguaggccgga

SEQ ID NO: 1968263 - RNA, 18 nt, Shigella flexneri 2a str. 301
agaaugccugugcgacag

SEQ ID NO: 1968264 - RNA, 20 nt, Shigella flexneri 2a str. 301
acugcaucagcgccuuacca

SEQ ID NO: 1968265 - RNA, 21 nt, Shigella flexneri 2a str. 301
acugccaguaaagcagcgaag

SEQ ID NO: 1968266 - RNA, 14 nt, Shigella flexneri 2a str. 301
acugcaaaucacca

SEQ ID NO: 1968267 - RNA, 15 nt, Shigella flexneri 2a str. 301
acugcaaaucaccac

SEQ ID NO: 1968268 - RNA, 22 nt, Shigella flexneri 2a str. 301
acugaucgucaucaaacggcau

SEQ ID NO: 1968269 - RNA, 21 nt, Shigella flexneri 2a str. 301
acugaugcacacacgcgcuga

SEQ ID NO: 1968270 - RNA, 15 nt, Shigella flexneri 2a str. 301
acugaucaucgccca

SEQ ID NO: 1968271 - RNA, 14 nt, Shigella flexneri 2a str. 301
acugaaggcgcauu

SEQ ID NO: 1968272 - RNA, 13 nt, Shigella flexneri 2a str. 301
acugaaaggcgcu

SEQ ID NO: 1968273 - RNA, 15 nt, Shigella flexneri 2a str. 301
acugaccacaaaggc

SEQ ID NO: 1968274 - RNA, 16 nt, Shigella flexneri 2a str. 301
acuuacacaucaagau

SEQ ID NO: 1968275 - RNA, 22 nt, Shigella flexneri 2a str. 301
acuguuucgcgguaaacugcau

SEQ ID NO: 1968276 - RNA, 17 nt, Shigella flexneri 2a str. 301
acugcgugcugagcggc

SEQ ID NO: 1968277 - RNA, 19 nt, Shigella flexneri 2a str. 301
acugccggaugcaucgcau

SEQ ID NO: 1968278 - RNA, 12 nt, Shigella flexneri 2a str. 301
acugcgccgcuc

SEQ ID NO: 1968279 - RNA, 14 nt, Shigella flexneri 2a str. 301
acugcgccgcucag

SEQ ID NO: 1968280 - RNA, 17 nt, Shigella flexneri 2a str. 301
acugcgcccgccagcau

SEQ ID NO: 1968281 - RNA, 19 nt, Shigella flexneri 2a str. 301
gccagcaucggcagcgcca

SEQ ID NO: 1968282 - RNA, 18 nt, Shigella flexneri 2a str. 301
gccagcauggcaccugcg

SEQ ID NO: 1968283 - RNA, 21 nt, Shigella flexneri 2a str. 301
gccacuucggugcgguuacgu

SEQ ID NO: 1968284 - RNA, 20 nt, Shigella flexneri 2a str. 301
gccacuucguaaccagccug

SEQ ID NO: 1968285 - RNA, 19 nt, Shigella flexneri 2a str. 301
gccagcggcguucgcguaa

SEQ ID NO: 1968286 - RNA, 19 nt, Shigella flexneri 2a str. 301
gccagcggcuccccgcuau

SEQ ID NO: 1968287 - RNA, 14 nt, Shigella flexneri 2a str. 301
gccagccuucacga

SEQ ID NO: 1968288 - RNA, 20 nt, Shigella flexneri 2a str. 301
gccagccgccgcuaucggca

SEQ ID NO: 1968289 - RNA, 22 nt, Shigella flexneri 2a str. 301
gccaggcuuuccgucagcggca

SEQ ID NO: 1968290 - RNA, 16 nt, Shigella flexneri 2a str. 301
gccaguaagcagucca

SEQ ID NO: 1968291 - RNA, 12 nt, Shigella flexneri 2a str. 301
gccaguaagcag

SEQ ID NO: 1968292 - RNA, 20 nt, Shigella flexneri 2a str. 301
gccaguaagacaccccacag

SEQ ID NO: 1968293 - RNA, 16 nt, Shigella flexneri 2a str. 301
gccaguaacagaacgc

SEQ ID NO: 1968294 - RNA, 18 nt, Shigella flexneri 2a str. 301
gccaguaacagaacgcau

SEQ ID NO: 1968295 - RNA, 15 nt, Shigella flexneri 2a str. 301
gccaguaaccuuuca

SEQ ID NO: 1968296 - RNA, 14 nt, Shigella flexneri 2a str. 301
gccaguaaucacga

SEQ ID NO: 1968297 - RNA, 16 nt, Shigella flexneri 2a str. 301
gccagcgugucgagca

SEQ ID NO: 1968298 - RNA, 17 nt, Shigella flexneri 2a str. 301
gccagcuugcgauccug

SEQ ID NO: 1968299 - RNA, 15 nt, Shigella flexneri 2a str. 301
gccaacuugcccagg

SEQ ID NO: 1968300 - RNA, 13 nt, Shigella flexneri 2a str. 301
gccaauucccagc

SEQ ID NO: 1968301 - RNA, 20 nt, Shigella flexneri 2a str. 301
gccacagcgccaucugcagg

SEQ ID NO: 1968302 - RNA, 20 nt, Shigella flexneri 2a str. 301
gccaauacccguccacacgg

SEQ ID NO: 1968303 - RNA, 22 nt, Shigella flexneri 2a str. 301
gccaccacaccggaccagacga

SEQ ID NO: 1968304 - RNA, 22 nt, Shigella flexneri 2a str. 301
gccaccacaauugaccaguaau

SEQ ID NO: 1968305 - RNA, 13 nt, Shigella flexneri 2a str. 301
gccaccccacgau

SEQ ID NO: 1968306 - RNA, 17 nt, Shigella flexneri 2a str. 301
gccaccagguucaacag

SEQ ID NO: 1968307 - RNA, 17 nt, Shigella flexneri 2a str. 301
gccacuguuccggagaa

SEQ ID NO: 1968308 - RNA, 18 nt, Shigella flexneri 2a str. 301
gccacgcuucaaucugau

SEQ ID NO: 1968309 - RNA, 20 nt, Shigella flexneri 2a str. 301
gccacgcuucaaucugauau

SEQ ID NO: 1968310 - RNA, 18 nt, Shigella flexneri 2a str. 301
gccacgcuuaaccccggg

SEQ ID NO: 1968311 - RNA, 18 nt, Shigella flexneri 2a str. 301
gccaccggcaaucugcug

SEQ ID NO: 1968312 - RNA, 18 nt, Shigella flexneri 2a str. 301
gccaccgcgccgggcaga

SEQ ID NO: 1968313 - RNA, 17 nt, Shigella flexneri 2a str. 301
gccaccgcccagagaau

SEQ ID NO: 1968314 - RNA, 19 nt, Shigella flexneri 2a str. 301
gcccaaucaucgcggcaca

SEQ ID NO: 1968315 - RNA, 22 nt, Shigella flexneri 2a str. 301
gcccaauauccugagccggaac

SEQ ID NO: 1968316 - RNA, 22 nt, Shigella flexneri 2a str. 301
gcccaacuaaaugcugcagcca

SEQ ID NO: 1968317 - RNA, 20 nt, Shigella flexneri 2a str. 301
gccauuuuuucgauaaucaa

SEQ ID NO: 1968318 - RNA, 22 nt, Shigella flexneri 2a str. 301
gcccaccauguucacugccgua

SEQ ID NO: 1968319 - RNA, 18 nt, Shigella flexneri 2a str. 301
gccagucuuccaucacaa

SEQ ID NO: 1968320 - RNA, 21 nt, Shigella flexneri 2a str. 301
gccauguuuaccaucugcgcc

SEQ ID NO: 1968321 - RNA, 23 nt, Shigella flexneri 2a str. 301
gccauugcccgaugcgcaaacuu

SEQ ID NO: 1968322 - RNA, 15 nt, Shigella flexneri 2a str. 301
gccauuuccagcgcu

SEQ ID NO: 1968323 - RNA, 17 nt, Shigella flexneri 2a str. 301
gcccacuccagcuaucg

SEQ ID NO: 1968324 - RNA, 16 nt, Shigella flexneri 2a str. 301
gcccacuuucugcgca

SEQ ID NO: 1968325 - RNA, 23 nt, Shigella flexneri 2a str. 301
gcccacggcuaccguugcggcgu

SEQ ID NO: 1968326 - RNA, 18 nt, Shigella flexneri 2a str. 301
gcccaccugcggcaccua

SEQ ID NO: 1968327 - RNA, 13 nt, Shigella flexneri 2a str. 301
gcccagcaucaga

SEQ ID NO: 1968328 - RNA, 13 nt, Shigella flexneri 2a str. 301
gcccagcgcuuca

SEQ ID NO: 1968329 - RNA, 16 nt, Shigella flexneri 2a str. 301
gcccagcgcgccgcca

SEQ ID NO: 1968330 - RNA, 21 nt, Shigella flexneri 2a str. 301
gcccagcgucuaaucgcuuua

SEQ ID NO: 1968331 - RNA, 23 nt, Shigella flexneri 2a str. 301
gccccaaugcguuccagcauguu

SEQ ID NO: 1968332 - RNA, 14 nt, Shigella flexneri 2a str. 301
gcccauccggcgaa

SEQ ID NO: 1968333 - RNA, 15 nt, Shigella flexneri 2a str. 301
gcccauagacagggu

SEQ ID NO: 1968334 - RNA, 20 nt, Shigella flexneri 2a str. 301
aagacgcgccagcgucgcau

SEQ ID NO: 1968335 - RNA, 20 nt, Shigella flexneri 2a str. 301
aagacgcgcuagcgucgcau

SEQ ID NO: 1968336 - RNA, 21 nt, Shigella flexneri 2a str. 301
aagacgcgaccggcgucgcau

SEQ ID NO: 1968337 - RNA, 21 nt, Shigella flexneri 2a str. 301
aagacgcgacaagcgucgcau

SEQ ID NO: 1968338 - RNA, 14 nt, Shigella flexneri 2a str. 301
aagacgccguccau

SEQ ID NO: 1968339 - RNA, 20 nt, Shigella flexneri 2a str. 301
aagacgccccggcgucgcau

SEQ ID NO: 1968340 - RNA, 18 nt, Shigella flexneri 2a str. 301
aagagaggcgugccaggu

SEQ ID NO: 1968341 - RNA, 18 nt, Shigella flexneri 2a str. 301
gccccguagccaugauga

SEQ ID NO: 1968342 - RNA, 17 nt, Shigella flexneri 2a str. 301
gccccuaagcgccggac

SEQ ID NO: 1968343 - RNA, 13 nt, Shigella flexneri 2a str. 301
gcccgcgcguuaa

SEQ ID NO: 1968344 - RNA, 17 nt, Shigella flexneri 2a str. 301
gcccgcgcugucgggca

SEQ ID NO: 1968345 - RNA, 22 nt, Shigella flexneri 2a str. 301
gcccgcgggcgaauuaucggca

SEQ ID NO: 1968346 - RNA, 16 nt, Shigella flexneri 2a str. 301
gcccgauagaaaccau

SEQ ID NO: 1968347 - RNA, 16 nt, Shigella flexneri 2a str. 301
gccgcuaacagcagca

SEQ ID NO: 1968348 - RNA, 15 nt, Shigella flexneri 2a str. 301
gccgcuaccagcgcg

SEQ ID NO: 1968349 - RNA, 19 nt, Shigella flexneri 2a str. 301
gccgcuaucgcugauauac

SEQ ID NO: 1968350 - RNA, 14 nt, Shigella flexneri 2a str. 301
gccgcuaucggcaa

SEQ ID NO: 1968351 - RNA, 14 nt, Shigella flexneri 2a str. 301
gccgcguaccgcag

SEQ ID NO: 1968352 - RNA, 13 nt, Shigella flexneri 2a str. 301
gccgccgcuuucg

SEQ ID NO: 1968353 - RNA, 21 nt, Shigella flexneri 2a str. 301
gccgccagacaauugccgcca

SEQ ID NO: 1968354 - RNA, 21 nt, Shigella flexneri 2a str. 301
gccgcgcaaauccacguucca

SEQ ID NO: 1968355 - RNA, 12 nt, Shigella flexneri 2a str. 301
gccgcgagaaua

SEQ ID NO: 1968356 - RNA, 20 nt, Shigella flexneri 2a str. 301
gccgcgagaauaugcugaau

SEQ ID NO: 1968357 - RNA, 20 nt, Shigella flexneri 2a str. 301
gccgcgaaccggaccagcaa

SEQ ID NO: 1968358 - RNA, 21 nt, Shigella flexneri 2a str. 301
gcccuuucagcgccuucagau

SEQ ID NO: 1968359 - RNA, 20 nt, Shigella flexneri 2a str. 301
gcccuuuccugacucagcau

SEQ ID NO: 1968360 - RNA, 13 nt, Shigella flexneri 2a str. 301
gccgaccgcuuca

SEQ ID NO: 1968361 - RNA, 15 nt, Shigella flexneri 2a str. 301
gcccucgaucggcuc

SEQ ID NO: 1968362 - RNA, 15 nt, Shigella flexneri 2a str. 301
gcccuggaugcaguc

SEQ ID NO: 1968363 - RNA, 17 nt, Shigella flexneri 2a str. 301
aagcaaaaacgcauacg

SEQ ID NO: 1968364 - RNA, 16 nt, Shigella flexneri 2a str. 301
aagcaaaacgccgguu

SEQ ID NO: 1968365 - RNA, 13 nt, Shigella flexneri 2a str. 301
aagcacugccaga

SEQ ID NO: 1968366 - RNA, 14 nt, Shigella flexneri 2a str. 301
gccgauguugcaug

SEQ ID NO: 1968367 - RNA, 16 nt, Shigella flexneri 2a str. 301
gccgauggcgcaaacu

SEQ ID NO: 1968368 - RNA, 16 nt, Shigella flexneri 2a str. 301
gccgaugggcgccauu

SEQ ID NO: 1968369 - RNA, 12 nt, Shigella flexneri 2a str. 301
gccgcauccggc

SEQ ID NO: 1968370 - RNA, 14 nt, Shigella flexneri 2a str. 301
gccgcauccggcaa

SEQ ID NO: 1968371 - RNA, 19 nt, Shigella flexneri 2a str. 301
gccgcauccgacacuggca

SEQ ID NO: 1968372 - RNA, 16 nt, Shigella flexneri 2a str. 301
gccgcauccggcaguu

SEQ ID NO: 1968373 - RNA, 15 nt, Shigella flexneri 2a str. 301
gccgcauccgacacu

SEQ ID NO: 1968374 - RNA, 14 nt, Shigella flexneri 2a str. 301
gccgccaccgauug

SEQ ID NO: 1968375 - RNA, 18 nt, Shigella flexneri 2a str. 301
gccgcacuuacagcaacg

SEQ ID NO: 1968376 - RNA, 16 nt, Shigella flexneri 2a str. 301
gccgcacuuacagcaa

SEQ ID NO: 1968377 - RNA, 17 nt, Shigella flexneri 2a str. 301
gccgaugccagaaagcg

SEQ ID NO: 1968378 - RNA, 15 nt, Shigella flexneri 2a str. 301
gccgaugccagaaag

SEQ ID NO: 1968379 - RNA, 15 nt, Shigella flexneri 2a str. 301
gccgaugccgacgau

SEQ ID NO: 1968380 - RNA, 20 nt, Shigella flexneri 2a str. 301
gccgaggugcucuccacgcu

SEQ ID NO: 1968381 - RNA, 20 nt, Shigella flexneri 2a str. 301
gccgauccggacaugcugca

SEQ ID NO: 1968382 - RNA, 12 nt, Shigella flexneri 2a str. 301
aagauuacugac

SEQ ID NO: 1968383 - RNA, 21 nt, Shigella flexneri 2a str. 301
aagaugcgucagcaucgcauc

SEQ ID NO: 1968384 - RNA, 23 nt, Shigella flexneri 2a str. 301
gcacacagggcgcuagccaacuu

SEQ ID NO: 1968385 - RNA, 18 nt, Shigella flexneri 2a str. 301
gcacaauuaccugucgcc

SEQ ID NO: 1968386 - RNA, 19 nt, Shigella flexneri 2a str. 301
gcacaauuaccugucgcca

SEQ ID NO: 1968387 - RNA, 15 nt, Shigella flexneri 2a str. 301
gcacaaucacgucag

SEQ ID NO: 1968388 - RNA, 18 nt, Shigella flexneri 2a str. 301
gcacaaagcgaugaugcu

SEQ ID NO: 1968389 - RNA, 24 nt, Shigella flexneri 2a str. 301
gcacaaucaaaucgacagccaguu

SEQ ID NO: 1968390 - RNA, 20 nt, Shigella flexneri 2a str. 301
gcacaaacauccaucugcuu

SEQ ID NO: 1968391 - RNA, 19 nt, Shigella flexneri 2a str. 301
gcaauuggucgcgcaaauu

SEQ ID NO: 1968392 - RNA, 13 nt, Shigella flexneri 2a str. 301
gcaacauaccgga

SEQ ID NO: 1968393 - RNA, 18 nt, Shigella flexneri 2a str. 301
gcaccacauucugcaucg

SEQ ID NO: 1968394 - RNA, 15 nt, Shigella flexneri 2a str. 301
gcaccaccagcagcu

SEQ ID NO: 1968395 - RNA, 20 nt, Shigella flexneri 2a str. 301
gcacauuucccggccacgca

SEQ ID NO: 1968396 - RNA, 22 nt, Shigella flexneri 2a str. 301
gcacaguuauaaaaugauacgc

SEQ ID NO: 1968397 - RNA, 15 nt, Shigella flexneri 2a str. 301
gcacaucagccagau

SEQ ID NO: 1968398 - RNA, 20 nt, Shigella flexneri 2a str. 301
gcacauugauggcgcuuucg

SEQ ID NO: 1968399 - RNA, 14 nt, Shigella flexneri 2a str. 301
gcacauagcaacuu

SEQ ID NO: 1968400 - RNA, 22 nt, Shigella flexneri 2a str. 301
gcaccagcaacaagccagucca

SEQ ID NO: 1968401 - RNA, 21 nt, Shigella flexneri 2a str. 301
gcaccagaaaguuuuucaaca

SEQ ID NO: 1968402 - RNA, 18 nt, Shigella flexneri 2a str. 301
gcaccgcacagaccauca

SEQ ID NO: 1968403 - RNA, 23 nt, Shigella flexneri 2a str. 301
gcaccgcacuggcuuuccagcgu

SEQ ID NO: 1968404 - RNA, 16 nt, Shigella flexneri 2a str. 301
gcaccuucacuggacg

SEQ ID NO: 1968405 - RNA, 15 nt, Shigella flexneri 2a str. 301
gcacgcccugauaaa

SEQ ID NO: 1968406 - RNA, 22 nt, Shigella flexneri 2a str. 301
gcacgcucuauggcaccuguug

SEQ ID NO: 1968407 - RNA, 19 nt, Shigella flexneri 2a str. 301
gcacguaggcgaucccggc

SEQ ID NO: 1968408 - RNA, 14 nt, Shigella flexneri 2a str. 301
gcagcaagccaucg

SEQ ID NO: 1968409 - RNA, 19 nt, Shigella flexneri 2a str. 301
gcagcaacucuuuuuccug

SEQ ID NO: 1968410 - RNA, 23 nt, Shigella flexneri 2a str. 301
gcagcaaggcuauucagcaguuc

SEQ ID NO: 1968411 - RNA, 19 nt, Shigella flexneri 2a str. 301
gcagcaagccaucguuaau

SEQ ID NO: 1968412 - RNA, 14 nt, Shigella flexneri 2a str. 301
gcagauagcccgga

SEQ ID NO: 1968413 - RNA, 17 nt, Shigella flexneri 2a str. 301
gcagauacauugccacc

SEQ ID NO: 1968414 - RNA, 21 nt, Shigella flexneri 2a str. 301
gcagauucagccacauuugcg

SEQ ID NO: 1968415 - RNA, 15 nt, Shigella flexneri 2a str. 301
gcagauuaugccuga

SEQ ID NO: 1968416 - RNA, 16 nt, Shigella flexneri 2a str. 301
gcagaacgcuuucgca

SEQ ID NO: 1968417 - RNA, 16 nt, Shigella flexneri 2a str. 301
gcagacaauaucggca

SEQ ID NO: 1968418 - RNA, 20 nt, Shigella flexneri 2a str. 301
gcagacaugacgcccggcaa

SEQ ID NO: 1968419 - RNA, 15 nt, Shigella flexneri 2a str. 301
gcagaaagcgacuuu

SEQ ID NO: 1968420 - RNA, 18 nt, Shigella flexneri 2a str. 301
gcagaaaaaacaaacggc

SEQ ID NO: 1968421 - RNA, 15 nt, Shigella flexneri 2a str. 301
gcagaaaaaccguaa

SEQ ID NO: 1968422 - RNA, 17 nt, Shigella flexneri 2a str. 301
gcagaaaaagagcauca

SEQ ID NO: 1968423 - RNA, 22 nt, Shigella flexneri 2a str. 301
gcacuuugccagaaauccaggc

SEQ ID NO: 1968424 - RNA, 19 nt, Shigella flexneri 2a str. 301
gcacuuucgccugcggcgc

SEQ ID NO: 1968425 - RNA, 19 nt, Shigella flexneri 2a str. 301
gcacuugguucgacggcca

SEQ ID NO: 1968426 - RNA, 18 nt, Shigella flexneri 2a str. 301
gcacugucuaacaacaug

SEQ ID NO: 1968427 - RNA, 14 nt, Shigella flexneri 2a str. 301
gcacucgcccugac

SEQ ID NO: 1968428 - RNA, 19 nt, Shigella flexneri 2a str. 301
gcacugcaucaaugccgga

SEQ ID NO: 1968429 - RNA, 17 nt, Shigella flexneri 2a str. 301
gcacgucuuugccgcgc

SEQ ID NO: 1968430 - RNA, 19 nt, Shigella flexneri 2a str. 301
gcacuaccgcccgaugaau

SEQ ID NO: 1968431 - RNA, 18 nt, Shigella flexneri 2a str. 301
gcacuaaguucugcccug

SEQ ID NO: 1968432 - RNA, 12 nt, Shigella flexneri 2a str. 301
gcacuccgcugu

SEQ ID NO: 1968433 - RNA, 21 nt, Shigella flexneri 2a str. 301
gcaggaaauacguaggccuga

SEQ ID NO: 1968434 - RNA, 20 nt, Shigella flexneri 2a str. 301
gcaggaaaagguaggccuga

SEQ ID NO: 1968435 - RNA, 20 nt, Shigella flexneri 2a str. 301
gcaggaacgauguaggccug

SEQ ID NO: 1968436 - RNA, 20 nt, Shigella flexneri 2a str. 301
gcaggaaucacguaggccug

SEQ ID NO: 1968437 - RNA, 21 nt, Shigella flexneri 2a str. 301
gcaggaucgacugcaaaccau

SEQ ID NO: 1968438 - RNA, 22 nt, Shigella flexneri 2a str. 301
gcaggaucgacugcaaaccaug

SEQ ID NO: 1968439 - RNA, 21 nt, Shigella flexneri 2a str. 301
gcaggagcagccccugcgcca

SEQ ID NO: 1968440 - RNA, 15 nt, Shigella flexneri 2a str. 301
gcaggagcgccgaau

SEQ ID NO: 1968441 - RNA, 23 nt, Shigella flexneri 2a str. 301
gcagcuucacaaaggcuugcugc

SEQ ID NO: 1968442 - RNA, 17 nt, Shigella flexneri 2a str. 301
gcagcuuucagcagcgg

SEQ ID NO: 1968443 - RNA, 20 nt, Shigella flexneri 2a str. 301
gcagcuuucccuucaggcgu

SEQ ID NO: 1968444 - RNA, 14 nt, Shigella flexneri 2a str. 301
gcagcuugauuucc

SEQ ID NO: 1968445 - RNA, 22 nt, Shigella flexneri 2a str. 301
gcagcugggcgagggcaaaccu

SEQ ID NO: 1968446 - RNA, 20 nt, Shigella flexneri 2a str. 301
gcagcugguguaacugcgcc

SEQ ID NO: 1968447 - RNA, 18 nt, Shigella flexneri 2a str. 301
gcagcucaucaagcuguu

SEQ ID NO: 1968448 - RNA, 17 nt, Shigella flexneri 2a str. 301
gcagcgucgcaucaggc

SEQ ID NO: 1968449 - RNA, 18 nt, Shigella flexneri 2a str. 301
gcagcgaaccgucgagau

SEQ ID NO: 1968450 - RNA, 21 nt, Shigella flexneri 2a str. 301
gcaggaucugacuggcgagau

SEQ ID NO: 1968451 - RNA, 20 nt, Shigella flexneri 2a str. 301
gcaggaugggcaacgcgcau

SEQ ID NO: 1968452 - RNA, 18 nt, Shigella flexneri 2a str. 301
gcaggccacgaaucagca

SEQ ID NO: 1968453 - RNA, 15 nt, Shigella flexneri 2a str. 301
gcaggccugauaagc

SEQ ID NO: 1968454 - RNA, 13 nt, Shigella flexneri 2a str. 301
gcaggcgcaaugg

SEQ ID NO: 1968455 - RNA, 20 nt, Shigella flexneri 2a str. 301
gcaggcgauccuguucaaac

SEQ ID NO: 1968456 - RNA, 15 nt, Shigella flexneri 2a str. 301
gcaggcggcuucgca

SEQ ID NO: 1968457 - RNA, 23 nt, Shigella flexneri 2a str. 301
gcaggcguuuuuggcaucggcaa

SEQ ID NO: 1968458 - RNA, 21 nt, Shigella flexneri 2a str. 301
gcaggcuucaacacaggccgg

SEQ ID NO: 1968459 - RNA, 14 nt, Shigella flexneri 2a str. 301
gcaggcuucaacac

SEQ ID NO: 1968460 - RNA, 23 nt, Shigella flexneri 2a str. 301
gcaguaaaccacccaccagcgcc

SEQ ID NO: 1968461 - RNA, 18 nt, Shigella flexneri 2a str. 301
gcaguaaaucaauaucca

SEQ ID NO: 1968462 - RNA, 21 nt, Shigella flexneri 2a str. 301
gcaguaaaccacccaccagcg

SEQ ID NO: 1968463 - RNA, 13 nt, Shigella flexneri 2a str. 301
gcagguuccgcau

SEQ ID NO: 1968464 - RNA, 23 nt, Shigella flexneri 2a str. 301
gcaguaccuccuucacaguggcg

SEQ ID NO: 1968465 - RNA, 16 nt, Shigella flexneri 2a str. 301
gcaguacaguaccgaa

SEQ ID NO: 1968466 - RNA, 22 nt, Shigella flexneri 2a str. 301
gcaguagaucuuauaugcgucu

SEQ ID NO: 1968467 - RNA, 12 nt, Shigella flexneri 2a str. 301
gcagucacggcg

SEQ ID NO: 1968468 - RNA, 12 nt, Shigella flexneri 2a str. 301
aagaacugacuu

SEQ ID NO: 1968469 - RNA, 17 nt, Shigella flexneri 2a str. 301
aagaaagcaauauugau

SEQ ID NO: 1968470 - RNA, 17 nt, Shigella flexneri 2a str. 301
aagaagucauuggcuga

SEQ ID NO: 1968471 - RNA, 20 nt, Shigella flexneri 2a str. 301
gcaggucaugguaggccgga

SEQ ID NO: 1968472 - RNA, 19 nt, Shigella flexneri 2a str. 301
gcaggguggugacaccaug

SEQ ID NO: 1968473 - RNA, 17 nt, Shigella flexneri 2a str. 301
gcagggcggcaggcagc

SEQ ID NO: 1968474 - RNA, 16 nt, Shigella flexneri 2a str. 301
gaggggcggcucuccu

SEQ ID NO: 1968475 - RNA, 19 nt, Shigella flexneri 2a str. 301
gagggaaccuguucaacaa

SEQ ID NO: 1968476 - RNA, 16 nt, Shigella flexneri 2a str. 301
gagguaggcagucaua

SEQ ID NO: 1968477 - RNA, 16 nt, Shigella flexneri 2a str. 301
gaggacguucaccguc

SEQ ID NO: 1968478 - RNA, 20 nt, Shigella flexneri 2a str. 301
gagcuuuguucaugccggau

SEQ ID NO: 1968479 - RNA, 20 nt, Shigella flexneri 2a str. 301
gagcucccaggcuccgccag

SEQ ID NO: 1968480 - RNA, 23 nt, Shigella flexneri 2a str. 301
gagcuaaugcaaaucacgcugcu

SEQ ID NO: 1968481 - RNA, 21 nt, Shigella flexneri 2a str. 301
aacugccggaacugccugcuc

SEQ ID NO: 1968482 - RNA, 14 nt, Shigella flexneri 2a str. 301
aacugcccgaucaa

SEQ ID NO: 1968483 - RNA, 13 nt, Shigella flexneri 2a str. 301
aacugccagggcu

SEQ ID NO: 1968484 - RNA, 18 nt, Shigella flexneri 2a str. 301
aacugacugacuucaaca

SEQ ID NO: 1968485 - RNA, 19 nt, Shigella flexneri 2a str. 301
aacugaggcaauaaugacg

SEQ ID NO: 1968486 - RNA, 15 nt, Shigella flexneri 2a str. 301
aacucugcggcauca

SEQ ID NO: 1968487 - RNA, 17 nt, Shigella flexneri 2a str. 301
aacucgcugccagcacu

SEQ ID NO: 1968488 - RNA, 12 nt, Shigella flexneri 2a str. 301
aacucgcugcca

SEQ ID NO: 1968489 - RNA, 17 nt, Shigella flexneri 2a str. 301
gacgguuuuacgcuccc

SEQ ID NO: 1968490 - RNA, 15 nt, Shigella flexneri 2a str. 301
gagcggacugaacgc

SEQ ID NO: 1968491 - RNA, 13 nt, Shigella flexneri 2a str. 301
gagcgccaccauc

SEQ ID NO: 1968492 - RNA, 16 nt, Shigella flexneri 2a str. 301
gauauuucaccagcgc

SEQ ID NO: 1968493 - RNA, 16 nt, Shigella flexneri 2a str. 301
gauagcgcacgcgcuu

SEQ ID NO: 1968494 - RNA, 17 nt, Shigella flexneri 2a str. 301
gauaguguuuuauguuc

SEQ ID NO: 1968495 - RNA, 17 nt, Shigella flexneri 2a str. 301
gauauaaaccaucggcg

SEQ ID NO: 1968496 - RNA, 22 nt, Shigella flexneri 2a str. 301
gauagcgucauuucuacgggua

SEQ ID NO: 1968497 - RNA, 20 nt, Shigella flexneri 2a str. 301
gauauguucagaaagcgcca

SEQ ID NO: 1968498 - RNA, 14 nt, Shigella flexneri 2a str. 301
gauaugcgucagau

SEQ ID NO: 1968499 - RNA, 18 nt, Shigella flexneri 2a str. 301
gauauucgcucgccacuu

SEQ ID NO: 1968500 - RNA, 16 nt, Shigella flexneri 2a str. 301
gauauuccugaauggu

SEQ ID NO: 1968501 - RNA, 11 nt, Shigella flexneri 2a str. 301
gauauucagua

SEQ ID NO: 1968502 - RNA, 21 nt, Shigella flexneri 2a str. 301
gauauccagauccagcaccuu

SEQ ID NO: 1968503 - RNA, 14 nt, Shigella flexneri 2a str. 301
gauauccagcgccg

SEQ ID NO: 1968504 - RNA, 17 nt, Shigella flexneri 2a str. 301
gauauaaaaauccgccu

SEQ ID NO: 1968505 - RNA, 19 nt, Shigella flexneri 2a str. 301
gauacagccaaaucaucag

SEQ ID NO: 1968506 - RNA, 14 nt, Shigella flexneri 2a str. 301
gaguaacagauugu

SEQ ID NO: 1968507 - RNA, 20 nt, Shigella flexneri 2a str. 301
gauaaauucguuuucgcgcu

SEQ ID NO: 1968508 - RNA, 14 nt, Shigella flexneri 2a str. 301
gaucaucggccaga

SEQ ID NO: 1968509 - RNA, 14 nt, Shigella flexneri 2a str. 301
gaucagccaggcga

SEQ ID NO: 1968510 - RNA, 23 nt, Shigella flexneri 2a str. 301
gauccuggcggggauuauugccg

SEQ ID NO: 1968511 - RNA, 15 nt, Shigella flexneri 2a str. 301
gaucgaacagcagca

SEQ ID NO: 1968512 - RNA, 23 nt, Shigella flexneri 2a str. 301
gauccuguuggccaacccgcgug

SEQ ID NO: 1968513 - RNA, 20 nt, Shigella flexneri 2a str. 301
gauccucuaucuguuugcca

SEQ ID NO: 1968514 - RNA, 20 nt, Shigella flexneri 2a str. 301
gauggcuguuuucagcacca

SEQ ID NO: 1968515 - RNA, 23 nt, Shigella flexneri 2a str. 301
gaugggcaguugcgcgcgcaccu

SEQ ID NO: 1968516 - RNA, 20 nt, Shigella flexneri 2a str. 301
gauggcggcagccuccugca

SEQ ID NO: 1968517 - RNA, 21 nt, Shigella flexneri 2a str. 301
gauguacuucaacauaacgca

SEQ ID NO: 1968518 - RNA, 22 nt, Shigella flexneri 2a str. 301
gaugucagcgggaugccaguca

SEQ ID NO: 1968519 - RNA, 15 nt, Shigella flexneri 2a str. 301
gaugcgcuacgcuua

SEQ ID NO: 1968520 - RNA, 17 nt, Shigella flexneri 2a str. 301
gaugcgcuacgcucauc

SEQ ID NO: 1968521 - RNA, 11 nt, Shigella flexneri 2a str. 301
aacuucgcgag

SEQ ID NO: 1968522 - RNA, 19 nt, Shigella flexneri 2a str. 301
aacuucgccauuucgucgu

SEQ ID NO: 1968523 - RNA, 15 nt, Shigella flexneri 2a str. 301
aacuucccgcaucca

SEQ ID NO: 1968524 - RNA, 13 nt, Shigella flexneri 2a str. 301
aacuucagcagca

SEQ ID NO: 1968525 - RNA, 16 nt, Shigella flexneri 2a str. 301
aacuucacuuccccga

SEQ ID NO: 1968526 - RNA, 19 nt, Shigella flexneri 2a str. 301
gaugcgcgaacuggaugaa

SEQ ID NO: 1968527 - RNA, 13 nt, Shigella flexneri 2a str. 301
gaugcgccagcau

SEQ ID NO: 1968528 - RNA, 19 nt, Shigella flexneri 2a str. 301
gaugcgcccuugcaggcga

SEQ ID NO: 1968529 - RNA, 18 nt, Shigella flexneri 2a str. 301
gauggccaaccaugucga

SEQ ID NO: 1968530 - RNA, 18 nt, Shigella flexneri 2a str. 301
gauggaguaguugaucgc

SEQ ID NO: 1968531 - RNA, 18 nt, Shigella flexneri 2a str. 301
gauggaccgugccggacg

SEQ ID NO: 1968532 - RNA, 22 nt, Shigella flexneri 2a str. 301
aacuucucuucuuccgcuucaa

SEQ ID NO: 1968533 - RNA, 15 nt, Shigella flexneri 2a str. 301
gaugcuccuggcgaa

SEQ ID NO: 1968534 - RNA, 18 nt, Shigella flexneri 2a str. 301
gcaaauaacgccccggca

SEQ ID NO: 1968535 - RNA, 12 nt, Shigella flexneri 2a str. 301
gcaaauaccgga

SEQ ID NO: 1968536 - RNA, 21 nt, Shigella flexneri 2a str. 301
gcaaauaauccaccuggccug

SEQ ID NO: 1968537 - RNA, 19 nt, Shigella flexneri 2a str. 301
gcaaauagaugcugcgcuu

SEQ ID NO: 1968538 - RNA, 20 nt, Shigella flexneri 2a str. 301
gcaaaucugcgccuacggca

SEQ ID NO: 1968539 - RNA, 15 nt, Shigella flexneri 2a str. 301
gcaacagcaccagca

SEQ ID NO: 1968540 - RNA, 17 nt, Shigella flexneri 2a str. 301
gcaacagcaauacguuu

SEQ ID NO: 1968541 - RNA, 14 nt, Shigella flexneri 2a str. 301
gcaacagaacgcgc

SEQ ID NO: 1968542 - RNA, 14 nt, Shigella flexneri 2a str. 301
gcaaaccuggcaac

SEQ ID NO: 1968543 - RNA, 17 nt, Shigella flexneri 2a str. 301
gauuuucaccagcaucg

SEQ ID NO: 1968544 - RNA, 16 nt, Shigella flexneri 2a str. 301
gauuuguaggccggau

SEQ ID NO: 1968545 - RNA, 21 nt, Shigella flexneri 2a str. 301
gauucggcgcaaugauaucgc

SEQ ID NO: 1968546 - RNA, 16 nt, Shigella flexneri 2a str. 301
gauucggccaguaacc

SEQ ID NO: 1968547 - RNA, 15 nt, Shigella flexneri 2a str. 301
gauucggcaugauag

SEQ ID NO: 1968548 - RNA, 16 nt, Shigella flexneri 2a str. 301
gauucggcaugauagc

SEQ ID NO: 1968549 - RNA, 16 nt, Shigella flexneri 2a str. 301
gauuuaacaucuccac

SEQ ID NO: 1968550 - RNA, 23 nt, Shigella flexneri 2a str. 301
gauuuaaacaccugggcaauggu

SEQ ID NO: 1968551 - RNA, 12 nt, Shigella flexneri 2a str. 301
gauugccgauau

SEQ ID NO: 1968552 - RNA, 20 nt, Shigella flexneri 2a str. 301
gaugugcuucaucagacgcu

SEQ ID NO: 1968553 - RNA, 20 nt, Shigella flexneri 2a str. 301
gauguggcgugaacgccuua

SEQ ID NO: 1968554 - RNA, 18 nt, Shigella flexneri 2a str. 301
gauguugccacacgccca

SEQ ID NO: 1968555 - RNA, 13 nt, Shigella flexneri 2a str. 301
gauguuccgccau

SEQ ID NO: 1968556 - RNA, 20 nt, Shigella flexneri 2a str. 301
gauuaccagcgacaucaccg

SEQ ID NO: 1968557 - RNA, 22 nt, Shigella flexneri 2a str. 301
gauuacacaaauccagcaccgu

SEQ ID NO: 1968558 - RNA, 12 nt, Shigella flexneri 2a str. 301
gauucagcaccg

SEQ ID NO: 1968559 - RNA, 18 nt, Shigella flexneri 2a str. 301
gauucagccacauuugcg

SEQ ID NO: 1968560 - RNA, 16 nt, Shigella flexneri 2a str. 301
gauucacauccggcca

SEQ ID NO: 1968561 - RNA, 12 nt, Shigella flexneri 2a str. 301
gauuacgcaccg

SEQ ID NO: 1968562 - RNA, 18 nt, Shigella flexneri 2a str. 301
gauuacgcaccgggcagg

SEQ ID NO: 1968563 - RNA, 22 nt, Shigella flexneri 2a str. 301
gaugaauuugugaacagccugu

SEQ ID NO: 1968564 - RNA, 23 nt, Shigella flexneri 2a str. 301
aacugcuggcuuaaaaaacggau

SEQ ID NO: 1968565 - RNA, 14 nt, Shigella flexneri 2a str. 301
aacugcugacgcag

SEQ ID NO: 1968566 - RNA, 15 nt, Shigella flexneri 2a str. 301
aacugcuccgggaau

SEQ ID NO: 1968567 - RNA, 20 nt, Shigella flexneri 2a str. 301
gaugaagaacucaaagcggu

SEQ ID NO: 1968568 - RNA, 23 nt, Shigella flexneri 2a str. 301
gaugaauaaaauucuccagcgcc

SEQ ID NO: 1968569 - RNA, 11 nt, Shigella flexneri 2a str. 301
aacugccugau

SEQ ID NO: 1968570 - RNA, 16 nt, Shigella flexneri 2a str. 301
gaugacgccacuggcu

SEQ ID NO: 1968571 - RNA, 17 nt, Shigella flexneri 2a str. 301
gaucgccguaacgcccu

SEQ ID NO: 1968572 - RNA, 18 nt, Shigella flexneri 2a str. 301
gaucuuccgcgucauuca

SEQ ID NO: 1968573 - RNA, 20 nt, Shigella flexneri 2a str. 301
gaucucuucgccugccugca

SEQ ID NO: 1968574 - RNA, 15 nt, Shigella flexneri 2a str. 301
gaucugguaucccgu

SEQ ID NO: 1968575 - RNA, 15 nt, Shigella flexneri 2a str. 301
gaugcacagcacgcu

SEQ ID NO: 1968576 - RNA, 18 nt, Shigella flexneri 2a str. 301
aacugugcacccgcuuca

SEQ ID NO: 1968577 - RNA, 19 nt, Shigella flexneri 2a str. 301
aacuguugauccaggagcu

SEQ ID NO: 1968578 - RNA, 17 nt, Shigella flexneri 2a str. 301
aacugucaauaaacgcc

SEQ ID NO: 1968579 - RNA, 18 nt, Shigella flexneri 2a str. 301
aacugucaauaaacgccu

SEQ ID NO: 1968580 - RNA, 14 nt, Shigella flexneri 2a str. 301
gaugcaggccacca

SEQ ID NO: 1968581 - RNA, 14 nt, Shigella flexneri 2a str. 301
gaugcagugcggcu

SEQ ID NO: 1968582 - RNA, 22 nt, Shigella flexneri 2a str. 301
gaugccaguaaucacgaucucg

SEQ ID NO: 1968583 - RNA, 21 nt, Shigella flexneri 2a str. 301
gaugcaucgcauccgacauca

SEQ ID NO: 1968584 - RNA, 15 nt, Shigella flexneri 2a str. 301
gaugcaucagucacg

SEQ ID NO: 1968585 - RNA, 17 nt, Shigella flexneri 2a str. 301
gaugccacaaacuggcu

SEQ ID NO: 1968586 - RNA, 15 nt, Shigella flexneri 2a str. 301
gaugcccaugccaau

SEQ ID NO: 1968587 - RNA, 16 nt, Shigella flexneri 2a str. 301
gaugcccccagcagcg

SEQ ID NO: 1968588 - RNA, 12 nt, Shigella flexneri 2a str. 301
gaugaugccaag

SEQ ID NO: 1968589 - RNA, 16 nt, Shigella flexneri 2a str. 301
gaugauuacgcgcuca

SEQ ID NO: 1968590 - RNA, 19 nt, Shigella flexneri 2a str. 301
aacuguaaugaaucgucgg

SEQ ID NO: 1968591 - RNA, 14 nt, Shigella flexneri 2a str. 301
gaugaucaccugca

SEQ ID NO: 1968592 - RNA, 22 nt, Shigella flexneri 2a str. 301
gaugaucgucacgaucgcgcca

SEQ ID NO: 1968593 - RNA, 21 nt, Shigella flexneri 2a str. 301
gaugccguuccacccagcuca

SEQ ID NO: 1968594 - RNA, 18 nt, Shigella flexneri 2a str. 301
gaugccgugcagcacgga

SEQ ID NO: 1968595 - RNA, 18 nt, Shigella flexneri 2a str. 301
gaugcgacuugucaucau

SEQ ID NO: 1968596 - RNA, 13 nt, Shigella flexneri 2a str. 301
gaugcgacgcuua

SEQ ID NO: 1968597 - RNA, 15 nt, Shigella flexneri 2a str. 301
gaugccugaugcggc

SEQ ID NO: 1968598 - RNA, 21 nt, Shigella flexneri 2a str. 301
gaugcccgacuugagcgcagu

SEQ ID NO: 1968599 - RNA, 14 nt, Shigella flexneri 2a str. 301
cgucauuaccgcga

SEQ ID NO: 1968600 - RNA, 19 nt, Shigella flexneri 2a str. 301
cgucauucagcucgcuaaa

SEQ ID NO: 1968601 - RNA, 16 nt, Shigella flexneri 2a str. 301
cguccagcgaaccuuc

SEQ ID NO: 1968602 - RNA, 22 nt, Shigella flexneri 2a str. 301
cgucgaacgcugcgcgaccauc

SEQ ID NO: 1968603 - RNA, 18 nt, Shigella flexneri 2a str. 301
cgucccagccuugccaga

SEQ ID NO: 1968604 - RNA, 17 nt, Shigella flexneri 2a str. 301
cguccggcugccagcca

SEQ ID NO: 1968605 - RNA, 17 nt, Shigella flexneri 2a str. 301
cguaacacauaacgcca

SEQ ID NO: 1968606 - RNA, 13 nt, Shigella flexneri 2a str. 301
cgguuuugccagc

SEQ ID NO: 1968607 - RNA, 17 nt, Shigella flexneri 2a str. 301
cgguuuguaggccugau

SEQ ID NO: 1968608 - RNA, 15 nt, Shigella flexneri 2a str. 301
cgguuucugaauuuc

SEQ ID NO: 1968609 - RNA, 14 nt, Shigella flexneri 2a str. 301
cgguugauggcagu

SEQ ID NO: 1968610 - RNA, 20 nt, Shigella flexneri 2a str. 301
cgguuaucccaaaucgcaau

SEQ ID NO: 1968611 - RNA, 13 nt, Shigella flexneri 2a str. 301
cgguuagcggcuu

SEQ ID NO: 1968612 - RNA, 17 nt, Shigella flexneri 2a str. 301
cgguuaccuuggcacug

SEQ ID NO: 1968613 - RNA, 12 nt, Shigella flexneri 2a str. 301
cguacgacguuc

SEQ ID NO: 1968614 - RNA, 23 nt, Shigella flexneri 2a str. 301
cguacuggcaaucgccagcggca

SEQ ID NO: 1968615 - RNA, 21 nt, Shigella flexneri 2a str. 301
cguacuggcaaucgccagcgg

SEQ ID NO: 1968616 - RNA, 18 nt, Shigella flexneri 2a str. 301
cguacuggcaaucgccag

SEQ ID NO: 1968617 - RNA, 17 nt, Shigella flexneri 2a str. 301
cguacuucaugaguucc

SEQ ID NO: 1968618 - RNA, 14 nt, Shigella flexneri 2a str. 301
cguacuccaucucg

SEQ ID NO: 1968619 - RNA, 11 nt, Shigella flexneri 2a str. 301
cguaacauauu

SEQ ID NO: 1968620 - RNA, 16 nt, Shigella flexneri 2a str. 301
cguaacauaguuuccc

SEQ ID NO: 1968621 - RNA, 17 nt, Shigella flexneri 2a str. 301
cguaaccagacggcgua

SEQ ID NO: 1968622 - RNA, 21 nt, Shigella flexneri 2a str. 301
cguacaucccgcgaacgagaa

SEQ ID NO: 1968623 - RNA, 22 nt, Shigella flexneri 2a str. 301
cguacauugccgacauggcaau

SEQ ID NO: 1968624 - RNA, 18 nt, Shigella flexneri 2a str. 301
cguaccaaaacaccagcc

SEQ ID NO: 1968625 - RNA, 14 nt, Shigella flexneri 2a str. 301
cguacaggcagcuu

SEQ ID NO: 1968626 - RNA, 22 nt, Shigella flexneri 2a str. 301
aacccgaaggaauuuuacagcc

SEQ ID NO: 1968627 - RNA, 19 nt, Shigella flexneri 2a str. 301
cguagaucauagagcacgg

SEQ ID NO: 1968628 - RNA, 19 nt, Shigella flexneri 2a str. 301
cguaggccugauaagcgua

SEQ ID NO: 1968629 - RNA, 20 nt, Shigella flexneri 2a str. 301
cguaggccggauaaggcguu

SEQ ID NO: 1968630 - RNA, 19 nt, Shigella flexneri 2a str. 301
cguaggccugauaagacgc

SEQ ID NO: 1968631 - RNA, 16 nt, Shigella flexneri 2a str. 301
cguauuuccugccaga

SEQ ID NO: 1968632 - RNA, 17 nt, Shigella flexneri 2a str. 301
cguaugaucauccgccu

SEQ ID NO: 1968633 - RNA, 11 nt, Shigella flexneri 2a str. 301
cguauccggcu

SEQ ID NO: 1968634 - RNA, 17 nt, Shigella flexneri 2a str. 301
cguaugcagccaggcca

SEQ ID NO: 1968635 - RNA, 15 nt, Shigella flexneri 2a str. 301
aacccgccaugcaug

SEQ ID NO: 1968636 - RNA, 15 nt, Shigella flexneri 2a str. 301
aaccgcgcagcgggc

SEQ ID NO: 1968637 - RNA, 23 nt, Shigella flexneri 2a str. 301
cgugcgaauaaugguaucgacac

SEQ ID NO: 1968638 - RNA, 23 nt, Shigella flexneri 2a str. 301
cgugccggaagucucuugccggu

SEQ ID NO: 1968639 - RNA, 12 nt, Shigella flexneri 2a str. 301
cguguuucagaa

SEQ ID NO: 1968640 - RNA, 16 nt, Shigella flexneri 2a str. 301
cguuaacagcgcauuc

SEQ ID NO: 1968641 - RNA, 12 nt, Shigella flexneri 2a str. 301
cguguuccaguu

SEQ ID NO: 1968642 - RNA, 21 nt, Shigella flexneri 2a str. 301
cguucacgucgcauccggcau

SEQ ID NO: 1968643 - RNA, 15 nt, Shigella flexneri 2a str. 301
cguuaugaucagcaa

SEQ ID NO: 1968644 - RNA, 16 nt, Shigella flexneri 2a str. 301
cguuauuacuggugcg

SEQ ID NO: 1968645 - RNA, 14 nt, Shigella flexneri 2a str. 301
cguuacagcuggag

SEQ ID NO: 1968646 - RNA, 17 nt, Shigella flexneri 2a str. 301
cguuaccacaaugcaau

SEQ ID NO: 1968647 - RNA, 13 nt, Shigella flexneri 2a str. 301
cguuaauccgccc

SEQ ID NO: 1968648 - RNA, 14 nt, Shigella flexneri 2a str. 301
cguuccccagaugc

SEQ ID NO: 1968649 - RNA, 22 nt, Shigella flexneri 2a str. 301
cguuccccuguugugccagacc

SEQ ID NO: 1968650 - RNA, 23 nt, Shigella flexneri 2a str. 301
cguugaaaaaucaaaaaacugga

SEQ ID NO: 1968651 - RNA, 14 nt, Shigella flexneri 2a str. 301
cguucuucccgccu

SEQ ID NO: 1968652 - RNA, 14 nt, Shigella flexneri 2a str. 301
cguugacaaacugc

SEQ ID NO: 1968653 - RNA, 12 nt, Shigella flexneri 2a str. 301
cguugaugcagg

SEQ ID NO: 1968654 - RNA, 23 nt, Shigella flexneri 2a str. 301
cguugcaaucagcggugccgcga

SEQ ID NO: 1968655 - RNA, 23 nt, Shigella flexneri 2a str. 301
cgugauuguggcaaucauauuca

SEQ ID NO: 1968656 - RNA, 14 nt, Shigella flexneri 2a str. 301
cgugcagugauuca

SEQ ID NO: 1968657 - RNA, 22 nt, Shigella flexneri 2a str. 301
cgugcccacguucaugccgacg

SEQ ID NO: 1968658 - RNA, 14 nt, Shigella flexneri 2a str. 301
cgugaaacgcguuu

SEQ ID NO: 1968659 - RNA, 16 nt, Shigella flexneri 2a str. 301
cgucuuuauccugacu

SEQ ID NO: 1968660 - RNA, 22 nt, Shigella flexneri 2a str. 301
cgucuuuuacagcgccagaagg

SEQ ID NO: 1968661 - RNA, 19 nt, Shigella flexneri 2a str. 301
cgucuuaucaggccuacaa

SEQ ID NO: 1968662 - RNA, 16 nt, Shigella flexneri 2a str. 301
cgucuuaucaugccua

SEQ ID NO: 1968663 - RNA, 23 nt, Shigella flexneri 2a str. 301
cgucuuaucaggccuacauuggu

SEQ ID NO: 1968664 - RNA, 21 nt, Shigella flexneri 2a str. 301
cgucugguaucgcgccagcca

SEQ ID NO: 1968665 - RNA, 20 nt, Shigella flexneri 2a str. 301
cgucugggcaaaaucaucac

SEQ ID NO: 1968666 - RNA, 12 nt, Shigella flexneri 2a str. 301
cgucuucaucaa

SEQ ID NO: 1968667 - RNA, 18 nt, Shigella flexneri 2a str. 301
aacccugaacgccgggcu

SEQ ID NO: 1968668 - RNA, 17 nt, Shigella flexneri 2a str. 301
aaccgacaauauugaug

SEQ ID NO: 1968669 - RNA, 21 nt, Shigella flexneri 2a str. 301
cgugaccaguaccaccgcgaa

SEQ ID NO: 1968670 - RNA, 17 nt, Shigella flexneri 2a str. 301
cgugaaugggaaaugac

SEQ ID NO: 1968671 - RNA, 22 nt, Shigella flexneri 2a str. 301
cgugaacugggccugcauaucg

SEQ ID NO: 1968672 - RNA, 16 nt, Shigella flexneri 2a str. 301
cugcacaccaaccgcu

SEQ ID NO: 1968673 - RNA, 18 nt, Shigella flexneri 2a str. 301
cugcacaaauagccagca

SEQ ID NO: 1968674 - RNA, 21 nt, Shigella flexneri 2a str. 301
cugcaauaaaauaucuuccac

SEQ ID NO: 1968675 - RNA, 16 nt, Shigella flexneri 2a str. 301
cugcaaugucaucagc

SEQ ID NO: 1968676 - RNA, 15 nt, Shigella flexneri 2a str. 301
cugcaccgauaauac

SEQ ID NO: 1968677 - RNA, 22 nt, Shigella flexneri 2a str. 301
cugcacggagauauccagcgcc

SEQ ID NO: 1968678 - RNA, 21 nt, Shigella flexneri 2a str. 301
cugcacgguuuuuccagcucu

SEQ ID NO: 1968679 - RNA, 20 nt, Shigella flexneri 2a str. 301
cugcacgucauacugcucag

SEQ ID NO: 1968680 - RNA, 19 nt, Shigella flexneri 2a str. 301
cugcacggcuucccacguc

SEQ ID NO: 1968681 - RNA, 15 nt, Shigella flexneri 2a str. 301
cugcacguuuugcug

SEQ ID NO: 1968682 - RNA, 21 nt, Shigella flexneri 2a str. 301
cugcacuuugugucagcgcca

SEQ ID NO: 1968683 - RNA, 22 nt, Shigella flexneri 2a str. 301
cugcaaggccauccgcugcggu

SEQ ID NO: 1968684 - RNA, 16 nt, Shigella flexneri 2a str. 301
cugcaaaucgaucuca

SEQ ID NO: 1968685 - RNA, 23 nt, Shigella flexneri 2a str. 301
cugcaacauacaggugcagccgu

SEQ ID NO: 1968686 - RNA, 17 nt, Shigella flexneri 2a str. 301
cugcaaaauuuucauug

SEQ ID NO: 1968687 - RNA, 15 nt, Shigella flexneri 2a str. 301
cugauugcugucggc

SEQ ID NO: 1968688 - RNA, 23 nt, Shigella flexneri 2a str. 301
cugauuggcaucgggaugcuggu

SEQ ID NO: 1968689 - RNA, 20 nt, Shigella flexneri 2a str. 301
cugauugccacccugcggcu

SEQ ID NO: 1968690 - RNA, 17 nt, Shigella flexneri 2a str. 301
cugauuguuaacaacgu

SEQ ID NO: 1968691 - RNA, 18 nt, Shigella flexneri 2a str. 301
cugauucgcgccacguuc

SEQ ID NO: 1968692 - RNA, 17 nt, Shigella flexneri 2a str. 301
cugauucugauccugca

SEQ ID NO: 1968693 - RNA, 18 nt, Shigella flexneri 2a str. 301
cugauucugauccugcac

SEQ ID NO: 1968694 - RNA, 18 nt, Shigella flexneri 2a str. 301
cugauuacccuucgcccu

SEQ ID NO: 1968695 - RNA, 18 nt, Shigella flexneri 2a str. 301
cugaugugauccaucagg

SEQ ID NO: 1968696 - RNA, 16 nt, Shigella flexneri 2a str. 301
cugaucguccugcggu

SEQ ID NO: 1968697 - RNA, 21 nt, Shigella flexneri 2a str. 301
cugaugcgcuucgcuuaucag

SEQ ID NO: 1968698 - RNA, 21 nt, Shigella flexneri 2a str. 301
cugaugcgcuaugcuuaucag

SEQ ID NO: 1968699 - RNA, 18 nt, Shigella flexneri 2a str. 301
cugauggaauuucaucau

SEQ ID NO: 1968700 - RNA, 22 nt, Shigella flexneri 2a str. 301
cugaugguguugcaccaucagg

SEQ ID NO: 1968701 - RNA, 12 nt, Shigella flexneri 2a str. 301
cugcaucuuccg

SEQ ID NO: 1968702 - RNA, 16 nt, Shigella flexneri 2a str. 301
cugcauggugccgcca

SEQ ID NO: 1968703 - RNA, 14 nt, Shigella flexneri 2a str. 301
cugcaucuccggcg

SEQ ID NO: 1968704 - RNA, 22 nt, Shigella flexneri 2a str. 301
cugccacgguaugacccagcgc

SEQ ID NO: 1968705 - RNA, 12 nt, Shigella flexneri 2a str. 301
cugccaccagua

SEQ ID NO: 1968706 - RNA, 17 nt, Shigella flexneri 2a str. 301
cugcauuauccagcgaa

SEQ ID NO: 1968707 - RNA, 19 nt, Shigella flexneri 2a str. 301
cugcauugcccaauacagc

SEQ ID NO: 1968708 - RNA, 14 nt, Shigella flexneri 2a str. 301
cugcauuugaaacg

SEQ ID NO: 1968709 - RNA, 16 nt, Shigella flexneri 2a str. 301
cugcauacgacgugcc

SEQ ID NO: 1968710 - RNA, 22 nt, Shigella flexneri 2a str. 301
cugcauacguuucaccagcacu

SEQ ID NO: 1968711 - RNA, 20 nt, Shigella flexneri 2a str. 301
cugcagguauugcuucucag

SEQ ID NO: 1968712 - RNA, 19 nt, Shigella flexneri 2a str. 301
cugccaguuguugcugaau

SEQ ID NO: 1968713 - RNA, 20 nt, Shigella flexneri 2a str. 301
cugccaguaaagcagcgaag

SEQ ID NO: 1968714 - RNA, 18 nt, Shigella flexneri 2a str. 301
cugccaguaaagcagcga

SEQ ID NO: 1968715 - RNA, 16 nt, Shigella flexneri 2a str. 301
cugccagauucuccaa

SEQ ID NO: 1968716 - RNA, 19 nt, Shigella flexneri 2a str. 301
cugccagaggagccaucac

SEQ ID NO: 1968717 - RNA, 20 nt, Shigella flexneri 2a str. 301
cugccagaucggccaucagu

SEQ ID NO: 1968718 - RNA, 23 nt, Shigella flexneri 2a str. 301
cugccacgguaugacccagcgcg

SEQ ID NO: 1968719 - RNA, 14 nt, Shigella flexneri 2a str. 301
cugccagcugcugu

SEQ ID NO: 1968720 - RNA, 22 nt, Shigella flexneri 2a str. 301
cucuuccaggcauuaaauccug

SEQ ID NO: 1968721 - RNA, 17 nt, Shigella flexneri 2a str. 301
cucugguuuuacaacgu

SEQ ID NO: 1968722 - RNA, 16 nt, Shigella flexneri 2a str. 301
cucuucauacgcggca

SEQ ID NO: 1968723 - RNA, 14 nt, Shigella flexneri 2a str. 301
cucuucauuaccuu

SEQ ID NO: 1968724 - RNA, 21 nt, Shigella flexneri 2a str. 301
cucuuccacauuuuccaucac

SEQ ID NO: 1968725 - RNA, 18 nt, Shigella flexneri 2a str. 301
cucuucaauggucagcca

SEQ ID NO: 1968726 - RNA, 14 nt, Shigella flexneri 2a str. 301
cucuuacgccgcca

SEQ ID NO: 1968727 - RNA, 22 nt, Shigella flexneri 2a str. 301
cucuauccgaucauuagcugga

SEQ ID NO: 1968728 - RNA, 23 nt, Shigella flexneri 2a str. 301
cucugccguaccaucgccagccc

SEQ ID NO: 1968729 - RNA, 15 nt, Shigella flexneri 2a str. 301
cugaacgccacgcuc

SEQ ID NO: 1968730 - RNA, 22 nt, Shigella flexneri 2a str. 301
cugaagcauugccgaacgggua

SEQ ID NO: 1968731 - RNA, 16 nt, Shigella flexneri 2a str. 301
cugaacugauugccac

SEQ ID NO: 1968732 - RNA, 22 nt, Shigella flexneri 2a str. 301
cugaacgucgucgugaagcaga

SEQ ID NO: 1968733 - RNA, 17 nt, Shigella flexneri 2a str. 301
cugaauaaacucgcaaa

SEQ ID NO: 1968734 - RNA, 18 nt, Shigella flexneri 2a str. 301
cugaaguuauaaggcguu

SEQ ID NO: 1968735 - RNA, 19 nt, Shigella flexneri 2a str. 301
cugaauaacuggcgcgaca

SEQ ID NO: 1968736 - RNA, 18 nt, Shigella flexneri 2a str. 301
cugaauaacaccagccag

SEQ ID NO: 1968737 - RNA, 23 nt, Shigella flexneri 2a str. 301
cugaaguaagaaauaacgccgga

SEQ ID NO: 1968738 - RNA, 16 nt, Shigella flexneri 2a str. 301
cugaagccgcaccugu

SEQ ID NO: 1968739 - RNA, 14 nt, Shigella flexneri 2a str. 301
cugaccaccagcac

SEQ ID NO: 1968740 - RNA, 14 nt, Shigella flexneri 2a str. 301
cugacccagaccga

SEQ ID NO: 1968741 - RNA, 16 nt, Shigella flexneri 2a str. 301
cugacacaggcagcaa

SEQ ID NO: 1968742 - RNA, 16 nt, Shigella flexneri 2a str. 301
cugacaaagugcgcgu

SEQ ID NO: 1968743 - RNA, 21 nt, Shigella flexneri 2a str. 301
cugaauaauccccauaucagg

SEQ ID NO: 1968744 - RNA, 23 nt, Shigella flexneri 2a str. 301
cugacgugcgcaaacuucuucag

SEQ ID NO: 1968745 - RNA, 13 nt, Shigella flexneri 2a str. 301
cugacggcagcga

SEQ ID NO: 1968746 - RNA, 13 nt, Shigella flexneri 2a str. 301
cugacuugcccgu

SEQ ID NO: 1968747 - RNA, 16 nt, Shigella flexneri 2a str. 301
cugacuguaggccgga

SEQ ID NO: 1968748 - RNA, 19 nt, Shigella flexneri 2a str. 301
cugacuuugauccagccau

SEQ ID NO: 1968749 - RNA, 14 nt, Shigella flexneri 2a str. 301
cugacguuguucag

SEQ ID NO: 1968750 - RNA, 14 nt, Shigella flexneri 2a str. 301
cugacugaaugcca

SEQ ID NO: 1968751 - RNA, 16 nt, Shigella flexneri 2a str. 301
cugaccguaggccgga

SEQ ID NO: 1968752 - RNA, 16 nt, Shigella flexneri 2a str. 301
cugacgaggcgucagc

SEQ ID NO: 1968753 - RNA, 20 nt, Shigella flexneri 2a str. 301
cugaccugcggcaccagcgg

SEQ ID NO: 1968754 - RNA, 23 nt, Shigella flexneri 2a str. 301
cugauaauccagacuauuugaca

SEQ ID NO: 1968755 - RNA, 21 nt, Shigella flexneri 2a str. 301
cugauaagacgcguaaagcgu

SEQ ID NO: 1968756 - RNA, 23 nt, Shigella flexneri 2a str. 301
cugagcgaagauuucguuuucua

SEQ ID NO: 1968757 - RNA, 18 nt, Shigella flexneri 2a str. 301
cugagcaucggucgcguu

SEQ ID NO: 1968758 - RNA, 13 nt, Shigella flexneri 2a str. 301
cucacuaucgcug

SEQ ID NO: 1968759 - RNA, 22 nt, Shigella flexneri 2a str. 301
cucacuucgcuuacgccugcca

SEQ ID NO: 1968760 - RNA, 23 nt, Shigella flexneri 2a str. 301
cucagauucagauuaugucgcuc

SEQ ID NO: 1968761 - RNA, 15 nt, Shigella flexneri 2a str. 301
cuccacgcugcaucg

SEQ ID NO: 1968762 - RNA, 21 nt, Shigella flexneri 2a str. 301
cuccacgcuauacagcagcca

SEQ ID NO: 1968763 - RNA, 17 nt, Shigella flexneri 2a str. 301
cuccaccuugcggaaac

SEQ ID NO: 1968764 - RNA, 23 nt, Shigella flexneri 2a str. 301
cuccaccuugcggaaacugucaa

SEQ ID NO: 1968765 - RNA, 12 nt, Shigella flexneri 2a str. 301
cuccacaagcuc

SEQ ID NO: 1968766 - RNA, 20 nt, Shigella flexneri 2a str. 301
cuccagugccugugacaaca

SEQ ID NO: 1968767 - RNA, 22 nt, Shigella flexneri 2a str. 301
cuccagguccuccuguaccuuc

SEQ ID NO: 1968768 - RNA, 18 nt, Shigella flexneri 2a str. 301
cucaaaaauaaucaucuc

SEQ ID NO: 1968769 - RNA, 12 nt, Shigella flexneri 2a str. 301
cuauuggcggau

SEQ ID NO: 1968770 - RNA, 19 nt, Shigella flexneri 2a str. 301
cucaauaucaucauuugca

SEQ ID NO: 1968771 - RNA, 23 nt, Shigella flexneri 2a str. 301
cucaaccagauucggcgcaauga

SEQ ID NO: 1968772 - RNA, 15 nt, Shigella flexneri 2a str. 301
cucaaccuuuccuug

SEQ ID NO: 1968773 - RNA, 22 nt, Shigella flexneri 2a str. 301
cuauuaaagaaaguaaucuaua

SEQ ID NO: 1968774 - RNA, 18 nt, Shigella flexneri 2a str. 301
cuaugcauaauccugccg

SEQ ID NO: 1968775 - RNA, 13 nt, Shigella flexneri 2a str. 301
cuauggucuugua

SEQ ID NO: 1968776 - RNA, 22 nt, Shigella flexneri 2a str. 301
cuaugaacacgaucucacgcug

SEQ ID NO: 1968777 - RNA, 17 nt, Shigella flexneri 2a str. 301
cuaucucuuuaccuucg

SEQ ID NO: 1968778 - RNA, 16 nt, Shigella flexneri 2a str. 301
cguugccuugccgaau

SEQ ID NO: 1968779 - RNA, 12 nt, Shigella flexneri 2a str. 301
cuacggcugaug

SEQ ID NO: 1968780 - RNA, 16 nt, Shigella flexneri 2a str. 301
cuacuauggaacgcuc

SEQ ID NO: 1968781 - RNA, 20 nt, Shigella flexneri 2a str. 301
cguugcgacacuccugacgc

SEQ ID NO: 1968782 - RNA, 22 nt, Shigella flexneri 2a str. 301
cuagaugugcaguuccugcaac

SEQ ID NO: 1968783 - RNA, 20 nt, Shigella flexneri 2a str. 301
cuaucagcaaacuaucccag

SEQ ID NO: 1968784 - RNA, 20 nt, Shigella flexneri 2a str. 301
cuccaugggagaacgaugcu

SEQ ID NO: 1968785 - RNA, 15 nt, Shigella flexneri 2a str. 301
cuccgcugagacgcg

SEQ ID NO: 1968786 - RNA, 18 nt, Shigella flexneri 2a str. 301
cuccgcuggagcggggaa

SEQ ID NO: 1968787 - RNA, 21 nt, Shigella flexneri 2a str. 301
cucgaucggcucuuccgcgaa

SEQ ID NO: 1968788 - RNA, 18 nt, Shigella flexneri 2a str. 301
cucgcaucagggcgcugg

SEQ ID NO: 1968789 - RNA, 13 nt, Shigella flexneri 2a str. 301
cucgcuuuccauu

SEQ ID NO: 1968790 - RNA, 16 nt, Shigella flexneri 2a str. 301
gaccgauaaugauccc

SEQ ID NO: 1968791 - RNA, 20 nt, Shigella flexneri 2a str. 301
gacccugcucuuucagcacc

SEQ ID NO: 1968792 - RNA, 21 nt, Shigella flexneri 2a str. 301
gacccugcucuuucagcaccg

SEQ ID NO: 1968793 - RNA, 15 nt, Shigella flexneri 2a str. 301
aacgcucccugccag

SEQ ID NO: 1968794 - RNA, 15 nt, Shigella flexneri 2a str. 301
aacggacgaccgauu

SEQ ID NO: 1968795 - RNA, 17 nt, Shigella flexneri 2a str. 301
aacgcuuuugcaucggc

SEQ ID NO: 1968796 - RNA, 19 nt, Shigella flexneri 2a str. 301
aacgcgcggcuuaucgggc

SEQ ID NO: 1968797 - RNA, 19 nt, Shigella flexneri 2a str. 301
gacccagccagacgccagc

SEQ ID NO: 1968798 - RNA, 19 nt, Shigella flexneri 2a str. 301
gaccaggccaucagcagcg

SEQ ID NO: 1968799 - RNA, 18 nt, Shigella flexneri 2a str. 301
gaccaucuuccagcauca

SEQ ID NO: 1968800 - RNA, 17 nt, Shigella flexneri 2a str. 301
aacgccacgcucacuca

SEQ ID NO: 1968801 - RNA, 14 nt, Shigella flexneri 2a str. 301
aacgccacgcucac

SEQ ID NO: 1968802 - RNA, 13 nt, Shigella flexneri 2a str. 301
aacgccagcagca

SEQ ID NO: 1968803 - RNA, 19 nt, Shigella flexneri 2a str. 301
aacgaugacaucgcagcaa

SEQ ID NO: 1968804 - RNA, 22 nt, Shigella flexneri 2a str. 301
aacgcccagcuaaucgagccga

SEQ ID NO: 1968805 - RNA, 18 nt, Shigella flexneri 2a str. 301
aacgcccagcuaaucgag

SEQ ID NO: 1968806 - RNA, 23 nt, Shigella flexneri 2a str. 301
aacgccauauucugaucgugcuc

SEQ ID NO: 1968807 - RNA, 13 nt, Shigella flexneri 2a str. 301
gaccagcagcauu

SEQ ID NO: 1968808 - RNA, 12 nt, Shigella flexneri 2a str. 301
aacgccgcgcca

SEQ ID NO: 1968809 - RNA, 16 nt, Shigella flexneri 2a str. 301
gaccacugcgccgcuc

SEQ ID NO: 1968810 - RNA, 18 nt, Shigella flexneri 2a str. 301
gacaugauguuuuaacac

SEQ ID NO: 1968811 - RNA, 20 nt, Shigella flexneri 2a str. 301
gaccaccgguuuuaucgagc

SEQ ID NO: 1968812 - RNA, 18 nt, Shigella flexneri 2a str. 301
gaccaccgucccaguaau

SEQ ID NO: 1968813 - RNA, 17 nt, Shigella flexneri 2a str. 301
gaauggaaacagcacca

SEQ ID NO: 1968814 - RNA, 14 nt, Shigella flexneri 2a str. 301
gaaugccugugcga

SEQ ID NO: 1968815 - RNA, 16 nt, Shigella flexneri 2a str. 301
gaauuucagcgccuga

SEQ ID NO: 1968816 - RNA, 21 nt, Shigella flexneri 2a str. 301
gaauuucucauccgcaguccc

SEQ ID NO: 1968817 - RNA, 14 nt, Shigella flexneri 2a str. 301
gaauuucaucacca

SEQ ID NO: 1968818 - RNA, 23 nt, Shigella flexneri 2a str. 301
gaauugcugcgcccgcagcggcg

SEQ ID NO: 1968819 - RNA, 19 nt, Shigella flexneri 2a str. 301
gaauuuucucuuucaacau

SEQ ID NO: 1968820 - RNA, 13 nt, Shigella flexneri 2a str. 301
gacaaucagguaa

SEQ ID NO: 1968821 - RNA, 22 nt, Shigella flexneri 2a str. 301
gacaacgcaacgccgccggaag

SEQ ID NO: 1968822 - RNA, 16 nt, Shigella flexneri 2a str. 301
gaacugcauugucgga

SEQ ID NO: 1968823 - RNA, 19 nt, Shigella flexneri 2a str. 301
gaaguggcacaggcaauag

SEQ ID NO: 1968824 - RNA, 23 nt, Shigella flexneri 2a str. 301
gaauaaaguuuuaguugccguuc

SEQ ID NO: 1968825 - RNA, 13 nt, Shigella flexneri 2a str. 301
gaauaaaacaggc

SEQ ID NO: 1968826 - RNA, 15 nt, Shigella flexneri 2a str. 301
gaauauuucaccggu

SEQ ID NO: 1968827 - RNA, 19 nt, Shigella flexneri 2a str. 301
gaauaucuuucucgcggca

SEQ ID NO: 1968828 - RNA, 19 nt, Shigella flexneri 2a str. 301
gaauaacgucgcggauggu

SEQ ID NO: 1968829 - RNA, 16 nt, Shigella flexneri 2a str. 301
gaaucaaucgccccuu

SEQ ID NO: 1968830 - RNA, 13 nt, Shigella flexneri 2a str. 301
gaaucaacggcaa

SEQ ID NO: 1968831 - RNA, 17 nt, Shigella flexneri 2a str. 301
gacaccagucgugcggu

SEQ ID NO: 1968832 - RNA, 22 nt, Shigella flexneri 2a str. 301
gacacaaauggcaguaucggca

SEQ ID NO: 1968833 - RNA, 18 nt, Shigella flexneri 2a str. 301
gacacaacaauucccagu

SEQ ID NO: 1968834 - RNA, 13 nt, Shigella flexneri 2a str. 301
gacacaggcagca

SEQ ID NO: 1968835 - RNA, 20 nt, Shigella flexneri 2a str. 301
gacacaucaccuccagcgaa

SEQ ID NO: 1968836 - RNA, 19 nt, Shigella flexneri 2a str. 301
gacaccguuaaauaacugg

SEQ ID NO: 1968837 - RNA, 17 nt, Shigella flexneri 2a str. 301
gacaccgccuccauucg

SEQ ID NO: 1968838 - RNA, 18 nt, Shigella flexneri 2a str. 301
gacacuaacgcgucuuau

SEQ ID NO: 1968839 - RNA, 14 nt, Shigella flexneri 2a str. 301
gacauacagaucgu

SEQ ID NO: 1968840 - RNA, 16 nt, Shigella flexneri 2a str. 301
gacaucccggcagaga

SEQ ID NO: 1968841 - RNA, 22 nt, Shigella flexneri 2a str. 301
gacauaaccacucaccgccguu

SEQ ID NO: 1968842 - RNA, 22 nt, Shigella flexneri 2a str. 301
aacgaccagaucggucagugcc

SEQ ID NO: 1968843 - RNA, 18 nt, Shigella flexneri 2a str. 301
aacgaccaguucacacca

SEQ ID NO: 1968844 - RNA, 22 nt, Shigella flexneri 2a str. 301
gacagcgucacaucaggccauc

SEQ ID NO: 1968845 - RNA, 18 nt, Shigella flexneri 2a str. 301
gacacucggcgcggaugc

SEQ ID NO: 1968846 - RNA, 14 nt, Shigella flexneri 2a str. 301
gacacuguucgcgu

SEQ ID NO: 1968847 - RNA, 17 nt, Shigella flexneri 2a str. 301
gacgaucuucggcguca

SEQ ID NO: 1968848 - RNA, 19 nt, Shigella flexneri 2a str. 301
gacgaucaccacaccguca

SEQ ID NO: 1968849 - RNA, 19 nt, Shigella flexneri 2a str. 301
aacgguuucagcagcggca

SEQ ID NO: 1968850 - RNA, 14 nt, Shigella flexneri 2a str. 301
aacgucaacgacgg

SEQ ID NO: 1968851 - RNA, 12 nt, Shigella flexneri 2a str. 301
aacgucaaacgc

SEQ ID NO: 1968852 - RNA, 19 nt, Shigella flexneri 2a str. 301
gacgaugaccgcaucaaug

SEQ ID NO: 1968853 - RNA, 17 nt, Shigella flexneri 2a str. 301
gaccuugucaugcagcu

SEQ ID NO: 1968854 - RNA, 20 nt, Shigella flexneri 2a str. 301
gacgaagcgccuucgauaau

SEQ ID NO: 1968855 - RNA, 14 nt, Shigella flexneri 2a str. 301
gaccugcgucacca

SEQ ID NO: 1968856 - RNA, 20 nt, Shigella flexneri 2a str. 301
gaccuguaccuucagcggca

SEQ ID NO: 1968857 - RNA, 22 nt, Shigella flexneri 2a str. 301
aacggcacggaaagcagcauac

SEQ ID NO: 1968858 - RNA, 23 nt, Shigella flexneri 2a str. 301
aacggcagcaaggcuauucagca

SEQ ID NO: 1968859 - RNA, 19 nt, Shigella flexneri 2a str. 301
gacgcauccgaucgcgcau

SEQ ID NO: 1968860 - RNA, 16 nt, Shigella flexneri 2a str. 301
gacgccacaaucugau

SEQ ID NO: 1968861 - RNA, 19 nt, Shigella flexneri 2a str. 301
gacgccacaaucugauaau

SEQ ID NO: 1968862 - RNA, 19 nt, Shigella flexneri 2a str. 301
gacgccaguuacugcugac

SEQ ID NO: 1968863 - RNA, 18 nt, Shigella flexneri 2a str. 301
gacgauugugcuggugau

SEQ ID NO: 1968864 - RNA, 17 nt, Shigella flexneri 2a str. 301
gacgauugugcugguga

SEQ ID NO: 1968865 - RNA, 23 nt, Shigella flexneri 2a str. 301
gacgaugguuuuuggguucagca

SEQ ID NO: 1968866 - RNA, 18 nt, Shigella flexneri 2a str. 301
gacgcacacguuucaggu

SEQ ID NO: 1968867 - RNA, 21 nt, Shigella flexneri 2a str. 301
gacgcacaucgcugugcugcu

SEQ ID NO: 1968868 - RNA, 20 nt, Shigella flexneri 2a str. 301
gacgcaaugccaguuccgcu

SEQ ID NO: 1968869 - RNA, 15 nt, Shigella flexneri 2a str. 301
gacgccuucagcgau

SEQ ID NO: 1968870 - RNA, 19 nt, Shigella flexneri 2a str. 301
gacgggcuaaucgucauca

SEQ ID NO: 1968871 - RNA, 17 nt, Shigella flexneri 2a str. 301
gacgggcccauaacgcc

SEQ ID NO: 1968872 - RNA, 18 nt, Shigella flexneri 2a str. 301
gacgguaaaccacgccag

SEQ ID NO: 1968873 - RNA, 23 nt, Shigella flexneri 2a str. 301
gacggucuuuuucuacagcgacu

SEQ ID NO: 1968874 - RNA, 22 nt, Shigella flexneri 2a str. 301
aacgucggaaaccgcuuugcca

SEQ ID NO: 1968875 - RNA, 17 nt, Shigella flexneri 2a str. 301
aacguccugcaacggcg

SEQ ID NO: 1968876 - RNA, 15 nt, Shigella flexneri 2a str. 301
gacggcguauugcau

SEQ ID NO: 1968877 - RNA, 15 nt, Shigella flexneri 2a str. 301
gacggcuuagcgcau

SEQ ID NO: 1968878 - RNA, 15 nt, Shigella flexneri 2a str. 301
gacggcuucucggca

SEQ ID NO: 1968879 - RNA, 16 nt, Shigella flexneri 2a str. 301
gacggcugauaugcca

SEQ ID NO: 1968880 - RNA, 15 nt, Shigella flexneri 2a str. 301
gacgcuggcuuugcc

SEQ ID NO: 1968881 - RNA, 20 nt, Shigella flexneri 2a str. 301
gacggacguccggugauauc

SEQ ID NO: 1968882 - RNA, 21 nt, Shigella flexneri 2a str. 301
gacggaacuucauaugcgcca

SEQ ID NO: 1968883 - RNA, 16 nt, Shigella flexneri 2a str. 301
gacggcagcgaagggu

SEQ ID NO: 1968884 - RNA, 14 nt, Shigella flexneri 2a str. 301
gacggcaucgccau

SEQ ID NO: 1968885 - RNA, 20 nt, Shigella flexneri 2a str. 301
gacgcggcagcgucgcauca

SEQ ID NO: 1968886 - RNA, 17 nt, Shigella flexneri 2a str. 301
gacgcgcuauugccgua

SEQ ID NO: 1968887 - RNA, 18 nt, Shigella flexneri 2a str. 301
gacgcgcuaagcgaaccu

SEQ ID NO: 1968888 - RNA, 20 nt, Shigella flexneri 2a str. 301
gacgcgcuagccucaggugu

SEQ ID NO: 1968889 - RNA, 23 nt, Shigella flexneri 2a str. 301
gacgcgcggcgaaccagccguug

SEQ ID NO: 1968890 - RNA, 14 nt, Shigella flexneri 2a str. 301
gacgcgcagcgucg

SEQ ID NO: 1968891 - RNA, 15 nt, Shigella flexneri 2a str. 301
gacgcgccagcaccg

SEQ ID NO: 1968892 - RNA, 18 nt, Shigella flexneri 2a str. 301
gacgcgccagcgucgcau

SEQ ID NO: 1968893 - RNA, 21 nt, Shigella flexneri 2a str. 301
gacgcgcaaaucagauugcca

SEQ ID NO: 1968894 - RNA, 21 nt, Shigella flexneri 2a str. 301
gacgcgucaagcgucgcauca

SEQ ID NO: 1968895 - RNA, 19 nt, Shigella flexneri 2a str. 301
gacgcgucaagcgucgcau

SEQ ID NO: 1968896 - RNA, 20 nt, Shigella flexneri 2a str. 301
gacgcgguagcacgucaucu

SEQ ID NO: 1968897 - RNA, 12 nt, Shigella flexneri 2a str. 301
gacgcgguagca

SEQ ID NO: 1968898 - RNA, 13 nt, Shigella flexneri 2a str. 301
gacgcgggcagca

SEQ ID NO: 1968899 - RNA, 13 nt, Shigella flexneri 2a str. 301
gacgcguuagcau

SEQ ID NO: 1968900 - RNA, 19 nt, Shigella flexneri 2a str. 301
gacgcguggagagucauca

SEQ ID NO: 1968901 - RNA, 12 nt, Shigella flexneri 2a str. 301
gacgcgucuuau

SEQ ID NO: 1968902 - RNA, 19 nt, Shigella flexneri 2a str. 301
gacgcgucuuaucuggccu

SEQ ID NO: 1968903 - RNA, 15 nt, Shigella flexneri 2a str. 301
cuuccagcuccagcc

SEQ ID NO: 1968904 - RNA, 19 nt, Shigella flexneri 2a str. 301
cuuccagcguucgccaaac

SEQ ID NO: 1968905 - RNA, 18 nt, Shigella flexneri 2a str. 301
cuuccuguucaucgacag

SEQ ID NO: 1968906 - RNA, 21 nt, Shigella flexneri 2a str. 301
cuucgaaugccgcagcacccu

SEQ ID NO: 1968907 - RNA, 13 nt, Shigella flexneri 2a str. 301
cuucgcugcugga

SEQ ID NO: 1968908 - RNA, 15 nt, Shigella flexneri 2a str. 301
cuucgcugcagcucu

SEQ ID NO: 1968909 - RNA, 22 nt, Shigella flexneri 2a str. 301
cuucgcuuaccaugccaacgcg

SEQ ID NO: 1968910 - RNA, 15 nt, Shigella flexneri 2a str. 301
cuucgguagcagcuu

SEQ ID NO: 1968911 - RNA, 19 nt, Shigella flexneri 2a str. 301
cuucgccaauguggguagc

SEQ ID NO: 1968912 - RNA, 14 nt, Shigella flexneri 2a str. 301
cuuccagauucagu

SEQ ID NO: 1968913 - RNA, 16 nt, Shigella flexneri 2a str. 301
cuucaguuccgcugca

SEQ ID NO: 1968914 - RNA, 15 nt, Shigella flexneri 2a str. 301
cuucaguuccgcugc

SEQ ID NO: 1968915 - RNA, 13 nt, Shigella flexneri 2a str. 301
cuucagucgccag

SEQ ID NO: 1968916 - RNA, 15 nt, Shigella flexneri 2a str. 301
cuucaucacgaugca

SEQ ID NO: 1968917 - RNA, 14 nt, Shigella flexneri 2a str. 301
cuucaucaucgcag

SEQ ID NO: 1968918 - RNA, 17 nt, Shigella flexneri 2a str. 301
cuucaguuccgcugcaa

SEQ ID NO: 1968919 - RNA, 14 nt, Shigella flexneri 2a str. 301
cuucaacgcaagaa

SEQ ID NO: 1968920 - RNA, 14 nt, Shigella flexneri 2a str. 301
cuucaacgacggcg

SEQ ID NO: 1968921 - RNA, 13 nt, Shigella flexneri 2a str. 301
cuuauguugcuua

SEQ ID NO: 1968922 - RNA, 22 nt, Shigella flexneri 2a str. 301
cuuauuaacagucagucucaag

SEQ ID NO: 1968923 - RNA, 12 nt, Shigella flexneri 2a str. 301
cuucagcggcag

SEQ ID NO: 1968924 - RNA, 15 nt, Shigella flexneri 2a str. 301
cuucagcggcagcuu

SEQ ID NO: 1968925 - RNA, 21 nt, Shigella flexneri 2a str. 301
cuucagccggaauaaucagau

SEQ ID NO: 1968926 - RNA, 14 nt, Shigella flexneri 2a str. 301
cugugcagcgacgu

SEQ ID NO: 1968927 - RNA, 22 nt, Shigella flexneri 2a str. 301
cugucggggccagcgcauccau

SEQ ID NO: 1968928 - RNA, 14 nt, Shigella flexneri 2a str. 301
cuguagcuggaaaa

SEQ ID NO: 1968929 - RNA, 21 nt, Shigella flexneri 2a str. 301
cugucaauaagugcuuuagcc

SEQ ID NO: 1968930 - RNA, 11 nt, Shigella flexneri 2a str. 301
cuguacggcag

SEQ ID NO: 1968931 - RNA, 17 nt, Shigella flexneri 2a str. 301
cuguacgguaauggcaa

SEQ ID NO: 1968932 - RNA, 17 nt, Shigella flexneri 2a str. 301
cuguuuaucuucccagc

SEQ ID NO: 1968933 - RNA, 20 nt, Shigella flexneri 2a str. 301
cuguuugcgucagcuucaga

SEQ ID NO: 1968934 - RNA, 17 nt, Shigella flexneri 2a str. 301
cuguggauucagcaccg

SEQ ID NO: 1968935 - RNA, 15 nt, Shigella flexneri 2a str. 301
cugugguagcggcuc

SEQ ID NO: 1968936 - RNA, 14 nt, Shigella flexneri 2a str. 301
cuuaagccagcgcc

SEQ ID NO: 1968937 - RNA, 15 nt, Shigella flexneri 2a str. 301
cuuaacucgcugaau

SEQ ID NO: 1968938 - RNA, 14 nt, Shigella flexneri 2a str. 301
cuuaagccaucauc

SEQ ID NO: 1968939 - RNA, 20 nt, Shigella flexneri 2a str. 301
cuggcgcucaccauuuccgg

SEQ ID NO: 1968940 - RNA, 23 nt, Shigella flexneri 2a str. 301
cuggcgcuguucgggaguugcag

SEQ ID NO: 1968941 - RNA, 14 nt, Shigella flexneri 2a str. 301
cuggcggaaagcca

SEQ ID NO: 1968942 - RNA, 14 nt, Shigella flexneri 2a str. 301
cuggcggcagcagg

SEQ ID NO: 1968943 - RNA, 13 nt, Shigella flexneri 2a str. 301
cuggcggcagugu

SEQ ID NO: 1968944 - RNA, 17 nt, Shigella flexneri 2a str. 301
cuggcgggaaguauugc

SEQ ID NO: 1968945 - RNA, 17 nt, Shigella flexneri 2a str. 301
cuggcgugggcaucgau

SEQ ID NO: 1968946 - RNA, 16 nt, Shigella flexneri 2a str. 301
cuggcgucacgccgac

SEQ ID NO: 1968947 - RNA, 14 nt, Shigella flexneri 2a str. 301
cuggcuaagccacc

SEQ ID NO: 1968948 - RNA, 14 nt, Shigella flexneri 2a str. 301
cugguauuuccagu

SEQ ID NO: 1968949 - RNA, 17 nt, Shigella flexneri 2a str. 301
cugguaguuguacaacu

SEQ ID NO: 1968950 - RNA, 17 nt, Shigella flexneri 2a str. 301
cugggcuucauccagca

SEQ ID NO: 1968951 - RNA, 17 nt, Shigella flexneri 2a str. 301
cugggccugcauaucgg

SEQ ID NO: 1968952 - RNA, 19 nt, Shigella flexneri 2a str. 301
cugggaaaucaccaccagc

SEQ ID NO: 1968953 - RNA, 13 nt, Shigella flexneri 2a str. 301
cuggcuuucauuu

SEQ ID NO: 1968954 - RNA, 21 nt, Shigella flexneri 2a str. 301
cuggcaagaucggugccgcca

SEQ ID NO: 1968955 - RNA, 15 nt, Shigella flexneri 2a str. 301
cuggcaagcugcugu

SEQ ID NO: 1968956 - RNA, 19 nt, Shigella flexneri 2a str. 301
cugcccguugccaggaccg

SEQ ID NO: 1968957 - RNA, 20 nt, Shigella flexneri 2a str. 301
cugcccucuuuagcauucag

SEQ ID NO: 1968958 - RNA, 20 nt, Shigella flexneri 2a str. 301
cugcccuugccaacgcaaac

SEQ ID NO: 1968959 - RNA, 16 nt, Shigella flexneri 2a str. 301
cuggcacgaccuggca

SEQ ID NO: 1968960 - RNA, 14 nt, Shigella flexneri 2a str. 301
cuggcaccaccugg

SEQ ID NO: 1968961 - RNA, 22 nt, Shigella flexneri 2a str. 301
cuggcaaugagcaguuugguua

SEQ ID NO: 1968962 - RNA, 14 nt, Shigella flexneri 2a str. 301
cuggcaauagcgca

SEQ ID NO: 1968963 - RNA, 14 nt, Shigella flexneri 2a str. 301
cuggcaaucgccag

SEQ ID NO: 1968964 - RNA, 13 nt, Shigella flexneri 2a str. 301
cuggcccaucaga

SEQ ID NO: 1968965 - RNA, 15 nt, Shigella flexneri 2a str. 301
cuggcccaucgccag

SEQ ID NO: 1968966 - RNA, 18 nt, Shigella flexneri 2a str. 301
cuggcgaacccaaccgug

SEQ ID NO: 1968967 - RNA, 22 nt, Shigella flexneri 2a str. 301
cuggcgaagccucuuacacuug

SEQ ID NO: 1968968 - RNA, 20 nt, Shigella flexneri 2a str. 301
cuggcgacaugcaucacgcg

SEQ ID NO: 1968969 - RNA, 24 nt, Shigella flexneri 2a str. 301
cuggcgagcauuaauacaccgcug

SEQ ID NO: 1968970 - RNA, 16 nt, Shigella flexneri 2a str. 301
cuggcgagcgccagca

SEQ ID NO: 1968971 - RNA, 11 nt, Shigella flexneri 2a str. 301
cuggcgcacaa

SEQ ID NO: 1968972 - RNA, 13 nt, Shigella flexneri 2a str. 301
cuggcgcagcugc

SEQ ID NO: 1968973 - RNA, 18 nt, Shigella flexneri 2a str. 301
cuuuacggcgcgucagau

SEQ ID NO: 1968974 - RNA, 19 nt, Shigella flexneri 2a str. 301
cuuuacgcaaaaucagcaa

SEQ ID NO: 1968975 - RNA, 21 nt, Shigella flexneri 2a str. 301
cuuuaauauuaacgccagccu

SEQ ID NO: 1968976 - RNA, 13 nt, Shigella flexneri 2a str. 301
aaccguaaacgau

SEQ ID NO: 1968977 - RNA, 12 nt, Shigella flexneri 2a str. 301
aaccgucagcac

SEQ ID NO: 1968978 - RNA, 20 nt, Shigella flexneri 2a str. 301
aaccgucugugugccugucg

SEQ ID NO: 1968979 - RNA, 20 nt, Shigella flexneri 2a str. 301
cuuucagauguuccgccauu

SEQ ID NO: 1968980 - RNA, 22 nt, Shigella flexneri 2a str. 301
cuuucagcaccagcccgacgau

SEQ ID NO: 1968981 - RNA, 15 nt, Shigella flexneri 2a str. 301
cuuucagcgcauguc

SEQ ID NO: 1968982 - RNA, 20 nt, Shigella flexneri 2a str. 301
cuuucacgucaggaucgugc

SEQ ID NO: 1968983 - RNA, 16 nt, Shigella flexneri 2a str. 301
cuuucacucauuaaga

SEQ ID NO: 1968984 - RNA, 17 nt, Shigella flexneri 2a str. 301
cuuuaugacgaucgcag

SEQ ID NO: 1968985 - RNA, 13 nt, Shigella flexneri 2a str. 301
cuuggcacugacg

SEQ ID NO: 1968986 - RNA, 23 nt, Shigella flexneri 2a str. 301
cuugcguacaccaacaucacgca

SEQ ID NO: 1968987 - RNA, 18 nt, Shigella flexneri 2a str. 301
cuucgugcaggcauucag

SEQ ID NO: 1968988 - RNA, 22 nt, Shigella flexneri 2a str. 301
cuuucggccaugggcgcgauaa

SEQ ID NO: 1968989 - RNA, 13 nt, Shigella flexneri 2a str. 301
cuuucggaucggc

SEQ ID NO: 1968990 - RNA, 15 nt, Shigella flexneri 2a str. 301
cuuucugcgcaaugc

SEQ ID NO: 1968991 - RNA, 22 nt, Shigella flexneri 2a str. 301
cuuucugaaggauuagccggau

SEQ ID NO: 1968992 - RNA, 13 nt, Shigella flexneri 2a str. 301
cuuucucgcggca

SEQ ID NO: 1968993 - RNA, 18 nt, Shigella flexneri 2a str. 301
cuuucgacggcaucagaa

SEQ ID NO: 1968994 - RNA, 20 nt, Shigella flexneri 2a str. 301
cuuuccaugccaucugccag

SEQ ID NO: 1968995 - RNA, 16 nt, Shigella flexneri 2a str. 301
cuuuccagguggugca

SEQ ID NO: 1968996 - RNA, 23 nt, Shigella flexneri 2a str. 301
cuuugcugauacuccaugaguaa

SEQ ID NO: 1968997 - RNA, 15 nt, Shigella flexneri 2a str. 301
cuuugccgucagcca

SEQ ID NO: 1968998 - RNA, 19 nt, Shigella flexneri 2a str. 301
cuuugcgcgcuuccaucgu

SEQ ID NO: 1968999 - RNA, 16 nt, Shigella flexneri 2a str. 301
cuuuggguugccgcca

SEQ ID NO: 1969000 - RNA, 15 nt, Shigella flexneri 2a str. 301
cuuuggccgcucggg

SEQ ID NO: 1969001 - RNA, 20 nt, Shigella flexneri 2a str. 301
cuuugacgucgaaacugaca

SEQ ID NO: 1969002 - RNA, 18 nt, Shigella flexneri 2a str. 301
cuuugacaacaucaucug

SEQ ID NO: 1969003 - RNA, 20 nt, Shigella flexneri 2a str. 301
cuuucuucaaccaggcggau

SEQ ID NO: 1969004 - RNA, 12 nt, Shigella flexneri 2a str. 301
cuuugaucgcgu

SEQ ID NO: 1969005 - RNA, 19 nt, Shigella flexneri 2a str. 301
cuuugcccgcagauccagu

SEQ ID NO: 1969006 - RNA, 16 nt, Shigella flexneri 2a str. 301
cuuuuagcucgcgguu

SEQ ID NO: 1969007 - RNA, 16 nt, Shigella flexneri 2a str. 301
cuuuguguugcugaac

SEQ ID NO: 1969008 - RNA, 14 nt, Shigella flexneri 2a str. 301
cuuuuauuuaaccg

SEQ ID NO: 1969009 - RNA, 18 nt, Shigella flexneri 2a str. 301
cuuuucaucagaucgcga

SEQ ID NO: 1969010 - RNA, 15 nt, Shigella flexneri 2a str. 301
cuuuuccauaucaag

SEQ ID NO: 1969011 - RNA, 13 nt, Shigella flexneri 2a str. 301
cuuuucccagcgc

SEQ ID NO: 1969012 - RNA, 22 nt, Shigella flexneri 2a str. 301
gaaaacgccggagugaaaauuc

SEQ ID NO: 1969013 - RNA, 17 nt, Shigella flexneri 2a str. 301
gaaaacgcauaccaguc

SEQ ID NO: 1969014 - RNA, 14 nt, Shigella flexneri 2a str. 301
gaaaacccggccug

SEQ ID NO: 1969015 - RNA, 17 nt, Shigella flexneri 2a str. 301
gaaaaaacguugucgcc

SEQ ID NO: 1969016 - RNA, 13 nt, Shigella flexneri 2a str. 301
cuuuucuuuagcg

SEQ ID NO: 1969017 - RNA, 22 nt, Shigella flexneri 2a str. 301
cuuuuuugagcagcauuaccug

SEQ ID NO: 1969018 - RNA, 15 nt, Shigella flexneri 2a str. 301
cuuuuuuacgccugu

SEQ ID NO: 1969019 - RNA, 18 nt, Shigella flexneri 2a str. 301
gaacggauaucgagaauc

SEQ ID NO: 1969020 - RNA, 16 nt, Shigella flexneri 2a str. 301
gaacgcuuuugcaucg

SEQ ID NO: 1969021 - RNA, 18 nt, Shigella flexneri 2a str. 301
gaacgggauugccagcau

SEQ ID NO: 1969022 - RNA, 23 nt, Shigella flexneri 2a str. 301
gaacggcagauccaaaccgacug

SEQ ID NO: 1969023 - RNA, 19 nt, Shigella flexneri 2a str. 301
gaacgcguucacugccgua

SEQ ID NO: 1969024 - RNA, 15 nt, Shigella flexneri 2a str. 301
gaacgcuucugucgc

SEQ ID NO: 1969025 - RNA, 14 nt, Shigella flexneri 2a str. 301
gaacguaggcugga

SEQ ID NO: 1969026 - RNA, 22 nt, Shigella flexneri 2a str. 301
gaacggucgccgcgcaaaucca

SEQ ID NO: 1969027 - RNA, 15 nt, Shigella flexneri 2a str. 301
gaacgugacacgcag

SEQ ID NO: 1969028 - RNA, 18 nt, Shigella flexneri 2a str. 301
gaacuccagcccggaaga

SEQ ID NO: 1969029 - RNA, 17 nt, Shigella flexneri 2a str. 301
gaacacucuuccagucg

SEQ ID NO: 1969030 - RNA, 22 nt, Shigella flexneri 2a str. 301
gaaccacggaauaaccagcgaa

SEQ ID NO: 1969031 - RNA, 17 nt, Shigella flexneri 2a str. 301
gaaccaugucaucaauu

SEQ ID NO: 1969032 - RNA, 16 nt, Shigella flexneri 2a str. 301
gaaccggcuggccgua

SEQ ID NO: 1969033 - RNA, 14 nt, Shigella flexneri 2a str. 301
gaaccggcgcguua

SEQ ID NO: 1969034 - RNA, 17 nt, Shigella flexneri 2a str. 301
gaacgaccaguucacac

SEQ ID NO: 1969035 - RNA, 24 nt, Shigella flexneri 2a str. 301
aaccugaccuuuuuucagcggugc

SEQ ID NO: 1969036 - RNA, 22 nt, Shigella flexneri 2a str. 301
gaaaaggcguucacgccgcauc

SEQ ID NO: 1969037 - RNA, 16 nt, Shigella flexneri 2a str. 301
gaaaaguuacgguuaa

SEQ ID NO: 1969038 - RNA, 17 nt, Shigella flexneri 2a str. 301
gaaaagcguuacgacug

SEQ ID NO: 1969039 - RNA, 14 nt, Shigella flexneri 2a str. 301
gaaaagcaccuguc

SEQ ID NO: 1969040 - RNA, 21 nt, Shigella flexneri 2a str. 301
aaccuuggucgaagcuucuca

SEQ ID NO: 1969041 - RNA, 18 nt, Shigella flexneri 2a str. 301
aaccuguggugcaggcgc

SEQ ID NO: 1969042 - RNA, 17 nt, Shigella flexneri 2a str. 301
gaaaaucacaggcgcga

SEQ ID NO: 1969043 - RNA, 18 nt, Shigella flexneri 2a str. 301
gaaaaucauucgccgguu

SEQ ID NO: 1969044 - RNA, 16 nt, Shigella flexneri 2a str. 301
gaaaccacccaccgca

SEQ ID NO: 1969045 - RNA, 19 nt, Shigella flexneri 2a str. 301
gaaaaugggagcugggagu

SEQ ID NO: 1969046 - RNA, 21 nt, Shigella flexneri 2a str. 301
gaaaauggccgucaggguugc

SEQ ID NO: 1969047 - RNA, 14 nt, Shigella flexneri 2a str. 301
gaaacaacaccgug

SEQ ID NO: 1969048 - RNA, 23 nt, Shigella flexneri 2a str. 301
gaaacaaaaaaaccgccucaggc

SEQ ID NO: 1969049 - RNA, 23 nt, Shigella flexneri 2a str. 301
gaaacggagaucgagcgcgagca

SEQ ID NO: 1969050 - RNA, 15 nt, Shigella flexneri 2a str. 301
gaaauaccagguugc

SEQ ID NO: 1969051 - RNA, 16 nt, Shigella flexneri 2a str. 301
gaaauagaaacuggcc

SEQ ID NO: 1969052 - RNA, 15 nt, Shigella flexneri 2a str. 301
gaaaucaccaccgca

SEQ ID NO: 1969053 - RNA, 18 nt, Shigella flexneri 2a str. 301
gaaauauagaccgccauc

SEQ ID NO: 1969054 - RNA, 22 nt, Shigella flexneri 2a str. 301
gaacaccguaccaucguaagcg

SEQ ID NO: 1969055 - RNA, 22 nt, Shigella flexneri 2a str. 301
gaacaacccggcgaaagagcug

SEQ ID NO: 1969056 - RNA, 21 nt, Shigella flexneri 2a str. 301
gaacaauaaauuucaccguuc

SEQ ID NO: 1969057 - RNA, 22 nt, Shigella flexneri 2a str. 301
gaacaauaaauuucaccguucg

SEQ ID NO: 1969058 - RNA, 19 nt, Shigella flexneri 2a str. 301
gaaauuuaucgcauauccu

SEQ ID NO: 1969059 - RNA, 20 nt, Shigella flexneri 2a str. 301
gcgcguuaaagagcauuaca

SEQ ID NO: 1969060 - RNA, 14 nt, Shigella flexneri 2a str. 301
gcgcguuagccaua

SEQ ID NO: 1969061 - RNA, 23 nt, Shigella flexneri 2a str. 301
gcgcguugcuggauuuucugugc

SEQ ID NO: 1969062 - RNA, 16 nt, Shigella flexneri 2a str. 301
gcgcgucuuguacuuc

SEQ ID NO: 1969063 - RNA, 14 nt, Shigella flexneri 2a str. 301
gcgcguccccugcc

SEQ ID NO: 1969064 - RNA, 20 nt, Shigella flexneri 2a str. 301
gcgcuccgcuuaucaggccu

SEQ ID NO: 1969065 - RNA, 19 nt, Shigella flexneri 2a str. 301
gcgcuccagauuaccagcg

SEQ ID NO: 1969066 - RNA, 22 nt, Shigella flexneri 2a str. 301
gcgcucauuuucucuuucagcg

SEQ ID NO: 1969067 - RNA, 14 nt, Shigella flexneri 2a str. 301
gcgcuauccagcgc

SEQ ID NO: 1969068 - RNA, 23 nt, Shigella flexneri 2a str. 301
gcgcuaucaauacuuuccagcau

SEQ ID NO: 1969069 - RNA, 13 nt, Shigella flexneri 2a str. 301
gcgcuaucagcau

SEQ ID NO: 1969070 - RNA, 22 nt, Shigella flexneri 2a str. 301
gcgcuaucaaagggcaccggcg

SEQ ID NO: 1969071 - RNA, 19 nt, Shigella flexneri 2a str. 301
gcgcucaccauuuccggag

SEQ ID NO: 1969072 - RNA, 17 nt, Shigella flexneri 2a str. 301
gcgcuacggcguuucac

SEQ ID NO: 1969073 - RNA, 21 nt, Shigella flexneri 2a str. 301
gcgcuacugaaucccugcgaa

SEQ ID NO: 1969074 - RNA, 20 nt, Shigella flexneri 2a str. 301
gcgcuacgcucaucaggccu

SEQ ID NO: 1969075 - RNA, 20 nt, Shigella flexneri 2a str. 301
gcgcuacgcuuaucaggccu

SEQ ID NO: 1969076 - RNA, 18 nt, Shigella flexneri 2a str. 301
gcgcgggaaagcaaccga

SEQ ID NO: 1969077 - RNA, 23 nt, Shigella flexneri 2a str. 301
gcgcguaaauaccuuccggcgua

SEQ ID NO: 1969078 - RNA, 20 nt, Shigella flexneri 2a str. 301
gcgcgguuuguaggccggau

SEQ ID NO: 1969079 - RNA, 14 nt, Shigella flexneri 2a str. 301
gcgcggugcugaaa

SEQ ID NO: 1969080 - RNA, 17 nt, Shigella flexneri 2a str. 301
gcgcggguaaugccgac

SEQ ID NO: 1969081 - RNA, 15 nt, Shigella flexneri 2a str. 301
gcgcgcucagcgcca

SEQ ID NO: 1969082 - RNA, 15 nt, Shigella flexneri 2a str. 301
gcgcgcgauaucgcg

SEQ ID NO: 1969083 - RNA, 14 nt, Shigella flexneri 2a str. 301
gcgcgccaggcgcu

SEQ ID NO: 1969084 - RNA, 21 nt, Shigella flexneri 2a str. 301
gcgcgccgccaauaaucagcg

SEQ ID NO: 1969085 - RNA, 12 nt, Shigella flexneri 2a str. 301
gcgcgagccaua

SEQ ID NO: 1969086 - RNA, 20 nt, Shigella flexneri 2a str. 301
gcgcgaucgcaccaccauug

SEQ ID NO: 1969087 - RNA, 18 nt, Shigella flexneri 2a str. 301
gcgcgcaaucagcaccgc

SEQ ID NO: 1969088 - RNA, 14 nt, Shigella flexneri 2a str. 301
gcgcccaacaguag

SEQ ID NO: 1969089 - RNA, 16 nt, Shigella flexneri 2a str. 301
gcgccauaguuacgcg

SEQ ID NO: 1969090 - RNA, 19 nt, Shigella flexneri 2a str. 301
gcgccauugccauaagcgg

SEQ ID NO: 1969091 - RNA, 16 nt, Shigella flexneri 2a str. 301
gcgcccgccagcaccg

SEQ ID NO: 1969092 - RNA, 22 nt, Shigella flexneri 2a str. 301
gcgccgacccugcguugucgca

SEQ ID NO: 1969093 - RNA, 14 nt, Shigella flexneri 2a str. 301
gcgccgccagucga

SEQ ID NO: 1969094 - RNA, 21 nt, Shigella flexneri 2a str. 301
gcgcaggguuugcaucgccau

SEQ ID NO: 1969095 - RNA, 14 nt, Shigella flexneri 2a str. 301
gcgccaccagcgcc

SEQ ID NO: 1969096 - RNA, 18 nt, Shigella flexneri 2a str. 301
gcgcaucuuauccggccu

SEQ ID NO: 1969097 - RNA, 13 nt, Shigella flexneri 2a str. 301
gcgcauguccgcu

SEQ ID NO: 1969098 - RNA, 16 nt, Shigella flexneri 2a str. 301
gcgcauguuggcgcgg

SEQ ID NO: 1969099 - RNA, 20 nt, Shigella flexneri 2a str. 301
gcgcauuaaaaacccgccau

SEQ ID NO: 1969100 - RNA, 14 nt, Shigella flexneri 2a str. 301
gcgcauaacugccg

SEQ ID NO: 1969101 - RNA, 17 nt, Shigella flexneri 2a str. 301
gcgcauaacugccggau

SEQ ID NO: 1969102 - RNA, 18 nt, Shigella flexneri 2a str. 301
gcgcagugccuucuggug

SEQ ID NO: 1969103 - RNA, 22 nt, Shigella flexneri 2a str. 301
gcgauauccagcgauaccggug

SEQ ID NO: 1969104 - RNA, 20 nt, Shigella flexneri 2a str. 301
gcgcaauucccggaccguca

SEQ ID NO: 1969105 - RNA, 21 nt, Shigella flexneri 2a str. 301
gcgcaauuggcacgccgacau

SEQ ID NO: 1969106 - RNA, 21 nt, Shigella flexneri 2a str. 301
gcgcacgucaccgcagcaucg

SEQ ID NO: 1969107 - RNA, 23 nt, Shigella flexneri 2a str. 301
gcgcagauagagcgccugcagac

SEQ ID NO: 1969108 - RNA, 18 nt, Shigella flexneri 2a str. 301
gcgcagaguuuccaggcu

SEQ ID NO: 1969109 - RNA, 13 nt, Shigella flexneri 2a str. 301
gcgcagccagcgu

SEQ ID NO: 1969110 - RNA, 16 nt, Shigella flexneri 2a str. 301
gccuacgugaggcauc

SEQ ID NO: 1969111 - RNA, 21 nt, Shigella flexneri 2a str. 301
gccguuauccugaucaagcac

SEQ ID NO: 1969112 - RNA, 20 nt, Shigella flexneri 2a str. 301
gccucuuuuuucagugcacc

SEQ ID NO: 1969113 - RNA, 23 nt, Shigella flexneri 2a str. 301
gccugagaagcgcaacgcaucag

SEQ ID NO: 1969114 - RNA, 23 nt, Shigella flexneri 2a str. 301
gccugauaagcguagcgcaucag

SEQ ID NO: 1969115 - RNA, 20 nt, Shigella flexneri 2a str. 301
gccugauaagcguagcgcau

SEQ ID NO: 1969116 - RNA, 15 nt, Shigella flexneri 2a str. 301
gccugauaagacgcg

SEQ ID NO: 1969117 - RNA, 16 nt, Shigella flexneri 2a str. 301
gccugagcggcaaugc

SEQ ID NO: 1969118 - RNA, 21 nt, Shigella flexneri 2a str. 301
gccugaugaugagucugaccg

SEQ ID NO: 1969119 - RNA, 16 nt, Shigella flexneri 2a str. 301
gccugcaccauugcug

SEQ ID NO: 1969120 - RNA, 23 nt, Shigella flexneri 2a str. 301
gccugaugcgacgcuugacgcgu

SEQ ID NO: 1969121 - RNA, 20 nt, Shigella flexneri 2a str. 301
gccucaguggcugcguuuca

SEQ ID NO: 1969122 - RNA, 20 nt, Shigella flexneri 2a str. 301
gccucaagaaucacuucauc

SEQ ID NO: 1969123 - RNA, 21 nt, Shigella flexneri 2a str. 301
gccgcucuuuuguucgcggcg

SEQ ID NO: 1969124 - RNA, 23 nt, Shigella flexneri 2a str. 301
gccgguuucacuauuaccgaugu

SEQ ID NO: 1969125 - RNA, 23 nt, Shigella flexneri 2a str. 301
gccgguugccccgcacgcuucau

SEQ ID NO: 1969126 - RNA, 20 nt, Shigella flexneri 2a str. 301
gccguaagcaaacagcgcaa

SEQ ID NO: 1969127 - RNA, 19 nt, Shigella flexneri 2a str. 301
gccguaaaucccagugccu

SEQ ID NO: 1969128 - RNA, 20 nt, Shigella flexneri 2a str. 301
gccguaauauuucucggcaa

SEQ ID NO: 1969129 - RNA, 20 nt, Shigella flexneri 2a str. 301
gccgguuuguuauccaccga

SEQ ID NO: 1969130 - RNA, 14 nt, Shigella flexneri 2a str. 301
gccgguuaauacgc

SEQ ID NO: 1969131 - RNA, 19 nt, Shigella flexneri 2a str. 301
gccggggagauauucccca

SEQ ID NO: 1969132 - RNA, 16 nt, Shigella flexneri 2a str. 301
gccgggguagaccgcg

SEQ ID NO: 1969133 - RNA, 15 nt, Shigella flexneri 2a str. 301
gccgguacagccgga

SEQ ID NO: 1969134 - RNA, 15 nt, Shigella flexneri 2a str. 301
gcgacgaacagcuca

SEQ ID NO: 1969135 - RNA, 21 nt, Shigella flexneri 2a str. 301
gcgacgccggucgcgucuuau

SEQ ID NO: 1969136 - RNA, 12 nt, Shigella flexneri 2a str. 301
gcgacgauaacc

SEQ ID NO: 1969137 - RNA, 21 nt, Shigella flexneri 2a str. 301
gcgaccggcgucgcauccggc

SEQ ID NO: 1969138 - RNA, 15 nt, Shigella flexneri 2a str. 301
gcgaccauacagcag

SEQ ID NO: 1969139 - RNA, 16 nt, Shigella flexneri 2a str. 301
gcgaauggcaugcucc

SEQ ID NO: 1969140 - RNA, 14 nt, Shigella flexneri 2a str. 301
gcgaaucgcuucau

SEQ ID NO: 1969141 - RNA, 13 nt, Shigella flexneri 2a str. 301
gcgacauggcgaa

SEQ ID NO: 1969142 - RNA, 17 nt, Shigella flexneri 2a str. 301
gcgacauugaccagcca

SEQ ID NO: 1969143 - RNA, 19 nt, Shigella flexneri 2a str. 301
gcgacagauuuugccagca

SEQ ID NO: 1969144 - RNA, 21 nt, Shigella flexneri 2a str. 301
gcgacacuguucgcgucuuau

SEQ ID NO: 1969145 - RNA, 21 nt, Shigella flexneri 2a str. 301
gcgacgcugauagcgucuuau

SEQ ID NO: 1969146 - RNA, 15 nt, Shigella flexneri 2a str. 301
gcgacgcucggcugu

SEQ ID NO: 1969147 - RNA, 23 nt, Shigella flexneri 2a str. 301
gcgagaaguucugcagcccgaac

SEQ ID NO: 1969148 - RNA, 20 nt, Shigella flexneri 2a str. 301
gcgagcaaaaucguaagcag

SEQ ID NO: 1969149 - RNA, 22 nt, Shigella flexneri 2a str. 301
gcgacuuugccuggcggcagau

SEQ ID NO: 1969150 - RNA, 23 nt, Shigella flexneri 2a str. 301
gcgagucgagaucccuuccggug

SEQ ID NO: 1969151 - RNA, 19 nt, Shigella flexneri 2a str. 301
gcgaagcuggucagcaucg

SEQ ID NO: 1969152 - RNA, 21 nt, Shigella flexneri 2a str. 301
gcgaauaguuuccgcuucugc

SEQ ID NO: 1969153 - RNA, 14 nt, Shigella flexneri 2a str. 301
gcgaaguucgccau

SEQ ID NO: 1969154 - RNA, 16 nt, Shigella flexneri 2a str. 301
gcgaaguucgccauca

SEQ ID NO: 1969155 - RNA, 19 nt, Shigella flexneri 2a str. 301
gcgaaauugguagacgcac

SEQ ID NO: 1969156 - RNA, 14 nt, Shigella flexneri 2a str. 301
gcgaaauugcugac

SEQ ID NO: 1969157 - RNA, 14 nt, Shigella flexneri 2a str. 301
gcgaaaguaccauu

SEQ ID NO: 1969158 - RNA, 13 nt, Shigella flexneri 2a str. 301
gcgaaauaaucaa

SEQ ID NO: 1969159 - RNA, 18 nt, Shigella flexneri 2a str. 301
gcgaacggauagcgaugg

SEQ ID NO: 1969160 - RNA, 19 nt, Shigella flexneri 2a str. 301
gccuuauccggccuacgau

SEQ ID NO: 1969161 - RNA, 19 nt, Shigella flexneri 2a str. 301
gccuuauccggccuacgaa

SEQ ID NO: 1969162 - RNA, 14 nt, Shigella flexneri 2a str. 301
gccuuaucuggccu

SEQ ID NO: 1969163 - RNA, 14 nt, Shigella flexneri 2a str. 301
gccuuauccggucu

SEQ ID NO: 1969164 - RNA, 12 nt, Shigella flexneri 2a str. 301
gccugugcgcgu

SEQ ID NO: 1969165 - RNA, 14 nt, Shigella flexneri 2a str. 301
gccugugucaggcc

SEQ ID NO: 1969166 - RNA, 22 nt, Shigella flexneri 2a str. 301
gccuguucgccgccgcuuucgu

SEQ ID NO: 1969167 - RNA, 16 nt, Shigella flexneri 2a str. 301
gccugcagggcuuuca

SEQ ID NO: 1969168 - RNA, 16 nt, Shigella flexneri 2a str. 301
gccuugcgcgcagugc

SEQ ID NO: 1969169 - RNA, 20 nt, Shigella flexneri 2a str. 301
gccuugauauaaaucccagg

SEQ ID NO: 1969170 - RNA, 12 nt, Shigella flexneri 2a str. 301
gccuuucucaga

SEQ ID NO: 1969171 - RNA, 21 nt, Shigella flexneri 2a str. 301
gccuuugaaaucgaacagguu

SEQ ID NO: 1969172 - RNA, 20 nt, Shigella flexneri 2a str. 301
gccuuugaaaucgaacaggu

SEQ ID NO: 1969173 - RNA, 13 nt, Shigella flexneri 2a str. 301
gccuuugaucuca

SEQ ID NO: 1969174 - RNA, 17 nt, Shigella flexneri 2a str. 301
gccuuuugcgccguaaa

SEQ ID NO: 1969175 - RNA, 15 nt, Shigella flexneri 2a str. 301
gcgaaaaagcguuca

SEQ ID NO: 1969176 - RNA, 21 nt, Shigella flexneri 2a str. 301
gccuuuuucagccgcaaacuc

SEQ ID NO: 1969177 - RNA, 16 nt, Shigella flexneri 2a str. 301
gccuuuuuucgccgca

SEQ ID NO: 1969178 - RNA, 16 nt, Shigella flexneri 2a str. 301
gcgaaaaccgguaaca

SEQ ID NO: 1969179 - RNA, 19 nt, Shigella flexneri 2a str. 301
gcgaaaacgauguuugcug

SEQ ID NO: 1969180 - RNA, 19 nt, Shigella flexneri 2a str. 301
gcggccaugccauaacgcg

SEQ ID NO: 1969181 - RNA, 12 nt, Shigella flexneri 2a str. 301
gcggcaguucgu

SEQ ID NO: 1969182 - RNA, 22 nt, Shigella flexneri 2a str. 301
aagcgcacguuguuacaauuua

SEQ ID NO: 1969183 - RNA, 15 nt, Shigella flexneri 2a str. 301
aagcgcagcgcauca

SEQ ID NO: 1969184 - RNA, 16 nt, Shigella flexneri 2a str. 301
gcggcauccgguaacc

SEQ ID NO: 1969185 - RNA, 18 nt, Shigella flexneri 2a str. 301
gcggcaggcagcgccacg

SEQ ID NO: 1969186 - RNA, 15 nt, Shigella flexneri 2a str. 301
gcggcagcuccagca

SEQ ID NO: 1969187 - RNA, 20 nt, Shigella flexneri 2a str. 301
gcggcaggcagcgccacgua

SEQ ID NO: 1969188 - RNA, 21 nt, Shigella flexneri 2a str. 301
aagcgauaacgcuggcagcaa

SEQ ID NO: 1969189 - RNA, 21 nt, Shigella flexneri 2a str. 301
aagcgaguugcgccaguauga

SEQ ID NO: 1969190 - RNA, 14 nt, Shigella flexneri 2a str. 301
aagcgagcaguaca

SEQ ID NO: 1969191 - RNA, 17 nt, Shigella flexneri 2a str. 301
gcggcguaucuuccagg

SEQ ID NO: 1969192 - RNA, 18 nt, Shigella flexneri 2a str. 301
aagcguuuugccaguucg

SEQ ID NO: 1969193 - RNA, 17 nt, Shigella flexneri 2a str. 301
gcggcgugaacgccuua

SEQ ID NO: 1969194 - RNA, 21 nt, Shigella flexneri 2a str. 301
aagcgucaccggaaccgucgc

SEQ ID NO: 1969195 - RNA, 18 nt, Shigella flexneri 2a str. 301
aagcguaauugauccgcg

SEQ ID NO: 1969196 - RNA, 21 nt, Shigella flexneri 2a str. 301
aagcguagcgcaucgggcgau

SEQ ID NO: 1969197 - RNA, 13 nt, Shigella flexneri 2a str. 301
gcggcuuaucgcg

SEQ ID NO: 1969198 - RNA, 18 nt, Shigella flexneri 2a str. 301
gcgggaaagcaaccgacg

SEQ ID NO: 1969199 - RNA, 14 nt, Shigella flexneri 2a str. 301
gcgggccacugacg

SEQ ID NO: 1969200 - RNA, 16 nt, Shigella flexneri 2a str. 301
gcggcguuccaccgcu

SEQ ID NO: 1969201 - RNA, 20 nt, Shigella flexneri 2a str. 301
gcggcugcugauguucgcca

SEQ ID NO: 1969202 - RNA, 18 nt, Shigella flexneri 2a str. 301
gcguauccgaugaaucac

SEQ ID NO: 1969203 - RNA, 13 nt, Shigella flexneri 2a str. 301
gcguauccaucac

SEQ ID NO: 1969204 - RNA, 19 nt, Shigella flexneri 2a str. 301
gcgucaagcgucgcaucag

SEQ ID NO: 1969205 - RNA, 18 nt, Shigella flexneri 2a str. 301
gcgucaaggucaacaguu

SEQ ID NO: 1969206 - RNA, 14 nt, Shigella flexneri 2a str. 301
gcgucaggcgcgug

SEQ ID NO: 1969207 - RNA, 20 nt, Shigella flexneri 2a str. 301
gcgucaggucacccaacaug

SEQ ID NO: 1969208 - RNA, 20 nt, Shigella flexneri 2a str. 301
gcguccauuuugagggaaac

SEQ ID NO: 1969209 - RNA, 18 nt, Shigella flexneri 2a str. 301
gcgucgacauagccaucc

SEQ ID NO: 1969210 - RNA, 17 nt, Shigella flexneri 2a str. 301
gcgucgcauccggcacu

SEQ ID NO: 1969211 - RNA, 16 nt, Shigella flexneri 2a str. 301
gcgucgcauccggcaa

SEQ ID NO: 1969212 - RNA, 22 nt, Shigella flexneri 2a str. 301
gcgucgcaucaggcaaugugcu

SEQ ID NO: 1969213 - RNA, 21 nt, Shigella flexneri 2a str. 301
gcguggcaucaauaccgcgua

SEQ ID NO: 1969214 - RNA, 16 nt, Shigella flexneri 2a str. 301
gcgugauuccagacgg

SEQ ID NO: 1969215 - RNA, 13 nt, Shigella flexneri 2a str. 301
gcguguucgguaa

SEQ ID NO: 1969216 - RNA, 22 nt, Shigella flexneri 2a str. 301
gcguucacgacgcauccggcau

SEQ ID NO: 1969217 - RNA, 18 nt, Shigella flexneri 2a str. 301
gcgugagaacaccaccug

SEQ ID NO: 1969218 - RNA, 22 nt, Shigella flexneri 2a str. 301
gcgugaucuaaaaucgcuucag

SEQ ID NO: 1969219 - RNA, 14 nt, Shigella flexneri 2a str. 301
gcgucuuauccggc

SEQ ID NO: 1969220 - RNA, 20 nt, Shigella flexneri 2a str. 301
gcgucuuaucaugccuacag

SEQ ID NO: 1969221 - RNA, 16 nt, Shigella flexneri 2a str. 301
gcgucuuaucaggccu

SEQ ID NO: 1969222 - RNA, 21 nt, Shigella flexneri 2a str. 301
gcgucuuaucaggccuacaag

SEQ ID NO: 1969223 - RNA, 16 nt, Shigella flexneri 2a str. 301
gcgucuuaucuggccu

SEQ ID NO: 1969224 - RNA, 23 nt, Shigella flexneri 2a str. 301
gcguaauccugaaagcgugucau

SEQ ID NO: 1969225 - RNA, 13 nt, Shigella flexneri 2a str. 301
gcguaaacgccuu

SEQ ID NO: 1969226 - RNA, 22 nt, Shigella flexneri 2a str. 301
gcguaaaggcggcagaacagaa

SEQ ID NO: 1969227 - RNA, 17 nt, Shigella flexneri 2a str. 301
gcguaagcgcggauuuu

SEQ ID NO: 1969228 - RNA, 20 nt, Shigella flexneri 2a str. 301
gcguacauugccgacauggc

SEQ ID NO: 1969229 - RNA, 15 nt, Shigella flexneri 2a str. 301
gcguaccaggcgugg

SEQ ID NO: 1969230 - RNA, 16 nt, Shigella flexneri 2a str. 301
gcgguugcaggcuauu

SEQ ID NO: 1969231 - RNA, 18 nt, Shigella flexneri 2a str. 301
gcgguuugcgcauccagc

SEQ ID NO: 1969232 - RNA, 14 nt, Shigella flexneri 2a str. 301
gcgguugugccgga

SEQ ID NO: 1969233 - RNA, 14 nt, Shigella flexneri 2a str. 301
gcggugucgccaga

SEQ ID NO: 1969234 - RNA, 19 nt, Shigella flexneri 2a str. 301
gcgguuaacaauacgccca

SEQ ID NO: 1969235 - RNA, 16 nt, Shigella flexneri 2a str. 301
gcgguuaaauuccguu

SEQ ID NO: 1969236 - RNA, 23 nt, Shigella flexneri 2a str. 301
gcgguaacaggauggcguucgca

SEQ ID NO: 1969237 - RNA, 16 nt, Shigella flexneri 2a str. 301
gcggugaccagcagca

SEQ ID NO: 1969238 - RNA, 20 nt, Shigella flexneri 2a str. 301
gcggugccaucgauaaucac

SEQ ID NO: 1969239 - RNA, 16 nt, Shigella flexneri 2a str. 301
gcggugacguugucau

SEQ ID NO: 1969240 - RNA, 14 nt, Shigella flexneri 2a str. 301
gcggugagcguuuc

SEQ ID NO: 1969241 - RNA, 22 nt, Shigella flexneri 2a str. 301
gcguucacgccgcauccggcau

SEQ ID NO: 1969242 - RNA, 14 nt, Shigella flexneri 2a str. 301
gcguuccacgugcg

SEQ ID NO: 1969243 - RNA, 18 nt, Shigella flexneri 2a str. 301
gcucauaaaaucacgcgc

SEQ ID NO: 1969244 - RNA, 23 nt, Shigella flexneri 2a str. 301
gcucauagggugugacgacacca

SEQ ID NO: 1969245 - RNA, 16 nt, Shigella flexneri 2a str. 301
gcucaucagcccggca

SEQ ID NO: 1969246 - RNA, 13 nt, Shigella flexneri 2a str. 301
gcucccgcagcca

SEQ ID NO: 1969247 - RNA, 18 nt, Shigella flexneri 2a str. 301
gcuccauacugccggcau

SEQ ID NO: 1969248 - RNA, 16 nt, Shigella flexneri 2a str. 301
gcuccagugcgcuuua

SEQ ID NO: 1969249 - RNA, 21 nt, Shigella flexneri 2a str. 301
gcucauucuuccuccagcggu

SEQ ID NO: 1969250 - RNA, 16 nt, Shigella flexneri 2a str. 301
gcuccagcagguuuaa

SEQ ID NO: 1969251 - RNA, 18 nt, Shigella flexneri 2a str. 301
gcuccaccgauuuugaga

SEQ ID NO: 1969252 - RNA, 16 nt, Shigella flexneri 2a str. 301
gcucgcuucaucugcc

SEQ ID NO: 1969253 - RNA, 21 nt, Shigella flexneri 2a str. 301
gcucgcgguuagcggcuucgu

SEQ ID NO: 1969254 - RNA, 16 nt, Shigella flexneri 2a str. 301
gcucggaguaacaggu

SEQ ID NO: 1969255 - RNA, 15 nt, Shigella flexneri 2a str. 301
gcucggcaacaccuc

SEQ ID NO: 1969256 - RNA, 21 nt, Shigella flexneri 2a str. 301
gcucgcggugacgaucguggu

SEQ ID NO: 1969257 - RNA, 17 nt, Shigella flexneri 2a str. 301
gcucccugcggcgauga

SEQ ID NO: 1969258 - RNA, 22 nt, Shigella flexneri 2a str. 301
gcucccugaauaacaccagcca

SEQ ID NO: 1969259 - RNA, 13 nt, Shigella flexneri 2a str. 301
gcucgacagcgcu

SEQ ID NO: 1969260 - RNA, 20 nt, Shigella flexneri 2a str. 301
gcugaaauaacguaggccug

SEQ ID NO: 1969261 - RNA, 15 nt, Shigella flexneri 2a str. 301
gcugaacgccacgcu

SEQ ID NO: 1969262 - RNA, 16 nt, Shigella flexneri 2a str. 301
gcugaaccguaggccg

SEQ ID NO: 1969263 - RNA, 15 nt, Shigella flexneri 2a str. 301
gcugacaacgcugaa

SEQ ID NO: 1969264 - RNA, 20 nt, Shigella flexneri 2a str. 301
gcucguucagcggcccguug

SEQ ID NO: 1969265 - RNA, 15 nt, Shigella flexneri 2a str. 301
gcugauaugccagac

SEQ ID NO: 1969266 - RNA, 17 nt, Shigella flexneri 2a str. 301
gcugauauucgacacca

SEQ ID NO: 1969267 - RNA, 22 nt, Shigella flexneri 2a str. 301
gcugauaaaucccgccgcuuca

SEQ ID NO: 1969268 - RNA, 17 nt, Shigella flexneri 2a str. 301
gcugacugucgcagcca

SEQ ID NO: 1969269 - RNA, 20 nt, Shigella flexneri 2a str. 301
gcugagaucaaacucuuuca

SEQ ID NO: 1969270 - RNA, 21 nt, Shigella flexneri 2a str. 301
gcugagauacucaagcagcca

SEQ ID NO: 1969271 - RNA, 19 nt, Shigella flexneri 2a str. 301
gcugacuuugauccagcca

SEQ ID NO: 1969272 - RNA, 22 nt, Shigella flexneri 2a str. 301
gcugagauuuaugacaaacgca

SEQ ID NO: 1969273 - RNA, 21 nt, Shigella flexneri 2a str. 301
gcugcauugcccaauacagcg

SEQ ID NO: 1969274 - RNA, 20 nt, Shigella flexneri 2a str. 301
gcugcaucuguuuuccgaug

SEQ ID NO: 1969275 - RNA, 13 nt, Shigella flexneri 2a str. 301
gcugccgacgcca

SEQ ID NO: 1969276 - RNA, 23 nt, Shigella flexneri 2a str. 301
gcugaugauuaacagcaaacagu

SEQ ID NO: 1969277 - RNA, 20 nt, Shigella flexneri 2a str. 301
gcugaugcaggcgaucgacg

SEQ ID NO: 1969278 - RNA, 14 nt, Shigella flexneri 2a str. 301
gcugaugccaggcu

SEQ ID NO: 1969279 - RNA, 18 nt, Shigella flexneri 2a str. 301
gcugcauccgcgcuuucu

SEQ ID NO: 1969280 - RNA, 14 nt, Shigella flexneri 2a str. 301
gcugcauccgcgcu

SEQ ID NO: 1969281 - RNA, 16 nt, Shigella flexneri 2a str. 301
gcugccgccaguuuac

SEQ ID NO: 1969282 - RNA, 18 nt, Shigella flexneri 2a str. 301
gcugcgguuuacgccagg

SEQ ID NO: 1969283 - RNA, 16 nt, Shigella flexneri 2a str. 301
gcugcgguugaacgcc

SEQ ID NO: 1969284 - RNA, 14 nt, Shigella flexneri 2a str. 301
ggaaagaucgccac

SEQ ID NO: 1969285 - RNA, 18 nt, Shigella flexneri 2a str. 301
ggaaaucccgugacggua

SEQ ID NO: 1969286 - RNA, 21 nt, Shigella flexneri 2a str. 301
ggaaaucccgugacgguaacg

SEQ ID NO: 1969287 - RNA, 23 nt, Shigella flexneri 2a str. 301
ggaaauauauuccccggucagca

SEQ ID NO: 1969288 - RNA, 21 nt, Shigella flexneri 2a str. 301
ggaaacucugcuggcggaaca

SEQ ID NO: 1969289 - RNA, 19 nt, Shigella flexneri 2a str. 301
ggaaacugucaauaaacgc

SEQ ID NO: 1969290 - RNA, 19 nt, Shigella flexneri 2a str. 301
gcuuuuuuggcgaucuccg

SEQ ID NO: 1969291 - RNA, 17 nt, Shigella flexneri 2a str. 301
gcuuuuuuuacgucugc

SEQ ID NO: 1969292 - RNA, 19 nt, Shigella flexneri 2a str. 301
gcuuuggcgugagaucgcg

SEQ ID NO: 1969293 - RNA, 18 nt, Shigella flexneri 2a str. 301
gcuuuguuuaugccggau

SEQ ID NO: 1969294 - RNA, 17 nt, Shigella flexneri 2a str. 301
gcuuuucagugccaggu

SEQ ID NO: 1969295 - RNA, 17 nt, Shigella flexneri 2a str. 301
gcuuuuguaggccggau

SEQ ID NO: 1969296 - RNA, 19 nt, Shigella flexneri 2a str. 301
gcuuuuuaguaucuauuca

SEQ ID NO: 1969297 - RNA, 23 nt, Shigella flexneri 2a str. 301
gcuuugacgaugcuccacuccug

SEQ ID NO: 1969298 - RNA, 21 nt, Shigella flexneri 2a str. 301
gcuuucuucaaccaggcggau

SEQ ID NO: 1969299 - RNA, 15 nt, Shigella flexneri 2a str. 301
gcuuugccgucaucu

SEQ ID NO: 1969300 - RNA, 13 nt, Shigella flexneri 2a str. 301
gcuuucaccgucg

SEQ ID NO: 1969301 - RNA, 14 nt, Shigella flexneri 2a str. 301
gcuuuaucgccgcu

SEQ ID NO: 1969302 - RNA, 12 nt, Shigella flexneri 2a str. 301
gcuuuccacgca

SEQ ID NO: 1969303 - RNA, 18 nt, Shigella flexneri 2a str. 301
gcuuucagagaagcaccg

SEQ ID NO: 1969304 - RNA, 17 nt, Shigella flexneri 2a str. 301
gcuuucacgccgccguu

SEQ ID NO: 1969305 - RNA, 13 nt, Shigella flexneri 2a str. 301
gcuuuaaacgauu

SEQ ID NO: 1969306 - RNA, 22 nt, Shigella flexneri 2a str. 301
gcuugcaccggcgacaucccag

SEQ ID NO: 1969307 - RNA, 18 nt, Shigella flexneri 2a str. 301
gcuugaugcacugggaga

SEQ ID NO: 1969308 - RNA, 14 nt, Shigella flexneri 2a str. 301
gcuugccgcgcucu

SEQ ID NO: 1969309 - RNA, 21 nt, Shigella flexneri 2a str. 301
gcuugccgcgcucugccagca

SEQ ID NO: 1969310 - RNA, 18 nt, Shigella flexneri 2a str. 301
gcuugcgcgcaaucagca

SEQ ID NO: 1969311 - RNA, 15 nt, Shigella flexneri 2a str. 301
gcuucuuccggcgau

SEQ ID NO: 1969312 - RNA, 22 nt, Shigella flexneri 2a str. 301
gcuucugacauaaccacucacc

SEQ ID NO: 1969313 - RNA, 20 nt, Shigella flexneri 2a str. 301
gcuucucuucagccaacgca

SEQ ID NO: 1969314 - RNA, 12 nt, Shigella flexneri 2a str. 301
gcuucccaacgc

SEQ ID NO: 1969315 - RNA, 16 nt, Shigella flexneri 2a str. 301
gcuucccacgucagac

SEQ ID NO: 1969316 - RNA, 22 nt, Shigella flexneri 2a str. 301
gcuucccggcaaucgccagauc

SEQ ID NO: 1969317 - RNA, 15 nt, Shigella flexneri 2a str. 301
gcuuccggcaagcaa

SEQ ID NO: 1969318 - RNA, 16 nt, Shigella flexneri 2a str. 301
gcuuccgccagcggcg

SEQ ID NO: 1969319 - RNA, 20 nt, Shigella flexneri 2a str. 301
gcuucaggugcccaacauac

SEQ ID NO: 1969320 - RNA, 22 nt, Shigella flexneri 2a str. 301
gcuucagcgaucgcuuucgcuu

SEQ ID NO: 1969321 - RNA, 18 nt, Shigella flexneri 2a str. 301
gcuucagucgccagcgcc

SEQ ID NO: 1969322 - RNA, 21 nt, Shigella flexneri 2a str. 301
gcuucaucgguuaaccggcaa

SEQ ID NO: 1969323 - RNA, 20 nt, Shigella flexneri 2a str. 301
gcuucaucaucgcagauuuc

SEQ ID NO: 1969324 - RNA, 14 nt, Shigella flexneri 2a str. 301
gcuucggucagcac

SEQ ID NO: 1969325 - RNA, 22 nt, Shigella flexneri 2a str. 301
gcuucgguuuucgcgccagcca

SEQ ID NO: 1969326 - RNA, 17 nt, Shigella flexneri 2a str. 301
gcuggcggaaacggguu

SEQ ID NO: 1969327 - RNA, 17 nt, Shigella flexneri 2a str. 301
gcugggccgucagguga

SEQ ID NO: 1969328 - RNA, 11 nt, Shigella flexneri 2a str. 301
gcuggguaaau

SEQ ID NO: 1969329 - RNA, 14 nt, Shigella flexneri 2a str. 301
gcugggcgucaucc

SEQ ID NO: 1969330 - RNA, 14 nt, Shigella flexneri 2a str. 301
gcuggucagcaucg

SEQ ID NO: 1969331 - RNA, 18 nt, Shigella flexneri 2a str. 301
gcugguuuuguaggccgg

SEQ ID NO: 1969332 - RNA, 20 nt, Shigella flexneri 2a str. 301
gcuggugccaagcuccagca

SEQ ID NO: 1969333 - RNA, 18 nt, Shigella flexneri 2a str. 301
gcugucaacugcgccacu

SEQ ID NO: 1969334 - RNA, 14 nt, Shigella flexneri 2a str. 301
gcugucauccagca

SEQ ID NO: 1969335 - RNA, 19 nt, Shigella flexneri 2a str. 301
gcuguccgcuucaccaccg

SEQ ID NO: 1969336 - RNA, 18 nt, Shigella flexneri 2a str. 301
gcuguagaagcugacgac

SEQ ID NO: 1969337 - RNA, 18 nt, Shigella flexneri 2a str. 301
gcuguagcuguucuggcg

SEQ ID NO: 1969338 - RNA, 15 nt, Shigella flexneri 2a str. 301
gcuguagcuuuucau

SEQ ID NO: 1969339 - RNA, 18 nt, Shigella flexneri 2a str. 301
gcuguaaaggugauauag

SEQ ID NO: 1969340 - RNA, 16 nt, Shigella flexneri 2a str. 301
gcuguaauaccagccu

SEQ ID NO: 1969341 - RNA, 20 nt, Shigella flexneri 2a str. 301
gcugucggcugccagccaua

SEQ ID NO: 1969342 - RNA, 24 nt, Shigella flexneri 2a str. 301
gcugugaagauggcuaacuaggcg

SEQ ID NO: 1969343 - RNA, 23 nt, Shigella flexneri 2a str. 301
gcugugaauauucauuuccggcg

SEQ ID NO: 1969344 - RNA, 16 nt, Shigella flexneri 2a str. 301
gcuguuggugccagau

SEQ ID NO: 1969345 - RNA, 21 nt, Shigella flexneri 2a str. 301
gcuguuggaaucacucaucau

SEQ ID NO: 1969346 - RNA, 12 nt, Shigella flexneri 2a str. 301
gcuguuucgcuu

SEQ ID NO: 1969347 - RNA, 14 nt, Shigella flexneri 2a str. 301
gcuguugaaugccg

SEQ ID NO: 1969348 - RNA, 20 nt, Shigella flexneri 2a str. 301
gcuguuaucccagcaguuuc

SEQ ID NO: 1969349 - RNA, 21 nt, Shigella flexneri 2a str. 301
gcuuaaucaauugcaggaagg

SEQ ID NO: 1969350 - RNA, 13 nt, Shigella flexneri 2a str. 301
gcuuaaucaccag

SEQ ID NO: 1969351 - RNA, 13 nt, Shigella flexneri 2a str. 301
gcuuaaauacgcc

SEQ ID NO: 1969352 - RNA, 15 nt, Shigella flexneri 2a str. 301
gcuuaacagaacggc

SEQ ID NO: 1969353 - RNA, 21 nt, Shigella flexneri 2a str. 301
gcuuaccguccucuucccaga

SEQ ID NO: 1969354 - RNA, 18 nt, Shigella flexneri 2a str. 301
gcuuaacugcgcuuucgc

SEQ ID NO: 1969355 - RNA, 22 nt, Shigella flexneri 2a str. 301
gcuuaauugcccgaagccaauu

SEQ ID NO: 1969356 - RNA, 18 nt, Shigella flexneri 2a str. 301
gcuuaaugcauggcagau

SEQ ID NO: 1969357 - RNA, 15 nt, Shigella flexneri 2a str. 301
gcuuacacacccggc

SEQ ID NO: 1969358 - RNA, 18 nt, Shigella flexneri 2a str. 301
gcuucaacacaggccggc

SEQ ID NO: 1969359 - RNA, 14 nt, Shigella flexneri 2a str. 301
gcuucaaccaacgc

SEQ ID NO: 1969360 - RNA, 15 nt, Shigella flexneri 2a str. 301
gcuucaaccaacgca

SEQ ID NO: 1969361 - RNA, 16 nt, Shigella flexneri 2a str. 301
gcuucaaaguuugcac

SEQ ID NO: 1969362 - RNA, 17 nt, Shigella flexneri 2a str. 301
gcuucacccgcagcacg

SEQ ID NO: 1969363 - RNA, 16 nt, Shigella flexneri 2a str. 301
gcuucacuaugacgaa

SEQ ID NO: 1969364 - RNA, 15 nt, Shigella flexneri 2a str. 301
gcuucagauuauguc

SEQ ID NO: 1969365 - RNA, 21 nt, Shigella flexneri 2a str. 301
gcuuaucgccagcgccacgca

SEQ ID NO: 1969366 - RNA, 18 nt, Shigella flexneri 2a str. 301
gcuuaucaggccuacgua

SEQ ID NO: 1969367 - RNA, 18 nt, Shigella flexneri 2a str. 301
gcuuaucaggccuacgcg

SEQ ID NO: 1969368 - RNA, 21 nt, Shigella flexneri 2a str. 301
gcuuacguuacccagcacgga

SEQ ID NO: 1969369 - RNA, 19 nt, Shigella flexneri 2a str. 301
gcuuaucaggccuacagca

SEQ ID NO: 1969370 - RNA, 17 nt, Shigella flexneri 2a str. 301
gcuuaucaggccuacca

SEQ ID NO: 1969371 - RNA, 20 nt, Shigella flexneri 2a str. 301
ggccugauaagcguagcgca

SEQ ID NO: 1969372 - RNA, 20 nt, Shigella flexneri 2a str. 301
ggccugauaagcgcagcgca

SEQ ID NO: 1969373 - RNA, 15 nt, Shigella flexneri 2a str. 301
ggccugagaagcgca

SEQ ID NO: 1969374 - RNA, 20 nt, Shigella flexneri 2a str. 301
ggccuacaaguccguugaaa

SEQ ID NO: 1969375 - RNA, 23 nt, Shigella flexneri 2a str. 301
ggccuacaaaaucuauugcaaca

SEQ ID NO: 1969376 - RNA, 13 nt, Shigella flexneri 2a str. 301
ggccugcacugca

SEQ ID NO: 1969377 - RNA, 19 nt, Shigella flexneri 2a str. 301
ggcccggauucagauugca

SEQ ID NO: 1969378 - RNA, 17 nt, Shigella flexneri 2a str. 301
ggccacagcgccagaca

SEQ ID NO: 1969379 - RNA, 19 nt, Shigella flexneri 2a str. 301
ggccaauaacccgcuguaa

SEQ ID NO: 1969380 - RNA, 22 nt, Shigella flexneri 2a str. 301
ggccaaugccucuacgcccggu

SEQ ID NO: 1969381 - RNA, 22 nt, Shigella flexneri 2a str. 301
ggcagauacaaccaaucgcggc

SEQ ID NO: 1969382 - RNA, 22 nt, Shigella flexneri 2a str. 301
ggcagauaaacaaccccaucgc

SEQ ID NO: 1969383 - RNA, 14 nt, Shigella flexneri 2a str. 301
ggcaggcagcgcca

SEQ ID NO: 1969384 - RNA, 18 nt, Shigella flexneri 2a str. 301
ggcaguagggugauuuca

SEQ ID NO: 1969385 - RNA, 22 nt, Shigella flexneri 2a str. 301
ggcaugagccgccgccacacgc

SEQ ID NO: 1969386 - RNA, 20 nt, Shigella flexneri 2a str. 301
ggcacagccagcgcuggcaa

SEQ ID NO: 1969387 - RNA, 23 nt, Shigella flexneri 2a str. 301
ggcacauucugacugggucagua

SEQ ID NO: 1969388 - RNA, 14 nt, Shigella flexneri 2a str. 301
ggcaagaucgcgau

SEQ ID NO: 1969389 - RNA, 18 nt, Shigella flexneri 2a str. 301
ggcaaucguagcccagcu

SEQ ID NO: 1969390 - RNA, 14 nt, Shigella flexneri 2a str. 301
ggcaaaagucacca

SEQ ID NO: 1969391 - RNA, 17 nt, Shigella flexneri 2a str. 301
ggcaaaagacaccaucg

SEQ ID NO: 1969392 - RNA, 17 nt, Shigella flexneri 2a str. 301
ggcaaacaggcgcuggg

SEQ ID NO: 1969393 - RNA, 20 nt, Shigella flexneri 2a str. 301
ggauugugcaggcgcucaua

SEQ ID NO: 1969394 - RNA, 16 nt, Shigella flexneri 2a str. 301
ggauugcuucugcuuc

SEQ ID NO: 1969395 - RNA, 12 nt, Shigella flexneri 2a str. 301
ggauuucgcccg

SEQ ID NO: 1969396 - RNA, 16 nt, Shigella flexneri 2a str. 301
ggcaaagcugucacca

SEQ ID NO: 1969397 - RNA, 13 nt, Shigella flexneri 2a str. 301
ggcacccagcgcu

SEQ ID NO: 1969398 - RNA, 17 nt, Shigella flexneri 2a str. 301
ggaaauugcagagcugc

SEQ ID NO: 1969399 - RNA, 19 nt, Shigella flexneri 2a str. 301
ggaaauuauggaucaccau

SEQ ID NO: 1969400 - RNA, 23 nt, Shigella flexneri 2a str. 301
ggaucgaguucaucacaccaguc

SEQ ID NO: 1969401 - RNA, 13 nt, Shigella flexneri 2a str. 301
ggaugacgcguca

SEQ ID NO: 1969402 - RNA, 19 nt, Shigella flexneri 2a str. 301
ggaugcguucgcaccaccg

SEQ ID NO: 1969403 - RNA, 18 nt, Shigella flexneri 2a str. 301
ggaugcgcuucgcuuauc

SEQ ID NO: 1969404 - RNA, 16 nt, Shigella flexneri 2a str. 301
ggaugcggcgugaacg

SEQ ID NO: 1969405 - RNA, 16 nt, Shigella flexneri 2a str. 301
ggaugcgccgucagag

SEQ ID NO: 1969406 - RNA, 12 nt, Shigella flexneri 2a str. 301
ggaugcgccauc

SEQ ID NO: 1969407 - RNA, 14 nt, Shigella flexneri 2a str. 301
ggauuagcgaccga

SEQ ID NO: 1969408 - RNA, 13 nt, Shigella flexneri 2a str. 301
ggauuagccggau

SEQ ID NO: 1969409 - RNA, 22 nt, Shigella flexneri 2a str. 301
ggauucgaaccucggaaugccg

SEQ ID NO: 1969410 - RNA, 11 nt, Shigella flexneri 2a str. 301
ggcgcagcgcg

SEQ ID NO: 1969411 - RNA, 23 nt, Shigella flexneri 2a str. 301
ggcgcacucaaaacuacaauguc

SEQ ID NO: 1969412 - RNA, 14 nt, Shigella flexneri 2a str. 301
ggcgauucuuugcu

SEQ ID NO: 1969413 - RNA, 21 nt, Shigella flexneri 2a str. 301
ggcgauuuuccuccauuugcc

SEQ ID NO: 1969414 - RNA, 15 nt, Shigella flexneri 2a str. 301
ggcgaucgccugaau

SEQ ID NO: 1969415 - RNA, 19 nt, Shigella flexneri 2a str. 301
ggcgaugauuacgcgcuca

SEQ ID NO: 1969416 - RNA, 21 nt, Shigella flexneri 2a str. 301
ggcgauauuauccccugcgau

SEQ ID NO: 1969417 - RNA, 15 nt, Shigella flexneri 2a str. 301
ggcgaucccagagcg

SEQ ID NO: 1969418 - RNA, 21 nt, Shigella flexneri 2a str. 301
ggcgaggaacgaucccagcgu

SEQ ID NO: 1969419 - RNA, 16 nt, Shigella flexneri 2a str. 301
ggcgcuacgcuaucag

SEQ ID NO: 1969420 - RNA, 15 nt, Shigella flexneri 2a str. 301
ggcuaaaauauucag

SEQ ID NO: 1969421 - RNA, 14 nt, Shigella flexneri 2a str. 301
ggcguuuucuggca

SEQ ID NO: 1969422 - RNA, 21 nt, Shigella flexneri 2a str. 301
ggcguucacgccgcauccgac

SEQ ID NO: 1969423 - RNA, 15 nt, Shigella flexneri 2a str. 301
ggcguggucgguuaa

SEQ ID NO: 1969424 - RNA, 15 nt, Shigella flexneri 2a str. 301
ggcucaccugcacac

SEQ ID NO: 1969425 - RNA, 13 nt, Shigella flexneri 2a str. 301
ggcucaacaacug

SEQ ID NO: 1969426 - RNA, 14 nt, Shigella flexneri 2a str. 301
ggcucagccgauga

SEQ ID NO: 1969427 - RNA, 12 nt, Shigella flexneri 2a str. 301
ggcuauauugca

SEQ ID NO: 1969428 - RNA, 14 nt, Shigella flexneri 2a str. 301
ggcucaugcaucag

SEQ ID NO: 1969429 - RNA, 15 nt, Shigella flexneri 2a str. 301
ggcgugauuccagac

SEQ ID NO: 1969430 - RNA, 22 nt, Shigella flexneri 2a str. 301
ggcugauaugccagacuucauc

SEQ ID NO: 1969431 - RNA, 21 nt, Shigella flexneri 2a str. 301
ggcugagcaaacaguucugca

SEQ ID NO: 1969432 - RNA, 13 nt, Shigella flexneri 2a str. 301
ggcugcccaugcc

SEQ ID NO: 1969433 - RNA, 17 nt, Shigella flexneri 2a str. 301
ggcuuuuacgcauugcu

SEQ ID NO: 1969434 - RNA, 14 nt, Shigella flexneri 2a str. 301
ggcuuuucgacaga

SEQ ID NO: 1969435 - RNA, 18 nt, Shigella flexneri 2a str. 301
ggcuuuuuacgcgacaca

SEQ ID NO: 1969436 - RNA, 20 nt, Shigella flexneri 2a str. 301
ggcuuuuuacuucucagcgu

SEQ ID NO: 1969437 - RNA, 14 nt, Shigella flexneri 2a str. 301
ggcuuauccggcau

SEQ ID NO: 1969438 - RNA, 23 nt, Shigella flexneri 2a str. 301
ggcuguuuuccagcaccacuucc

SEQ ID NO: 1969439 - RNA, 20 nt, Shigella flexneri 2a str. 301
ggcugcugcuguagccgaug

SEQ ID NO: 1969440 - RNA, 14 nt, Shigella flexneri 2a str. 301
ggcuggcaaugacc

SEQ ID NO: 1969441 - RNA, 21 nt, Shigella flexneri 2a str. 301
ggcuggguuuccggaucgcca

SEQ ID NO: 1969442 - RNA, 22 nt, Shigella flexneri 2a str. 301
gguucaccgcgagcauaggcau

SEQ ID NO: 1969443 - RNA, 18 nt, Shigella flexneri 2a str. 301
gguucaacagcgugaacu

SEQ ID NO: 1969444 - RNA, 15 nt, Shigella flexneri 2a str. 301
gguuagcucaacgca

SEQ ID NO: 1969445 - RNA, 17 nt, Shigella flexneri 2a str. 301
gguucgauauccgccaa

SEQ ID NO: 1969446 - RNA, 21 nt, Shigella flexneri 2a str. 301
gguucguugaucacuuucacc

SEQ ID NO: 1969447 - RNA, 18 nt, Shigella flexneri 2a str. 301
gguuaacaucaugucggc

SEQ ID NO: 1969448 - RNA, 20 nt, Shigella flexneri 2a str. 301
gguuaagccucacgguucau

SEQ ID NO: 1969449 - RNA, 18 nt, Shigella flexneri 2a str. 301
gguuaacaagcggacuuc

SEQ ID NO: 1969450 - RNA, 20 nt, Shigella flexneri 2a str. 301
gguuacgcaccagauaagca

SEQ ID NO: 1969451 - RNA, 13 nt, Shigella flexneri 2a str. 301
gguuacggaucuc

SEQ ID NO: 1969452 - RNA, 22 nt, Shigella flexneri 2a str. 301
gguuacuuuuuaugucauuaac

SEQ ID NO: 1969453 - RNA, 15 nt, Shigella flexneri 2a str. 301
gguguuuaguuucgu

SEQ ID NO: 1969454 - RNA, 13 nt, Shigella flexneri 2a str. 301
gguugaacccuuu

SEQ ID NO: 1969455 - RNA, 16 nt, Shigella flexneri 2a str. 301
gguugauauuccaucu

SEQ ID NO: 1969456 - RNA, 23 nt, Shigella flexneri 2a str. 301
gguugccagcgccaacgcaccug

SEQ ID NO: 1969457 - RNA, 21 nt, Shigella flexneri 2a str. 301
gguugccccgcacgcuucauc

SEQ ID NO: 1969458 - RNA, 13 nt, Shigella flexneri 2a str. 301
gguugcccagcgc

SEQ ID NO: 1969459 - RNA, 13 nt, Shigella flexneri 2a str. 301
gguuucaacugcg

SEQ ID NO: 1969460 - RNA, 20 nt, Shigella flexneri 2a str. 301
gguuucagauuggugacaaa

SEQ ID NO: 1969461 - RNA, 16 nt, Shigella flexneri 2a str. 301
gguugguggcgguaac

SEQ ID NO: 1969462 - RNA, 22 nt, Shigella flexneri 2a str. 301
ggugguagugcccaauagggcu

SEQ ID NO: 1969463 - RNA, 18 nt, Shigella flexneri 2a str. 301
gguguacugcaacucgcg

SEQ ID NO: 1969464 - RNA, 22 nt, Shigella flexneri 2a str. 301
ggugaugguauuguccugcaag

SEQ ID NO: 1969465 - RNA, 22 nt, Shigella flexneri 2a str. 301
guagacuuuagcgcaaucgcau

SEQ ID NO: 1969466 - RNA, 16 nt, Shigella flexneri 2a str. 301
guagcggcucggaaua

SEQ ID NO: 1969467 - RNA, 14 nt, Shigella flexneri 2a str. 301
guagcgggcaguaa

SEQ ID NO: 1969468 - RNA, 17 nt, Shigella flexneri 2a str. 301
guagcgggaaagcguau

SEQ ID NO: 1969469 - RNA, 19 nt, Shigella flexneri 2a str. 301
guagcuacgcaucaacugc

SEQ ID NO: 1969470 - RNA, 19 nt, Shigella flexneri 2a str. 301
guaggcuggauaaggcguu

SEQ ID NO: 1969471 - RNA, 18 nt, Shigella flexneri 2a str. 301
guaggcuggauaaggcgu

SEQ ID NO: 1969472 - RNA, 12 nt, Shigella flexneri 2a str. 301
guaggcuggaua

SEQ ID NO: 1969473 - RNA, 19 nt, Shigella flexneri 2a str. 301
guauagaauuuacggcuag

SEQ ID NO: 1969474 - RNA, 19 nt, Shigella flexneri 2a str. 301
guaggccagauaaggcguu

SEQ ID NO: 1969475 - RNA, 19 nt, Shigella flexneri 2a str. 301
guaggccggauaaggcguu

SEQ ID NO: 1969476 - RNA, 20 nt, Shigella flexneri 2a str. 301
guaggccggucaagcgcagc

SEQ ID NO: 1969477 - RNA, 18 nt, Shigella flexneri 2a str. 301
guaggccguauccggcau

SEQ ID NO: 1969478 - RNA, 20 nt, Shigella flexneri 2a str. 301
guaggccugagaagcgcaac

SEQ ID NO: 1969479 - RNA, 19 nt, Shigella flexneri 2a str. 301
guaggccugauaagacgcg

SEQ ID NO: 1969480 - RNA, 17 nt, Shigella flexneri 2a str. 301
guaacgacugacuuucg

SEQ ID NO: 1969481 - RNA, 14 nt, Shigella flexneri 2a str. 301
guaacgcaccaggc

SEQ ID NO: 1969482 - RNA, 22 nt, Shigella flexneri 2a str. 301
guaacguuugauuaacgccaga

SEQ ID NO: 1969483 - RNA, 22 nt, Shigella flexneri 2a str. 301
guaacguaaccguugaccagca

SEQ ID NO: 1969484 - RNA, 18 nt, Shigella flexneri 2a str. 301
guaacgcuugcugauaac

SEQ ID NO: 1969485 - RNA, 19 nt, Shigella flexneri 2a str. 301
guaauguuuagagacgcau

SEQ ID NO: 1969486 - RNA, 13 nt, Shigella flexneri 2a str. 301
guaauucagccau

SEQ ID NO: 1969487 - RNA, 19 nt, Shigella flexneri 2a str. 301
guaaugccuuugaaaucga

SEQ ID NO: 1969488 - RNA, 23 nt, Shigella flexneri 2a str. 301
guaaacugcgucgacauagccau

SEQ ID NO: 1969489 - RNA, 20 nt, Shigella flexneri 2a str. 301
guaaacgccuuauccggccu

SEQ ID NO: 1969490 - RNA, 22 nt, Shigella flexneri 2a str. 301
guaaccagcgcagacaccagaa

SEQ ID NO: 1969491 - RNA, 14 nt, Shigella flexneri 2a str. 301
guaacauuacgugg

SEQ ID NO: 1969492 - RNA, 22 nt, Shigella flexneri 2a str. 301
guaacauaccuaaaagcacgcc

SEQ ID NO: 1969493 - RNA, 18 nt, Shigella flexneri 2a str. 301
guaacacauaacgccaau

SEQ ID NO: 1969494 - RNA, 22 nt, Shigella flexneri 2a str. 301
gguuucgggucgaaaauaucgg

SEQ ID NO: 1969495 - RNA, 12 nt, Shigella flexneri 2a str. 301
gguuucgugcau

SEQ ID NO: 1969496 - RNA, 22 nt, Shigella flexneri 2a str. 301
guaaaccggucguuaccaguaa

SEQ ID NO: 1969497 - RNA, 12 nt, Shigella flexneri 2a str. 301
guaccagcgcac

SEQ ID NO: 1969498 - RNA, 21 nt, Shigella flexneri 2a str. 301
guaccgccgcgaaccugugaa

SEQ ID NO: 1969499 - RNA, 20 nt, Shigella flexneri 2a str. 301
guaccaccagaaucgccagc

SEQ ID NO: 1969500 - RNA, 12 nt, Shigella flexneri 2a str. 301
guaccacgccac

SEQ ID NO: 1969501 - RNA, 13 nt, Shigella flexneri 2a str. 301
guaccagcaccgu

SEQ ID NO: 1969502 - RNA, 16 nt, Shigella flexneri 2a str. 301
guaccgguaaaccugg

SEQ ID NO: 1969503 - RNA, 16 nt, Shigella flexneri 2a str. 301
guacgcccacgccagc

SEQ ID NO: 1969504 - RNA, 15 nt, Shigella flexneri 2a str. 301
guacgcuccagcagg

SEQ ID NO: 1969505 - RNA, 11 nt, Shigella flexneri 2a str. 301
guacuccagca

SEQ ID NO: 1969506 - RNA, 13 nt, Shigella flexneri 2a str. 301
guacuccagcaga

SEQ ID NO: 1969507 - RNA, 11 nt, Shigella flexneri 2a str. 301
guacgcuuuca

SEQ ID NO: 1969508 - RNA, 17 nt, Shigella flexneri 2a str. 301
ggugauacugaucguca

SEQ ID NO: 1969509 - RNA, 19 nt, Shigella flexneri 2a str. 301
ggugauaccagaccauaca

SEQ ID NO: 1969510 - RNA, 13 nt, Shigella flexneri 2a str. 301
ggugacgcgcuuu

SEQ ID NO: 1969511 - RNA, 23 nt, Shigella flexneri 2a str. 301
ggucggauaaggcgcucgcgccg

SEQ ID NO: 1969512 - RNA, 20 nt, Shigella flexneri 2a str. 301
ggucgcuuuguggcggcaaa

SEQ ID NO: 1969513 - RNA, 11 nt, Shigella flexneri 2a str. 301
ggucgcuucgc

SEQ ID NO: 1969514 - RNA, 22 nt, Shigella flexneri 2a str. 301
ggucgcgcaaauucggcggcgu

SEQ ID NO: 1969515 - RNA, 20 nt, Shigella flexneri 2a str. 301
ggguauaaaacucaccgcgc

SEQ ID NO: 1969516 - RNA, 10 nt, Shigella flexneri 2a str. 301
gggucaccgc

SEQ ID NO: 1969517 - RNA, 21 nt, Shigella flexneri 2a str. 301
gggucaccgccgauaccgaca

SEQ ID NO: 1969518 - RNA, 13 nt, Shigella flexneri 2a str. 301
ggguucagcauug

SEQ ID NO: 1969519 - RNA, 20 nt, Shigella flexneri 2a str. 301
ggguuugcguuugcagcauu

SEQ ID NO: 1969520 - RNA, 16 nt, Shigella flexneri 2a str. 301
ggguuuuauuauucca

SEQ ID NO: 1969521 - RNA, 12 nt, Shigella flexneri 2a str. 301
ggguuuuccagu

SEQ ID NO: 1969522 - RNA, 15 nt, Shigella flexneri 2a str. 301
gguacgaauacggau

SEQ ID NO: 1969523 - RNA, 21 nt, Shigella flexneri 2a str. 301
gguacaaagccaacagcagcc

SEQ ID NO: 1969524 - RNA, 13 nt, Shigella flexneri 2a str. 301
gguacaaagccaa

SEQ ID NO: 1969525 - RNA, 22 nt, Shigella flexneri 2a str. 301
gggugcgacaggagccgcagua

SEQ ID NO: 1969526 - RNA, 16 nt, Shigella flexneri 2a str. 301
gggugccgggaacugg

SEQ ID NO: 1969527 - RNA, 21 nt, Shigella flexneri 2a str. 301
gggugcaaucaacaccacugc

SEQ ID NO: 1969528 - RNA, 20 nt, Shigella flexneri 2a str. 301
gggugccauuuuuuauugcg

SEQ ID NO: 1969529 - RNA, 20 nt, Shigella flexneri 2a str. 301
gucauucugcaaggcaaaau

SEQ ID NO: 1969530 - RNA, 21 nt, Shigella flexneri 2a str. 301
gucaugcagcuccaccgauuu

SEQ ID NO: 1969531 - RNA, 21 nt, Shigella flexneri 2a str. 301
gucaugaaauauagaccgcca

SEQ ID NO: 1969532 - RNA, 19 nt, Shigella flexneri 2a str. 301
gucaguggacgauaagcac

SEQ ID NO: 1969533 - RNA, 23 nt, Shigella flexneri 2a str. 301
gucagugccugcgccaccguuuc

SEQ ID NO: 1969534 - RNA, 13 nt, Shigella flexneri 2a str. 301
gucaguucauggu

SEQ ID NO: 1969535 - RNA, 21 nt, Shigella flexneri 2a str. 301
gucauacgcguaaaacagcca

SEQ ID NO: 1969536 - RNA, 22 nt, Shigella flexneri 2a str. 301
gucaguuuccagcauucgcgca

SEQ ID NO: 1969537 - RNA, 23 nt, Shigella flexneri 2a str. 301
gucagcuuucagagaagcaccgc

SEQ ID NO: 1969538 - RNA, 22 nt, Shigella flexneri 2a str. 301
guaucgcacagaugcgacggca

SEQ ID NO: 1969539 - RNA, 21 nt, Shigella flexneri 2a str. 301
guauccggcauggacgacagc

SEQ ID NO: 1969540 - RNA, 23 nt, Shigella flexneri 2a str. 301
gucaggucacccaacaugccgag

SEQ ID NO: 1969541 - RNA, 14 nt, Shigella flexneri 2a str. 301
gucccguacccagc

SEQ ID NO: 1969542 - RNA, 17 nt, Shigella flexneri 2a str. 301
gucgaugaaagcgccau

SEQ ID NO: 1969543 - RNA, 18 nt, Shigella flexneri 2a str. 301
gucgagaacaacggcgag

SEQ ID NO: 1969544 - RNA, 14 nt, Shigella flexneri 2a str. 301
gucgaacggguuaa

SEQ ID NO: 1969545 - RNA, 18 nt, Shigella flexneri 2a str. 301
gucgaacagguuauugac

SEQ ID NO: 1969546 - RNA, 21 nt, Shigella flexneri 2a str. 301
guccuuuugccgcccagucac

SEQ ID NO: 1969547 - RNA, 22 nt, Shigella flexneri 2a str. 301
gucgaaaccgacagcccuucgc

SEQ ID NO: 1969548 - RNA, 16 nt, Shigella flexneri 2a str. 301
guccggcugccagcca

SEQ ID NO: 1969549 - RNA, 21 nt, Shigella flexneri 2a str. 301
gucgccaaguucgaacgccgc

SEQ ID NO: 1969550 - RNA, 19 nt, Shigella flexneri 2a str. 301
gucgccuguacuuccuguu

SEQ ID NO: 1969551 - RNA, 14 nt, Shigella flexneri 2a str. 301
gucugaaugccgcu

SEQ ID NO: 1969552 - RNA, 16 nt, Shigella flexneri 2a str. 301
gucugaccgucuuuca

SEQ ID NO: 1969553 - RNA, 16 nt, Shigella flexneri 2a str. 301
gucugcagauauucau

SEQ ID NO: 1969554 - RNA, 16 nt, Shigella flexneri 2a str. 301
gucguuuucaguugcu

SEQ ID NO: 1969555 - RNA, 16 nt, Shigella flexneri 2a str. 301
gucugguaucgcgcca

SEQ ID NO: 1969556 - RNA, 14 nt, Shigella flexneri 2a str. 301
gucuguacggcagu

SEQ ID NO: 1969557 - RNA, 24 nt, Shigella flexneri 2a str. 301
gucuuuuuucacuggcaaugacgg

SEQ ID NO: 1969558 - RNA, 13 nt, Shigella flexneri 2a str. 301
gucuuaauguaau

SEQ ID NO: 1969559 - RNA, 18 nt, Shigella flexneri 2a str. 301
gucuuaucaggccuacaa

SEQ ID NO: 1969560 - RNA, 19 nt, Shigella flexneri 2a str. 301
gugacagauuuugccagca

SEQ ID NO: 1969561 - RNA, 12 nt, Shigella flexneri 2a str. 301
gugaauuacugc

SEQ ID NO: 1969562 - RNA, 16 nt, Shigella flexneri 2a str. 301
gugacccgcagccagc

SEQ ID NO: 1969563 - RNA, 20 nt, Shigella flexneri 2a str. 301
gugaccagaacugauccaua

SEQ ID NO: 1969564 - RNA, 17 nt, Shigella flexneri 2a str. 301
gugaagguugucaucaa

SEQ ID NO: 1969565 - RNA, 22 nt, Shigella flexneri 2a str. 301
gugaaggcaaacuucucgccau

SEQ ID NO: 1969566 - RNA, 13 nt, Shigella flexneri 2a str. 301
gugaagaugccaa

SEQ ID NO: 1969567 - RNA, 20 nt, Shigella flexneri 2a str. 301
gugaacgccuaauccagccu

SEQ ID NO: 1969568 - RNA, 20 nt, Shigella flexneri 2a str. 301
gugaacgccuuauccgcccu

SEQ ID NO: 1969569 - RNA, 20 nt, Shigella flexneri 2a str. 301
gugaacgccuuauccggucu

SEQ ID NO: 1969570 - RNA, 16 nt, Shigella flexneri 2a str. 301
gugagcgguguugccg

SEQ ID NO: 1969571 - RNA, 13 nt, Shigella flexneri 2a str. 301
gugagaacugcug

SEQ ID NO: 1969572 - RNA, 20 nt, Shigella flexneri 2a str. 301
gugacgcacaguacgcgccc

SEQ ID NO: 1969573 - RNA, 20 nt, Shigella flexneri 2a str. 301
gugacgccagaaaaccuggc

SEQ ID NO: 1969574 - RNA, 20 nt, Shigella flexneri 2a str. 301
gugaccgccuuauccggccu

SEQ ID NO: 1969575 - RNA, 15 nt, Shigella flexneri 2a str. 301
gucggggccagcgca

SEQ ID NO: 1969576 - RNA, 14 nt, Shigella flexneri 2a str. 301
gucgggcaucagaa

SEQ ID NO: 1969577 - RNA, 15 nt, Shigella flexneri 2a str. 301
gucggcuuucagcgc

SEQ ID NO: 1969578 - RNA, 12 nt, Shigella flexneri 2a str. 301
gucgugaaugcc

SEQ ID NO: 1969579 - RNA, 13 nt, Shigella flexneri 2a str. 301
cgccgcauccggu

SEQ ID NO: 1969580 - RNA, 13 nt, Shigella flexneri 2a str. 301
cgccgcauccgac

SEQ ID NO: 1969581 - RNA, 12 nt, Shigella flexneri 2a str. 301
cgccgcacacgc

SEQ ID NO: 1969582 - RNA, 14 nt, Shigella flexneri 2a str. 301
cgccgcacacgccg

SEQ ID NO: 1969583 - RNA, 16 nt, Shigella flexneri 2a str. 301
cgcccacguuucacug

SEQ ID NO: 1969584 - RNA, 23 nt, Shigella flexneri 2a str. 301
cgccgauaaucaacgcgccgcca

SEQ ID NO: 1969585 - RNA, 14 nt, Shigella flexneri 2a str. 301
cgccgaggcgcugg

SEQ ID NO: 1969586 - RNA, 14 nt, Shigella flexneri 2a str. 301
cgccgccaguacgc

SEQ ID NO: 1969587 - RNA, 13 nt, Shigella flexneri 2a str. 301
cgccgccacacgc

SEQ ID NO: 1969588 - RNA, 19 nt, Shigella flexneri 2a str. 301
cgccgccuuuuacgcauuc

SEQ ID NO: 1969589 - RNA, 16 nt, Shigella flexneri 2a str. 301
cgccgggguuauguga

SEQ ID NO: 1969590 - RNA, 16 nt, Shigella flexneri 2a str. 301
cgccggguucgacgcg

SEQ ID NO: 1969591 - RNA, 16 nt, Shigella flexneri 2a str. 301
cgccgggcuaaccgcu

SEQ ID NO: 1969592 - RNA, 16 nt, Shigella flexneri 2a str. 301
cgccguaaaucccgcc

SEQ ID NO: 1969593 - RNA, 18 nt, Shigella flexneri 2a str. 301
cgccguccacaaaccguu

SEQ ID NO: 1969594 - RNA, 16 nt, Shigella flexneri 2a str. 301
cgccgucaucacaccg

SEQ ID NO: 1969595 - RNA, 14 nt, Shigella flexneri 2a str. 301
cgccggucaacgcg

SEQ ID NO: 1969596 - RNA, 22 nt, Shigella flexneri 2a str. 301
cgccggauagacaugcccggaa

SEQ ID NO: 1969597 - RNA, 23 nt, Shigella flexneri 2a str. 301
cgccgcuggccauuucugccagu

SEQ ID NO: 1969598 - RNA, 14 nt, Shigella flexneri 2a str. 301
cgccuuauccgccc

SEQ ID NO: 1969599 - RNA, 23 nt, Shigella flexneri 2a str. 301
cgccuuccacuucugcgucgaua

SEQ ID NO: 1969600 - RNA, 19 nt, Shigella flexneri 2a str. 301
cgccuuauccggccuaccg

SEQ ID NO: 1969601 - RNA, 14 nt, Shigella flexneri 2a str. 301
cgccuguuccagca

SEQ ID NO: 1969602 - RNA, 19 nt, Shigella flexneri 2a str. 301
cgccuggacaucaugcugc

SEQ ID NO: 1969603 - RNA, 16 nt, Shigella flexneri 2a str. 301
cgccucccuucgcugc

SEQ ID NO: 1969604 - RNA, 17 nt, Shigella flexneri 2a str. 301
cgccuccuguucugcgc

SEQ ID NO: 1969605 - RNA, 18 nt, Shigella flexneri 2a str. 301
cgccugcaccauugcugc

SEQ ID NO: 1969606 - RNA, 19 nt, Shigella flexneri 2a str. 301
cgccucguaaugcuccggc

SEQ ID NO: 1969607 - RNA, 13 nt, Shigella flexneri 2a str. 301
cgccuuuuccagc

SEQ ID NO: 1969608 - RNA, 22 nt, Shigella flexneri 2a str. 301
cgccuuuucaguuggcugacaa

SEQ ID NO: 1969609 - RNA, 23 nt, Shigella flexneri 2a str. 301
cgccuuguuaccugaugcagcgu

SEQ ID NO: 1969610 - RNA, 16 nt, Shigella flexneri 2a str. 301
cgcgaauaguuuccgc

SEQ ID NO: 1969611 - RNA, 12 nt, Shigella flexneri 2a str. 301
cgcgaccagcgu

SEQ ID NO: 1969612 - RNA, 22 nt, Shigella flexneri 2a str. 301
cgcgaccgccucgcgccagcgu

SEQ ID NO: 1969613 - RNA, 21 nt, Shigella flexneri 2a str. 301
cgcgacauggcgaaaauuggu

SEQ ID NO: 1969614 - RNA, 18 nt, Shigella flexneri 2a str. 301
cgcgcaguucgucgcguu

SEQ ID NO: 1969615 - RNA, 14 nt, Shigella flexneri 2a str. 301
cgcgcaggcgcuga

SEQ ID NO: 1969616 - RNA, 15 nt, Shigella flexneri 2a str. 301
cgcgcauaaugcaga

SEQ ID NO: 1969617 - RNA, 16 nt, Shigella flexneri 2a str. 301
cgcgcaucagcaguuc

SEQ ID NO: 1969618 - RNA, 11 nt, Shigella flexneri 2a str. 301
cgcgccagccg

SEQ ID NO: 1969619 - RNA, 21 nt, Shigella flexneri 2a str. 301
cgcgcaccuuuaaugcaucag

SEQ ID NO: 1969620 - RNA, 16 nt, Shigella flexneri 2a str. 301
cgcgauuaucauuuua

SEQ ID NO: 1969621 - RNA, 13 nt, Shigella flexneri 2a str. 301
cgcgaucuuccac

SEQ ID NO: 1969622 - RNA, 12 nt, Shigella flexneri 2a str. 301
cgcggcagcagg

SEQ ID NO: 1969623 - RNA, 12 nt, Shigella flexneri 2a str. 301
cgcggcaggcau

SEQ ID NO: 1969624 - RNA, 14 nt, Shigella flexneri 2a str. 301
cgcgcuugccgccg

SEQ ID NO: 1969625 - RNA, 20 nt, Shigella flexneri 2a str. 301
cgcgcuugcggaagcaaccg

SEQ ID NO: 1969626 - RNA, 15 nt, Shigella flexneri 2a str. 301
cgcgcuucgguguua

SEQ ID NO: 1969627 - RNA, 12 nt, Shigella flexneri 2a str. 301
cgcggacgcaca

SEQ ID NO: 1969628 - RNA, 16 nt, Shigella flexneri 2a str. 301
aacagcaggcagaucc

SEQ ID NO: 1969629 - RNA, 15 nt, Shigella flexneri 2a str. 301
aacagccacugguga

SEQ ID NO: 1969630 - RNA, 16 nt, Shigella flexneri 2a str. 301
cgcgugaaugccugau

SEQ ID NO: 1969631 - RNA, 18 nt, Shigella flexneri 2a str. 301
cgcuaaaaagcgccguuu

SEQ ID NO: 1969632 - RNA, 20 nt, Shigella flexneri 2a str. 301
cgcucccggcugcaaccaga

SEQ ID NO: 1969633 - RNA, 13 nt, Shigella flexneri 2a str. 301
cgcuacauccgac

SEQ ID NO: 1969634 - RNA, 18 nt, Shigella flexneri 2a str. 301
cgcuacauaacgcagcgg

SEQ ID NO: 1969635 - RNA, 17 nt, Shigella flexneri 2a str. 301
cgcuaccauuugcgcgg

SEQ ID NO: 1969636 - RNA, 14 nt, Shigella flexneri 2a str. 301
cgcuaacagcagca

SEQ ID NO: 1969637 - RNA, 21 nt, Shigella flexneri 2a str. 301
cgcuaaaugccgcguggccug

SEQ ID NO: 1969638 - RNA, 19 nt, Shigella flexneri 2a str. 301
cgcuaaugcgacccaugca

SEQ ID NO: 1969639 - RNA, 17 nt, Shigella flexneri 2a str. 301
cgcgguagcacgucauc

SEQ ID NO: 1969640 - RNA, 16 nt, Shigella flexneri 2a str. 301
cgcgguguauaccagc

SEQ ID NO: 1969641 - RNA, 14 nt, Shigella flexneri 2a str. 301
cgcuucaccaauca

SEQ ID NO: 1969642 - RNA, 15 nt, Shigella flexneri 2a str. 301
cgcuucaaccaacgc

SEQ ID NO: 1969643 - RNA, 23 nt, Shigella flexneri 2a str. 301
cgcuuauuguugucaauauucug

SEQ ID NO: 1969644 - RNA, 17 nt, Shigella flexneri 2a str. 301
cgcuucaccaaucagaa

SEQ ID NO: 1969645 - RNA, 13 nt, Shigella flexneri 2a str. 301
cgcuuauccggcc

SEQ ID NO: 1969646 - RNA, 18 nt, Shigella flexneri 2a str. 301
cgcuuaucaggccuacaa

SEQ ID NO: 1969647 - RNA, 13 nt, Shigella flexneri 2a str. 301
cgcuucccaacgc

SEQ ID NO: 1969648 - RNA, 14 nt, Shigella flexneri 2a str. 301
cgcuuccugcaacg

SEQ ID NO: 1969649 - RNA, 20 nt, Shigella flexneri 2a str. 301
cgcuucggcuccagcgcguc

SEQ ID NO: 1969650 - RNA, 14 nt, Shigella flexneri 2a str. 301
cgcuucggcgcaua

SEQ ID NO: 1969651 - RNA, 23 nt, Shigella flexneri 2a str. 301
cgcuucgguuuucgcgccagcca

SEQ ID NO: 1969652 - RNA, 13 nt, Shigella flexneri 2a str. 301
cgcuucugcguuc

SEQ ID NO: 1969653 - RNA, 17 nt, Shigella flexneri 2a str. 301
cgcuucuggcggcggca

SEQ ID NO: 1969654 - RNA, 14 nt, Shigella flexneri 2a str. 301
cgcuucuuccagca

SEQ ID NO: 1969655 - RNA, 16 nt, Shigella flexneri 2a str. 301
cgcuguccggcgcacu

SEQ ID NO: 1969656 - RNA, 16 nt, Shigella flexneri 2a str. 301
cgcuuacacacccggc

SEQ ID NO: 1969657 - RNA, 19 nt, Shigella flexneri 2a str. 301
cgcuguuuagcgcggcaau

SEQ ID NO: 1969658 - RNA, 20 nt, Shigella flexneri 2a str. 301
cgcugucuggcgucuccugc

SEQ ID NO: 1969659 - RNA, 21 nt, Shigella flexneri 2a str. 301
cggaacaucgccugccgcagg

SEQ ID NO: 1969660 - RNA, 16 nt, Shigella flexneri 2a str. 301
cggaacgcuuucuuug

SEQ ID NO: 1969661 - RNA, 20 nt, Shigella flexneri 2a str. 301
cggaaugauauuggucacca

SEQ ID NO: 1969662 - RNA, 16 nt, Shigella flexneri 2a str. 301
cggaauaccacuuuca

SEQ ID NO: 1969663 - RNA, 18 nt, Shigella flexneri 2a str. 301
cggaacacucuuccaguc

SEQ ID NO: 1969664 - RNA, 21 nt, Shigella flexneri 2a str. 301
cgcuuuuuccaggcuggcagg

SEQ ID NO: 1969665 - RNA, 16 nt, Shigella flexneri 2a str. 301
cgcuuuuuuuacgucu

SEQ ID NO: 1969666 - RNA, 23 nt, Shigella flexneri 2a str. 301
cgcuugcguaucgacggcguauu

SEQ ID NO: 1969667 - RNA, 14 nt, Shigella flexneri 2a str. 301
cgcuuguucgcaua

SEQ ID NO: 1969668 - RNA, 20 nt, Shigella flexneri 2a str. 301
cgcuuuacaauauccagcgc

SEQ ID NO: 1969669 - RNA, 15 nt, Shigella flexneri 2a str. 301
cgcuuucagugucug

SEQ ID NO: 1969670 - RNA, 23 nt, Shigella flexneri 2a str. 301
cgcuuucauguuaaauuccggcu

SEQ ID NO: 1969671 - RNA, 17 nt, Shigella flexneri 2a str. 301
cgcuuucccagcgauga

SEQ ID NO: 1969672 - RNA, 13 nt, Shigella flexneri 2a str. 301
cgcuuuaucgccg

SEQ ID NO: 1969673 - RNA, 20 nt, Shigella flexneri 2a str. 301
cgcuuuccgggguaaauuuc

SEQ ID NO: 1969674 - RNA, 14 nt, Shigella flexneri 2a str. 301
cgcuuugccaccca

SEQ ID NO: 1969675 - RNA, 20 nt, Shigella flexneri 2a str. 301
cgcugauuggccccauugcc

SEQ ID NO: 1969676 - RNA, 22 nt, Shigella flexneri 2a str. 301
cgcugauuugcuucaauacgcu

SEQ ID NO: 1969677 - RNA, 22 nt, Shigella flexneri 2a str. 301
cgcugcaaguuuugucaguucg

SEQ ID NO: 1969678 - RNA, 17 nt, Shigella flexneri 2a str. 301
cgcugauaaaucccgcc

SEQ ID NO: 1969679 - RNA, 20 nt, Shigella flexneri 2a str. 301
cgcugauauucgacaccauc

SEQ ID NO: 1969680 - RNA, 13 nt, Shigella flexneri 2a str. 301
cgcugccgcuucu

SEQ ID NO: 1969681 - RNA, 11 nt, Shigella flexneri 2a str. 301
cgcugccguug

SEQ ID NO: 1969682 - RNA, 23 nt, Shigella flexneri 2a str. 301
cgcuggcagcugcuacgccguca

SEQ ID NO: 1969683 - RNA, 16 nt, Shigella flexneri 2a str. 301
cgcuggcgucacgccg

SEQ ID NO: 1969684 - RNA, 13 nt, Shigella flexneri 2a str. 301
cgcuggcgcaugu

SEQ ID NO: 1969685 - RNA, 22 nt, Shigella flexneri 2a str. 301
cgcuggcuuugcccuggcgcga

SEQ ID NO: 1969686 - RNA, 14 nt, Shigella flexneri 2a str. 301
cgggaccagcauuc

SEQ ID NO: 1969687 - RNA, 16 nt, Shigella flexneri 2a str. 301
cggcuugaaccagcca

SEQ ID NO: 1969688 - RNA, 17 nt, Shigella flexneri 2a str. 301
cgggcacagauuuccaa

SEQ ID NO: 1969689 - RNA, 17 nt, Shigella flexneri 2a str. 301
cgggcacaggcgaugcc

SEQ ID NO: 1969690 - RNA, 14 nt, Shigella flexneri 2a str. 301
cgggcaaagcgacg

SEQ ID NO: 1969691 - RNA, 15 nt, Shigella flexneri 2a str. 301
cgggcaaagcgacgc

SEQ ID NO: 1969692 - RNA, 18 nt, Shigella flexneri 2a str. 301
aacauugcgccucaccgg

SEQ ID NO: 1969693 - RNA, 16 nt, Shigella flexneri 2a str. 301
cgggcaggcuucaaca

SEQ ID NO: 1969694 - RNA, 15 nt, Shigella flexneri 2a str. 301
cgggccaaagcauuc

SEQ ID NO: 1969695 - RNA, 22 nt, Shigella flexneri 2a str. 301
cgggcuaacuucuuuuucgaca

SEQ ID NO: 1969696 - RNA, 16 nt, Shigella flexneri 2a str. 301
cggcucucaccuugua

SEQ ID NO: 1969697 - RNA, 15 nt, Shigella flexneri 2a str. 301
cggcugcccaucauc

SEQ ID NO: 1969698 - RNA, 16 nt, Shigella flexneri 2a str. 301
cggcugcgcgacggcg

SEQ ID NO: 1969699 - RNA, 22 nt, Shigella flexneri 2a str. 301
cggcuguaguccuaacagagca

SEQ ID NO: 1969700 - RNA, 20 nt, Shigella flexneri 2a str. 301
cggcuggugauuucguccag

SEQ ID NO: 1969701 - RNA, 20 nt, Shigella flexneri 2a str. 301
cggcuucgccuccuguucug

SEQ ID NO: 1969702 - RNA, 14 nt, Shigella flexneri 2a str. 301
cggcucauugccau

SEQ ID NO: 1969703 - RNA, 13 nt, Shigella flexneri 2a str. 301
cggcuauuuccgg

SEQ ID NO: 1969704 - RNA, 20 nt, Shigella flexneri 2a str. 301
cggcguuuucucaucgcugc

SEQ ID NO: 1969705 - RNA, 23 nt, Shigella flexneri 2a str. 301
cggcguuuuguagagcagcacgc

SEQ ID NO: 1969706 - RNA, 19 nt, Shigella flexneri 2a str. 301
cggcgucauaauccggcaa

SEQ ID NO: 1969707 - RNA, 21 nt, Shigella flexneri 2a str. 301
cggcguccuggaacuggugga

SEQ ID NO: 1969708 - RNA, 15 nt, Shigella flexneri 2a str. 301
cggcgucaucgacau

SEQ ID NO: 1969709 - RNA, 18 nt, Shigella flexneri 2a str. 301
cggcguacuaucugcugc

SEQ ID NO: 1969710 - RNA, 21 nt, Shigella flexneri 2a str. 301
cggcgucugguaucgcgccag

SEQ ID NO: 1969711 - RNA, 22 nt, Shigella flexneri 2a str. 301
cggcgugaacgccuuauccggc

SEQ ID NO: 1969712 - RNA, 16 nt, Shigella flexneri 2a str. 301
aaccagcuuaugccug

SEQ ID NO: 1969713 - RNA, 14 nt, Shigella flexneri 2a str. 301
aaccagcggacaau

SEQ ID NO: 1969714 - RNA, 17 nt, Shigella flexneri 2a str. 301
cggggugcaucgcccug

SEQ ID NO: 1969715 - RNA, 11 nt, Shigella flexneri 2a str. 301
aaccaaagcgu

SEQ ID NO: 1969716 - RNA, 19 nt, Shigella flexneri 2a str. 301
aacauuuucuucugccagg

SEQ ID NO: 1969717 - RNA, 13 nt, Shigella flexneri 2a str. 301
aaccaacggccuu

SEQ ID NO: 1969718 - RNA, 19 nt, Shigella flexneri 2a str. 301
aaccacgcagcguuggcag

SEQ ID NO: 1969719 - RNA, 14 nt, Shigella flexneri 2a str. 301
aaccaccuccacgc

SEQ ID NO: 1969720 - RNA, 15 nt, Shigella flexneri 2a str. 301
aaccacggcagcaac

SEQ ID NO: 1969721 - RNA, 16 nt, Shigella flexneri 2a str. 301
aaccacggaauaacca

SEQ ID NO: 1969722 - RNA, 14 nt, Shigella flexneri 2a str. 301
aaccaaucugugcc

SEQ ID NO: 1969723 - RNA, 16 nt, Shigella flexneri 2a str. 301
cggguccgggcaucag

SEQ ID NO: 1969724 - RNA, 17 nt, Shigella flexneri 2a str. 301
cgggucaccugccaggg

SEQ ID NO: 1969725 - RNA, 16 nt, Shigella flexneri 2a str. 301
cgggucauaaucagau

SEQ ID NO: 1969726 - RNA, 21 nt, Shigella flexneri 2a str. 301
cggucaacgcgcggcuuaucg

SEQ ID NO: 1969727 - RNA, 23 nt, Shigella flexneri 2a str. 301
cgguaguggcaaccagcagaugu

SEQ ID NO: 1969728 - RNA, 15 nt, Shigella flexneri 2a str. 301
cgguaguggcaacca

SEQ ID NO: 1969729 - RNA, 13 nt, Shigella flexneri 2a str. 301
cgguauccaucag

SEQ ID NO: 1969730 - RNA, 21 nt, Shigella flexneri 2a str. 301
cgguagcagcuuucagcagcg

SEQ ID NO: 1969731 - RNA, 22 nt, Shigella flexneri 2a str. 301
cgguacgcuuucacccggcgcu

SEQ ID NO: 1969732 - RNA, 17 nt, Shigella flexneri 2a str. 301
aacccaccaugccgaug

SEQ ID NO: 1969733 - RNA, 18 nt, Shigella flexneri 2a str. 301
cgguaaaauggucagcca

SEQ ID NO: 1969734 - RNA, 17 nt, Shigella flexneri 2a str. 301
cgguaaaccguuaucac

SEQ ID NO: 1969735 - RNA, 20 nt, Shigella flexneri 2a str. 301
aaccaucgcuacauaacgca

SEQ ID NO: 1969736 - RNA, 13 nt, Shigella flexneri 2a str. 301
cggguuuccugga

SEQ ID NO: 1969737 - RNA, 14 nt, Shigella flexneri 2a str. 301
cgguaauuccggcg

SEQ ID NO: 1969738 - RNA, 23 nt, Shigella flexneri 2a str. 301
cggucagccauugcuaccgcuuc

SEQ ID NO: 1969739 - RNA, 21 nt, Shigella flexneri 2a str. 301
cggucagccauugcuaccgcu

SEQ ID NO: 1969740 - RNA, 14 nt, Shigella flexneri 2a str. 301
cggucagcagcacc

SEQ ID NO: 1969741 - RNA, 20 nt, Shigella flexneri 2a str. 301
cggucgaggcaaccagcacg

SEQ ID NO: 1969742 - RNA, 20 nt, Shigella flexneri 2a str. 301
aacaucccgguaauaaugca

SEQ ID NO: 1969743 - RNA, 14 nt, Shigella flexneri 2a str. 301
aacaucuucggcgu

SEQ ID NO: 1969744 - RNA, 20 nt, Shigella flexneri 2a str. 301
cggccaucaguacgcauucg

SEQ ID NO: 1969745 - RNA, 20 nt, Shigella flexneri 2a str. 301
cggcccguuccgcgacuauc

SEQ ID NO: 1969746 - RNA, 18 nt, Shigella flexneri 2a str. 301
cggcagccuccugcacgg

SEQ ID NO: 1969747 - RNA, 14 nt, Shigella flexneri 2a str. 301
cggcagcgguucca

SEQ ID NO: 1969748 - RNA, 19 nt, Shigella flexneri 2a str. 301
cggcaguauagcggcaugg

SEQ ID NO: 1969749 - RNA, 15 nt, Shigella flexneri 2a str. 301
cggccaaauauccgc

SEQ ID NO: 1969750 - RNA, 21 nt, Shigella flexneri 2a str. 301
cggccaaccauccgucaucca

SEQ ID NO: 1969751 - RNA, 22 nt, Shigella flexneri 2a str. 301
cggcauaaucauuacaaccgcu

SEQ ID NO: 1969752 - RNA, 16 nt, Shigella flexneri 2a str. 301
cggcagucacauucug

SEQ ID NO: 1969753 - RNA, 14 nt, Shigella flexneri 2a str. 301
cggcaugauaccga

SEQ ID NO: 1969754 - RNA, 14 nt, Shigella flexneri 2a str. 301
cggcaugaaagcga

SEQ ID NO: 1969755 - RNA, 18 nt, Shigella flexneri 2a str. 301
cggcaugagccgccgcca

SEQ ID NO: 1969756 - RNA, 21 nt, Shigella flexneri 2a str. 301
cggcacgcguugcgcaugacc

SEQ ID NO: 1969757 - RNA, 24 nt, Shigella flexneri 2a str. 301
aacagggaacuuaucaucgcaaau

SEQ ID NO: 1969758 - RNA, 17 nt, Shigella flexneri 2a str. 301
cggacagaucugccugu

SEQ ID NO: 1969759 - RNA, 19 nt, Shigella flexneri 2a str. 301
cggcaccuuuucaucaggu

SEQ ID NO: 1969760 - RNA, 15 nt, Shigella flexneri 2a str. 301
cggcagcaaucgacc

SEQ ID NO: 1969761 - RNA, 15 nt, Shigella flexneri 2a str. 301
aacauagcuuggcag

SEQ ID NO: 1969762 - RNA, 22 nt, Shigella flexneri 2a str. 301
aacauacugcuccauaauugcc

SEQ ID NO: 1969763 - RNA, 17 nt, Shigella flexneri 2a str. 301
aacaguucagcagcacu

SEQ ID NO: 1969764 - RNA, 21 nt, Shigella flexneri 2a str. 301
cggcagaucaaauucaaugac

SEQ ID NO: 1969765 - RNA, 20 nt, Shigella flexneri 2a str. 301
cggcagaugacuugccgcaa

SEQ ID NO: 1969766 - RNA, 15 nt, Shigella flexneri 2a str. 301
cggcacguuccugca

SEQ ID NO: 1969767 - RNA, 19 nt, Shigella flexneri 2a str. 301
cggcacguuccugcauacg

SEQ ID NO: 1969768 - RNA, 17 nt, Shigella flexneri 2a str. 301
cggcacuguuucgccag

SEQ ID NO: 1969769 - RNA, 13 nt, Shigella flexneri 2a str. 301
cggcgcucaaucc

SEQ ID NO: 1969770 - RNA, 14 nt, Shigella flexneri 2a str. 301
cggcgcuacggcgu

SEQ ID NO: 1969771 - RNA, 17 nt, Shigella flexneri 2a str. 301
cggcggaucaccgcguc

SEQ ID NO: 1969772 - RNA, 20 nt, Shigella flexneri 2a str. 301
cggcggaugaguuuacgaac

SEQ ID NO: 1969773 - RNA, 18 nt, Shigella flexneri 2a str. 301
cggcgcaucggucgauga

SEQ ID NO: 1969774 - RNA, 18 nt, Shigella flexneri 2a str. 301
cggcgagcaacgcagcgg

SEQ ID NO: 1969775 - RNA, 13 nt, Shigella flexneri 2a str. 301
cggcgauaccagu

SEQ ID NO: 1969776 - RNA, 14 nt, Shigella flexneri 2a str. 301
cggcgaguguucgg

SEQ ID NO: 1969777 - RNA, 18 nt, Shigella flexneri 2a str. 301
cggcgagguacgcccagc

SEQ ID NO: 1969778 - RNA, 20 nt, Shigella flexneri 2a str. 301
cggccuugcggguaguccgc

SEQ ID NO: 1969779 - RNA, 15 nt, Shigella flexneri 2a str. 301
cggcgaauuaccagc

SEQ ID NO: 1969780 - RNA, 13 nt, Shigella flexneri 2a str. 301
ccggaggcgcugg

SEQ ID NO: 1969781 - RNA, 21 nt, Shigella flexneri 2a str. 301
ccggauaagguguuuacaccg

SEQ ID NO: 1969782 - RNA, 14 nt, Shigella flexneri 2a str. 301
ccggaucgcuuucu

SEQ ID NO: 1969783 - RNA, 12 nt, Shigella flexneri 2a str. 301
ccggagacgacg

SEQ ID NO: 1969784 - RNA, 14 nt, Shigella flexneri 2a str. 301
ccggagccagccgu

SEQ ID NO: 1969785 - RNA, 20 nt, Shigella flexneri 2a str. 301
ccggacgacggcaucgccau

SEQ ID NO: 1969786 - RNA, 21 nt, Shigella flexneri 2a str. 301
ccgcugcuuaauuacugccuu

SEQ ID NO: 1969787 - RNA, 13 nt, Shigella flexneri 2a str. 301
ccggacacugcuu

SEQ ID NO: 1969788 - RNA, 16 nt, Shigella flexneri 2a str. 301
ccggaccagacgaucg

SEQ ID NO: 1969789 - RNA, 14 nt, Shigella flexneri 2a str. 301
ccgcguaaucaaca

SEQ ID NO: 1969790 - RNA, 14 nt, Shigella flexneri 2a str. 301
ccgcguuuuccagu

SEQ ID NO: 1969791 - RNA, 14 nt, Shigella flexneri 2a str. 301
ccgcgugacgcugg

SEQ ID NO: 1969792 - RNA, 19 nt, Shigella flexneri 2a str. 301
ccgcguuuguugcgcuaag

SEQ ID NO: 1969793 - RNA, 22 nt, Shigella flexneri 2a str. 301
ccgcucggcggcuggcuggaug

SEQ ID NO: 1969794 - RNA, 14 nt, Shigella flexneri 2a str. 301
ccggccauuccagc

SEQ ID NO: 1969795 - RNA, 16 nt, Shigella flexneri 2a str. 301
ccggcauccagcguuc

SEQ ID NO: 1969796 - RNA, 23 nt, Shigella flexneri 2a str. 301
ccggccuguuuauccaucacgcu

SEQ ID NO: 1969797 - RNA, 13 nt, Shigella flexneri 2a str. 301
ccggccuggaugg

SEQ ID NO: 1969798 - RNA, 24 nt, Shigella flexneri 2a str. 301
ccggcagucaguguuaucaaauca

SEQ ID NO: 1969799 - RNA, 14 nt, Shigella flexneri 2a str. 301
ccggcaaccagcac

SEQ ID NO: 1969800 - RNA, 17 nt, Shigella flexneri 2a str. 301
ccggcaauaagcaacgc

SEQ ID NO: 1969801 - RNA, 22 nt, Shigella flexneri 2a str. 301
ccggcacaaagcuguaucccag

SEQ ID NO: 1969802 - RNA, 22 nt, Shigella flexneri 2a str. 301
ccggcaauucucugcuccugau

SEQ ID NO: 1969803 - RNA, 13 nt, Shigella flexneri 2a str. 301
ccggaugcaucac

SEQ ID NO: 1969804 - RNA, 19 nt, Shigella flexneri 2a str. 301
ccggcaaaaccaucaaucc

SEQ ID NO: 1969805 - RNA, 22 nt, Shigella flexneri 2a str. 301
ccgccucaccgccauuugcauc

SEQ ID NO: 1969806 - RNA, 16 nt, Shigella flexneri 2a str. 301
ccgccuaccauaauca

SEQ ID NO: 1969807 - RNA, 21 nt, Shigella flexneri 2a str. 301
ccgccguugccgcagcgaugg

SEQ ID NO: 1969808 - RNA, 14 nt, Shigella flexneri 2a str. 301
ccgccuguuccagc

SEQ ID NO: 1969809 - RNA, 14 nt, Shigella flexneri 2a str. 301
ccgcgaaauaauca

SEQ ID NO: 1969810 - RNA, 23 nt, Shigella flexneri 2a str. 301
ccgcgaaauaaucaaaugaaugc

SEQ ID NO: 1969811 - RNA, 21 nt, Shigella flexneri 2a str. 301
ccgcgaacggggcugccagcu

SEQ ID NO: 1969812 - RNA, 20 nt, Shigella flexneri 2a str. 301
aaaugcagcauugccugaug

SEQ ID NO: 1969813 - RNA, 18 nt, Shigella flexneri 2a str. 301
aaaugauguagaccugau

SEQ ID NO: 1969814 - RNA, 14 nt, Shigella flexneri 2a str. 301
aaaugcgcaugaug

SEQ ID NO: 1969815 - RNA, 18 nt, Shigella flexneri 2a str. 301
ccgcgaguaaucacauca

SEQ ID NO: 1969816 - RNA, 23 nt, Shigella flexneri 2a str. 301
ccgcgccugaccauuaucaaaca

SEQ ID NO: 1969817 - RNA, 11 nt, Shigella flexneri 2a str. 301
ccgccgauacc

SEQ ID NO: 1969818 - RNA, 21 nt, Shigella flexneri 2a str. 301
ccgcccuguuugguugccagc

SEQ ID NO: 1969819 - RNA, 21 nt, Shigella flexneri 2a str. 301
ccgcccgauaaaacgguuuau

SEQ ID NO: 1969820 - RNA, 23 nt, Shigella flexneri 2a str. 301
ccgcaguuaaagcaauuccagcg

SEQ ID NO: 1969821 - RNA, 17 nt, Shigella flexneri 2a str. 301
ccgcaguggcuucggcg

SEQ ID NO: 1969822 - RNA, 22 nt, Shigella flexneri 2a str. 301
ccgcaguuaaagcaauuccagc

SEQ ID NO: 1969823 - RNA, 15 nt, Shigella flexneri 2a str. 301
ccgcaguaaagcgca

SEQ ID NO: 1969824 - RNA, 11 nt, Shigella flexneri 2a str. 301
ccgccagcgcg

SEQ ID NO: 1969825 - RNA, 12 nt, Shigella flexneri 2a str. 301
ccgccagcgcca

SEQ ID NO: 1969826 - RNA, 17 nt, Shigella flexneri 2a str. 301
ccgccaguucuuccagu

SEQ ID NO: 1969827 - RNA, 17 nt, Shigella flexneri 2a str. 301
ccgccagugcagcgaag

SEQ ID NO: 1969828 - RNA, 15 nt, Shigella flexneri 2a str. 301
ccgcauccggcaauu

SEQ ID NO: 1969829 - RNA, 22 nt, Shigella flexneri 2a str. 301
ccugccguuguugccuuauugc

SEQ ID NO: 1969830 - RNA, 14 nt, Shigella flexneri 2a str. 301
ccugccaucuggca

SEQ ID NO: 1969831 - RNA, 16 nt, Shigella flexneri 2a str. 301
ccugccaugcgcaauc

SEQ ID NO: 1969832 - RNA, 19 nt, Shigella flexneri 2a str. 301
ccugcggcggcaucgccuu

SEQ ID NO: 1969833 - RNA, 14 nt, Shigella flexneri 2a str. 301
ccugcggccagcag

SEQ ID NO: 1969834 - RNA, 18 nt, Shigella flexneri 2a str. 301
ccugcguugucgcaguga

SEQ ID NO: 1969835 - RNA, 19 nt, Shigella flexneri 2a str. 301
ccugcucuuucagcaccgc

SEQ ID NO: 1969836 - RNA, 17 nt, Shigella flexneri 2a str. 301
ccugcugauuauccgca

SEQ ID NO: 1969837 - RNA, 12 nt, Shigella flexneri 2a str. 301
ccugcuggcagu

SEQ ID NO: 1969838 - RNA, 20 nt, Shigella flexneri 2a str. 301
ccugcugcuguugcgucucg

SEQ ID NO: 1969839 - RNA, 14 nt, Shigella flexneri 2a str. 301
ccugcugugccgua

SEQ ID NO: 1969840 - RNA, 15 nt, Shigella flexneri 2a str. 301
ccuggcuggugacgc

SEQ ID NO: 1969841 - RNA, 15 nt, Shigella flexneri 2a str. 301
ccugggcauuugcgc

SEQ ID NO: 1969842 - RNA, 21 nt, Shigella flexneri 2a str. 301
ccugguccuucaucuucaacu

SEQ ID NO: 1969843 - RNA, 12 nt, Shigella flexneri 2a str. 301
ccuggcgcgaaa

SEQ ID NO: 1969844 - RNA, 16 nt, Shigella flexneri 2a str. 301
ccuggcccaucgccag

SEQ ID NO: 1969845 - RNA, 16 nt, Shigella flexneri 2a str. 301
ccugcuuuuucaucau

SEQ ID NO: 1969846 - RNA, 15 nt, Shigella flexneri 2a str. 301
ccugauguacaacca

SEQ ID NO: 1969847 - RNA, 19 nt, Shigella flexneri 2a str. 301
ccugaugcgaugcuugacg

SEQ ID NO: 1969848 - RNA, 15 nt, Shigella flexneri 2a str. 301
ccugaucaagcacau

SEQ ID NO: 1969849 - RNA, 17 nt, Shigella flexneri 2a str. 301
ccugauagcacgucacg

SEQ ID NO: 1969850 - RNA, 16 nt, Shigella flexneri 2a str. 301
ccugcaacagcaccag

SEQ ID NO: 1969851 - RNA, 23 nt, Shigella flexneri 2a str. 301
ccugcaauagauugaauuagcaa

SEQ ID NO: 1969852 - RNA, 16 nt, Shigella flexneri 2a str. 301
ccugcauaaacgccgu

SEQ ID NO: 1969853 - RNA, 19 nt, Shigella flexneri 2a str. 301
ccugaaucaaucagagcca

SEQ ID NO: 1969854 - RNA, 14 nt, Shigella flexneri 2a str. 301
ccugaccaaagccc

SEQ ID NO: 1969855 - RNA, 14 nt, Shigella flexneri 2a str. 301
ccugagaagcgcaa

SEQ ID NO: 1969856 - RNA, 21 nt, Shigella flexneri 2a str. 301
ccugauaagacgcgccagcgu

SEQ ID NO: 1969857 - RNA, 21 nt, Shigella flexneri 2a str. 301
ccugaacucgccgcacaggcg

SEQ ID NO: 1969858 - RNA, 20 nt, Shigella flexneri 2a str. 301
ccugaagcaguuucaccagc

SEQ ID NO: 1969859 - RNA, 13 nt, Shigella flexneri 2a str. 301
ccugaaaccauag

SEQ ID NO: 1969860 - RNA, 15 nt, Shigella flexneri 2a str. 301
ccucuuccauaaucg

SEQ ID NO: 1969861 - RNA, 19 nt, Shigella flexneri 2a str. 301
ccucuucauacaucugcaa

SEQ ID NO: 1969862 - RNA, 15 nt, Shigella flexneri 2a str. 301
ccucuuucucauaaa

SEQ ID NO: 1969863 - RNA, 20 nt, Shigella flexneri 2a str. 301
ccucuucagccgcaaaccug

SEQ ID NO: 1969864 - RNA, 15 nt, Shigella flexneri 2a str. 301
ccucgccguuaauga

SEQ ID NO: 1969865 - RNA, 14 nt, Shigella flexneri 2a str. 301
ccuccaagccugau

SEQ ID NO: 1969866 - RNA, 16 nt, Shigella flexneri 2a str. 301
ccucagcagacugaua

SEQ ID NO: 1969867 - RNA, 22 nt, Shigella flexneri 2a str. 301
ccucacgaucacagcaguccag

SEQ ID NO: 1969868 - RNA, 22 nt, Shigella flexneri 2a str. 301
ccguggucggcaaaauacauga

SEQ ID NO: 1969869 - RNA, 20 nt, Shigella flexneri 2a str. 301
ccguggucuguuuaaccgcu

SEQ ID NO: 1969870 - RNA, 21 nt, Shigella flexneri 2a str. 301
ccuccagcgagcuggcgcuga

SEQ ID NO: 1969871 - RNA, 19 nt, Shigella flexneri 2a str. 301
ccgguucgucauacuccag

SEQ ID NO: 1969872 - RNA, 22 nt, Shigella flexneri 2a str. 301
ccgguucguugaucacuuucac

SEQ ID NO: 1969873 - RNA, 16 nt, Shigella flexneri 2a str. 301
ccggugccuuaccgcu

SEQ ID NO: 1969874 - RNA, 15 nt, Shigella flexneri 2a str. 301
ccggugaucauuaaa

SEQ ID NO: 1969875 - RNA, 18 nt, Shigella flexneri 2a str. 301
ccguagcuucaccgcauc

SEQ ID NO: 1969876 - RNA, 19 nt, Shigella flexneri 2a str. 301
ccgucagcgaucagcauuu

SEQ ID NO: 1969877 - RNA, 14 nt, Shigella flexneri 2a str. 301
ccgucagccugacg

SEQ ID NO: 1969878 - RNA, 12 nt, Shigella flexneri 2a str. 301
ccgucagcagga

SEQ ID NO: 1969879 - RNA, 18 nt, Shigella flexneri 2a str. 301
ccgucagagcaccaucgc

SEQ ID NO: 1969880 - RNA, 13 nt, Shigella flexneri 2a str. 301
ccgucaucgguau

SEQ ID NO: 1969881 - RNA, 20 nt, Shigella flexneri 2a str. 301
ccgucacuucuucgcgaucg

SEQ ID NO: 1969882 - RNA, 12 nt, Shigella flexneri 2a str. 301
ccgucaccggca

SEQ ID NO: 1969883 - RNA, 20 nt, Shigella flexneri 2a str. 301
ccgucaacguuaacuuucgu

SEQ ID NO: 1969884 - RNA, 21 nt, Shigella flexneri 2a str. 301
ccgucguugagcaucugcaaa

SEQ ID NO: 1969885 - RNA, 18 nt, Shigella flexneri 2a str. 301
ccgugcugugugccgcga

SEQ ID NO: 1969886 - RNA, 19 nt, Shigella flexneri 2a str. 301
ccggucacgcccggaauuu

SEQ ID NO: 1969887 - RNA, 20 nt, Shigella flexneri 2a str. 301
ccggucagcagcaccaccgc

SEQ ID NO: 1969888 - RNA, 14 nt, Shigella flexneri 2a str. 301
ccgguaguuucagc

SEQ ID NO: 1969889 - RNA, 13 nt, Shigella flexneri 2a str. 301
ccgguaauaaugc

SEQ ID NO: 1969890 - RNA, 20 nt, Shigella flexneri 2a str. 301
ccgguaaagcaaugaagaac

SEQ ID NO: 1969891 - RNA, 14 nt, Shigella flexneri 2a str. 301
ccgguaaucaggca

SEQ ID NO: 1969892 - RNA, 22 nt, Shigella flexneri 2a str. 301
ccgggaacuggcaacaauggca

SEQ ID NO: 1969893 - RNA, 18 nt, Shigella flexneri 2a str. 301
ccggcuuguucaucacca

SEQ ID NO: 1969894 - RNA, 15 nt, Shigella flexneri 2a str. 301
ccggcuuguugcccg

SEQ ID NO: 1969895 - RNA, 22 nt, Shigella flexneri 2a str. 301
cgagcaguacagccgccagaca

SEQ ID NO: 1969896 - RNA, 16 nt, Shigella flexneri 2a str. 301
cgagcaguacagccgc

SEQ ID NO: 1969897 - RNA, 19 nt, Shigella flexneri 2a str. 301
cgagcagcugacuuccagc

SEQ ID NO: 1969898 - RNA, 18 nt, Shigella flexneri 2a str. 301
cgagcauugccagcauug

SEQ ID NO: 1969899 - RNA, 16 nt, Shigella flexneri 2a str. 301
cgagcauugccagcau

SEQ ID NO: 1969900 - RNA, 20 nt, Shigella flexneri 2a str. 301
cgagccagcgcauccuggcu

SEQ ID NO: 1969901 - RNA, 23 nt, Shigella flexneri 2a str. 301
cgagcagagaaacgccagcagca

SEQ ID NO: 1969902 - RNA, 16 nt, Shigella flexneri 2a str. 301
cgagcacgacuuucuc

SEQ ID NO: 1969903 - RNA, 17 nt, Shigella flexneri 2a str. 301
cgagauuagacggcgca

SEQ ID NO: 1969904 - RNA, 22 nt, Shigella flexneri 2a str. 301
cgacuucuucauucauccgccg

SEQ ID NO: 1969905 - RNA, 23 nt, Shigella flexneri 2a str. 301
cgacuucagauaaaucacgcuuc

SEQ ID NO: 1969906 - RNA, 20 nt, Shigella flexneri 2a str. 301
cgacuuugccuggcggcaga

SEQ ID NO: 1969907 - RNA, 13 nt, Shigella flexneri 2a str. 301
cgagaaacgcuuu

SEQ ID NO: 1969908 - RNA, 20 nt, Shigella flexneri 2a str. 301
cgagaacgacauggcccagc

SEQ ID NO: 1969909 - RNA, 16 nt, Shigella flexneri 2a str. 301
cgagaucggccagcac

SEQ ID NO: 1969910 - RNA, 23 nt, Shigella flexneri 2a str. 301
cgagacgguuaaaaacagccagc

SEQ ID NO: 1969911 - RNA, 16 nt, Shigella flexneri 2a str. 301
cgacgugaccuuucag

SEQ ID NO: 1969912 - RNA, 16 nt, Shigella flexneri 2a str. 301
cgacgugcagcaucga

SEQ ID NO: 1969913 - RNA, 22 nt, Shigella flexneri 2a str. 301
cgagccuguaccacaaccugca

SEQ ID NO: 1969914 - RNA, 17 nt, Shigella flexneri 2a str. 301
cgagcgauacaucauca

SEQ ID NO: 1969915 - RNA, 19 nt, Shigella flexneri 2a str. 301
cgagcgccaccaucgauac

SEQ ID NO: 1969916 - RNA, 13 nt, Shigella flexneri 2a str. 301
cgaggacagcauc

SEQ ID NO: 1969917 - RNA, 20 nt, Shigella flexneri 2a str. 301
cgaggaucuuugccagaucg

SEQ ID NO: 1969918 - RNA, 15 nt, Shigella flexneri 2a str. 301
cgaguuggugcgccg

SEQ ID NO: 1969919 - RNA, 14 nt, Shigella flexneri 2a str. 301
cgaguugcccgcau

SEQ ID NO: 1969920 - RNA, 17 nt, Shigella flexneri 2a str. 301
cgauaaacgccggauga

SEQ ID NO: 1969921 - RNA, 20 nt, Shigella flexneri 2a str. 301
cgaguuugccgcuguccagu

SEQ ID NO: 1969922 - RNA, 16 nt, Shigella flexneri 2a str. 301
cgagugcggcgagcau

SEQ ID NO: 1969923 - RNA, 22 nt, Shigella flexneri 2a str. 301
cgauacaucaucacugccagga

SEQ ID NO: 1969924 - RNA, 17 nt, Shigella flexneri 2a str. 301
cgauaucgacgaccuga

SEQ ID NO: 1969925 - RNA, 17 nt, Shigella flexneri 2a str. 301
cgauaucggaggccugu

SEQ ID NO: 1969926 - RNA, 22 nt, Shigella flexneri 2a str. 301
cgauaucgauaaucaguaacgu

SEQ ID NO: 1969927 - RNA, 12 nt, Shigella flexneri 2a str. 301
cgaguccuucca

SEQ ID NO: 1969928 - RNA, 14 nt, Shigella flexneri 2a str. 301
cgaguaaucaggcu

SEQ ID NO: 1969929 - RNA, 12 nt, Shigella flexneri 2a str. 301
aacaagcgaauu

SEQ ID NO: 1969930 - RNA, 12 nt, Shigella flexneri 2a str. 301
cgacaccgccuc

SEQ ID NO: 1969931 - RNA, 22 nt, Shigella flexneri 2a str. 301
aacaaaucggcgcggaaucgcc

SEQ ID NO: 1969932 - RNA, 20 nt, Shigella flexneri 2a str. 301
aacaaccugcauuugcgcag

SEQ ID NO: 1969933 - RNA, 23 nt, Shigella flexneri 2a str. 301
aacaacgggcaccgccgccgcuu

SEQ ID NO: 1969934 - RNA, 16 nt, Shigella flexneri 2a str. 301
aacaaagcgcacuuua

SEQ ID NO: 1969935 - RNA, 13 nt, Shigella flexneri 2a str. 301
cgacaauucgcgu

SEQ ID NO: 1969936 - RNA, 16 nt, Shigella flexneri 2a str. 301
cgacacaaauggcagu

SEQ ID NO: 1969937 - RNA, 20 nt, Shigella flexneri 2a str. 301
cgacagauucaggcgcagca

SEQ ID NO: 1969938 - RNA, 18 nt, Shigella flexneri 2a str. 301
cgacagcaaauugcgcca

SEQ ID NO: 1969939 - RNA, 16 nt, Shigella flexneri 2a str. 301
cgacacugcucgcaga

SEQ ID NO: 1969940 - RNA, 21 nt, Shigella flexneri 2a str. 301
cgacagcguguuaaugcccau

SEQ ID NO: 1969941 - RNA, 15 nt, Shigella flexneri 2a str. 301
cgacaguaccagcag

SEQ ID NO: 1969942 - RNA, 20 nt, Shigella flexneri 2a str. 301
cgacagugacuuccguacca

SEQ ID NO: 1969943 - RNA, 21 nt, Shigella flexneri 2a str. 301
cgaauuauaauuccuucacgu

SEQ ID NO: 1969944 - RNA, 22 nt, Shigella flexneri 2a str. 301
cgaagucccacggugcagcugc

SEQ ID NO: 1969945 - RNA, 13 nt, Shigella flexneri 2a str. 301
cgaaggcggcgaa

SEQ ID NO: 1969946 - RNA, 15 nt, Shigella flexneri 2a str. 301
cgaagaucucgguaa

SEQ ID NO: 1969947 - RNA, 17 nt, Shigella flexneri 2a str. 301
cgaagaucucgguaacg

SEQ ID NO: 1969948 - RNA, 13 nt, Shigella flexneri 2a str. 301
cgaagacgugcgc

SEQ ID NO: 1969949 - RNA, 18 nt, Shigella flexneri 2a str. 301
cgaacucauacaccagcg

SEQ ID NO: 1969950 - RNA, 19 nt, Shigella flexneri 2a str. 301
cgaacucauacaccagcgg

SEQ ID NO: 1969951 - RNA, 21 nt, Shigella flexneri 2a str. 301
cgacgcgcgcgggucaccgcg

SEQ ID NO: 1969952 - RNA, 15 nt, Shigella flexneri 2a str. 301
cgacgcgccagcacc

SEQ ID NO: 1969953 - RNA, 17 nt, Shigella flexneri 2a str. 301
cgaccgccauuaaacgc

SEQ ID NO: 1969954 - RNA, 15 nt, Shigella flexneri 2a str. 301
cgaccauacagcagc

SEQ ID NO: 1969955 - RNA, 19 nt, Shigella flexneri 2a str. 301
cgaccaggccaucagcagc

SEQ ID NO: 1969956 - RNA, 13 nt, Shigella flexneri 2a str. 301
cgaccaggcaaac

SEQ ID NO: 1969957 - RNA, 22 nt, Shigella flexneri 2a str. 301
cgcccacgcgcauucccagcgc

SEQ ID NO: 1969958 - RNA, 20 nt, Shigella flexneri 2a str. 301
cgcccaaaccacccagcagc

SEQ ID NO: 1969959 - RNA, 17 nt, Shigella flexneri 2a str. 301
cgccauugaaaccgcug

SEQ ID NO: 1969960 - RNA, 23 nt, Shigella flexneri 2a str. 301
cgccaguucuuccaguuccggca

SEQ ID NO: 1969961 - RNA, 14 nt, Shigella flexneri 2a str. 301
cgccaguugcggcu

SEQ ID NO: 1969962 - RNA, 21 nt, Shigella flexneri 2a str. 301
cgccaguuuacugucugcuuc

SEQ ID NO: 1969963 - RNA, 20 nt, Shigella flexneri 2a str. 301
cgccaguuuggucuggcaaa

SEQ ID NO: 1969964 - RNA, 17 nt, Shigella flexneri 2a str. 301
cgccauaaacagcaggc

SEQ ID NO: 1969965 - RNA, 15 nt, Shigella flexneri 2a str. 301
cgccaucgcccaucc

SEQ ID NO: 1969966 - RNA, 14 nt, Shigella flexneri 2a str. 301
cgccaucgccagca

SEQ ID NO: 1969967 - RNA, 19 nt, Shigella flexneri 2a str. 301
cgccaucugccgauacgcu

SEQ ID NO: 1969968 - RNA, 17 nt, Shigella flexneri 2a str. 301
cgccaugaacgcgaagg

SEQ ID NO: 1969969 - RNA, 19 nt, Shigella flexneri 2a str. 301
cgccaggagacgcgcaaau

SEQ ID NO: 1969970 - RNA, 20 nt, Shigella flexneri 2a str. 301
cgccaggagacgcgcaaauc

SEQ ID NO: 1969971 - RNA, 18 nt, Shigella flexneri 2a str. 301
cgccagcugcauuucaua

SEQ ID NO: 1969972 - RNA, 14 nt, Shigella flexneri 2a str. 301
cgccagcgcgcguu

SEQ ID NO: 1969973 - RNA, 15 nt, Shigella flexneri 2a str. 301
cgccaguucgauauc

SEQ ID NO: 1969974 - RNA, 19 nt, Shigella flexneri 2a str. 301
cgccagugcgccccaggua

SEQ ID NO: 1969975 - RNA, 19 nt, Shigella flexneri 2a str. 301
cgccaguguuggcgucaga

SEQ ID NO: 1969976 - RNA, 16 nt, Shigella flexneri 2a str. 301
cgccaguguuucgaca

SEQ ID NO: 1969977 - RNA, 18 nt, Shigella flexneri 2a str. 301
cgccaguuacugccacca

SEQ ID NO: 1969978 - RNA, 16 nt, Shigella flexneri 2a str. 301
cgccaguaccagcagc

SEQ ID NO: 1969979 - RNA, 15 nt, Shigella flexneri 2a str. 301
cgccagguuucaaua

SEQ ID NO: 1969980 - RNA, 17 nt, Shigella flexneri 2a str. 301
cgccaguaugaggcaaa

SEQ ID NO: 1969981 - RNA, 19 nt, Shigella flexneri 2a str. 301
cgccacuuucacgccgcca

SEQ ID NO: 1969982 - RNA, 20 nt, Shigella flexneri 2a str. 301
cgccagaaacagugaccuga

SEQ ID NO: 1969983 - RNA, 13 nt, Shigella flexneri 2a str. 301
cgccagaaaucag

SEQ ID NO: 1969984 - RNA, 19 nt, Shigella flexneri 2a str. 301
cgccagaagcguucggcaa

SEQ ID NO: 1969985 - RNA, 14 nt, Shigella flexneri 2a str. 301
cgccagauuacgcu

SEQ ID NO: 1969986 - RNA, 21 nt, Shigella flexneri 2a str. 301
cgccagcaaaaucaccaucac

SEQ ID NO: 1969987 - RNA, 17 nt, Shigella flexneri 2a str. 301
cgccagaggcgacaaac

SEQ ID NO: 1969988 - RNA, 17 nt, Shigella flexneri 2a str. 301
cgccagaccgcagaagc

SEQ ID NO: 1969989 - RNA, 15 nt, Shigella flexneri 2a str. 301
cgccagcaucgcauc

SEQ ID NO: 1969990 - RNA, 19 nt, Shigella flexneri 2a str. 301
cgccagcagcagcgccaac

SEQ ID NO: 1969991 - RNA, 15 nt, Shigella flexneri 2a str. 301
cgccagcagccauuc

SEQ ID NO: 1969992 - RNA, 15 nt, Shigella flexneri 2a str. 301
cgccagcagcagcgc

SEQ ID NO: 1969993 - RNA, 23 nt, Shigella flexneri 2a str. 301
cgccagcaccggacuauccgccu

SEQ ID NO: 1969994 - RNA, 23 nt, Shigella flexneri 2a str. 301
cgccagccaguuuacccagcgaa

SEQ ID NO: 1969995 - RNA, 14 nt, Shigella flexneri 2a str. 301
cgccagccgcaguu

SEQ ID NO: 1969996 - RNA, 13 nt, Shigella flexneri 2a str. 301
cgccaaucagcgc

SEQ ID NO: 1969997 - RNA, 16 nt, Shigella flexneri 2a str. 301
cgccaaagcggcaguu

SEQ ID NO: 1969998 - RNA, 17 nt, Shigella flexneri 2a str. 301
cgccaaagaaaccgcgc

SEQ ID NO: 1969999 - RNA, 20 nt, Shigella flexneri 2a str. 301
cgcaggguuugcaucgccau

SEQ ID NO: 1970000 - RNA, 23 nt, Shigella flexneri 2a str. 301
cgcauugaacucuucuuccggca

SEQ ID NO: 1970001 - RNA, 17 nt, Shigella flexneri 2a str. 301
cgccaaaacaucuucgg

SEQ ID NO: 1970002 - RNA, 19 nt, Shigella flexneri 2a str. 301
cgccaccguguucaugacc

SEQ ID NO: 1970003 - RNA, 14 nt, Shigella flexneri 2a str. 301
cgccaccccacgau

SEQ ID NO: 1970004 - RNA, 18 nt, Shigella flexneri 2a str. 301
cgccaccauuuuacgucc

SEQ ID NO: 1970005 - RNA, 13 nt, Shigella flexneri 2a str. 301
cgccacggcauga

SEQ ID NO: 1970006 - RNA, 18 nt, Shigella flexneri 2a str. 301
cgcacggccgcaagcaga

SEQ ID NO: 1970007 - RNA, 11 nt, Shigella flexneri 2a str. 301
cgcacgcucaa

SEQ ID NO: 1970008 - RNA, 13 nt, Shigella flexneri 2a str. 301
cgcacgcuggaga

SEQ ID NO: 1970009 - RNA, 14 nt, Shigella flexneri 2a str. 301
cgcacuuaccuuca

SEQ ID NO: 1970010 - RNA, 12 nt, Shigella flexneri 2a str. 301
cgcacuggugcc

SEQ ID NO: 1970011 - RNA, 15 nt, Shigella flexneri 2a str. 301
cgcaccgcuggcaga

SEQ ID NO: 1970012 - RNA, 14 nt, Shigella flexneri 2a str. 301
cgcacgacgaaucu

SEQ ID NO: 1970013 - RNA, 20 nt, Shigella flexneri 2a str. 301
cgcaccccugauaaccgcau

SEQ ID NO: 1970014 - RNA, 20 nt, Shigella flexneri 2a str. 301
cgcagaaaaagagcaucagc

SEQ ID NO: 1970015 - RNA, 22 nt, Shigella flexneri 2a str. 301
cgcagaaaaagagcaucagcag

SEQ ID NO: 1970016 - RNA, 19 nt, Shigella flexneri 2a str. 301
cgcagaacuucacucucuu

SEQ ID NO: 1970017 - RNA, 22 nt, Shigella flexneri 2a str. 301
cgcagcauugcucaccgccagc

SEQ ID NO: 1970018 - RNA, 20 nt, Shigella flexneri 2a str. 301
cgcaggcgcaauggcgcaau

SEQ ID NO: 1970019 - RNA, 15 nt, Shigella flexneri 2a str. 301
cgcaggcgacauauc

SEQ ID NO: 1970020 - RNA, 12 nt, Shigella flexneri 2a str. 301
cgcagcuucucg

SEQ ID NO: 1970021 - RNA, 14 nt, Shigella flexneri 2a str. 301
cgcaggcgcgcugu

SEQ ID NO: 1970022 - RNA, 15 nt, Shigella flexneri 2a str. 301
cgcagcgucagcacc

SEQ ID NO: 1970023 - RNA, 17 nt, Shigella flexneri 2a str. 301
cgcagcucacuucgauc

SEQ ID NO: 1970024 - RNA, 13 nt, Shigella flexneri 2a str. 301
cgcagcuccagcc

SEQ ID NO: 1970025 - RNA, 17 nt, Shigella flexneri 2a str. 301
cgcagcucauaaccguc

SEQ ID NO: 1970026 - RNA, 22 nt, Shigella flexneri 2a str. 301
cgcagcugguguaacugcgcca

SEQ ID NO: 1970027 - RNA, 19 nt, Shigella flexneri 2a str. 301
cgaugaaaaaccguaucca

SEQ ID NO: 1970028 - RNA, 12 nt, Shigella flexneri 2a str. 301
cgauauugccac

SEQ ID NO: 1970029 - RNA, 15 nt, Shigella flexneri 2a str. 301
cgaugaucaacagca

SEQ ID NO: 1970030 - RNA, 18 nt, Shigella flexneri 2a str. 301
cgauguucccccagccag

SEQ ID NO: 1970031 - RNA, 18 nt, Shigella flexneri 2a str. 301
cgauguccugacgcccga

SEQ ID NO: 1970032 - RNA, 23 nt, Shigella flexneri 2a str. 301
cgauguccagacgcgcagcuuca

SEQ ID NO: 1970033 - RNA, 14 nt, Shigella flexneri 2a str. 301
cgauguauccggca

SEQ ID NO: 1970034 - RNA, 19 nt, Shigella flexneri 2a str. 301
cgauguacuucaacauaac

SEQ ID NO: 1970035 - RNA, 16 nt, Shigella flexneri 2a str. 301
cgauugcugccgaugg

SEQ ID NO: 1970036 - RNA, 21 nt, Shigella flexneri 2a str. 301
cgauugaucucguugaucacc

SEQ ID NO: 1970037 - RNA, 14 nt, Shigella flexneri 2a str. 301
cgauugccggaugc

SEQ ID NO: 1970038 - RNA, 19 nt, Shigella flexneri 2a str. 301
cgauuguauacgcuggcgg

SEQ ID NO: 1970039 - RNA, 21 nt, Shigella flexneri 2a str. 301
cgcaaaacugccugaugcgcu

SEQ ID NO: 1970040 - RNA, 15 nt, Shigella flexneri 2a str. 301
cgcaacauugcgccu

SEQ ID NO: 1970041 - RNA, 14 nt, Shigella flexneri 2a str. 301
cgcaaccagcguca

SEQ ID NO: 1970042 - RNA, 17 nt, Shigella flexneri 2a str. 301
cgcaaagagagaagcca

SEQ ID NO: 1970043 - RNA, 20 nt, Shigella flexneri 2a str. 301
cgauucccagucauccggcu

SEQ ID NO: 1970044 - RNA, 13 nt, Shigella flexneri 2a str. 301
cgauucaacagua

SEQ ID NO: 1970045 - RNA, 19 nt, Shigella flexneri 2a str. 301
ccaaugcaggcaucgguga

SEQ ID NO: 1970046 - RNA, 21 nt, Shigella flexneri 2a str. 301
ccaaugaccacuccggcauga

SEQ ID NO: 1970047 - RNA, 15 nt, Shigella flexneri 2a str. 301
ccaaugaccgcgcca

SEQ ID NO: 1970048 - RNA, 18 nt, Shigella flexneri 2a str. 301
aaagcgagaguuacagcu

SEQ ID NO: 1970049 - RNA, 15 nt, Shigella flexneri 2a str. 301
aaagccuuuugccag

SEQ ID NO: 1970050 - RNA, 15 nt, Shigella flexneri 2a str. 301
ccacaaaaaccgcug

SEQ ID NO: 1970051 - RNA, 16 nt, Shigella flexneri 2a str. 301
ccaaugccguucucug

SEQ ID NO: 1970052 - RNA, 17 nt, Shigella flexneri 2a str. 301
ccacaaucagccagaac

SEQ ID NO: 1970053 - RNA, 14 nt, Shigella flexneri 2a str. 301
ccacaaucagccag

SEQ ID NO: 1970054 - RNA, 20 nt, Shigella flexneri 2a str. 301
ccacaauaacugccggaacu

SEQ ID NO: 1970055 - RNA, 14 nt, Shigella flexneri 2a str. 301
aaagccgcgugcgc

SEQ ID NO: 1970056 - RNA, 20 nt, Shigella flexneri 2a str. 301
aaagccggaugaucauccgg

SEQ ID NO: 1970057 - RNA, 16 nt, Shigella flexneri 2a str. 301
ccaaucaucgcggcac

SEQ ID NO: 1970058 - RNA, 17 nt, Shigella flexneri 2a str. 301
ccaauccagcccugcca

SEQ ID NO: 1970059 - RNA, 18 nt, Shigella flexneri 2a str. 301
ccaagaccaauccgccag

SEQ ID NO: 1970060 - RNA, 19 nt, Shigella flexneri 2a str. 301
ccaacgcgccaccgaccag

SEQ ID NO: 1970061 - RNA, 12 nt, Shigella flexneri 2a str. 301
ccaacgcugcca

SEQ ID NO: 1970062 - RNA, 22 nt, Shigella flexneri 2a str. 301
ccaacgccccguaaaucgucag

SEQ ID NO: 1970063 - RNA, 19 nt, Shigella flexneri 2a str. 301
ccaacgcccuuaccgccag

SEQ ID NO: 1970064 - RNA, 16 nt, Shigella flexneri 2a str. 301
ccaacgccuuucgcug

SEQ ID NO: 1970065 - RNA, 12 nt, Shigella flexneri 2a str. 301
ccaacgcagcaa

SEQ ID NO: 1970066 - RNA, 19 nt, Shigella flexneri 2a str. 301
caugccggucgcgcgggaa

SEQ ID NO: 1970067 - RNA, 22 nt, Shigella flexneri 2a str. 301
ccaccgcgcguuugaucgacag

SEQ ID NO: 1970068 - RNA, 16 nt, Shigella flexneri 2a str. 301
ccaccgaugaucaaca

SEQ ID NO: 1970069 - RNA, 16 nt, Shigella flexneri 2a str. 301
ccaccgauuuugagaa

SEQ ID NO: 1970070 - RNA, 22 nt, Shigella flexneri 2a str. 301
aaaggcaccaauauugacugau

SEQ ID NO: 1970071 - RNA, 23 nt, Shigella flexneri 2a str. 301
aaaggcaccaauauugacugaug

SEQ ID NO: 1970072 - RNA, 17 nt, Shigella flexneri 2a str. 301
ccaccaguggacggcug

SEQ ID NO: 1970073 - RNA, 21 nt, Shigella flexneri 2a str. 301
ccaccagugcaggcaccagcc

SEQ ID NO: 1970074 - RNA, 14 nt, Shigella flexneri 2a str. 301
ccaccauaagcccg

SEQ ID NO: 1970075 - RNA, 16 nt, Shigella flexneri 2a str. 301
ccaccagguucaacag

SEQ ID NO: 1970076 - RNA, 14 nt, Shigella flexneri 2a str. 301
ccaccacgccaaga

SEQ ID NO: 1970077 - RNA, 20 nt, Shigella flexneri 2a str. 301
ccaccacagacaaucgccag

SEQ ID NO: 1970078 - RNA, 17 nt, Shigella flexneri 2a str. 301
ccagaucccauaaccaa

SEQ ID NO: 1970079 - RNA, 16 nt, Shigella flexneri 2a str. 301
ccagacguuucgccag

SEQ ID NO: 1970080 - RNA, 18 nt, Shigella flexneri 2a str. 301
ccagaucgccugccgcca

SEQ ID NO: 1970081 - RNA, 18 nt, Shigella flexneri 2a str. 301
ccagauccugauccugca

SEQ ID NO: 1970082 - RNA, 18 nt, Shigella flexneri 2a str. 301
ccagaucggucagugcca

SEQ ID NO: 1970083 - RNA, 22 nt, Shigella flexneri 2a str. 301
ccagaacuacccgguucgucau

SEQ ID NO: 1970084 - RNA, 17 nt, Shigella flexneri 2a str. 301
ccagauuaccagcgaca

SEQ ID NO: 1970085 - RNA, 16 nt, Shigella flexneri 2a str. 301
ccagcaacaacagcgc

SEQ ID NO: 1970086 - RNA, 14 nt, Shigella flexneri 2a str. 301
ccagcaaaucccag

SEQ ID NO: 1970087 - RNA, 14 nt, Shigella flexneri 2a str. 301
ccagcaaacaggug

SEQ ID NO: 1970088 - RNA, 15 nt, Shigella flexneri 2a str. 301
ccagcaacaagccag

SEQ ID NO: 1970089 - RNA, 18 nt, Shigella flexneri 2a str. 301
ccagcaccagcuccggca

SEQ ID NO: 1970090 - RNA, 15 nt, Shigella flexneri 2a str. 301
ccagcaccagcaacg

SEQ ID NO: 1970091 - RNA, 23 nt, Shigella flexneri 2a str. 301
ccacgucguuccccauuaccuga

SEQ ID NO: 1970092 - RNA, 11 nt, Shigella flexneri 2a str. 301
ccacuccagcu

SEQ ID NO: 1970093 - RNA, 22 nt, Shigella flexneri 2a str. 301
ccacuccgguaauaucgcgcag

SEQ ID NO: 1970094 - RNA, 22 nt, Shigella flexneri 2a str. 301
aaaggucccugaugcaucaguc

SEQ ID NO: 1970095 - RNA, 12 nt, Shigella flexneri 2a str. 301
aaaggcgaaacc

SEQ ID NO: 1970096 - RNA, 22 nt, Shigella flexneri 2a str. 301
ccaccugcucgucauccgccag

SEQ ID NO: 1970097 - RNA, 15 nt, Shigella flexneri 2a str. 301
ccaccugaccugcga

SEQ ID NO: 1970098 - RNA, 23 nt, Shigella flexneri 2a str. 301
aaaguagggcugauaaacaagcg

SEQ ID NO: 1970099 - RNA, 17 nt, Shigella flexneri 2a str. 301
aaaguacggacgcggca

SEQ ID NO: 1970100 - RNA, 23 nt, Shigella flexneri 2a str. 301
aaaguccggguucaaaucgaaau

SEQ ID NO: 1970101 - RNA, 22 nt, Shigella flexneri 2a str. 301
aaagugcgcuuaguuuaugccg

SEQ ID NO: 1970102 - RNA, 19 nt, Shigella flexneri 2a str. 301
ccacgcugcaucgccaauc

SEQ ID NO: 1970103 - RNA, 17 nt, Shigella flexneri 2a str. 301
ccacgcgggaagucacu

SEQ ID NO: 1970104 - RNA, 14 nt, Shigella flexneri 2a str. 301
aaaucacgcuucac

SEQ ID NO: 1970105 - RNA, 21 nt, Shigella flexneri 2a str. 301
aaauccaccaguggacggcug

SEQ ID NO: 1970106 - RNA, 18 nt, Shigella flexneri 2a str. 301
ccagcgucgcauccgaca

SEQ ID NO: 1970107 - RNA, 20 nt, Shigella flexneri 2a str. 301
ccagcgucgcaucaggcauc

SEQ ID NO: 1970108 - RNA, 18 nt, Shigella flexneri 2a str. 301
ccagcgucgcaucaggca

SEQ ID NO: 1970109 - RNA, 21 nt, Shigella flexneri 2a str. 301
ccagcgucgcacccggcauuu

SEQ ID NO: 1970110 - RNA, 21 nt, Shigella flexneri 2a str. 301
ccagcguaccaugauccugca

SEQ ID NO: 1970111 - RNA, 18 nt, Shigella flexneri 2a str. 301
ccagcgguuuuugcgcca

SEQ ID NO: 1970112 - RNA, 23 nt, Shigella flexneri 2a str. 301
ccagcgguucacuccacuggcug

SEQ ID NO: 1970113 - RNA, 20 nt, Shigella flexneri 2a str. 301
ccagcgcguaaauaucggca

SEQ ID NO: 1970114 - RNA, 20 nt, Shigella flexneri 2a str. 301
ccagcggaauucccgcuucu

SEQ ID NO: 1970115 - RNA, 15 nt, Shigella flexneri 2a str. 301
ccagcggaauaacgc

SEQ ID NO: 1970116 - RNA, 23 nt, Shigella flexneri 2a str. 301
ccagcggcugcugauguucgcca

SEQ ID NO: 1970117 - RNA, 15 nt, Shigella flexneri 2a str. 301
ccagcauucccgcca

SEQ ID NO: 1970118 - RNA, 18 nt, Shigella flexneri 2a str. 301
ccagcaucgcauccggca

SEQ ID NO: 1970119 - RNA, 16 nt, Shigella flexneri 2a str. 301
ccagcaucgcaacaug

SEQ ID NO: 1970120 - RNA, 13 nt, Shigella flexneri 2a str. 301
ccagcauccggca

SEQ ID NO: 1970121 - RNA, 21 nt, Shigella flexneri 2a str. 301
ccagcauacgcugccagccau

SEQ ID NO: 1970122 - RNA, 20 nt, Shigella flexneri 2a str. 301
ccagcacgaucagugccgca

SEQ ID NO: 1970123 - RNA, 20 nt, Shigella flexneri 2a str. 301
ccagccccagaauucacgca

SEQ ID NO: 1970124 - RNA, 21 nt, Shigella flexneri 2a str. 301
ccagccgauuuuaaugcggca

SEQ ID NO: 1970125 - RNA, 23 nt, Shigella flexneri 2a str. 301
ccagcgaaggaucaccccgaugg

SEQ ID NO: 1970126 - RNA, 21 nt, Shigella flexneri 2a str. 301
ccagcgauuuaucggcaauuu

SEQ ID NO: 1970127 - RNA, 20 nt, Shigella flexneri 2a str. 301
ccaggacaaucacauccgga

SEQ ID NO: 1970128 - RNA, 23 nt, Shigella flexneri 2a str. 301
ccaggacaaucacauccggaucg

SEQ ID NO: 1970129 - RNA, 20 nt, Shigella flexneri 2a str. 301
ccagcuuuuuaaucgccauc

SEQ ID NO: 1970130 - RNA, 19 nt, Shigella flexneri 2a str. 301
ccagcguuuccagcaccag

SEQ ID NO: 1970131 - RNA, 15 nt, Shigella flexneri 2a str. 301
ccagcucaaacgaau

SEQ ID NO: 1970132 - RNA, 12 nt, Shigella flexneri 2a str. 301
ccagcuccgcca

SEQ ID NO: 1970133 - RNA, 13 nt, Shigella flexneri 2a str. 301
ccagggcagcagu

SEQ ID NO: 1970134 - RNA, 16 nt, Shigella flexneri 2a str. 301
ccaggcgagaucggca

SEQ ID NO: 1970135 - RNA, 19 nt, Shigella flexneri 2a str. 301
ccagguucgauauccgcca

SEQ ID NO: 1970136 - RNA, 18 nt, Shigella flexneri 2a str. 301
ccaguacgcccacgccag

SEQ ID NO: 1970137 - RNA, 18 nt, Shigella flexneri 2a str. 301
ccaguaccgccagugcag

SEQ ID NO: 1970138 - RNA, 21 nt, Shigella flexneri 2a str. 301
ccaguaauugacgcauccgau

SEQ ID NO: 1970139 - RNA, 17 nt, Shigella flexneri 2a str. 301
ccaggucgcauccggca

SEQ ID NO: 1970140 - RNA, 14 nt, Shigella flexneri 2a str. 301
cccgaugccagcac

SEQ ID NO: 1970141 - RNA, 22 nt, Shigella flexneri 2a str. 301
cccgcgcaaaccaccuggcagu

SEQ ID NO: 1970142 - RNA, 23 nt, Shigella flexneri 2a str. 301
ccccuucugccgcaauucgcccu

SEQ ID NO: 1970143 - RNA, 12 nt, Shigella flexneri 2a str. 301
ccccagcgcaag

SEQ ID NO: 1970144 - RNA, 19 nt, Shigella flexneri 2a str. 301
ccccacagcgucauuguca

SEQ ID NO: 1970145 - RNA, 20 nt, Shigella flexneri 2a str. 301
ccccagcgcucgguagugcc

SEQ ID NO: 1970146 - RNA, 12 nt, Shigella flexneri 2a str. 301
ccccgccagcag

SEQ ID NO: 1970147 - RNA, 16 nt, Shigella flexneri 2a str. 301
aaaucgaaaucaacau

SEQ ID NO: 1970148 - RNA, 18 nt, Shigella flexneri 2a str. 301
ccaugcguugucgccauc

SEQ ID NO: 1970149 - RNA, 21 nt, Shigella flexneri 2a str. 301
ccaguagacgagccguuccua

SEQ ID NO: 1970150 - RNA, 22 nt, Shigella flexneri 2a str. 301
ccaguacucggaauaaccgguu

SEQ ID NO: 1970151 - RNA, 23 nt, Shigella flexneri 2a str. 301
ccauuaaacgcaguaagcgccag

SEQ ID NO: 1970152 - RNA, 16 nt, Shigella flexneri 2a str. 301
aaaucgaucaucaccu

SEQ ID NO: 1970153 - RNA, 14 nt, Shigella flexneri 2a str. 301
aaaucgcauugcgu

SEQ ID NO: 1970154 - RNA, 15 nt, Shigella flexneri 2a str. 301
aaaucgccggugauu

SEQ ID NO: 1970155 - RNA, 16 nt, Shigella flexneri 2a str. 301
ccauuguuagcaacga

SEQ ID NO: 1970156 - RNA, 16 nt, Shigella flexneri 2a str. 301
ccauuguaggccugau

SEQ ID NO: 1970157 - RNA, 15 nt, Shigella flexneri 2a str. 301
ccauuucaucgccag

SEQ ID NO: 1970158 - RNA, 17 nt, Shigella flexneri 2a str. 301
ccauuucuucuccggca

SEQ ID NO: 1970159 - RNA, 16 nt, Shigella flexneri 2a str. 301
ccauuugugcuggcaa

SEQ ID NO: 1970160 - RNA, 17 nt, Shigella flexneri 2a str. 301
ccauuuucgcuggcaga

SEQ ID NO: 1970161 - RNA, 22 nt, Shigella flexneri 2a str. 301
cccaaccgauaaccacgcucag

SEQ ID NO: 1970162 - RNA, 17 nt, Shigella flexneri 2a str. 301
cccaacuuugugcaauu

SEQ ID NO: 1970163 - RNA, 15 nt, Shigella flexneri 2a str. 301
cccagugcggcaucg

SEQ ID NO: 1970164 - RNA, 19 nt, Shigella flexneri 2a str. 301
cccagugccguuauucagg

SEQ ID NO: 1970165 - RNA, 19 nt, Shigella flexneri 2a str. 301
cccaguugauucgcgcguu

SEQ ID NO: 1970166 - RNA, 16 nt, Shigella flexneri 2a str. 301
cccaucaccgcgaggc

SEQ ID NO: 1970167 - RNA, 23 nt, Shigella flexneri 2a str. 301
cccaguuuugcgcguuggcaaga

SEQ ID NO: 1970168 - RNA, 23 nt, Shigella flexneri 2a str. 301
cccaucgcguuugcgcuccggcg

SEQ ID NO: 1970169 - RNA, 22 nt, Shigella flexneri 2a str. 301
cccaugccggaugcgccagcau

SEQ ID NO: 1970170 - RNA, 18 nt, Shigella flexneri 2a str. 301
cccaugccauuuccagcg

SEQ ID NO: 1970171 - RNA, 19 nt, Shigella flexneri 2a str. 301
cccagauagcaacagcagc

SEQ ID NO: 1970172 - RNA, 14 nt, Shigella flexneri 2a str. 301
cccagauagcaaca

SEQ ID NO: 1970173 - RNA, 19 nt, Shigella flexneri 2a str. 301
cccaggcuuaauugcgcaa

SEQ ID NO: 1970174 - RNA, 22 nt, Shigella flexneri 2a str. 301
cccagcguggagagcagcauca

SEQ ID NO: 1970175 - RNA, 22 nt, Shigella flexneri 2a str. 301
ccgagaaaaauagcauuaaugc

SEQ ID NO: 1970176 - RNA, 16 nt, Shigella flexneri 2a str. 301
ccgacgugcagcaucg

SEQ ID NO: 1970177 - RNA, 11 nt, Shigella flexneri 2a str. 301
ccgagcaaacc

SEQ ID NO: 1970178 - RNA, 21 nt, Shigella flexneri 2a str. 301
ccgagaagauuuuuugccagc

SEQ ID NO: 1970179 - RNA, 14 nt, Shigella flexneri 2a str. 301
ccgagaaccggcgc

SEQ ID NO: 1970180 - RNA, 19 nt, Shigella flexneri 2a str. 301
ccgacgauguuagcggcga

SEQ ID NO: 1970181 - RNA, 23 nt, Shigella flexneri 2a str. 301
ccgacaaacaaugagaauaccga

SEQ ID NO: 1970182 - RNA, 16 nt, Shigella flexneri 2a str. 301
ccgaauuucauccugu

SEQ ID NO: 1970183 - RNA, 14 nt, Shigella flexneri 2a str. 301
ccgaauacggucuu

SEQ ID NO: 1970184 - RNA, 12 nt, Shigella flexneri 2a str. 301
ccgacaucacgg

SEQ ID NO: 1970185 - RNA, 13 nt, Shigella flexneri 2a str. 301
ccgacaucgccac

SEQ ID NO: 1970186 - RNA, 19 nt, Shigella flexneri 2a str. 301
ccgaccuucacgcugcgca

SEQ ID NO: 1970187 - RNA, 14 nt, Shigella flexneri 2a str. 301
aaaugaacugggca

SEQ ID NO: 1970188 - RNA, 23 nt, Shigella flexneri 2a str. 301
cccgucagcaaaauacugaacag

SEQ ID NO: 1970189 - RNA, 16 nt, Shigella flexneri 2a str. 301
aaaucuauugcaacau

SEQ ID NO: 1970190 - RNA, 12 nt, Shigella flexneri 2a str. 301
aaaucuggugcu

SEQ ID NO: 1970191 - RNA, 21 nt, Shigella flexneri 2a str. 301
cccguaguguggggaaugaua

SEQ ID NO: 1970192 - RNA, 12 nt, Shigella flexneri 2a str. 301
cccggugggcga

SEQ ID NO: 1970193 - RNA, 15 nt, Shigella flexneri 2a str. 301
cccgggucagcgcca

SEQ ID NO: 1970194 - RNA, 17 nt, Shigella flexneri 2a str. 301
cccggucauaaugagca

SEQ ID NO: 1970195 - RNA, 14 nt, Shigella flexneri 2a str. 301
cccggucaugauac

SEQ ID NO: 1970196 - RNA, 23 nt, Shigella flexneri 2a str. 301
cccggauuuggcaaaugcaucag

SEQ ID NO: 1970197 - RNA, 14 nt, Shigella flexneri 2a str. 301
cccuugcucaauga

SEQ ID NO: 1970198 - RNA, 15 nt, Shigella flexneri 2a str. 301
cccuugccgaugcgg

SEQ ID NO: 1970199 - RNA, 23 nt, Shigella flexneri 2a str. 301
cccugcgauggugaagucauuga

SEQ ID NO: 1970200 - RNA, 14 nt, Shigella flexneri 2a str. 301
ccgaaaaaccugac

SEQ ID NO: 1970201 - RNA, 14 nt, Shigella flexneri 2a str. 301
ccgaauaacgcgca

SEQ ID NO: 1970202 - RNA, 12 nt, Shigella flexneri 2a str. 301
ccgaagacaucg

SEQ ID NO: 1970203 - RNA, 19 nt, Shigella flexneri 2a str. 301
cagguaccgagauaacguu

SEQ ID NO: 1970204 - RNA, 20 nt, Shigella flexneri 2a str. 301
caggguuauauaaaaccgca

SEQ ID NO: 1970205 - RNA, 23 nt, Shigella flexneri 2a str. 301
caggguaauuuguaacugucggg

SEQ ID NO: 1970206 - RNA, 19 nt, Shigella flexneri 2a str. 301
caggguaaaaccaugccau

SEQ ID NO: 1970207 - RNA, 16 nt, Shigella flexneri 2a str. 301
cagggcgcggaaaugg

SEQ ID NO: 1970208 - RNA, 15 nt, Shigella flexneri 2a str. 301
cagucaugcgagaag

SEQ ID NO: 1970209 - RNA, 22 nt, Shigella flexneri 2a str. 301
caguauuaacgccauaucauuc

SEQ ID NO: 1970210 - RNA, 13 nt, Shigella flexneri 2a str. 301
caguccagcgccu

SEQ ID NO: 1970211 - RNA, 19 nt, Shigella flexneri 2a str. 301
cagucgaauggcaucuacg

SEQ ID NO: 1970212 - RNA, 16 nt, Shigella flexneri 2a str. 301
cagugcgugcgcugcu

SEQ ID NO: 1970213 - RNA, 15 nt, Shigella flexneri 2a str. 301
cagucuucaucaucc

SEQ ID NO: 1970214 - RNA, 22 nt, Shigella flexneri 2a str. 301
cagucuuugccguuggcggcgu

SEQ ID NO: 1970215 - RNA, 18 nt, Shigella flexneri 2a str. 301
caguagcgucgccagcag

SEQ ID NO: 1970216 - RNA, 22 nt, Shigella flexneri 2a str. 301
caguagcgcaaucaccaccacg

SEQ ID NO: 1970217 - RNA, 21 nt, Shigella flexneri 2a str. 301
caggcggauugcuucugcuuc

SEQ ID NO: 1970218 - RNA, 20 nt, Shigella flexneri 2a str. 301
caggccuacaaaaucuugca

SEQ ID NO: 1970219 - RNA, 17 nt, Shigella flexneri 2a str. 301
caggcgcaacccgugaa

SEQ ID NO: 1970220 - RNA, 23 nt, Shigella flexneri 2a str. 301
caggcugguaacagugcaccgga

SEQ ID NO: 1970221 - RNA, 21 nt, Shigella flexneri 2a str. 301
cagggaguacguggaggaugg

SEQ ID NO: 1970222 - RNA, 20 nt, Shigella flexneri 2a str. 301
caggcguaacacucgugcgu

SEQ ID NO: 1970223 - RNA, 14 nt, Shigella flexneri 2a str. 301
caggcaaaucccau

SEQ ID NO: 1970224 - RNA, 13 nt, Shigella flexneri 2a str. 301
caggauuuccagc

SEQ ID NO: 1970225 - RNA, 18 nt, Shigella flexneri 2a str. 301
caggcacuacguucucac

SEQ ID NO: 1970226 - RNA, 17 nt, Shigella flexneri 2a str. 301
caggauaaacuccugca

SEQ ID NO: 1970227 - RNA, 18 nt, Shigella flexneri 2a str. 301
caggauauauuucaucaa

SEQ ID NO: 1970228 - RNA, 20 nt, Shigella flexneri 2a str. 301
cagcguuaucccaucccacu

SEQ ID NO: 1970229 - RNA, 22 nt, Shigella flexneri 2a str. 301
cagcguuaaugauaucccugcu

SEQ ID NO: 1970230 - RNA, 16 nt, Shigella flexneri 2a str. 301
caggccaucagcagcg

SEQ ID NO: 1970231 - RNA, 16 nt, Shigella flexneri 2a str. 301
caggcccagcgguguc

SEQ ID NO: 1970232 - RNA, 19 nt, Shigella flexneri 2a str. 301
caggcaucagcaacacgcu

SEQ ID NO: 1970233 - RNA, 15 nt, Shigella flexneri 2a str. 301
caggcagcugccaga

SEQ ID NO: 1970234 - RNA, 20 nt, Shigella flexneri 2a str. 301
caggcagcuuagaaaucgac

SEQ ID NO: 1970235 - RNA, 14 nt, Shigella flexneri 2a str. 301
caggcaguaaaccg

SEQ ID NO: 1970236 - RNA, 13 nt, Shigella flexneri 2a str. 301
caggccgccugca

SEQ ID NO: 1970237 - RNA, 15 nt, Shigella flexneri 2a str. 301
caucgcgaccaauca

SEQ ID NO: 1970238 - RNA, 19 nt, Shigella flexneri 2a str. 301
caucgcggucaaccaucgc

SEQ ID NO: 1970239 - RNA, 12 nt, Shigella flexneri 2a str. 301
caucgcccacau

SEQ ID NO: 1970240 - RNA, 21 nt, Shigella flexneri 2a str. 301
caucgccagcgaauuccaguu

SEQ ID NO: 1970241 - RNA, 13 nt, Shigella flexneri 2a str. 301
caucgccagaaau

SEQ ID NO: 1970242 - RNA, 13 nt, Shigella flexneri 2a str. 301
caucgacuccagc

SEQ ID NO: 1970243 - RNA, 12 nt, Shigella flexneri 2a str. 301
caucagcggcac

SEQ ID NO: 1970244 - RNA, 16 nt, Shigella flexneri 2a str. 301
caucagcgccaccagc

SEQ ID NO: 1970245 - RNA, 20 nt, Shigella flexneri 2a str. 301
caucaggcagucugcgcccu

SEQ ID NO: 1970246 - RNA, 16 nt, Shigella flexneri 2a str. 301
cauccgggcgaacugg

SEQ ID NO: 1970247 - RNA, 14 nt, Shigella flexneri 2a str. 301
cauccgggccagcg

SEQ ID NO: 1970248 - RNA, 22 nt, Shigella flexneri 2a str. 301
cauccggcuccgguuaacgccg

SEQ ID NO: 1970249 - RNA, 23 nt, Shigella flexneri 2a str. 301
cauccgugguggcagccagccau

SEQ ID NO: 1970250 - RNA, 14 nt, Shigella flexneri 2a str. 301
cauccgucauccau

SEQ ID NO: 1970251 - RNA, 21 nt, Shigella flexneri 2a str. 301
caucccuguaaaacgcgcccu

SEQ ID NO: 1970252 - RNA, 18 nt, Shigella flexneri 2a str. 301
cauccggcaugauaccga

SEQ ID NO: 1970253 - RNA, 20 nt, Shigella flexneri 2a str. 301
cauccggcaguaauaccaga

SEQ ID NO: 1970254 - RNA, 21 nt, Shigella flexneri 2a str. 301
cauccgcccacaccagucagc

SEQ ID NO: 1970255 - RNA, 22 nt, Shigella flexneri 2a str. 301
cauccgaucgcgcaucagcagu

SEQ ID NO: 1970256 - RNA, 21 nt, Shigella flexneri 2a str. 301
caucaauaccauuaucauuga

SEQ ID NO: 1970257 - RNA, 23 nt, Shigella flexneri 2a str. 301
caucacaaucauccuaccgccag

SEQ ID NO: 1970258 - RNA, 15 nt, Shigella flexneri 2a str. 301
caucaaugccagcau

SEQ ID NO: 1970259 - RNA, 18 nt, Shigella flexneri 2a str. 301
cauauucgccgcccugca

SEQ ID NO: 1970260 - RNA, 21 nt, Shigella flexneri 2a str. 301
cauauuucuguuugcgucagc

SEQ ID NO: 1970261 - RNA, 18 nt, Shigella flexneri 2a str. 301
cauauuauucauaaugcc

SEQ ID NO: 1970262 - RNA, 19 nt, Shigella flexneri 2a str. 301
cauauguuuacgcuggcgg

SEQ ID NO: 1970263 - RNA, 17 nt, Shigella flexneri 2a str. 301
cauagccuaauccuucu

SEQ ID NO: 1970264 - RNA, 14 nt, Shigella flexneri 2a str. 301
caucaccacugacg

SEQ ID NO: 1970265 - RNA, 13 nt, Shigella flexneri 2a str. 301
caucagaacguaa

SEQ ID NO: 1970266 - RNA, 15 nt, Shigella flexneri 2a str. 301
caucacgcgcaucug

SEQ ID NO: 1970267 - RNA, 15 nt, Shigella flexneri 2a str. 301
caucacuaucgccau

SEQ ID NO: 1970268 - RNA, 18 nt, Shigella flexneri 2a str. 301
caucagcauaaucaccag

SEQ ID NO: 1970269 - RNA, 13 nt, Shigella flexneri 2a str. 301
cauacaccagcgg

SEQ ID NO: 1970270 - RNA, 17 nt, Shigella flexneri 2a str. 301
cauaccuuccagcgcgu

SEQ ID NO: 1970271 - RNA, 17 nt, Shigella flexneri 2a str. 301
cauaccgucgccagacg

SEQ ID NO: 1970272 - RNA, 14 nt, Shigella flexneri 2a str. 301
cauacuuccacgca

SEQ ID NO: 1970273 - RNA, 17 nt, Shigella flexneri 2a str. 301
cauacuccagucgcugc

SEQ ID NO: 1970274 - RNA, 16 nt, Shigella flexneri 2a str. 301
cauacgguuuaccgag

SEQ ID NO: 1970275 - RNA, 22 nt, Shigella flexneri 2a str. 301
caguguuaaacgcagcuccggg

SEQ ID NO: 1970276 - RNA, 19 nt, Shigella flexneri 2a str. 301
caguuaacgcggauccccu

SEQ ID NO: 1970277 - RNA, 14 nt, Shigella flexneri 2a str. 301
cauaacgccugcuc

SEQ ID NO: 1970278 - RNA, 22 nt, Shigella flexneri 2a str. 301
cauaacgccgguauuuuuauug

SEQ ID NO: 1970279 - RNA, 14 nt, Shigella flexneri 2a str. 301
cauaacgcgucuca

SEQ ID NO: 1970280 - RNA, 18 nt, Shigella flexneri 2a str. 301
cauaacuggucaucaaau

SEQ ID NO: 1970281 - RNA, 15 nt, Shigella flexneri 2a str. 301
cauaacggacgaucu

SEQ ID NO: 1970282 - RNA, 21 nt, Shigella flexneri 2a str. 301
caugacccgugacacacugaa

SEQ ID NO: 1970283 - RNA, 22 nt, Shigella flexneri 2a str. 301
caugaccuuucaguuugccgcu

SEQ ID NO: 1970284 - RNA, 18 nt, Shigella flexneri 2a str. 301
caugaccuuccagcgccg

SEQ ID NO: 1970285 - RNA, 11 nt, Shigella flexneri 2a str. 301
caugaccugcc

SEQ ID NO: 1970286 - RNA, 19 nt, Shigella flexneri 2a str. 301
caugacgcgcaucacgaca

SEQ ID NO: 1970287 - RNA, 15 nt, Shigella flexneri 2a str. 301
caugacgccaccagc

SEQ ID NO: 1970288 - RNA, 21 nt, Shigella flexneri 2a str. 301
caucuucacuguccgucagac

SEQ ID NO: 1970289 - RNA, 18 nt, Shigella flexneri 2a str. 301
caucuuauuccuuucggc

SEQ ID NO: 1970290 - RNA, 17 nt, Shigella flexneri 2a str. 301
caucuuauugaucaucc

SEQ ID NO: 1970291 - RNA, 19 nt, Shigella flexneri 2a str. 301
caucugcuuuuaaccgcuu

SEQ ID NO: 1970292 - RNA, 14 nt, Shigella flexneri 2a str. 301
caucuugauaccaa

SEQ ID NO: 1970293 - RNA, 21 nt, Shigella flexneri 2a str. 301
caucuuguucauagugccuga

SEQ ID NO: 1970294 - RNA, 17 nt, Shigella flexneri 2a str. 301
caucuuguaggccugau

SEQ ID NO: 1970295 - RNA, 13 nt, Shigella flexneri 2a str. 301
caugaaacgcguu

SEQ ID NO: 1970296 - RNA, 20 nt, Shigella flexneri 2a str. 301
caugaaaugaaaaucaccau

SEQ ID NO: 1970297 - RNA, 18 nt, Shigella flexneri 2a str. 301
caucuuugaaaucacgca

SEQ ID NO: 1970298 - RNA, 21 nt, Shigella flexneri 2a str. 301
caugaaccauuauccgucagc

SEQ ID NO: 1970299 - RNA, 20 nt, Shigella flexneri 2a str. 301
caugcacgauauaccgugcu

SEQ ID NO: 1970300 - RNA, 21 nt, Shigella flexneri 2a str. 301
caugauuuuguaggccggaua

SEQ ID NO: 1970301 - RNA, 14 nt, Shigella flexneri 2a str. 301
caugauuucgucau

SEQ ID NO: 1970302 - RNA, 20 nt, Shigella flexneri 2a str. 301
caugauuuuguaggccggau

SEQ ID NO: 1970303 - RNA, 22 nt, Shigella flexneri 2a str. 301
caugcagggcaaacucugagag

SEQ ID NO: 1970304 - RNA, 15 nt, Shigella flexneri 2a str. 301
caugcacuccgcugu

SEQ ID NO: 1970305 - RNA, 21 nt, Shigella flexneri 2a str. 301
caugccacacacgauccugca

SEQ ID NO: 1970306 - RNA, 16 nt, Shigella flexneri 2a str. 301
caugcaugauuacugg

SEQ ID NO: 1970307 - RNA, 14 nt, Shigella flexneri 2a str. 301
caugauagcccgga

SEQ ID NO: 1970308 - RNA, 17 nt, Shigella flexneri 2a str. 301
caugauaucaaaacgcu

SEQ ID NO: 1970309 - RNA, 20 nt, Shigella flexneri 2a str. 301
caugauauuggcaucgccag

SEQ ID NO: 1970310 - RNA, 20 nt, Shigella flexneri 2a str. 301
caugaugauaucacugguga

SEQ ID NO: 1970311 - RNA, 18 nt, Shigella flexneri 2a str. 301
caugaugugcuucaucag

SEQ ID NO: 1970312 - RNA, 19 nt, Shigella flexneri 2a str. 301
caugaugugcuucaucaga

SEQ ID NO: 1970313 - RNA, 16 nt, Shigella flexneri 2a str. 301
caugccaucugccagc

SEQ ID NO: 1970314 - RNA, 22 nt, Shigella flexneri 2a str. 301
caucggcaaucacaucaccaua

SEQ ID NO: 1970315 - RNA, 16 nt, Shigella flexneri 2a str. 301
caucggcagcgccagc

SEQ ID NO: 1970316 - RNA, 14 nt, Shigella flexneri 2a str. 301
caucggccagauaa

SEQ ID NO: 1970317 - RNA, 13 nt, Shigella flexneri 2a str. 301
caucgguuugcgc

SEQ ID NO: 1970318 - RNA, 15 nt, Shigella flexneri 2a str. 301
caucggugcuggccu

SEQ ID NO: 1970319 - RNA, 20 nt, Shigella flexneri 2a str. 301
caucggugaggaucaccagu

SEQ ID NO: 1970320 - RNA, 13 nt, Shigella flexneri 2a str. 301
caucgggugcagu

SEQ ID NO: 1970321 - RNA, 21 nt, Shigella flexneri 2a str. 301
caucgggaagaggaucugcuc

SEQ ID NO: 1970322 - RNA, 15 nt, Shigella flexneri 2a str. 301
caucgggacaugaua

SEQ ID NO: 1970323 - RNA, 12 nt, Shigella flexneri 2a str. 301
caucggcggcgu

SEQ ID NO: 1970324 - RNA, 13 nt, Shigella flexneri 2a str. 301
caucggguaacgg

SEQ ID NO: 1970325 - RNA, 19 nt, Shigella flexneri 2a str. 301
caucgggcagcaucgccag

SEQ ID NO: 1970326 - RNA, 21 nt, Shigella flexneri 2a str. 301
caucuauagugaggcuauucc

SEQ ID NO: 1970327 - RNA, 16 nt, Shigella flexneri 2a str. 301
caucucuacagcgccc

SEQ ID NO: 1970328 - RNA, 15 nt, Shigella flexneri 2a str. 301
caucguuacgauugg

SEQ ID NO: 1970329 - RNA, 13 nt, Shigella flexneri 2a str. 301
caucgucuccaga

SEQ ID NO: 1970330 - RNA, 23 nt, Shigella flexneri 2a str. 301
caucgucaggggcauuuucaagu

SEQ ID NO: 1970331 - RNA, 20 nt, Shigella flexneri 2a str. 301
cagcaaggguucaccgguga

SEQ ID NO: 1970332 - RNA, 18 nt, Shigella flexneri 2a str. 301
cagcaaucgcgccagccg

SEQ ID NO: 1970333 - RNA, 14 nt, Shigella flexneri 2a str. 301
cagcaaucgaccag

SEQ ID NO: 1970334 - RNA, 19 nt, Shigella flexneri 2a str. 301
cagcaaucacugccagaau

SEQ ID NO: 1970335 - RNA, 16 nt, Shigella flexneri 2a str. 301
cagcaaagugccccca

SEQ ID NO: 1970336 - RNA, 12 nt, Shigella flexneri 2a str. 301
cagcaaauacgu

SEQ ID NO: 1970337 - RNA, 18 nt, Shigella flexneri 2a str. 301
cagcaaaaucaccaucac

SEQ ID NO: 1970338 - RNA, 21 nt, Shigella flexneri 2a str. 301
cagauuucaaucuggccugag

SEQ ID NO: 1970339 - RNA, 15 nt, Shigella flexneri 2a str. 301
cagcaacucaaucgc

SEQ ID NO: 1970340 - RNA, 23 nt, Shigella flexneri 2a str. 301
cagauggggauagcgcugcugca

SEQ ID NO: 1970341 - RNA, 20 nt, Shigella flexneri 2a str. 301
cagauggcuauaaucacuca

SEQ ID NO: 1970342 - RNA, 17 nt, Shigella flexneri 2a str. 301
cagauggcggcuggcgc

SEQ ID NO: 1970343 - RNA, 18 nt, Shigella flexneri 2a str. 301
cagauuugccaguaccga

SEQ ID NO: 1970344 - RNA, 23 nt, Shigella flexneri 2a str. 301
cagauuuaccgccauggccugag

SEQ ID NO: 1970345 - RNA, 19 nt, Shigella flexneri 2a str. 301
cagaugcggcuucgcuuca

SEQ ID NO: 1970346 - RNA, 20 nt, Shigella flexneri 2a str. 301
cagauggccaauaacccgcu

SEQ ID NO: 1970347 - RNA, 17 nt, Shigella flexneri 2a str. 301
cagaugauuaguauugc

SEQ ID NO: 1970348 - RNA, 19 nt, Shigella flexneri 2a str. 301
cagaugccggaugcggcgu

SEQ ID NO: 1970349 - RNA, 20 nt, Shigella flexneri 2a str. 301
cagcaccugcuugaacgcac

SEQ ID NO: 1970350 - RNA, 19 nt, Shigella flexneri 2a str. 301
cagcacuuaucucuuccgc

SEQ ID NO: 1970351 - RNA, 23 nt, Shigella flexneri 2a str. 301
cagcacugauuuuuuccaacagg

SEQ ID NO: 1970352 - RNA, 23 nt, Shigella flexneri 2a str. 301
cagcacgcuuuucagugccaggu

SEQ ID NO: 1970353 - RNA, 14 nt, Shigella flexneri 2a str. 301
cagcacgcugaaca

SEQ ID NO: 1970354 - RNA, 16 nt, Shigella flexneri 2a str. 301
cagcaauguuucucug

SEQ ID NO: 1970355 - RNA, 15 nt, Shigella flexneri 2a str. 301
cagcaucgaccagga

SEQ ID NO: 1970356 - RNA, 15 nt, Shigella flexneri 2a str. 301
cagcaucgcauccgg

SEQ ID NO: 1970357 - RNA, 16 nt, Shigella flexneri 2a str. 301
cagcaucgcauccggc

SEQ ID NO: 1970358 - RNA, 22 nt, Shigella flexneri 2a str. 301
cagcauggaaauguuccggcga

SEQ ID NO: 1970359 - RNA, 19 nt, Shigella flexneri 2a str. 301
cagcauuucuuccagcguu

SEQ ID NO: 1970360 - RNA, 17 nt, Shigella flexneri 2a str. 301
cagcauucccgccagcg

SEQ ID NO: 1970361 - RNA, 15 nt, Shigella flexneri 2a str. 301
cagcaguugccaguc

SEQ ID NO: 1970362 - RNA, 14 nt, Shigella flexneri 2a str. 301
cagcaguugccagu

SEQ ID NO: 1970363 - RNA, 21 nt, Shigella flexneri 2a str. 301
cagcaguuguuuaauggcaaa

SEQ ID NO: 1970364 - RNA, 17 nt, Shigella flexneri 2a str. 301
cagcaguucacgcagcu

SEQ ID NO: 1970365 - RNA, 21 nt, Shigella flexneri 2a str. 301
cagcagcagccgguauccagc

SEQ ID NO: 1970366 - RNA, 12 nt, Shigella flexneri 2a str. 301
cagcagcagccg

SEQ ID NO: 1970367 - RNA, 14 nt, Shigella flexneri 2a str. 301
cagcaggccaagau

SEQ ID NO: 1970368 - RNA, 14 nt, Shigella flexneri 2a str. 301
cagaagacgcucca

SEQ ID NO: 1970369 - RNA, 23 nt, Shigella flexneri 2a str. 301
cagaagagagauaauucagcagg

SEQ ID NO: 1970370 - RNA, 12 nt, Shigella flexneri 2a str. 301
cagaaucgccag

SEQ ID NO: 1970371 - RNA, 19 nt, Shigella flexneri 2a str. 301
cagaacggauaucgagaau

SEQ ID NO: 1970372 - RNA, 14 nt, Shigella flexneri 2a str. 301
cagaacagugccau

SEQ ID NO: 1970373 - RNA, 17 nt, Shigella flexneri 2a str. 301
cagaaaucggccuucca

SEQ ID NO: 1970374 - RNA, 17 nt, Shigella flexneri 2a str. 301
cacuuugcgcucgcugg

SEQ ID NO: 1970375 - RNA, 11 nt, Shigella flexneri 2a str. 301
cacuuccugcc

SEQ ID NO: 1970376 - RNA, 22 nt, Shigella flexneri 2a str. 301
cacuuccugcucggucugcugg

SEQ ID NO: 1970377 - RNA, 15 nt, Shigella flexneri 2a str. 301
cacuuccaccagcgg

SEQ ID NO: 1970378 - RNA, 20 nt, Shigella flexneri 2a str. 301
cacuuccaccagcaacggca

SEQ ID NO: 1970379 - RNA, 17 nt, Shigella flexneri 2a str. 301
cacuuccaccagcggcu

SEQ ID NO: 1970380 - RNA, 22 nt, Shigella flexneri 2a str. 301
cacuucauagccgccgcgcaug

SEQ ID NO: 1970381 - RNA, 18 nt, Shigella flexneri 2a str. 301
cacuucacccaucgccag

SEQ ID NO: 1970382 - RNA, 21 nt, Shigella flexneri 2a str. 301
cacuuggguaacagcccaaua

SEQ ID NO: 1970383 - RNA, 14 nt, Shigella flexneri 2a str. 301
cacguugcugcggc

SEQ ID NO: 1970384 - RNA, 20 nt, Shigella flexneri 2a str. 301
cacuaucccaacaacucuuc

SEQ ID NO: 1970385 - RNA, 18 nt, Shigella flexneri 2a str. 301
cacucaacaaccagaagg

SEQ ID NO: 1970386 - RNA, 14 nt, Shigella flexneri 2a str. 301
cacuauuggcggau

SEQ ID NO: 1970387 - RNA, 15 nt, Shigella flexneri 2a str. 301
cacucaccgccguua

SEQ ID NO: 1970388 - RNA, 17 nt, Shigella flexneri 2a str. 301
cacucaucgcaucgccu

SEQ ID NO: 1970389 - RNA, 17 nt, Shigella flexneri 2a str. 301
cacgcgauuuugccagu

SEQ ID NO: 1970390 - RNA, 14 nt, Shigella flexneri 2a str. 301
cacgcgcauauuga

SEQ ID NO: 1970391 - RNA, 14 nt, Shigella flexneri 2a str. 301
cacuccauccagca

SEQ ID NO: 1970392 - RNA, 17 nt, Shigella flexneri 2a str. 301
cacugauaagcugagca

SEQ ID NO: 1970393 - RNA, 17 nt, Shigella flexneri 2a str. 301
cacugcaaaucaccaca

SEQ ID NO: 1970394 - RNA, 19 nt, Shigella flexneri 2a str. 301
cacugcuuuccgcuggcgu

SEQ ID NO: 1970395 - RNA, 16 nt, Shigella flexneri 2a str. 301
aaagaucgccacugcu

SEQ ID NO: 1970396 - RNA, 23 nt, Shigella flexneri 2a str. 301
aaagaggcccgauggugaugcca

SEQ ID NO: 1970397 - RNA, 16 nt, Shigella flexneri 2a str. 301
aaagagcaucagcagu

SEQ ID NO: 1970398 - RNA, 14 nt, Shigella flexneri 2a str. 301
cagacuccgcuucg

SEQ ID NO: 1970399 - RNA, 21 nt, Shigella flexneri 2a str. 301
cagacguugauaaccacggcg

SEQ ID NO: 1970400 - RNA, 17 nt, Shigella flexneri 2a str. 301
cagaauuuuucgcuaaa

SEQ ID NO: 1970401 - RNA, 13 nt, Shigella flexneri 2a str. 301
cagacaacgcuuc

SEQ ID NO: 1970402 - RNA, 22 nt, Shigella flexneri 2a str. 301
cagacaauaucggcaccagcgc

SEQ ID NO: 1970403 - RNA, 14 nt, Shigella flexneri 2a str. 301
cagacgcaacagaa

SEQ ID NO: 1970404 - RNA, 23 nt, Shigella flexneri 2a str. 301
cagaccaaaacgugcagcugccu

SEQ ID NO: 1970405 - RNA, 20 nt, Shigella flexneri 2a str. 301
cagacauaaagccugcuuca

SEQ ID NO: 1970406 - RNA, 21 nt, Shigella flexneri 2a str. 301
cagacaggcgaaacccgcugc

SEQ ID NO: 1970407 - RNA, 18 nt, Shigella flexneri 2a str. 301
cagauaaaucacgcuuca

SEQ ID NO: 1970408 - RNA, 14 nt, Shigella flexneri 2a str. 301
cagauaaccaucgc

SEQ ID NO: 1970409 - RNA, 22 nt, Shigella flexneri 2a str. 301
cagauaaacaucgggacaugau

SEQ ID NO: 1970410 - RNA, 21 nt, Shigella flexneri 2a str. 301
cagauccugauuuaacaucuc

SEQ ID NO: 1970411 - RNA, 23 nt, Shigella flexneri 2a str. 301
cagaucccguugaaggguauugc

SEQ ID NO: 1970412 - RNA, 17 nt, Shigella flexneri 2a str. 301
cagaucaucguuuccga

SEQ ID NO: 1970413 - RNA, 19 nt, Shigella flexneri 2a str. 301
cagaucguugaacccggca

SEQ ID NO: 1970414 - RNA, 18 nt, Shigella flexneri 2a str. 301
cagaucugccuguccgga

SEQ ID NO: 1970415 - RNA, 17 nt, Shigella flexneri 2a str. 301
cagaugaaaacgccgga

SEQ ID NO: 1970416 - RNA, 14 nt, Shigella flexneri 2a str. 301
cagaucuucaucac

SEQ ID NO: 1970417 - RNA, 15 nt, Shigella flexneri 2a str. 301
cagaucggcaaucgc

SEQ ID NO: 1970418 - RNA, 16 nt, Shigella flexneri 2a str. 301
cagcgcgcuaucggca

SEQ ID NO: 1970419 - RNA, 13 nt, Shigella flexneri 2a str. 301
cagcgcgcugaca

SEQ ID NO: 1970420 - RNA, 16 nt, Shigella flexneri 2a str. 301
cagcgcgccgucgaug

SEQ ID NO: 1970421 - RNA, 20 nt, Shigella flexneri 2a str. 301
cagcgcgccgccaauaauca

SEQ ID NO: 1970422 - RNA, 22 nt, Shigella flexneri 2a str. 301
cagcgcgaggaucacgcaaucg

SEQ ID NO: 1970423 - RNA, 16 nt, Shigella flexneri 2a str. 301
cagcgcgggcuggcgu

SEQ ID NO: 1970424 - RNA, 19 nt, Shigella flexneri 2a str. 301
cagcgcggugauaaccguu

SEQ ID NO: 1970425 - RNA, 18 nt, Shigella flexneri 2a str. 301
cagcgcggugauaaccgu

SEQ ID NO: 1970426 - RNA, 15 nt, Shigella flexneri 2a str. 301
cagcgcugacgugau

SEQ ID NO: 1970427 - RNA, 21 nt, Shigella flexneri 2a str. 301
cagcgcugcgcgcuucgcccu

SEQ ID NO: 1970428 - RNA, 16 nt, Shigella flexneri 2a str. 301
cagcgcgucgucaauc

SEQ ID NO: 1970429 - RNA, 12 nt, Shigella flexneri 2a str. 301
cagcggcaauuc

SEQ ID NO: 1970430 - RNA, 16 nt, Shigella flexneri 2a str. 301
cagcggaucgaacucc

SEQ ID NO: 1970431 - RNA, 15 nt, Shigella flexneri 2a str. 301
cagcggaauaucaga

SEQ ID NO: 1970432 - RNA, 20 nt, Shigella flexneri 2a str. 301
cagcguaccaugauccugca

SEQ ID NO: 1970433 - RNA, 14 nt, Shigella flexneri 2a str. 301
cagcgucucauacc

SEQ ID NO: 1970434 - RNA, 23 nt, Shigella flexneri 2a str. 301
cagcgucucacuaucgcugagau

SEQ ID NO: 1970435 - RNA, 22 nt, Shigella flexneri 2a str. 301
cagcguacaauagccacauugc

SEQ ID NO: 1970436 - RNA, 14 nt, Shigella flexneri 2a str. 301
cagcggucacaugu

SEQ ID NO: 1970437 - RNA, 11 nt, Shigella flexneri 2a str. 301
cagcgggcgaa

SEQ ID NO: 1970438 - RNA, 16 nt, Shigella flexneri 2a str. 301
cagcggcugccagcau

SEQ ID NO: 1970439 - RNA, 17 nt, Shigella flexneri 2a str. 301
cagcgggaugccaguca

SEQ ID NO: 1970440 - RNA, 23 nt, Shigella flexneri 2a str. 301
cagcgcccgcuugcgagacggcg

SEQ ID NO: 1970441 - RNA, 20 nt, Shigella flexneri 2a str. 301
cagcgauauccagcgauacc

SEQ ID NO: 1970442 - RNA, 17 nt, Shigella flexneri 2a str. 301
cagcgcaauucgcgucg

SEQ ID NO: 1970443 - RNA, 19 nt, Shigella flexneri 2a str. 301
cagcgcaauuggcacgccg

SEQ ID NO: 1970444 - RNA, 11 nt, Shigella flexneri 2a str. 301
cagcgacacca

SEQ ID NO: 1970445 - RNA, 23 nt, Shigella flexneri 2a str. 301
cagcgaaccguugaggauggcgu

SEQ ID NO: 1970446 - RNA, 14 nt, Shigella flexneri 2a str. 301
cagccgaucauugg

SEQ ID NO: 1970447 - RNA, 14 nt, Shigella flexneri 2a str. 301
cagcccugccaggu

SEQ ID NO: 1970448 - RNA, 13 nt, Shigella flexneri 2a str. 301
cagcccugccagg

SEQ ID NO: 1970449 - RNA, 18 nt, Shigella flexneri 2a str. 301
caccgcagcaucgucauc

SEQ ID NO: 1970450 - RNA, 24 nt, Shigella flexneri 2a str. 301
caccgcaagccaaauacauugaua

SEQ ID NO: 1970451 - RNA, 18 nt, Shigella flexneri 2a str. 301
caccgcaguaaucggcga

SEQ ID NO: 1970452 - RNA, 16 nt, Shigella flexneri 2a str. 301
caccgacauugccagc

SEQ ID NO: 1970453 - RNA, 15 nt, Shigella flexneri 2a str. 301
caccugccagcgccg

SEQ ID NO: 1970454 - RNA, 18 nt, Shigella flexneri 2a str. 301
caccugauccaucgucuc

SEQ ID NO: 1970455 - RNA, 16 nt, Shigella flexneri 2a str. 301
caccugaccgcgagua

SEQ ID NO: 1970456 - RNA, 18 nt, Shigella flexneri 2a str. 301
caccggcguucccguccg

SEQ ID NO: 1970457 - RNA, 15 nt, Shigella flexneri 2a str. 301
caccgguucaucacg

SEQ ID NO: 1970458 - RNA, 16 nt, Shigella flexneri 2a str. 301
cacgccuucuuccagc

SEQ ID NO: 1970459 - RNA, 14 nt, Shigella flexneri 2a str. 301
cacgccagccugcu

SEQ ID NO: 1970460 - RNA, 23 nt, Shigella flexneri 2a str. 301
cacgcauccucuauauuucaccg

SEQ ID NO: 1970461 - RNA, 21 nt, Shigella flexneri 2a str. 301
cacgcagggugugcuccaguc

SEQ ID NO: 1970462 - RNA, 18 nt, Shigella flexneri 2a str. 301
caccuucauccagcauca

SEQ ID NO: 1970463 - RNA, 23 nt, Shigella flexneri 2a str. 301
caccuuauaacccgacuucgucg

SEQ ID NO: 1970464 - RNA, 21 nt, Shigella flexneri 2a str. 301
caccuggcugcguuuucgaga

SEQ ID NO: 1970465 - RNA, 20 nt, Shigella flexneri 2a str. 301
caccugcucgucauccgcca

SEQ ID NO: 1970466 - RNA, 13 nt, Shigella flexneri 2a str. 301
caccuggcgcugu

SEQ ID NO: 1970467 - RNA, 12 nt, Shigella flexneri 2a str. 301
caccuuuaaccu

SEQ ID NO: 1970468 - RNA, 22 nt, Shigella flexneri 2a str. 301
cacgauauaccgugcugacuca

SEQ ID NO: 1970469 - RNA, 19 nt, Shigella flexneri 2a str. 301
cacgaauuccaagcagacg

SEQ ID NO: 1970470 - RNA, 17 nt, Shigella flexneri 2a str. 301
cacgaauucaacgcguu

SEQ ID NO: 1970471 - RNA, 16 nt, Shigella flexneri 2a str. 301
cacgaccgcagcauug

SEQ ID NO: 1970472 - RNA, 17 nt, Shigella flexneri 2a str. 301
cacgacguguuccugaa

SEQ ID NO: 1970473 - RNA, 20 nt, Shigella flexneri 2a str. 301
caccaacgauuuuuuccgca

SEQ ID NO: 1970474 - RNA, 19 nt, Shigella flexneri 2a str. 301
cacaucuaccgccagccag

SEQ ID NO: 1970475 - RNA, 14 nt, Shigella flexneri 2a str. 301
cacaucgacccaga

SEQ ID NO: 1970476 - RNA, 19 nt, Shigella flexneri 2a str. 301
cacagguuuguagaacgua

SEQ ID NO: 1970477 - RNA, 22 nt, Shigella flexneri 2a str. 301
cacaggcguucuacauaaaacg

SEQ ID NO: 1970478 - RNA, 13 nt, Shigella flexneri 2a str. 301
caccacaauugac

SEQ ID NO: 1970479 - RNA, 22 nt, Shigella flexneri 2a str. 301
caccaaugaaagccccaccagc

SEQ ID NO: 1970480 - RNA, 15 nt, Shigella flexneri 2a str. 301
caccaauaaugaacg

SEQ ID NO: 1970481 - RNA, 22 nt, Shigella flexneri 2a str. 301
caccaauacgcauaugcaucag

SEQ ID NO: 1970482 - RNA, 12 nt, Shigella flexneri 2a str. 301
caccacaggccu

SEQ ID NO: 1970483 - RNA, 20 nt, Shigella flexneri 2a str. 301
caccaccgacggacccgccg

SEQ ID NO: 1970484 - RNA, 17 nt, Shigella flexneri 2a str. 301
cacagcacgcuuuucag

SEQ ID NO: 1970485 - RNA, 18 nt, Shigella flexneri 2a str. 301
cacacugaugacaggcua

SEQ ID NO: 1970486 - RNA, 15 nt, Shigella flexneri 2a str. 301
cacacgugcaucucu

SEQ ID NO: 1970487 - RNA, 15 nt, Shigella flexneri 2a str. 301
cacagacauccugcg

SEQ ID NO: 1970488 - RNA, 19 nt, Shigella flexneri 2a str. 301
cacagacauaaagccugcu

SEQ ID NO: 1970489 - RNA, 18 nt, Shigella flexneri 2a str. 301
cacacuguaagccaccga

SEQ ID NO: 1970490 - RNA, 19 nt, Shigella flexneri 2a str. 301
cacaccgaagacaucgcag

SEQ ID NO: 1970491 - RNA, 18 nt, Shigella flexneri 2a str. 301
cacacccgguaucaaacc

SEQ ID NO: 1970492 - RNA, 21 nt, Shigella flexneri 2a str. 301
caccaggaacgcgccaagaua

SEQ ID NO: 1970493 - RNA, 13 nt, Shigella flexneri 2a str. 301
caccagcaccgcg

SEQ ID NO: 1970494 - RNA, 12 nt, Shigella flexneri 2a str. 301
caccagcaccgc

SEQ ID NO: 1970495 - RNA, 19 nt, Shigella flexneri 2a str. 301
caccagcaucaacaacaau

SEQ ID NO: 1970496 - RNA, 14 nt, Shigella flexneri 2a str. 301
caccacugccagau

SEQ ID NO: 1970497 - RNA, 13 nt, Shigella flexneri 2a str. 301
caccacugcaaug

SEQ ID NO: 1970498 - RNA, 18 nt, Shigella flexneri 2a str. 301
caccaccuaacccgcuac

SEQ ID NO: 1970499 - RNA, 17 nt, Shigella flexneri 2a str. 301
caccagcaacagcgccg

SEQ ID NO: 1970500 - RNA, 15 nt, Shigella flexneri 2a str. 301
caccagagugaccgc

SEQ ID NO: 1970501 - RNA, 14 nt, Shigella flexneri 2a str. 301
cacccaucacuacc

SEQ ID NO: 1970502 - RNA, 15 nt, Shigella flexneri 2a str. 301
cacccaucgccagau

SEQ ID NO: 1970503 - RNA, 21 nt, Shigella flexneri 2a str. 301
caccaguaaauugucgccgga

SEQ ID NO: 1970504 - RNA, 17 nt, Shigella flexneri 2a str. 301
caccaguaacgauaacg

SEQ ID NO: 1970505 - RNA, 22 nt, Shigella flexneri 2a str. 301
caccaggaacgcgccaagauag

SEQ ID NO: 1970506 - RNA, 23 nt, Shigella flexneri 2a str. 301
caccagugcaggcaccagccccu

SEQ ID NO: 1970507 - RNA, 15 nt, Shigella flexneri 2a str. 301
caccaguccaucggc

SEQ ID NO: 1970508 - RNA, 13 nt, Shigella flexneri 2a str. 301
caccaucagcagc

SEQ ID NO: 1970509 - RNA, 20 nt, Shigella flexneri 2a str. 301
caccaucggacggaagacgu

SEQ ID NO: 1970510 - RNA, 22 nt, Shigella flexneri 2a str. 301
caaugcgcuguuuagcgcggca

SEQ ID NO: 1970511 - RNA, 21 nt, Shigella flexneri 2a str. 301
caaugaguucgcgcgcugcca

SEQ ID NO: 1970512 - RNA, 13 nt, Shigella flexneri 2a str. 301
caaugacgggcuu

SEQ ID NO: 1970513 - RNA, 18 nt, Shigella flexneri 2a str. 301
caaugacucgcgguuuau

SEQ ID NO: 1970514 - RNA, 18 nt, Shigella flexneri 2a str. 301
caaugaauauuccacagc

SEQ ID NO: 1970515 - RNA, 19 nt, Shigella flexneri 2a str. 301
caaugaaacgcaaauacug

SEQ ID NO: 1970516 - RNA, 16 nt, Shigella flexneri 2a str. 301
caaucgguaacgcuug

SEQ ID NO: 1970517 - RNA, 15 nt, Shigella flexneri 2a str. 301
caaucggcugcaccu

SEQ ID NO: 1970518 - RNA, 14 nt, Shigella flexneri 2a str. 301
caaucgcugcggca

SEQ ID NO: 1970519 - RNA, 16 nt, Shigella flexneri 2a str. 301
caauaccuucugcgcc

SEQ ID NO: 1970520 - RNA, 18 nt, Shigella flexneri 2a str. 301
caauacgauuaacgccag

SEQ ID NO: 1970521 - RNA, 16 nt, Shigella flexneri 2a str. 301
caaucagcgcagcacc

SEQ ID NO: 1970522 - RNA, 12 nt, Shigella flexneri 2a str. 301
caauacauagaa

SEQ ID NO: 1970523 - RNA, 19 nt, Shigella flexneri 2a str. 301
caauccacuucgccagacg

SEQ ID NO: 1970524 - RNA, 15 nt, Shigella flexneri 2a str. 301
caaucgcauagccag

SEQ ID NO: 1970525 - RNA, 16 nt, Shigella flexneri 2a str. 301
caauuugcccaccggu

SEQ ID NO: 1970526 - RNA, 22 nt, Shigella flexneri 2a str. 301
caauuucuucugguuucaguaa

SEQ ID NO: 1970527 - RNA, 18 nt, Shigella flexneri 2a str. 301
cacaacauucccaucagu

SEQ ID NO: 1970528 - RNA, 13 nt, Shigella flexneri 2a str. 301
caauuuaucagac

SEQ ID NO: 1970529 - RNA, 14 nt, Shigella flexneri 2a str. 301
caauuucgcugccc

SEQ ID NO: 1970530 - RNA, 22 nt, Shigella flexneri 2a str. 301
caauguaaggugcaucggggaa

SEQ ID NO: 1970531 - RNA, 18 nt, Shigella flexneri 2a str. 301
caaugucagggccaucgc

SEQ ID NO: 1970532 - RNA, 19 nt, Shigella flexneri 2a str. 301
caaugugcuaaucagugcc

SEQ ID NO: 1970533 - RNA, 19 nt, Shigella flexneri 2a str. 301
caauugcugugccggaagg

SEQ ID NO: 1970534 - RNA, 21 nt, Shigella flexneri 2a str. 301
cacaaguuuuuaggcaugaua

SEQ ID NO: 1970535 - RNA, 23 nt, Shigella flexneri 2a str. 301
cacaacuucgcgaacacccgacg

SEQ ID NO: 1970536 - RNA, 18 nt, Shigella flexneri 2a str. 301
cacacauuauaggccuga

SEQ ID NO: 1970537 - RNA, 14 nt, Shigella flexneri 2a str. 301
cacaauuaccuucc

SEQ ID NO: 1970538 - RNA, 20 nt, Shigella flexneri 2a str. 301
cacaauuuuguaggccggau

SEQ ID NO: 1970539 - RNA, 22 nt, Shigella flexneri 2a str. 301
cacacaagccgugaaucacucc

SEQ ID NO: 1970540 - RNA, 12 nt, Shigella flexneri 2a str. 301
cacacacaucga

SEQ ID NO: 1970541 - RNA, 13 nt, Shigella flexneri 2a str. 301
cacaaugccugau

SEQ ID NO: 1970542 - RNA, 20 nt, Shigella flexneri 2a str. 301
cacaaugccugaugcgacgc

SEQ ID NO: 1970543 - RNA, 21 nt, Shigella flexneri 2a str. 301
caagccaucguuaauuaacgc

SEQ ID NO: 1970544 - RNA, 14 nt, Shigella flexneri 2a str. 301
caagcccgccggga

SEQ ID NO: 1970545 - RNA, 21 nt, Shigella flexneri 2a str. 301
caagccaugcccgugcugaca

SEQ ID NO: 1970546 - RNA, 15 nt, Shigella flexneri 2a str. 301
caagcaccauccugu

SEQ ID NO: 1970547 - RNA, 19 nt, Shigella flexneri 2a str. 301
caagaaucucuucuucgcu

SEQ ID NO: 1970548 - RNA, 15 nt, Shigella flexneri 2a str. 301
caacuuucaucagca

SEQ ID NO: 1970549 - RNA, 19 nt, Shigella flexneri 2a str. 301
caagaaccaaagaaaucag

SEQ ID NO: 1970550 - RNA, 23 nt, Shigella flexneri 2a str. 301
caacuucgaguacauccacugca

SEQ ID NO: 1970551 - RNA, 23 nt, Shigella flexneri 2a str. 301
caacuucagcaacaaaauggcaa

SEQ ID NO: 1970552 - RNA, 21 nt, Shigella flexneri 2a str. 301
caacugugccgccgccaccga

SEQ ID NO: 1970553 - RNA, 15 nt, Shigella flexneri 2a str. 301
caacuccaucaagcu

SEQ ID NO: 1970554 - RNA, 18 nt, Shigella flexneri 2a str. 301
caacuccacuucaccgcg

SEQ ID NO: 1970555 - RNA, 12 nt, Shigella flexneri 2a str. 301
caacucacgauu

SEQ ID NO: 1970556 - RNA, 20 nt, Shigella flexneri 2a str. 301
caacagcaauacguuucaua

SEQ ID NO: 1970557 - RNA, 14 nt, Shigella flexneri 2a str. 301
caagguauccagac

SEQ ID NO: 1970558 - RNA, 15 nt, Shigella flexneri 2a str. 301
caagggugccgggaa

SEQ ID NO: 1970559 - RNA, 22 nt, Shigella flexneri 2a str. 301
caagggugccgggaacuggcaa

SEQ ID NO: 1970560 - RNA, 17 nt, Shigella flexneri 2a str. 301
caagucggcaucgccac

SEQ ID NO: 1970561 - RNA, 21 nt, Shigella flexneri 2a str. 301
caagcgucgcaucaggcauuu

SEQ ID NO: 1970562 - RNA, 21 nt, Shigella flexneri 2a str. 301
caagcgucgcaucaggcauga

SEQ ID NO: 1970563 - RNA, 23 nt, Shigella flexneri 2a str. 301
caagcgggguaaaugccaucagg

SEQ ID NO: 1970564 - RNA, 16 nt, Shigella flexneri 2a str. 301
caagcgccgccagucg

SEQ ID NO: 1970565 - RNA, 12 nt, Shigella flexneri 2a str. 301
caauaacgcuuu

SEQ ID NO: 1970566 - RNA, 19 nt, Shigella flexneri 2a str. 301
caauaacacauugcuguau

SEQ ID NO: 1970567 - RNA, 18 nt, Shigella flexneri 2a str. 301
caauaaauuccccgcagg

SEQ ID NO: 1970568 - RNA, 19 nt, Shigella flexneri 2a str. 301
caauaauauuacuucgcgu

SEQ ID NO: 1970569 - RNA, 21 nt, Shigella flexneri 2a str. 301
caauaaugaugucaucaagcg

SEQ ID NO: 1970570 - RNA, 15 nt, Shigella flexneri 2a str. 301
caauaauacccagca

SEQ ID NO: 1970571 - RNA, 20 nt, Shigella flexneri 2a str. 301
caagucgugaaaucugaaau

SEQ ID NO: 1970572 - RNA, 22 nt, Shigella flexneri 2a str. 301
caagucucaagagugaacacgu

SEQ ID NO: 1970573 - RNA, 19 nt, Shigella flexneri 2a str. 301
caagugcggcgcaccagca

SEQ ID NO: 1970574 - RNA, 23 nt, Shigella flexneri 2a str. 301
caaguucgaacgccgccaguacg

SEQ ID NO: 1970575 - RNA, 18 nt, Shigella flexneri 2a str. 301
augccggaugcggcguaa

SEQ ID NO: 1970576 - RNA, 16 nt, Shigella flexneri 2a str. 301
augccggaugcggcgu

SEQ ID NO: 1970577 - RNA, 22 nt, Shigella flexneri 2a str. 301
augccggaugcgccagcauccg

SEQ ID NO: 1970578 - RNA, 16 nt, Shigella flexneri 2a str. 301
augccggaugcggaga

SEQ ID NO: 1970579 - RNA, 23 nt, Shigella flexneri 2a str. 301
augccggagucgcauuaacagcc

SEQ ID NO: 1970580 - RNA, 23 nt, Shigella flexneri 2a str. 301
augccggccagcgccaccaccag

SEQ ID NO: 1970581 - RNA, 15 nt, Shigella flexneri 2a str. 301
augcgccaaccugcu

SEQ ID NO: 1970582 - RNA, 21 nt, Shigella flexneri 2a str. 301
augcgacgcuugacgcgucuu

SEQ ID NO: 1970583 - RNA, 12 nt, Shigella flexneri 2a str. 301
augcgcgucaga

SEQ ID NO: 1970584 - RNA, 16 nt, Shigella flexneri 2a str. 301
augcggcgacuggaua

SEQ ID NO: 1970585 - RNA, 13 nt, Shigella flexneri 2a str. 301
augcggcggacgu

SEQ ID NO: 1970586 - RNA, 16 nt, Shigella flexneri 2a str. 301
augcggcguuaacgcc

SEQ ID NO: 1970587 - RNA, 17 nt, Shigella flexneri 2a str. 301
augcggcguaaaugccu

SEQ ID NO: 1970588 - RNA, 20 nt, Shigella flexneri 2a str. 301
augccgccgaggauacagcc

SEQ ID NO: 1970589 - RNA, 22 nt, Shigella flexneri 2a str. 301
augccgccguagaaaaugccca

SEQ ID NO: 1970590 - RNA, 22 nt, Shigella flexneri 2a str. 301
augccgacgauguuagcggcga

SEQ ID NO: 1970591 - RNA, 16 nt, Shigella flexneri 2a str. 301
augcccgaugaccuug

SEQ ID NO: 1970592 - RNA, 21 nt, Shigella flexneri 2a str. 301
augccacgacguuuuccaucg

SEQ ID NO: 1970593 - RNA, 20 nt, Shigella flexneri 2a str. 301
augccacgacguuuuccauc

SEQ ID NO: 1970594 - RNA, 14 nt, Shigella flexneri 2a str. 301
augccaaucacaag

SEQ ID NO: 1970595 - RNA, 23 nt, Shigella flexneri 2a str. 301
augccaaucaguucaccacuuug

SEQ ID NO: 1970596 - RNA, 19 nt, Shigella flexneri 2a str. 301
augcaugcccggcauccgg

SEQ ID NO: 1970597 - RNA, 20 nt, Shigella flexneri 2a str. 301
augcccauucaccgacguga

SEQ ID NO: 1970598 - RNA, 19 nt, Shigella flexneri 2a str. 301
augccccauugcaacgugg

SEQ ID NO: 1970599 - RNA, 20 nt, Shigella flexneri 2a str. 301
augggcgaauaaaaagccua

SEQ ID NO: 1970600 - RNA, 23 nt, Shigella flexneri 2a str. 301
auggcguagcagcagcgauucgu

SEQ ID NO: 1970601 - RNA, 15 nt, Shigella flexneri 2a str. 301
auggcggucgcgagu

SEQ ID NO: 1970602 - RNA, 24 nt, Shigella flexneri 2a str. 301
auggcggcggcuuuuacgagcauc

SEQ ID NO: 1970603 - RNA, 18 nt, Shigella flexneri 2a str. 301
auggcggcuaggacgcac

SEQ ID NO: 1970604 - RNA, 17 nt, Shigella flexneri 2a str. 301
augguuguaauccaccu

SEQ ID NO: 1970605 - RNA, 17 nt, Shigella flexneri 2a str. 301
augguuucauuccagua

SEQ ID NO: 1970606 - RNA, 19 nt, Shigella flexneri 2a str. 301
augguguuuuccaccguga

SEQ ID NO: 1970607 - RNA, 20 nt, Shigella flexneri 2a str. 301
auggucaguacgccgccguu

SEQ ID NO: 1970608 - RNA, 19 nt, Shigella flexneri 2a str. 301
auggucagcuucaccuucc

SEQ ID NO: 1970609 - RNA, 17 nt, Shigella flexneri 2a str. 301
augucagaugcggcgug

SEQ ID NO: 1970610 - RNA, 18 nt, Shigella flexneri 2a str. 301
augucagaugcggcguga

SEQ ID NO: 1970611 - RNA, 20 nt, Shigella flexneri 2a str. 301
augcugccgauggcgcaaac

SEQ ID NO: 1970612 - RNA, 15 nt, Shigella flexneri 2a str. 301
augcugcacgccauc

SEQ ID NO: 1970613 - RNA, 22 nt, Shigella flexneri 2a str. 301
augcugcaauugcggcagguca

SEQ ID NO: 1970614 - RNA, 15 nt, Shigella flexneri 2a str. 301
auggauuagcgaccg

SEQ ID NO: 1970615 - RNA, 18 nt, Shigella flexneri 2a str. 301
auggagcacauugccuga

SEQ ID NO: 1970616 - RNA, 23 nt, Shigella flexneri 2a str. 301
auggcgcaggauaucguggcacg

SEQ ID NO: 1970617 - RNA, 21 nt, Shigella flexneri 2a str. 301
auggccgggguuucagauuau

SEQ ID NO: 1970618 - RNA, 16 nt, Shigella flexneri 2a str. 301
auggcauccgccacuu

SEQ ID NO: 1970619 - RNA, 14 nt, Shigella flexneri 2a str. 301
auggcauccgccac

SEQ ID NO: 1970620 - RNA, 16 nt, Shigella flexneri 2a str. 301
auggcaguaucggcaa

SEQ ID NO: 1970621 - RNA, 17 nt, Shigella flexneri 2a str. 301
aucugauuugucggcag

SEQ ID NO: 1970622 - RNA, 18 nt, Shigella flexneri 2a str. 301
aucugccagaaggauuga

SEQ ID NO: 1970623 - RNA, 19 nt, Shigella flexneri 2a str. 301
aucuggcaagccugaaaac

SEQ ID NO: 1970624 - RNA, 17 nt, Shigella flexneri 2a str. 301
aucuggcacuauuggcg

SEQ ID NO: 1970625 - RNA, 15 nt, Shigella flexneri 2a str. 301
aucuggauccacgau

SEQ ID NO: 1970626 - RNA, 18 nt, Shigella flexneri 2a str. 301
aucugccuuauugaagcu

SEQ ID NO: 1970627 - RNA, 14 nt, Shigella flexneri 2a str. 301
aucucucgcaucag

SEQ ID NO: 1970628 - RNA, 22 nt, Shigella flexneri 2a str. 301
aucucugcgcuauccagcgcau

SEQ ID NO: 1970629 - RNA, 17 nt, Shigella flexneri 2a str. 301
aucugauaucucaccag

SEQ ID NO: 1970630 - RNA, 20 nt, Shigella flexneri 2a str. 301
aucugauggaaaaucaucag

SEQ ID NO: 1970631 - RNA, 20 nt, Shigella flexneri 2a str. 301
aucugacuggcgagauccgg

SEQ ID NO: 1970632 - RNA, 19 nt, Shigella flexneri 2a str. 301
aucguggccaugaccgccg

SEQ ID NO: 1970633 - RNA, 20 nt, Shigella flexneri 2a str. 301
aucguggccaugaccgccgc

SEQ ID NO: 1970634 - RNA, 13 nt, Shigella flexneri 2a str. 301
aucucauccauca

SEQ ID NO: 1970635 - RNA, 13 nt, Shigella flexneri 2a str. 301
aucguuaauuccu

SEQ ID NO: 1970636 - RNA, 14 nt, Shigella flexneri 2a str. 301
aucuccgcuggagc

SEQ ID NO: 1970637 - RNA, 21 nt, Shigella flexneri 2a str. 301
aucucgcucaaaaauccagau

SEQ ID NO: 1970638 - RNA, 17 nt, Shigella flexneri 2a str. 301
aucgucggaauggcauc

SEQ ID NO: 1970639 - RNA, 15 nt, Shigella flexneri 2a str. 301
aucguauccggcauu

SEQ ID NO: 1970640 - RNA, 14 nt, Shigella flexneri 2a str. 301
aucguauccggcau

SEQ ID NO: 1970641 - RNA, 21 nt, Shigella flexneri 2a str. 301
aucguauucuggcuucgcgau

SEQ ID NO: 1970642 - RNA, 16 nt, Shigella flexneri 2a str. 301
aucggugcaaaugcca

SEQ ID NO: 1970643 - RNA, 18 nt, Shigella flexneri 2a str. 301
aucggugcacgaugccug

SEQ ID NO: 1970644 - RNA, 14 nt, Shigella flexneri 2a str. 301
aucguaauacccuu

SEQ ID NO: 1970645 - RNA, 15 nt, Shigella flexneri 2a str. 301
aucguacucaccaga

SEQ ID NO: 1970646 - RNA, 16 nt, Shigella flexneri 2a str. 301
aucgguuuugcggcgu

SEQ ID NO: 1970647 - RNA, 23 nt, Shigella flexneri 2a str. 301
aucgaacaugcgggucuuacugg

SEQ ID NO: 1970648 - RNA, 15 nt, Shigella flexneri 2a str. 301
aucgaagccgucagc

SEQ ID NO: 1970649 - RNA, 16 nt, Shigella flexneri 2a str. 301
aucgaacuucccgccg

SEQ ID NO: 1970650 - RNA, 22 nt, Shigella flexneri 2a str. 301
aucgggcuauuuuuauugugcc

SEQ ID NO: 1970651 - RNA, 14 nt, Shigella flexneri 2a str. 301
aucgggcaacugcu

SEQ ID NO: 1970652 - RNA, 16 nt, Shigella flexneri 2a str. 301
aucgggcacagcggug

SEQ ID NO: 1970653 - RNA, 18 nt, Shigella flexneri 2a str. 301
aucgggcagcaucgccag

SEQ ID NO: 1970654 - RNA, 21 nt, Shigella flexneri 2a str. 301
augauuuuuuugaugccguug

SEQ ID NO: 1970655 - RNA, 19 nt, Shigella flexneri 2a str. 301
augcaaacauggaaaccau

SEQ ID NO: 1970656 - RNA, 15 nt, Shigella flexneri 2a str. 301
augauuugaucccag

SEQ ID NO: 1970657 - RNA, 19 nt, Shigella flexneri 2a str. 301
augagauauuucagagcuu

SEQ ID NO: 1970658 - RNA, 20 nt, Shigella flexneri 2a str. 301
augacuuuguacuuggccgu

SEQ ID NO: 1970659 - RNA, 22 nt, Shigella flexneri 2a str. 301
augacggagaguacugccggga

SEQ ID NO: 1970660 - RNA, 15 nt, Shigella flexneri 2a str. 301
augcagugcauccag

SEQ ID NO: 1970661 - RNA, 16 nt, Shigella flexneri 2a str. 301
augcagugccgcugcu

SEQ ID NO: 1970662 - RNA, 17 nt, Shigella flexneri 2a str. 301
augcaucagaucggcag

SEQ ID NO: 1970663 - RNA, 14 nt, Shigella flexneri 2a str. 301
augcaucggcauaa

SEQ ID NO: 1970664 - RNA, 17 nt, Shigella flexneri 2a str. 301
augcaguaccagauaau

SEQ ID NO: 1970665 - RNA, 21 nt, Shigella flexneri 2a str. 301
augcacgauauaccgugcuga

SEQ ID NO: 1970666 - RNA, 14 nt, Shigella flexneri 2a str. 301
augcacagaaccgg

SEQ ID NO: 1970667 - RNA, 15 nt, Shigella flexneri 2a str. 301
aucuucuugcagcuu

SEQ ID NO: 1970668 - RNA, 21 nt, Shigella flexneri 2a str. 301
aucuuuaaaaaaagcauuuaa

SEQ ID NO: 1970669 - RNA, 18 nt, Shigella flexneri 2a str. 301
augaaaagucauccggcg

SEQ ID NO: 1970670 - RNA, 20 nt, Shigella flexneri 2a str. 301
augaaaccuucuugacgcug

SEQ ID NO: 1970671 - RNA, 23 nt, Shigella flexneri 2a str. 301
augaaaccuucuugacgcugauu

SEQ ID NO: 1970672 - RNA, 17 nt, Shigella flexneri 2a str. 301
augaacaaguauaucaa

SEQ ID NO: 1970673 - RNA, 15 nt, Shigella flexneri 2a str. 301
augaagucugccguu

SEQ ID NO: 1970674 - RNA, 16 nt, Shigella flexneri 2a str. 301
augaagucugccguug

SEQ ID NO: 1970675 - RNA, 22 nt, Shigella flexneri 2a str. 301
augaagccuaccgggaugcuga

SEQ ID NO: 1970676 - RNA, 21 nt, Shigella flexneri 2a str. 301
augaacgguuuaaaccugauu

SEQ ID NO: 1970677 - RNA, 16 nt, Shigella flexneri 2a str. 301
augaccuuccagcgcc

SEQ ID NO: 1970678 - RNA, 12 nt, Shigella flexneri 2a str. 301
augaccacucau

SEQ ID NO: 1970679 - RNA, 13 nt, Shigella flexneri 2a str. 301
augaccugcaaau

SEQ ID NO: 1970680 - RNA, 15 nt, Shigella flexneri 2a str. 301
augacgauacggaau

SEQ ID NO: 1970681 - RNA, 14 nt, Shigella flexneri 2a str. 301
augacaucuccagc

SEQ ID NO: 1970682 - RNA, 11 nt, Shigella flexneri 2a str. 301
caaacaggcug

SEQ ID NO: 1970683 - RNA, 13 nt, Shigella flexneri 2a str. 301
caaacaucgacuc

SEQ ID NO: 1970684 - RNA, 15 nt, Shigella flexneri 2a str. 301
caaacaaaagggcga

SEQ ID NO: 1970685 - RNA, 21 nt, Shigella flexneri 2a str. 301
caaacacgccgacgggucagc

SEQ ID NO: 1970686 - RNA, 22 nt, Shigella flexneri 2a str. 301
caaaaugguggagauaaacucc

SEQ ID NO: 1970687 - RNA, 21 nt, Shigella flexneri 2a str. 301
caaaaugcugcaauugcggca

SEQ ID NO: 1970688 - RNA, 14 nt, Shigella flexneri 2a str. 301
caaaaucacuggcg

SEQ ID NO: 1970689 - RNA, 17 nt, Shigella flexneri 2a str. 301
caaaccaacgcuguccg

SEQ ID NO: 1970690 - RNA, 22 nt, Shigella flexneri 2a str. 301
caaaccucagaguuaaccugaa

SEQ ID NO: 1970691 - RNA, 16 nt, Shigella flexneri 2a str. 301
caaacgcccguccauc

SEQ ID NO: 1970692 - RNA, 18 nt, Shigella flexneri 2a str. 301
caaacgcugacggugcca

SEQ ID NO: 1970693 - RNA, 15 nt, Shigella flexneri 2a str. 301
caaacggcgcuucca

SEQ ID NO: 1970694 - RNA, 22 nt, Shigella flexneri 2a str. 301
caaacggaucgcguaaggcuuc

SEQ ID NO: 1970695 - RNA, 16 nt, Shigella flexneri 2a str. 301
caaacucaauuaccaa

SEQ ID NO: 1970696 - RNA, 18 nt, Shigella flexneri 2a str. 301
caaacucgcgcaggcuga

SEQ ID NO: 1970697 - RNA, 18 nt, Shigella flexneri 2a str. 301
caaacuuaugcugcgcca

SEQ ID NO: 1970698 - RNA, 18 nt, Shigella flexneri 2a str. 301
caaauccggccagcgccg

SEQ ID NO: 1970699 - RNA, 22 nt, Shigella flexneri 2a str. 301
caaaucaccauauucagcagca

SEQ ID NO: 1970700 - RNA, 18 nt, Shigella flexneri 2a str. 301
caaagcugucaccaauca

SEQ ID NO: 1970701 - RNA, 18 nt, Shigella flexneri 2a str. 301
caaaggcacaacugcgac

SEQ ID NO: 1970702 - RNA, 16 nt, Shigella flexneri 2a str. 301
caacagaaacgccauc

SEQ ID NO: 1970703 - RNA, 14 nt, Shigella flexneri 2a str. 301
caacacaaaccggg

SEQ ID NO: 1970704 - RNA, 14 nt, Shigella flexneri 2a str. 301
caacacauaaccgu

SEQ ID NO: 1970705 - RNA, 12 nt, Shigella flexneri 2a str. 301
caacaauggcau

SEQ ID NO: 1970706 - RNA, 22 nt, Shigella flexneri 2a str. 301
caacaauucccgcagcuccagc

SEQ ID NO: 1970707 - RNA, 19 nt, Shigella flexneri 2a str. 301
caaauucuuuaucgauaaa

SEQ ID NO: 1970708 - RNA, 12 nt, Shigella flexneri 2a str. 301
caaaucgcggca

SEQ ID NO: 1970709 - RNA, 19 nt, Shigella flexneri 2a str. 301
auuuuuugaucaaucugcu

SEQ ID NO: 1970710 - RNA, 16 nt, Shigella flexneri 2a str. 301
auuuuuuccagcgcau

SEQ ID NO: 1970711 - RNA, 16 nt, Shigella flexneri 2a str. 301
auuuuugacuagugau

SEQ ID NO: 1970712 - RNA, 20 nt, Shigella flexneri 2a str. 301
auuuugcaucguccacuuga

SEQ ID NO: 1970713 - RNA, 17 nt, Shigella flexneri 2a str. 301
auuuugcagaucgccaa

SEQ ID NO: 1970714 - RNA, 13 nt, Shigella flexneri 2a str. 301
auuuugccaguua

SEQ ID NO: 1970715 - RNA, 16 nt, Shigella flexneri 2a str. 301
auuuugcagaucgcca

SEQ ID NO: 1970716 - RNA, 20 nt, Shigella flexneri 2a str. 301
auuuugcugaugcagcgaug

SEQ ID NO: 1970717 - RNA, 22 nt, Shigella flexneri 2a str. 301
auuuuguguugaggaucacaaa

SEQ ID NO: 1970718 - RNA, 17 nt, Shigella flexneri 2a str. 301
auuuugcugaucggcaa

SEQ ID NO: 1970719 - RNA, 13 nt, Shigella flexneri 2a str. 301
caaaaaaccgcca

SEQ ID NO: 1970720 - RNA, 15 nt, Shigella flexneri 2a str. 301
caaaaaaccgccauu

SEQ ID NO: 1970721 - RNA, 14 nt, Shigella flexneri 2a str. 301
caaaacagcgacac

SEQ ID NO: 1970722 - RNA, 23 nt, Shigella flexneri 2a str. 301
caaaaccaucaauccacuucgcc

SEQ ID NO: 1970723 - RNA, 18 nt, Shigella flexneri 2a str. 301
caaaaccgguucugccgc

SEQ ID NO: 1970724 - RNA, 16 nt, Shigella flexneri 2a str. 301
caaaaccucuuccagc

SEQ ID NO: 1970725 - RNA, 21 nt, Shigella flexneri 2a str. 301
caaaacgcgcaaccagcaggc

SEQ ID NO: 1970726 - RNA, 12 nt, Shigella flexneri 2a str. 301
caaaacguggcc

SEQ ID NO: 1970727 - RNA, 19 nt, Shigella flexneri 2a str. 301
caaaagcggugauaaaccc

SEQ ID NO: 1970728 - RNA, 16 nt, Shigella flexneri 2a str. 301
caaaagacaccaucgc

SEQ ID NO: 1970729 - RNA, 21 nt, Shigella flexneri 2a str. 301
auuugaaaugugguuucacuu

SEQ ID NO: 1970730 - RNA, 20 nt, Shigella flexneri 2a str. 301
auuugcuucaauacgcucca

SEQ ID NO: 1970731 - RNA, 22 nt, Shigella flexneri 2a str. 301
auuugcaucaacgaucagcgug

SEQ ID NO: 1970732 - RNA, 16 nt, Shigella flexneri 2a str. 301
auuugugcacgugcca

SEQ ID NO: 1970733 - RNA, 18 nt, Shigella flexneri 2a str. 301
auuuucaccagcaucgcc

SEQ ID NO: 1970734 - RNA, 23 nt, Shigella flexneri 2a str. 301
auuuucaaaauaucgacauucaa

SEQ ID NO: 1970735 - RNA, 12 nt, Shigella flexneri 2a str. 301
auuuuaccguca

SEQ ID NO: 1970736 - RNA, 14 nt, Shigella flexneri 2a str. 301
auuggcacgccgac

SEQ ID NO: 1970737 - RNA, 16 nt, Shigella flexneri 2a str. 301
auugcggaacggcagc

SEQ ID NO: 1970738 - RNA, 12 nt, Shigella flexneri 2a str. 301
auugugcggcgg

SEQ ID NO: 1970739 - RNA, 21 nt, Shigella flexneri 2a str. 301
auugugcggcgguaucgucgg

SEQ ID NO: 1970740 - RNA, 21 nt, Shigella flexneri 2a str. 301
auugucuaugaacacgaucuc

SEQ ID NO: 1970741 - RNA, 20 nt, Shigella flexneri 2a str. 301
auugucauucgccugacgca

SEQ ID NO: 1970742 - RNA, 14 nt, Shigella flexneri 2a str. 301
auucucaucaccau

SEQ ID NO: 1970743 - RNA, 16 nt, Shigella flexneri 2a str. 301
auucuccuucacgauc

SEQ ID NO: 1970744 - RNA, 15 nt, Shigella flexneri 2a str. 301
auugccgcagcgauu

SEQ ID NO: 1970745 - RNA, 16 nt, Shigella flexneri 2a str. 301
auugccgaugaacggc

SEQ ID NO: 1970746 - RNA, 21 nt, Shigella flexneri 2a str. 301
auugcgcacaagcuaccagcc

SEQ ID NO: 1970747 - RNA, 23 nt, Shigella flexneri 2a str. 301
auugccauauacgccaucgccag

SEQ ID NO: 1970748 - RNA, 15 nt, Shigella flexneri 2a str. 301
auuuauucccgccag

SEQ ID NO: 1970749 - RNA, 22 nt, Shigella flexneri 2a str. 301
auugugcucacuacggcucagu

SEQ ID NO: 1970750 - RNA, 12 nt, Shigella flexneri 2a str. 301
auuuacacuuca

SEQ ID NO: 1970751 - RNA, 13 nt, Shigella flexneri 2a str. 301
auuucaucgccca

SEQ ID NO: 1970752 - RNA, 14 nt, Shigella flexneri 2a str. 301
auuucauauucaaa

SEQ ID NO: 1970753 - RNA, 23 nt, Shigella flexneri 2a str. 301
auuuccgccaccugauccaucgu

SEQ ID NO: 1970754 - RNA, 21 nt, Shigella flexneri 2a str. 301
auuucggcagcgcgcucgcca

SEQ ID NO: 1970755 - RNA, 21 nt, Shigella flexneri 2a str. 301
auuucgucauccggugugaug

SEQ ID NO: 1970756 - RNA, 19 nt, Shigella flexneri 2a str. 301
auuucguuggcucgcucca

SEQ ID NO: 1970757 - RNA, 15 nt, Shigella flexneri 2a str. 301
auuucgaagaaaccg

SEQ ID NO: 1970758 - RNA, 15 nt, Shigella flexneri 2a str. 301
auuucgcagucgaua

SEQ ID NO: 1970759 - RNA, 14 nt, Shigella flexneri 2a str. 301
auuucgcuaccacc

SEQ ID NO: 1970760 - RNA, 22 nt, Shigella flexneri 2a str. 301
auucgccagaccuaccaucucc

SEQ ID NO: 1970761 - RNA, 19 nt, Shigella flexneri 2a str. 301
auuccggugcugcgucagu

SEQ ID NO: 1970762 - RNA, 18 nt, Shigella flexneri 2a str. 301
auuccgucuccggaaugg

SEQ ID NO: 1970763 - RNA, 20 nt, Shigella flexneri 2a str. 301
auuccggcgugacgaucacc

SEQ ID NO: 1970764 - RNA, 22 nt, Shigella flexneri 2a str. 301
auuccggcgugacgaucaccac

SEQ ID NO: 1970765 - RNA, 20 nt, Shigella flexneri 2a str. 301
auuccggcuuguucaucacc

SEQ ID NO: 1970766 - RNA, 22 nt, Shigella flexneri 2a str. 301
aaacuccagcccuuuugacgcg

SEQ ID NO: 1970767 - RNA, 13 nt, Shigella flexneri 2a str. 301
aaacucugcggca

SEQ ID NO: 1970768 - RNA, 22 nt, Shigella flexneri 2a str. 301
auuccgcaccugccagcgccga

SEQ ID NO: 1970769 - RNA, 15 nt, Shigella flexneri 2a str. 301
auuccgccaccugcg

SEQ ID NO: 1970770 - RNA, 22 nt, Shigella flexneri 2a str. 301
auucccugcagucaccugcccu

SEQ ID NO: 1970771 - RNA, 16 nt, Shigella flexneri 2a str. 301
aaacugagccaaacgc

SEQ ID NO: 1970772 - RNA, 14 nt, Shigella flexneri 2a str. 301
auucagguggcagu

SEQ ID NO: 1970773 - RNA, 19 nt, Shigella flexneri 2a str. 301
auucaggcccgccagcgcc

SEQ ID NO: 1970774 - RNA, 21 nt, Shigella flexneri 2a str. 301
auucacgcaggcgagaaucaa

SEQ ID NO: 1970775 - RNA, 21 nt, Shigella flexneri 2a str. 301
auuccaguccacaucaaccag

SEQ ID NO: 1970776 - RNA, 24 nt, Shigella flexneri 2a str. 301
auuccaguuaucgcgauacaccag

SEQ ID NO: 1970777 - RNA, 22 nt, Shigella flexneri 2a str. 301
auucccauuuauuuuuccucca

SEQ ID NO: 1970778 - RNA, 11 nt, Shigella flexneri 2a str. 301
auuccauccug

SEQ ID NO: 1970779 - RNA, 13 nt, Shigella flexneri 2a str. 301
auuccauccugcu

SEQ ID NO: 1970780 - RNA, 15 nt, Shigella flexneri 2a str. 301
aaacuaaucgacagu

SEQ ID NO: 1970781 - RNA, 16 nt, Shigella flexneri 2a str. 301
auuacugcugcggaau

SEQ ID NO: 1970782 - RNA, 19 nt, Shigella flexneri 2a str. 301
auuaccguuaaaaccaucg

SEQ ID NO: 1970783 - RNA, 14 nt, Shigella flexneri 2a str. 301
auuaccuucaacac

SEQ ID NO: 1970784 - RNA, 21 nt, Shigella flexneri 2a str. 301
auuacgcucggcaaagcgcug

SEQ ID NO: 1970785 - RNA, 12 nt, Shigella flexneri 2a str. 301
auucacauuuaa

SEQ ID NO: 1970786 - RNA, 14 nt, Shigella flexneri 2a str. 301
auuaugaucgccac

SEQ ID NO: 1970787 - RNA, 15 nt, Shigella flexneri 2a str. 301
auuaucgucgucacg

SEQ ID NO: 1970788 - RNA, 23 nt, Shigella flexneri 2a str. 301
auuacccugcacguuggcgcaua

SEQ ID NO: 1970789 - RNA, 18 nt, Shigella flexneri 2a str. 301
augucggaugcggcguga

SEQ ID NO: 1970790 - RNA, 16 nt, Shigella flexneri 2a str. 301
augucggaugcggcgu

SEQ ID NO: 1970791 - RNA, 23 nt, Shigella flexneri 2a str. 301
auuaaucgauaaaccagcaacca

SEQ ID NO: 1970792 - RNA, 13 nt, Shigella flexneri 2a str. 301
agguaaaaccuga

SEQ ID NO: 1970793 - RNA, 20 nt, Shigella flexneri 2a str. 301
aggguuucgcgguugguggc

SEQ ID NO: 1970794 - RNA, 18 nt, Shigella flexneri 2a str. 301
agggguuuuugccagcaa

SEQ ID NO: 1970795 - RNA, 22 nt, Shigella flexneri 2a str. 301
agggcggcaggcagcgccacgu

SEQ ID NO: 1970796 - RNA, 22 nt, Shigella flexneri 2a str. 301
agggcaccggcguaacgccacg

SEQ ID NO: 1970797 - RNA, 17 nt, Shigella flexneri 2a str. 301
agggaaggguguucauc

SEQ ID NO: 1970798 - RNA, 17 nt, Shigella flexneri 2a str. 301
aggcuuuccugauaauc

SEQ ID NO: 1970799 - RNA, 18 nt, Shigella flexneri 2a str. 301
aggcuuuuaacaccugca

SEQ ID NO: 1970800 - RNA, 13 nt, Shigella flexneri 2a str. 301
aggcuucaggugc

SEQ ID NO: 1970801 - RNA, 16 nt, Shigella flexneri 2a str. 301
aggcuucgacgcucag

SEQ ID NO: 1970802 - RNA, 20 nt, Shigella flexneri 2a str. 301
aggcuuccacuucacgaugc

SEQ ID NO: 1970803 - RNA, 20 nt, Shigella flexneri 2a str. 301
aggcguucacgacgcauccg

SEQ ID NO: 1970804 - RNA, 15 nt, Shigella flexneri 2a str. 301
aggcugcaaagucug

SEQ ID NO: 1970805 - RNA, 19 nt, Shigella flexneri 2a str. 301
aggcugcgaguccuguugu

SEQ ID NO: 1970806 - RNA, 20 nt, Shigella flexneri 2a str. 301
agguggcguuugccaccugu

SEQ ID NO: 1970807 - RNA, 16 nt, Shigella flexneri 2a str. 301
aggugucaaccagcca

SEQ ID NO: 1970808 - RNA, 22 nt, Shigella flexneri 2a str. 301
agguagacaccaaggaacugug

SEQ ID NO: 1970809 - RNA, 13 nt, Shigella flexneri 2a str. 301
agguacaaagcca

SEQ ID NO: 1970810 - RNA, 14 nt, Shigella flexneri 2a str. 301
agguacaaccaucc

SEQ ID NO: 1970811 - RNA, 15 nt, Shigella flexneri 2a str. 301
agguacgcuccagca

SEQ ID NO: 1970812 - RNA, 12 nt, Shigella flexneri 2a str. 301
agguuaaugcug

SEQ ID NO: 1970813 - RNA, 16 nt, Shigella flexneri 2a str. 301
aguacaguauucaggu

SEQ ID NO: 1970814 - RNA, 16 nt, Shigella flexneri 2a str. 301
aguccaggcugcaaag

SEQ ID NO: 1970815 - RNA, 15 nt, Shigella flexneri 2a str. 301
aguccaucggcggcu

SEQ ID NO: 1970816 - RNA, 19 nt, Shigella flexneri 2a str. 301
agucaggcaugaucagcgu

SEQ ID NO: 1970817 - RNA, 16 nt, Shigella flexneri 2a str. 301
agucaugaaauauaga

SEQ ID NO: 1970818 - RNA, 12 nt, Shigella flexneri 2a str. 301
aguccguugaaa

SEQ ID NO: 1970819 - RNA, 22 nt, Shigella flexneri 2a str. 301
agucgaauggcaucuacgcucu

SEQ ID NO: 1970820 - RNA, 23 nt, Shigella flexneri 2a str. 301
agucgcgguccgggccgcaaacc

SEQ ID NO: 1970821 - RNA, 21 nt, Shigella flexneri 2a str. 301
agucgcuugcaggaucagcuc

SEQ ID NO: 1970822 - RNA, 13 nt, Shigella flexneri 2a str. 301
aguggcgcagagc

SEQ ID NO: 1970823 - RNA, 15 nt, Shigella flexneri 2a str. 301
agugccguuccagcc

SEQ ID NO: 1970824 - RNA, 17 nt, Shigella flexneri 2a str. 301
aguggcgcagagccuga

SEQ ID NO: 1970825 - RNA, 21 nt, Shigella flexneri 2a str. 301
agugccggauaugaaauccgg

SEQ ID NO: 1970826 - RNA, 14 nt, Shigella flexneri 2a str. 301
agugccgucagcag

SEQ ID NO: 1970827 - RNA, 14 nt, Shigella flexneri 2a str. 301
aguguuaccuucau

SEQ ID NO: 1970828 - RNA, 17 nt, Shigella flexneri 2a str. 301
aguguuauucccaacgc

SEQ ID NO: 1970829 - RNA, 16 nt, Shigella flexneri 2a str. 301
aguguguauacggcaa

SEQ ID NO: 1970830 - RNA, 13 nt, Shigella flexneri 2a str. 301
aguuaccuguggc

SEQ ID NO: 1970831 - RNA, 13 nt, Shigella flexneri 2a str. 301
agucgugccgcau

SEQ ID NO: 1970832 - RNA, 12 nt, Shigella flexneri 2a str. 301
auaaacaacgag

SEQ ID NO: 1970833 - RNA, 20 nt, Shigella flexneri 2a str. 301
auaaacaaccccaucgcguu

SEQ ID NO: 1970834 - RNA, 13 nt, Shigella flexneri 2a str. 301
auaaaauuaacga

SEQ ID NO: 1970835 - RNA, 21 nt, Shigella flexneri 2a str. 301
auaaacauagcgcaucaggca

SEQ ID NO: 1970836 - RNA, 16 nt, Shigella flexneri 2a str. 301
auaaaccacgcaauaa

SEQ ID NO: 1970837 - RNA, 19 nt, Shigella flexneri 2a str. 301
auaaacgccauauucugau

SEQ ID NO: 1970838 - RNA, 16 nt, Shigella flexneri 2a str. 301
auaaauaagaugcgag

SEQ ID NO: 1970839 - RNA, 22 nt, Shigella flexneri 2a str. 301
aguuauuacaaucccgcuuaca

SEQ ID NO: 1970840 - RNA, 16 nt, Shigella flexneri 2a str. 301
aguucacgcagcuucu

SEQ ID NO: 1970841 - RNA, 21 nt, Shigella flexneri 2a str. 301
aguucacgcggguugaacggu

SEQ ID NO: 1970842 - RNA, 14 nt, Shigella flexneri 2a str. 301
auaaggcgcaauaa

SEQ ID NO: 1970843 - RNA, 13 nt, Shigella flexneri 2a str. 301
auaaucaccagua

SEQ ID NO: 1970844 - RNA, 16 nt, Shigella flexneri 2a str. 301
auaaucaacaugaugg

SEQ ID NO: 1970845 - RNA, 17 nt, Shigella flexneri 2a str. 301
auaauccaucacuucau

SEQ ID NO: 1970846 - RNA, 16 nt, Shigella flexneri 2a str. 301
auaaucgaucgcguaa

SEQ ID NO: 1970847 - RNA, 16 nt, Shigella flexneri 2a str. 301
auaaucguaaucagca

SEQ ID NO: 1970848 - RNA, 17 nt, Shigella flexneri 2a str. 301
auaaugggcgcgggcga

SEQ ID NO: 1970849 - RNA, 19 nt, Shigella flexneri 2a str. 301
auaaugugcgcacauugcc

SEQ ID NO: 1970850 - RNA, 13 nt, Shigella flexneri 2a str. 301
auaauucuguaau

SEQ ID NO: 1970851 - RNA, 20 nt, Shigella flexneri 2a str. 301
auaauuccugcgcugcguag

SEQ ID NO: 1970852 - RNA, 16 nt, Shigella flexneri 2a str. 301
auaauugccagcuugc

SEQ ID NO: 1970853 - RNA, 16 nt, Shigella flexneri 2a str. 301
auagcgggaaauacug

SEQ ID NO: 1970854 - RNA, 17 nt, Shigella flexneri 2a str. 301
auagcgucccaguaacg

SEQ ID NO: 1970855 - RNA, 17 nt, Shigella flexneri 2a str. 301
auaggugucaaccagcc

SEQ ID NO: 1970856 - RNA, 17 nt, Shigella flexneri 2a str. 301
auaccaucaccaacgau

SEQ ID NO: 1970857 - RNA, 17 nt, Shigella flexneri 2a str. 301
auaguccugagucagaa

SEQ ID NO: 1970858 - RNA, 13 nt, Shigella flexneri 2a str. 301
auagugccugaug

SEQ ID NO: 1970859 - RNA, 18 nt, Shigella flexneri 2a str. 301
auauccaccgcguucagc

SEQ ID NO: 1970860 - RNA, 13 nt, Shigella flexneri 2a str. 301
auauccagcgaua

SEQ ID NO: 1970861 - RNA, 23 nt, Shigella flexneri 2a str. 301
auaugccagccccagcgucagca

SEQ ID NO: 1970862 - RNA, 21 nt, Shigella flexneri 2a str. 301
auauccauagucacuaccugu

SEQ ID NO: 1970863 - RNA, 15 nt, Shigella flexneri 2a str. 301
auaucccgccagcac

SEQ ID NO: 1970864 - RNA, 20 nt, Shigella flexneri 2a str. 301
auaucuuucugccaccagua

SEQ ID NO: 1970865 - RNA, 14 nt, Shigella flexneri 2a str. 301
auauucggcuccag

SEQ ID NO: 1970866 - RNA, 18 nt, Shigella flexneri 2a str. 301
auauuccgcaccugccag

SEQ ID NO: 1970867 - RNA, 13 nt, Shigella flexneri 2a str. 301
auauuccaucgcu

SEQ ID NO: 1970868 - RNA, 20 nt, Shigella flexneri 2a str. 301
auaugccguaaaaguacaga

SEQ ID NO: 1970869 - RNA, 17 nt, Shigella flexneri 2a str. 301
auauucaacaccgaugc

SEQ ID NO: 1970870 - RNA, 15 nt, Shigella flexneri 2a str. 301
aucaacgcuggcaug

SEQ ID NO: 1970871 - RNA, 17 nt, Shigella flexneri 2a str. 301
aucaacgccaucgccag

SEQ ID NO: 1970872 - RNA, 17 nt, Shigella flexneri 2a str. 301
aucaacaggcacuacgu

SEQ ID NO: 1970873 - RNA, 23 nt, Shigella flexneri 2a str. 301
auauuuccccuguugcaaacuga

SEQ ID NO: 1970874 - RNA, 22 nt, Shigella flexneri 2a str. 301
aucaauaacagcgcaaucaccg

SEQ ID NO: 1970875 - RNA, 16 nt, Shigella flexneri 2a str. 301
aucaaucaccgcuuca

SEQ ID NO: 1970876 - RNA, 14 nt, Shigella flexneri 2a str. 301
aucaauauccaccg

SEQ ID NO: 1970877 - RNA, 18 nt, Shigella flexneri 2a str. 301
aucaacgcgaaaaugccc

SEQ ID NO: 1970878 - RNA, 19 nt, Shigella flexneri 2a str. 301
aucaccuccagcgaaggau

SEQ ID NO: 1970879 - RNA, 19 nt, Shigella flexneri 2a str. 301
aucaccguuuaggcgucac

SEQ ID NO: 1970880 - RNA, 13 nt, Shigella flexneri 2a str. 301
aucacuuucagac

SEQ ID NO: 1970881 - RNA, 15 nt, Shigella flexneri 2a str. 301
aucacuucaucgccg

SEQ ID NO: 1970882 - RNA, 18 nt, Shigella flexneri 2a str. 301
aucacuuugcgcucgcug

SEQ ID NO: 1970883 - RNA, 13 nt, Shigella flexneri 2a str. 301
aucagaaccgccc

SEQ ID NO: 1970884 - RNA, 12 nt, Shigella flexneri 2a str. 301
aucagaauccgg

SEQ ID NO: 1970885 - RNA, 21 nt, Shigella flexneri 2a str. 301
aucacgcgguuacgcaccggu

SEQ ID NO: 1970886 - RNA, 16 nt, Shigella flexneri 2a str. 301
aucacgcgaccaucgc

SEQ ID NO: 1970887 - RNA, 22 nt, Shigella flexneri 2a str. 301
aucagcccaaagcagaguugcu

SEQ ID NO: 1970888 - RNA, 15 nt, Shigella flexneri 2a str. 301
aucagcauccgcacg

SEQ ID NO: 1970889 - RNA, 16 nt, Shigella flexneri 2a str. 301
aucaucuauccggcau

SEQ ID NO: 1970890 - RNA, 14 nt, Shigella flexneri 2a str. 301
aucaucggucagcg

SEQ ID NO: 1970891 - RNA, 21 nt, Shigella flexneri 2a str. 301
aucaugccugaugcgacgcuu

SEQ ID NO: 1970892 - RNA, 19 nt, Shigella flexneri 2a str. 301
aucaugccggccagcgcca

SEQ ID NO: 1970893 - RNA, 15 nt, Shigella flexneri 2a str. 301
aucaugacgggcaag

SEQ ID NO: 1970894 - RNA, 16 nt, Shigella flexneri 2a str. 301
aucauccauccggcug

SEQ ID NO: 1970895 - RNA, 15 nt, Shigella flexneri 2a str. 301
aucaucacgcaucac

SEQ ID NO: 1970896 - RNA, 20 nt, Shigella flexneri 2a str. 301
aucagucugagccugccauu

SEQ ID NO: 1970897 - RNA, 22 nt, Shigella flexneri 2a str. 301
aucaguugauuaugaucgccac

SEQ ID NO: 1970898 - RNA, 22 nt, Shigella flexneri 2a str. 301
aucagucuagcccgauggcauc

SEQ ID NO: 1970899 - RNA, 19 nt, Shigella flexneri 2a str. 301
aucagcgugaccaguugcu

SEQ ID NO: 1970900 - RNA, 19 nt, Shigella flexneri 2a str. 301
auccgacauuucugcugcc

SEQ ID NO: 1970901 - RNA, 15 nt, Shigella flexneri 2a str. 301
auccgcaucacucca

SEQ ID NO: 1970902 - RNA, 20 nt, Shigella flexneri 2a str. 301
auccggcauuuuacgcauua

SEQ ID NO: 1970903 - RNA, 14 nt, Shigella flexneri 2a str. 301
auccggccuacgau

SEQ ID NO: 1970904 - RNA, 17 nt, Shigella flexneri 2a str. 301
auccggcgaauuaccag

SEQ ID NO: 1970905 - RNA, 22 nt, Shigella flexneri 2a str. 301
auccgcucccuggcccaucgcc

SEQ ID NO: 1970906 - RNA, 16 nt, Shigella flexneri 2a str. 301
auccggcaaguuguau

SEQ ID NO: 1970907 - RNA, 20 nt, Shigella flexneri 2a str. 301
auccuaaaggcaaaaugcca

SEQ ID NO: 1970908 - RNA, 15 nt, Shigella flexneri 2a str. 301
auccuauauagcccc

SEQ ID NO: 1970909 - RNA, 19 nt, Shigella flexneri 2a str. 301
auccugcgcuuccugcaac

SEQ ID NO: 1970910 - RNA, 15 nt, Shigella flexneri 2a str. 301
auccuggccuggauu

SEQ ID NO: 1970911 - RNA, 13 nt, Shigella flexneri 2a str. 301
auccugccgcagu

SEQ ID NO: 1970912 - RNA, 12 nt, Shigella flexneri 2a str. 301
auccugccgcag

SEQ ID NO: 1970913 - RNA, 15 nt, Shigella flexneri 2a str. 301
auccugaaucaccug

SEQ ID NO: 1970914 - RNA, 21 nt, Shigella flexneri 2a str. 301
auccugaauaacuggcgcgac

SEQ ID NO: 1970915 - RNA, 14 nt, Shigella flexneri 2a str. 301
auccugaccaccau

SEQ ID NO: 1970916 - RNA, 22 nt, Shigella flexneri 2a str. 301
auccugauagcuuacggcgcug

SEQ ID NO: 1970917 - RNA, 19 nt, Shigella flexneri 2a str. 301
auccuugcuaaccaacaau

SEQ ID NO: 1970918 - RNA, 23 nt, Shigella flexneri 2a str. 301
auccagcacggugaagaagcgga

SEQ ID NO: 1970919 - RNA, 11 nt, Shigella flexneri 2a str. 301
auccagaucac

SEQ ID NO: 1970920 - RNA, 23 nt, Shigella flexneri 2a str. 301
auccacuuuuggcccgacgauga

SEQ ID NO: 1970921 - RNA, 12 nt, Shigella flexneri 2a str. 301
auccagccaguc

SEQ ID NO: 1970922 - RNA, 19 nt, Shigella flexneri 2a str. 301
aucauuaaaguuaucgccg

SEQ ID NO: 1970923 - RNA, 17 nt, Shigella flexneri 2a str. 301
aucaugguaucgggcag

SEQ ID NO: 1970924 - RNA, 20 nt, Shigella flexneri 2a str. 301
aucaugucgcccacgccaga

SEQ ID NO: 1970925 - RNA, 20 nt, Shigella flexneri 2a str. 301
aucauggcgaugagaaucag

SEQ ID NO: 1970926 - RNA, 21 nt, Shigella flexneri 2a str. 301
aucauuagcccaauaaucacc

SEQ ID NO: 1970927 - RNA, 23 nt, Shigella flexneri 2a str. 301
aucauugcgugguuuuugcugac

SEQ ID NO: 1970928 - RNA, 17 nt, Shigella flexneri 2a str. 301
auccaccgccacgccga

SEQ ID NO: 1970929 - RNA, 21 nt, Shigella flexneri 2a str. 301
aucccgcgauaugccggcauc

SEQ ID NO: 1970930 - RNA, 13 nt, Shigella flexneri 2a str. 301
aucccgugacggu

SEQ ID NO: 1970931 - RNA, 23 nt, Shigella flexneri 2a str. 301
auccaugauauuggcaucgccag

SEQ ID NO: 1970932 - RNA, 16 nt, Shigella flexneri 2a str. 301
auccauucaucgccuu

SEQ ID NO: 1970933 - RNA, 22 nt, Shigella flexneri 2a str. 301
auccauuuucuauuuugcauua

SEQ ID NO: 1970934 - RNA, 21 nt, Shigella flexneri 2a str. 301
aucccauuacguccagcgauu

SEQ ID NO: 1970935 - RNA, 16 nt, Shigella flexneri 2a str. 301
aucccagugcggcauc

SEQ ID NO: 1970936 - RNA, 14 nt, Shigella flexneri 2a str. 301
aucccagugcggca

SEQ ID NO: 1970937 - RNA, 18 nt, Shigella flexneri 2a str. 301
aucccagucuucaucauc

SEQ ID NO: 1970938 - RNA, 13 nt, Shigella flexneri 2a str. 301
aucccagcccagc

SEQ ID NO: 1970939 - RNA, 14 nt, Shigella flexneri 2a str. 301
agcgacuugggcga

SEQ ID NO: 1970940 - RNA, 17 nt, Shigella flexneri 2a str. 301
agcgacuuugccuggcg

SEQ ID NO: 1970941 - RNA, 19 nt, Shigella flexneri 2a str. 301
agcgacuuuggugccguga

SEQ ID NO: 1970942 - RNA, 19 nt, Shigella flexneri 2a str. 301
agcgacuucuucccaccau

SEQ ID NO: 1970943 - RNA, 23 nt, Shigella flexneri 2a str. 301
agcgaauaauaaaaaaccggagc

SEQ ID NO: 1970944 - RNA, 23 nt, Shigella flexneri 2a str. 301
agcgaucauguaccguugcugcc

SEQ ID NO: 1970945 - RNA, 22 nt, Shigella flexneri 2a str. 301
agcgccauuucuucuccggcau

SEQ ID NO: 1970946 - RNA, 21 nt, Shigella flexneri 2a str. 301
agcgcccgccagcaccggagg

SEQ ID NO: 1970947 - RNA, 12 nt, Shigella flexneri 2a str. 301
agcgccaacggu

SEQ ID NO: 1970948 - RNA, 22 nt, Shigella flexneri 2a str. 301
agcgccaccacaaaagcgguga

SEQ ID NO: 1970949 - RNA, 16 nt, Shigella flexneri 2a str. 301
agcgcauaaaccgggc

SEQ ID NO: 1970950 - RNA, 22 nt, Shigella flexneri 2a str. 301
agcgcaucaggcauuacggauc

SEQ ID NO: 1970951 - RNA, 14 nt, Shigella flexneri 2a str. 301
agccugcucaguug

SEQ ID NO: 1970952 - RNA, 21 nt, Shigella flexneri 2a str. 301
agccugccagcaugcauaaca

SEQ ID NO: 1970953 - RNA, 21 nt, Shigella flexneri 2a str. 301
agccugaacuaaagccuuuug

SEQ ID NO: 1970954 - RNA, 17 nt, Shigella flexneri 2a str. 301
agccugauaagacgcga

SEQ ID NO: 1970955 - RNA, 14 nt, Shigella flexneri 2a str. 301
agcgaaaucgccuu

SEQ ID NO: 1970956 - RNA, 17 nt, Shigella flexneri 2a str. 301
agccgcuuuuucugcgc

SEQ ID NO: 1970957 - RNA, 15 nt, Shigella flexneri 2a str. 301
agccggaugaucauc

SEQ ID NO: 1970958 - RNA, 23 nt, Shigella flexneri 2a str. 301
agccgcgcuuucuucuucgcgac

SEQ ID NO: 1970959 - RNA, 15 nt, Shigella flexneri 2a str. 301
agccgaucgugcuaa

SEQ ID NO: 1970960 - RNA, 23 nt, Shigella flexneri 2a str. 301
agccgaagccguuagucaucauc

SEQ ID NO: 1970961 - RNA, 22 nt, Shigella flexneri 2a str. 301
agcccgccaaccaccgccagua

SEQ ID NO: 1970962 - RNA, 16 nt, Shigella flexneri 2a str. 301
agccccagcacuucgc

SEQ ID NO: 1970963 - RNA, 15 nt, Shigella flexneri 2a str. 301
agccauccaguuuaa

SEQ ID NO: 1970964 - RNA, 19 nt, Shigella flexneri 2a str. 301
agccaugcccgugcugaca

SEQ ID NO: 1970965 - RNA, 18 nt, Shigella flexneri 2a str. 301
agcaugggugaacugcuu

SEQ ID NO: 1970966 - RNA, 16 nt, Shigella flexneri 2a str. 301
agcaugcaucccgccg

SEQ ID NO: 1970967 - RNA, 21 nt, Shigella flexneri 2a str. 301
agcaugaucagcgcauagaga

SEQ ID NO: 1970968 - RNA, 13 nt, Shigella flexneri 2a str. 301
agcauuucgcgau

SEQ ID NO: 1970969 - RNA, 21 nt, Shigella flexneri 2a str. 301
agccaaagggcuggcaaugac

SEQ ID NO: 1970970 - RNA, 13 nt, Shigella flexneri 2a str. 301
agccaaaaugccu

SEQ ID NO: 1970971 - RNA, 20 nt, Shigella flexneri 2a str. 301
agccaaaucauccagaccgc

SEQ ID NO: 1970972 - RNA, 20 nt, Shigella flexneri 2a str. 301
agcauuuucauccauuacca

SEQ ID NO: 1970973 - RNA, 16 nt, Shigella flexneri 2a str. 301
agccagcggcggcaca

SEQ ID NO: 1970974 - RNA, 17 nt, Shigella flexneri 2a str. 301
agccagugauuaacgcg

SEQ ID NO: 1970975 - RNA, 21 nt, Shigella flexneri 2a str. 301
agccaguuuacccagcgaauc

SEQ ID NO: 1970976 - RNA, 21 nt, Shigella flexneri 2a str. 301
agcagcugcucccagcgcauu

SEQ ID NO: 1970977 - RNA, 20 nt, Shigella flexneri 2a str. 301
agcaguuuccgcgccggcuc

SEQ ID NO: 1970978 - RNA, 13 nt, Shigella flexneri 2a str. 301
agcauaauaagcu

SEQ ID NO: 1970979 - RNA, 22 nt, Shigella flexneri 2a str. 301
agcaguuuuuccccugccagau

SEQ ID NO: 1970980 - RNA, 17 nt, Shigella flexneri 2a str. 301
agcauaggcauuaaaca

SEQ ID NO: 1970981 - RNA, 19 nt, Shigella flexneri 2a str. 301
agauuuaugacaaacgcaa

SEQ ID NO: 1970982 - RNA, 18 nt, Shigella flexneri 2a str. 301
agauuuuaccgucaccga

SEQ ID NO: 1970983 - RNA, 23 nt, Shigella flexneri 2a str. 301
agauucgguaaccauccauucag

SEQ ID NO: 1970984 - RNA, 20 nt, Shigella flexneri 2a str. 301
agauuucaaucuggccugag

SEQ ID NO: 1970985 - RNA, 12 nt, Shigella flexneri 2a str. 301
agauuaaucgcg

SEQ ID NO: 1970986 - RNA, 18 nt, Shigella flexneri 2a str. 301
agauuacgcucugacgac

SEQ ID NO: 1970987 - RNA, 11 nt, Shigella flexneri 2a str. 301
agauuaugccg

SEQ ID NO: 1970988 - RNA, 17 nt, Shigella flexneri 2a str. 301
aggcauucucgccgugg

SEQ ID NO: 1970989 - RNA, 12 nt, Shigella flexneri 2a str. 301
aggcauugugcu

SEQ ID NO: 1970990 - RNA, 18 nt, Shigella flexneri 2a str. 301
aggcaauuggcgcaucau

SEQ ID NO: 1970991 - RNA, 13 nt, Shigella flexneri 2a str. 301
aggcaauccauaa

SEQ ID NO: 1970992 - RNA, 12 nt, Shigella flexneri 2a str. 301
aggauuucauuu

SEQ ID NO: 1970993 - RNA, 21 nt, Shigella flexneri 2a str. 301
aggaugcgggucaggccagga

SEQ ID NO: 1970994 - RNA, 21 nt, Shigella flexneri 2a str. 301
aaacguugcgcggugagcguu

SEQ ID NO: 1970995 - RNA, 17 nt, Shigella flexneri 2a str. 301
aggagccaucaccaucg

SEQ ID NO: 1970996 - RNA, 21 nt, Shigella flexneri 2a str. 301
aaacgguaccguugaccaguc

SEQ ID NO: 1970997 - RNA, 16 nt, Shigella flexneri 2a str. 301
aaacguuaugcaccga

SEQ ID NO: 1970998 - RNA, 12 nt, Shigella flexneri 2a str. 301
aaacgugccauu

SEQ ID NO: 1970999 - RNA, 22 nt, Shigella flexneri 2a str. 301
aaacgugacagcauaccuucac

SEQ ID NO: 1971000 - RNA, 20 nt, Shigella flexneri 2a str. 301
aaacguaaaacugccugaug

SEQ ID NO: 1971001 - RNA, 14 nt, Shigella flexneri 2a str. 301
aggagauaaaccga

SEQ ID NO: 1971002 - RNA, 14 nt, Shigella flexneri 2a str. 301
aggaaaucgucgag

SEQ ID NO: 1971003 - RNA, 20 nt, Shigella flexneri 2a str. 301
aggaaccugugacagcagcg

SEQ ID NO: 1971004 - RNA, 23 nt, Shigella flexneri 2a str. 301
agcuuuucccagcgcgacagaua

SEQ ID NO: 1971005 - RNA, 20 nt, Shigella flexneri 2a str. 301
aggaaaaacgaaugacugau

SEQ ID NO: 1971006 - RNA, 19 nt, Shigella flexneri 2a str. 301
agcuuuuguaggccugaua

SEQ ID NO: 1971007 - RNA, 15 nt, Shigella flexneri 2a str. 301
aggaagcguugcgcc

SEQ ID NO: 1971008 - RNA, 20 nt, Shigella flexneri 2a str. 301
aggaaucacguaggccugau

SEQ ID NO: 1971009 - RNA, 12 nt, Shigella flexneri 2a str. 301
aggaauccgggu

SEQ ID NO: 1971010 - RNA, 21 nt, Shigella flexneri 2a str. 301
aggaaguuaagaucagaagcg

SEQ ID NO: 1971011 - RNA, 15 nt, Shigella flexneri 2a str. 301
aggacagucagaccg

SEQ ID NO: 1971012 - RNA, 20 nt, Shigella flexneri 2a str. 301
agcuugcgauccugcagaua

SEQ ID NO: 1971013 - RNA, 21 nt, Shigella flexneri 2a str. 301
agcuucaggcacccgccguua

SEQ ID NO: 1971014 - RNA, 14 nt, Shigella flexneri 2a str. 301
agcuuaaucaccag

SEQ ID NO: 1971015 - RNA, 21 nt, Shigella flexneri 2a str. 301
agcuggugaacauuuuaaccg

SEQ ID NO: 1971016 - RNA, 20 nt, Shigella flexneri 2a str. 301
agcggaaacguaacguacug

SEQ ID NO: 1971017 - RNA, 15 nt, Shigella flexneri 2a str. 301
agcgcuuuuggcgcg

SEQ ID NO: 1971018 - RNA, 23 nt, Shigella flexneri 2a str. 301
agcgcugcugcacauacugcauc

SEQ ID NO: 1971019 - RNA, 19 nt, Shigella flexneri 2a str. 301
agcgcugcgaaaguaccau

SEQ ID NO: 1971020 - RNA, 15 nt, Shigella flexneri 2a str. 301
agcggcguuugcucc

SEQ ID NO: 1971021 - RNA, 19 nt, Shigella flexneri 2a str. 301
agcgggacgcucguugcag

SEQ ID NO: 1971022 - RNA, 23 nt, Shigella flexneri 2a str. 301
agcggcgguaaaaucauccugcu

SEQ ID NO: 1971023 - RNA, 21 nt, Shigella flexneri 2a str. 301
agcgggcagacaaaacauacc

SEQ ID NO: 1971024 - RNA, 15 nt, Shigella flexneri 2a str. 301
agcggccgucagauc

SEQ ID NO: 1971025 - RNA, 22 nt, Shigella flexneri 2a str. 301
agcggccuuuuccuuucagagu

SEQ ID NO: 1971026 - RNA, 21 nt, Shigella flexneri 2a str. 301
agcggcgacaauaaucaccac

SEQ ID NO: 1971027 - RNA, 21 nt, Shigella flexneri 2a str. 301
agcggcgggcuuuaaucaccc

SEQ ID NO: 1971028 - RNA, 13 nt, Shigella flexneri 2a str. 301
agcgucggcguca

SEQ ID NO: 1971029 - RNA, 17 nt, Shigella flexneri 2a str. 301
agcgucagcuuucagag

SEQ ID NO: 1971030 - RNA, 22 nt, Shigella flexneri 2a str. 301
agcguuuccagcaccaguucac

SEQ ID NO: 1971031 - RNA, 14 nt, Shigella flexneri 2a str. 301
agcguuuccagcca

SEQ ID NO: 1971032 - RNA, 17 nt, Shigella flexneri 2a str. 301
agcguucaaaacggcug

SEQ ID NO: 1971033 - RNA, 12 nt, Shigella flexneri 2a str. 301
agcguuucaaca

SEQ ID NO: 1971034 - RNA, 16 nt, Shigella flexneri 2a str. 301
agcguuauagcgcaug

SEQ ID NO: 1971035 - RNA, 13 nt, Shigella flexneri 2a str. 301
agcguuaccggcu

SEQ ID NO: 1971036 - RNA, 20 nt, Shigella flexneri 2a str. 301
agcguaaaggcggcagaaca

SEQ ID NO: 1971037 - RNA, 17 nt, Shigella flexneri 2a str. 301
agcguaauugauccgcg

SEQ ID NO: 1971038 - RNA, 21 nt, Shigella flexneri 2a str. 301
agcgucacuucggcagugcga

SEQ ID NO: 1971039 - RNA, 22 nt, Shigella flexneri 2a str. 301
agcguuuuuucaucggcaguuu

SEQ ID NO: 1971040 - RNA, 15 nt, Shigella flexneri 2a str. 301
agcuaccacgccgau

SEQ ID NO: 1971041 - RNA, 21 nt, Shigella flexneri 2a str. 301
agcucauaacggcaacggcgg

SEQ ID NO: 1971042 - RNA, 16 nt, Shigella flexneri 2a str. 301
agcucaguuaacggca

SEQ ID NO: 1971043 - RNA, 16 nt, Shigella flexneri 2a str. 301
agcucgaccgcugccg

SEQ ID NO: 1971044 - RNA, 22 nt, Shigella flexneri 2a str. 301
agcucauccagcguuucgugaa

SEQ ID NO: 1971045 - RNA, 13 nt, Shigella flexneri 2a str. 301
agcugccaguugu

SEQ ID NO: 1971046 - RNA, 16 nt, Shigella flexneri 2a str. 301
agcugccaguugucgg

SEQ ID NO: 1971047 - RNA, 19 nt, Shigella flexneri 2a str. 301
agcugccuguacggcagug

SEQ ID NO: 1971048 - RNA, 11 nt, Shigella flexneri 2a str. 301
uuuuuuuaugc

SEQ ID NO: 1971049 - RNA, 11 nt, Shigella flexneri 2a str. 301
uuuuuuugcca

SEQ ID NO: 1971050 - RNA, 11 nt, Shigella flexneri 2a str. 301
uuuuuucacau

SEQ ID NO: 1971051 - RNA, 18 nt, Shigella flexneri 2a str. 301
uuuuguaucgaacaagau

SEQ ID NO: 1971052 - RNA, 11 nt, Shigella flexneri 2a str. 301
uuuugugggca

SEQ ID NO: 1971053 - RNA, 14 nt, Shigella flexneri 2a str. 301
uuuuguuuaaauau

SEQ ID NO: 1971054 - RNA, 18 nt, Shigella flexneri 2a str. 301
uuuuggagaucacgccac

SEQ ID NO: 1971055 - RNA, 19 nt, Shigella flexneri 2a str. 301
uuuugccggauguggcgug

SEQ ID NO: 1971056 - RNA, 20 nt, Shigella flexneri 2a str. 301
uuuugcccggcaacaacagg

SEQ ID NO: 1971057 - RNA, 16 nt, Shigella flexneri 2a str. 301
uuuugcggaucugcuc

SEQ ID NO: 1971058 - RNA, 11 nt, Shigella flexneri 2a str. 301
uuuugcugccg

SEQ ID NO: 1971059 - RNA, 23 nt, Shigella flexneri 2a str. 301
uuuugcugcaaaauuauuccguu

SEQ ID NO: 1971060 - RNA, 20 nt, Shigella flexneri 2a str. 301
uuuugcguccgguaauuuuu

SEQ ID NO: 1971061 - RNA, 22 nt, Shigella flexneri 2a str. 301
uuuuuacauguucaaaaaaauc

SEQ ID NO: 1971062 - RNA, 21 nt, Shigella flexneri 2a str. 301
uuuuucaagaaucggcuuugu

SEQ ID NO: 1971063 - RNA, 14 nt, Shigella flexneri 2a str. 301
uuuuuaguuagcaa

SEQ ID NO: 1971064 - RNA, 12 nt, Shigella flexneri 2a str. 301
uuuuuaucuuca

SEQ ID NO: 1971065 - RNA, 21 nt, Shigella flexneri 2a str. 301
uuuuuaugguggaguuaccag

SEQ ID NO: 1971066 - RNA, 19 nt, Shigella flexneri 2a str. 301
uuuucggcaaccgcaucca

SEQ ID NO: 1971067 - RNA, 15 nt, Shigella flexneri 2a str. 301
uuuucggauuuaccg

SEQ ID NO: 1971068 - RNA, 21 nt, Shigella flexneri 2a str. 301
uuuucgaucuguuuuagagaa

SEQ ID NO: 1971069 - RNA, 12 nt, Shigella flexneri 2a str. 301
uuuucgccgcau

SEQ ID NO: 1971070 - RNA, 20 nt, Shigella flexneri 2a str. 301
uuuugcaggaaaaacugccc

SEQ ID NO: 1971071 - RNA, 22 nt, Shigella flexneri 2a str. 301
uuuugcaaucagauaaaauaca

SEQ ID NO: 1971072 - RNA, 13 nt, Shigella flexneri 2a str. 301
uuuugcaauaaug

SEQ ID NO: 1971073 - RNA, 17 nt, Shigella flexneri 2a str. 301
uuuugcaacgcuuugcu

SEQ ID NO: 1971074 - RNA, 22 nt, Shigella flexneri 2a str. 301
uuuugccaccccuuuugacuuu

SEQ ID NO: 1971075 - RNA, 16 nt, Shigella flexneri 2a str. 301
uuuugcauaauuucca

SEQ ID NO: 1971076 - RNA, 15 nt, Shigella flexneri 2a str. 301
uuuugccaaauaucu

SEQ ID NO: 1971077 - RNA, 15 nt, Shigella flexneri 2a str. 301
uuuugagcgguacac

SEQ ID NO: 1971078 - RNA, 12 nt, Shigella flexneri 2a str. 301
uuuucaccaguu

SEQ ID NO: 1971079 - RNA, 16 nt, Shigella flexneri 2a str. 301
uuuucaccaucgccau

SEQ ID NO: 1971080 - RNA, 17 nt, Shigella flexneri 2a str. 301
uuuucacgccugcggcu

SEQ ID NO: 1971081 - RNA, 13 nt, Shigella flexneri 2a str. 301
uuuaccugauccu

SEQ ID NO: 1971082 - RNA, 21 nt, Shigella flexneri 2a str. 301
uuuaccguagcguucuuugag

SEQ ID NO: 1971083 - RNA, 22 nt, Shigella flexneri 2a str. 301
uuuaccgcgaccaccaccaaac

SEQ ID NO: 1971084 - RNA, 16 nt, Shigella flexneri 2a str. 301
uuuucagccaucaucc

SEQ ID NO: 1971085 - RNA, 13 nt, Shigella flexneri 2a str. 301
uuuucaguuguug

SEQ ID NO: 1971086 - RNA, 12 nt, Shigella flexneri 2a str. 301
uuuucgaaaaaa

SEQ ID NO: 1971087 - RNA, 14 nt, Shigella flexneri 2a str. 301
uuuuccugcugcau

SEQ ID NO: 1971088 - RNA, 21 nt, Shigella flexneri 2a str. 301
uuuuccugcugcaucugaaac

SEQ ID NO: 1971089 - RNA, 17 nt, Shigella flexneri 2a str. 301
uuuuccgccucaucauc

SEQ ID NO: 1971090 - RNA, 14 nt, Shigella flexneri 2a str. 301
ucugaugauauuuu

SEQ ID NO: 1971091 - RNA, 21 nt, Shigella flexneri 2a str. 301
ucugaugauauuuuucccuga

SEQ ID NO: 1971092 - RNA, 20 nt, Shigella flexneri 2a str. 301
ucugaugaggcauaagcgac

SEQ ID NO: 1971093 - RNA, 18 nt, Shigella flexneri 2a str. 301
ucugcaaauauuaauaau

SEQ ID NO: 1971094 - RNA, 20 nt, Shigella flexneri 2a str. 301
ucugcaaaauagccaaucau

SEQ ID NO: 1971095 - RNA, 16 nt, Shigella flexneri 2a str. 301
ucugaugcauaaaaaa

SEQ ID NO: 1971096 - RNA, 17 nt, Shigella flexneri 2a str. 301
ucugagauucaauuaua

SEQ ID NO: 1971097 - RNA, 23 nt, Shigella flexneri 2a str. 301
ucugauaguuaaaauucaagaca

SEQ ID NO: 1971098 - RNA, 20 nt, Shigella flexneri 2a str. 301
ucugauagugauccaucagg

SEQ ID NO: 1971099 - RNA, 22 nt, Shigella flexneri 2a str. 301
ucugacgugcgcaaacuucuuc

SEQ ID NO: 1971100 - RNA, 19 nt, Shigella flexneri 2a str. 301
ucugacgcgcauacucucc

SEQ ID NO: 1971101 - RNA, 17 nt, Shigella flexneri 2a str. 301
ucugagagcaugaaaug

SEQ ID NO: 1971102 - RNA, 21 nt, Shigella flexneri 2a str. 301
ucugaauauucggcuccagau

SEQ ID NO: 1971103 - RNA, 16 nt, Shigella flexneri 2a str. 301
ucugaccgucuuucau

SEQ ID NO: 1971104 - RNA, 17 nt, Shigella flexneri 2a str. 301
ucugaauccaucuguau

SEQ ID NO: 1971105 - RNA, 22 nt, Shigella flexneri 2a str. 301
ucugaagacgcgucuggcauca

SEQ ID NO: 1971106 - RNA, 23 nt, Shigella flexneri 2a str. 301
ucucugcaaucaccacugccagc

SEQ ID NO: 1971107 - RNA, 18 nt, Shigella flexneri 2a str. 301
ucucugcgcuauccagcg

SEQ ID NO: 1971108 - RNA, 15 nt, Shigella flexneri 2a str. 301
ucucugcuccugaug

SEQ ID NO: 1971109 - RNA, 12 nt, Shigella flexneri 2a str. 301
ucucuggaagag

SEQ ID NO: 1971110 - RNA, 23 nt, Shigella flexneri 2a str. 301
ucucuggcccgcuuuucauuauc

SEQ ID NO: 1971111 - RNA, 19 nt, Shigella flexneri 2a str. 301
ucucuggcccgcuuuucau

SEQ ID NO: 1971112 - RNA, 16 nt, Shigella flexneri 2a str. 301
ucucugcuuucgcauu

SEQ ID NO: 1971113 - RNA, 18 nt, Shigella flexneri 2a str. 301
ucucuggcuguuucgcuu

SEQ ID NO: 1971114 - RNA, 21 nt, Shigella flexneri 2a str. 301
ucucuggcuguuucgcuucuu

SEQ ID NO: 1971115 - RNA, 17 nt, Shigella flexneri 2a str. 301
ucucugggagauuaccu

SEQ ID NO: 1971116 - RNA, 15 nt, Shigella flexneri 2a str. 301
ucucuauuucaccca

SEQ ID NO: 1971117 - RNA, 16 nt, Shigella flexneri 2a str. 301
ucucuauuccaccauc

SEQ ID NO: 1971118 - RNA, 17 nt, Shigella flexneri 2a str. 301
ucucucuugcuaucacc

SEQ ID NO: 1971119 - RNA, 14 nt, Shigella flexneri 2a str. 301
ucucuccuuucggc

SEQ ID NO: 1971120 - RNA, 24 nt, Shigella flexneri 2a str. 301
ucucuucaacacggcgcauugcca

SEQ ID NO: 1971121 - RNA, 13 nt, Shigella flexneri 2a str. 301
ucucuuaucaucc

SEQ ID NO: 1971122 - RNA, 17 nt, Shigella flexneri 2a str. 301
ucucuucgccugccugc

SEQ ID NO: 1971123 - RNA, 23 nt, Shigella flexneri 2a str. 301
ucucuucggcuucugccuuaucc

SEQ ID NO: 1971124 - RNA, 18 nt, Shigella flexneri 2a str. 301
ucucuuucaacauccugu

SEQ ID NO: 1971125 - RNA, 15 nt, Shigella flexneri 2a str. 301
ucucuuucaccagcg

SEQ ID NO: 1971126 - RNA, 18 nt, Shigella flexneri 2a str. 301
ucucuuggggcuucaucu

SEQ ID NO: 1971127 - RNA, 18 nt, Shigella flexneri 2a str. 301
ucucuuuaaaaaguaaaa

SEQ ID NO: 1971128 - RNA, 23 nt, Shigella flexneri 2a str. 301
ucucuugcuggcauuacaagaau

SEQ ID NO: 1971129 - RNA, 13 nt, Shigella flexneri 2a str. 301
ucucuucugcuuu

SEQ ID NO: 1971130 - RNA, 15 nt, Shigella flexneri 2a str. 301
ucucuucguuuucaa

SEQ ID NO: 1971131 - RNA, 14 nt, Shigella flexneri 2a str. 301
ucucuacaccauua

SEQ ID NO: 1971132 - RNA, 13 nt, Shigella flexneri 2a str. 301
ucucgugccgcca

SEQ ID NO: 1971133 - RNA, 21 nt, Shigella flexneri 2a str. 301
ucucgucgguaauuucacaag

SEQ ID NO: 1971134 - RNA, 14 nt, Shigella flexneri 2a str. 301
ucucgggaaggccc

SEQ ID NO: 1971135 - RNA, 17 nt, Shigella flexneri 2a str. 301
ucucgggaaggcccuuu

SEQ ID NO: 1971136 - RNA, 16 nt, Shigella flexneri 2a str. 301
ucucgcagcucaucaa

SEQ ID NO: 1971137 - RNA, 23 nt, Shigella flexneri 2a str. 301
ucuccuggcgcaccuuuuuuuau

SEQ ID NO: 1971138 - RNA, 22 nt, Shigella flexneri 2a str. 301
ucuccugcaacagguugcgcug

SEQ ID NO: 1971139 - RNA, 21 nt, Shigella flexneri 2a str. 301
ucuccugccaauacaaaauuu

SEQ ID NO: 1971140 - RNA, 12 nt, Shigella flexneri 2a str. 301
ucuccugcgcac

SEQ ID NO: 1971141 - RNA, 18 nt, Shigella flexneri 2a str. 301
ucucgauaaaccauccug

SEQ ID NO: 1971142 - RNA, 23 nt, Shigella flexneri 2a str. 301
ucucccgaaugaccgccccugcg

SEQ ID NO: 1971143 - RNA, 12 nt, Shigella flexneri 2a str. 301
ucuccccggagg

SEQ ID NO: 1971144 - RNA, 14 nt, Shigella flexneri 2a str. 301
ucucccgccagcga

SEQ ID NO: 1971145 - RNA, 17 nt, Shigella flexneri 2a str. 301
ucuccgcuggagcgggg

SEQ ID NO: 1971146 - RNA, 22 nt, Shigella flexneri 2a str. 301
ucuccgcugagacgcgcuugca

SEQ ID NO: 1971147 - RNA, 14 nt, Shigella flexneri 2a str. 301
ucuccuccgaugac

SEQ ID NO: 1971148 - RNA, 18 nt, Shigella flexneri 2a str. 301
ucuccagcgcaucgaucu

SEQ ID NO: 1971149 - RNA, 12 nt, Shigella flexneri 2a str. 301
ucuccagcuccc

SEQ ID NO: 1971150 - RNA, 21 nt, Shigella flexneri 2a str. 301
ucucauuccaccgaaacuuuu

SEQ ID NO: 1971151 - RNA, 14 nt, Shigella flexneri 2a str. 301
ucuacauugcucau

SEQ ID NO: 1971152 - RNA, 18 nt, Shigella flexneri 2a str. 301
ucucaucuuugaaaucac

SEQ ID NO: 1971153 - RNA, 20 nt, Shigella flexneri 2a str. 301
ucugguuugccacguucuga

SEQ ID NO: 1971154 - RNA, 14 nt, Shigella flexneri 2a str. 301
ucugguuucaagau

SEQ ID NO: 1971155 - RNA, 18 nt, Shigella flexneri 2a str. 301
ucuguaacgcacuggugg

SEQ ID NO: 1971156 - RNA, 15 nt, Shigella flexneri 2a str. 301
ucuguaccaccagaa

SEQ ID NO: 1971157 - RNA, 14 nt, Shigella flexneri 2a str. 301
ucugucgcucugcu

SEQ ID NO: 1971158 - RNA, 23 nt, Shigella flexneri 2a str. 301
ucuguguaaaugccuuucucaga

SEQ ID NO: 1971159 - RNA, 16 nt, Shigella flexneri 2a str. 301
ucugucagguaacaag

SEQ ID NO: 1971160 - RNA, 16 nt, Shigella flexneri 2a str. 301
ucugucaguuggcugu

SEQ ID NO: 1971161 - RNA, 13 nt, Shigella flexneri 2a str. 301
ucugguugagcag

SEQ ID NO: 1971162 - RNA, 15 nt, Shigella flexneri 2a str. 301
ucugguuaccggcau

SEQ ID NO: 1971163 - RNA, 23 nt, Shigella flexneri 2a str. 301
ucugguucgccaaaugucaccag

SEQ ID NO: 1971164 - RNA, 17 nt, Shigella flexneri 2a str. 301
ucuggcuugccagcagg

SEQ ID NO: 1971165 - RNA, 16 nt, Shigella flexneri 2a str. 301
ucuggugcuuuuucaa

SEQ ID NO: 1971166 - RNA, 16 nt, Shigella flexneri 2a str. 301
ucuggcuugccagcag

SEQ ID NO: 1971167 - RNA, 20 nt, Shigella flexneri 2a str. 301
ucuggacaaagagcuuucau

SEQ ID NO: 1971168 - RNA, 14 nt, Shigella flexneri 2a str. 301
ucuggaagaggcug

SEQ ID NO: 1971169 - RNA, 23 nt, Shigella flexneri 2a str. 301
ucuggaauggaaacagcaccauc

SEQ ID NO: 1971170 - RNA, 16 nt, Shigella flexneri 2a str. 301
ucuggcggaagcucca

SEQ ID NO: 1971171 - RNA, 17 nt, Shigella flexneri 2a str. 301
ucuggcguacagagggc

SEQ ID NO: 1971172 - RNA, 23 nt, Shigella flexneri 2a str. 301
ucuggcguacagagggcaggcaa

SEQ ID NO: 1971173 - RNA, 19 nt, Shigella flexneri 2a str. 301
ucuggcucaucgccuucca

SEQ ID NO: 1971174 - RNA, 22 nt, Shigella flexneri 2a str. 301
ucuggcuacugaugguuuuaau

SEQ ID NO: 1971175 - RNA, 15 nt, Shigella flexneri 2a str. 301
ucugcaauuuaccuu

SEQ ID NO: 1971176 - RNA, 17 nt, Shigella flexneri 2a str. 301
ucugcaauuuaccuuuc

SEQ ID NO: 1971177 - RNA, 18 nt, Shigella flexneri 2a str. 301
ucugcacaucuaaccauu

SEQ ID NO: 1971178 - RNA, 16 nt, Shigella flexneri 2a str. 301
ucugcaauuacugcau

SEQ ID NO: 1971179 - RNA, 23 nt, Shigella flexneri 2a str. 301
ucugcaaugcugcgaucagugca

SEQ ID NO: 1971180 - RNA, 14 nt, Shigella flexneri 2a str. 301
ucugcguaacccac

SEQ ID NO: 1971181 - RNA, 18 nt, Shigella flexneri 2a str. 301
ucugcggguuagucugca

SEQ ID NO: 1971182 - RNA, 18 nt, Shigella flexneri 2a str. 301
ucugcagcgcggcgagag

SEQ ID NO: 1971183 - RNA, 13 nt, Shigella flexneri 2a str. 301
ucugcgcuugguu

SEQ ID NO: 1971184 - RNA, 14 nt, Shigella flexneri 2a str. 301
ucugcgcgugcagu

SEQ ID NO: 1971185 - RNA, 13 nt, Shigella flexneri 2a str. 301
ucugcugaacagu

SEQ ID NO: 1971186 - RNA, 20 nt, Shigella flexneri 2a str. 301
ucugcucuucuuucaucaug

SEQ ID NO: 1971187 - RNA, 12 nt, Shigella flexneri 2a str. 301
ucugcguucuga

SEQ ID NO: 1971188 - RNA, 21 nt, Shigella flexneri 2a str. 301
ucuuacccuuccuuagcaaaa

SEQ ID NO: 1971189 - RNA, 14 nt, Shigella flexneri 2a str. 301
ucuuaccccugauu

SEQ ID NO: 1971190 - RNA, 14 nt, Shigella flexneri 2a str. 301
ucuguuccggcgua

SEQ ID NO: 1971191 - RNA, 15 nt, Shigella flexneri 2a str. 301
ucuguucaucuauac

SEQ ID NO: 1971192 - RNA, 13 nt, Shigella flexneri 2a str. 301
ucuguucagcaaa

SEQ ID NO: 1971193 - RNA, 13 nt, Shigella flexneri 2a str. 301
ucuuacauuccgu

SEQ ID NO: 1971194 - RNA, 21 nt, Shigella flexneri 2a str. 301
ucuguuaucacuuaacccauu

SEQ ID NO: 1971195 - RNA, 17 nt, Shigella flexneri 2a str. 301
ucuuacgcgaauaguuu

SEQ ID NO: 1971196 - RNA, 19 nt, Shigella flexneri 2a str. 301
ucuuacuaaguacauuaag

SEQ ID NO: 1971197 - RNA, 17 nt, Shigella flexneri 2a str. 301
ucuuacucuuucaauuu

SEQ ID NO: 1971198 - RNA, 13 nt, Shigella flexneri 2a str. 301
ucuuacuuuuaau

SEQ ID NO: 1971199 - RNA, 20 nt, Shigella flexneri 2a str. 301
ucuuacuucaacacauaacc

SEQ ID NO: 1971200 - RNA, 13 nt, Shigella flexneri 2a str. 301
ucuuaucaggccu

SEQ ID NO: 1971201 - RNA, 17 nt, Shigella flexneri 2a str. 301
ucuuaucaggccuacaa

SEQ ID NO: 1971202 - RNA, 13 nt, Shigella flexneri 2a str. 301
ucuuauaugauga

SEQ ID NO: 1971203 - RNA, 16 nt, Shigella flexneri 2a str. 301
ucuuagugcgccugau

SEQ ID NO: 1971204 - RNA, 17 nt, Shigella flexneri 2a str. 301
ucuuagugcgccugauc

SEQ ID NO: 1971205 - RNA, 15 nt, Shigella flexneri 2a str. 301
ucuuauaaagaaaau

SEQ ID NO: 1971206 - RNA, 19 nt, Shigella flexneri 2a str. 301
ucuuaugauguaaauaaca

SEQ ID NO: 1971207 - RNA, 21 nt, Shigella flexneri 2a str. 301
ucuuaucuggccuacuuuaau

SEQ ID NO: 1971208 - RNA, 20 nt, Shigella flexneri 2a str. 301
ucuuauccugcguuuguccg

SEQ ID NO: 1971209 - RNA, 17 nt, Shigella flexneri 2a str. 301
ucuuauccagcaaccag

SEQ ID NO: 1971210 - RNA, 19 nt, Shigella flexneri 2a str. 301
ucuuauccggccuuccugu

SEQ ID NO: 1971211 - RNA, 17 nt, Shigella flexneri 2a str. 301
ucuuaucaugccuacau

SEQ ID NO: 1971212 - RNA, 19 nt, Shigella flexneri 2a str. 301
ucuuaucaguauacgccac

SEQ ID NO: 1971213 - RNA, 15 nt, Shigella flexneri 2a str. 301
ucuucacaucaucau

SEQ ID NO: 1971214 - RNA, 16 nt, Shigella flexneri 2a str. 301
ucuucaacgaagaaaa

SEQ ID NO: 1971215 - RNA, 22 nt, Shigella flexneri 2a str. 301
ucuucaacacacugaauaaaaa

SEQ ID NO: 1971216 - RNA, 14 nt, Shigella flexneri 2a str. 301
ucuucaacugccau

SEQ ID NO: 1971217 - RNA, 19 nt, Shigella flexneri 2a str. 301
ucuucaacugccaugaccg

SEQ ID NO: 1971218 - RNA, 18 nt, Shigella flexneri 2a str. 301
ucuucaacuucagcagca

SEQ ID NO: 1971219 - RNA, 13 nt, Shigella flexneri 2a str. 301
ucuucaacuucag

SEQ ID NO: 1971220 - RNA, 17 nt, Shigella flexneri 2a str. 301
ucuucaacuucagcagc

SEQ ID NO: 1971221 - RNA, 16 nt, Shigella flexneri 2a str. 301
ucuucaagaauacugu

SEQ ID NO: 1971222 - RNA, 20 nt, Shigella flexneri 2a str. 301
ucuucaaccgucaccagccc

SEQ ID NO: 1971223 - RNA, 18 nt, Shigella flexneri 2a str. 301
ucuucaacaauugaagaa

SEQ ID NO: 1971224 - RNA, 17 nt, Shigella flexneri 2a str. 301
ucuucaaaaaagucaga

SEQ ID NO: 1971225 - RNA, 13 nt, Shigella flexneri 2a str. 301
ucuuauuucacua

SEQ ID NO: 1971226 - RNA, 15 nt, Shigella flexneri 2a str. 301
ucuucacgcccgccc

SEQ ID NO: 1971227 - RNA, 19 nt, Shigella flexneri 2a str. 301
ucuucacguuuuucgaaaa

SEQ ID NO: 1971228 - RNA, 15 nt, Shigella flexneri 2a str. 301
ucuucacuucuucaa

SEQ ID NO: 1971229 - RNA, 20 nt, Shigella flexneri 2a str. 301
ucuuccagaauaaacaacug

SEQ ID NO: 1971230 - RNA, 20 nt, Shigella flexneri 2a str. 301
ucuucaugccucguuucccu

SEQ ID NO: 1971231 - RNA, 15 nt, Shigella flexneri 2a str. 301
ucuucaucauccucu

SEQ ID NO: 1971232 - RNA, 17 nt, Shigella flexneri 2a str. 301
ucuucaucauccucuuc

SEQ ID NO: 1971233 - RNA, 13 nt, Shigella flexneri 2a str. 301
ucuucaucauccu

SEQ ID NO: 1971234 - RNA, 12 nt, Shigella flexneri 2a str. 301
ucuucaucaucc

SEQ ID NO: 1971235 - RNA, 17 nt, Shigella flexneri 2a str. 301
ucuucaucgcuaaaaua

SEQ ID NO: 1971236 - RNA, 17 nt, Shigella flexneri 2a str. 301
ugaaacugauaauuuuc

SEQ ID NO: 1971237 - RNA, 22 nt, Shigella flexneri 2a str. 301
ugaaagaaaaucaauccagugu

SEQ ID NO: 1971238 - RNA, 14 nt, Shigella flexneri 2a str. 301
ugaaacucacgcag

SEQ ID NO: 1971239 - RNA, 17 nt, Shigella flexneri 2a str. 301
ugaaacucgcugccagc

SEQ ID NO: 1971240 - RNA, 19 nt, Shigella flexneri 2a str. 301
ugaaacggaugccaaucac

SEQ ID NO: 1971241 - RNA, 17 nt, Shigella flexneri 2a str. 301
ugaaacgucacccagga

SEQ ID NO: 1971242 - RNA, 15 nt, Shigella flexneri 2a str. 301
ugaaacgaaaucuug

SEQ ID NO: 1971243 - RNA, 14 nt, Shigella flexneri 2a str. 301
ugaaacgaaaucuu

SEQ ID NO: 1971244 - RNA, 16 nt, Shigella flexneri 2a str. 301
ugaaaccuuuaugcag

SEQ ID NO: 1971245 - RNA, 15 nt, Shigella flexneri 2a str. 301
ugaaauaaaaauaag

SEQ ID NO: 1971246 - RNA, 16 nt, Shigella flexneri 2a str. 301
ugaaauaaaaauaaga

SEQ ID NO: 1971247 - RNA, 17 nt, Shigella flexneri 2a str. 301
ugaaauaaaaauaagaa

SEQ ID NO: 1971248 - RNA, 22 nt, Shigella flexneri 2a str. 301
ugaaagccccaccagcaaauau

SEQ ID NO: 1971249 - RNA, 16 nt, Shigella flexneri 2a str. 301
ugaaagcgugucaugu

SEQ ID NO: 1971250 - RNA, 19 nt, Shigella flexneri 2a str. 301
ugaaagcguuguguuuuuu

SEQ ID NO: 1971251 - RNA, 15 nt, Shigella flexneri 2a str. 301
ugaaagggcaaauaa

SEQ ID NO: 1971252 - RNA, 15 nt, Shigella flexneri 2a str. 301
ugaaaggcuucccaa

SEQ ID NO: 1971253 - RNA, 16 nt, Shigella flexneri 2a str. 301
ugaaaguaaaaaagaa

SEQ ID NO: 1971254 - RNA, 18 nt, Shigella flexneri 2a str. 301
ugaaagcugaacaaagcc

SEQ ID NO: 1971255 - RNA, 12 nt, Shigella flexneri 2a str. 301
ugaaaggaaaaa

SEQ ID NO: 1971256 - RNA, 14 nt, Shigella flexneri 2a str. 301
ugaaaggaaaaaau

SEQ ID NO: 1971257 - RNA, 14 nt, Shigella flexneri 2a str. 301
ugaaaauuauaucu

SEQ ID NO: 1971258 - RNA, 23 nt, Shigella flexneri 2a str. 301
ugaaacaagaaguuauccuggua

SEQ ID NO: 1971259 - RNA, 20 nt, Shigella flexneri 2a str. 301
ugaaacaacguggaacaaau

SEQ ID NO: 1971260 - RNA, 17 nt, Shigella flexneri 2a str. 301
ugaaacaggggcuggaa

SEQ ID NO: 1971261 - RNA, 18 nt, Shigella flexneri 2a str. 301
ugaaacaggggcuggaag

SEQ ID NO: 1971262 - RNA, 17 nt, Shigella flexneri 2a str. 301
ugaaaaguccaggcugc

SEQ ID NO: 1971263 - RNA, 18 nt, Shigella flexneri 2a str. 301
ugaaaagguugccugucu

SEQ ID NO: 1971264 - RNA, 21 nt, Shigella flexneri 2a str. 301
ugaaaaccggacugaaaguac

SEQ ID NO: 1971265 - RNA, 22 nt, Shigella flexneri 2a str. 301
ugaaaacccuauuuuuggaggu

SEQ ID NO: 1971266 - RNA, 18 nt, Shigella flexneri 2a str. 301
ugaaaaaucaaaaaacug

SEQ ID NO: 1971267 - RNA, 20 nt, Shigella flexneri 2a str. 301
ugaaaaagccaaaacugcac

SEQ ID NO: 1971268 - RNA, 19 nt, Shigella flexneri 2a str. 301
ugaaaacgcauaccagucu

SEQ ID NO: 1971269 - RNA, 20 nt, Shigella flexneri 2a str. 301
ugaaaacgccggagugaaaa

SEQ ID NO: 1971270 - RNA, 17 nt, Shigella flexneri 2a str. 301
ugaaaaccucucuggaa

SEQ ID NO: 1971271 - RNA, 14 nt, Shigella flexneri 2a str. 301
ugaaaacgaaggcc

SEQ ID NO: 1971272 - RNA, 17 nt, Shigella flexneri 2a str. 301
ugaaaagaguaguaauu

SEQ ID NO: 1971273 - RNA, 21 nt, Shigella flexneri 2a str. 301
ugaaaagaguaguaauugcuu

SEQ ID NO: 1971274 - RNA, 20 nt, Shigella flexneri 2a str. 301
ugaaaaggucacucccggau

SEQ ID NO: 1971275 - RNA, 13 nt, Shigella flexneri 2a str. 301
ugaacccugaagg

SEQ ID NO: 1971276 - RNA, 21 nt, Shigella flexneri 2a str. 301
ugaacccugaaggacgccaga

SEQ ID NO: 1971277 - RNA, 21 nt, Shigella flexneri 2a str. 301
ugaaccgguaugaauuugcag

SEQ ID NO: 1971278 - RNA, 16 nt, Shigella flexneri 2a str. 301
ugaacauugcugcuga

SEQ ID NO: 1971279 - RNA, 18 nt, Shigella flexneri 2a str. 301
ugaacauuuucuucugcc

SEQ ID NO: 1971280 - RNA, 13 nt, Shigella flexneri 2a str. 301
ugaacauuuucuu

SEQ ID NO: 1971281 - RNA, 14 nt, Shigella flexneri 2a str. 301
ugaacauugcugcu

SEQ ID NO: 1971282 - RNA, 17 nt, Shigella flexneri 2a str. 301
ugaaccagacugcacau

SEQ ID NO: 1971283 - RNA, 21 nt, Shigella flexneri 2a str. 301
ugaaccagacugcacauggcg

SEQ ID NO: 1971284 - RNA, 15 nt, Shigella flexneri 2a str. 301
ugaacgcccccucac

SEQ ID NO: 1971285 - RNA, 17 nt, Shigella flexneri 2a str. 301
ugaacgccaaauucuuu

SEQ ID NO: 1971286 - RNA, 18 nt, Shigella flexneri 2a str. 301
ugaacgagucaacgcuuc

SEQ ID NO: 1971287 - RNA, 22 nt, Shigella flexneri 2a str. 301
ugaacgaccuccacucucgaaa

SEQ ID NO: 1971288 - RNA, 22 nt, Shigella flexneri 2a str. 301
ugaaccugccgccuuaaaccuc

SEQ ID NO: 1971289 - RNA, 12 nt, Shigella flexneri 2a str. 301
ugaacaaccaga

SEQ ID NO: 1971290 - RNA, 12 nt, Shigella flexneri 2a str. 301
ugaacaaagccg

SEQ ID NO: 1971291 - RNA, 13 nt, Shigella flexneri 2a str. 301
ugaacaagcaaga

SEQ ID NO: 1971292 - RNA, 23 nt, Shigella flexneri 2a str. 301
ugaacaaguauaucaaacagugg

SEQ ID NO: 1971293 - RNA, 16 nt, Shigella flexneri 2a str. 301
ugaacacacccggaga

SEQ ID NO: 1971294 - RNA, 19 nt, Shigella flexneri 2a str. 301
ugaacagaccacauuccag

SEQ ID NO: 1971295 - RNA, 15 nt, Shigella flexneri 2a str. 301
ugaacaccuucucag

SEQ ID NO: 1971296 - RNA, 20 nt, Shigella flexneri 2a str. 301
ugaacaccaaacccugagug

SEQ ID NO: 1971297 - RNA, 15 nt, Shigella flexneri 2a str. 301
ugaacauaaucugca

SEQ ID NO: 1971298 - RNA, 12 nt, Shigella flexneri 2a str. 301
ugaacagccaga

SEQ ID NO: 1971299 - RNA, 22 nt, Shigella flexneri 2a str. 301
ugaacagcagaacaucagcugg

SEQ ID NO: 1971300 - RNA, 14 nt, Shigella flexneri 2a str. 301
ugaaauugcugguu

SEQ ID NO: 1971301 - RNA, 19 nt, Shigella flexneri 2a str. 301
ugaaauugugauaaaaauc

SEQ ID NO: 1971302 - RNA, 14 nt, Shigella flexneri 2a str. 301
ugaacaaaaaagag

SEQ ID NO: 1971303 - RNA, 17 nt, Shigella flexneri 2a str. 301
ugaacaaaaaagaguaa

SEQ ID NO: 1971304 - RNA, 14 nt, Shigella flexneri 2a str. 301
ugaaauuccaucac

SEQ ID NO: 1971305 - RNA, 14 nt, Shigella flexneri 2a str. 301
ugaaaugaaaauca

SEQ ID NO: 1971306 - RNA, 22 nt, Shigella flexneri 2a str. 301
ugaaaugccaaauauuucuuua

SEQ ID NO: 1971307 - RNA, 19 nt, Shigella flexneri 2a str. 301
ugaaaucugaaaucaucaa

SEQ ID NO: 1971308 - RNA, 16 nt, Shigella flexneri 2a str. 301
ugaaaucugaaaucau

SEQ ID NO: 1971309 - RNA, 23 nt, Shigella flexneri 2a str. 301
ugaaaucagcacauaagucagcc

SEQ ID NO: 1971310 - RNA, 16 nt, Shigella flexneri 2a str. 301
ugaaaucgaacagguu

SEQ ID NO: 1971311 - RNA, 15 nt, Shigella flexneri 2a str. 301
ugaaauaaugcagcg

SEQ ID NO: 1971312 - RNA, 14 nt, Shigella flexneri 2a str. 301
ugaaaucacgcauc

SEQ ID NO: 1971313 - RNA, 12 nt, Shigella flexneri 2a str. 301
ugaaaucacuaa

SEQ ID NO: 1971314 - RNA, 22 nt, Shigella flexneri 2a str. 301
ugaaauaguugcauuccagucc

SEQ ID NO: 1971315 - RNA, 21 nt, Shigella flexneri 2a str. 301
ucuuguucauagugccugaug

SEQ ID NO: 1971316 - RNA, 15 nt, Shigella flexneri 2a str. 301
ucuuggcugcucauu

SEQ ID NO: 1971317 - RNA, 18 nt, Shigella flexneri 2a str. 301
ucuugcugauacuccuca

SEQ ID NO: 1971318 - RNA, 23 nt, Shigella flexneri 2a str. 301
ucuugcuggcauuacaagaauca

SEQ ID NO: 1971319 - RNA, 15 nt, Shigella flexneri 2a str. 301
ucuucccgccuguca

SEQ ID NO: 1971320 - RNA, 22 nt, Shigella flexneri 2a str. 301
ucuuccagcguuucaaguguac

SEQ ID NO: 1971321 - RNA, 19 nt, Shigella flexneri 2a str. 301
ucuuccagcgugucaaaug

SEQ ID NO: 1971322 - RNA, 14 nt, Shigella flexneri 2a str. 301
ucuuccagucgccu

SEQ ID NO: 1971323 - RNA, 23 nt, Shigella flexneri 2a str. 301
ucuuccagcgcaaggaaauaacg

SEQ ID NO: 1971324 - RNA, 14 nt, Shigella flexneri 2a str. 301
ucuuccagcaucag

SEQ ID NO: 1971325 - RNA, 21 nt, Shigella flexneri 2a str. 301
ucuuccagaucaccgcagaag

SEQ ID NO: 1971326 - RNA, 18 nt, Shigella flexneri 2a str. 301
ucuucccagccaaugcag

SEQ ID NO: 1971327 - RNA, 14 nt, Shigella flexneri 2a str. 301
ucuucccagccccc

SEQ ID NO: 1971328 - RNA, 21 nt, Shigella flexneri 2a str. 301
ucuucccagguuucaaugccg

SEQ ID NO: 1971329 - RNA, 15 nt, Shigella flexneri 2a str. 301
ucuuccaucacaaag

SEQ ID NO: 1971330 - RNA, 19 nt, Shigella flexneri 2a str. 301
ucuuccauaaucgacuccc

SEQ ID NO: 1971331 - RNA, 14 nt, Shigella flexneri 2a str. 301
ucuuucuaugagaa

SEQ ID NO: 1971332 - RNA, 15 nt, Shigella flexneri 2a str. 301
ucuuucuaugagaaa

SEQ ID NO: 1971333 - RNA, 11 nt, Shigella flexneri 2a str. 301
ucuuucucauc

SEQ ID NO: 1971334 - RNA, 20 nt, Shigella flexneri 2a str. 301
ucuuucucgccuuucuuaaa

SEQ ID NO: 1971335 - RNA, 17 nt, Shigella flexneri 2a str. 301
ucuuucugccaccagua

SEQ ID NO: 1971336 - RNA, 21 nt, Shigella flexneri 2a str. 301
ucuuucucugcaaauauuaau

SEQ ID NO: 1971337 - RNA, 19 nt, Shigella flexneri 2a str. 301
ucuuucgcccaauaaaaaa

SEQ ID NO: 1971338 - RNA, 22 nt, Shigella flexneri 2a str. 301
ucuuucauauucaauuugcaau

SEQ ID NO: 1971339 - RNA, 18 nt, Shigella flexneri 2a str. 301
ucuuucacggccacucug

SEQ ID NO: 1971340 - RNA, 20 nt, Shigella flexneri 2a str. 301
ucuuucacggccacucugcc

SEQ ID NO: 1971341 - RNA, 18 nt, Shigella flexneri 2a str. 301
ucuuucacgaacacagug

SEQ ID NO: 1971342 - RNA, 11 nt, Shigella flexneri 2a str. 301
ucuuucaguac

SEQ ID NO: 1971343 - RNA, 12 nt, Shigella flexneri 2a str. 301
ucuuuaaugaca

SEQ ID NO: 1971344 - RNA, 13 nt, Shigella flexneri 2a str. 301
ucuuuaucaauca

SEQ ID NO: 1971345 - RNA, 23 nt, Shigella flexneri 2a str. 301
ucuuuaucaccaaugauaaguuu

SEQ ID NO: 1971346 - RNA, 13 nt, Shigella flexneri 2a str. 301
ucuuuauccugac

SEQ ID NO: 1971347 - RNA, 11 nt, Shigella flexneri 2a str. 301
ucuuuaucugc

SEQ ID NO: 1971348 - RNA, 17 nt, Shigella flexneri 2a str. 301
ucuuugcagcuuugcug

SEQ ID NO: 1971349 - RNA, 21 nt, Shigella flexneri 2a str. 301
ucuuugauugaagaaaucagu

SEQ ID NO: 1971350 - RNA, 12 nt, Shigella flexneri 2a str. 301
ucuuugccugau

SEQ ID NO: 1971351 - RNA, 23 nt, Shigella flexneri 2a str. 301
ucuuugccugaucggugaaagua

SEQ ID NO: 1971352 - RNA, 14 nt, Shigella flexneri 2a str. 301
ucuuuggcaucaau

SEQ ID NO: 1971353 - RNA, 19 nt, Shigella flexneri 2a str. 301
ucuuuguauuuauuuucag

SEQ ID NO: 1971354 - RNA, 20 nt, Shigella flexneri 2a str. 301
ucuuuguguugcugaacuua

SEQ ID NO: 1971355 - RNA, 13 nt, Shigella flexneri 2a str. 301
ucuuuguucggca

SEQ ID NO: 1971356 - RNA, 19 nt, Shigella flexneri 2a str. 301
ucuuuuacagcgccagaag

SEQ ID NO: 1971357 - RNA, 22 nt, Shigella flexneri 2a str. 301
ucuuuuacaucuacaaaaaacu

SEQ ID NO: 1971358 - RNA, 14 nt, Shigella flexneri 2a str. 301
ucuuuucacgcaau

SEQ ID NO: 1971359 - RNA, 15 nt, Shigella flexneri 2a str. 301
ucuuuuuucacuggc

SEQ ID NO: 1971360 - RNA, 20 nt, Shigella flexneri 2a str. 301
ucuuuuugggguuuuaauuc

SEQ ID NO: 1971361 - RNA, 19 nt, Shigella flexneri 2a str. 301
ucuuuuuuuauuaaaugug

SEQ ID NO: 1971362 - RNA, 22 nt, Shigella flexneri 2a str. 301
ucuuuuuuguucaguucagaaa

SEQ ID NO: 1971363 - RNA, 15 nt, Shigella flexneri 2a str. 301
ugaaaaaaccagaaa

SEQ ID NO: 1971364 - RNA, 13 nt, Shigella flexneri 2a str. 301
ucuuuuccuuucg

SEQ ID NO: 1971365 - RNA, 23 nt, Shigella flexneri 2a str. 301
ucuuuugcuaucgggaauauuaa

SEQ ID NO: 1971366 - RNA, 16 nt, Shigella flexneri 2a str. 301
ucggcaaaaucuucca

SEQ ID NO: 1971367 - RNA, 19 nt, Shigella flexneri 2a str. 301
ucggcaaagcgcugaagaa

SEQ ID NO: 1971368 - RNA, 13 nt, Shigella flexneri 2a str. 301
ucggaugcagaac

SEQ ID NO: 1971369 - RNA, 12 nt, Shigella flexneri 2a str. 301
ucggccaugggc

SEQ ID NO: 1971370 - RNA, 18 nt, Shigella flexneri 2a str. 301
ucggccaguaaccuuuca

SEQ ID NO: 1971371 - RNA, 23 nt, Shigella flexneri 2a str. 301
ucggcgaaacugaccugcggcac

SEQ ID NO: 1971372 - RNA, 15 nt, Shigella flexneri 2a str. 301
ucgcugugcugcuga

SEQ ID NO: 1971373 - RNA, 17 nt, Shigella flexneri 2a str. 301
ucgcuguguaaacccag

SEQ ID NO: 1971374 - RNA, 13 nt, Shigella flexneri 2a str. 301
ucgcuggucagcg

SEQ ID NO: 1971375 - RNA, 15 nt, Shigella flexneri 2a str. 301
ucgcuguauuuugcg

SEQ ID NO: 1971376 - RNA, 17 nt, Shigella flexneri 2a str. 301
ucgcuguauuuugcguu

SEQ ID NO: 1971377 - RNA, 12 nt, Shigella flexneri 2a str. 301
ucgcuggcagac

SEQ ID NO: 1971378 - RNA, 21 nt, Shigella flexneri 2a str. 301
ucgcuggcgucggauauaaaa

SEQ ID NO: 1971379 - RNA, 22 nt, Shigella flexneri 2a str. 301
ucgcugcuaauuuaucggcguu

SEQ ID NO: 1971380 - RNA, 15 nt, Shigella flexneri 2a str. 301
ucgcugcugguucug

SEQ ID NO: 1971381 - RNA, 19 nt, Shigella flexneri 2a str. 301
ucgcgcagauagagcgccu

SEQ ID NO: 1971382 - RNA, 14 nt, Shigella flexneri 2a str. 301
ucgcgcacggugca

SEQ ID NO: 1971383 - RNA, 19 nt, Shigella flexneri 2a str. 301
ucgcgcacuaugugccagc

SEQ ID NO: 1971384 - RNA, 17 nt, Shigella flexneri 2a str. 301
ucgcuuaacgcccaugc

SEQ ID NO: 1971385 - RNA, 20 nt, Shigella flexneri 2a str. 301
ucgcuguuuuuacucggucu

SEQ ID NO: 1971386 - RNA, 18 nt, Shigella flexneri 2a str. 301
ucgcuugcucgcgcaccu

SEQ ID NO: 1971387 - RNA, 20 nt, Shigella flexneri 2a str. 301
ucgcuuuuucugcaucaacc

SEQ ID NO: 1971388 - RNA, 21 nt, Shigella flexneri 2a str. 301
ucgcuuuccagucguuaugca

SEQ ID NO: 1971389 - RNA, 13 nt, Shigella flexneri 2a str. 301
ucgcuuuccaggu

SEQ ID NO: 1971390 - RNA, 13 nt, Shigella flexneri 2a str. 301
ucgcuuucucuuc

SEQ ID NO: 1971391 - RNA, 18 nt, Shigella flexneri 2a str. 301
ucggagagaaaagcaaaa

SEQ ID NO: 1971392 - RNA, 17 nt, Shigella flexneri 2a str. 301
ucggaucggcaaugaga

SEQ ID NO: 1971393 - RNA, 22 nt, Shigella flexneri 2a str. 301
ucggauaaggcgcucgcgccgc

SEQ ID NO: 1971394 - RNA, 23 nt, Shigella flexneri 2a str. 301
ucggcguucauccugcuggugcc

SEQ ID NO: 1971395 - RNA, 14 nt, Shigella flexneri 2a str. 301
ucggcuauggcgua

SEQ ID NO: 1971396 - RNA, 20 nt, Shigella flexneri 2a str. 301
ucggcugacgauaccaggug

SEQ ID NO: 1971397 - RNA, 15 nt, Shigella flexneri 2a str. 301
ucggcugccagccau

SEQ ID NO: 1971398 - RNA, 20 nt, Shigella flexneri 2a str. 301
ucggcgcauaaugccugaug

SEQ ID NO: 1971399 - RNA, 13 nt, Shigella flexneri 2a str. 301
ucggcggcgugcc

SEQ ID NO: 1971400 - RNA, 14 nt, Shigella flexneri 2a str. 301
ucggcggcuggcug

SEQ ID NO: 1971401 - RNA, 22 nt, Shigella flexneri 2a str. 301
ucggcgcggcgguugacgcccc

SEQ ID NO: 1971402 - RNA, 21 nt, Shigella flexneri 2a str. 301
ucgggcaacguugaccaguca

SEQ ID NO: 1971403 - RNA, 13 nt, Shigella flexneri 2a str. 301
ucgggcagcaucg

SEQ ID NO: 1971404 - RNA, 14 nt, Shigella flexneri 2a str. 301
ucgggaaccggcug

SEQ ID NO: 1971405 - RNA, 22 nt, Shigella flexneri 2a str. 301
ucgggaaaaucugcgggaacau

SEQ ID NO: 1971406 - RNA, 13 nt, Shigella flexneri 2a str. 301
ucgggaaauaaca

SEQ ID NO: 1971407 - RNA, 22 nt, Shigella flexneri 2a str. 301
ucgggaaggcccuuccccuucu

SEQ ID NO: 1971408 - RNA, 20 nt, Shigella flexneri 2a str. 301
ucggggcggcuaucccaaag

SEQ ID NO: 1971409 - RNA, 23 nt, Shigella flexneri 2a str. 301
ucggggcgaucgcgccaaucagc

SEQ ID NO: 1971410 - RNA, 16 nt, Shigella flexneri 2a str. 301
ucgggccgucuggcug

SEQ ID NO: 1971411 - RNA, 21 nt, Shigella flexneri 2a str. 301
ucgggcguuucgccaggacag

SEQ ID NO: 1971412 - RNA, 18 nt, Shigella flexneri 2a str. 301
ucguaagccgugaaaaca

SEQ ID NO: 1971413 - RNA, 14 nt, Shigella flexneri 2a str. 301
ucgguuuucaaucg

SEQ ID NO: 1971414 - RNA, 13 nt, Shigella flexneri 2a str. 301
ucggugugcagcg

SEQ ID NO: 1971415 - RNA, 19 nt, Shigella flexneri 2a str. 301
ucggugucguuacgccgca

SEQ ID NO: 1971416 - RNA, 21 nt, Shigella flexneri 2a str. 301
ucggugcacaauugccggaug

SEQ ID NO: 1971417 - RNA, 20 nt, Shigella flexneri 2a str. 301
ucggugcacgaugccugaug

SEQ ID NO: 1971418 - RNA, 14 nt, Shigella flexneri 2a str. 301
ucggugcaaaugcc

SEQ ID NO: 1971419 - RNA, 14 nt, Shigella flexneri 2a str. 301
ucggugaugaaccc

SEQ ID NO: 1971420 - RNA, 17 nt, Shigella flexneri 2a str. 301
ucgguauuuccauuuuu

SEQ ID NO: 1971421 - RNA, 23 nt, Shigella flexneri 2a str. 301
ucggguuuacgugcacaggcaac

SEQ ID NO: 1971422 - RNA, 11 nt, Shigella flexneri 2a str. 301
ucggucacagu

SEQ ID NO: 1971423 - RNA, 19 nt, Shigella flexneri 2a str. 301
ucggucacugacaccagca

SEQ ID NO: 1971424 - RNA, 14 nt, Shigella flexneri 2a str. 301
ucguacgaaagugc

SEQ ID NO: 1971425 - RNA, 14 nt, Shigella flexneri 2a str. 301
ucguauagaucacu

SEQ ID NO: 1971426 - RNA, 17 nt, Shigella flexneri 2a str. 301
ucguaaugcuccggcuc

SEQ ID NO: 1971427 - RNA, 14 nt, Shigella flexneri 2a str. 301
ucguaauuuuucgg

SEQ ID NO: 1971428 - RNA, 16 nt, Shigella flexneri 2a str. 301
ucgucccaaaagcucg

SEQ ID NO: 1971429 - RNA, 15 nt, Shigella flexneri 2a str. 301
ucgugaaaggaaaaa

SEQ ID NO: 1971430 - RNA, 22 nt, Shigella flexneri 2a str. 301
ucgugaacauguccuuucaggg

SEQ ID NO: 1971431 - RNA, 16 nt, Shigella flexneri 2a str. 301
ucgucguuuauauaga

SEQ ID NO: 1971432 - RNA, 16 nt, Shigella flexneri 2a str. 301
ucgucguacugaccgu

SEQ ID NO: 1971433 - RNA, 15 nt, Shigella flexneri 2a str. 301
ucguccgcguccagc

SEQ ID NO: 1971434 - RNA, 14 nt, Shigella flexneri 2a str. 301
ucgucgccagacca

SEQ ID NO: 1971435 - RNA, 15 nt, Shigella flexneri 2a str. 301
ucuaacucuucugaa

SEQ ID NO: 1971436 - RNA, 16 nt, Shigella flexneri 2a str. 301
ucuaacucuucugaaa

SEQ ID NO: 1971437 - RNA, 15 nt, Shigella flexneri 2a str. 301
ucuaaauguucaaua

SEQ ID NO: 1971438 - RNA, 15 nt, Shigella flexneri 2a str. 301
ucuacaaaagauuau

SEQ ID NO: 1971439 - RNA, 22 nt, Shigella flexneri 2a str. 301
ucuaauuuuuugcgccacuuuu

SEQ ID NO: 1971440 - RNA, 21 nt, Shigella flexneri 2a str. 301
ucuacaaccagcuuaugccug

SEQ ID NO: 1971441 - RNA, 15 nt, Shigella flexneri 2a str. 301
ucguuaaauucuaau

SEQ ID NO: 1971442 - RNA, 22 nt, Shigella flexneri 2a str. 301
ucguucauaccacgccaucaac

SEQ ID NO: 1971443 - RNA, 12 nt, Shigella flexneri 2a str. 301
ucguucuucccu

SEQ ID NO: 1971444 - RNA, 13 nt, Shigella flexneri 2a str. 301
ucguucgcugcau

SEQ ID NO: 1971445 - RNA, 18 nt, Shigella flexneri 2a str. 301
ucguugguguccacgccg

SEQ ID NO: 1971446 - RNA, 15 nt, Shigella flexneri 2a str. 301
ucguuguaacugucu

SEQ ID NO: 1971447 - RNA, 12 nt, Shigella flexneri 2a str. 301
uccuucagcaac

SEQ ID NO: 1971448 - RNA, 20 nt, Shigella flexneri 2a str. 301
uccuucaucuucaacugcca

SEQ ID NO: 1971449 - RNA, 16 nt, Shigella flexneri 2a str. 301
uccuucacacugccuc

SEQ ID NO: 1971450 - RNA, 19 nt, Shigella flexneri 2a str. 301
uccuucacuuuugccagac

SEQ ID NO: 1971451 - RNA, 21 nt, Shigella flexneri 2a str. 301
uccuucgauaaaagccauccc

SEQ ID NO: 1971452 - RNA, 16 nt, Shigella flexneri 2a str. 301
uccuucgauaaaagcc

SEQ ID NO: 1971453 - RNA, 22 nt, Shigella flexneri 2a str. 301
uccuuccuuggauauuuuaauc

SEQ ID NO: 1971454 - RNA, 13 nt, Shigella flexneri 2a str. 301
uccuuccagguca

SEQ ID NO: 1971455 - RNA, 15 nt, Shigella flexneri 2a str. 301
uccuuacugcccccg

SEQ ID NO: 1971456 - RNA, 23 nt, Shigella flexneri 2a str. 301
uccuuagcaacaggccaguucga

SEQ ID NO: 1971457 - RNA, 11 nt, Shigella flexneri 2a str. 301
uccuuaauaaa

SEQ ID NO: 1971458 - RNA, 13 nt, Shigella flexneri 2a str. 301
uccuucaacccgc

SEQ ID NO: 1971459 - RNA, 16 nt, Shigella flexneri 2a str. 301
uccuucugucaugauu

SEQ ID NO: 1971460 - RNA, 17 nt, Shigella flexneri 2a str. 301
uccuucggauuuccguu

SEQ ID NO: 1971461 - RNA, 19 nt, Shigella flexneri 2a str. 301
uccuucuauaaggccccuu

SEQ ID NO: 1971462 - RNA, 23 nt, Shigella flexneri 2a str. 301
uccuucuauaaggccccuuccuc

SEQ ID NO: 1971463 - RNA, 21 nt, Shigella flexneri 2a str. 301
uccuugcgcuuucuuaaauua

SEQ ID NO: 1971464 - RNA, 17 nt, Shigella flexneri 2a str. 301
uccugcggcgacaaaug

SEQ ID NO: 1971465 - RNA, 20 nt, Shigella flexneri 2a str. 301
uccugcggaugcgccaucca

SEQ ID NO: 1971466 - RNA, 21 nt, Shigella flexneri 2a str. 301
uccugcggcagacgcucgcca

SEQ ID NO: 1971467 - RNA, 23 nt, Shigella flexneri 2a str. 301
uccugcggcagacgcucgccauu

SEQ ID NO: 1971468 - RNA, 18 nt, Shigella flexneri 2a str. 301
uccugcucaaguaauaaa

SEQ ID NO: 1971469 - RNA, 19 nt, Shigella flexneri 2a str. 301
uccugcgugacuaaaaccc

SEQ ID NO: 1971470 - RNA, 16 nt, Shigella flexneri 2a str. 301
uccugcgcuuccagcu

SEQ ID NO: 1971471 - RNA, 18 nt, Shigella flexneri 2a str. 301
uccugcggagcaaccugc

SEQ ID NO: 1971472 - RNA, 19 nt, Shigella flexneri 2a str. 301
uccugcauugacucgccuu

SEQ ID NO: 1971473 - RNA, 13 nt, Shigella flexneri 2a str. 301
uccugcgcuucca

SEQ ID NO: 1971474 - RNA, 15 nt, Shigella flexneri 2a str. 301
uccugcagcguugcc

SEQ ID NO: 1971475 - RNA, 18 nt, Shigella flexneri 2a str. 301
uccugcagcuucacggaa

SEQ ID NO: 1971476 - RNA, 22 nt, Shigella flexneri 2a str. 301
uccugcacggcuucccacguca

SEQ ID NO: 1971477 - RNA, 21 nt, Shigella flexneri 2a str. 301
ucagcgaguuuuucaguccac

SEQ ID NO: 1971478 - RNA, 17 nt, Shigella flexneri 2a str. 301
ucagcgagagcaaugcg

SEQ ID NO: 1971479 - RNA, 14 nt, Shigella flexneri 2a str. 301
ucagcgcaaagagu

SEQ ID NO: 1971480 - RNA, 17 nt, Shigella flexneri 2a str. 301
ucagcgcaaagagugaa

SEQ ID NO: 1971481 - RNA, 19 nt, Shigella flexneri 2a str. 301
ucagcgcaaagagugaagu

SEQ ID NO: 1971482 - RNA, 16 nt, Shigella flexneri 2a str. 301
ucagcgaucagcauuu

SEQ ID NO: 1971483 - RNA, 19 nt, Shigella flexneri 2a str. 301
uccuggaucacaauccgcu

SEQ ID NO: 1971484 - RNA, 19 nt, Shigella flexneri 2a str. 301
uccugcugcacgcccugau

SEQ ID NO: 1971485 - RNA, 12 nt, Shigella flexneri 2a str. 301
uccugcuggugc

SEQ ID NO: 1971486 - RNA, 15 nt, Shigella flexneri 2a str. 301
uccuguaugacccgg

SEQ ID NO: 1971487 - RNA, 20 nt, Shigella flexneri 2a str. 301
uccuguaucgucacugguuc

SEQ ID NO: 1971488 - RNA, 18 nt, Shigella flexneri 2a str. 301
uccuguauuguuccacuc

SEQ ID NO: 1971489 - RNA, 20 nt, Shigella flexneri 2a str. 301
uccuggcccggaauggugcu

SEQ ID NO: 1971490 - RNA, 18 nt, Shigella flexneri 2a str. 301
uccuguaaugagaauaau

SEQ ID NO: 1971491 - RNA, 13 nt, Shigella flexneri 2a str. 301
uccuuaauaaaau

SEQ ID NO: 1971492 - RNA, 16 nt, Shigella flexneri 2a str. 301
uccuuaauaaaauacu

SEQ ID NO: 1971493 - RNA, 20 nt, Shigella flexneri 2a str. 301
uccuguggacgcagcucaua

SEQ ID NO: 1971494 - RNA, 16 nt, Shigella flexneri 2a str. 301
uccuguacuguuucac

SEQ ID NO: 1971495 - RNA, 16 nt, Shigella flexneri 2a str. 301
uccugucuucccugcu

SEQ ID NO: 1971496 - RNA, 15 nt, Shigella flexneri 2a str. 301
uccugucuucccugc

SEQ ID NO: 1971497 - RNA, 14 nt, Shigella flexneri 2a str. 301
uccugucuucccug

SEQ ID NO: 1971498 - RNA, 20 nt, Shigella flexneri 2a str. 301
uccugugacucaaugaaauc

SEQ ID NO: 1971499 - RNA, 14 nt, Shigella flexneri 2a str. 301
ucgaaguuuuccuc

SEQ ID NO: 1971500 - RNA, 17 nt, Shigella flexneri 2a str. 301
ucgaacauacacaagcc

SEQ ID NO: 1971501 - RNA, 16 nt, Shigella flexneri 2a str. 301
ucgaacauacgcugca

SEQ ID NO: 1971502 - RNA, 14 nt, Shigella flexneri 2a str. 301
ucgaacaucugcgu

SEQ ID NO: 1971503 - RNA, 20 nt, Shigella flexneri 2a str. 301
ucgaaccaucggcuuuggca

SEQ ID NO: 1971504 - RNA, 15 nt, Shigella flexneri 2a str. 301
ucgaacaugcggguc

SEQ ID NO: 1971505 - RNA, 17 nt, Shigella flexneri 2a str. 301
ucgacccgacagaugcu

SEQ ID NO: 1971506 - RNA, 21 nt, Shigella flexneri 2a str. 301
ucgacagacgccagcgcuuuu

SEQ ID NO: 1971507 - RNA, 18 nt, Shigella flexneri 2a str. 301
ucgaccggguuucuuauu

SEQ ID NO: 1971508 - RNA, 15 nt, Shigella flexneri 2a str. 301
ucgacagacgccagc

SEQ ID NO: 1971509 - RNA, 17 nt, Shigella flexneri 2a str. 301
ucgaauauaucagccug

SEQ ID NO: 1971510 - RNA, 14 nt, Shigella flexneri 2a str. 301
ucgaauccucccgg

SEQ ID NO: 1971511 - RNA, 24 nt, Shigella flexneri 2a str. 301
ucgaaauccauguugcuggaagau

SEQ ID NO: 1971512 - RNA, 19 nt, Shigella flexneri 2a str. 301
ucgaaaauggccucggcua

SEQ ID NO: 1971513 - RNA, 14 nt, Shigella flexneri 2a str. 301
ucgaaaaucugccc

SEQ ID NO: 1971514 - RNA, 14 nt, Shigella flexneri 2a str. 301
ucgaaaaucucaua

SEQ ID NO: 1971515 - RNA, 16 nt, Shigella flexneri 2a str. 301
ucgaaaaccacuccug

SEQ ID NO: 1971516 - RNA, 18 nt, Shigella flexneri 2a str. 301
uccuuggauauuuuaauc

SEQ ID NO: 1971517 - RNA, 17 nt, Shigella flexneri 2a str. 301
uccuuggauauuuuaau

SEQ ID NO: 1971518 - RNA, 20 nt, Shigella flexneri 2a str. 301
uccuuuuaccacuacaucaa

SEQ ID NO: 1971519 - RNA, 21 nt, Shigella flexneri 2a str. 301
uccuuuguacaggauauauuu

SEQ ID NO: 1971520 - RNA, 12 nt, Shigella flexneri 2a str. 301
uccuuuguacca

SEQ ID NO: 1971521 - RNA, 12 nt, Shigella flexneri 2a str. 301
ucgacgcgcgca

SEQ ID NO: 1971522 - RNA, 16 nt, Shigella flexneri 2a str. 301
ucgacgcccuggaaga

SEQ ID NO: 1971523 - RNA, 19 nt, Shigella flexneri 2a str. 301
ucgacggaauaaacccaca

SEQ ID NO: 1971524 - RNA, 23 nt, Shigella flexneri 2a str. 301
ucgaggccaauuuggcugccaug

SEQ ID NO: 1971525 - RNA, 12 nt, Shigella flexneri 2a str. 301
ucgaggaaaacc

SEQ ID NO: 1971526 - RNA, 16 nt, Shigella flexneri 2a str. 301
ucgaguaaaaauauuu

SEQ ID NO: 1971527 - RNA, 19 nt, Shigella flexneri 2a str. 301
ucgaguagcaaucggcuuu

SEQ ID NO: 1971528 - RNA, 14 nt, Shigella flexneri 2a str. 301
ucgauaaaccagca

SEQ ID NO: 1971529 - RNA, 20 nt, Shigella flexneri 2a str. 301
ucgauaacacgguaaugacu

SEQ ID NO: 1971530 - RNA, 21 nt, Shigella flexneri 2a str. 301
ucgaucacuucgcgcaaccag

SEQ ID NO: 1971531 - RNA, 16 nt, Shigella flexneri 2a str. 301
ucgaucacuuucugcg

SEQ ID NO: 1971532 - RNA, 13 nt, Shigella flexneri 2a str. 301
ucgauaucaagcc

SEQ ID NO: 1971533 - RNA, 19 nt, Shigella flexneri 2a str. 301
ucgauaucguacuugccaa

SEQ ID NO: 1971534 - RNA, 21 nt, Shigella flexneri 2a str. 301
ucgcaauccgccgauguugca

SEQ ID NO: 1971535 - RNA, 16 nt, Shigella flexneri 2a str. 301
ucgcaccaaacgggca

SEQ ID NO: 1971536 - RNA, 15 nt, Shigella flexneri 2a str. 301
ucgcaccaaacgggc

SEQ ID NO: 1971537 - RNA, 14 nt, Shigella flexneri 2a str. 301
ucgcacguauaaac

SEQ ID NO: 1971538 - RNA, 19 nt, Shigella flexneri 2a str. 301
ucgcacguugucagcaacu

SEQ ID NO: 1971539 - RNA, 14 nt, Shigella flexneri 2a str. 301
ucgcaccuuucaac

SEQ ID NO: 1971540 - RNA, 15 nt, Shigella flexneri 2a str. 301
ucgauuuucaaaaua

SEQ ID NO: 1971541 - RNA, 18 nt, Shigella flexneri 2a str. 301
ucgauuuugcaauaaugg

SEQ ID NO: 1971542 - RNA, 18 nt, Shigella flexneri 2a str. 301
ucgcaauacccugaccca

SEQ ID NO: 1971543 - RNA, 12 nt, Shigella flexneri 2a str. 301
ucgcaaccagcg

SEQ ID NO: 1971544 - RNA, 19 nt, Shigella flexneri 2a str. 301
ucgcaacgccuuccgucag

SEQ ID NO: 1971545 - RNA, 20 nt, Shigella flexneri 2a str. 301
ucgcaagacgaaaaaugaau

SEQ ID NO: 1971546 - RNA, 17 nt, Shigella flexneri 2a str. 301
ucgccgcacuuucuccu

SEQ ID NO: 1971547 - RNA, 16 nt, Shigella flexneri 2a str. 301
ucgccgauuuugccuu

SEQ ID NO: 1971548 - RNA, 17 nt, Shigella flexneri 2a str. 301
ucgccgcggacaaacgg

SEQ ID NO: 1971549 - RNA, 22 nt, Shigella flexneri 2a str. 301
ucgccgcguagagaaaaccaau

SEQ ID NO: 1971550 - RNA, 23 nt, Shigella flexneri 2a str. 301
ucgccggaauuucuuucagcagu

SEQ ID NO: 1971551 - RNA, 18 nt, Shigella flexneri 2a str. 301
ucgccgcugugauuucag

SEQ ID NO: 1971552 - RNA, 23 nt, Shigella flexneri 2a str. 301
ucgccggaaccugaucagacacg

SEQ ID NO: 1971553 - RNA, 21 nt, Shigella flexneri 2a str. 301
ucgccgaacacacauuuaucc

SEQ ID NO: 1971554 - RNA, 16 nt, Shigella flexneri 2a str. 301
ucgcccuucaucuuug

SEQ ID NO: 1971555 - RNA, 20 nt, Shigella flexneri 2a str. 301
ucgccgaugaaguacagccc

SEQ ID NO: 1971556 - RNA, 18 nt, Shigella flexneri 2a str. 301
ucgccgaggcgcuggcag

SEQ ID NO: 1971557 - RNA, 21 nt, Shigella flexneri 2a str. 301
ucgccuuaugcugcuucauug

SEQ ID NO: 1971558 - RNA, 13 nt, Shigella flexneri 2a str. 301
ucgccuuaauaac

SEQ ID NO: 1971559 - RNA, 18 nt, Shigella flexneri 2a str. 301
ucgccuggaccagcgggu

SEQ ID NO: 1971560 - RNA, 20 nt, Shigella flexneri 2a str. 301
ucgccuuccggcaguuucau

SEQ ID NO: 1971561 - RNA, 20 nt, Shigella flexneri 2a str. 301
ucgccggaugaaaagucauc

SEQ ID NO: 1971562 - RNA, 15 nt, Shigella flexneri 2a str. 301
ucgccgguuccagcu

SEQ ID NO: 1971563 - RNA, 20 nt, Shigella flexneri 2a str. 301
ucgccgguuccagcuucaga

SEQ ID NO: 1971564 - RNA, 15 nt, Shigella flexneri 2a str. 301
ucgccgucaggcaag

SEQ ID NO: 1971565 - RNA, 16 nt, Shigella flexneri 2a str. 301
ucgccugcaucaccau

SEQ ID NO: 1971566 - RNA, 21 nt, Shigella flexneri 2a str. 301
ucgccguuuucuggggcgggg

SEQ ID NO: 1971567 - RNA, 14 nt, Shigella flexneri 2a str. 301
ucgcccggauuaca

SEQ ID NO: 1971568 - RNA, 16 nt, Shigella flexneri 2a str. 301
ucgcccguuuugagaa

SEQ ID NO: 1971569 - RNA, 22 nt, Shigella flexneri 2a str. 301
ucgcccuggacaacauuccugc

SEQ ID NO: 1971570 - RNA, 16 nt, Shigella flexneri 2a str. 301
ucgcccuggaugcagu

SEQ ID NO: 1971571 - RNA, 18 nt, Shigella flexneri 2a str. 301
ucgcccugccaaaucagu

SEQ ID NO: 1971572 - RNA, 21 nt, Shigella flexneri 2a str. 301
ucgcccugcuccagcaacuca

SEQ ID NO: 1971573 - RNA, 13 nt, Shigella flexneri 2a str. 301
ucgcccagcgcgu

SEQ ID NO: 1971574 - RNA, 23 nt, Shigella flexneri 2a str. 301
ucgcccacuucuuucgcccagcg

SEQ ID NO: 1971575 - RNA, 23 nt, Shigella flexneri 2a str. 301
ucgcccaguugaucaccagugcg

SEQ ID NO: 1971576 - RNA, 16 nt, Shigella flexneri 2a str. 301
ucgccccgagaaaaau

SEQ ID NO: 1971577 - RNA, 18 nt, Shigella flexneri 2a str. 301
ucgccccgagaaaaauag

SEQ ID NO: 1971578 - RNA, 22 nt, Shigella flexneri 2a str. 301
ucgcagggaucauccacccgca

SEQ ID NO: 1971579 - RNA, 20 nt, Shigella flexneri 2a str. 301
ucgcaucaggcauuugcucc

SEQ ID NO: 1971580 - RNA, 23 nt, Shigella flexneri 2a str. 301
ucgcaucaggcauuugcuccaga

SEQ ID NO: 1971581 - RNA, 16 nt, Shigella flexneri 2a str. 301
ucgccaacaaucucuu

SEQ ID NO: 1971582 - RNA, 20 nt, Shigella flexneri 2a str. 301
ucgccaacaaucucuuccag

SEQ ID NO: 1971583 - RNA, 23 nt, Shigella flexneri 2a str. 301
ucgccauccgaauucacuuaauc

SEQ ID NO: 1971584 - RNA, 23 nt, Shigella flexneri 2a str. 301
ucgccaaguucgaacgccgccag

SEQ ID NO: 1971585 - RNA, 17 nt, Shigella flexneri 2a str. 301
ucgccaugaacgcgaag

SEQ ID NO: 1971586 - RNA, 16 nt, Shigella flexneri 2a str. 301
ucgccauuucgucguc

SEQ ID NO: 1971587 - RNA, 22 nt, Shigella flexneri 2a str. 301
ucgccauuccuggggucaucag

SEQ ID NO: 1971588 - RNA, 18 nt, Shigella flexneri 2a str. 301
ugauaacgugcagcuuuc

SEQ ID NO: 1971589 - RNA, 22 nt, Shigella flexneri 2a str. 301
ugauaacgugcagcuuucccuu

SEQ ID NO: 1971590 - RNA, 18 nt, Shigella flexneri 2a str. 301
ugauaacgcggcagcagg

SEQ ID NO: 1971591 - RNA, 20 nt, Shigella flexneri 2a str. 301
ugauaaccccgcaauuucau

SEQ ID NO: 1971592 - RNA, 22 nt, Shigella flexneri 2a str. 301
ugauaauccaucacuucaucau

SEQ ID NO: 1971593 - RNA, 19 nt, Shigella flexneri 2a str. 301
ugauaauccaucacuucau

SEQ ID NO: 1971594 - RNA, 22 nt, Shigella flexneri 2a str. 301
ugauaauuguuaucguuugcau

SEQ ID NO: 1971595 - RNA, 23 nt, Shigella flexneri 2a str. 301
ugauaauguuauuuaauuacuga

SEQ ID NO: 1971596 - RNA, 23 nt, Shigella flexneri 2a str. 301
ugauaauuguuaucguuugcauu

SEQ ID NO: 1971597 - RNA, 18 nt, Shigella flexneri 2a str. 301
ugauaauuauuauaauaa

SEQ ID NO: 1971598 - RNA, 14 nt, Shigella flexneri 2a str. 301
ugauaauuaugaag

SEQ ID NO: 1971599 - RNA, 21 nt, Shigella flexneri 2a str. 301
ugauaccgggcguccugcuug

SEQ ID NO: 1971600 - RNA, 19 nt, Shigella flexneri 2a str. 301
ugauacgggaggucaucag

SEQ ID NO: 1971601 - RNA, 15 nt, Shigella flexneri 2a str. 301
ugauacguaaaccac

SEQ ID NO: 1971602 - RNA, 18 nt, Shigella flexneri 2a str. 301
ugagcaguuuucacccuu

SEQ ID NO: 1971603 - RNA, 19 nt, Shigella flexneri 2a str. 301
ugagcaguggcaaacugag

SEQ ID NO: 1971604 - RNA, 19 nt, Shigella flexneri 2a str. 301
ugagcaugaugccugaugc

SEQ ID NO: 1971605 - RNA, 14 nt, Shigella flexneri 2a str. 301
ugagucagaaaucu

SEQ ID NO: 1971606 - RNA, 16 nt, Shigella flexneri 2a str. 301
ugagucaauuucugca

SEQ ID NO: 1971607 - RNA, 18 nt, Shigella flexneri 2a str. 301
ugaguuccgccguauguu

SEQ ID NO: 1971608 - RNA, 11 nt, Shigella flexneri 2a str. 301
ugaguuuucag

SEQ ID NO: 1971609 - RNA, 23 nt, Shigella flexneri 2a str. 301
ugaguuucgucuuugguauagug

SEQ ID NO: 1971610 - RNA, 20 nt, Shigella flexneri 2a str. 301
ugaguuucuauguauugugc

SEQ ID NO: 1971611 - RNA, 21 nt, Shigella flexneri 2a str. 301
ugauaaaauucauucaauuaa

SEQ ID NO: 1971612 - RNA, 14 nt, Shigella flexneri 2a str. 301
ugauaaaucaccug

SEQ ID NO: 1971613 - RNA, 12 nt, Shigella flexneri 2a str. 301
ugauaaaaaacc

SEQ ID NO: 1971614 - RNA, 15 nt, Shigella flexneri 2a str. 301
ugauaaaaaacccgc

SEQ ID NO: 1971615 - RNA, 21 nt, Shigella flexneri 2a str. 301
ugaguuuuuuguccguuacca

SEQ ID NO: 1971616 - RNA, 15 nt, Shigella flexneri 2a str. 301
ugaucaacagcauca

SEQ ID NO: 1971617 - RNA, 13 nt, Shigella flexneri 2a str. 301
ugaucaacagcau

SEQ ID NO: 1971618 - RNA, 22 nt, Shigella flexneri 2a str. 301
ugaucaaaaucauauaauuguu

SEQ ID NO: 1971619 - RNA, 18 nt, Shigella flexneri 2a str. 301
ugauauguuuuaaagcga

SEQ ID NO: 1971620 - RNA, 12 nt, Shigella flexneri 2a str. 301
ugaucaccagua

SEQ ID NO: 1971621 - RNA, 12 nt, Shigella flexneri 2a str. 301
ugaucaccagug

SEQ ID NO: 1971622 - RNA, 15 nt, Shigella flexneri 2a str. 301
ugaucaggucagauu

SEQ ID NO: 1971623 - RNA, 12 nt, Shigella flexneri 2a str. 301
ugauauguuuau

SEQ ID NO: 1971624 - RNA, 15 nt, Shigella flexneri 2a str. 301
ugauauguuuauuag

SEQ ID NO: 1971625 - RNA, 12 nt, Shigella flexneri 2a str. 301
ugauauggucaa

SEQ ID NO: 1971626 - RNA, 19 nt, Shigella flexneri 2a str. 301
ugauaguguuuuauguuca

SEQ ID NO: 1971627 - RNA, 13 nt, Shigella flexneri 2a str. 301
ugauagugcugcc

SEQ ID NO: 1971628 - RNA, 18 nt, Shigella flexneri 2a str. 301
ugauagcccggauuucca

SEQ ID NO: 1971629 - RNA, 13 nt, Shigella flexneri 2a str. 301
ugaugaaaacgaa

SEQ ID NO: 1971630 - RNA, 14 nt, Shigella flexneri 2a str. 301
ugaugaacccgguc

SEQ ID NO: 1971631 - RNA, 11 nt, Shigella flexneri 2a str. 301
ugaucuuuuuu

SEQ ID NO: 1971632 - RNA, 14 nt, Shigella flexneri 2a str. 301
ugaucuuuuuauug

SEQ ID NO: 1971633 - RNA, 14 nt, Shigella flexneri 2a str. 301
ugaucuuucuucag

SEQ ID NO: 1971634 - RNA, 12 nt, Shigella flexneri 2a str. 301
ugaucuucauag

SEQ ID NO: 1971635 - RNA, 16 nt, Shigella flexneri 2a str. 301
ugaugagcgauaaaca

SEQ ID NO: 1971636 - RNA, 21 nt, Shigella flexneri 2a str. 301
ugaugccgauuguauacgcug

SEQ ID NO: 1971637 - RNA, 16 nt, Shigella flexneri 2a str. 301
ugaugauuaacagcaa

SEQ ID NO: 1971638 - RNA, 11 nt, Shigella flexneri 2a str. 301
ugaugccaucg

SEQ ID NO: 1971639 - RNA, 11 nt, Shigella flexneri 2a str. 301
ugaucaucauu

SEQ ID NO: 1971640 - RNA, 22 nt, Shigella flexneri 2a str. 301
ugaucaugugcaggauuaauaa

SEQ ID NO: 1971641 - RNA, 23 nt, Shigella flexneri 2a str. 301
ugaucaugugcaggauuaauaaa

SEQ ID NO: 1971642 - RNA, 23 nt, Shigella flexneri 2a str. 301
ugaucauccgccucuaacagauc

SEQ ID NO: 1971643 - RNA, 19 nt, Shigella flexneri 2a str. 301
ugaucauagcgaauaaucc

SEQ ID NO: 1971644 - RNA, 23 nt, Shigella flexneri 2a str. 301
ugaucgugccaggaccauucaca

SEQ ID NO: 1971645 - RNA, 14 nt, Shigella flexneri 2a str. 301
ugaucauucaccag

SEQ ID NO: 1971646 - RNA, 23 nt, Shigella flexneri 2a str. 301
ugaucuaaaaucgcuucagccgg

SEQ ID NO: 1971647 - RNA, 18 nt, Shigella flexneri 2a str. 301
ugaucuuaugauguaaau

SEQ ID NO: 1971648 - RNA, 21 nt, Shigella flexneri 2a str. 301
ugaucugcgucgcuuuccagu

SEQ ID NO: 1971649 - RNA, 18 nt, Shigella flexneri 2a str. 301
ugaucuaccgcuucccuu

SEQ ID NO: 1971650 - RNA, 19 nt, Shigella flexneri 2a str. 301
ugaucugaccgaaugcagu

SEQ ID NO: 1971651 - RNA, 13 nt, Shigella flexneri 2a str. 301
ugaucucuuucca

SEQ ID NO: 1971652 - RNA, 16 nt, Shigella flexneri 2a str. 301
ugcaaaaccugguugg

SEQ ID NO: 1971653 - RNA, 22 nt, Shigella flexneri 2a str. 301
ugcaaaauuuucauugccgcau

SEQ ID NO: 1971654 - RNA, 22 nt, Shigella flexneri 2a str. 301
ugcaaaauuuuuuugcaccaua

SEQ ID NO: 1971655 - RNA, 16 nt, Shigella flexneri 2a str. 301
ugcaaaauaccaauaa

SEQ ID NO: 1971656 - RNA, 17 nt, Shigella flexneri 2a str. 301
ugcaaaugccagauaag

SEQ ID NO: 1971657 - RNA, 17 nt, Shigella flexneri 2a str. 301
ugcaaaucggcaaucuc

SEQ ID NO: 1971658 - RNA, 14 nt, Shigella flexneri 2a str. 301
ugcaaauauuaaua

SEQ ID NO: 1971659 - RNA, 13 nt, Shigella flexneri 2a str. 301
ugcaaauauuaau

SEQ ID NO: 1971660 - RNA, 18 nt, Shigella flexneri 2a str. 301
ugcaaaucacgcugcuga

SEQ ID NO: 1971661 - RNA, 14 nt, Shigella flexneri 2a str. 301
ugcaaauaauccac

SEQ ID NO: 1971662 - RNA, 17 nt, Shigella flexneri 2a str. 301
ugauuuugauggaagaa

SEQ ID NO: 1971663 - RNA, 20 nt, Shigella flexneri 2a str. 301
ugauuuugccugugcaaccu

SEQ ID NO: 1971664 - RNA, 16 nt, Shigella flexneri 2a str. 301
ugauuuauagauuuac

SEQ ID NO: 1971665 - RNA, 19 nt, Shigella flexneri 2a str. 301
ugauuuucgaaaaaaaaga

SEQ ID NO: 1971666 - RNA, 14 nt, Shigella flexneri 2a str. 301
ugauuucacacaua

SEQ ID NO: 1971667 - RNA, 16 nt, Shigella flexneri 2a str. 301
ugauuggcaucaucag

SEQ ID NO: 1971668 - RNA, 22 nt, Shigella flexneri 2a str. 301
ugauuggcgcgaaccaucaccu

SEQ ID NO: 1971669 - RNA, 20 nt, Shigella flexneri 2a str. 301
ugauugcucugguuguggug

SEQ ID NO: 1971670 - RNA, 17 nt, Shigella flexneri 2a str. 301
ugauugccacccugcgg

SEQ ID NO: 1971671 - RNA, 14 nt, Shigella flexneri 2a str. 301
ugauugaacugugg

SEQ ID NO: 1971672 - RNA, 16 nt, Shigella flexneri 2a str. 301
ugauugaagaaaucag

SEQ ID NO: 1971673 - RNA, 19 nt, Shigella flexneri 2a str. 301
ugauugaaaaauaccucau

SEQ ID NO: 1971674 - RNA, 20 nt, Shigella flexneri 2a str. 301
ugauugacgcguucgcuaaa

SEQ ID NO: 1971675 - RNA, 15 nt, Shigella flexneri 2a str. 301
ugauucacguucgug

SEQ ID NO: 1971676 - RNA, 20 nt, Shigella flexneri 2a str. 301
ugauucacuuucugaaggau

SEQ ID NO: 1971677 - RNA, 20 nt, Shigella flexneri 2a str. 301
ugauucauaaagcagccuau

SEQ ID NO: 1971678 - RNA, 20 nt, Shigella flexneri 2a str. 301
ugauuccggcaaauaacaga

SEQ ID NO: 1971679 - RNA, 23 nt, Shigella flexneri 2a str. 301
ugauuccgggaauucgaagcugu

SEQ ID NO: 1971680 - RNA, 17 nt, Shigella flexneri 2a str. 301
ugauucugagaaacuca

SEQ ID NO: 1971681 - RNA, 18 nt, Shigella flexneri 2a str. 301
ugauuccggcaaauaaca

SEQ ID NO: 1971682 - RNA, 16 nt, Shigella flexneri 2a str. 301
ugauuaccaauaucaa

SEQ ID NO: 1971683 - RNA, 20 nt, Shigella flexneri 2a str. 301
ugauuaccaauaucaaauaa

SEQ ID NO: 1971684 - RNA, 15 nt, Shigella flexneri 2a str. 301
ugauuacuaaaugug

SEQ ID NO: 1971685 - RNA, 14 nt, Shigella flexneri 2a str. 301
ugaugcgacuuguc

SEQ ID NO: 1971686 - RNA, 17 nt, Shigella flexneri 2a str. 301
ugaugcgaugcuugacg

SEQ ID NO: 1971687 - RNA, 15 nt, Shigella flexneri 2a str. 301
ugaugcgacgcuggc

SEQ ID NO: 1971688 - RNA, 17 nt, Shigella flexneri 2a str. 301
ugaugcgacgcuugacg

SEQ ID NO: 1971689 - RNA, 15 nt, Shigella flexneri 2a str. 301
ugaugccguuuaugc

SEQ ID NO: 1971690 - RNA, 14 nt, Shigella flexneri 2a str. 301
ugaugccgugcagc

SEQ ID NO: 1971691 - RNA, 15 nt, Shigella flexneri 2a str. 301
ugaugccgugcagca

SEQ ID NO: 1971692 - RNA, 14 nt, Shigella flexneri 2a str. 301
ugauuaacaggcug

SEQ ID NO: 1971693 - RNA, 23 nt, Shigella flexneri 2a str. 301
ugauuaacgcuuguaaaugaacu

SEQ ID NO: 1971694 - RNA, 13 nt, Shigella flexneri 2a str. 301
ugcaccgggcuuu

SEQ ID NO: 1971695 - RNA, 15 nt, Shigella flexneri 2a str. 301
ugcaccucugcugcu

SEQ ID NO: 1971696 - RNA, 12 nt, Shigella flexneri 2a str. 301
ugcacgcccuga

SEQ ID NO: 1971697 - RNA, 15 nt, Shigella flexneri 2a str. 301
ugcacgcagaucggu

SEQ ID NO: 1971698 - RNA, 23 nt, Shigella flexneri 2a str. 301
ugcacgcccugauaaaucaccug

SEQ ID NO: 1971699 - RNA, 15 nt, Shigella flexneri 2a str. 301
ugcacgcgcuucagu

SEQ ID NO: 1971700 - RNA, 16 nt, Shigella flexneri 2a str. 301
ugcacgcuaguuuccu

SEQ ID NO: 1971701 - RNA, 21 nt, Shigella flexneri 2a str. 301
ugcacggagauauccagcgcc

SEQ ID NO: 1971702 - RNA, 22 nt, Shigella flexneri 2a str. 301
ugcacggagauauccagcgccg

SEQ ID NO: 1971703 - RNA, 15 nt, Shigella flexneri 2a str. 301
ugcaccauugcugcc

SEQ ID NO: 1971704 - RNA, 19 nt, Shigella flexneri 2a str. 301
ugcaccauugcugccgcca

SEQ ID NO: 1971705 - RNA, 18 nt, Shigella flexneri 2a str. 301
ugcaccaucaggcauauu

SEQ ID NO: 1971706 - RNA, 17 nt, Shigella flexneri 2a str. 301
ugcacccgcuucaguga

SEQ ID NO: 1971707 - RNA, 16 nt, Shigella flexneri 2a str. 301
ugcaauuauuaaccug

SEQ ID NO: 1971708 - RNA, 16 nt, Shigella flexneri 2a str. 301
ugcaauuccaucauau

SEQ ID NO: 1971709 - RNA, 19 nt, Shigella flexneri 2a str. 301
ugcaccagcaacaagccag

SEQ ID NO: 1971710 - RNA, 18 nt, Shigella flexneri 2a str. 301
ugcaacuucucuuucggc

SEQ ID NO: 1971711 - RNA, 14 nt, Shigella flexneri 2a str. 301
ugcaagaaaugaca

SEQ ID NO: 1971712 - RNA, 20 nt, Shigella flexneri 2a str. 301
ugcaagaucgcgcaucagcu

SEQ ID NO: 1971713 - RNA, 23 nt, Shigella flexneri 2a str. 301
ugcaagaucgcgcaucagcuccg

SEQ ID NO: 1971714 - RNA, 18 nt, Shigella flexneri 2a str. 301
ugcaagaucgcucaucag

SEQ ID NO: 1971715 - RNA, 19 nt, Shigella flexneri 2a str. 301
ugcaagaucgcucaucagc

SEQ ID NO: 1971716 - RNA, 15 nt, Shigella flexneri 2a str. 301
ugcaagauagcgcgu

SEQ ID NO: 1971717 - RNA, 21 nt, Shigella flexneri 2a str. 301
ugcaagacgaugacauuaucu

SEQ ID NO: 1971718 - RNA, 18 nt, Shigella flexneri 2a str. 301
ugcaauacuuccgcuucc

SEQ ID NO: 1971719 - RNA, 21 nt, Shigella flexneri 2a str. 301
ugcaauagauugaauuagcaa

SEQ ID NO: 1971720 - RNA, 23 nt, Shigella flexneri 2a str. 301
ugcaauaccauggcucaccagca

SEQ ID NO: 1971721 - RNA, 15 nt, Shigella flexneri 2a str. 301
ugcaauaugcuggca

SEQ ID NO: 1971722 - RNA, 16 nt, Shigella flexneri 2a str. 301
ugcaauaucaaccuga

SEQ ID NO: 1971723 - RNA, 19 nt, Shigella flexneri 2a str. 301
ugcaaugucaucagcauuc

SEQ ID NO: 1971724 - RNA, 22 nt, Shigella flexneri 2a str. 301
ugcaaugucaucagcauucuca

SEQ ID NO: 1971725 - RNA, 23 nt, Shigella flexneri 2a str. 301
ugcaaugucaucagcauucucau

SEQ ID NO: 1971726 - RNA, 22 nt, Shigella flexneri 2a str. 301
ugcaauuaaggucggcuuugaa

SEQ ID NO: 1971727 - RNA, 16 nt, Shigella flexneri 2a str. 301
ugcaaucacuuccuca

SEQ ID NO: 1971728 - RNA, 16 nt, Shigella flexneri 2a str. 301
ugcaauauauugaauu

SEQ ID NO: 1971729 - RNA, 15 nt, Shigella flexneri 2a str. 301
ugcaaucacaaauag

SEQ ID NO: 1971730 - RNA, 13 nt, Shigella flexneri 2a str. 301
ugcaaucaguuca

SEQ ID NO: 1971731 - RNA, 20 nt, Shigella flexneri 2a str. 301
ugcaaucaguucaaauucau

SEQ ID NO: 1971732 - RNA, 22 nt, Shigella flexneri 2a str. 301
ugcaacccgccagguuucauag

SEQ ID NO: 1971733 - RNA, 22 nt, Shigella flexneri 2a str. 301
ugcaacgaaucaaaucccugau

SEQ ID NO: 1971734 - RNA, 18 nt, Shigella flexneri 2a str. 301
ugcaacgcccaucaacau

SEQ ID NO: 1971735 - RNA, 22 nt, Shigella flexneri 2a str. 301
ugcaacaacugaaaaaaaauua

SEQ ID NO: 1971736 - RNA, 18 nt, Shigella flexneri 2a str. 301
ugcaacaacugaaaaaaa

SEQ ID NO: 1971737 - RNA, 14 nt, Shigella flexneri 2a str. 301
ugcaaauucaauau

SEQ ID NO: 1971738 - RNA, 17 nt, Shigella flexneri 2a str. 301
ugcaacauguugaaucu

SEQ ID NO: 1971739 - RNA, 17 nt, Shigella flexneri 2a str. 301
ugcaacaucagaggcga

SEQ ID NO: 1971740 - RNA, 16 nt, Shigella flexneri 2a str. 301
ugacggugauaaucau

SEQ ID NO: 1971741 - RNA, 15 nt, Shigella flexneri 2a str. 301
ugacgggcaaggcug

SEQ ID NO: 1971742 - RNA, 19 nt, Shigella flexneri 2a str. 301
ugacguagcagcuccgcca

SEQ ID NO: 1971743 - RNA, 14 nt, Shigella flexneri 2a str. 301
ugacguucaguuca

SEQ ID NO: 1971744 - RNA, 19 nt, Shigella flexneri 2a str. 301
ugacguugucauacgggcu

SEQ ID NO: 1971745 - RNA, 17 nt, Shigella flexneri 2a str. 301
ugacgucuuaauaaaug

SEQ ID NO: 1971746 - RNA, 17 nt, Shigella flexneri 2a str. 301
ugacugauaacgcggca

SEQ ID NO: 1971747 - RNA, 18 nt, Shigella flexneri 2a str. 301
ugacucuuguaacagagu

SEQ ID NO: 1971748 - RNA, 14 nt, Shigella flexneri 2a str. 301
ugacucucauccaa

SEQ ID NO: 1971749 - RNA, 15 nt, Shigella flexneri 2a str. 301
ugacugaaaaguuaa

SEQ ID NO: 1971750 - RNA, 18 nt, Shigella flexneri 2a str. 301
ugacucuuuauuucauuu

SEQ ID NO: 1971751 - RNA, 20 nt, Shigella flexneri 2a str. 301
ugacuagaugugcaguuccu

SEQ ID NO: 1971752 - RNA, 21 nt, Shigella flexneri 2a str. 301
ugacuauccuggacuuuaaac

SEQ ID NO: 1971753 - RNA, 22 nt, Shigella flexneri 2a str. 301
ugacuauauaaauuacccuuua

SEQ ID NO: 1971754 - RNA, 14 nt, Shigella flexneri 2a str. 301
ugacuaacacuuca

SEQ ID NO: 1971755 - RNA, 18 nt, Shigella flexneri 2a str. 301
ugacuacacuaaacgucu

SEQ ID NO: 1971756 - RNA, 19 nt, Shigella flexneri 2a str. 301
ugagaaacucaguugauuc

SEQ ID NO: 1971757 - RNA, 13 nt, Shigella flexneri 2a str. 301
ugagaaagcugcg

SEQ ID NO: 1971758 - RNA, 17 nt, Shigella flexneri 2a str. 301
ugacuucugccagcugc

SEQ ID NO: 1971759 - RNA, 15 nt, Shigella flexneri 2a str. 301
ugacuuccacuuccu

SEQ ID NO: 1971760 - RNA, 20 nt, Shigella flexneri 2a str. 301
ugacuuccguaccagccuug

SEQ ID NO: 1971761 - RNA, 14 nt, Shigella flexneri 2a str. 301
ugacuuccacuucc

SEQ ID NO: 1971762 - RNA, 19 nt, Shigella flexneri 2a str. 301
ugacuucaauuugagcgaa

SEQ ID NO: 1971763 - RNA, 22 nt, Shigella flexneri 2a str. 301
ugagaacaagauugccugaugc

SEQ ID NO: 1971764 - RNA, 21 nt, Shigella flexneri 2a str. 301
ugagaauuccggcagagaaag

SEQ ID NO: 1971765 - RNA, 14 nt, Shigella flexneri 2a str. 301
ugagacgcacccuc

SEQ ID NO: 1971766 - RNA, 11 nt, Shigella flexneri 2a str. 301
ugagagaaaaa

SEQ ID NO: 1971767 - RNA, 16 nt, Shigella flexneri 2a str. 301
ugagagaaaaaaaagc

SEQ ID NO: 1971768 - RNA, 14 nt, Shigella flexneri 2a str. 301
ugagauaauucugu

SEQ ID NO: 1971769 - RNA, 19 nt, Shigella flexneri 2a str. 301
ugaccgaaccuguuuucac

SEQ ID NO: 1971770 - RNA, 14 nt, Shigella flexneri 2a str. 301
ugaccgaaugcagu

SEQ ID NO: 1971771 - RNA, 18 nt, Shigella flexneri 2a str. 301
ugacccucucggcauaua

SEQ ID NO: 1971772 - RNA, 14 nt, Shigella flexneri 2a str. 301
ugaccagaacugau

SEQ ID NO: 1971773 - RNA, 17 nt, Shigella flexneri 2a str. 301
ugaccagcgauaaaaau

SEQ ID NO: 1971774 - RNA, 20 nt, Shigella flexneri 2a str. 301
ugaccaggacuuugaaagcg

SEQ ID NO: 1971775 - RNA, 19 nt, Shigella flexneri 2a str. 301
ugaccaggacuuugaaagc

SEQ ID NO: 1971776 - RNA, 17 nt, Shigella flexneri 2a str. 301
ugaccaguaccaccgcg

SEQ ID NO: 1971777 - RNA, 19 nt, Shigella flexneri 2a str. 301
ugaccaguaauauccccag

SEQ ID NO: 1971778 - RNA, 23 nt, Shigella flexneri 2a str. 301
ugacauuugcuuuuguuaauugc

SEQ ID NO: 1971779 - RNA, 16 nt, Shigella flexneri 2a str. 301
ugacacaaucaaaucc

SEQ ID NO: 1971780 - RNA, 17 nt, Shigella flexneri 2a str. 301
ugacaucuccagcgcau

SEQ ID NO: 1971781 - RNA, 15 nt, Shigella flexneri 2a str. 301
ugacaucgcccugau

SEQ ID NO: 1971782 - RNA, 14 nt, Shigella flexneri 2a str. 301
ugacaucuccagcg

SEQ ID NO: 1971783 - RNA, 16 nt, Shigella flexneri 2a str. 301
ugacaucauuuuuucc

SEQ ID NO: 1971784 - RNA, 13 nt, Shigella flexneri 2a str. 301
ugaccuucuucag

SEQ ID NO: 1971785 - RNA, 16 nt, Shigella flexneri 2a str. 301
ugaccuuccagcgccg

SEQ ID NO: 1971786 - RNA, 18 nt, Shigella flexneri 2a str. 301
ugaccuugucaugcagcu

SEQ ID NO: 1971787 - RNA, 16 nt, Shigella flexneri 2a str. 301
ugacgaccacccagca

SEQ ID NO: 1971788 - RNA, 22 nt, Shigella flexneri 2a str. 301
ugacgaagauguuguacagcga

SEQ ID NO: 1971789 - RNA, 22 nt, Shigella flexneri 2a str. 301
ugaccgcccgcuaugagcagau

SEQ ID NO: 1971790 - RNA, 14 nt, Shigella flexneri 2a str. 301
ugaccugcagcguu

SEQ ID NO: 1971791 - RNA, 20 nt, Shigella flexneri 2a str. 301
ugacgccaccauucaccaag

SEQ ID NO: 1971792 - RNA, 22 nt, Shigella flexneri 2a str. 301
ugacgccccuggcgaugccccc

SEQ ID NO: 1971793 - RNA, 23 nt, Shigella flexneri 2a str. 301
ugacgccaucucccggcauacca

SEQ ID NO: 1971794 - RNA, 20 nt, Shigella flexneri 2a str. 301
ugacgcccguuaaccgcucu

SEQ ID NO: 1971795 - RNA, 15 nt, Shigella flexneri 2a str. 301
ugacgauuguagaaa

SEQ ID NO: 1971796 - RNA, 21 nt, Shigella flexneri 2a str. 301
ugacgcgcauacucuccucca

SEQ ID NO: 1971797 - RNA, 17 nt, Shigella flexneri 2a str. 301
ugacgcgggcagcagaa

SEQ ID NO: 1971798 - RNA, 13 nt, Shigella flexneri 2a str. 301
ugaacucuucuuc

SEQ ID NO: 1971799 - RNA, 17 nt, Shigella flexneri 2a str. 301
ugaacucuucuuccggc

SEQ ID NO: 1971800 - RNA, 15 nt, Shigella flexneri 2a str. 301
ugaacugaacaaaaa

SEQ ID NO: 1971801 - RNA, 23 nt, Shigella flexneri 2a str. 301
ugaacucgacgcccuggaagaaa

SEQ ID NO: 1971802 - RNA, 19 nt, Shigella flexneri 2a str. 301
ugaacugggccugcauauc

SEQ ID NO: 1971803 - RNA, 19 nt, Shigella flexneri 2a str. 301
ugaacugcuuuuuaaucuc

SEQ ID NO: 1971804 - RNA, 22 nt, Shigella flexneri 2a str. 301
ugaacgugggucugucccauuu

SEQ ID NO: 1971805 - RNA, 21 nt, Shigella flexneri 2a str. 301
ugaacgugcaaaaucaaacag

SEQ ID NO: 1971806 - RNA, 15 nt, Shigella flexneri 2a str. 301
ugaacggugaugcuc

SEQ ID NO: 1971807 - RNA, 16 nt, Shigella flexneri 2a str. 301
ugaacgguaagaacaa

SEQ ID NO: 1971808 - RNA, 14 nt, Shigella flexneri 2a str. 301
ugaacgccuuaucc

SEQ ID NO: 1971809 - RNA, 14 nt, Shigella flexneri 2a str. 301
ugaacgccuuaucu

SEQ ID NO: 1971810 - RNA, 22 nt, Shigella flexneri 2a str. 301
ugaacgccaccccacaccagug

SEQ ID NO: 1971811 - RNA, 21 nt, Shigella flexneri 2a str. 301
ugaacgccacgcucacucauc

SEQ ID NO: 1971812 - RNA, 18 nt, Shigella flexneri 2a str. 301
ugaagaggaacaaauuuu

SEQ ID NO: 1971813 - RNA, 17 nt, Shigella flexneri 2a str. 301
ugaagaguuugaucaug

SEQ ID NO: 1971814 - RNA, 16 nt, Shigella flexneri 2a str. 301
ugaagaauuuuugcgg

SEQ ID NO: 1971815 - RNA, 18 nt, Shigella flexneri 2a str. 301
ugaagaagcggaaaucac

SEQ ID NO: 1971816 - RNA, 13 nt, Shigella flexneri 2a str. 301
ugaacuucacgua

SEQ ID NO: 1971817 - RNA, 18 nt, Shigella flexneri 2a str. 301
ugaagaaccgcaccaggc

SEQ ID NO: 1971818 - RNA, 12 nt, Shigella flexneri 2a str. 301
ugaagaaaucag

SEQ ID NO: 1971819 - RNA, 14 nt, Shigella flexneri 2a str. 301
ugaagaaccgcacc

SEQ ID NO: 1971820 - RNA, 20 nt, Shigella flexneri 2a str. 301
ugaagcuggcagaaguuguc

SEQ ID NO: 1971821 - RNA, 19 nt, Shigella flexneri 2a str. 301
ugaagcuggcagaaguugu

SEQ ID NO: 1971822 - RNA, 22 nt, Shigella flexneri 2a str. 301
ugaagguuguuaaccaccagua

SEQ ID NO: 1971823 - RNA, 23 nt, Shigella flexneri 2a str. 301
ugaaguaaaaggucugaaagaua

SEQ ID NO: 1971824 - RNA, 15 nt, Shigella flexneri 2a str. 301
ugaaguacacauaaa

SEQ ID NO: 1971825 - RNA, 16 nt, Shigella flexneri 2a str. 301
ugaaguacagcccagg

SEQ ID NO: 1971826 - RNA, 20 nt, Shigella flexneri 2a str. 301
ugaagguuguuaaccaccag

SEQ ID NO: 1971827 - RNA, 20 nt, Shigella flexneri 2a str. 301
ugaaggcgcauugcuggcug

SEQ ID NO: 1971828 - RNA, 12 nt, Shigella flexneri 2a str. 301
ugaagccaaauc

SEQ ID NO: 1971829 - RNA, 18 nt, Shigella flexneri 2a str. 301
ugaagccaaaucauccag

SEQ ID NO: 1971830 - RNA, 17 nt, Shigella flexneri 2a str. 301
ugaagcaguuucaccag

SEQ ID NO: 1971831 - RNA, 21 nt, Shigella flexneri 2a str. 301
ugaagauggucuguaccacca

SEQ ID NO: 1971832 - RNA, 20 nt, Shigella flexneri 2a str. 301
ugaagcaauccauaccagca

SEQ ID NO: 1971833 - RNA, 17 nt, Shigella flexneri 2a str. 301
ugaaugcggcaggcaca

SEQ ID NO: 1971834 - RNA, 16 nt, Shigella flexneri 2a str. 301
ugaaucacgacaaaca

SEQ ID NO: 1971835 - RNA, 17 nt, Shigella flexneri 2a str. 301
ugaaucaaaaucaucau

SEQ ID NO: 1971836 - RNA, 18 nt, Shigella flexneri 2a str. 301
ugaaucaaaaucaucauc

SEQ ID NO: 1971837 - RNA, 18 nt, Shigella flexneri 2a str. 301
ugaaucagaagacgauaa

SEQ ID NO: 1971838 - RNA, 23 nt, Shigella flexneri 2a str. 301
ugaaucaucguucauauauuccu

SEQ ID NO: 1971839 - RNA, 14 nt, Shigella flexneri 2a str. 301
ugaauccaucugua

SEQ ID NO: 1971840 - RNA, 17 nt, Shigella flexneri 2a str. 301
ugaauuugucgauuucc

SEQ ID NO: 1971841 - RNA, 18 nt, Shigella flexneri 2a str. 301
ugaauuugugaacagccu

SEQ ID NO: 1971842 - RNA, 21 nt, Shigella flexneri 2a str. 301
ugaauuacugggaugugaaaa

SEQ ID NO: 1971843 - RNA, 15 nt, Shigella flexneri 2a str. 301
ugaauuugcaugacu

SEQ ID NO: 1971844 - RNA, 19 nt, Shigella flexneri 2a str. 301
ugaaugucugucugacaac

SEQ ID NO: 1971845 - RNA, 17 nt, Shigella flexneri 2a str. 301
ugaauuacuucucuuuc

SEQ ID NO: 1971846 - RNA, 14 nt, Shigella flexneri 2a str. 301
ugaauuaaugccuc

SEQ ID NO: 1971847 - RNA, 19 nt, Shigella flexneri 2a str. 301
ugaaguuacuaacaucgau

SEQ ID NO: 1971848 - RNA, 23 nt, Shigella flexneri 2a str. 301
ugaaguugccggauguguugcau

SEQ ID NO: 1971849 - RNA, 21 nt, Shigella flexneri 2a str. 301
ugaaguacgaaaaaaccggga

SEQ ID NO: 1971850 - RNA, 20 nt, Shigella flexneri 2a str. 301
ugaagucagggucuuccagc

SEQ ID NO: 1971851 - RNA, 15 nt, Shigella flexneri 2a str. 301
ugaagucucaauuag

SEQ ID NO: 1971852 - RNA, 18 nt, Shigella flexneri 2a str. 301
ugaagucgcgcucaucag

SEQ ID NO: 1971853 - RNA, 22 nt, Shigella flexneri 2a str. 301
ugaagucgggcagaaugcccug

SEQ ID NO: 1971854 - RNA, 22 nt, Shigella flexneri 2a str. 301
ugaagucuuuuuucaacuuuau

SEQ ID NO: 1971855 - RNA, 17 nt, Shigella flexneri 2a str. 301
ugaauaaacucaccaaa

SEQ ID NO: 1971856 - RNA, 18 nt, Shigella flexneri 2a str. 301
ugaauaacaccagccaga

SEQ ID NO: 1971857 - RNA, 14 nt, Shigella flexneri 2a str. 301
ugaauaacaccagc

SEQ ID NO: 1971858 - RNA, 22 nt, Shigella flexneri 2a str. 301
ugaauauugccggaugugaugc

SEQ ID NO: 1971859 - RNA, 16 nt, Shigella flexneri 2a str. 301
ugaauauuccuuaugg

SEQ ID NO: 1971860 - RNA, 19 nt, Shigella flexneri 2a str. 301
ugaauagugccacaccagc

SEQ ID NO: 1971861 - RNA, 17 nt, Shigella flexneri 2a str. 301
ugaauauucggcuccag

SEQ ID NO: 1971862 - RNA, 16 nt, Shigella flexneri 2a str. 301
ugaauagcggaaaucu

SEQ ID NO: 1971863 - RNA, 15 nt, Shigella flexneri 2a str. 301
ugcugacggcacuac

SEQ ID NO: 1971864 - RNA, 17 nt, Shigella flexneri 2a str. 301
ugcugacgcaucuucuc

SEQ ID NO: 1971865 - RNA, 18 nt, Shigella flexneri 2a str. 301
ugcugaacuuaugcaaaa

SEQ ID NO: 1971866 - RNA, 19 nt, Shigella flexneri 2a str. 301
ugcugaacagcuuuuuccu

SEQ ID NO: 1971867 - RNA, 16 nt, Shigella flexneri 2a str. 301
ugcucuuucagcaccg

SEQ ID NO: 1971868 - RNA, 18 nt, Shigella flexneri 2a str. 301
ugcucguauaaugacugc

SEQ ID NO: 1971869 - RNA, 23 nt, Shigella flexneri 2a str. 301
ugcugaaacuuaacucacugugg

SEQ ID NO: 1971870 - RNA, 18 nt, Shigella flexneri 2a str. 301
ugcugaaagggcaaauaa

SEQ ID NO: 1971871 - RNA, 17 nt, Shigella flexneri 2a str. 301
ugcugauucgucaauau

SEQ ID NO: 1971872 - RNA, 21 nt, Shigella flexneri 2a str. 301
ugcugcaccaacaucaugcca

SEQ ID NO: 1971873 - RNA, 14 nt, Shigella flexneri 2a str. 301
ugcugaugcacgau

SEQ ID NO: 1971874 - RNA, 21 nt, Shigella flexneri 2a str. 301
ugcugauggcgggauguguaa

SEQ ID NO: 1971875 - RNA, 15 nt, Shigella flexneri 2a str. 301
ugcugauaacgugca

SEQ ID NO: 1971876 - RNA, 14 nt, Shigella flexneri 2a str. 301
ugcugcacgaaauu

SEQ ID NO: 1971877 - RNA, 20 nt, Shigella flexneri 2a str. 301
ugcugcauugagguaaacag

SEQ ID NO: 1971878 - RNA, 19 nt, Shigella flexneri 2a str. 301
ugcugccgacaaaugcagu

SEQ ID NO: 1971879 - RNA, 14 nt, Shigella flexneri 2a str. 301
ugcucaacugccag

SEQ ID NO: 1971880 - RNA, 22 nt, Shigella flexneri 2a str. 301
ugcucaacccuuuccagcgccg

SEQ ID NO: 1971881 - RNA, 17 nt, Shigella flexneri 2a str. 301
ugcucaaucaucacgau

SEQ ID NO: 1971882 - RNA, 22 nt, Shigella flexneri 2a str. 301
ugcguugucaucgaauaaauug

SEQ ID NO: 1971883 - RNA, 21 nt, Shigella flexneri 2a str. 301
ugcucaucgauaucgaccacu

SEQ ID NO: 1971884 - RNA, 19 nt, Shigella flexneri 2a str. 301
ugcucauuacaguagcuau

SEQ ID NO: 1971885 - RNA, 23 nt, Shigella flexneri 2a str. 301
ugcucaauugacaguuuauuuuc

SEQ ID NO: 1971886 - RNA, 20 nt, Shigella flexneri 2a str. 301
ugcucaauugacaguuuauu

SEQ ID NO: 1971887 - RNA, 13 nt, Shigella flexneri 2a str. 301
ugcucaaugaguu

SEQ ID NO: 1971888 - RNA, 16 nt, Shigella flexneri 2a str. 301
ugcucaaugagcaccu

SEQ ID NO: 1971889 - RNA, 15 nt, Shigella flexneri 2a str. 301
ugcucauaaaaugau

SEQ ID NO: 1971890 - RNA, 16 nt, Shigella flexneri 2a str. 301
ugcucccgcagugaaa

SEQ ID NO: 1971891 - RNA, 14 nt, Shigella flexneri 2a str. 301
ugcuccacgcugca

SEQ ID NO: 1971892 - RNA, 22 nt, Shigella flexneri 2a str. 301
ugcucgaacauccccacagaaa

SEQ ID NO: 1971893 - RNA, 14 nt, Shigella flexneri 2a str. 301
ugcuccuccuucuc

SEQ ID NO: 1971894 - RNA, 20 nt, Shigella flexneri 2a str. 301
ugcucgccacgucacucuuu

SEQ ID NO: 1971895 - RNA, 12 nt, Shigella flexneri 2a str. 301
ugcucguacguu

SEQ ID NO: 1971896 - RNA, 18 nt, Shigella flexneri 2a str. 301
ugcucgcccuggaugcag

SEQ ID NO: 1971897 - RNA, 16 nt, Shigella flexneri 2a str. 301
ugcucgcccuggaugc

SEQ ID NO: 1971898 - RNA, 18 nt, Shigella flexneri 2a str. 301
ugcuggaaccacagcgcc

SEQ ID NO: 1971899 - RNA, 13 nt, Shigella flexneri 2a str. 301
ugcuggaaaaccu

SEQ ID NO: 1971900 - RNA, 19 nt, Shigella flexneri 2a str. 301
ugcugcuuuugcuucuaug

SEQ ID NO: 1971901 - RNA, 16 nt, Shigella flexneri 2a str. 301
ugcugggauaauugcg

SEQ ID NO: 1971902 - RNA, 17 nt, Shigella flexneri 2a str. 301
ugcuggcguugucaucg

SEQ ID NO: 1971903 - RNA, 22 nt, Shigella flexneri 2a str. 301
ugcugccgauggcgcaaacuua

SEQ ID NO: 1971904 - RNA, 13 nt, Shigella flexneri 2a str. 301
ugcugccgcgcca

SEQ ID NO: 1971905 - RNA, 16 nt, Shigella flexneri 2a str. 301
ugcugccguuuuuauu

SEQ ID NO: 1971906 - RNA, 18 nt, Shigella flexneri 2a str. 301
ugcugcugauccagcuuc

SEQ ID NO: 1971907 - RNA, 23 nt, Shigella flexneri 2a str. 301
ugcugcugauccagcuuccaggc

SEQ ID NO: 1971908 - RNA, 21 nt, Shigella flexneri 2a str. 301
ugcuggggauucguuuuucuu

SEQ ID NO: 1971909 - RNA, 16 nt, Shigella flexneri 2a str. 301
ugcuggggccaauacc

SEQ ID NO: 1971910 - RNA, 18 nt, Shigella flexneri 2a str. 301
ugcugguuuugugcgcca

SEQ ID NO: 1971911 - RNA, 15 nt, Shigella flexneri 2a str. 301
ugcuguaaaaugagu

SEQ ID NO: 1971912 - RNA, 14 nt, Shigella flexneri 2a str. 301
ugcuguaauuucac

SEQ ID NO: 1971913 - RNA, 17 nt, Shigella flexneri 2a str. 301
ugcuguacauauccagu

SEQ ID NO: 1971914 - RNA, 19 nt, Shigella flexneri 2a str. 301
ugcuguaaauucucaauau

SEQ ID NO: 1971915 - RNA, 12 nt, Shigella flexneri 2a str. 301
ugcuguaaacaa

SEQ ID NO: 1971916 - RNA, 21 nt, Shigella flexneri 2a str. 301
ugcuguaaacaacaugguccu

SEQ ID NO: 1971917 - RNA, 15 nt, Shigella flexneri 2a str. 301
ugcugugguuugccc

SEQ ID NO: 1971918 - RNA, 18 nt, Shigella flexneri 2a str. 301
ugcuguggauucagcacc

SEQ ID NO: 1971919 - RNA, 18 nt, Shigella flexneri 2a str. 301
ugcuguaucacuaugaaa

SEQ ID NO: 1971920 - RNA, 16 nt, Shigella flexneri 2a str. 301
ugcuguguucaauauc

SEQ ID NO: 1971921 - RNA, 22 nt, Shigella flexneri 2a str. 301
ugcuguuacgccagaacagcua

SEQ ID NO: 1971922 - RNA, 20 nt, Shigella flexneri 2a str. 301
ugcuguucgguuuugcccac

SEQ ID NO: 1971923 - RNA, 15 nt, Shigella flexneri 2a str. 301
ugcuguugaugcgua

SEQ ID NO: 1971924 - RNA, 18 nt, Shigella flexneri 2a str. 301
ugcuuacuuacgaaaaaa

SEQ ID NO: 1971925 - RNA, 18 nt, Shigella flexneri 2a str. 301
ugcuucacgcccagaucc

SEQ ID NO: 1971926 - RNA, 22 nt, Shigella flexneri 2a str. 301
ugcuucagccgcacuuuuuaaa

SEQ ID NO: 1971927 - RNA, 23 nt, Shigella flexneri 2a str. 301
ugcuugcacaaccggaaccagcg

SEQ ID NO: 1971928 - RNA, 16 nt, Shigella flexneri 2a str. 301
ugcuucaccagcagcg

SEQ ID NO: 1971929 - RNA, 12 nt, Shigella flexneri 2a str. 301
ugcuucaccgau

SEQ ID NO: 1971930 - RNA, 14 nt, Shigella flexneri 2a str. 301
ugcuucacacuggg

SEQ ID NO: 1971931 - RNA, 22 nt, Shigella flexneri 2a str. 301
ugcuuaucgcgaugauuuucgc

SEQ ID NO: 1971932 - RNA, 19 nt, Shigella flexneri 2a str. 301
ugcuuugguggucaccaug

SEQ ID NO: 1971933 - RNA, 15 nt, Shigella flexneri 2a str. 301
ugcuuuggcugccgc

SEQ ID NO: 1971934 - RNA, 15 nt, Shigella flexneri 2a str. 301
ugcuuuaaucgccuu

SEQ ID NO: 1971935 - RNA, 15 nt, Shigella flexneri 2a str. 301
ugcuuuaaguucagc

SEQ ID NO: 1971936 - RNA, 19 nt, Shigella flexneri 2a str. 301
ugcuuuauacgaugccugc

SEQ ID NO: 1971937 - RNA, 15 nt, Shigella flexneri 2a str. 301
ugcuuuaucaaucac

SEQ ID NO: 1971938 - RNA, 11 nt, Shigella flexneri 2a str. 301
ugcuuuaaaag

SEQ ID NO: 1971939 - RNA, 20 nt, Shigella flexneri 2a str. 301
ugcuugccggaagcaaaaua

SEQ ID NO: 1971940 - RNA, 13 nt, Shigella flexneri 2a str. 301
ugcgccagcgcgc

SEQ ID NO: 1971941 - RNA, 12 nt, Shigella flexneri 2a str. 301
ugcgccagcucg

SEQ ID NO: 1971942 - RNA, 19 nt, Shigella flexneri 2a str. 301
ugccuguacggcagugaac

SEQ ID NO: 1971943 - RNA, 13 nt, Shigella flexneri 2a str. 301
ugccuuccauccc

SEQ ID NO: 1971944 - RNA, 21 nt, Shigella flexneri 2a str. 301
ugcgcccugggcuucauccag

SEQ ID NO: 1971945 - RNA, 14 nt, Shigella flexneri 2a str. 301
ugcgcccuguucug

SEQ ID NO: 1971946 - RNA, 21 nt, Shigella flexneri 2a str. 301
ugcgccccacaccaccaugcu

SEQ ID NO: 1971947 - RNA, 23 nt, Shigella flexneri 2a str. 301
ugcgcccgaaugcgaaaauccuc

SEQ ID NO: 1971948 - RNA, 21 nt, Shigella flexneri 2a str. 301
ugcgccaucgccacaccagua

SEQ ID NO: 1971949 - RNA, 22 nt, Shigella flexneri 2a str. 301
ugcgccauaccaugcaccaacc

SEQ ID NO: 1971950 - RNA, 17 nt, Shigella flexneri 2a str. 301
ugcgcgacucccugacu

SEQ ID NO: 1971951 - RNA, 16 nt, Shigella flexneri 2a str. 301
ugcgcgagguuaaaaa

SEQ ID NO: 1971952 - RNA, 13 nt, Shigella flexneri 2a str. 301
ugcgccugggccg

SEQ ID NO: 1971953 - RNA, 18 nt, Shigella flexneri 2a str. 301
ugcgccucgccgcugccu

SEQ ID NO: 1971954 - RNA, 17 nt, Shigella flexneri 2a str. 301
ugcgccuggauuuucuc

SEQ ID NO: 1971955 - RNA, 21 nt, Shigella flexneri 2a str. 301
ugcgccugcgaccagaccagg

SEQ ID NO: 1971956 - RNA, 18 nt, Shigella flexneri 2a str. 301
ugcgcgcaaucagcaccg

SEQ ID NO: 1971957 - RNA, 21 nt, Shigella flexneri 2a str. 301
ugcgcgccgccgcugaacuga

SEQ ID NO: 1971958 - RNA, 19 nt, Shigella flexneri 2a str. 301
ugcgcggauggccucugcc

SEQ ID NO: 1971959 - RNA, 20 nt, Shigella flexneri 2a str. 301
ugcgguccaugcgaagaccg

SEQ ID NO: 1971960 - RNA, 19 nt, Shigella flexneri 2a str. 301
ugcggcgcaugcauuuuca

SEQ ID NO: 1971961 - RNA, 18 nt, Shigella flexneri 2a str. 301
ugcggcgcaccagcaggc

SEQ ID NO: 1971962 - RNA, 16 nt, Shigella flexneri 2a str. 301
ugcggcggaacaucaa

SEQ ID NO: 1971963 - RNA, 15 nt, Shigella flexneri 2a str. 301
ugcgguuaaugguug

SEQ ID NO: 1971964 - RNA, 19 nt, Shigella flexneri 2a str. 301
ugcgucucugguuuuacaa

SEQ ID NO: 1971965 - RNA, 18 nt, Shigella flexneri 2a str. 301
ugcguaaucuuuucauau

SEQ ID NO: 1971966 - RNA, 19 nt, Shigella flexneri 2a str. 301
ugcgugcgcugcuuguucc

SEQ ID NO: 1971967 - RNA, 15 nt, Shigella flexneri 2a str. 301
ugcgucuuccgugcc

SEQ ID NO: 1971968 - RNA, 20 nt, Shigella flexneri 2a str. 301
ugcgucucuuguugcaacaa

SEQ ID NO: 1971969 - RNA, 16 nt, Shigella flexneri 2a str. 301
ugcgugacuaaaaccc

SEQ ID NO: 1971970 - RNA, 17 nt, Shigella flexneri 2a str. 301
ugcggcaucuucuccac

SEQ ID NO: 1971971 - RNA, 16 nt, Shigella flexneri 2a str. 301
ugcggcauucccagcc

SEQ ID NO: 1971972 - RNA, 19 nt, Shigella flexneri 2a str. 301
ugcggcgaaaacgccacau

SEQ ID NO: 1971973 - RNA, 19 nt, Shigella flexneri 2a str. 301
ugcggagacucaaaccccg

SEQ ID NO: 1971974 - RNA, 22 nt, Shigella flexneri 2a str. 301
ugcggacagucacguagcggcg

SEQ ID NO: 1971975 - RNA, 17 nt, Shigella flexneri 2a str. 301
ugcggaacccagcgcga

SEQ ID NO: 1971976 - RNA, 22 nt, Shigella flexneri 2a str. 301
ugcggacaaaacgugacagcau

SEQ ID NO: 1971977 - RNA, 16 nt, Shigella flexneri 2a str. 301
ugcgcucauacuucca

SEQ ID NO: 1971978 - RNA, 13 nt, Shigella flexneri 2a str. 301
ugcggaaaaaaga

SEQ ID NO: 1971979 - RNA, 20 nt, Shigella flexneri 2a str. 301
ugcggaaaaaagaaagaagc

SEQ ID NO: 1971980 - RNA, 14 nt, Shigella flexneri 2a str. 301
ugcgcgugcagugg

SEQ ID NO: 1971981 - RNA, 16 nt, Shigella flexneri 2a str. 301
ugcgcuaaauguuuag

SEQ ID NO: 1971982 - RNA, 21 nt, Shigella flexneri 2a str. 301
ugcgcuacgcucaucaggccu

SEQ ID NO: 1971983 - RNA, 21 nt, Shigella flexneri 2a str. 301
ugcgcuacgcuuaucaggccu

SEQ ID NO: 1971984 - RNA, 12 nt, Shigella flexneri 2a str. 301
ugcaucugaaac

SEQ ID NO: 1971985 - RNA, 17 nt, Shigella flexneri 2a str. 301
ugcaucuucacacugau

SEQ ID NO: 1971986 - RNA, 15 nt, Shigella flexneri 2a str. 301
ugcaucggugcgcug

SEQ ID NO: 1971987 - RNA, 11 nt, Shigella flexneri 2a str. 301
ugcaucggcaa

SEQ ID NO: 1971988 - RNA, 23 nt, Shigella flexneri 2a str. 301
ugcaucgucuguuuuaucucccu

SEQ ID NO: 1971989 - RNA, 23 nt, Shigella flexneri 2a str. 301
ugcaucgccauaauaagcgccau

SEQ ID NO: 1971990 - RNA, 21 nt, Shigella flexneri 2a str. 301
ugcaucgccaaucugcugaua

SEQ ID NO: 1971991 - RNA, 17 nt, Shigella flexneri 2a str. 301
ugcaucgcgaccaauca

SEQ ID NO: 1971992 - RNA, 23 nt, Shigella flexneri 2a str. 301
ugcauccggucagacaacuuccc

SEQ ID NO: 1971993 - RNA, 15 nt, Shigella flexneri 2a str. 301
ugcauccguucuucg

SEQ ID NO: 1971994 - RNA, 15 nt, Shigella flexneri 2a str. 301
ugcaucauggaagca

SEQ ID NO: 1971995 - RNA, 13 nt, Shigella flexneri 2a str. 301
ugcaucagugaca

SEQ ID NO: 1971996 - RNA, 16 nt, Shigella flexneri 2a str. 301
ugcauccacuuugguu

SEQ ID NO: 1971997 - RNA, 14 nt, Shigella flexneri 2a str. 301
ugcauccagcagcc

SEQ ID NO: 1971998 - RNA, 19 nt, Shigella flexneri 2a str. 301
ugcauggucgauucuuaua

SEQ ID NO: 1971999 - RNA, 17 nt, Shigella flexneri 2a str. 301
ugcauggucgauucuua

SEQ ID NO: 1972000 - RNA, 16 nt, Shigella flexneri 2a str. 301
ugcauguaaaucaagc

SEQ ID NO: 1972001 - RNA, 14 nt, Shigella flexneri 2a str. 301
ugcaugacagcgcc

SEQ ID NO: 1972002 - RNA, 14 nt, Shigella flexneri 2a str. 301
ugcaugcccggcau

SEQ ID NO: 1972003 - RNA, 18 nt, Shigella flexneri 2a str. 301
ugcaugcgaaugcagggc

SEQ ID NO: 1972004 - RNA, 17 nt, Shigella flexneri 2a str. 301
ugcauggcagauaaaca

SEQ ID NO: 1972005 - RNA, 15 nt, Shigella flexneri 2a str. 301
ugcagugcaaugacu

SEQ ID NO: 1972006 - RNA, 21 nt, Shigella flexneri 2a str. 301
ugcagugaucgugugccacca

SEQ ID NO: 1972007 - RNA, 19 nt, Shigella flexneri 2a str. 301
ugcacucgcauccucuuua

SEQ ID NO: 1972008 - RNA, 19 nt, Shigella flexneri 2a str. 301
ugcacuagacgaugaaaaa

SEQ ID NO: 1972009 - RNA, 22 nt, Shigella flexneri 2a str. 301
ugcacuacccaguauguaacug

SEQ ID NO: 1972010 - RNA, 17 nt, Shigella flexneri 2a str. 301
ugcaguuccugcaacuu

SEQ ID NO: 1972011 - RNA, 15 nt, Shigella flexneri 2a str. 301
ugcaguuccugcaac

SEQ ID NO: 1972012 - RNA, 15 nt, Shigella flexneri 2a str. 301
ugcauaaaugccgca

SEQ ID NO: 1972013 - RNA, 19 nt, Shigella flexneri 2a str. 301
ugcauaacagauaaaucau

SEQ ID NO: 1972014 - RNA, 20 nt, Shigella flexneri 2a str. 301
ugcauaaucgacauuuccug

SEQ ID NO: 1972015 - RNA, 13 nt, Shigella flexneri 2a str. 301
ugcauaauuucuu

SEQ ID NO: 1972016 - RNA, 18 nt, Shigella flexneri 2a str. 301
ugcauagcagcacaccac

SEQ ID NO: 1972017 - RNA, 13 nt, Shigella flexneri 2a str. 301
ugcauaggcggca

SEQ ID NO: 1972018 - RNA, 23 nt, Shigella flexneri 2a str. 301
ugcauauccaggcuaauccaguc

SEQ ID NO: 1972019 - RNA, 16 nt, Shigella flexneri 2a str. 301
ugcauaucucccagua

SEQ ID NO: 1972020 - RNA, 22 nt, Shigella flexneri 2a str. 301
ugcaucacauccggcaauauuc

SEQ ID NO: 1972021 - RNA, 19 nt, Shigella flexneri 2a str. 301
ugcaucagcacgacuauua

SEQ ID NO: 1972022 - RNA, 17 nt, Shigella flexneri 2a str. 301
ugcaucagaucggcagg

SEQ ID NO: 1972023 - RNA, 18 nt, Shigella flexneri 2a str. 301
ugccaaacgcguccauca

SEQ ID NO: 1972024 - RNA, 13 nt, Shigella flexneri 2a str. 301
ugccaaagccagu

SEQ ID NO: 1972025 - RNA, 13 nt, Shigella flexneri 2a str. 301
ugcauuugcugca

SEQ ID NO: 1972026 - RNA, 20 nt, Shigella flexneri 2a str. 301
ugcauuucgcuaccaccaaa

SEQ ID NO: 1972027 - RNA, 19 nt, Shigella flexneri 2a str. 301
ugcauuuccgcugauucaa

SEQ ID NO: 1972028 - RNA, 15 nt, Shigella flexneri 2a str. 301
ugcauuucauugagc

SEQ ID NO: 1972029 - RNA, 15 nt, Shigella flexneri 2a str. 301
ugcauuuauauuaca

SEQ ID NO: 1972030 - RNA, 14 nt, Shigella flexneri 2a str. 301
ugcauuguuugcaa

SEQ ID NO: 1972031 - RNA, 18 nt, Shigella flexneri 2a str. 301
ugcauugauggaguaguu

SEQ ID NO: 1972032 - RNA, 21 nt, Shigella flexneri 2a str. 301
ugccacacaggccauuucccc

SEQ ID NO: 1972033 - RNA, 16 nt, Shigella flexneri 2a str. 301
ugccacacaggccauu

SEQ ID NO: 1972034 - RNA, 16 nt, Shigella flexneri 2a str. 301
ugccaauggcaggcuc

SEQ ID NO: 1972035 - RNA, 20 nt, Shigella flexneri 2a str. 301
ugccaaauauuucuuuauca

SEQ ID NO: 1972036 - RNA, 14 nt, Shigella flexneri 2a str. 301
ugccaaauauuucu

SEQ ID NO: 1972037 - RNA, 18 nt, Shigella flexneri 2a str. 301
ugccacacgcccaacuaa

SEQ ID NO: 1972038 - RNA, 19 nt, Shigella flexneri 2a str. 301
ugccacacgcccaacuaaa

SEQ ID NO: 1972039 - RNA, 20 nt, Shigella flexneri 2a str. 301
ugccacccugcggcugcuga

SEQ ID NO: 1972040 - RNA, 16 nt, Shigella flexneri 2a str. 301
ugccacgccacagccg

SEQ ID NO: 1972041 - RNA, 16 nt, Shigella flexneri 2a str. 301
ugccacgccacgcugc

SEQ ID NO: 1972042 - RNA, 15 nt, Shigella flexneri 2a str. 301
ugccaccugugcaau

SEQ ID NO: 1972043 - RNA, 16 nt, Shigella flexneri 2a str. 301
ugccacguucugaucu

SEQ ID NO: 1972044 - RNA, 19 nt, Shigella flexneri 2a str. 301
ugccaguacgccaaucugc

SEQ ID NO: 1972045 - RNA, 22 nt, Shigella flexneri 2a str. 301
ugccaguacccaugugauuuaa

SEQ ID NO: 1972046 - RNA, 19 nt, Shigella flexneri 2a str. 301
ugccaguaauccggcuucc

SEQ ID NO: 1972047 - RNA, 20 nt, Shigella flexneri 2a str. 301
ugccaguaacagaacgcaua

SEQ ID NO: 1972048 - RNA, 23 nt, Shigella flexneri 2a str. 301
ugccaguaacagaacgcauaaca

SEQ ID NO: 1972049 - RNA, 13 nt, Shigella flexneri 2a str. 301
ugccauccagcuu

SEQ ID NO: 1972050 - RNA, 20 nt, Shigella flexneri 2a str. 301
ugccaugacuuucuggcacg

SEQ ID NO: 1972051 - RNA, 18 nt, Shigella flexneri 2a str. 301
ugccaugcacgcaagaac

SEQ ID NO: 1972052 - RNA, 14 nt, Shigella flexneri 2a str. 301
ugccaucucugcaa

SEQ ID NO: 1972053 - RNA, 23 nt, Shigella flexneri 2a str. 301
ugccaucgcauagcgcaauaaca

SEQ ID NO: 1972054 - RNA, 15 nt, Shigella flexneri 2a str. 301
ugccagccgccgcua

SEQ ID NO: 1972055 - RNA, 22 nt, Shigella flexneri 2a str. 301
ugccagccgccgcuaucggcaa

SEQ ID NO: 1972056 - RNA, 22 nt, Shigella flexneri 2a str. 301
ugccaggucaucauugcaguca

SEQ ID NO: 1972057 - RNA, 21 nt, Shigella flexneri 2a str. 301
ugccagguaaacaccuucauc

SEQ ID NO: 1972058 - RNA, 20 nt, Shigella flexneri 2a str. 301
ugccagggcuuuuuuauuuc

SEQ ID NO: 1972059 - RNA, 23 nt, Shigella flexneri 2a str. 301
ugccaggcuggcagaugcgucuu

SEQ ID NO: 1972060 - RNA, 14 nt, Shigella flexneri 2a str. 301
ugccagauacaaaa

SEQ ID NO: 1972061 - RNA, 16 nt, Shigella flexneri 2a str. 301
ugccagauaaauauua

SEQ ID NO: 1972062 - RNA, 15 nt, Shigella flexneri 2a str. 301
ugccagauaagacac

SEQ ID NO: 1972063 - RNA, 16 nt, Shigella flexneri 2a str. 301
ugccagaugcagcggu

SEQ ID NO: 1972064 - RNA, 15 nt, Shigella flexneri 2a str. 301
ugccagauguugucu

SEQ ID NO: 1972065 - RNA, 17 nt, Shigella flexneri 2a str. 301
ugccagauucuccaaca

SEQ ID NO: 1972066 - RNA, 18 nt, Shigella flexneri 2a str. 301
ugccagacaacaugagaa

SEQ ID NO: 1972067 - RNA, 23 nt, Shigella flexneri 2a str. 301
ugccagaauuaacgcugacaccc

SEQ ID NO: 1972068 - RNA, 22 nt, Shigella flexneri 2a str. 301
ugccagaauagccgcagccauc

SEQ ID NO: 1972069 - RNA, 19 nt, Shigella flexneri 2a str. 301
ugccagaauccccacugca

SEQ ID NO: 1972070 - RNA, 22 nt, Shigella flexneri 2a str. 301
ugccagacgaauaaaacagaaa

SEQ ID NO: 1972071 - RNA, 18 nt, Shigella flexneri 2a str. 301
ugccagaccaaacagcau

SEQ ID NO: 1972072 - RNA, 16 nt, Shigella flexneri 2a str. 301
ugccgccucugccgca

SEQ ID NO: 1972073 - RNA, 22 nt, Shigella flexneri 2a str. 301
ugccgccgcagaaaaagagcau

SEQ ID NO: 1972074 - RNA, 13 nt, Shigella flexneri 2a str. 301
ugccgcagcuucu

SEQ ID NO: 1972075 - RNA, 20 nt, Shigella flexneri 2a str. 301
ugccgcagaagaucagaaau

SEQ ID NO: 1972076 - RNA, 13 nt, Shigella flexneri 2a str. 301
ugccgcagcaccc

SEQ ID NO: 1972077 - RNA, 20 nt, Shigella flexneri 2a str. 301
ugccgcccuaaagggcggca

SEQ ID NO: 1972078 - RNA, 17 nt, Shigella flexneri 2a str. 301
ugccgcccuaaagggcg

SEQ ID NO: 1972079 - RNA, 16 nt, Shigella flexneri 2a str. 301
ugccgcccguuuucuc

SEQ ID NO: 1972080 - RNA, 17 nt, Shigella flexneri 2a str. 301
ugccgauacgcuggaug

SEQ ID NO: 1972081 - RNA, 20 nt, Shigella flexneri 2a str. 301
ugccgcacuuugagcagcug

SEQ ID NO: 1972082 - RNA, 15 nt, Shigella flexneri 2a str. 301
ugcccugcuaugcaa

SEQ ID NO: 1972083 - RNA, 21 nt, Shigella flexneri 2a str. 301
ugcccuaucacgccaccagca

SEQ ID NO: 1972084 - RNA, 18 nt, Shigella flexneri 2a str. 301
ugcccgaugaccuuguca

SEQ ID NO: 1972085 - RNA, 23 nt, Shigella flexneri 2a str. 301
ugcccgaugaccuugucaugcag

SEQ ID NO: 1972086 - RNA, 16 nt, Shigella flexneri 2a str. 301
ugcccgaccacuucau

SEQ ID NO: 1972087 - RNA, 19 nt, Shigella flexneri 2a str. 301
ugcccgacuugagcgcagu

SEQ ID NO: 1972088 - RNA, 19 nt, Shigella flexneri 2a str. 301
ugcccgagcgccauuucuu

SEQ ID NO: 1972089 - RNA, 14 nt, Shigella flexneri 2a str. 301
ugcccguuccaggc

SEQ ID NO: 1972090 - RNA, 17 nt, Shigella flexneri 2a str. 301
ugcccucaauaucuuuc

SEQ ID NO: 1972091 - RNA, 14 nt, Shigella flexneri 2a str. 301
ugcccuacaaacug

SEQ ID NO: 1972092 - RNA, 21 nt, Shigella flexneri 2a str. 301
ugcccguuggcagaccgccaa

SEQ ID NO: 1972093 - RNA, 16 nt, Shigella flexneri 2a str. 301
ugcccggagcagcagu

SEQ ID NO: 1972094 - RNA, 21 nt, Shigella flexneri 2a str. 301
ugcccggaaguaccaauggca

SEQ ID NO: 1972095 - RNA, 22 nt, Shigella flexneri 2a str. 301
ugcccgcuuaacguacugcuga

SEQ ID NO: 1972096 - RNA, 21 nt, Shigella flexneri 2a str. 301
ugccauuaacaggccaaaugc

SEQ ID NO: 1972097 - RNA, 16 nt, Shigella flexneri 2a str. 301
ugccauuuccagcgcu

SEQ ID NO: 1972098 - RNA, 19 nt, Shigella flexneri 2a str. 301
ugccauuggcauaaauaau

SEQ ID NO: 1972099 - RNA, 24 nt, Shigella flexneri 2a str. 301
ugccauuucuggcgucaaagcugc

SEQ ID NO: 1972100 - RNA, 14 nt, Shigella flexneri 2a str. 301
ugcccgaagccaau

SEQ ID NO: 1972101 - RNA, 18 nt, Shigella flexneri 2a str. 301
ugcccgaaugcagcucca

SEQ ID NO: 1972102 - RNA, 13 nt, Shigella flexneri 2a str. 301
ugcccgaagccaa

SEQ ID NO: 1972103 - RNA, 13 nt, Shigella flexneri 2a str. 301
ugccccaguuccu

SEQ ID NO: 1972104 - RNA, 14 nt, Shigella flexneri 2a str. 301
ugccccauauggcc

SEQ ID NO: 1972105 - RNA, 22 nt, Shigella flexneri 2a str. 301
ugccguugcuugaugcacuggg

SEQ ID NO: 1972106 - RNA, 18 nt, Shigella flexneri 2a str. 301
ugccguuugcugcaugau

SEQ ID NO: 1972107 - RNA, 19 nt, Shigella flexneri 2a str. 301
ugccguuauacaucgcuuu

SEQ ID NO: 1972108 - RNA, 19 nt, Shigella flexneri 2a str. 301
ugccguggcgauacacuga

SEQ ID NO: 1972109 - RNA, 12 nt, Shigella flexneri 2a str. 301
ugccgugcagca

SEQ ID NO: 1972110 - RNA, 21 nt, Shigella flexneri 2a str. 301
ugccggucgcgcgggaaauca

SEQ ID NO: 1972111 - RNA, 14 nt, Shigella flexneri 2a str. 301
ugccguacagacag

SEQ ID NO: 1972112 - RNA, 15 nt, Shigella flexneri 2a str. 301
ugccguacaggcagc

SEQ ID NO: 1972113 - RNA, 13 nt, Shigella flexneri 2a str. 301
ugccgguuauuuu

SEQ ID NO: 1972114 - RNA, 22 nt, Shigella flexneri 2a str. 301
ugccuacacaaugccugaugcg

SEQ ID NO: 1972115 - RNA, 19 nt, Shigella flexneri 2a str. 301
ugccuacacaaugccugau

SEQ ID NO: 1972116 - RNA, 19 nt, Shigella flexneri 2a str. 301
ugccuaauaaaucuaaaac

SEQ ID NO: 1972117 - RNA, 14 nt, Shigella flexneri 2a str. 301
ugccucguucuucc

SEQ ID NO: 1972118 - RNA, 17 nt, Shigella flexneri 2a str. 301
ugccucugcgcccagca

SEQ ID NO: 1972119 - RNA, 21 nt, Shigella flexneri 2a str. 301
ugccucuccuguucucacuaa

SEQ ID NO: 1972120 - RNA, 22 nt, Shigella flexneri 2a str. 301
ugccugggcgauuuccuucagc

SEQ ID NO: 1972121 - RNA, 21 nt, Shigella flexneri 2a str. 301
ugccuguccucuucagcauca

SEQ ID NO: 1972122 - RNA, 21 nt, Shigella flexneri 2a str. 301
ugccugggcgauuuccuucag

SEQ ID NO: 1972123 - RNA, 17 nt, Shigella flexneri 2a str. 301
ugccgcuuccagcagac

SEQ ID NO: 1972124 - RNA, 14 nt, Shigella flexneri 2a str. 301
ugccgcuacaucac

SEQ ID NO: 1972125 - RNA, 14 nt, Shigella flexneri 2a str. 301
ugccgcucaccuga

SEQ ID NO: 1972126 - RNA, 16 nt, Shigella flexneri 2a str. 301
ugccgcguaaucaaca

SEQ ID NO: 1972127 - RNA, 21 nt, Shigella flexneri 2a str. 301
ugccgcguaaucaacauauuc

SEQ ID NO: 1972128 - RNA, 21 nt, Shigella flexneri 2a str. 301
ugccgcgccagaucagggaag

SEQ ID NO: 1972129 - RNA, 18 nt, Shigella flexneri 2a str. 301
ugccggaagacacauugc

SEQ ID NO: 1972130 - RNA, 15 nt, Shigella flexneri 2a str. 301
ugccgcuuuuuccag

SEQ ID NO: 1972131 - RNA, 15 nt, Shigella flexneri 2a str. 301
ugccggggcgcggcg

SEQ ID NO: 1972132 - RNA, 20 nt, Shigella flexneri 2a str. 301
uuaccaaauuggcaaaauuu

SEQ ID NO: 1972133 - RNA, 22 nt, Shigella flexneri 2a str. 301
uuaccaaauaaacgaaucugca

SEQ ID NO: 1972134 - RNA, 18 nt, Shigella flexneri 2a str. 301
uuaccaaauuggcaaaau

SEQ ID NO: 1972135 - RNA, 13 nt, Shigella flexneri 2a str. 301
uuacagcaccuua

SEQ ID NO: 1972136 - RNA, 14 nt, Shigella flexneri 2a str. 301
uuacagcucucacu

SEQ ID NO: 1972137 - RNA, 21 nt, Shigella flexneri 2a str. 301
uuacagccagccgcuaacuuc

SEQ ID NO: 1972138 - RNA, 15 nt, Shigella flexneri 2a str. 301
uuacagccugccagc

SEQ ID NO: 1972139 - RNA, 15 nt, Shigella flexneri 2a str. 301
uuacaucaucagaaa

SEQ ID NO: 1972140 - RNA, 12 nt, Shigella flexneri 2a str. 301
uuacagaaucug

SEQ ID NO: 1972141 - RNA, 15 nt, Shigella flexneri 2a str. 301
uuaaugcgcccagcg

SEQ ID NO: 1972142 - RNA, 19 nt, Shigella flexneri 2a str. 301
uuaaugccucuccccagcg

SEQ ID NO: 1972143 - RNA, 13 nt, Shigella flexneri 2a str. 301
uuaaugcgcuuuu

SEQ ID NO: 1972144 - RNA, 16 nt, Shigella flexneri 2a str. 301
uuaauggcaaaaacuu

SEQ ID NO: 1972145 - RNA, 16 nt, Shigella flexneri 2a str. 301
uuaauuauuaacaaaa

SEQ ID NO: 1972146 - RNA, 14 nt, Shigella flexneri 2a str. 301
uuaauuauccccuc

SEQ ID NO: 1972147 - RNA, 23 nt, Shigella flexneri 2a str. 301
uuaaugaucgcgccgccgcccau

SEQ ID NO: 1972148 - RNA, 18 nt, Shigella flexneri 2a str. 301
uuaaugcaccaacaaaua

SEQ ID NO: 1972149 - RNA, 19 nt, Shigella flexneri 2a str. 301
uuaaugccacauuagauaa

SEQ ID NO: 1972150 - RNA, 22 nt, Shigella flexneri 2a str. 301
uuaaugccacauuagauaaaaa

SEQ ID NO: 1972151 - RNA, 13 nt, Shigella flexneri 2a str. 301
uuaaucugguauc

SEQ ID NO: 1972152 - RNA, 17 nt, Shigella flexneri 2a str. 301
uuaaucuuccagaucac

SEQ ID NO: 1972153 - RNA, 15 nt, Shigella flexneri 2a str. 301
uuaauaccugccugg

SEQ ID NO: 1972154 - RNA, 18 nt, Shigella flexneri 2a str. 301
uuaauaccgagcguucaa

SEQ ID NO: 1972155 - RNA, 11 nt, Shigella flexneri 2a str. 301
uuacucucugg

SEQ ID NO: 1972156 - RNA, 20 nt, Shigella flexneri 2a str. 301
uuacugacuagaugugcagu

SEQ ID NO: 1972157 - RNA, 16 nt, Shigella flexneri 2a str. 301
uuacugagagaaaaaa

SEQ ID NO: 1972158 - RNA, 15 nt, Shigella flexneri 2a str. 301
uuacuuuauuuauau

SEQ ID NO: 1972159 - RNA, 15 nt, Shigella flexneri 2a str. 301
uuacugucugcuucu

SEQ ID NO: 1972160 - RNA, 16 nt, Shigella flexneri 2a str. 301
uuacugucgcgcagca

SEQ ID NO: 1972161 - RNA, 14 nt, Shigella flexneri 2a str. 301
uuacugucugcuuc

SEQ ID NO: 1972162 - RNA, 22 nt, Shigella flexneri 2a str. 301
uuacugcguauuuccugccaga

SEQ ID NO: 1972163 - RNA, 17 nt, Shigella flexneri 2a str. 301
uuagaauaccugccugu

SEQ ID NO: 1972164 - RNA, 13 nt, Shigella flexneri 2a str. 301
uuacccagauaau

SEQ ID NO: 1972165 - RNA, 13 nt, Shigella flexneri 2a str. 301
uuaccaugcuuca

SEQ ID NO: 1972166 - RNA, 22 nt, Shigella flexneri 2a str. 301
uuaccccacgucaucugucaua

SEQ ID NO: 1972167 - RNA, 21 nt, Shigella flexneri 2a str. 301
uuacgcagcauuggguaaaau

SEQ ID NO: 1972168 - RNA, 17 nt, Shigella flexneri 2a str. 301
uuacgcagcgguauaau

SEQ ID NO: 1972169 - RNA, 23 nt, Shigella flexneri 2a str. 301
uuacgcaggcaauccauaacgcu

SEQ ID NO: 1972170 - RNA, 20 nt, Shigella flexneri 2a str. 301
uuacgcaaaaccucuuccag

SEQ ID NO: 1972171 - RNA, 19 nt, Shigella flexneri 2a str. 301
uuacgauccaccaccgcaa

SEQ ID NO: 1972172 - RNA, 20 nt, Shigella flexneri 2a str. 301
uuacgccccgguuucucuuc

SEQ ID NO: 1972173 - RNA, 17 nt, Shigella flexneri 2a str. 301
uuacgccccaacacaau

SEQ ID NO: 1972174 - RNA, 17 nt, Shigella flexneri 2a str. 301
uuacgccgcauccaaca

SEQ ID NO: 1972175 - RNA, 14 nt, Shigella flexneri 2a str. 301
uuacgccgcaucag

SEQ ID NO: 1972176 - RNA, 20 nt, Shigella flexneri 2a str. 301
uuacgccgcaucuggcauaa

SEQ ID NO: 1972177 - RNA, 18 nt, Shigella flexneri 2a str. 301
uuacgccgcauccggcaa

SEQ ID NO: 1972178 - RNA, 16 nt, Shigella flexneri 2a str. 301
uuacgccgagcgccag

SEQ ID NO: 1972179 - RNA, 17 nt, Shigella flexneri 2a str. 301
uuacguuuacgcaucug

SEQ ID NO: 1972180 - RNA, 17 nt, Shigella flexneri 2a str. 301
uuacuaaguacauuaag

SEQ ID NO: 1972181 - RNA, 23 nt, Shigella flexneri 2a str. 301
uuacggguucaagucccguccuc

SEQ ID NO: 1972182 - RNA, 23 nt, Shigella flexneri 2a str. 301
uuacgggcgaaguucgccaucaa

SEQ ID NO: 1972183 - RNA, 17 nt, Shigella flexneri 2a str. 301
uuacgggcgauauaccu

SEQ ID NO: 1972184 - RNA, 16 nt, Shigella flexneri 2a str. 301
uuacgcucacugcaaa

SEQ ID NO: 1972185 - RNA, 16 nt, Shigella flexneri 2a str. 301
uuacgcucaccaaaac

SEQ ID NO: 1972186 - RNA, 16 nt, Shigella flexneri 2a str. 301
uuacgcucuuccacgc

SEQ ID NO: 1972187 - RNA, 19 nt, Shigella flexneri 2a str. 301
uuacgcggaucgagaaucu

SEQ ID NO: 1972188 - RNA, 14 nt, Shigella flexneri 2a str. 301
uuacggcacuccuc

SEQ ID NO: 1972189 - RNA, 22 nt, Shigella flexneri 2a str. 301
uuacggcugcggauguauuggc

SEQ ID NO: 1972190 - RNA, 16 nt, Shigella flexneri 2a str. 301
uuacggacgugggggu

SEQ ID NO: 1972191 - RNA, 22 nt, Shigella flexneri 2a str. 301
uuaaacaauuucagaauagaca

SEQ ID NO: 1972192 - RNA, 17 nt, Shigella flexneri 2a str. 301
uuaaacagcuuggauuc

SEQ ID NO: 1972193 - RNA, 18 nt, Shigella flexneri 2a str. 301
uuaaacaagguuugaaaa

SEQ ID NO: 1972194 - RNA, 22 nt, Shigella flexneri 2a str. 301
uguugccgccgugugcaauauc

SEQ ID NO: 1972195 - RNA, 20 nt, Shigella flexneri 2a str. 301
uguugcgccaguaaauuuau

SEQ ID NO: 1972196 - RNA, 17 nt, Shigella flexneri 2a str. 301
uuaaaggcaccaauauu

SEQ ID NO: 1972197 - RNA, 17 nt, Shigella flexneri 2a str. 301
uuaaauacagcuuaauc

SEQ ID NO: 1972198 - RNA, 22 nt, Shigella flexneri 2a str. 301
uuaaauacauauaagcguuaau

SEQ ID NO: 1972199 - RNA, 22 nt, Shigella flexneri 2a str. 301
uuaaaguacucuuugaacagcc

SEQ ID NO: 1972200 - RNA, 13 nt, Shigella flexneri 2a str. 301
uuaaagaaaguaa

SEQ ID NO: 1972201 - RNA, 22 nt, Shigella flexneri 2a str. 301
uuaaagagacagaaucaggcca

SEQ ID NO: 1972202 - RNA, 23 nt, Shigella flexneri 2a str. 301
uuaaagacggcggcaacauggca

SEQ ID NO: 1972203 - RNA, 18 nt, Shigella flexneri 2a str. 301
uuaaacgggucaucaaaa

SEQ ID NO: 1972204 - RNA, 19 nt, Shigella flexneri 2a str. 301
uuaaacgcagagacaucac

SEQ ID NO: 1972205 - RNA, 15 nt, Shigella flexneri 2a str. 301
uuaaauugucuuaaa

SEQ ID NO: 1972206 - RNA, 22 nt, Shigella flexneri 2a str. 301
uuaaauucgcugcggacaaaac

SEQ ID NO: 1972207 - RNA, 12 nt, Shigella flexneri 2a str. 301
uuaaauuaauaa

SEQ ID NO: 1972208 - RNA, 17 nt, Shigella flexneri 2a str. 301
uuaaauggacgcaaaaa

SEQ ID NO: 1972209 - RNA, 18 nt, Shigella flexneri 2a str. 301
uuaaauauuuauguguuu

SEQ ID NO: 1972210 - RNA, 17 nt, Shigella flexneri 2a str. 301
uuaaaugauaccgggcu

SEQ ID NO: 1972211 - RNA, 12 nt, Shigella flexneri 2a str. 301
uuaaauauaaaa

SEQ ID NO: 1972212 - RNA, 14 nt, Shigella flexneri 2a str. 301
uuaauaaacaucag

SEQ ID NO: 1972213 - RNA, 16 nt, Shigella flexneri 2a str. 301
uuaauaaaauuaucca

SEQ ID NO: 1972214 - RNA, 20 nt, Shigella flexneri 2a str. 301
uuaauaaaauuauccagcuu

SEQ ID NO: 1972215 - RNA, 15 nt, Shigella flexneri 2a str. 301
uuaauaaaauacuuu

SEQ ID NO: 1972216 - RNA, 20 nt, Shigella flexneri 2a str. 301
uuaauaacacauauauuaau

SEQ ID NO: 1972217 - RNA, 15 nt, Shigella flexneri 2a str. 301
uuaauaaauauuaau

SEQ ID NO: 1972218 - RNA, 14 nt, Shigella flexneri 2a str. 301
uuaauaacgacaua

SEQ ID NO: 1972219 - RNA, 11 nt, Shigella flexneri 2a str. 301
uuaagaaaacg

SEQ ID NO: 1972220 - RNA, 15 nt, Shigella flexneri 2a str. 301
uuaacuuuucauccu

SEQ ID NO: 1972221 - RNA, 18 nt, Shigella flexneri 2a str. 301
uuaacuuaauaaacauca

SEQ ID NO: 1972222 - RNA, 22 nt, Shigella flexneri 2a str. 301
uuaagcgcaucgacgccaucau

SEQ ID NO: 1972223 - RNA, 18 nt, Shigella flexneri 2a str. 301
uuaagccaguucucacca

SEQ ID NO: 1972224 - RNA, 18 nt, Shigella flexneri 2a str. 301
uuaagccaucaucaauau

SEQ ID NO: 1972225 - RNA, 22 nt, Shigella flexneri 2a str. 301
uuaagcaacugacuggcucuuu

SEQ ID NO: 1972226 - RNA, 21 nt, Shigella flexneri 2a str. 301
uuaacgacacucucuucaaca

SEQ ID NO: 1972227 - RNA, 22 nt, Shigella flexneri 2a str. 301
uuaaccuuugcgguuaaaaaua

SEQ ID NO: 1972228 - RNA, 15 nt, Shigella flexneri 2a str. 301
uuaaccccgggcugg

SEQ ID NO: 1972229 - RNA, 17 nt, Shigella flexneri 2a str. 301
uuaacccgcaacagcaa

SEQ ID NO: 1972230 - RNA, 18 nt, Shigella flexneri 2a str. 301
uuaaccagucggaaacau

SEQ ID NO: 1972231 - RNA, 14 nt, Shigella flexneri 2a str. 301
uuaacgguaucuuu

SEQ ID NO: 1972232 - RNA, 13 nt, Shigella flexneri 2a str. 301
uuaacguuaucug

SEQ ID NO: 1972233 - RNA, 15 nt, Shigella flexneri 2a str. 301
uuaacgggcagguca

SEQ ID NO: 1972234 - RNA, 18 nt, Shigella flexneri 2a str. 301
uuaacgcuucucccagcc

SEQ ID NO: 1972235 - RNA, 18 nt, Shigella flexneri 2a str. 301
uuaacgcgggcuucuucu

SEQ ID NO: 1972236 - RNA, 23 nt, Shigella flexneri 2a str. 301
uuaaccaccaguaaauugucgcc

SEQ ID NO: 1972237 - RNA, 20 nt, Shigella flexneri 2a str. 301
uuaaccagcacguugaacug

SEQ ID NO: 1972238 - RNA, 15 nt, Shigella flexneri 2a str. 301
uuaaccagcaccagc

SEQ ID NO: 1972239 - RNA, 17 nt, Shigella flexneri 2a str. 301
uuaacaaucacaauaga

SEQ ID NO: 1972240 - RNA, 16 nt, Shigella flexneri 2a str. 301
uuaacacacaauuacc

SEQ ID NO: 1972241 - RNA, 19 nt, Shigella flexneri 2a str. 301
uuaacacacaauuaccuuc

SEQ ID NO: 1972242 - RNA, 14 nt, Shigella flexneri 2a str. 301
uuaacaaucacaau

SEQ ID NO: 1972243 - RNA, 20 nt, Shigella flexneri 2a str. 301
uuaacacugagaauugaagu

SEQ ID NO: 1972244 - RNA, 13 nt, Shigella flexneri 2a str. 301
uuauuuccaguuc

SEQ ID NO: 1972245 - RNA, 14 nt, Shigella flexneri 2a str. 301
uuauuucuguauua

SEQ ID NO: 1972246 - RNA, 14 nt, Shigella flexneri 2a str. 301
uuauuuccugcauu

SEQ ID NO: 1972247 - RNA, 11 nt, Shigella flexneri 2a str. 301
uuauuuuauuu

SEQ ID NO: 1972248 - RNA, 15 nt, Shigella flexneri 2a str. 301
uuauugauuaaagga

SEQ ID NO: 1972249 - RNA, 20 nt, Shigella flexneri 2a str. 301
uuauugauuccagcauaaug

SEQ ID NO: 1972250 - RNA, 19 nt, Shigella flexneri 2a str. 301
uuauugggcgaaagaaaag

SEQ ID NO: 1972251 - RNA, 23 nt, Shigella flexneri 2a str. 301
uuauuuacuugggaaaacagcgc

SEQ ID NO: 1972252 - RNA, 19 nt, Shigella flexneri 2a str. 301
uuauuucaaugcauuauca

SEQ ID NO: 1972253 - RNA, 22 nt, Shigella flexneri 2a str. 301
uuauuaucuggcaagccugaaa

SEQ ID NO: 1972254 - RNA, 14 nt, Shigella flexneri 2a str. 301
uuauuacugcguau

SEQ ID NO: 1972255 - RNA, 19 nt, Shigella flexneri 2a str. 301
uuauuacuuaucccugucu

SEQ ID NO: 1972256 - RNA, 13 nt, Shigella flexneri 2a str. 301
uuauuaaauuuaa

SEQ ID NO: 1972257 - RNA, 16 nt, Shigella flexneri 2a str. 301
uuauuaaauuuaauaa

SEQ ID NO: 1972258 - RNA, 15 nt, Shigella flexneri 2a str. 301
uuauuaacuucccac

SEQ ID NO: 1972259 - RNA, 22 nt, Shigella flexneri 2a str. 301
uuauucaugccuguauugguuu

SEQ ID NO: 1972260 - RNA, 16 nt, Shigella flexneri 2a str. 301
uuauuccauccugcuc

SEQ ID NO: 1972261 - RNA, 14 nt, Shigella flexneri 2a str. 301
uuauuauuuacuug

SEQ ID NO: 1972262 - RNA, 20 nt, Shigella flexneri 2a str. 301
uucaaaaacuaauucaccuu

SEQ ID NO: 1972263 - RNA, 17 nt, Shigella flexneri 2a str. 301
uucaaaaaccugaccua

SEQ ID NO: 1972264 - RNA, 15 nt, Shigella flexneri 2a str. 301
uucaaaaacaaagaa

SEQ ID NO: 1972265 - RNA, 21 nt, Shigella flexneri 2a str. 301
uucaaaguucugugucuuauu

SEQ ID NO: 1972266 - RNA, 20 nt, Shigella flexneri 2a str. 301
uucaaaguaauauucaacgu

SEQ ID NO: 1972267 - RNA, 23 nt, Shigella flexneri 2a str. 301
uucaaagugauauccaccgcguu

SEQ ID NO: 1972268 - RNA, 12 nt, Shigella flexneri 2a str. 301
uucaaagcgauu

SEQ ID NO: 1972269 - RNA, 19 nt, Shigella flexneri 2a str. 301
uucaaaagaugagaaaaau

SEQ ID NO: 1972270 - RNA, 16 nt, Shigella flexneri 2a str. 301
uucaaauuaugucuca

SEQ ID NO: 1972271 - RNA, 22 nt, Shigella flexneri 2a str. 301
uucaaauuacgauccaccaccg

SEQ ID NO: 1972272 - RNA, 17 nt, Shigella flexneri 2a str. 301
uucaaauccuucagacu

SEQ ID NO: 1972273 - RNA, 18 nt, Shigella flexneri 2a str. 301
uucaaaucauuacaguuu

SEQ ID NO: 1972274 - RNA, 16 nt, Shigella flexneri 2a str. 301
uucaaaucgaaaucaa

SEQ ID NO: 1972275 - RNA, 18 nt, Shigella flexneri 2a str. 301
uucaacacacugaauaaa

SEQ ID NO: 1972276 - RNA, 13 nt, Shigella flexneri 2a str. 301
uucaacagauuuc

SEQ ID NO: 1972277 - RNA, 13 nt, Shigella flexneri 2a str. 301
uucaacaguuuuc

SEQ ID NO: 1972278 - RNA, 22 nt, Shigella flexneri 2a str. 301
uucaacaguaaacucgacuuuc

SEQ ID NO: 1972279 - RNA, 16 nt, Shigella flexneri 2a str. 301
uucaacaguaaacucg

SEQ ID NO: 1972280 - RNA, 22 nt, Shigella flexneri 2a str. 301
uucaacauauccuucacacaua

SEQ ID NO: 1972281 - RNA, 21 nt, Shigella flexneri 2a str. 301
uucaacagguuaacucccccu

SEQ ID NO: 1972282 - RNA, 21 nt, Shigella flexneri 2a str. 301
uucaacgccgcuaucagauuc

SEQ ID NO: 1972283 - RNA, 23 nt, Shigella flexneri 2a str. 301
uucaacgacccagccagacgcca

SEQ ID NO: 1972284 - RNA, 14 nt, Shigella flexneri 2a str. 301
uucaaccuaaagua

SEQ ID NO: 1972285 - RNA, 21 nt, Shigella flexneri 2a str. 301
uucaaccuaaaguaaaggaac

SEQ ID NO: 1972286 - RNA, 18 nt, Shigella flexneri 2a str. 301
uucaaccguugcuggaaa

SEQ ID NO: 1972287 - RNA, 21 nt, Shigella flexneri 2a str. 301
uucaagacaucaauaaacaau

SEQ ID NO: 1972288 - RNA, 19 nt, Shigella flexneri 2a str. 301
uucaagacaucaauaaaca

SEQ ID NO: 1972289 - RNA, 13 nt, Shigella flexneri 2a str. 301
uucaacuucagca

SEQ ID NO: 1972290 - RNA, 17 nt, Shigella flexneri 2a str. 301
uucaagacgccguccau

SEQ ID NO: 1972291 - RNA, 22 nt, Shigella flexneri 2a str. 301
uucaagccaaaacgcgcaacca

SEQ ID NO: 1972292 - RNA, 19 nt, Shigella flexneri 2a str. 301
uuaucgauuuucaaaauau

SEQ ID NO: 1972293 - RNA, 22 nt, Shigella flexneri 2a str. 301
uuauccuucgauaaaagccauc

SEQ ID NO: 1972294 - RNA, 14 nt, Shigella flexneri 2a str. 301
uuauccucuguaaa

SEQ ID NO: 1972295 - RNA, 22 nt, Shigella flexneri 2a str. 301
uuaucgcgucuaaauuuugcau

SEQ ID NO: 1972296 - RNA, 19 nt, Shigella flexneri 2a str. 301
uuaucggcucgaucuggug

SEQ ID NO: 1972297 - RNA, 18 nt, Shigella flexneri 2a str. 301
uuaucgcgaugauuuucg

SEQ ID NO: 1972298 - RNA, 19 nt, Shigella flexneri 2a str. 301
uuaucgcgauacaccagau

SEQ ID NO: 1972299 - RNA, 17 nt, Shigella flexneri 2a str. 301
uuaucuauaacaaaacu

SEQ ID NO: 1972300 - RNA, 15 nt, Shigella flexneri 2a str. 301
uuaucucaacacacg

SEQ ID NO: 1972301 - RNA, 20 nt, Shigella flexneri 2a str. 301
uuaucucccuguaucccagu

SEQ ID NO: 1972302 - RNA, 17 nt, Shigella flexneri 2a str. 301
uuaucugaucaauauag

SEQ ID NO: 1972303 - RNA, 20 nt, Shigella flexneri 2a str. 301
uuaucugccgaacaggcugc

SEQ ID NO: 1972304 - RNA, 17 nt, Shigella flexneri 2a str. 301
uuaucuggauccacgau

SEQ ID NO: 1972305 - RNA, 20 nt, Shigella flexneri 2a str. 301
uuaucuggauuuaacgauaa

SEQ ID NO: 1972306 - RNA, 17 nt, Shigella flexneri 2a str. 301
uuaucuggcauuugcac

SEQ ID NO: 1972307 - RNA, 21 nt, Shigella flexneri 2a str. 301
uuaucuggcauuugcacugaa

SEQ ID NO: 1972308 - RNA, 19 nt, Shigella flexneri 2a str. 301
uuaucuggccuacagauga

SEQ ID NO: 1972309 - RNA, 17 nt, Shigella flexneri 2a str. 301
uuaucuucgcacuuacc

SEQ ID NO: 1972310 - RNA, 16 nt, Shigella flexneri 2a str. 301
uuaucuuacccuuccu

SEQ ID NO: 1972311 - RNA, 22 nt, Shigella flexneri 2a str. 301
uuaucuggaauuccuuucccua

SEQ ID NO: 1972312 - RNA, 18 nt, Shigella flexneri 2a str. 301
uuauggcucgccauccag

SEQ ID NO: 1972313 - RNA, 18 nt, Shigella flexneri 2a str. 301
uuauggcgauaucaaaaa

SEQ ID NO: 1972314 - RNA, 17 nt, Shigella flexneri 2a str. 301
uuaugggccaacggcau

SEQ ID NO: 1972315 - RNA, 23 nt, Shigella flexneri 2a str. 301
uuauggguaugucacugaugaca

SEQ ID NO: 1972316 - RNA, 18 nt, Shigella flexneri 2a str. 301
uuaugugguuaugccauu

SEQ ID NO: 1972317 - RNA, 22 nt, Shigella flexneri 2a str. 301
uuauguaacaacuggcggucau

SEQ ID NO: 1972318 - RNA, 13 nt, Shigella flexneri 2a str. 301
uuauuaaacagac

SEQ ID NO: 1972319 - RNA, 21 nt, Shigella flexneri 2a str. 301
uuauguucagauaaugcccga

SEQ ID NO: 1972320 - RNA, 19 nt, Shigella flexneri 2a str. 301
uuaugaaauaucuucaaua

SEQ ID NO: 1972321 - RNA, 22 nt, Shigella flexneri 2a str. 301
uuaugacuacgacauugaagaa

SEQ ID NO: 1972322 - RNA, 14 nt, Shigella flexneri 2a str. 301
uuaugaucaucaag

SEQ ID NO: 1972323 - RNA, 19 nt, Shigella flexneri 2a str. 301
uuaugaguauuuaacggau

SEQ ID NO: 1972324 - RNA, 22 nt, Shigella flexneri 2a str. 301
uuaugccgaucaucauccagca

SEQ ID NO: 1972325 - RNA, 19 nt, Shigella flexneri 2a str. 301
uuaugcccggacuagcgcu

SEQ ID NO: 1972326 - RNA, 21 nt, Shigella flexneri 2a str. 301
uuaugcacaccccgcgcagcu

SEQ ID NO: 1972327 - RNA, 21 nt, Shigella flexneri 2a str. 301
uuauccaccgaaauaaucaga

SEQ ID NO: 1972328 - RNA, 22 nt, Shigella flexneri 2a str. 301
uuauccagccuacaaaaacuca

SEQ ID NO: 1972329 - RNA, 19 nt, Shigella flexneri 2a str. 301
uuauccagcuucacuuuca

SEQ ID NO: 1972330 - RNA, 23 nt, Shigella flexneri 2a str. 301
uuauccaucaaagguuuuucagu

SEQ ID NO: 1972331 - RNA, 21 nt, Shigella flexneri 2a str. 301
uuaucccugcggaaaaaagaa

SEQ ID NO: 1972332 - RNA, 23 nt, Shigella flexneri 2a str. 301
uuauccgccagugccaaagccag

SEQ ID NO: 1972333 - RNA, 16 nt, Shigella flexneri 2a str. 301
uuauccguccuacgaa

SEQ ID NO: 1972334 - RNA, 11 nt, Shigella flexneri 2a str. 301
uuauccggccu

SEQ ID NO: 1972335 - RNA, 16 nt, Shigella flexneri 2a str. 301
uuaucccuguuaaaac

SEQ ID NO: 1972336 - RNA, 15 nt, Shigella flexneri 2a str. 301
uuauccccucaaccu

SEQ ID NO: 1972337 - RNA, 21 nt, Shigella flexneri 2a str. 301
uuaucaggccuacauuuucuc

SEQ ID NO: 1972338 - RNA, 15 nt, Shigella flexneri 2a str. 301
uuaucaggccugcaa

SEQ ID NO: 1972339 - RNA, 20 nt, Shigella flexneri 2a str. 301
uuaucaggccuacgacuuuc

SEQ ID NO: 1972340 - RNA, 18 nt, Shigella flexneri 2a str. 301
uuaucaggccuacaaguc

SEQ ID NO: 1972341 - RNA, 15 nt, Shigella flexneri 2a str. 301
uuaucaucgggcuga

SEQ ID NO: 1972342 - RNA, 11 nt, Shigella flexneri 2a str. 301
uuaucaucacc

SEQ ID NO: 1972343 - RNA, 13 nt, Shigella flexneri 2a str. 301
uuauauauuaauc

SEQ ID NO: 1972344 - RNA, 19 nt, Shigella flexneri 2a str. 301
uuauauauugggaucaaaa

SEQ ID NO: 1972345 - RNA, 14 nt, Shigella flexneri 2a str. 301
uuauaucccauuuu

SEQ ID NO: 1972346 - RNA, 16 nt, Shigella flexneri 2a str. 301
uuauaucccauuuuug

SEQ ID NO: 1972347 - RNA, 19 nt, Shigella flexneri 2a str. 301
uuauaucagugauauauuu

SEQ ID NO: 1972348 - RNA, 21 nt, Shigella flexneri 2a str. 301
uuauacagacucaaaccaaug

SEQ ID NO: 1972349 - RNA, 18 nt, Shigella flexneri 2a str. 301
uuauagacuaaauuucac

SEQ ID NO: 1972350 - RNA, 20 nt, Shigella flexneri 2a str. 301
uuauagccguaacuguaagc

SEQ ID NO: 1972351 - RNA, 15 nt, Shigella flexneri 2a str. 301
uuauauaaugccagg

SEQ ID NO: 1972352 - RNA, 18 nt, Shigella flexneri 2a str. 301
uuauaaucuuuaaaaaaa

SEQ ID NO: 1972353 - RNA, 13 nt, Shigella flexneri 2a str. 301
uuauaaauaaaaa

SEQ ID NO: 1972354 - RNA, 18 nt, Shigella flexneri 2a str. 301
uuauaagccaguaagaca

SEQ ID NO: 1972355 - RNA, 12 nt, Shigella flexneri 2a str. 301
uuauaagccaug

SEQ ID NO: 1972356 - RNA, 16 nt, Shigella flexneri 2a str. 301
uuauaagccauguuua

SEQ ID NO: 1972357 - RNA, 13 nt, Shigella flexneri 2a str. 301
uuauaaaagaaaa

SEQ ID NO: 1972358 - RNA, 21 nt, Shigella flexneri 2a str. 301
uuauaaaccacgcaauaaaca

SEQ ID NO: 1972359 - RNA, 14 nt, Shigella flexneri 2a str. 301
uuagagcacaucac

SEQ ID NO: 1972360 - RNA, 16 nt, Shigella flexneri 2a str. 301
uuagaggucaguuuga

SEQ ID NO: 1972361 - RNA, 11 nt, Shigella flexneri 2a str. 301
ugucaaaucca

SEQ ID NO: 1972362 - RNA, 17 nt, Shigella flexneri 2a str. 301
ugucaaccagccagcgc

SEQ ID NO: 1972363 - RNA, 20 nt, Shigella flexneri 2a str. 301
ugucaacugcgccacucgau

SEQ ID NO: 1972364 - RNA, 21 nt, Shigella flexneri 2a str. 301
ugucaauucccgagcugcucg

SEQ ID NO: 1972365 - RNA, 20 nt, Shigella flexneri 2a str. 301
ugucaguauaacuacugaug

SEQ ID NO: 1972366 - RNA, 22 nt, Shigella flexneri 2a str. 301
ugucaguauaacuacugauggc

SEQ ID NO: 1972367 - RNA, 14 nt, Shigella flexneri 2a str. 301
ugucaguuggcugu

SEQ ID NO: 1972368 - RNA, 22 nt, Shigella flexneri 2a str. 301
ugucauaggugucaaccagcca

SEQ ID NO: 1972369 - RNA, 22 nt, Shigella flexneri 2a str. 301
ugucauaacacagguaacuuaa

SEQ ID NO: 1972370 - RNA, 14 nt, Shigella flexneri 2a str. 301
uguauugauuuagc

SEQ ID NO: 1972371 - RNA, 21 nt, Shigella flexneri 2a str. 301
uguacaggauauauuucauca

SEQ ID NO: 1972372 - RNA, 16 nt, Shigella flexneri 2a str. 301
uguacaggauauauuu

SEQ ID NO: 1972373 - RNA, 12 nt, Shigella flexneri 2a str. 301
uguaucuucauc

SEQ ID NO: 1972374 - RNA, 15 nt, Shigella flexneri 2a str. 301
ugucauauuaucuau

SEQ ID NO: 1972375 - RNA, 14 nt, Shigella flexneri 2a str. 301
ugucauacugccca

SEQ ID NO: 1972376 - RNA, 19 nt, Shigella flexneri 2a str. 301
ugucauacugcccaaucuc

SEQ ID NO: 1972377 - RNA, 21 nt, Shigella flexneri 2a str. 301
ugucauacugcccaaucucac

SEQ ID NO: 1972378 - RNA, 16 nt, Shigella flexneri 2a str. 301
ugucagguaacaagcc

SEQ ID NO: 1972379 - RNA, 15 nt, Shigella flexneri 2a str. 301
ugucaugcagcucca

SEQ ID NO: 1972380 - RNA, 20 nt, Shigella flexneri 2a str. 301
ugucaugaguaaacuuuugg

SEQ ID NO: 1972381 - RNA, 16 nt, Shigella flexneri 2a str. 301
ugucaugcagcuccac

SEQ ID NO: 1972382 - RNA, 16 nt, Shigella flexneri 2a str. 301
ugucaugacuacacua

SEQ ID NO: 1972383 - RNA, 22 nt, Shigella flexneri 2a str. 301
uguccaaauccuucagcaacuu

SEQ ID NO: 1972384 - RNA, 22 nt, Shigella flexneri 2a str. 301
ugucauguauauuauccaucaa

SEQ ID NO: 1972385 - RNA, 17 nt, Shigella flexneri 2a str. 301
ugucaugcgcucuccca

SEQ ID NO: 1972386 - RNA, 22 nt, Shigella flexneri 2a str. 301
ugucauggcagucuuaaucgcu

SEQ ID NO: 1972387 - RNA, 14 nt, Shigella flexneri 2a str. 301
ugucauggcaguuc

SEQ ID NO: 1972388 - RNA, 22 nt, Shigella flexneri 2a str. 301
ugucauucgccugacgcaauaa

SEQ ID NO: 1972389 - RNA, 16 nt, Shigella flexneri 2a str. 301
ugucauucaagauugc

SEQ ID NO: 1972390 - RNA, 16 nt, Shigella flexneri 2a str. 301
uguccagguuauuaaa

SEQ ID NO: 1972391 - RNA, 20 nt, Shigella flexneri 2a str. 301
uguccagcuugaucaauaac

SEQ ID NO: 1972392 - RNA, 12 nt, Shigella flexneri 2a str. 301
uguccacuuccg

SEQ ID NO: 1972393 - RNA, 16 nt, Shigella flexneri 2a str. 301
uguccauuauuucaau

SEQ ID NO: 1972394 - RNA, 20 nt, Shigella flexneri 2a str. 301
ugucccaaccuuguuucuga

SEQ ID NO: 1972395 - RNA, 13 nt, Shigella flexneri 2a str. 301
ugucccgcuggug

SEQ ID NO: 1972396 - RNA, 22 nt, Shigella flexneri 2a str. 301
ugucccaagugauuuuuaauag

SEQ ID NO: 1972397 - RNA, 16 nt, Shigella flexneri 2a str. 301
uguccgcuucaccacc

SEQ ID NO: 1972398 - RNA, 14 nt, Shigella flexneri 2a str. 301
uguccgcggccuuu

SEQ ID NO: 1972399 - RNA, 18 nt, Shigella flexneri 2a str. 301
uguccggcgcacuggugc

SEQ ID NO: 1972400 - RNA, 17 nt, Shigella flexneri 2a str. 301
uguccggcgcacuggug

SEQ ID NO: 1972401 - RNA, 18 nt, Shigella flexneri 2a str. 301
uguccgccaauuucauca

SEQ ID NO: 1972402 - RNA, 18 nt, Shigella flexneri 2a str. 301
uguccucgccguuuucug

SEQ ID NO: 1972403 - RNA, 15 nt, Shigella flexneri 2a str. 301
uguccguuuguggug

SEQ ID NO: 1972404 - RNA, 22 nt, Shigella flexneri 2a str. 301
ugucgauaaaguuagagccagg

SEQ ID NO: 1972405 - RNA, 17 nt, Shigella flexneri 2a str. 301
ugucgaaagccccagcc

SEQ ID NO: 1972406 - RNA, 22 nt, Shigella flexneri 2a str. 301
ugucgcauccgacaaggcauca

SEQ ID NO: 1972407 - RNA, 14 nt, Shigella flexneri 2a str. 301
ugucgcagugaagu

SEQ ID NO: 1972408 - RNA, 14 nt, Shigella flexneri 2a str. 301
ugucgcagccagcg

SEQ ID NO: 1972409 - RNA, 22 nt, Shigella flexneri 2a str. 301
ugucgcauccggcaauuggugc

SEQ ID NO: 1972410 - RNA, 13 nt, Shigella flexneri 2a str. 301
ugucgccauccag

SEQ ID NO: 1972411 - RNA, 16 nt, Shigella flexneri 2a str. 301
ugucgugcgaggaaaa

SEQ ID NO: 1972412 - RNA, 20 nt, Shigella flexneri 2a str. 301
ugucgguggcgggcaagcgg

SEQ ID NO: 1972413 - RNA, 17 nt, Shigella flexneri 2a str. 301
ugucgggcaggcuucaa

SEQ ID NO: 1972414 - RNA, 21 nt, Shigella flexneri 2a str. 301
ugucgggugcuuuuuucaauu

SEQ ID NO: 1972415 - RNA, 20 nt, Shigella flexneri 2a str. 301
ugucggcccgcauuauucag

SEQ ID NO: 1972416 - RNA, 20 nt, Shigella flexneri 2a str. 301
ugucggcacugaccaccacc

SEQ ID NO: 1972417 - RNA, 22 nt, Shigella flexneri 2a str. 301
ugucgcucaaugcgcugagugu

SEQ ID NO: 1972418 - RNA, 18 nt, Shigella flexneri 2a str. 301
ugucgcucaaugugcuga

SEQ ID NO: 1972419 - RNA, 15 nt, Shigella flexneri 2a str. 301
ugucgcugaagucuc

SEQ ID NO: 1972420 - RNA, 18 nt, Shigella flexneri 2a str. 301
ugucucccgcccaaucga

SEQ ID NO: 1972421 - RNA, 18 nt, Shigella flexneri 2a str. 301
ugucuccacuauaaaaaa

SEQ ID NO: 1972422 - RNA, 18 nt, Shigella flexneri 2a str. 301
ugucuccggcauccagcg

SEQ ID NO: 1972423 - RNA, 14 nt, Shigella flexneri 2a str. 301
ugucucagauucag

SEQ ID NO: 1972424 - RNA, 13 nt, Shigella flexneri 2a str. 301
ugucugagccgaa

SEQ ID NO: 1972425 - RNA, 13 nt, Shigella flexneri 2a str. 301
ugucucucagcac

SEQ ID NO: 1972426 - RNA, 22 nt, Shigella flexneri 2a str. 301
ugucguucaggcgcugaaagaa

SEQ ID NO: 1972427 - RNA, 17 nt, Shigella flexneri 2a str. 301
ugucguuaaugcgccaa

SEQ ID NO: 1972428 - RNA, 14 nt, Shigella flexneri 2a str. 301
ugucguuauauaaa

SEQ ID NO: 1972429 - RNA, 20 nt, Shigella flexneri 2a str. 301
ugucuacgccuuguuucuuc

SEQ ID NO: 1972430 - RNA, 15 nt, Shigella flexneri 2a str. 301
ugucuaccagcaccu

SEQ ID NO: 1972431 - RNA, 15 nt, Shigella flexneri 2a str. 301
ugucuauuuccaccc

SEQ ID NO: 1972432 - RNA, 19 nt, Shigella flexneri 2a str. 301
ugucuguacggcagugaac

SEQ ID NO: 1972433 - RNA, 23 nt, Shigella flexneri 2a str. 301
ugucuggacgcucaggcuacuuu

SEQ ID NO: 1972434 - RNA, 17 nt, Shigella flexneri 2a str. 301
ugucuguacggcaguga

SEQ ID NO: 1972435 - RNA, 22 nt, Shigella flexneri 2a str. 301
ugucugaugcgcugcgcuuauc

SEQ ID NO: 1972436 - RNA, 15 nt, Shigella flexneri 2a str. 301
ugucugcuucugccu

SEQ ID NO: 1972437 - RNA, 16 nt, Shigella flexneri 2a str. 301
ugucuuaucuggcauu

SEQ ID NO: 1972438 - RNA, 15 nt, Shigella flexneri 2a str. 301
ugucuuaucaggccu

SEQ ID NO: 1972439 - RNA, 16 nt, Shigella flexneri 2a str. 301
ugucuuccuguggugc

SEQ ID NO: 1972440 - RNA, 14 nt, Shigella flexneri 2a str. 301
ugucuucccugcug

SEQ ID NO: 1972441 - RNA, 22 nt, Shigella flexneri 2a str. 301
ugucuuucucaucuuucagaau

SEQ ID NO: 1972442 - RNA, 23 nt, Shigella flexneri 2a str. 301
ugucuuuaaauugcguaaagccu

SEQ ID NO: 1972443 - RNA, 20 nt, Shigella flexneri 2a str. 301
ugugaacgagaaaaugacga

SEQ ID NO: 1972444 - RNA, 23 nt, Shigella flexneri 2a str. 301
ugugaacucaggcugccagauca

SEQ ID NO: 1972445 - RNA, 16 nt, Shigella flexneri 2a str. 301
ugugaaaucagcacau

SEQ ID NO: 1972446 - RNA, 14 nt, Shigella flexneri 2a str. 301
ugugauggcuauua

SEQ ID NO: 1972447 - RNA, 14 nt, Shigella flexneri 2a str. 301
ugugaucuuuuucg

SEQ ID NO: 1972448 - RNA, 19 nt, Shigella flexneri 2a str. 301
ugugauaaaaaucggcagg

SEQ ID NO: 1972449 - RNA, 15 nt, Shigella flexneri 2a str. 301
ugugauacuucuucg

SEQ ID NO: 1972450 - RNA, 15 nt, Shigella flexneri 2a str. 301
ugugauuuaaaucaa

SEQ ID NO: 1972451 - RNA, 18 nt, Shigella flexneri 2a str. 301
ugugccagcucgugcaga

SEQ ID NO: 1972452 - RNA, 15 nt, Shigella flexneri 2a str. 301
ugugccauuaauguc

SEQ ID NO: 1972453 - RNA, 13 nt, Shigella flexneri 2a str. 301
ugugccgccgcca

SEQ ID NO: 1972454 - RNA, 16 nt, Shigella flexneri 2a str. 301
ugugccgcgacagauu

SEQ ID NO: 1972455 - RNA, 12 nt, Shigella flexneri 2a str. 301
ugugcuggcaaa

SEQ ID NO: 1972456 - RNA, 16 nt, Shigella flexneri 2a str. 301
ugugcugugacagauu

SEQ ID NO: 1972457 - RNA, 18 nt, Shigella flexneri 2a str. 301
ugugcugguacuggugca

SEQ ID NO: 1972458 - RNA, 20 nt, Shigella flexneri 2a str. 301
ugugcuuuacaccaugccac

SEQ ID NO: 1972459 - RNA, 17 nt, Shigella flexneri 2a str. 301
uguggaucgauuucaau

SEQ ID NO: 1972460 - RNA, 19 nt, Shigella flexneri 2a str. 301
uguggauuaaauugcgcca

SEQ ID NO: 1972461 - RNA, 19 nt, Shigella flexneri 2a str. 301
uguggagugcagcaugcac

SEQ ID NO: 1972462 - RNA, 20 nt, Shigella flexneri 2a str. 301
uguggagugcagcaugcacc

SEQ ID NO: 1972463 - RNA, 14 nt, Shigella flexneri 2a str. 301
ugugcuuuguucau

SEQ ID NO: 1972464 - RNA, 23 nt, Shigella flexneri 2a str. 301
ugugguguaacgagacaaugcaa

SEQ ID NO: 1972465 - RNA, 21 nt, Shigella flexneri 2a str. 301
ugugguuggcguguuucagcu

SEQ ID NO: 1972466 - RNA, 23 nt, Shigella flexneri 2a str. 301
uguguaggcguugaugccggaug

SEQ ID NO: 1972467 - RNA, 21 nt, Shigella flexneri 2a str. 301
uguguacauccuaaaggcaaa

SEQ ID NO: 1972468 - RNA, 18 nt, Shigella flexneri 2a str. 301
uguuacguuucucugcua

SEQ ID NO: 1972469 - RNA, 21 nt, Shigella flexneri 2a str. 301
uguuacgauagaauauuucua

SEQ ID NO: 1972470 - RNA, 18 nt, Shigella flexneri 2a str. 301
uguuacaacaucaacaaa

SEQ ID NO: 1972471 - RNA, 21 nt, Shigella flexneri 2a str. 301
uguguugcauccggcauggca

SEQ ID NO: 1972472 - RNA, 23 nt, Shigella flexneri 2a str. 301
uguguugaggaucacaaaacgaa

SEQ ID NO: 1972473 - RNA, 20 nt, Shigella flexneri 2a str. 301
uguguugcugaacuuaugca

SEQ ID NO: 1972474 - RNA, 11 nt, Shigella flexneri 2a str. 301
uguguuuauaa

SEQ ID NO: 1972475 - RNA, 22 nt, Shigella flexneri 2a str. 301
uguuagaugugggcaaucucac

SEQ ID NO: 1972476 - RNA, 20 nt, Shigella flexneri 2a str. 301
uguuagaugugggcaaucuc

SEQ ID NO: 1972477 - RNA, 18 nt, Shigella flexneri 2a str. 301
uguuagcggcgacaauaa

SEQ ID NO: 1972478 - RNA, 22 nt, Shigella flexneri 2a str. 301
uguuagcaugcuggcugcgcuc

SEQ ID NO: 1972479 - RNA, 12 nt, Shigella flexneri 2a str. 301
uguucaacaauu

SEQ ID NO: 1972480 - RNA, 16 nt, Shigella flexneri 2a str. 301
uguugaguuuuuuguc

SEQ ID NO: 1972481 - RNA, 15 nt, Shigella flexneri 2a str. 301
uguugccauuucugc

SEQ ID NO: 1972482 - RNA, 17 nt, Shigella flexneri 2a str. 301
uguugauggggguccug

SEQ ID NO: 1972483 - RNA, 22 nt, Shigella flexneri 2a str. 301
uguucgcccacgcgcauuccca

SEQ ID NO: 1972484 - RNA, 15 nt, Shigella flexneri 2a str. 301
uguucgagcaucaca

SEQ ID NO: 1972485 - RNA, 22 nt, Shigella flexneri 2a str. 301
uguucaucugcauuccggugua

SEQ ID NO: 1972486 - RNA, 14 nt, Shigella flexneri 2a str. 301
uguucucuucugcu

SEQ ID NO: 1972487 - RNA, 16 nt, Shigella flexneri 2a str. 301
uguucggcauucugcu

SEQ ID NO: 1972488 - RNA, 16 nt, Shigella flexneri 2a str. 301
uguucuggucacucuc

SEQ ID NO: 1972489 - RNA, 19 nt, Shigella flexneri 2a str. 301
uguucugcgcuugguuuug

SEQ ID NO: 1972490 - RNA, 18 nt, Shigella flexneri 2a str. 301
uguucugcgccaaacaga

SEQ ID NO: 1972491 - RNA, 19 nt, Shigella flexneri 2a str. 301
uguucugcgccaaacagau

SEQ ID NO: 1972492 - RNA, 20 nt, Shigella flexneri 2a str. 301
uggugcaagaaaugacagag

SEQ ID NO: 1972493 - RNA, 22 nt, Shigella flexneri 2a str. 301
uggugcaaauugcaccauccau

SEQ ID NO: 1972494 - RNA, 23 nt, Shigella flexneri 2a str. 301
uggugauggacaacgcuuuuugg

SEQ ID NO: 1972495 - RNA, 19 nt, Shigella flexneri 2a str. 301
uggugaugagcugaccaga

SEQ ID NO: 1972496 - RNA, 14 nt, Shigella flexneri 2a str. 301
uggugaugcauugu

SEQ ID NO: 1972497 - RNA, 21 nt, Shigella flexneri 2a str. 301
uggugaugcauuguuugcaaa

SEQ ID NO: 1972498 - RNA, 17 nt, Shigella flexneri 2a str. 301
uggugaagccaccagca

SEQ ID NO: 1972499 - RNA, 17 nt, Shigella flexneri 2a str. 301
uggugaaaaaaaggcga

SEQ ID NO: 1972500 - RNA, 19 nt, Shigella flexneri 2a str. 301
uggucuggaacuggcugcc

SEQ ID NO: 1972501 - RNA, 23 nt, Shigella flexneri 2a str. 301
ugguggucuccacgcuuaacaac

SEQ ID NO: 1972502 - RNA, 17 nt, Shigella flexneri 2a str. 301
uggugcuuugcuguguu

SEQ ID NO: 1972503 - RNA, 22 nt, Shigella flexneri 2a str. 301
uggugccagauuuaacggcagc

SEQ ID NO: 1972504 - RNA, 16 nt, Shigella flexneri 2a str. 301
ugguauuggaagguua

SEQ ID NO: 1972505 - RNA, 12 nt, Shigella flexneri 2a str. 301
uggucaccacgg

SEQ ID NO: 1972506 - RNA, 22 nt, Shigella flexneri 2a str. 301
uggucauaucaauaguaaccag

SEQ ID NO: 1972507 - RNA, 17 nt, Shigella flexneri 2a str. 301
uggucaucgguuuucag

SEQ ID NO: 1972508 - RNA, 21 nt, Shigella flexneri 2a str. 301
uggucauucggcgcagguuua

SEQ ID NO: 1972509 - RNA, 16 nt, Shigella flexneri 2a str. 301
ugguagauaagcaagg

SEQ ID NO: 1972510 - RNA, 17 nt, Shigella flexneri 2a str. 301
ugguaaucaccacccau

SEQ ID NO: 1972511 - RNA, 19 nt, Shigella flexneri 2a str. 301
ugguaacgccccacaaacc

SEQ ID NO: 1972512 - RNA, 19 nt, Shigella flexneri 2a str. 301
ugggguauuuccagggccu

SEQ ID NO: 1972513 - RNA, 19 nt, Shigella flexneri 2a str. 301
uguaaugagaauaaucacc

SEQ ID NO: 1972514 - RNA, 13 nt, Shigella flexneri 2a str. 301
uguaaugauuuaa

SEQ ID NO: 1972515 - RNA, 11 nt, Shigella flexneri 2a str. 301
uguaaucaacu

SEQ ID NO: 1972516 - RNA, 16 nt, Shigella flexneri 2a str. 301
uguaagucggucacag

SEQ ID NO: 1972517 - RNA, 15 nt, Shigella flexneri 2a str. 301
ugguuuuguaggcug

SEQ ID NO: 1972518 - RNA, 17 nt, Shigella flexneri 2a str. 301
ugguuuugaacagcggu

SEQ ID NO: 1972519 - RNA, 16 nt, Shigella flexneri 2a str. 301
ugguuuuccugagcaa

SEQ ID NO: 1972520 - RNA, 17 nt, Shigella flexneri 2a str. 301
ugguuuucgccggaacc

SEQ ID NO: 1972521 - RNA, 16 nt, Shigella flexneri 2a str. 301
uguaagguggcgucaa

SEQ ID NO: 1972522 - RNA, 16 nt, Shigella flexneri 2a str. 301
uguaagcagaaaagcc

SEQ ID NO: 1972523 - RNA, 22 nt, Shigella flexneri 2a str. 301
uguaagccaagcgccgccucag

SEQ ID NO: 1972524 - RNA, 14 nt, Shigella flexneri 2a str. 301
uguaacaaaaaaca

SEQ ID NO: 1972525 - RNA, 14 nt, Shigella flexneri 2a str. 301
ugguuuggaucugu

SEQ ID NO: 1972526 - RNA, 14 nt, Shigella flexneri 2a str. 301
ugguuugcauccac

SEQ ID NO: 1972527 - RNA, 20 nt, Shigella flexneri 2a str. 301
ugguuucugguggaaaagaa

SEQ ID NO: 1972528 - RNA, 22 nt, Shigella flexneri 2a str. 301
ugguuuuaaagaaucgggcaac

SEQ ID NO: 1972529 - RNA, 14 nt, Shigella flexneri 2a str. 301
ugguuuguuuucag

SEQ ID NO: 1972530 - RNA, 15 nt, Shigella flexneri 2a str. 301
ugguuuccagcaucg

SEQ ID NO: 1972531 - RNA, 13 nt, Shigella flexneri 2a str. 301
ugguuguaaucca

SEQ ID NO: 1972532 - RNA, 14 nt, Shigella flexneri 2a str. 301
ugguuguuccugcg

SEQ ID NO: 1972533 - RNA, 21 nt, Shigella flexneri 2a str. 301
ugguuuaucuccguuaaaggc

SEQ ID NO: 1972534 - RNA, 14 nt, Shigella flexneri 2a str. 301
ugguugcaugauga

SEQ ID NO: 1972535 - RNA, 20 nt, Shigella flexneri 2a str. 301
ugguugccagccacaccugg

SEQ ID NO: 1972536 - RNA, 13 nt, Shigella flexneri 2a str. 301
ugguucuccaaau

SEQ ID NO: 1972537 - RNA, 21 nt, Shigella flexneri 2a str. 301
ugguuccgguuuauccauccc

SEQ ID NO: 1972538 - RNA, 18 nt, Shigella flexneri 2a str. 301
ugguucccaacaacagcg

SEQ ID NO: 1972539 - RNA, 14 nt, Shigella flexneri 2a str. 301
ugguuccugacucc

SEQ ID NO: 1972540 - RNA, 15 nt, Shigella flexneri 2a str. 301
ugguucgcaacggcu

SEQ ID NO: 1972541 - RNA, 15 nt, Shigella flexneri 2a str. 301
ugguuacgcagauau

SEQ ID NO: 1972542 - RNA, 21 nt, Shigella flexneri 2a str. 301
ugguuacgcauaaaaccagca

SEQ ID NO: 1972543 - RNA, 16 nt, Shigella flexneri 2a str. 301
ugguucccaacaacag

SEQ ID NO: 1972544 - RNA, 22 nt, Shigella flexneri 2a str. 301
uggcggggagggaauccagcaa

SEQ ID NO: 1972545 - RNA, 15 nt, Shigella flexneri 2a str. 301
uggcgggauguguaa

SEQ ID NO: 1972546 - RNA, 16 nt, Shigella flexneri 2a str. 301
uggcguacccaucaac

SEQ ID NO: 1972547 - RNA, 21 nt, Shigella flexneri 2a str. 301
uggcgucacgccgaccagacc

SEQ ID NO: 1972548 - RNA, 19 nt, Shigella flexneri 2a str. 301
uggcgcgaccaaugucagg

SEQ ID NO: 1972549 - RNA, 17 nt, Shigella flexneri 2a str. 301
uggcgcuaugcuggaug

SEQ ID NO: 1972550 - RNA, 22 nt, Shigella flexneri 2a str. 301
uggcgcucugguagauaagcaa

SEQ ID NO: 1972551 - RNA, 20 nt, Shigella flexneri 2a str. 301
uggcgcugauaaaucccgcc

SEQ ID NO: 1972552 - RNA, 23 nt, Shigella flexneri 2a str. 301
uggcuauaaucacucaaaauauc

SEQ ID NO: 1972553 - RNA, 23 nt, Shigella flexneri 2a str. 301
uggcuauuuaccaauauaauucc

SEQ ID NO: 1972554 - RNA, 15 nt, Shigella flexneri 2a str. 301
uggcuaugggauauu

SEQ ID NO: 1972555 - RNA, 11 nt, Shigella flexneri 2a str. 301
uggcucaagca

SEQ ID NO: 1972556 - RNA, 17 nt, Shigella flexneri 2a str. 301
uggcucaagcaccaucc

SEQ ID NO: 1972557 - RNA, 14 nt, Shigella flexneri 2a str. 301
uggcucaacaacug

SEQ ID NO: 1972558 - RNA, 18 nt, Shigella flexneri 2a str. 301
uggcucagauugaacgcu

SEQ ID NO: 1972559 - RNA, 18 nt, Shigella flexneri 2a str. 301
uggcucaaucgccaccac

SEQ ID NO: 1972560 - RNA, 20 nt, Shigella flexneri 2a str. 301
uggcucaucgccuuccagcg

SEQ ID NO: 1972561 - RNA, 20 nt, Shigella flexneri 2a str. 301
uggcuccgggugugacaaca

SEQ ID NO: 1972562 - RNA, 19 nt, Shigella flexneri 2a str. 301
uggcucugaauaaagcguu

SEQ ID NO: 1972563 - RNA, 18 nt, Shigella flexneri 2a str. 301
uggcucugauugauucag

SEQ ID NO: 1972564 - RNA, 22 nt, Shigella flexneri 2a str. 301
uggcguuugaccaacaccggua

SEQ ID NO: 1972565 - RNA, 21 nt, Shigella flexneri 2a str. 301
uggcguuuuuccaaaacugga

SEQ ID NO: 1972566 - RNA, 20 nt, Shigella flexneri 2a str. 301
uggcguuuccagcaguucca

SEQ ID NO: 1972567 - RNA, 16 nt, Shigella flexneri 2a str. 301
uggcguucagcgacgu

SEQ ID NO: 1972568 - RNA, 23 nt, Shigella flexneri 2a str. 301
uggcgucagaccggcaaccagca

SEQ ID NO: 1972569 - RNA, 18 nt, Shigella flexneri 2a str. 301
uggcgucggauauaaaaa

SEQ ID NO: 1972570 - RNA, 19 nt, Shigella flexneri 2a str. 301
uggcgucuccugccgagcg

SEQ ID NO: 1972571 - RNA, 19 nt, Shigella flexneri 2a str. 301
uggggauagcgcugcugca

SEQ ID NO: 1972572 - RNA, 19 nt, Shigella flexneri 2a str. 301
uggggacaaucaccaugcc

SEQ ID NO: 1972573 - RNA, 22 nt, Shigella flexneri 2a str. 301
ugggcggcgugauuggcaucau

SEQ ID NO: 1972574 - RNA, 14 nt, Shigella flexneri 2a str. 301
ugggcgcugcugua

SEQ ID NO: 1972575 - RNA, 13 nt, Shigella flexneri 2a str. 301
ugggcgaggucca

SEQ ID NO: 1972576 - RNA, 23 nt, Shigella flexneri 2a str. 301
ugggcgagggcaaaccucaccgc

SEQ ID NO: 1972577 - RNA, 21 nt, Shigella flexneri 2a str. 301
ugggcgauacgggcucgggca

SEQ ID NO: 1972578 - RNA, 15 nt, Shigella flexneri 2a str. 301
ugggccagaaaaaac

SEQ ID NO: 1972579 - RNA, 20 nt, Shigella flexneri 2a str. 301
ugggagcgauucggcuacua

SEQ ID NO: 1972580 - RNA, 15 nt, Shigella flexneri 2a str. 301
ugggacgcagacugg

SEQ ID NO: 1972581 - RNA, 22 nt, Shigella flexneri 2a str. 301
ugggacaguaucgauauggacu

SEQ ID NO: 1972582 - RNA, 13 nt, Shigella flexneri 2a str. 301
uggcuucauccac

SEQ ID NO: 1972583 - RNA, 14 nt, Shigella flexneri 2a str. 301
uggcuuaaucugcc

SEQ ID NO: 1972584 - RNA, 17 nt, Shigella flexneri 2a str. 301
uggcuugcgucauccag

SEQ ID NO: 1972585 - RNA, 20 nt, Shigella flexneri 2a str. 301
uggcuucuuccccggaugag

SEQ ID NO: 1972586 - RNA, 14 nt, Shigella flexneri 2a str. 301
ugggaaaugacauu

SEQ ID NO: 1972587 - RNA, 17 nt, Shigella flexneri 2a str. 301
uggcuuuccaccaucac

SEQ ID NO: 1972588 - RNA, 13 nt, Shigella flexneri 2a str. 301
ugggaaauccaac

SEQ ID NO: 1972589 - RNA, 23 nt, Shigella flexneri 2a str. 301
uggcuguaaaauuauccucuuca

SEQ ID NO: 1972590 - RNA, 19 nt, Shigella flexneri 2a str. 301
uggcuguuuucagcaccag

SEQ ID NO: 1972591 - RNA, 19 nt, Shigella flexneri 2a str. 301
uggcuuaaacgcagagaca

SEQ ID NO: 1972592 - RNA, 21 nt, Shigella flexneri 2a str. 301
uggcugccgagcaaaucgcgg

SEQ ID NO: 1972593 - RNA, 20 nt, Shigella flexneri 2a str. 301
uggcugcaaagcauuuuuuc

SEQ ID NO: 1972594 - RNA, 16 nt, Shigella flexneri 2a str. 301
uggcugccaugguuug

SEQ ID NO: 1972595 - RNA, 21 nt, Shigella flexneri 2a str. 301
uggcugagugaaucagaagac

SEQ ID NO: 1972596 - RNA, 14 nt, Shigella flexneri 2a str. 301
uggcugacugucgc

SEQ ID NO: 1972597 - RNA, 13 nt, Shigella flexneri 2a str. 301
uggcugaccagaa

SEQ ID NO: 1972598 - RNA, 19 nt, Shigella flexneri 2a str. 301
uggcugacugucgcagcca

SEQ ID NO: 1972599 - RNA, 14 nt, Shigella flexneri 2a str. 301
uucaguaaugaagg

SEQ ID NO: 1972600 - RNA, 21 nt, Shigella flexneri 2a str. 301
uucaguacguucacgcagcuc

SEQ ID NO: 1972601 - RNA, 17 nt, Shigella flexneri 2a str. 301
uucaguauugagcaaug

SEQ ID NO: 1972602 - RNA, 18 nt, Shigella flexneri 2a str. 301
uucaguauugagcaaugu

SEQ ID NO: 1972603 - RNA, 16 nt, Shigella flexneri 2a str. 301
uucagguuguuuucug

SEQ ID NO: 1972604 - RNA, 23 nt, Shigella flexneri 2a str. 301
uucaggauggucaacgucaacuu

SEQ ID NO: 1972605 - RNA, 15 nt, Shigella flexneri 2a str. 301
uucaggaugguauug

SEQ ID NO: 1972606 - RNA, 21 nt, Shigella flexneri 2a str. 301
uucaggauauuuauauuuugc

SEQ ID NO: 1972607 - RNA, 17 nt, Shigella flexneri 2a str. 301
uucaggccgcgcaguuc

SEQ ID NO: 1972608 - RNA, 21 nt, Shigella flexneri 2a str. 301
uucaggcgaaccggaacauca

SEQ ID NO: 1972609 - RNA, 17 nt, Shigella flexneri 2a str. 301
uucaggguaugaauggc

SEQ ID NO: 1972610 - RNA, 14 nt, Shigella flexneri 2a str. 301
uucagccucugccg

SEQ ID NO: 1972611 - RNA, 19 nt, Shigella flexneri 2a str. 301
uucagcgccugauacagcc

SEQ ID NO: 1972612 - RNA, 21 nt, Shigella flexneri 2a str. 301
uucagcggcgcaacccccaca

SEQ ID NO: 1972613 - RNA, 11 nt, Shigella flexneri 2a str. 301
uucagcggcag

SEQ ID NO: 1972614 - RNA, 17 nt, Shigella flexneri 2a str. 301
uucagccggaauaauca

SEQ ID NO: 1972615 - RNA, 14 nt, Shigella flexneri 2a str. 301
uucagccccagcac

SEQ ID NO: 1972616 - RNA, 23 nt, Shigella flexneri 2a str. 301
uucagccgcaaaccuggcaacaa

SEQ ID NO: 1972617 - RNA, 16 nt, Shigella flexneri 2a str. 301
uucagcgaucguuuuu

SEQ ID NO: 1972618 - RNA, 20 nt, Shigella flexneri 2a str. 301
uucagccugacagcacgccc

SEQ ID NO: 1972619 - RNA, 19 nt, Shigella flexneri 2a str. 301
uucaggaauucagaaaaau

SEQ ID NO: 1972620 - RNA, 16 nt, Shigella flexneri 2a str. 301
uucaggaauucagaaa

SEQ ID NO: 1972621 - RNA, 14 nt, Shigella flexneri 2a str. 301
uucaggaaauaaau

SEQ ID NO: 1972622 - RNA, 16 nt, Shigella flexneri 2a str. 301
uucaggaaauaaauaa

SEQ ID NO: 1972623 - RNA, 21 nt, Shigella flexneri 2a str. 301
uucaggaacaccgcacgcaga

SEQ ID NO: 1972624 - RNA, 20 nt, Shigella flexneri 2a str. 301
uucagcuuuuuagcgaucuc

SEQ ID NO: 1972625 - RNA, 23 nt, Shigella flexneri 2a str. 301
uucaggaaacugcgcccgcuuuu

SEQ ID NO: 1972626 - RNA, 14 nt, Shigella flexneri 2a str. 301
uucagcucaagaau

SEQ ID NO: 1972627 - RNA, 14 nt, Shigella flexneri 2a str. 301
uucauacccugaau

SEQ ID NO: 1972628 - RNA, 22 nt, Shigella flexneri 2a str. 301
uucauacccugaaucaaucaga

SEQ ID NO: 1972629 - RNA, 13 nt, Shigella flexneri 2a str. 301
uucauacagcgga

SEQ ID NO: 1972630 - RNA, 18 nt, Shigella flexneri 2a str. 301
uucauaggcuuccacuuc

SEQ ID NO: 1972631 - RNA, 12 nt, Shigella flexneri 2a str. 301
uucauacugccg

SEQ ID NO: 1972632 - RNA, 18 nt, Shigella flexneri 2a str. 301
uucauauucaauuugcaa

SEQ ID NO: 1972633 - RNA, 20 nt, Shigella flexneri 2a str. 301
uucauaugcgccagcugcau

SEQ ID NO: 1972634 - RNA, 13 nt, Shigella flexneri 2a str. 301
uucauaucugcca

SEQ ID NO: 1972635 - RNA, 15 nt, Shigella flexneri 2a str. 301
uucagugcaaaugcc

SEQ ID NO: 1972636 - RNA, 18 nt, Shigella flexneri 2a str. 301
uucagugacuucugccag

SEQ ID NO: 1972637 - RNA, 23 nt, Shigella flexneri 2a str. 301
uucaguguccagcggcauaaaac

SEQ ID NO: 1972638 - RNA, 15 nt, Shigella flexneri 2a str. 301
uucaguucagaaagc

SEQ ID NO: 1972639 - RNA, 14 nt, Shigella flexneri 2a str. 301
uucaguugcucugc

SEQ ID NO: 1972640 - RNA, 20 nt, Shigella flexneri 2a str. 301
uucauaauauauaaagauuc

SEQ ID NO: 1972641 - RNA, 23 nt, Shigella flexneri 2a str. 301
uucauaaacacgguuuuucauug

SEQ ID NO: 1972642 - RNA, 16 nt, Shigella flexneri 2a str. 301
uucaugaacacacccg

SEQ ID NO: 1972643 - RNA, 13 nt, Shigella flexneri 2a str. 301
uucaucuucaguc

SEQ ID NO: 1972644 - RNA, 15 nt, Shigella flexneri 2a str. 301
uucaucuucagucag

SEQ ID NO: 1972645 - RNA, 15 nt, Shigella flexneri 2a str. 301
uucaucgcuaaaaua

SEQ ID NO: 1972646 - RNA, 17 nt, Shigella flexneri 2a str. 301
uucaucgugcucgcuuu

SEQ ID NO: 1972647 - RNA, 16 nt, Shigella flexneri 2a str. 301
uucaucugauagcuuu

SEQ ID NO: 1972648 - RNA, 11 nt, Shigella flexneri 2a str. 301
uucaucugccu

SEQ ID NO: 1972649 - RNA, 13 nt, Shigella flexneri 2a str. 301
uucaucucaguga

SEQ ID NO: 1972650 - RNA, 15 nt, Shigella flexneri 2a str. 301
uucaucacaccaguc

SEQ ID NO: 1972651 - RNA, 20 nt, Shigella flexneri 2a str. 301
uucaucacuaccuucuuccc

SEQ ID NO: 1972652 - RNA, 20 nt, Shigella flexneri 2a str. 301
uucaucacuugauccauauc

SEQ ID NO: 1972653 - RNA, 18 nt, Shigella flexneri 2a str. 301
uucaucacgaaaaucauu

SEQ ID NO: 1972654 - RNA, 22 nt, Shigella flexneri 2a str. 301
uucaucauccgugaauaaugca

SEQ ID NO: 1972655 - RNA, 17 nt, Shigella flexneri 2a str. 301
uucaucauccucuucag

SEQ ID NO: 1972656 - RNA, 12 nt, Shigella flexneri 2a str. 301
uucauccagcau

SEQ ID NO: 1972657 - RNA, 16 nt, Shigella flexneri 2a str. 301
uucauccguuucucug

SEQ ID NO: 1972658 - RNA, 13 nt, Shigella flexneri 2a str. 301
uucaucgcccaca

SEQ ID NO: 1972659 - RNA, 23 nt, Shigella flexneri 2a str. 301
uucauccuguacgacaaaagaau

SEQ ID NO: 1972660 - RNA, 19 nt, Shigella flexneri 2a str. 301
uucauccuguacgacaaaa

SEQ ID NO: 1972661 - RNA, 22 nt, Shigella flexneri 2a str. 301
uucauccuguacgacaaaagaa

SEQ ID NO: 1972662 - RNA, 20 nt, Shigella flexneri 2a str. 301
uucaucccgguuauuaaaac

SEQ ID NO: 1972663 - RNA, 17 nt, Shigella flexneri 2a str. 301
uucaucccucucaucca

SEQ ID NO: 1972664 - RNA, 22 nt, Shigella flexneri 2a str. 301
uucaucccgguuauuaaaacga

SEQ ID NO: 1972665 - RNA, 20 nt, Shigella flexneri 2a str. 301
uucauccguuucucuguuca

SEQ ID NO: 1972666 - RNA, 23 nt, Shigella flexneri 2a str. 301
uucauugaacgggugauuucccc

SEQ ID NO: 1972667 - RNA, 18 nt, Shigella flexneri 2a str. 301
uucauucaauuaauaaca

SEQ ID NO: 1972668 - RNA, 15 nt, Shigella flexneri 2a str. 301
uucauucaggccaaa

SEQ ID NO: 1972669 - RNA, 12 nt, Shigella flexneri 2a str. 301
uucauuguugac

SEQ ID NO: 1972670 - RNA, 15 nt, Shigella flexneri 2a str. 301
uucauuguucuccca

SEQ ID NO: 1972671 - RNA, 21 nt, Shigella flexneri 2a str. 301
uucauuugccagcuucagcgc

SEQ ID NO: 1972672 - RNA, 13 nt, Shigella flexneri 2a str. 301
uucauuaauauca

SEQ ID NO: 1972673 - RNA, 20 nt, Shigella flexneri 2a str. 301
uucauguucagauuguugau

SEQ ID NO: 1972674 - RNA, 15 nt, Shigella flexneri 2a str. 301
uucauuaaagccgcc

SEQ ID NO: 1972675 - RNA, 19 nt, Shigella flexneri 2a str. 301
uucauuaugaucaaaauca

SEQ ID NO: 1972676 - RNA, 16 nt, Shigella flexneri 2a str. 301
uucauuaccaaccuga

SEQ ID NO: 1972677 - RNA, 20 nt, Shigella flexneri 2a str. 301
uucauuaccuuuuuucccuu

SEQ ID NO: 1972678 - RNA, 17 nt, Shigella flexneri 2a str. 301
uucaugcuauuccuuga

SEQ ID NO: 1972679 - RNA, 20 nt, Shigella flexneri 2a str. 301
uucaugcuuaaucaucgacu

SEQ ID NO: 1972680 - RNA, 21 nt, Shigella flexneri 2a str. 301
uucauggugcaagaaaugaca

SEQ ID NO: 1972681 - RNA, 14 nt, Shigella flexneri 2a str. 301
uucaugcuauuccu

SEQ ID NO: 1972682 - RNA, 20 nt, Shigella flexneri 2a str. 301
uucaugccuguauugguuuc

SEQ ID NO: 1972683 - RNA, 16 nt, Shigella flexneri 2a str. 301
uucaugcgaauacacc

SEQ ID NO: 1972684 - RNA, 16 nt, Shigella flexneri 2a str. 301
uucaugccauccgcau

SEQ ID NO: 1972685 - RNA, 13 nt, Shigella flexneri 2a str. 301
uucaaguaauuca

SEQ ID NO: 1972686 - RNA, 23 nt, Shigella flexneri 2a str. 301
uucaagucucggaagguuucuuc

SEQ ID NO: 1972687 - RNA, 22 nt, Shigella flexneri 2a str. 301
uucaagcucaaaauaauacaca

SEQ ID NO: 1972688 - RNA, 14 nt, Shigella flexneri 2a str. 301
uucaaguccccccc

SEQ ID NO: 1972689 - RNA, 17 nt, Shigella flexneri 2a str. 301
uucaauacgcucgaaca

SEQ ID NO: 1972690 - RNA, 22 nt, Shigella flexneri 2a str. 301
uucaauaccgccugcaaauaaa

SEQ ID NO: 1972691 - RNA, 19 nt, Shigella flexneri 2a str. 301
uucaauaaccugcaaaaua

SEQ ID NO: 1972692 - RNA, 15 nt, Shigella flexneri 2a str. 301
uucaauaacuccauc

SEQ ID NO: 1972693 - RNA, 23 nt, Shigella flexneri 2a str. 301
uucaaugcugccgggguaaagcg

SEQ ID NO: 1972694 - RNA, 17 nt, Shigella flexneri 2a str. 301
uucaaugcauuaucaga

SEQ ID NO: 1972695 - RNA, 18 nt, Shigella flexneri 2a str. 301
uucaauauggaaguuuug

SEQ ID NO: 1972696 - RNA, 14 nt, Shigella flexneri 2a str. 301
uucaauauauugca

SEQ ID NO: 1972697 - RNA, 21 nt, Shigella flexneri 2a str. 301
uucaauauauugcugaaauaa

SEQ ID NO: 1972698 - RNA, 21 nt, Shigella flexneri 2a str. 301
uucacacacaucgacccagaa

SEQ ID NO: 1972699 - RNA, 17 nt, Shigella flexneri 2a str. 301
uucacaaaggcuugcug

SEQ ID NO: 1972700 - RNA, 21 nt, Shigella flexneri 2a str. 301
uucaccaaacuucagcccuuu

SEQ ID NO: 1972701 - RNA, 20 nt, Shigella flexneri 2a str. 301
uucaccaaagcugauuucug

SEQ ID NO: 1972702 - RNA, 23 nt, Shigella flexneri 2a str. 301
uucacaguaaugauuuaaaacca

SEQ ID NO: 1972703 - RNA, 18 nt, Shigella flexneri 2a str. 301
uucacaggccgccaggca

SEQ ID NO: 1972704 - RNA, 20 nt, Shigella flexneri 2a str. 301
uucacaucaccauagccuaa

SEQ ID NO: 1972705 - RNA, 16 nt, Shigella flexneri 2a str. 301
uucacauauugcagcu

SEQ ID NO: 1972706 - RNA, 22 nt, Shigella flexneri 2a str. 301
uucacaguuaaguuaauucuga

SEQ ID NO: 1972707 - RNA, 13 nt, Shigella flexneri 2a str. 301
uucaccauuuuuu

SEQ ID NO: 1972708 - RNA, 15 nt, Shigella flexneri 2a str. 301
uucaccaguuuacug

SEQ ID NO: 1972709 - RNA, 19 nt, Shigella flexneri 2a str. 301
uucaccaucgcgaucauca

SEQ ID NO: 1972710 - RNA, 16 nt, Shigella flexneri 2a str. 301
uucaccagaccugaaa

SEQ ID NO: 1972711 - RNA, 18 nt, Shigella flexneri 2a str. 301
uucaccacugaauaacau

SEQ ID NO: 1972712 - RNA, 23 nt, Shigella flexneri 2a str. 301
uucagauaauccccaaugaccuu

SEQ ID NO: 1972713 - RNA, 23 nt, Shigella flexneri 2a str. 301
uucagauaauagguaaacauccg

SEQ ID NO: 1972714 - RNA, 15 nt, Shigella flexneri 2a str. 301
uucagauaaugcccg

SEQ ID NO: 1972715 - RNA, 23 nt, Shigella flexneri 2a str. 301
uucagauaaugcccgaugaccuu

SEQ ID NO: 1972716 - RNA, 14 nt, Shigella flexneri 2a str. 301
uucagaccaauaau

SEQ ID NO: 1972717 - RNA, 16 nt, Shigella flexneri 2a str. 301
uucagauaauagguaa

SEQ ID NO: 1972718 - RNA, 20 nt, Shigella flexneri 2a str. 301
uucagauucagcgucgucag

SEQ ID NO: 1972719 - RNA, 21 nt, Shigella flexneri 2a str. 301
uucagauuguugacaaagugc

SEQ ID NO: 1972720 - RNA, 13 nt, Shigella flexneri 2a str. 301
uucagauguuccg

SEQ ID NO: 1972721 - RNA, 12 nt, Shigella flexneri 2a str. 301
uucagcaaaugg

SEQ ID NO: 1972722 - RNA, 21 nt, Shigella flexneri 2a str. 301
uucagccauacguugcauaaa

SEQ ID NO: 1972723 - RNA, 18 nt, Shigella flexneri 2a str. 301
uucagccaguugaucucu

SEQ ID NO: 1972724 - RNA, 17 nt, Shigella flexneri 2a str. 301
uucagcaguucugccag

SEQ ID NO: 1972725 - RNA, 13 nt, Shigella flexneri 2a str. 301
uucagcaguuuuu

SEQ ID NO: 1972726 - RNA, 18 nt, Shigella flexneri 2a str. 301
uucagcauccguuaacuu

SEQ ID NO: 1972727 - RNA, 20 nt, Shigella flexneri 2a str. 301
uucagcagcggcucggucag

SEQ ID NO: 1972728 - RNA, 17 nt, Shigella flexneri 2a str. 301
uucagcaaucucuucaa

SEQ ID NO: 1972729 - RNA, 23 nt, Shigella flexneri 2a str. 301
uucagcaauucucucuucagcuu

SEQ ID NO: 1972730 - RNA, 20 nt, Shigella flexneri 2a str. 301
uucagcaauucucucuucag

SEQ ID NO: 1972731 - RNA, 17 nt, Shigella flexneri 2a str. 301
uucagaauauucgaaau

SEQ ID NO: 1972732 - RNA, 14 nt, Shigella flexneri 2a str. 301
uucagaaucaaguc

SEQ ID NO: 1972733 - RNA, 15 nt, Shigella flexneri 2a str. 301
uucagaagcugaagc

SEQ ID NO: 1972734 - RNA, 16 nt, Shigella flexneri 2a str. 301
uucagaauagacaaaa

SEQ ID NO: 1972735 - RNA, 19 nt, Shigella flexneri 2a str. 301
uucacuuuugcugcaaaau

SEQ ID NO: 1972736 - RNA, 13 nt, Shigella flexneri 2a str. 301
uucacuuucugaa

SEQ ID NO: 1972737 - RNA, 14 nt, Shigella flexneri 2a str. 301
uucacuuucugaag

SEQ ID NO: 1972738 - RNA, 23 nt, Shigella flexneri 2a str. 301
uucagaaagcccgaaucaguaau

SEQ ID NO: 1972739 - RNA, 13 nt, Shigella flexneri 2a str. 301
uucagaaaaagcg

SEQ ID NO: 1972740 - RNA, 12 nt, Shigella flexneri 2a str. 301
uucagaaaguaa

SEQ ID NO: 1972741 - RNA, 17 nt, Shigella flexneri 2a str. 301
uucacgcaggcgagaau

SEQ ID NO: 1972742 - RNA, 23 nt, Shigella flexneri 2a str. 301
uucacgccgcauccggcaauaag

SEQ ID NO: 1972743 - RNA, 16 nt, Shigella flexneri 2a str. 301
uucacgcccagaucca

SEQ ID NO: 1972744 - RNA, 23 nt, Shigella flexneri 2a str. 301
uucacgacauaaacauuccacuu

SEQ ID NO: 1972745 - RNA, 16 nt, Shigella flexneri 2a str. 301
uucacgaauauuuccc

SEQ ID NO: 1972746 - RNA, 13 nt, Shigella flexneri 2a str. 301
uucaccuuuuucc

SEQ ID NO: 1972747 - RNA, 14 nt, Shigella flexneri 2a str. 301
uucaccuuuuucca

SEQ ID NO: 1972748 - RNA, 16 nt, Shigella flexneri 2a str. 301
uucaccggugagcugc

SEQ ID NO: 1972749 - RNA, 23 nt, Shigella flexneri 2a str. 301
uucaccggauaaucggcaauacu

SEQ ID NO: 1972750 - RNA, 19 nt, Shigella flexneri 2a str. 301
uucaccguucgcuggaagc

SEQ ID NO: 1972751 - RNA, 15 nt, Shigella flexneri 2a str. 301
uucacccauugccgc

SEQ ID NO: 1972752 - RNA, 21 nt, Shigella flexneri 2a str. 301
uucacccaucacuaccugauu

SEQ ID NO: 1972753 - RNA, 23 nt, Shigella flexneri 2a str. 301
uucaccgcguaugcccagcgcag

SEQ ID NO: 1972754 - RNA, 19 nt, Shigella flexneri 2a str. 301
uucacgcuuugcaggcugg

SEQ ID NO: 1972755 - RNA, 17 nt, Shigella flexneri 2a str. 301
uucacggcaccagccau

SEQ ID NO: 1972756 - RNA, 15 nt, Shigella flexneri 2a str. 301
uucacguucacccau

SEQ ID NO: 1972757 - RNA, 13 nt, Shigella flexneri 2a str. 301
uucacguucaccc

SEQ ID NO: 1972758 - RNA, 15 nt, Shigella flexneri 2a str. 301
uucacuguccgucag

SEQ ID NO: 1972759 - RNA, 13 nt, Shigella flexneri 2a str. 301
uucacucacgccg

SEQ ID NO: 1972760 - RNA, 12 nt, Shigella flexneri 2a str. 301
uucacucacgcc

SEQ ID NO: 1972761 - RNA, 13 nt, Shigella flexneri 2a str. 301
uucacuauuucuu

SEQ ID NO: 1972762 - RNA, 17 nt, Shigella flexneri 2a str. 301
uucacuccacuggcugc

SEQ ID NO: 1972763 - RNA, 17 nt, Shigella flexneri 2a str. 301
uuccacagcucacggcc

SEQ ID NO: 1972764 - RNA, 18 nt, Shigella flexneri 2a str. 301
uuccacagcucacggccc

SEQ ID NO: 1972765 - RNA, 17 nt, Shigella flexneri 2a str. 301
uuccacauaaaguagcc

SEQ ID NO: 1972766 - RNA, 14 nt, Shigella flexneri 2a str. 301
uuccacgcagauua

SEQ ID NO: 1972767 - RNA, 21 nt, Shigella flexneri 2a str. 301
uuccacgccauagcggagcaa

SEQ ID NO: 1972768 - RNA, 18 nt, Shigella flexneri 2a str. 301
uuccacggaauauuucac

SEQ ID NO: 1972769 - RNA, 19 nt, Shigella flexneri 2a str. 301
uuccacucuuucagcacca

SEQ ID NO: 1972770 - RNA, 20 nt, Shigella flexneri 2a str. 301
uuccaagauuaaaggcacca

SEQ ID NO: 1972771 - RNA, 16 nt, Shigella flexneri 2a str. 301
uuccauaccuaaaaaa

SEQ ID NO: 1972772 - RNA, 15 nt, Shigella flexneri 2a str. 301
uuccauaccuaaaaa

SEQ ID NO: 1972773 - RNA, 18 nt, Shigella flexneri 2a str. 301
uuccauaccgaccaugua

SEQ ID NO: 1972774 - RNA, 18 nt, Shigella flexneri 2a str. 301
uuccauaagcccagaaca

SEQ ID NO: 1972775 - RNA, 17 nt, Shigella flexneri 2a str. 301
uuccaucagauucagca

SEQ ID NO: 1972776 - RNA, 23 nt, Shigella flexneri 2a str. 301
uuccauccggcaacaucaaauua

SEQ ID NO: 1972777 - RNA, 20 nt, Shigella flexneri 2a str. 301
uuccaucguccgugaagaaa

SEQ ID NO: 1972778 - RNA, 17 nt, Shigella flexneri 2a str. 301
uuccaguugcacgccac

SEQ ID NO: 1972779 - RNA, 19 nt, Shigella flexneri 2a str. 301
uuccaguugaagugaaaag

SEQ ID NO: 1972780 - RNA, 20 nt, Shigella flexneri 2a str. 301
uuccaguugaagugaaaagc

SEQ ID NO: 1972781 - RNA, 19 nt, Shigella flexneri 2a str. 301
uuccaguuugcucaaaucc

SEQ ID NO: 1972782 - RNA, 20 nt, Shigella flexneri 2a str. 301
uuccagucuucuugcuccac

SEQ ID NO: 1972783 - RNA, 18 nt, Shigella flexneri 2a str. 301
uuccagucuucuugcucc

SEQ ID NO: 1972784 - RNA, 22 nt, Shigella flexneri 2a str. 301
uuccaguguuuccggaauuaaa

SEQ ID NO: 1972785 - RNA, 21 nt, Shigella flexneri 2a str. 301
uuccagucggcguaauccuga

SEQ ID NO: 1972786 - RNA, 23 nt, Shigella flexneri 2a str. 301
uuccagucggcguaauccugaaa

SEQ ID NO: 1972787 - RNA, 22 nt, Shigella flexneri 2a str. 301
uuccagguuauuuuauuucugu

SEQ ID NO: 1972788 - RNA, 16 nt, Shigella flexneri 2a str. 301
uuccagggccucuccu

SEQ ID NO: 1972789 - RNA, 19 nt, Shigella flexneri 2a str. 301
uuccagacucaacaggccc

SEQ ID NO: 1972790 - RNA, 16 nt, Shigella flexneri 2a str. 301
uuccagagcagcgaau

SEQ ID NO: 1972791 - RNA, 23 nt, Shigella flexneri 2a str. 301
uuccagaucaccgcagaagcgau

SEQ ID NO: 1972792 - RNA, 12 nt, Shigella flexneri 2a str. 301
uuccagcaauua

SEQ ID NO: 1972793 - RNA, 15 nt, Shigella flexneri 2a str. 301
uuccagcaauuacac

SEQ ID NO: 1972794 - RNA, 17 nt, Shigella flexneri 2a str. 301
uuccagcacaaagcgau

SEQ ID NO: 1972795 - RNA, 15 nt, Shigella flexneri 2a str. 301
uuccagcaacucgau

SEQ ID NO: 1972796 - RNA, 22 nt, Shigella flexneri 2a str. 301
uuccagcagaccagcaauaacu

SEQ ID NO: 1972797 - RNA, 19 nt, Shigella flexneri 2a str. 301
uuccagcagauauugcccc

SEQ ID NO: 1972798 - RNA, 16 nt, Shigella flexneri 2a str. 301
uuccagcauuucuucc

SEQ ID NO: 1972799 - RNA, 13 nt, Shigella flexneri 2a str. 301
uuccagcuucaaa

SEQ ID NO: 1972800 - RNA, 14 nt, Shigella flexneri 2a str. 301
uuccagcugugcca

SEQ ID NO: 1972801 - RNA, 23 nt, Shigella flexneri 2a str. 301
uuccagcuucaaauuagccgcag

SEQ ID NO: 1972802 - RNA, 13 nt, Shigella flexneri 2a str. 301
uuccaggcaucag

SEQ ID NO: 1972803 - RNA, 18 nt, Shigella flexneri 2a str. 301
uuccagcucggcaaucug

SEQ ID NO: 1972804 - RNA, 16 nt, Shigella flexneri 2a str. 301
uuccagcggcaggccg

SEQ ID NO: 1972805 - RNA, 18 nt, Shigella flexneri 2a str. 301
uuccagcgguaacuuauc

SEQ ID NO: 1972806 - RNA, 21 nt, Shigella flexneri 2a str. 301
uuccagcguagugaaggcaaa

SEQ ID NO: 1972807 - RNA, 22 nt, Shigella flexneri 2a str. 301
uuccagcgccgccagaagggaa

SEQ ID NO: 1972808 - RNA, 17 nt, Shigella flexneri 2a str. 301
uuccauuucccugacaa

SEQ ID NO: 1972809 - RNA, 17 nt, Shigella flexneri 2a str. 301
uucccaacaacagcgcg

SEQ ID NO: 1972810 - RNA, 19 nt, Shigella flexneri 2a str. 301
uucccacucuugagcucca

SEQ ID NO: 1972811 - RNA, 20 nt, Shigella flexneri 2a str. 301
uucccacgucagaccaaaac

SEQ ID NO: 1972812 - RNA, 20 nt, Shigella flexneri 2a str. 301
uucccacugcucaaucauca

SEQ ID NO: 1972813 - RNA, 23 nt, Shigella flexneri 2a str. 301
uucccaccauacugcuuaaacca

SEQ ID NO: 1972814 - RNA, 16 nt, Shigella flexneri 2a str. 301
uuccauugccgcuuuc

SEQ ID NO: 1972815 - RNA, 18 nt, Shigella flexneri 2a str. 301
uucccaucucaauauuag

SEQ ID NO: 1972816 - RNA, 12 nt, Shigella flexneri 2a str. 301
uucccaggcacc

SEQ ID NO: 1972817 - RNA, 15 nt, Shigella flexneri 2a str. 301
uucccagcaagaacc

SEQ ID NO: 1972818 - RNA, 19 nt, Shigella flexneri 2a str. 301
uuccccgcuucagcccgcg

SEQ ID NO: 1972819 - RNA, 17 nt, Shigella flexneri 2a str. 301
uuccccccacaaucagc

SEQ ID NO: 1972820 - RNA, 12 nt, Shigella flexneri 2a str. 301
uucccccacagc

SEQ ID NO: 1972821 - RNA, 23 nt, Shigella flexneri 2a str. 301
uuccccuguugugccagaccaaa

SEQ ID NO: 1972822 - RNA, 15 nt, Shigella flexneri 2a str. 301
uuccccuaacucuuu

SEQ ID NO: 1972823 - RNA, 13 nt, Shigella flexneri 2a str. 301
uucccgcaacacc

SEQ ID NO: 1972824 - RNA, 22 nt, Shigella flexneri 2a str. 301
uucccgcagguugggcaauuca

SEQ ID NO: 1972825 - RNA, 21 nt, Shigella flexneri 2a str. 301
uucccgccagcggcccggaga

SEQ ID NO: 1972826 - RNA, 21 nt, Shigella flexneri 2a str. 301
uucccgagacauuccuuuacu

SEQ ID NO: 1972827 - RNA, 17 nt, Shigella flexneri 2a str. 301
uucccuguucagccuga

SEQ ID NO: 1972828 - RNA, 11 nt, Shigella flexneri 2a str. 301
uucccuuucag

SEQ ID NO: 1972829 - RNA, 21 nt, Shigella flexneri 2a str. 301
uucccugcugaauccccuucu

SEQ ID NO: 1972830 - RNA, 18 nt, Shigella flexneri 2a str. 301
uucccucccguuucccug

SEQ ID NO: 1972831 - RNA, 22 nt, Shigella flexneri 2a str. 301
uucccggucaguagaauaaucu

SEQ ID NO: 1972832 - RNA, 21 nt, Shigella flexneri 2a str. 301
uucccgggucgcgacugccag

SEQ ID NO: 1972833 - RNA, 20 nt, Shigella flexneri 2a str. 301
uucccggaauaauugcgguu

SEQ ID NO: 1972834 - RNA, 17 nt, Shigella flexneri 2a str. 301
uucccgccguugccgca

SEQ ID NO: 1972835 - RNA, 14 nt, Shigella flexneri 2a str. 301
uucccggaauaauu

SEQ ID NO: 1972836 - RNA, 21 nt, Shigella flexneri 2a str. 301
uuccgcugcaaguuuugucag

SEQ ID NO: 1972837 - RNA, 14 nt, Shigella flexneri 2a str. 301
uuccgcuucugcuu

SEQ ID NO: 1972838 - RNA, 22 nt, Shigella flexneri 2a str. 301
uuccgcgcaaucgcccagcgcg

SEQ ID NO: 1972839 - RNA, 13 nt, Shigella flexneri 2a str. 301
uuccgccgucacc

SEQ ID NO: 1972840 - RNA, 19 nt, Shigella flexneri 2a str. 301
uuccgacagaauauaaguc

SEQ ID NO: 1972841 - RNA, 15 nt, Shigella flexneri 2a str. 301
uuccgcaccugccag

SEQ ID NO: 1972842 - RNA, 14 nt, Shigella flexneri 2a str. 301
uuccgcaccugcca

SEQ ID NO: 1972843 - RNA, 20 nt, Shigella flexneri 2a str. 301
uucgcagcuuauuucuguga

SEQ ID NO: 1972844 - RNA, 16 nt, Shigella flexneri 2a str. 301
uucgccgguuccagcu

SEQ ID NO: 1972845 - RNA, 12 nt, Shigella flexneri 2a str. 301
uucgcccugcag

SEQ ID NO: 1972846 - RNA, 17 nt, Shigella flexneri 2a str. 301
uucgcccuggacaacau

SEQ ID NO: 1972847 - RNA, 15 nt, Shigella flexneri 2a str. 301
uucgccugaaauaau

SEQ ID NO: 1972848 - RNA, 20 nt, Shigella flexneri 2a str. 301
uucgccuccuguucugugcg

SEQ ID NO: 1972849 - RNA, 22 nt, Shigella flexneri 2a str. 301
uucgcuugucacuucugccucu

SEQ ID NO: 1972850 - RNA, 14 nt, Shigella flexneri 2a str. 301
uucgcuuucacuca

SEQ ID NO: 1972851 - RNA, 13 nt, Shigella flexneri 2a str. 301
uucgcuucuucag

SEQ ID NO: 1972852 - RNA, 20 nt, Shigella flexneri 2a str. 301
uucggacauguuuuccagca

SEQ ID NO: 1972853 - RNA, 17 nt, Shigella flexneri 2a str. 301
uucgcuuucacucagug

SEQ ID NO: 1972854 - RNA, 21 nt, Shigella flexneri 2a str. 301
uucgcuccccugcaaauuauu

SEQ ID NO: 1972855 - RNA, 16 nt, Shigella flexneri 2a str. 301
uucgcugccacaccau

SEQ ID NO: 1972856 - RNA, 16 nt, Shigella flexneri 2a str. 301
uucgcuuaccaugcca

SEQ ID NO: 1972857 - RNA, 18 nt, Shigella flexneri 2a str. 301
uucgcuuacgccugccag

SEQ ID NO: 1972858 - RNA, 18 nt, Shigella flexneri 2a str. 301
uucgcguaguaaagccuu

SEQ ID NO: 1972859 - RNA, 15 nt, Shigella flexneri 2a str. 301
uucgcguacugcuga

SEQ ID NO: 1972860 - RNA, 20 nt, Shigella flexneri 2a str. 301
uucgcggcguugaauuuaug

SEQ ID NO: 1972861 - RNA, 15 nt, Shigella flexneri 2a str. 301
uucgcuaccuuucag

SEQ ID NO: 1972862 - RNA, 20 nt, Shigella flexneri 2a str. 301
uucgcuacgaucgauaacca

SEQ ID NO: 1972863 - RNA, 22 nt, Shigella flexneri 2a str. 301
uucgcuaaagacuuugcugccu

SEQ ID NO: 1972864 - RNA, 16 nt, Shigella flexneri 2a str. 301
uucgccuuucaguuca

SEQ ID NO: 1972865 - RNA, 16 nt, Shigella flexneri 2a str. 301
uucgauuuuuuccagc

SEQ ID NO: 1972866 - RNA, 20 nt, Shigella flexneri 2a str. 301
uucgcagagugauucuuugu

SEQ ID NO: 1972867 - RNA, 20 nt, Shigella flexneri 2a str. 301
uucgcacaccgcugacuuuc

SEQ ID NO: 1972868 - RNA, 17 nt, Shigella flexneri 2a str. 301
uucgauaaacucaauca

SEQ ID NO: 1972869 - RNA, 16 nt, Shigella flexneri 2a str. 301
uucgauagcaaauugc

SEQ ID NO: 1972870 - RNA, 19 nt, Shigella flexneri 2a str. 301
uucgaugaugccggaauca

SEQ ID NO: 1972871 - RNA, 14 nt, Shigella flexneri 2a str. 301
uucgauaaucaaau

SEQ ID NO: 1972872 - RNA, 23 nt, Shigella flexneri 2a str. 301
uucgaugaugccggaaucaacca

SEQ ID NO: 1972873 - RNA, 12 nt, Shigella flexneri 2a str. 301
uucgacuucauc

SEQ ID NO: 1972874 - RNA, 23 nt, Shigella flexneri 2a str. 301
uucgaguacauccacugcauacu

SEQ ID NO: 1972875 - RNA, 18 nt, Shigella flexneri 2a str. 301
uucgagcuggaagccaca

SEQ ID NO: 1972876 - RNA, 15 nt, Shigella flexneri 2a str. 301
uucgagauucuuaaa

SEQ ID NO: 1972877 - RNA, 18 nt, Shigella flexneri 2a str. 301
uucgagcaggucagucag

SEQ ID NO: 1972878 - RNA, 18 nt, Shigella flexneri 2a str. 301
uucgaauauucugaagca

SEQ ID NO: 1972879 - RNA, 17 nt, Shigella flexneri 2a str. 301
uucgaagaguuccaacg

SEQ ID NO: 1972880 - RNA, 18 nt, Shigella flexneri 2a str. 301
uucgaccagccaggccgc

SEQ ID NO: 1972881 - RNA, 17 nt, Shigella flexneri 2a str. 301
uucgaccggguuucuua

SEQ ID NO: 1972882 - RNA, 15 nt, Shigella flexneri 2a str. 301
uucgacaacugcuga

SEQ ID NO: 1972883 - RNA, 13 nt, Shigella flexneri 2a str. 301
uucgaauuuucca

SEQ ID NO: 1972884 - RNA, 14 nt, Shigella flexneri 2a str. 301
uucgacaauaauca

SEQ ID NO: 1972885 - RNA, 20 nt, Shigella flexneri 2a str. 301
uucgaaaauggccucggcua

SEQ ID NO: 1972886 - RNA, 19 nt, Shigella flexneri 2a str. 301
uucgaaauagagaaaguaa

SEQ ID NO: 1972887 - RNA, 14 nt, Shigella flexneri 2a str. 301
uucgaaaaaaaaga

SEQ ID NO: 1972888 - RNA, 17 nt, Shigella flexneri 2a str. 301
uucgaaaaaaaagaaga

SEQ ID NO: 1972889 - RNA, 18 nt, Shigella flexneri 2a str. 301
uucgaaaaaaaagaagac

SEQ ID NO: 1972890 - RNA, 21 nt, Shigella flexneri 2a str. 301
uucgaaaaaaaagaagaccug

SEQ ID NO: 1972891 - RNA, 18 nt, Shigella flexneri 2a str. 301
uuccuucacgugacaaaa

SEQ ID NO: 1972892 - RNA, 13 nt, Shigella flexneri 2a str. 301
uuccuucagcuuu

SEQ ID NO: 1972893 - RNA, 15 nt, Shigella flexneri 2a str. 301
uuccuucagcagcag

SEQ ID NO: 1972894 - RNA, 17 nt, Shigella flexneri 2a str. 301
uuccuuguuuaaggaaa

SEQ ID NO: 1972895 - RNA, 19 nt, Shigella flexneri 2a str. 301
uuccuugaaaaagagguug

SEQ ID NO: 1972896 - RNA, 12 nt, Shigella flexneri 2a str. 301
uuccuugaaaaa

SEQ ID NO: 1972897 - RNA, 23 nt, Shigella flexneri 2a str. 301
uuccuggccgugaagaagaguuu

SEQ ID NO: 1972898 - RNA, 20 nt, Shigella flexneri 2a str. 301
uuccugggauaugagcgauu

SEQ ID NO: 1972899 - RNA, 14 nt, Shigella flexneri 2a str. 301
uuccuuaaaaguga

SEQ ID NO: 1972900 - RNA, 16 nt, Shigella flexneri 2a str. 301
uuccuuaugacuacga

SEQ ID NO: 1972901 - RNA, 23 nt, Shigella flexneri 2a str. 301
uuccugcaaucgucgauuguuau

SEQ ID NO: 1972902 - RNA, 16 nt, Shigella flexneri 2a str. 301
uuccugcaacuucucu

SEQ ID NO: 1972903 - RNA, 15 nt, Shigella flexneri 2a str. 301
uuccugagugaauau

SEQ ID NO: 1972904 - RNA, 22 nt, Shigella flexneri 2a str. 301
uuccugaguaauaacuuccuga

SEQ ID NO: 1972905 - RNA, 19 nt, Shigella flexneri 2a str. 301
uuccugauacaugaaugau

SEQ ID NO: 1972906 - RNA, 23 nt, Shigella flexneri 2a str. 301
uuccugcggcagacgcucgccau

SEQ ID NO: 1972907 - RNA, 15 nt, Shigella flexneri 2a str. 301
uuccugcugcaucug

SEQ ID NO: 1972908 - RNA, 20 nt, Shigella flexneri 2a str. 301
uuccugcuuuauaaucccuc

SEQ ID NO: 1972909 - RNA, 20 nt, Shigella flexneri 2a str. 301
uuccgggguaaauuucuucc

SEQ ID NO: 1972910 - RNA, 21 nt, Shigella flexneri 2a str. 301
uuccggguuugccacaucacu

SEQ ID NO: 1972911 - RNA, 21 nt, Shigella flexneri 2a str. 301
uuccguagcuuaucuguucag

SEQ ID NO: 1972912 - RNA, 20 nt, Shigella flexneri 2a str. 301
uuccgggaucugauucugau

SEQ ID NO: 1972913 - RNA, 17 nt, Shigella flexneri 2a str. 301
uuccggcaagcaaauga

SEQ ID NO: 1972914 - RNA, 15 nt, Shigella flexneri 2a str. 301
uuccggcaccacaaa

SEQ ID NO: 1972915 - RNA, 18 nt, Shigella flexneri 2a str. 301
uuccggcagcauguguaa

SEQ ID NO: 1972916 - RNA, 17 nt, Shigella flexneri 2a str. 301
uuccggcguccaccugc

SEQ ID NO: 1972917 - RNA, 18 nt, Shigella flexneri 2a str. 301
uuccuaucuucauggaga

SEQ ID NO: 1972918 - RNA, 19 nt, Shigella flexneri 2a str. 301
uuccuaucgaugaacgguu

SEQ ID NO: 1972919 - RNA, 14 nt, Shigella flexneri 2a str. 301
uuccuacugcuccu

SEQ ID NO: 1972920 - RNA, 18 nt, Shigella flexneri 2a str. 301
uuccucgucccaaaagcu

SEQ ID NO: 1972921 - RNA, 16 nt, Shigella flexneri 2a str. 301
uuccugaacucgccag

SEQ ID NO: 1972922 - RNA, 18 nt, Shigella flexneri 2a str. 301
uuccugaacucgccagcc

SEQ ID NO: 1972923 - RNA, 24 nt, Shigella flexneri 2a str. 301
uuccucuucgcguaacugaagcau

SEQ ID NO: 1972924 - RNA, 12 nt, Shigella flexneri 2a str. 301
uuccucugcccu

SEQ ID NO: 1972925 - RNA, 18 nt, Shigella flexneri 2a str. 301
uugcgggccaaagaccag

SEQ ID NO: 1972926 - RNA, 16 nt, Shigella flexneri 2a str. 301
uugcggcuauauucaa

SEQ ID NO: 1972927 - RNA, 20 nt, Shigella flexneri 2a str. 301
uugcggcuacacuauuuccu

SEQ ID NO: 1972928 - RNA, 13 nt, Shigella flexneri 2a str. 301
uugcggcacccau

SEQ ID NO: 1972929 - RNA, 19 nt, Shigella flexneri 2a str. 301
uugcggaaacugucaauaa

SEQ ID NO: 1972930 - RNA, 12 nt, Shigella flexneri 2a str. 301
uugcgccagcgc

SEQ ID NO: 1972931 - RNA, 20 nt, Shigella flexneri 2a str. 301
uugccugaugcgcugggcaa

SEQ ID NO: 1972932 - RNA, 19 nt, Shigella flexneri 2a str. 301
uugccugaucgcgcaaaca

SEQ ID NO: 1972933 - RNA, 21 nt, Shigella flexneri 2a str. 301
uugccugugacuuucugagau

SEQ ID NO: 1972934 - RNA, 14 nt, Shigella flexneri 2a str. 301
uugccugggugcaa

SEQ ID NO: 1972935 - RNA, 17 nt, Shigella flexneri 2a str. 301
uugccuuaaugcuugug

SEQ ID NO: 1972936 - RNA, 17 nt, Shigella flexneri 2a str. 301
uugcgcaacugaggcaa

SEQ ID NO: 1972937 - RNA, 21 nt, Shigella flexneri 2a str. 301
uugcgcacaucaauuugccca

SEQ ID NO: 1972938 - RNA, 14 nt, Shigella flexneri 2a str. 301
uugcgcaugacaca

SEQ ID NO: 1972939 - RNA, 16 nt, Shigella flexneri 2a str. 301
uugcgcauggcauuuu

SEQ ID NO: 1972940 - RNA, 15 nt, Shigella flexneri 2a str. 301
uugcuaucgggaaua

SEQ ID NO: 1972941 - RNA, 19 nt, Shigella flexneri 2a str. 301
uugcuaucgcgaaucccua

SEQ ID NO: 1972942 - RNA, 23 nt, Shigella flexneri 2a str. 301
uugcuaccccugagacaguuauu

SEQ ID NO: 1972943 - RNA, 19 nt, Shigella flexneri 2a str. 301
uugcuaacuggaaaggaau

SEQ ID NO: 1972944 - RNA, 19 nt, Shigella flexneri 2a str. 301
uugcuaaccaacaaugcaa

SEQ ID NO: 1972945 - RNA, 12 nt, Shigella flexneri 2a str. 301
uugcguaacuga

SEQ ID NO: 1972946 - RNA, 15 nt, Shigella flexneri 2a str. 301
uugcgguuucaacug

SEQ ID NO: 1972947 - RNA, 19 nt, Shigella flexneri 2a str. 301
uugcgguaagcugaugacg

SEQ ID NO: 1972948 - RNA, 20 nt, Shigella flexneri 2a str. 301
uugcugcgcccgcagcggcg

SEQ ID NO: 1972949 - RNA, 20 nt, Shigella flexneri 2a str. 301
uugcugcgccccacaccacc

SEQ ID NO: 1972950 - RNA, 16 nt, Shigella flexneri 2a str. 301
uugcucucgggcagua

SEQ ID NO: 1972951 - RNA, 13 nt, Shigella flexneri 2a str. 301
uugcuccauccau

SEQ ID NO: 1972952 - RNA, 16 nt, Shigella flexneri 2a str. 301
uugcuccugcucauca

SEQ ID NO: 1972953 - RNA, 11 nt, Shigella flexneri 2a str. 301
uugcucgcacu

SEQ ID NO: 1972954 - RNA, 22 nt, Shigella flexneri 2a str. 301
uugccguuaaaacuaaaaacag

SEQ ID NO: 1972955 - RNA, 13 nt, Shigella flexneri 2a str. 301
uugccguugaucu

SEQ ID NO: 1972956 - RNA, 19 nt, Shigella flexneri 2a str. 301
uugccguccggcaucgcaa

SEQ ID NO: 1972957 - RNA, 16 nt, Shigella flexneri 2a str. 301
uugccguauacacacu

SEQ ID NO: 1972958 - RNA, 18 nt, Shigella flexneri 2a str. 301
uugccgggcgugcugccg

SEQ ID NO: 1972959 - RNA, 18 nt, Shigella flexneri 2a str. 301
uugccagugaaaguuuuc

SEQ ID NO: 1972960 - RNA, 20 nt, Shigella flexneri 2a str. 301
uugccaucaaucacuuugcg

SEQ ID NO: 1972961 - RNA, 24 nt, Shigella flexneri 2a str. 301
uugccaugcaauauuguagcaacu

SEQ ID NO: 1972962 - RNA, 22 nt, Shigella flexneri 2a str. 301
uugcauaaugguggaguggccc

SEQ ID NO: 1972963 - RNA, 12 nt, Shigella flexneri 2a str. 301
uugcaggaucag

SEQ ID NO: 1972964 - RNA, 23 nt, Shigella flexneri 2a str. 301
uugcaggcgauccuguucaaaca

SEQ ID NO: 1972965 - RNA, 12 nt, Shigella flexneri 2a str. 301
uugcaggcuauu

SEQ ID NO: 1972966 - RNA, 14 nt, Shigella flexneri 2a str. 301
uugcaggaaaaacu

SEQ ID NO: 1972967 - RNA, 19 nt, Shigella flexneri 2a str. 301
uugcaggaaaaacugcccg

SEQ ID NO: 1972968 - RNA, 14 nt, Shigella flexneri 2a str. 301
uugcagguucugcu

SEQ ID NO: 1972969 - RNA, 12 nt, Shigella flexneri 2a str. 301
uugccagcgcca

SEQ ID NO: 1972970 - RNA, 20 nt, Shigella flexneri 2a str. 301
uugccagaucgccugccgcc

SEQ ID NO: 1972971 - RNA, 15 nt, Shigella flexneri 2a str. 301
uugccagauaaacau

SEQ ID NO: 1972972 - RNA, 10 nt, Shigella flexneri 2a str. 301
uugccaggac

SEQ ID NO: 1972973 - RNA, 23 nt, Shigella flexneri 2a str. 301
uugccaccgguacaaacaucauc

SEQ ID NO: 1972974 - RNA, 14 nt, Shigella flexneri 2a str. 301
uugccacugccggu

SEQ ID NO: 1972975 - RNA, 16 nt, Shigella flexneri 2a str. 301
uuggauaggcaccgcc

SEQ ID NO: 1972976 - RNA, 18 nt, Shigella flexneri 2a str. 301
uuggaucuguugcuggcu

SEQ ID NO: 1972977 - RNA, 14 nt, Shigella flexneri 2a str. 301
uuggcaaauacaaa

SEQ ID NO: 1972978 - RNA, 16 nt, Shigella flexneri 2a str. 301
uuggcaaucagcggca

SEQ ID NO: 1972979 - RNA, 17 nt, Shigella flexneri 2a str. 301
uuggcacagaagucacc

SEQ ID NO: 1972980 - RNA, 21 nt, Shigella flexneri 2a str. 301
uuggcaaagugccgaacguac

SEQ ID NO: 1972981 - RNA, 15 nt, Shigella flexneri 2a str. 301
uugcugcugaagcaa

SEQ ID NO: 1972982 - RNA, 20 nt, Shigella flexneri 2a str. 301
uugcuggauaagaugcuaca

SEQ ID NO: 1972983 - RNA, 21 nt, Shigella flexneri 2a str. 301
uugcuggacgcauugcauuuc

SEQ ID NO: 1972984 - RNA, 14 nt, Shigella flexneri 2a str. 301
uugcuucaccagca

SEQ ID NO: 1972985 - RNA, 12 nt, Shigella flexneri 2a str. 301
uugcuucucuug

SEQ ID NO: 1972986 - RNA, 12 nt, Shigella flexneri 2a str. 301
uugcuucugcuu

SEQ ID NO: 1972987 - RNA, 18 nt, Shigella flexneri 2a str. 301
uugcuucaagaugccauu

SEQ ID NO: 1972988 - RNA, 23 nt, Shigella flexneri 2a str. 301
uugcuucaauacgcuccaguacc

SEQ ID NO: 1972989 - RNA, 14 nt, Shigella flexneri 2a str. 301
uugcugguuuugua

SEQ ID NO: 1972990 - RNA, 20 nt, Shigella flexneri 2a str. 301
uugcuguaucacuaugaaaa

SEQ ID NO: 1972991 - RNA, 20 nt, Shigella flexneri 2a str. 301
uuggggcauauuaucagcaa

SEQ ID NO: 1972992 - RNA, 19 nt, Shigella flexneri 2a str. 301
uuggggauuaucugaauca

SEQ ID NO: 1972993 - RNA, 16 nt, Shigella flexneri 2a str. 301
uuggccugacagguga

SEQ ID NO: 1972994 - RNA, 16 nt, Shigella flexneri 2a str. 301
uugguuucgaggaucc

SEQ ID NO: 1972995 - RNA, 21 nt, Shigella flexneri 2a str. 301
uuggugauaaaacgcagucuu

SEQ ID NO: 1972996 - RNA, 13 nt, Shigella flexneri 2a str. 301
uuggguauucauu

SEQ ID NO: 1972997 - RNA, 16 nt, Shigella flexneri 2a str. 301
uugggucgugauuaca

SEQ ID NO: 1972998 - RNA, 18 nt, Shigella flexneri 2a str. 301
uugguaaaugcgaauagc

SEQ ID NO: 1972999 - RNA, 15 nt, Shigella flexneri 2a str. 301
uugggugacaaucac

SEQ ID NO: 1973000 - RNA, 16 nt, Shigella flexneri 2a str. 301
uugguccuggucugau

SEQ ID NO: 1973001 - RNA, 14 nt, Shigella flexneri 2a str. 301
uuuaacuuuaauuu

SEQ ID NO: 1973002 - RNA, 22 nt, Shigella flexneri 2a str. 301
uuuaacuucgcguucuguggca

SEQ ID NO: 1973003 - RNA, 17 nt, Shigella flexneri 2a str. 301
uuuaagaauugauggua

SEQ ID NO: 1973004 - RNA, 20 nt, Shigella flexneri 2a str. 301
uuuaaagagacagaaucagg

SEQ ID NO: 1973005 - RNA, 19 nt, Shigella flexneri 2a str. 301
uuuaaacagagauuacuuu

SEQ ID NO: 1973006 - RNA, 22 nt, Shigella flexneri 2a str. 301
uuuaaacaucaaaccacuuaau

SEQ ID NO: 1973007 - RNA, 23 nt, Shigella flexneri 2a str. 301
uuuaaacaucaaaccacuuaauu

SEQ ID NO: 1973008 - RNA, 20 nt, Shigella flexneri 2a str. 301
uuuaauauccggugcauuca

SEQ ID NO: 1973009 - RNA, 19 nt, Shigella flexneri 2a str. 301
uuuaagcuggguaaaugca

SEQ ID NO: 1973010 - RNA, 16 nt, Shigella flexneri 2a str. 301
uuuaaugccaaucuuc

SEQ ID NO: 1973011 - RNA, 16 nt, Shigella flexneri 2a str. 301
uuuaauauuaaaccac

SEQ ID NO: 1973012 - RNA, 13 nt, Shigella flexneri 2a str. 301
uuuaaucacacca

SEQ ID NO: 1973013 - RNA, 12 nt, Shigella flexneri 2a str. 301
uuuaauuuuuca

SEQ ID NO: 1973014 - RNA, 15 nt, Shigella flexneri 2a str. 301
uuuacaagcaacuug

SEQ ID NO: 1973015 - RNA, 11 nt, Shigella flexneri 2a str. 301
uuuacccuucg

SEQ ID NO: 1973016 - RNA, 21 nt, Shigella flexneri 2a str. 301
uuuacccgguuaaguaaaauc

SEQ ID NO: 1973017 - RNA, 16 nt, Shigella flexneri 2a str. 301
uuuacccaauccccca

SEQ ID NO: 1973018 - RNA, 21 nt, Shigella flexneri 2a str. 301
uuuaccaccgucaaaaaaacg

SEQ ID NO: 1973019 - RNA, 18 nt, Shigella flexneri 2a str. 301
uuuaccaccgucaaaaaa

SEQ ID NO: 1973020 - RNA, 14 nt, Shigella flexneri 2a str. 301
uuguaaagcgccaa

SEQ ID NO: 1973021 - RNA, 14 nt, Shigella flexneri 2a str. 301
uuguaaauuuccca

SEQ ID NO: 1973022 - RNA, 23 nt, Shigella flexneri 2a str. 301
uuguaugucacaggccuuuugcg

SEQ ID NO: 1973023 - RNA, 23 nt, Shigella flexneri 2a str. 301
uuguaggcggauaaggcguuuuc

SEQ ID NO: 1973024 - RNA, 18 nt, Shigella flexneri 2a str. 301
uugucaacgacguaccaa

SEQ ID NO: 1973025 - RNA, 12 nt, Shigella flexneri 2a str. 301
uugucaauaauc

SEQ ID NO: 1973026 - RNA, 14 nt, Shigella flexneri 2a str. 301
uugucuguuugccu

SEQ ID NO: 1973027 - RNA, 12 nt, Shigella flexneri 2a str. 301
uugucugaaucc

SEQ ID NO: 1973028 - RNA, 13 nt, Shigella flexneri 2a str. 301
uugucugaaucca

SEQ ID NO: 1973029 - RNA, 19 nt, Shigella flexneri 2a str. 301
uugucugaauccaucugua

SEQ ID NO: 1973030 - RNA, 11 nt, Shigella flexneri 2a str. 301
uugucuucaau

SEQ ID NO: 1973031 - RNA, 21 nt, Shigella flexneri 2a str. 301
uugucuucaagaucagcggca

SEQ ID NO: 1973032 - RNA, 16 nt, Shigella flexneri 2a str. 301
uugucuuuccagacuc

SEQ ID NO: 1973033 - RNA, 18 nt, Shigella flexneri 2a str. 301
uugucuuuuuaaugacuu

SEQ ID NO: 1973034 - RNA, 17 nt, Shigella flexneri 2a str. 301
uuguguaaguuuaaccu

SEQ ID NO: 1973035 - RNA, 20 nt, Shigella flexneri 2a str. 301
uugugaacgagaaaaugacg

SEQ ID NO: 1973036 - RNA, 15 nt, Shigella flexneri 2a str. 301
uugugacuuugugaa

SEQ ID NO: 1973037 - RNA, 20 nt, Shigella flexneri 2a str. 301
uuguugcgcuaagccugcug

SEQ ID NO: 1973038 - RNA, 19 nt, Shigella flexneri 2a str. 301
uuguuuagauccauaucca

SEQ ID NO: 1973039 - RNA, 23 nt, Shigella flexneri 2a str. 301
uuguuucuucgauggcuggggua

SEQ ID NO: 1973040 - RNA, 23 nt, Shigella flexneri 2a str. 301
uuguuucggugaauucagcgacu

SEQ ID NO: 1973041 - RNA, 15 nt, Shigella flexneri 2a str. 301
uuguuuccauaugua

SEQ ID NO: 1973042 - RNA, 15 nt, Shigella flexneri 2a str. 301
uuguugcaggaacag

SEQ ID NO: 1973043 - RNA, 14 nt, Shigella flexneri 2a str. 301
uuguugauaaggaa

SEQ ID NO: 1973044 - RNA, 14 nt, Shigella flexneri 2a str. 301
uuguucaggcucca

SEQ ID NO: 1973045 - RNA, 20 nt, Shigella flexneri 2a str. 301
uugaagaacugcuugcccag

SEQ ID NO: 1973046 - RNA, 16 nt, Shigella flexneri 2a str. 301
uugagaacgacaguga

SEQ ID NO: 1973047 - RNA, 21 nt, Shigella flexneri 2a str. 301
uugacgcgucuuaucaggccu

SEQ ID NO: 1973048 - RNA, 15 nt, Shigella flexneri 2a str. 301
uugacgccaaggagu

SEQ ID NO: 1973049 - RNA, 16 nt, Shigella flexneri 2a str. 301
uugacgcccccaaacu

SEQ ID NO: 1973050 - RNA, 22 nt, Shigella flexneri 2a str. 301
uugacgagauagcgaaguagac

SEQ ID NO: 1973051 - RNA, 18 nt, Shigella flexneri 2a str. 301
uugaauuuggaagaauuu

SEQ ID NO: 1973052 - RNA, 14 nt, Shigella flexneri 2a str. 301
uugaauuuauguuu

SEQ ID NO: 1973053 - RNA, 19 nt, Shigella flexneri 2a str. 301
uugaauuuauguuuccuua

SEQ ID NO: 1973054 - RNA, 23 nt, Shigella flexneri 2a str. 301
uugaaacgaaaucuuguuuuuuu

SEQ ID NO: 1973055 - RNA, 23 nt, Shigella flexneri 2a str. 301
uugaaacgaguggugucgucaaa

SEQ ID NO: 1973056 - RNA, 11 nt, Shigella flexneri 2a str. 301
uucuuuuucau

SEQ ID NO: 1973057 - RNA, 21 nt, Shigella flexneri 2a str. 301
uucuuugagcuucgccuggac

SEQ ID NO: 1973058 - RNA, 21 nt, Shigella flexneri 2a str. 301
uucuuugcugccguuaacccg

SEQ ID NO: 1973059 - RNA, 14 nt, Shigella flexneri 2a str. 301
uucuugccuuuccu

SEQ ID NO: 1973060 - RNA, 13 nt, Shigella flexneri 2a str. 301
uugauaaaaaaaa

SEQ ID NO: 1973061 - RNA, 12 nt, Shigella flexneri 2a str. 301
uugauaaaaaaa

SEQ ID NO: 1973062 - RNA, 19 nt, Shigella flexneri 2a str. 301
uugaguuuuucaucccucu

SEQ ID NO: 1973063 - RNA, 16 nt, Shigella flexneri 2a str. 301
uugaucgccaaagaaa

SEQ ID NO: 1973064 - RNA, 19 nt, Shigella flexneri 2a str. 301
uugaucaaauacuucaaua

SEQ ID NO: 1973065 - RNA, 19 nt, Shigella flexneri 2a str. 301
uugaguggcgcaucuucau

SEQ ID NO: 1973066 - RNA, 16 nt, Shigella flexneri 2a str. 301
uugaguauuuaccaga

SEQ ID NO: 1973067 - RNA, 18 nt, Shigella flexneri 2a str. 301
uugagcuggucugaauca

SEQ ID NO: 1973068 - RNA, 22 nt, Shigella flexneri 2a str. 301
uugaguaagcaggguugcagcc

SEQ ID NO: 1973069 - RNA, 14 nt, Shigella flexneri 2a str. 301
uugagcuugaacau

SEQ ID NO: 1973070 - RNA, 15 nt, Shigella flexneri 2a str. 301
uugagcaucugcaaa

SEQ ID NO: 1973071 - RNA, 15 nt, Shigella flexneri 2a str. 301
uugagcauugccgcc

SEQ ID NO: 1973072 - RNA, 15 nt, Shigella flexneri 2a str. 301
uugagaauaaccucu

SEQ ID NO: 1973073 - RNA, 20 nt, Shigella flexneri 2a str. 301
uugagccaaaaugccugaug

SEQ ID NO: 1973074 - RNA, 16 nt, Shigella flexneri 2a str. 301
uugauucuguucagua

SEQ ID NO: 1973075 - RNA, 14 nt, Shigella flexneri 2a str. 301
uugaugccguucca

SEQ ID NO: 1973076 - RNA, 15 nt, Shigella flexneri 2a str. 301
uugaugcauuuuuua

SEQ ID NO: 1973077 - RNA, 14 nt, Shigella flexneri 2a str. 301
uugaugcacaccau

SEQ ID NO: 1973078 - RNA, 21 nt, Shigella flexneri 2a str. 301
uugaugcacugggagaacgcu

SEQ ID NO: 1973079 - RNA, 20 nt, Shigella flexneri 2a str. 301
uugaugaguugaaaaccucu

SEQ ID NO: 1973080 - RNA, 19 nt, Shigella flexneri 2a str. 301
uugaugaaaaaaccagaaa

SEQ ID NO: 1973081 - RNA, 17 nt, Shigella flexneri 2a str. 301
uugaugaaaaaaccaga

SEQ ID NO: 1973082 - RNA, 13 nt, Shigella flexneri 2a str. 301
uugaucucaaacg

SEQ ID NO: 1973083 - RNA, 22 nt, Shigella flexneri 2a str. 301
uugcaauacaccuccggcuggg

SEQ ID NO: 1973084 - RNA, 18 nt, Shigella flexneri 2a str. 301
uugcaaucagauaaaaua

SEQ ID NO: 1973085 - RNA, 19 nt, Shigella flexneri 2a str. 301
uugcaagccuguaguacaa

SEQ ID NO: 1973086 - RNA, 23 nt, Shigella flexneri 2a str. 301
uugcaagaucgcucaucagcucc

SEQ ID NO: 1973087 - RNA, 18 nt, Shigella flexneri 2a str. 301
uugauuuuuuugauaaac

SEQ ID NO: 1973088 - RNA, 12 nt, Shigella flexneri 2a str. 301
uugauuuuauug

SEQ ID NO: 1973089 - RNA, 16 nt, Shigella flexneri 2a str. 301
uugauuuucgaaaaaa

SEQ ID NO: 1973090 - RNA, 17 nt, Shigella flexneri 2a str. 301
uugauuuucgaaaaaaa

SEQ ID NO: 1973091 - RNA, 12 nt, Shigella flexneri 2a str. 301
uucuggcugcca

SEQ ID NO: 1973092 - RNA, 19 nt, Shigella flexneri 2a str. 301
uucuggcgcgaacagcaca

SEQ ID NO: 1973093 - RNA, 12 nt, Shigella flexneri 2a str. 301
uucugguuuuuc

SEQ ID NO: 1973094 - RNA, 21 nt, Shigella flexneri 2a str. 301
uucuggucaugaaccugccgc

SEQ ID NO: 1973095 - RNA, 22 nt, Shigella flexneri 2a str. 301
uucuggcaccggacgcuuguca

SEQ ID NO: 1973096 - RNA, 18 nt, Shigella flexneri 2a str. 301
uucugcuuuggcugccgc

SEQ ID NO: 1973097 - RNA, 19 nt, Shigella flexneri 2a str. 301
uucuggaaguaaucacgaa

SEQ ID NO: 1973098 - RNA, 15 nt, Shigella flexneri 2a str. 301
uucugcuucugccag

SEQ ID NO: 1973099 - RNA, 14 nt, Shigella flexneri 2a str. 301
uucugcugccuaca

SEQ ID NO: 1973100 - RNA, 14 nt, Shigella flexneri 2a str. 301
uucugagcaucaca

SEQ ID NO: 1973101 - RNA, 12 nt, Shigella flexneri 2a str. 301
uucugacucagg

SEQ ID NO: 1973102 - RNA, 21 nt, Shigella flexneri 2a str. 301
uucugagagcaugaaaugaaa

SEQ ID NO: 1973103 - RNA, 18 nt, Shigella flexneri 2a str. 301
uucucgcuucugagcugg

SEQ ID NO: 1973104 - RNA, 19 nt, Shigella flexneri 2a str. 301
uucucggcaucacgcuuga

SEQ ID NO: 1973105 - RNA, 18 nt, Shigella flexneri 2a str. 301
uucucgcgaaccgccugg

SEQ ID NO: 1973106 - RNA, 18 nt, Shigella flexneri 2a str. 301
uucucgccguggcuguug

SEQ ID NO: 1973107 - RNA, 18 nt, Shigella flexneri 2a str. 301
uucucgcggacugccugg

SEQ ID NO: 1973108 - RNA, 13 nt, Shigella flexneri 2a str. 301
uucucgccaccgg

SEQ ID NO: 1973109 - RNA, 17 nt, Shigella flexneri 2a str. 301
uucucgauaaaaccuuc

SEQ ID NO: 1973110 - RNA, 16 nt, Shigella flexneri 2a str. 301
uucugaacugaacaaa

SEQ ID NO: 1973111 - RNA, 22 nt, Shigella flexneri 2a str. 301
uucugaaggauuagccggauau

SEQ ID NO: 1973112 - RNA, 12 nt, Shigella flexneri 2a str. 301
uucuucacugac

SEQ ID NO: 1973113 - RNA, 15 nt, Shigella flexneri 2a str. 301
uucuucagcagccca

SEQ ID NO: 1973114 - RNA, 22 nt, Shigella flexneri 2a str. 301
uucuucagcguccgggaaaucc

SEQ ID NO: 1973115 - RNA, 21 nt, Shigella flexneri 2a str. 301
uucuucauucccggaaauugc

SEQ ID NO: 1973116 - RNA, 20 nt, Shigella flexneri 2a str. 301
uucuuccucgucccaaaagc

SEQ ID NO: 1973117 - RNA, 11 nt, Shigella flexneri 2a str. 301
uucuuccagca

SEQ ID NO: 1973118 - RNA, 20 nt, Shigella flexneri 2a str. 301
uucuucaacaccacuuuugc

SEQ ID NO: 1973119 - RNA, 17 nt, Shigella flexneri 2a str. 301
uucuucaagccaggcuu

SEQ ID NO: 1973120 - RNA, 18 nt, Shigella flexneri 2a str. 301
uucuucacggaaaauauu

SEQ ID NO: 1973121 - RNA, 23 nt, Shigella flexneri 2a str. 301
uucuucaaguguggccgccagug

SEQ ID NO: 1973122 - RNA, 19 nt, Shigella flexneri 2a str. 301
uucuuaccccugauuuugu

SEQ ID NO: 1973123 - RNA, 17 nt, Shigella flexneri 2a str. 301
uucuuacgccgacuaau

SEQ ID NO: 1973124 - RNA, 16 nt, Shigella flexneri 2a str. 301
uucuuacuguagugcu

SEQ ID NO: 1973125 - RNA, 15 nt, Shigella flexneri 2a str. 301
uucucagcaguuuuu

SEQ ID NO: 1973126 - RNA, 22 nt, Shigella flexneri 2a str. 301
uucucagagacucuuaaaauau

SEQ ID NO: 1973127 - RNA, 20 nt, Shigella flexneri 2a str. 301
uucucagguagcgcauaagc

SEQ ID NO: 1973128 - RNA, 12 nt, Shigella flexneri 2a str. 301
uucucauaaaac

SEQ ID NO: 1973129 - RNA, 16 nt, Shigella flexneri 2a str. 301
uucuccucccuugucu

SEQ ID NO: 1973130 - RNA, 19 nt, Shigella flexneri 2a str. 301
uucuccacaccguugccgc

SEQ ID NO: 1973131 - RNA, 14 nt, Shigella flexneri 2a str. 301
uucuccaaauacau

SEQ ID NO: 1973132 - RNA, 18 nt, Shigella flexneri 2a str. 301
uucuccucgcuccauacu

SEQ ID NO: 1973133 - RNA, 16 nt, Shigella flexneri 2a str. 301
uucuaacucauuuuuu

SEQ ID NO: 1973134 - RNA, 20 nt, Shigella flexneri 2a str. 301
uucggcauacauaaucaaua

SEQ ID NO: 1973135 - RNA, 15 nt, Shigella flexneri 2a str. 301
uucggcagugccagu

SEQ ID NO: 1973136 - RNA, 15 nt, Shigella flexneri 2a str. 301
uucgguucaaguccc

SEQ ID NO: 1973137 - RNA, 15 nt, Shigella flexneri 2a str. 301
uucgguugccagcgc

SEQ ID NO: 1973138 - RNA, 22 nt, Shigella flexneri 2a str. 301
uucgguguuuuuacgaaacaga

SEQ ID NO: 1973139 - RNA, 23 nt, Shigella flexneri 2a str. 301
uucggugugcagcguacuucaug

SEQ ID NO: 1973140 - RNA, 23 nt, Shigella flexneri 2a str. 301
uucguaaacgacugauugaacug

SEQ ID NO: 1973141 - RNA, 17 nt, Shigella flexneri 2a str. 301
uucguaaguacauuaaa

SEQ ID NO: 1973142 - RNA, 19 nt, Shigella flexneri 2a str. 301
uucguaaguacauuaaaau

SEQ ID NO: 1973143 - RNA, 13 nt, Shigella flexneri 2a str. 301
uucgugagcguuu

SEQ ID NO: 1973144 - RNA, 17 nt, Shigella flexneri 2a str. 301
uucuaaauguucaauaa

SEQ ID NO: 1973145 - RNA, 23 nt, Shigella flexneri 2a str. 301
uucuaacgacauuuucugcccau

SEQ ID NO: 1973146 - RNA, 23 nt, Shigella flexneri 2a str. 301
uucguuagguucucucagucuuu

SEQ ID NO: 1973147 - RNA, 19 nt, Shigella flexneri 2a str. 301
gagucgccugcucuaacca

SEQ ID NO: 1973148 - RNA, 19 nt, Shigella flexneri 2a str. 301
gagugccgaagaacauaaa

SEQ ID NO: 1973149 - RNA, 21 nt, Shigella flexneri 2a str. 301
gagugcguucaccgaagacgu

SEQ ID NO: 1973150 - RNA, 17 nt, Shigella flexneri 2a str. 301
gagugccgaagaacaua

SEQ ID NO: 1973151 - RNA, 17 nt, Shigella flexneri 2a str. 301
gagugcagcaugcaccc

SEQ ID NO: 1973152 - RNA, 12 nt, Shigella flexneri 2a str. 301
gaguaucugcug

SEQ ID NO: 1973153 - RNA, 19 nt, Shigella flexneri 2a str. 301
gagucacaaacaucaugcc

SEQ ID NO: 1973154 - RNA, 14 nt, Shigella flexneri 2a str. 301
gagucacaaacauc

SEQ ID NO: 1973155 - RNA, 18 nt, Shigella flexneri 2a str. 301
gagucacucgacagcacc

SEQ ID NO: 1973156 - RNA, 21 nt, Shigella flexneri 2a str. 301
gagucaagggugucggcacac

SEQ ID NO: 1973157 - RNA, 20 nt, Shigella flexneri 2a str. 301
gagucacuuuacgaccagcc

SEQ ID NO: 1973158 - RNA, 20 nt, Shigella flexneri 2a str. 301
gaauuucaucaucacgaaau

SEQ ID NO: 1973159 - RNA, 16 nt, Shigella flexneri 2a str. 301
gaauuucgccuuucug

SEQ ID NO: 1973160 - RNA, 18 nt, Shigella flexneri 2a str. 301
gaauuucucgugccacca

SEQ ID NO: 1973161 - RNA, 13 nt, Shigella flexneri 2a str. 301
gaauuugcaugac

SEQ ID NO: 1973162 - RNA, 16 nt, Shigella flexneri 2a str. 301
gaguucaggcgcugca

SEQ ID NO: 1973163 - RNA, 15 nt, Shigella flexneri 2a str. 301
gaguucauuaagcug

SEQ ID NO: 1973164 - RNA, 19 nt, Shigella flexneri 2a str. 301
gaguucccggcagggaagc

SEQ ID NO: 1973165 - RNA, 12 nt, Shigella flexneri 2a str. 301
gauaaaaaaccc

SEQ ID NO: 1973166 - RNA, 14 nt, Shigella flexneri 2a str. 301
gauaaaacgacacc

SEQ ID NO: 1973167 - RNA, 21 nt, Shigella flexneri 2a str. 301
gauaaaacgcagucuucccag

SEQ ID NO: 1973168 - RNA, 21 nt, Shigella flexneri 2a str. 301
gauaaaacucucaucuuugaa

SEQ ID NO: 1973169 - RNA, 19 nt, Shigella flexneri 2a str. 301
gauaaaagccaucccugua

SEQ ID NO: 1973170 - RNA, 14 nt, Shigella flexneri 2a str. 301
gauaaaacuucccg

SEQ ID NO: 1973171 - RNA, 12 nt, Shigella flexneri 2a str. 301
gauaaaaaugaa

SEQ ID NO: 1973172 - RNA, 21 nt, Shigella flexneri 2a str. 301
gauaaaaauaccgagcagcca

SEQ ID NO: 1973173 - RNA, 21 nt, Shigella flexneri 2a str. 301
gauaaaaucccauaagugcgu

SEQ ID NO: 1973174 - RNA, 21 nt, Shigella flexneri 2a str. 301
gauaaagcccccgcaacauug

SEQ ID NO: 1973175 - RNA, 12 nt, Shigella flexneri 2a str. 301
gauaaaggucga

SEQ ID NO: 1973176 - RNA, 21 nt, Shigella flexneri 2a str. 301
gauacugcccaccgacgcagu

SEQ ID NO: 1973177 - RNA, 15 nt, Shigella flexneri 2a str. 301
gauacugaauguaug

SEQ ID NO: 1973178 - RNA, 13 nt, Shigella flexneri 2a str. 301
gauacucugccau

SEQ ID NO: 1973179 - RNA, 21 nt, Shigella flexneri 2a str. 301
gauacgcuugccggacaugcu

SEQ ID NO: 1973180 - RNA, 16 nt, Shigella flexneri 2a str. 301
gauagauauucuccag

SEQ ID NO: 1973181 - RNA, 22 nt, Shigella flexneri 2a str. 301
gauagauuuauuuauuauuaaa

SEQ ID NO: 1973182 - RNA, 15 nt, Shigella flexneri 2a str. 301
gauacagccaaauca

SEQ ID NO: 1973183 - RNA, 19 nt, Shigella flexneri 2a str. 301
gauacagccaaaucaucag

SEQ ID NO: 1973184 - RNA, 17 nt, Shigella flexneri 2a str. 301
gauacagcucaugggcu

SEQ ID NO: 1973185 - RNA, 15 nt, Shigella flexneri 2a str. 301
gauacaguuuuugcg

SEQ ID NO: 1973186 - RNA, 14 nt, Shigella flexneri 2a str. 301
gauacaguuuuugc

SEQ ID NO: 1973187 - RNA, 19 nt, Shigella flexneri 2a str. 301
gauacaucgcauaaaacaa

SEQ ID NO: 1973188 - RNA, 13 nt, Shigella flexneri 2a str. 301
gauacccaucauc

SEQ ID NO: 1973189 - RNA, 18 nt, Shigella flexneri 2a str. 301
gauaaugcccgaugaccu

SEQ ID NO: 1973190 - RNA, 18 nt, Shigella flexneri 2a str. 301
gauaauccaucacuucau

SEQ ID NO: 1973191 - RNA, 18 nt, Shigella flexneri 2a str. 301
gauaauccaggacauauc

SEQ ID NO: 1973192 - RNA, 12 nt, Shigella flexneri 2a str. 301
gauaauccacgc

SEQ ID NO: 1973193 - RNA, 20 nt, Shigella flexneri 2a str. 301
gauaauuagugcugcuggaa

SEQ ID NO: 1973194 - RNA, 17 nt, Shigella flexneri 2a str. 301
gauaauuaaucuuucua

SEQ ID NO: 1973195 - RNA, 15 nt, Shigella flexneri 2a str. 301
gauaauuauuauaau

SEQ ID NO: 1973196 - RNA, 16 nt, Shigella flexneri 2a str. 301
gauaacguuauauccc

SEQ ID NO: 1973197 - RNA, 14 nt, Shigella flexneri 2a str. 301
gauaacguuccggg

SEQ ID NO: 1973198 - RNA, 22 nt, Shigella flexneri 2a str. 301
gauaacguacugggcggcaaaa

SEQ ID NO: 1973199 - RNA, 22 nt, Shigella flexneri 2a str. 301
gauaacgccuagaaaucauuca

SEQ ID NO: 1973200 - RNA, 16 nt, Shigella flexneri 2a str. 301
gauaacgcggcagcag

SEQ ID NO: 1973201 - RNA, 21 nt, Shigella flexneri 2a str. 301
gauaaccuucuucauuaugaa

SEQ ID NO: 1973202 - RNA, 18 nt, Shigella flexneri 2a str. 301
gauaaauaacuuuuaucu

SEQ ID NO: 1973203 - RNA, 16 nt, Shigella flexneri 2a str. 301
gauaaucaacaaacca

SEQ ID NO: 1973204 - RNA, 23 nt, Shigella flexneri 2a str. 301
gauaaucaucccacaugaauucg

SEQ ID NO: 1973205 - RNA, 18 nt, Shigella flexneri 2a str. 301
gaucaacagcaucaucgc

SEQ ID NO: 1973206 - RNA, 16 nt, Shigella flexneri 2a str. 301
gauauuuauuuccuuc

SEQ ID NO: 1973207 - RNA, 14 nt, Shigella flexneri 2a str. 301
gaucaaaucucgcc

SEQ ID NO: 1973208 - RNA, 21 nt, Shigella flexneri 2a str. 301
gaucaaccaccgucgucccuu

SEQ ID NO: 1973209 - RNA, 17 nt, Shigella flexneri 2a str. 301
gaucaacuuuguucuga

SEQ ID NO: 1973210 - RNA, 23 nt, Shigella flexneri 2a str. 301
gaucaaccgcuacauacuuaaau

SEQ ID NO: 1973211 - RNA, 20 nt, Shigella flexneri 2a str. 301
gaucaagcaacauaaccuga

SEQ ID NO: 1973212 - RNA, 13 nt, Shigella flexneri 2a str. 301
gaucagcauuucg

SEQ ID NO: 1973213 - RNA, 20 nt, Shigella flexneri 2a str. 301
gaucagcauccauaucgcca

SEQ ID NO: 1973214 - RNA, 16 nt, Shigella flexneri 2a str. 301
gaucagcggacgcugc

SEQ ID NO: 1973215 - RNA, 21 nt, Shigella flexneri 2a str. 301
gaucagcgaagcgugauuguu

SEQ ID NO: 1973216 - RNA, 18 nt, Shigella flexneri 2a str. 301
gaucauuauuaaacagac

SEQ ID NO: 1973217 - RNA, 14 nt, Shigella flexneri 2a str. 301
gaucaugugcagga

SEQ ID NO: 1973218 - RNA, 18 nt, Shigella flexneri 2a str. 301
gaucagcgguuuugccag

SEQ ID NO: 1973219 - RNA, 13 nt, Shigella flexneri 2a str. 301
gaucagcgguggu

SEQ ID NO: 1973220 - RNA, 15 nt, Shigella flexneri 2a str. 301
gaucagcggugguga

SEQ ID NO: 1973221 - RNA, 13 nt, Shigella flexneri 2a str. 301
gaucagcgguuuu

SEQ ID NO: 1973222 - RNA, 13 nt, Shigella flexneri 2a str. 301
gaucaggcaaacg

SEQ ID NO: 1973223 - RNA, 15 nt, Shigella flexneri 2a str. 301
gauagcaucuuccag

SEQ ID NO: 1973224 - RNA, 21 nt, Shigella flexneri 2a str. 301
gauaucauuaaaguuaucgcc

SEQ ID NO: 1973225 - RNA, 13 nt, Shigella flexneri 2a str. 301
gauaucaccacca

SEQ ID NO: 1973226 - RNA, 14 nt, Shigella flexneri 2a str. 301
gauaucaccaccaa

SEQ ID NO: 1973227 - RNA, 16 nt, Shigella flexneri 2a str. 301
gauaucccgccagcac

SEQ ID NO: 1973228 - RNA, 15 nt, Shigella flexneri 2a str. 301
gauauccgccaggcu

SEQ ID NO: 1973229 - RNA, 23 nt, Shigella flexneri 2a str. 301
gauaucuucccgccguugccgca

SEQ ID NO: 1973230 - RNA, 15 nt, Shigella flexneri 2a str. 301
gauaucugcccgcac

SEQ ID NO: 1973231 - RNA, 13 nt, Shigella flexneri 2a str. 301
gauaucgcuggca

SEQ ID NO: 1973232 - RNA, 17 nt, Shigella flexneri 2a str. 301
gauaucgauguccugac

SEQ ID NO: 1973233 - RNA, 19 nt, Shigella flexneri 2a str. 301
gauauggcgagaagagagg

SEQ ID NO: 1973234 - RNA, 14 nt, Shigella flexneri 2a str. 301
gauaugcagcagcc

SEQ ID NO: 1973235 - RNA, 16 nt, Shigella flexneri 2a str. 301
gauaugcgagcaccug

SEQ ID NO: 1973236 - RNA, 17 nt, Shigella flexneri 2a str. 301
gauaugcaucaugaaaa

SEQ ID NO: 1973237 - RNA, 23 nt, Shigella flexneri 2a str. 301
gauauguucaggauauuuauauu

SEQ ID NO: 1973238 - RNA, 15 nt, Shigella flexneri 2a str. 301
gauauguugugggag

SEQ ID NO: 1973239 - RNA, 20 nt, Shigella flexneri 2a str. 301
gauauugauucaucucuucu

SEQ ID NO: 1973240 - RNA, 21 nt, Shigella flexneri 2a str. 301
gauauugauucaucucuucuu

SEQ ID NO: 1973241 - RNA, 15 nt, Shigella flexneri 2a str. 301
gauauugccaccugc

SEQ ID NO: 1973242 - RNA, 15 nt, Shigella flexneri 2a str. 301
gauauuguaggcccg

SEQ ID NO: 1973243 - RNA, 18 nt, Shigella flexneri 2a str. 301
gauauugcggaacaucgc

SEQ ID NO: 1973244 - RNA, 19 nt, Shigella flexneri 2a str. 301
gaucgccgcacuuucuccu

SEQ ID NO: 1973245 - RNA, 20 nt, Shigella flexneri 2a str. 301
gaucgccccggaagcaucaa

SEQ ID NO: 1973246 - RNA, 21 nt, Shigella flexneri 2a str. 301
gaucgccugcagggcuuucac

SEQ ID NO: 1973247 - RNA, 16 nt, Shigella flexneri 2a str. 301
gaucgcauggcggauc

SEQ ID NO: 1973248 - RNA, 14 nt, Shigella flexneri 2a str. 301
gaucgccaaagaaa

SEQ ID NO: 1973249 - RNA, 15 nt, Shigella flexneri 2a str. 301
gaucgaucauauuuc

SEQ ID NO: 1973250 - RNA, 13 nt, Shigella flexneri 2a str. 301
gaucgcguaauaa

SEQ ID NO: 1973251 - RNA, 19 nt, Shigella flexneri 2a str. 301
gaucgcucaucugcugcgu

SEQ ID NO: 1973252 - RNA, 21 nt, Shigella flexneri 2a str. 301
gaucgcuaaggguauagaagc

SEQ ID NO: 1973253 - RNA, 23 nt, Shigella flexneri 2a str. 301
gaucgcuuucgcuacuucaaaca

SEQ ID NO: 1973254 - RNA, 14 nt, Shigella flexneri 2a str. 301
gaucgcuucggucu

SEQ ID NO: 1973255 - RNA, 16 nt, Shigella flexneri 2a str. 301
gaucggcaagugccug

SEQ ID NO: 1973256 - RNA, 15 nt, Shigella flexneri 2a str. 301
gauccaccaccgcaa

SEQ ID NO: 1973257 - RNA, 15 nt, Shigella flexneri 2a str. 301
gauccaccacgcugu

SEQ ID NO: 1973258 - RNA, 22 nt, Shigella flexneri 2a str. 301
gauccuggcgaaaacgcccggc

SEQ ID NO: 1973259 - RNA, 15 nt, Shigella flexneri 2a str. 301
gauccugcacuuuca

SEQ ID NO: 1973260 - RNA, 21 nt, Shigella flexneri 2a str. 301
gauccugauacagaccgcgca

SEQ ID NO: 1973261 - RNA, 15 nt, Shigella flexneri 2a str. 301
gauccugauccugca

SEQ ID NO: 1973262 - RNA, 22 nt, Shigella flexneri 2a str. 301
gauccugauuuaacaucuccac

SEQ ID NO: 1973263 - RNA, 15 nt, Shigella flexneri 2a str. 301
gauccugcaacagca

SEQ ID NO: 1973264 - RNA, 16 nt, Shigella flexneri 2a str. 301
gauccuuuuucccaaa

SEQ ID NO: 1973265 - RNA, 15 nt, Shigella flexneri 2a str. 301
gauccuuuuucccaa

SEQ ID NO: 1973266 - RNA, 17 nt, Shigella flexneri 2a str. 301
gaucgacagcgggugca

SEQ ID NO: 1973267 - RNA, 17 nt, Shigella flexneri 2a str. 301
gauccuacacauacuua

SEQ ID NO: 1973268 - RNA, 17 nt, Shigella flexneri 2a str. 301
gauccugagccaguuuu

SEQ ID NO: 1973269 - RNA, 18 nt, Shigella flexneri 2a str. 301
gauccgggcauauuuccg

SEQ ID NO: 1973270 - RNA, 14 nt, Shigella flexneri 2a str. 301
gaugaaucaccaca

SEQ ID NO: 1973271 - RNA, 18 nt, Shigella flexneri 2a str. 301
gaugaaucaguaggugca

SEQ ID NO: 1973272 - RNA, 18 nt, Shigella flexneri 2a str. 301
gaucguguaacguacugc

SEQ ID NO: 1973273 - RNA, 15 nt, Shigella flexneri 2a str. 301
gaugacaucgcagca

SEQ ID NO: 1973274 - RNA, 14 nt, Shigella flexneri 2a str. 301
gaugacaugcaaug

SEQ ID NO: 1973275 - RNA, 16 nt, Shigella flexneri 2a str. 301
gaugacagacuccgcu

SEQ ID NO: 1973276 - RNA, 20 nt, Shigella flexneri 2a str. 301
gaugaucauccggcuuuuuu

SEQ ID NO: 1973277 - RNA, 18 nt, Shigella flexneri 2a str. 301
gaugauccuggccuggau

SEQ ID NO: 1973278 - RNA, 23 nt, Shigella flexneri 2a str. 301
gaugagcaaauccgcacucaucu

SEQ ID NO: 1973279 - RNA, 14 nt, Shigella flexneri 2a str. 301
gaugaucaacagca

SEQ ID NO: 1973280 - RNA, 16 nt, Shigella flexneri 2a str. 301
gaugcaugauccggca

SEQ ID NO: 1973281 - RNA, 16 nt, Shigella flexneri 2a str. 301
gaugcagcguaaaccc

SEQ ID NO: 1973282 - RNA, 21 nt, Shigella flexneri 2a str. 301
gaugcggcgugaacgccuuau

SEQ ID NO: 1973283 - RNA, 17 nt, Shigella flexneri 2a str. 301
gaugcgguaaccuggca

SEQ ID NO: 1973284 - RNA, 22 nt, Shigella flexneri 2a str. 301
gaugcgaucgcgaauaugcugg

SEQ ID NO: 1973285 - RNA, 23 nt, Shigella flexneri 2a str. 301
gaugccuugugggccugaaagcu

SEQ ID NO: 1973286 - RNA, 13 nt, Shigella flexneri 2a str. 301
gaugccgccagac

SEQ ID NO: 1973287 - RNA, 18 nt, Shigella flexneri 2a str. 301
gaugccaauccccagacc

SEQ ID NO: 1973288 - RNA, 16 nt, Shigella flexneri 2a str. 301
gaugcggugcaagcac

SEQ ID NO: 1973289 - RNA, 16 nt, Shigella flexneri 2a str. 301
gaugcuguugcuccuu

SEQ ID NO: 1973290 - RNA, 17 nt, Shigella flexneri 2a str. 301
gauggcaagcggugcga

SEQ ID NO: 1973291 - RNA, 18 nt, Shigella flexneri 2a str. 301
gauggcaaaagugauauu

SEQ ID NO: 1973292 - RNA, 16 nt, Shigella flexneri 2a str. 301
gauggcaauuuucacu

SEQ ID NO: 1973293 - RNA, 17 nt, Shigella flexneri 2a str. 301
gauggcaauuuucacug

SEQ ID NO: 1973294 - RNA, 18 nt, Shigella flexneri 2a str. 301
gauggcaaacugauuauc

SEQ ID NO: 1973295 - RNA, 15 nt, Shigella flexneri 2a str. 301
gauggaaugagcauc

SEQ ID NO: 1973296 - RNA, 19 nt, Shigella flexneri 2a str. 301
gauggaaaaagagcagcug

SEQ ID NO: 1973297 - RNA, 20 nt, Shigella flexneri 2a str. 301
gauggcaucaccaucgggcc

SEQ ID NO: 1973298 - RNA, 16 nt, Shigella flexneri 2a str. 301
gauggcagucuggaca

SEQ ID NO: 1973299 - RNA, 16 nt, Shigella flexneri 2a str. 301
gauggcgauaaucuuu

SEQ ID NO: 1973300 - RNA, 23 nt, Shigella flexneri 2a str. 301
gauggucacggacaggugaugca

SEQ ID NO: 1973301 - RNA, 17 nt, Shigella flexneri 2a str. 301
gaugguauuguccugca

SEQ ID NO: 1973302 - RNA, 21 nt, Shigella flexneri 2a str. 301
gaugguaugcgaagguggcgg

SEQ ID NO: 1973303 - RNA, 19 nt, Shigella flexneri 2a str. 301
gaugguacgcguggacugg

SEQ ID NO: 1973304 - RNA, 20 nt, Shigella flexneri 2a str. 301
gaugguacuucaaucgccac

SEQ ID NO: 1973305 - RNA, 23 nt, Shigella flexneri 2a str. 301
gaugguacuucaaucgccaccac

SEQ ID NO: 1973306 - RNA, 23 nt, Shigella flexneri 2a str. 301
gaugggcguuuucuaccagguuu

SEQ ID NO: 1973307 - RNA, 23 nt, Shigella flexneri 2a str. 301
gauguaaucaacuccgccagcaa

SEQ ID NO: 1973308 - RNA, 22 nt, Shigella flexneri 2a str. 301
gaugguuuuuggguucagcauu

SEQ ID NO: 1973309 - RNA, 15 nt, Shigella flexneri 2a str. 301
gaugguuuuauagcg

SEQ ID NO: 1973310 - RNA, 22 nt, Shigella flexneri 2a str. 301
gauggugcaaauugcaccaucc

SEQ ID NO: 1973311 - RNA, 19 nt, Shigella flexneri 2a str. 301
gauggucgcuuuguggcgg

SEQ ID NO: 1973312 - RNA, 12 nt, Shigella flexneri 2a str. 301
gauggugguggg

SEQ ID NO: 1973313 - RNA, 14 nt, Shigella flexneri 2a str. 301
gauguuugagcuaa

SEQ ID NO: 1973314 - RNA, 20 nt, Shigella flexneri 2a str. 301
gauuaaaggaaggucaucca

SEQ ID NO: 1973315 - RNA, 21 nt, Shigella flexneri 2a str. 301
gauuaaacaagguuugaaaaa

SEQ ID NO: 1973316 - RNA, 18 nt, Shigella flexneri 2a str. 301
gauguuuucugccucugc

SEQ ID NO: 1973317 - RNA, 18 nt, Shigella flexneri 2a str. 301
gauuaaaaacccugcaga

SEQ ID NO: 1973318 - RNA, 23 nt, Shigella flexneri 2a str. 301
gauuaacugggcgucaaagugaa

SEQ ID NO: 1973319 - RNA, 18 nt, Shigella flexneri 2a str. 301
gauuaacgcgccggaaau

SEQ ID NO: 1973320 - RNA, 15 nt, Shigella flexneri 2a str. 301
gauuauccaugccac

SEQ ID NO: 1973321 - RNA, 15 nt, Shigella flexneri 2a str. 301
gauuacuuaacuuau

SEQ ID NO: 1973322 - RNA, 15 nt, Shigella flexneri 2a str. 301
gauuacuguacagau

SEQ ID NO: 1973323 - RNA, 22 nt, Shigella flexneri 2a str. 301
gauuacuguacagauccgccau

SEQ ID NO: 1973324 - RNA, 22 nt, Shigella flexneri 2a str. 301
gauuauggaucaguguacuuau

SEQ ID NO: 1973325 - RNA, 17 nt, Shigella flexneri 2a str. 301
gauuaagugaaccuuaa

SEQ ID NO: 1973326 - RNA, 22 nt, Shigella flexneri 2a str. 301
gauuaauaaaauuauccagcuu

SEQ ID NO: 1973327 - RNA, 15 nt, Shigella flexneri 2a str. 301
gauuaauaaauuuua

SEQ ID NO: 1973328 - RNA, 18 nt, Shigella flexneri 2a str. 301
gauuacgcgcucaccgcu

SEQ ID NO: 1973329 - RNA, 14 nt, Shigella flexneri 2a str. 301
gauuacgucuuuac

SEQ ID NO: 1973330 - RNA, 19 nt, Shigella flexneri 2a str. 301
gauuacguagcacaaucaa

SEQ ID NO: 1973331 - RNA, 21 nt, Shigella flexneri 2a str. 301
gauuacugcaaacucaucgcc

SEQ ID NO: 1973332 - RNA, 13 nt, Shigella flexneri 2a str. 301
gauuauucacaau

SEQ ID NO: 1973333 - RNA, 16 nt, Shigella flexneri 2a str. 301
gauuaugucaucaucg

SEQ ID NO: 1973334 - RNA, 13 nt, Shigella flexneri 2a str. 301
gauugaagaaauc

SEQ ID NO: 1973335 - RNA, 16 nt, Shigella flexneri 2a str. 301
gauucuucgaugaugc

SEQ ID NO: 1973336 - RNA, 19 nt, Shigella flexneri 2a str. 301
gauugcgaauauguacuuu

SEQ ID NO: 1973337 - RNA, 19 nt, Shigella flexneri 2a str. 301
gauugccggaauggugcuu

SEQ ID NO: 1973338 - RNA, 12 nt, Shigella flexneri 2a str. 301
gauugcuucugc

SEQ ID NO: 1973339 - RNA, 13 nt, Shigella flexneri 2a str. 301
gauugcuucugcu

SEQ ID NO: 1973340 - RNA, 18 nt, Shigella flexneri 2a str. 301
gauugugugauacuucuu

SEQ ID NO: 1973341 - RNA, 14 nt, Shigella flexneri 2a str. 301
gauuucuuuauccg

SEQ ID NO: 1973342 - RNA, 17 nt, Shigella flexneri 2a str. 301
gauuucuucaccagccu

SEQ ID NO: 1973343 - RNA, 15 nt, Shigella flexneri 2a str. 301
gauuuuguaaaagaa

SEQ ID NO: 1973344 - RNA, 16 nt, Shigella flexneri 2a str. 301
gauuuuggucaugcua

SEQ ID NO: 1973345 - RNA, 16 nt, Shigella flexneri 2a str. 301
gcaaaaauaaggcgga

SEQ ID NO: 1973346 - RNA, 22 nt, Shigella flexneri 2a str. 301
gcaaaaacccuucuuccauacc

SEQ ID NO: 1973347 - RNA, 19 nt, Shigella flexneri 2a str. 301
gcaaaaaucgacagcagga

SEQ ID NO: 1973348 - RNA, 20 nt, Shigella flexneri 2a str. 301
gcaaaaaucgacagcaggau

SEQ ID NO: 1973349 - RNA, 13 nt, Shigella flexneri 2a str. 301
gcaaaaaaggcgu

SEQ ID NO: 1973350 - RNA, 12 nt, Shigella flexneri 2a str. 301
gcaaaaucccac

SEQ ID NO: 1973351 - RNA, 18 nt, Shigella flexneri 2a str. 301
gcaaaaucguaagcagga

SEQ ID NO: 1973352 - RNA, 24 nt, Shigella flexneri 2a str. 301
gcaaaaucucacacucaugauccu

SEQ ID NO: 1973353 - RNA, 11 nt, Shigella flexneri 2a str. 301
gcaaaauaggu

SEQ ID NO: 1973354 - RNA, 12 nt, Shigella flexneri 2a str. 301
gcaaaauaggua

SEQ ID NO: 1973355 - RNA, 22 nt, Shigella flexneri 2a str. 301
gcaaaauagguaucguaauuuu

SEQ ID NO: 1973356 - RNA, 19 nt, Shigella flexneri 2a str. 301
gcaaaauaaccggcaagca

SEQ ID NO: 1973357 - RNA, 14 nt, Shigella flexneri 2a str. 301
gcaaacaccagcga

SEQ ID NO: 1973358 - RNA, 14 nt, Shigella flexneri 2a str. 301
gcaaaauuagcucg

SEQ ID NO: 1973359 - RNA, 18 nt, Shigella flexneri 2a str. 301
gcaaaauuuuuuugcacc

SEQ ID NO: 1973360 - RNA, 18 nt, Shigella flexneri 2a str. 301
gcaaaccgccagcuaggc

SEQ ID NO: 1973361 - RNA, 22 nt, Shigella flexneri 2a str. 301
gcaaacaguuucugcagcucca

SEQ ID NO: 1973362 - RNA, 18 nt, Shigella flexneri 2a str. 301
gcaaacaguucugcagcg

SEQ ID NO: 1973363 - RNA, 22 nt, Shigella flexneri 2a str. 301
gcaaacauggaaaccaucaucu

SEQ ID NO: 1973364 - RNA, 17 nt, Shigella flexneri 2a str. 301
gcaaacaucggcuuauu

SEQ ID NO: 1973365 - RNA, 15 nt, Shigella flexneri 2a str. 301
gcaaagagagaagcc

SEQ ID NO: 1973366 - RNA, 20 nt, Shigella flexneri 2a str. 301
gcaaacugucuaauggugaa

SEQ ID NO: 1973367 - RNA, 21 nt, Shigella flexneri 2a str. 301
gcaaacucaucgccgccaaac

SEQ ID NO: 1973368 - RNA, 19 nt, Shigella flexneri 2a str. 301
gcaaacucugagagaucuu

SEQ ID NO: 1973369 - RNA, 11 nt, Shigella flexneri 2a str. 301
gcaaacugagu

SEQ ID NO: 1973370 - RNA, 23 nt, Shigella flexneri 2a str. 301
gcaaacgguuguagcucggcgca

SEQ ID NO: 1973371 - RNA, 16 nt, Shigella flexneri 2a str. 301
gcaaacguaaaacugc

SEQ ID NO: 1973372 - RNA, 14 nt, Shigella flexneri 2a str. 301
gcaaacgaaagcag

SEQ ID NO: 1973373 - RNA, 17 nt, Shigella flexneri 2a str. 301
gcaaacgaaagcagggc

SEQ ID NO: 1973374 - RNA, 16 nt, Shigella flexneri 2a str. 301
gcaaacgaaaucugac

SEQ ID NO: 1973375 - RNA, 15 nt, Shigella flexneri 2a str. 301
gcaaaccucaggaau

SEQ ID NO: 1973376 - RNA, 17 nt, Shigella flexneri 2a str. 301
gcaaaccuuaaagcauu

SEQ ID NO: 1973377 - RNA, 16 nt, Shigella flexneri 2a str. 301
gcaaaccugcaaugau

SEQ ID NO: 1973378 - RNA, 21 nt, Shigella flexneri 2a str. 301
gcaaaccuggcauguggcggc

SEQ ID NO: 1973379 - RNA, 16 nt, Shigella flexneri 2a str. 301
gcaaauccaucgccug

SEQ ID NO: 1973380 - RNA, 15 nt, Shigella flexneri 2a str. 301
gcaaaucccaucggu

SEQ ID NO: 1973381 - RNA, 21 nt, Shigella flexneri 2a str. 301
gcaaauccacguuccagaucu

SEQ ID NO: 1973382 - RNA, 17 nt, Shigella flexneri 2a str. 301
gcaaaucacgcugcuga

SEQ ID NO: 1973383 - RNA, 12 nt, Shigella flexneri 2a str. 301
gcaaaucaccac

SEQ ID NO: 1973384 - RNA, 19 nt, Shigella flexneri 2a str. 301
gcaaauacccaaaaaauag

SEQ ID NO: 1973385 - RNA, 17 nt, Shigella flexneri 2a str. 301
gcaaauacaguugcgcc

SEQ ID NO: 1973386 - RNA, 20 nt, Shigella flexneri 2a str. 301
gcaaaucgaucucaaugagc

SEQ ID NO: 1973387 - RNA, 23 nt, Shigella flexneri 2a str. 301
gcaaaucgacgccacaaucugau

SEQ ID NO: 1973388 - RNA, 12 nt, Shigella flexneri 2a str. 301
gcaaaucgcggc

SEQ ID NO: 1973389 - RNA, 15 nt, Shigella flexneri 2a str. 301
gcaaaugaugcacca

SEQ ID NO: 1973390 - RNA, 22 nt, Shigella flexneri 2a str. 301
gcaaaucuucgucgugaaagga

SEQ ID NO: 1973391 - RNA, 23 nt, Shigella flexneri 2a str. 301
gcaaaugcggagacucaaacccc

SEQ ID NO: 1973392 - RNA, 23 nt, Shigella flexneri 2a str. 301
gcaaauuauuugcguagucugac

SEQ ID NO: 1973393 - RNA, 15 nt, Shigella flexneri 2a str. 301
gcaaaguaauaauga

SEQ ID NO: 1973394 - RNA, 17 nt, Shigella flexneri 2a str. 301
gcaaaguagagcgaaac

SEQ ID NO: 1973395 - RNA, 14 nt, Shigella flexneri 2a str. 301
gcaaagguuuuacc

SEQ ID NO: 1973396 - RNA, 20 nt, Shigella flexneri 2a str. 301
gcaaagugaauacagaacag

SEQ ID NO: 1973397 - RNA, 16 nt, Shigella flexneri 2a str. 301
gcaaagugaauacaga

SEQ ID NO: 1973398 - RNA, 19 nt, Shigella flexneri 2a str. 301
gcaaagcugucaccaauca

SEQ ID NO: 1973399 - RNA, 16 nt, Shigella flexneri 2a str. 301
gcaaaggccagcaauc

SEQ ID NO: 1973400 - RNA, 15 nt, Shigella flexneri 2a str. 301
gcaaagcaaauuuug

SEQ ID NO: 1973401 - RNA, 11 nt, Shigella flexneri 2a str. 301
gcaaagcccac

SEQ ID NO: 1973402 - RNA, 19 nt, Shigella flexneri 2a str. 301
gcaaagcauuuuuucacau

SEQ ID NO: 1973403 - RNA, 21 nt, Shigella flexneri 2a str. 301
gcagcauucgccgcauugucu

SEQ ID NO: 1973404 - RNA, 14 nt, Shigella flexneri 2a str. 301
gcagcauggucagg

SEQ ID NO: 1973405 - RNA, 18 nt, Shigella flexneri 2a str. 301
gcagcauguguaaccgcu

SEQ ID NO: 1973406 - RNA, 19 nt, Shigella flexneri 2a str. 301
gcagccaaaaaugacgccc

SEQ ID NO: 1973407 - RNA, 22 nt, Shigella flexneri 2a str. 301
gcagcaugcacccucaauaacu

SEQ ID NO: 1973408 - RNA, 16 nt, Shigella flexneri 2a str. 301
gcagcaugcacccuca

SEQ ID NO: 1973409 - RNA, 13 nt, Shigella flexneri 2a str. 301
gcagcauggucag

SEQ ID NO: 1973410 - RNA, 18 nt, Shigella flexneri 2a str. 301
gcagcccguaagcaaaag

SEQ ID NO: 1973411 - RNA, 13 nt, Shigella flexneri 2a str. 301
gcagcccgcagcg

SEQ ID NO: 1973412 - RNA, 22 nt, Shigella flexneri 2a str. 301
gcagcgcaauuaacgccccaag

SEQ ID NO: 1973413 - RNA, 17 nt, Shigella flexneri 2a str. 301
gcagcgcaaucgccucc

SEQ ID NO: 1973414 - RNA, 16 nt, Shigella flexneri 2a str. 301
gcagcgcauuguuucu

SEQ ID NO: 1973415 - RNA, 21 nt, Shigella flexneri 2a str. 301
gcagcgccagcgaagccagcu

SEQ ID NO: 1973416 - RNA, 17 nt, Shigella flexneri 2a str. 301
gcagcaucgcucaccca

SEQ ID NO: 1973417 - RNA, 15 nt, Shigella flexneri 2a str. 301
gcagcaucgccagga

SEQ ID NO: 1973418 - RNA, 16 nt, Shigella flexneri 2a str. 301
gcagcaucaucauaau

SEQ ID NO: 1973419 - RNA, 12 nt, Shigella flexneri 2a str. 301
gcagcagcgcgc

SEQ ID NO: 1973420 - RNA, 16 nt, Shigella flexneri 2a str. 301
gcagcagcgcgcccgg

SEQ ID NO: 1973421 - RNA, 20 nt, Shigella flexneri 2a str. 301
gcagcacccugaguuuucag

SEQ ID NO: 1973422 - RNA, 19 nt, Shigella flexneri 2a str. 301
gcagcacccugaguuuuca

SEQ ID NO: 1973423 - RNA, 14 nt, Shigella flexneri 2a str. 301
gcagcagagaaaau

SEQ ID NO: 1973424 - RNA, 19 nt, Shigella flexneri 2a str. 301
gcagcagagaaaauauccc

SEQ ID NO: 1973425 - RNA, 22 nt, Shigella flexneri 2a str. 301
gcagauuagccgguaaaucacc

SEQ ID NO: 1973426 - RNA, 15 nt, Shigella flexneri 2a str. 301
gcagauuaugccgcu

SEQ ID NO: 1973427 - RNA, 16 nt, Shigella flexneri 2a str. 301
gcacuguuucgccagg

SEQ ID NO: 1973428 - RNA, 14 nt, Shigella flexneri 2a str. 301
gcacuuacuuuccu

SEQ ID NO: 1973429 - RNA, 15 nt, Shigella flexneri 2a str. 301
gcacugguacucaac

SEQ ID NO: 1973430 - RNA, 19 nt, Shigella flexneri 2a str. 301
gcacugggcgaagguggcg

SEQ ID NO: 1973431 - RNA, 22 nt, Shigella flexneri 2a str. 301
gcagcgccuuuuguuuguucuu

SEQ ID NO: 1973432 - RNA, 12 nt, Shigella flexneri 2a str. 301
gcagcugagaaa

SEQ ID NO: 1973433 - RNA, 17 nt, Shigella flexneri 2a str. 301
gcagcggugagccagga

SEQ ID NO: 1973434 - RNA, 17 nt, Shigella flexneri 2a str. 301
gcagcgucacucgcugc

SEQ ID NO: 1973435 - RNA, 17 nt, Shigella flexneri 2a str. 301
gcaggcgcaauggcgca

SEQ ID NO: 1973436 - RNA, 20 nt, Shigella flexneri 2a str. 301
gcaggcgauccuguucaaac

SEQ ID NO: 1973437 - RNA, 18 nt, Shigella flexneri 2a str. 301
gcaggcguuaaaacaggu

SEQ ID NO: 1973438 - RNA, 19 nt, Shigella flexneri 2a str. 301
gcaggcguaacacucgugc

SEQ ID NO: 1973439 - RNA, 19 nt, Shigella flexneri 2a str. 301
gcaggcgguggaagcaccu

SEQ ID NO: 1973440 - RNA, 20 nt, Shigella flexneri 2a str. 301
gcaggccugauaagcgcagc

SEQ ID NO: 1973441 - RNA, 17 nt, Shigella flexneri 2a str. 301
gcaggccuggguaaaaa

SEQ ID NO: 1973442 - RNA, 21 nt, Shigella flexneri 2a str. 301
gcaggcaggccuauugacgcu

SEQ ID NO: 1973443 - RNA, 16 nt, Shigella flexneri 2a str. 301
gcaggcaucaucagau

SEQ ID NO: 1973444 - RNA, 19 nt, Shigella flexneri 2a str. 301
gcaggcaucggugaugcuc

SEQ ID NO: 1973445 - RNA, 14 nt, Shigella flexneri 2a str. 301
gcaggcaucggugc

SEQ ID NO: 1973446 - RNA, 21 nt, Shigella flexneri 2a str. 301
gcaggccaacagucuuaaagg

SEQ ID NO: 1973447 - RNA, 14 nt, Shigella flexneri 2a str. 301
gcaggaaaaaagcg

SEQ ID NO: 1973448 - RNA, 14 nt, Shigella flexneri 2a str. 301
gcagcuuugugcuu

SEQ ID NO: 1973449 - RNA, 15 nt, Shigella flexneri 2a str. 301
gcagcuuucagcagc

SEQ ID NO: 1973450 - RNA, 23 nt, Shigella flexneri 2a str. 301
gcaggcaaccguucggaaaaaua

SEQ ID NO: 1973451 - RNA, 23 nt, Shigella flexneri 2a str. 301
gcagcuugcuguuucgcugacga

SEQ ID NO: 1973452 - RNA, 18 nt, Shigella flexneri 2a str. 301
gcaguuucauccuucauu

SEQ ID NO: 1973453 - RNA, 17 nt, Shigella flexneri 2a str. 301
gcaguuucaccagcagu

SEQ ID NO: 1973454 - RNA, 21 nt, Shigella flexneri 2a str. 301
gcaguuucugauacugcuccg

SEQ ID NO: 1973455 - RNA, 21 nt, Shigella flexneri 2a str. 301
gcaguuugcgguguguggcug

SEQ ID NO: 1973456 - RNA, 17 nt, Shigella flexneri 2a str. 301
gcaguuuuuccccugcc

SEQ ID NO: 1973457 - RNA, 16 nt, Shigella flexneri 2a str. 301
gcagugcuuucauuuc

SEQ ID NO: 1973458 - RNA, 14 nt, Shigella flexneri 2a str. 301
gcaguggcaaccag

SEQ ID NO: 1973459 - RNA, 15 nt, Shigella flexneri 2a str. 301
gcaguggauaauaca

SEQ ID NO: 1973460 - RNA, 21 nt, Shigella flexneri 2a str. 301
gcaguggauaauacacuaaca

SEQ ID NO: 1973461 - RNA, 16 nt, Shigella flexneri 2a str. 301
gcauaaacaaagcgca

SEQ ID NO: 1973462 - RNA, 12 nt, Shigella flexneri 2a str. 301
gcauaaaaauau

SEQ ID NO: 1973463 - RNA, 19 nt, Shigella flexneri 2a str. 301
gcauaaaacaacgccaccc

SEQ ID NO: 1973464 - RNA, 17 nt, Shigella flexneri 2a str. 301
gcaguuuugccuucccc

SEQ ID NO: 1973465 - RNA, 21 nt, Shigella flexneri 2a str. 301
gcauaaucauuacaaccgcug

SEQ ID NO: 1973466 - RNA, 13 nt, Shigella flexneri 2a str. 301
gcauaaucaccag

SEQ ID NO: 1973467 - RNA, 13 nt, Shigella flexneri 2a str. 301
gcauaagccaccu

SEQ ID NO: 1973468 - RNA, 16 nt, Shigella flexneri 2a str. 301
gcauaucagcaacucu

SEQ ID NO: 1973469 - RNA, 13 nt, Shigella flexneri 2a str. 301
gcauauccaggcu

SEQ ID NO: 1973470 - RNA, 17 nt, Shigella flexneri 2a str. 301
gcauaucgacgaaccau

SEQ ID NO: 1973471 - RNA, 15 nt, Shigella flexneri 2a str. 301
gcauauaccacaccc

SEQ ID NO: 1973472 - RNA, 14 nt, Shigella flexneri 2a str. 301
gcauauaaugcaac

SEQ ID NO: 1973473 - RNA, 22 nt, Shigella flexneri 2a str. 301
gcauagagacuuuuccagccga

SEQ ID NO: 1973474 - RNA, 17 nt, Shigella flexneri 2a str. 301
gcauagguugaaauaaa

SEQ ID NO: 1973475 - RNA, 15 nt, Shigella flexneri 2a str. 301
gcauaaucggcuggg

SEQ ID NO: 1973476 - RNA, 17 nt, Shigella flexneri 2a str. 301
gcauaaugcagccaucc

SEQ ID NO: 1973477 - RNA, 14 nt, Shigella flexneri 2a str. 301
gcauaaugccugau

SEQ ID NO: 1973478 - RNA, 17 nt, Shigella flexneri 2a str. 301
gcauacggguaaaggcg

SEQ ID NO: 1973479 - RNA, 15 nt, Shigella flexneri 2a str. 301
gcauacggguuuucc

SEQ ID NO: 1973480 - RNA, 16 nt, Shigella flexneri 2a str. 301
gcauacucuccuccag

SEQ ID NO: 1973481 - RNA, 20 nt, Shigella flexneri 2a str. 301
gcauacucuccuccagguua

SEQ ID NO: 1973482 - RNA, 16 nt, Shigella flexneri 2a str. 301
gcauacguuucaccag

SEQ ID NO: 1973483 - RNA, 19 nt, Shigella flexneri 2a str. 301
gcagucaccugcccuccgg

SEQ ID NO: 1973484 - RNA, 16 nt, Shigella flexneri 2a str. 301
gcagucaaaucuuaua

SEQ ID NO: 1973485 - RNA, 14 nt, Shigella flexneri 2a str. 301
gcagucaggcgcgc

SEQ ID NO: 1973486 - RNA, 15 nt, Shigella flexneri 2a str. 301
gcagucaccagcauc

SEQ ID NO: 1973487 - RNA, 17 nt, Shigella flexneri 2a str. 301
gcagucagguucagcgu

SEQ ID NO: 1973488 - RNA, 16 nt, Shigella flexneri 2a str. 301
gcaguaaaccacccac

SEQ ID NO: 1973489 - RNA, 12 nt, Shigella flexneri 2a str. 301
gcaguaaaccac

SEQ ID NO: 1973490 - RNA, 15 nt, Shigella flexneri 2a str. 301
gcaguaaaccaccca

SEQ ID NO: 1973491 - RNA, 16 nt, Shigella flexneri 2a str. 301
gcaggcuuuuuuggua

SEQ ID NO: 1973492 - RNA, 18 nt, Shigella flexneri 2a str. 301
gcagggaucugauuuucc

SEQ ID NO: 1973493 - RNA, 13 nt, Shigella flexneri 2a str. 301
gcagggcaucaag

SEQ ID NO: 1973494 - RNA, 16 nt, Shigella flexneri 2a str. 301
gcagggcaucgcaggc

SEQ ID NO: 1973495 - RNA, 18 nt, Shigella flexneri 2a str. 301
gcaggucgucuuuuacag

SEQ ID NO: 1973496 - RNA, 19 nt, Shigella flexneri 2a str. 301
gcaucaaccaacaccuguu

SEQ ID NO: 1973497 - RNA, 15 nt, Shigella flexneri 2a str. 301
gcaucaaagccaggc

SEQ ID NO: 1973498 - RNA, 13 nt, Shigella flexneri 2a str. 301
gcaucaauaauca

SEQ ID NO: 1973499 - RNA, 17 nt, Shigella flexneri 2a str. 301
gcaucaauaaucaacgc

SEQ ID NO: 1973500 - RNA, 16 nt, Shigella flexneri 2a str. 301
gcaucaauaacccugg

SEQ ID NO: 1973501 - RNA, 22 nt, Shigella flexneri 2a str. 301
gcaucacauccggcaauauuca

SEQ ID NO: 1973502 - RNA, 12 nt, Shigella flexneri 2a str. 301
gcaucaccagac

SEQ ID NO: 1973503 - RNA, 18 nt, Shigella flexneri 2a str. 301
gcauaucguagccccagu

SEQ ID NO: 1973504 - RNA, 14 nt, Shigella flexneri 2a str. 301
gcauaugcggugcg

SEQ ID NO: 1973505 - RNA, 17 nt, Shigella flexneri 2a str. 301
gcauauuccaucgcuac

SEQ ID NO: 1973506 - RNA, 21 nt, Shigella flexneri 2a str. 301
gcaucaugucgcccacgccag

SEQ ID NO: 1973507 - RNA, 18 nt, Shigella flexneri 2a str. 301
gcaucaugaauauauaau

SEQ ID NO: 1973508 - RNA, 21 nt, Shigella flexneri 2a str. 301
gcaucagucacgacaaagaca

SEQ ID NO: 1973509 - RNA, 20 nt, Shigella flexneri 2a str. 301
gcaucagucucaaaccggcu

SEQ ID NO: 1973510 - RNA, 17 nt, Shigella flexneri 2a str. 301
gcaucaggccaaacaga

SEQ ID NO: 1973511 - RNA, 21 nt, Shigella flexneri 2a str. 301
gcaucaggcauugugcuccau

SEQ ID NO: 1973512 - RNA, 20 nt, Shigella flexneri 2a str. 301
gcaucagcgccaccagcgcc

SEQ ID NO: 1973513 - RNA, 16 nt, Shigella flexneri 2a str. 301
gcaucagcaacacgcu

SEQ ID NO: 1973514 - RNA, 17 nt, Shigella flexneri 2a str. 301
gcaucagcccaaagcag

SEQ ID NO: 1973515 - RNA, 14 nt, Shigella flexneri 2a str. 301
gcaucagcagcacg

SEQ ID NO: 1973516 - RNA, 15 nt, Shigella flexneri 2a str. 301
gcaucagaucggcag

SEQ ID NO: 1973517 - RNA, 14 nt, Shigella flexneri 2a str. 301
gcaucacuccacac

SEQ ID NO: 1973518 - RNA, 17 nt, Shigella flexneri 2a str. 301
gcaucacgacagcacca

SEQ ID NO: 1973519 - RNA, 17 nt, Shigella flexneri 2a str. 301
gcaucacgaauccgcac

SEQ ID NO: 1973520 - RNA, 19 nt, Shigella flexneri 2a str. 301
gcauccgggauggucagcg

SEQ ID NO: 1973521 - RNA, 20 nt, Shigella flexneri 2a str. 301
gcauccgggauggucagcgg

SEQ ID NO: 1973522 - RNA, 21 nt, Shigella flexneri 2a str. 301
gcauccggcauuugagcagga

SEQ ID NO: 1973523 - RNA, 20 nt, Shigella flexneri 2a str. 301
gcauccggcauaaacaaagc

SEQ ID NO: 1973524 - RNA, 14 nt, Shigella flexneri 2a str. 301
gcauccggcaugaa

SEQ ID NO: 1973525 - RNA, 19 nt, Shigella flexneri 2a str. 301
gcauccggcaaucggugca

SEQ ID NO: 1973526 - RNA, 17 nt, Shigella flexneri 2a str. 301
gcauccggcaauaagca

SEQ ID NO: 1973527 - RNA, 21 nt, Shigella flexneri 2a str. 301
gcauccggcaauugugauggu

SEQ ID NO: 1973528 - RNA, 21 nt, Shigella flexneri 2a str. 301
gcauccggcaauucucucuga

SEQ ID NO: 1973529 - RNA, 17 nt, Shigella flexneri 2a str. 301
gcauccggugauuuuca

SEQ ID NO: 1973530 - RNA, 16 nt, Shigella flexneri 2a str. 301
gcauccgucgccgcuu

SEQ ID NO: 1973531 - RNA, 14 nt, Shigella flexneri 2a str. 301
gcauccuugcuaac

SEQ ID NO: 1973532 - RNA, 18 nt, Shigella flexneri 2a str. 301
gcauccugaucguccugc

SEQ ID NO: 1973533 - RNA, 16 nt, Shigella flexneri 2a str. 301
gcauccgacacuggca

SEQ ID NO: 1973534 - RNA, 14 nt, Shigella flexneri 2a str. 301
gcauccgacaucaa

SEQ ID NO: 1973535 - RNA, 17 nt, Shigella flexneri 2a str. 301
gcauccgacauuugcac

SEQ ID NO: 1973536 - RNA, 14 nt, Shigella flexneri 2a str. 301
gcauccgcugaugc

SEQ ID NO: 1973537 - RNA, 16 nt, Shigella flexneri 2a str. 301
gcauccgcugaugcaa

SEQ ID NO: 1973538 - RNA, 19 nt, Shigella flexneri 2a str. 301
gcaucccgguaucaaagcg

SEQ ID NO: 1973539 - RNA, 16 nt, Shigella flexneri 2a str. 301
gcaucccggcagcccc

SEQ ID NO: 1973540 - RNA, 22 nt, Shigella flexneri 2a str. 301
gcaucccggcagccccaaacag

SEQ ID NO: 1973541 - RNA, 15 nt, Shigella flexneri 2a str. 301
gcaucccaacucauu

SEQ ID NO: 1973542 - RNA, 21 nt, Shigella flexneri 2a str. 301
gcaucccauuucuccagcagu

SEQ ID NO: 1973543 - RNA, 16 nt, Shigella flexneri 2a str. 301
gcauccauaucgccau

SEQ ID NO: 1973544 - RNA, 23 nt, Shigella flexneri 2a str. 301
gcaucauuuaaaaagaaaaaacu

SEQ ID NO: 1973545 - RNA, 16 nt, Shigella flexneri 2a str. 301
gcaucaucgcaaugau

SEQ ID NO: 1973546 - RNA, 22 nt, Shigella flexneri 2a str. 301
gcaauuacccaguagacagcaa

SEQ ID NO: 1973547 - RNA, 20 nt, Shigella flexneri 2a str. 301
gcaauuaccgccaccaggaa

SEQ ID NO: 1973548 - RNA, 16 nt, Shigella flexneri 2a str. 301
gcaauuacaugcuggu

SEQ ID NO: 1973549 - RNA, 16 nt, Shigella flexneri 2a str. 301
gcaauuacccaguaga

SEQ ID NO: 1973550 - RNA, 19 nt, Shigella flexneri 2a str. 301
gcaauuagcggcuggcugu

SEQ ID NO: 1973551 - RNA, 16 nt, Shigella flexneri 2a str. 301
gcaauuccggugacca

SEQ ID NO: 1973552 - RNA, 17 nt, Shigella flexneri 2a str. 301
gcaauggcuucauccac

SEQ ID NO: 1973553 - RNA, 16 nt, Shigella flexneri 2a str. 301
gcacacacugcuuaac

SEQ ID NO: 1973554 - RNA, 24 nt, Shigella flexneri 2a str. 301
gcacacacugcuuaacugcgcuuu

SEQ ID NO: 1973555 - RNA, 13 nt, Shigella flexneri 2a str. 301
gcacacacaucac

SEQ ID NO: 1973556 - RNA, 23 nt, Shigella flexneri 2a str. 301
gcacaauggagcuaaacagcgcu

SEQ ID NO: 1973557 - RNA, 15 nt, Shigella flexneri 2a str. 301
gcacaauaaucagcc

SEQ ID NO: 1973558 - RNA, 16 nt, Shigella flexneri 2a str. 301
gcacaacucggcggcu

SEQ ID NO: 1973559 - RNA, 13 nt, Shigella flexneri 2a str. 301
gcacaagcccaug

SEQ ID NO: 1973560 - RNA, 18 nt, Shigella flexneri 2a str. 301
gcaauuuuuccugguucu

SEQ ID NO: 1973561 - RNA, 16 nt, Shigella flexneri 2a str. 301
gcacauacugcaucag

SEQ ID NO: 1973562 - RNA, 15 nt, Shigella flexneri 2a str. 301
gcacauagcgugaca

SEQ ID NO: 1973563 - RNA, 23 nt, Shigella flexneri 2a str. 301
gcacauagcgugacaccagcaca

SEQ ID NO: 1973564 - RNA, 13 nt, Shigella flexneri 2a str. 301
gcacauauuuuuc

SEQ ID NO: 1973565 - RNA, 14 nt, Shigella flexneri 2a str. 301
gcacagaucgcacu

SEQ ID NO: 1973566 - RNA, 22 nt, Shigella flexneri 2a str. 301
gcacauaacucauacugagcaa

SEQ ID NO: 1973567 - RNA, 14 nt, Shigella flexneri 2a str. 301
gcacagaaccggag

SEQ ID NO: 1973568 - RNA, 12 nt, Shigella flexneri 2a str. 301
gcacagaccauc

SEQ ID NO: 1973569 - RNA, 18 nt, Shigella flexneri 2a str. 301
gcacacagggcgcuagcc

SEQ ID NO: 1973570 - RNA, 23 nt, Shigella flexneri 2a str. 301
gcacaccaggcucuuuaaacagu

SEQ ID NO: 1973571 - RNA, 19 nt, Shigella flexneri 2a str. 301
gcaccaccagcagcugcuc

SEQ ID NO: 1973572 - RNA, 22 nt, Shigella flexneri 2a str. 301
gcaccaacccuaacccaacauu

SEQ ID NO: 1973573 - RNA, 19 nt, Shigella flexneri 2a str. 301
gcaccaccauugagguuga

SEQ ID NO: 1973574 - RNA, 22 nt, Shigella flexneri 2a str. 301
gcaccaccuggcuugccgggcc

SEQ ID NO: 1973575 - RNA, 14 nt, Shigella flexneri 2a str. 301
gcacauuucaauca

SEQ ID NO: 1973576 - RNA, 17 nt, Shigella flexneri 2a str. 301
gcacauuucacucacgc

SEQ ID NO: 1973577 - RNA, 23 nt, Shigella flexneri 2a str. 301
gcacauuucagaaaguauauaaa

SEQ ID NO: 1973578 - RNA, 20 nt, Shigella flexneri 2a str. 301
gcacauuuuguaggccugau

SEQ ID NO: 1973579 - RNA, 15 nt, Shigella flexneri 2a str. 301
gcacaucaauuugcc

SEQ ID NO: 1973580 - RNA, 17 nt, Shigella flexneri 2a str. 301
gcaccaaacgggcaagc

SEQ ID NO: 1973581 - RNA, 21 nt, Shigella flexneri 2a str. 301
gcaccaaacgggcaagccagc

SEQ ID NO: 1973582 - RNA, 15 nt, Shigella flexneri 2a str. 301
gcaccaccagcagcu

SEQ ID NO: 1973583 - RNA, 16 nt, Shigella flexneri 2a str. 301
gcaccaccagcagcug

SEQ ID NO: 1973584 - RNA, 13 nt, Shigella flexneri 2a str. 301
gcaccaacaaaua

SEQ ID NO: 1973585 - RNA, 16 nt, Shigella flexneri 2a str. 301
gcaccaacaaauagag

SEQ ID NO: 1973586 - RNA, 11 nt, Shigella flexneri 2a str. 301
gcaccaacaaa

SEQ ID NO: 1973587 - RNA, 20 nt, Shigella flexneri 2a str. 301
gcaaauucuugugcgggggc

SEQ ID NO: 1973588 - RNA, 20 nt, Shigella flexneri 2a str. 301
gcaaauucggcggcgugccu

SEQ ID NO: 1973589 - RNA, 14 nt, Shigella flexneri 2a str. 301
gcaaauugacuaca

SEQ ID NO: 1973590 - RNA, 19 nt, Shigella flexneri 2a str. 301
gcaaauugccccagaugcc

SEQ ID NO: 1973591 - RNA, 12 nt, Shigella flexneri 2a str. 301
gcaacuucucuu

SEQ ID NO: 1973592 - RNA, 21 nt, Shigella flexneri 2a str. 301
gcaacaaaauccgccguaaau

SEQ ID NO: 1973593 - RNA, 13 nt, Shigella flexneri 2a str. 301
gcaacaaaauggc

SEQ ID NO: 1973594 - RNA, 12 nt, Shigella flexneri 2a str. 301
gcaacaaacgcg

SEQ ID NO: 1973595 - RNA, 16 nt, Shigella flexneri 2a str. 301
gcaagauuccagugcc

SEQ ID NO: 1973596 - RNA, 19 nt, Shigella flexneri 2a str. 301
gcaagaucgcgcaucagcu

SEQ ID NO: 1973597 - RNA, 23 nt, Shigella flexneri 2a str. 301
gcaagaucgcucaucagcuccgg

SEQ ID NO: 1973598 - RNA, 22 nt, Shigella flexneri 2a str. 301
gcaagaaauaccgaagaguaac

SEQ ID NO: 1973599 - RNA, 13 nt, Shigella flexneri 2a str. 301
gcaagaaaugaca

SEQ ID NO: 1973600 - RNA, 13 nt, Shigella flexneri 2a str. 301
gcaagaaauaccg

SEQ ID NO: 1973601 - RNA, 22 nt, Shigella flexneri 2a str. 301
gcaacuuuagccgguuuuucaa

SEQ ID NO: 1973602 - RNA, 20 nt, Shigella flexneri 2a str. 301
gcaacuuuucaacaaauucu

SEQ ID NO: 1973603 - RNA, 20 nt, Shigella flexneri 2a str. 301
gcaagccgcuaacagcagca

SEQ ID NO: 1973604 - RNA, 13 nt, Shigella flexneri 2a str. 301
gcaagccugaaaa

SEQ ID NO: 1973605 - RNA, 20 nt, Shigella flexneri 2a str. 301
gcaagcgaguugcgccagua

SEQ ID NO: 1973606 - RNA, 12 nt, Shigella flexneri 2a str. 301
gcaagcccagcc

SEQ ID NO: 1973607 - RNA, 17 nt, Shigella flexneri 2a str. 301
gcaagcccagcacccag

SEQ ID NO: 1973608 - RNA, 15 nt, Shigella flexneri 2a str. 301
gcaagccagguuuug

SEQ ID NO: 1973609 - RNA, 15 nt, Shigella flexneri 2a str. 301
gcaagcaggucggcu

SEQ ID NO: 1973610 - RNA, 19 nt, Shigella flexneri 2a str. 301
gcaagcaggucggcucagc

SEQ ID NO: 1973611 - RNA, 15 nt, Shigella flexneri 2a str. 301
gcaagcggcgacuga

SEQ ID NO: 1973612 - RNA, 12 nt, Shigella flexneri 2a str. 301
gcaagcggcggc

SEQ ID NO: 1973613 - RNA, 13 nt, Shigella flexneri 2a str. 301
gcaauagaauaag

SEQ ID NO: 1973614 - RNA, 16 nt, Shigella flexneri 2a str. 301
gcaagucauuguccag

SEQ ID NO: 1973615 - RNA, 22 nt, Shigella flexneri 2a str. 301
gcaauagcuucuuccacauugu

SEQ ID NO: 1973616 - RNA, 13 nt, Shigella flexneri 2a str. 301
gcaauauauugaa

SEQ ID NO: 1973617 - RNA, 17 nt, Shigella flexneri 2a str. 301
gcaauaugcggugccau

SEQ ID NO: 1973618 - RNA, 14 nt, Shigella flexneri 2a str. 301
gcaaucaccgccag

SEQ ID NO: 1973619 - RNA, 13 nt, Shigella flexneri 2a str. 301
gcaaucacaucac

SEQ ID NO: 1973620 - RNA, 16 nt, Shigella flexneri 2a str. 301
gcaaucugauugacau

SEQ ID NO: 1973621 - RNA, 19 nt, Shigella flexneri 2a str. 301
gcaauauuguagcaacucc

SEQ ID NO: 1973622 - RNA, 21 nt, Shigella flexneri 2a str. 301
gcaaucaaauaccaccagcga

SEQ ID NO: 1973623 - RNA, 20 nt, Shigella flexneri 2a str. 301
gcaauauucauuaaaacuga

SEQ ID NO: 1973624 - RNA, 23 nt, Shigella flexneri 2a str. 301
gcaaucaaauaccaccagcgaaa

SEQ ID NO: 1973625 - RNA, 20 nt, Shigella flexneri 2a str. 301
gcaauggccguuccggcaac

SEQ ID NO: 1973626 - RNA, 14 nt, Shigella flexneri 2a str. 301
gcaaugcuuccugc

SEQ ID NO: 1973627 - RNA, 16 nt, Shigella flexneri 2a str. 301
gcaaugcguuccagca

SEQ ID NO: 1973628 - RNA, 22 nt, Shigella flexneri 2a str. 301
gcaaucuguuuauuugacagcc

SEQ ID NO: 1973629 - RNA, 11 nt, Shigella flexneri 2a str. 301
gcaaugaaauu

SEQ ID NO: 1973630 - RNA, 21 nt, Shigella flexneri 2a str. 301
gcacgacuuucucuucaucua

SEQ ID NO: 1973631 - RNA, 16 nt, Shigella flexneri 2a str. 301
gcacgccgacaaagau

SEQ ID NO: 1973632 - RNA, 22 nt, Shigella flexneri 2a str. 301
gcaccuuacucaguuggugucc

SEQ ID NO: 1973633 - RNA, 17 nt, Shigella flexneri 2a str. 301
gcaccuuuucaucaggu

SEQ ID NO: 1973634 - RNA, 24 nt, Shigella flexneri 2a str. 301
gcaccuuuuccaccaauggcggaa

SEQ ID NO: 1973635 - RNA, 12 nt, Shigella flexneri 2a str. 301
gcaccuuuacca

SEQ ID NO: 1973636 - RNA, 24 nt, Shigella flexneri 2a str. 301
gcaccugaguaauuaauacgccag

SEQ ID NO: 1973637 - RNA, 16 nt, Shigella flexneri 2a str. 301
gcaccgugacaguaau

SEQ ID NO: 1973638 - RNA, 15 nt, Shigella flexneri 2a str. 301
gcaccguaaacggcu

SEQ ID NO: 1973639 - RNA, 15 nt, Shigella flexneri 2a str. 301
gcaccgccaccaccg

SEQ ID NO: 1973640 - RNA, 17 nt, Shigella flexneri 2a str. 301
gcaccgauaauacacuu

SEQ ID NO: 1973641 - RNA, 12 nt, Shigella flexneri 2a str. 301
gcaccgccgccg

SEQ ID NO: 1973642 - RNA, 22 nt, Shigella flexneri 2a str. 301
gcaccaggcaguuuauccagcc

SEQ ID NO: 1973643 - RNA, 13 nt, Shigella flexneri 2a str. 301
gcaccagcaacaa

SEQ ID NO: 1973644 - RNA, 19 nt, Shigella flexneri 2a str. 301
gcaccagaauuccguaagc

SEQ ID NO: 1973645 - RNA, 22 nt, Shigella flexneri 2a str. 301
gcaccagaauaccuugcugcuc

SEQ ID NO: 1973646 - RNA, 15 nt, Shigella flexneri 2a str. 301
gcaccagaaacaaua

SEQ ID NO: 1973647 - RNA, 19 nt, Shigella flexneri 2a str. 301
gcaccacuuccggcaacaa

SEQ ID NO: 1973648 - RNA, 14 nt, Shigella flexneri 2a str. 301
gcaccacuugcaga

SEQ ID NO: 1973649 - RNA, 18 nt, Shigella flexneri 2a str. 301
gcaccagggaaauaaucg

SEQ ID NO: 1973650 - RNA, 22 nt, Shigella flexneri 2a str. 301
gcacguaccaugcgcaucaucg

SEQ ID NO: 1973651 - RNA, 22 nt, Shigella flexneri 2a str. 301
gcacggucaggcuaaagaaaac

SEQ ID NO: 1973652 - RNA, 18 nt, Shigella flexneri 2a str. 301
gcacggauaccgcacgcu

SEQ ID NO: 1973653 - RNA, 18 nt, Shigella flexneri 2a str. 301
gcacgcuugccugugcca

SEQ ID NO: 1973654 - RNA, 18 nt, Shigella flexneri 2a str. 301
gcacgcucuguucugcgc

SEQ ID NO: 1973655 - RNA, 17 nt, Shigella flexneri 2a str. 301
gcacuauacaaccagau

SEQ ID NO: 1973656 - RNA, 14 nt, Shigella flexneri 2a str. 301
gcacuaccgcccga

SEQ ID NO: 1973657 - RNA, 23 nt, Shigella flexneri 2a str. 301
gcacuaugugccagcuucccgcu

SEQ ID NO: 1973658 - RNA, 15 nt, Shigella flexneri 2a str. 301
gcacucaaaacuaca

SEQ ID NO: 1973659 - RNA, 16 nt, Shigella flexneri 2a str. 301
gcacuaugugccagcu

SEQ ID NO: 1973660 - RNA, 18 nt, Shigella flexneri 2a str. 301
gcacucagguaacaggga

SEQ ID NO: 1973661 - RNA, 21 nt, Shigella flexneri 2a str. 301
gcacguuagaaacaaaaaaac

SEQ ID NO: 1973662 - RNA, 19 nt, Shigella flexneri 2a str. 301
gcacguuagaaacaaaaaa

SEQ ID NO: 1973663 - RNA, 19 nt, Shigella flexneri 2a str. 301
gcacguugucagcaacugu

SEQ ID NO: 1973664 - RNA, 14 nt, Shigella flexneri 2a str. 301
gcacguucauccca

SEQ ID NO: 1973665 - RNA, 17 nt, Shigella flexneri 2a str. 301
gcacguuuugcggaugc

SEQ ID NO: 1973666 - RNA, 16 nt, Shigella flexneri 2a str. 301
gcacugcgcccgccag

SEQ ID NO: 1973667 - RNA, 18 nt, Shigella flexneri 2a str. 301
gcacugcgcccgccagca

SEQ ID NO: 1973668 - RNA, 19 nt, Shigella flexneri 2a str. 301
gcacugcuuaaauuucuua

SEQ ID NO: 1973669 - RNA, 15 nt, Shigella flexneri 2a str. 301
gcacugcuugaagcg

SEQ ID NO: 1973670 - RNA, 12 nt, Shigella flexneri 2a str. 301
gcacugauucau

SEQ ID NO: 1973671 - RNA, 23 nt, Shigella flexneri 2a str. 301
gcacugauuuuuuccaacaggcg

SEQ ID NO: 1973672 - RNA, 15 nt, Shigella flexneri 2a str. 301
gcacugcaggcugau

SEQ ID NO: 1973673 - RNA, 16 nt, Shigella flexneri 2a str. 301
gcacugaccaccacca

SEQ ID NO: 1973674 - RNA, 13 nt, Shigella flexneri 2a str. 301
gcacucugacgga

SEQ ID NO: 1973675 - RNA, 20 nt, Shigella flexneri 2a str. 301
gcacugaucgucagguuuug

SEQ ID NO: 1973676 - RNA, 18 nt, Shigella flexneri 2a str. 301
gcacucgcccugaccugc

SEQ ID NO: 1973677 - RNA, 14 nt, Shigella flexneri 2a str. 301
gcacucgcagaagc

SEQ ID NO: 1973678 - RNA, 22 nt, Shigella flexneri 2a str. 301
gcccgcaacaaacuuaugcugc

SEQ ID NO: 1973679 - RNA, 17 nt, Shigella flexneri 2a str. 301
gcccgauggcaucacca

SEQ ID NO: 1973680 - RNA, 18 nt, Shigella flexneri 2a str. 301
gcccgauuaacuggggca

SEQ ID NO: 1973681 - RNA, 15 nt, Shigella flexneri 2a str. 301
gcccggcaacaacag

SEQ ID NO: 1973682 - RNA, 13 nt, Shigella flexneri 2a str. 301
gcccggaggaugc

SEQ ID NO: 1973683 - RNA, 16 nt, Shigella flexneri 2a str. 301
gccccgguuucucuuc

SEQ ID NO: 1973684 - RNA, 15 nt, Shigella flexneri 2a str. 301
gccccgguggcgcug

SEQ ID NO: 1973685 - RNA, 15 nt, Shigella flexneri 2a str. 301
gccccgugaugaacu

SEQ ID NO: 1973686 - RNA, 17 nt, Shigella flexneri 2a str. 301
gccccguugccacccau

SEQ ID NO: 1973687 - RNA, 16 nt, Shigella flexneri 2a str. 301
gcccagcgcgccgcca

SEQ ID NO: 1973688 - RNA, 22 nt, Shigella flexneri 2a str. 301
gccccugagcguuacccgcagc

SEQ ID NO: 1973689 - RNA, 21 nt, Shigella flexneri 2a str. 301
gccccugagcguuacccgcag

SEQ ID NO: 1973690 - RNA, 14 nt, Shigella flexneri 2a str. 301
gcccgaugaccuug

SEQ ID NO: 1973691 - RNA, 23 nt, Shigella flexneri 2a str. 301
gcccgguuucgccacggcgcagc

SEQ ID NO: 1973692 - RNA, 17 nt, Shigella flexneri 2a str. 301
gcccgucugggcgcggc

SEQ ID NO: 1973693 - RNA, 15 nt, Shigella flexneri 2a str. 301
gcccgguauccauca

SEQ ID NO: 1973694 - RNA, 14 nt, Shigella flexneri 2a str. 301
gcccgguccgcgca

SEQ ID NO: 1973695 - RNA, 15 nt, Shigella flexneri 2a str. 301
gcccuaggcauagaa

SEQ ID NO: 1973696 - RNA, 15 nt, Shigella flexneri 2a str. 301
gcccuacgcgguucu

SEQ ID NO: 1973697 - RNA, 18 nt, Shigella flexneri 2a str. 301
gcccuaggcauagaaaaa

SEQ ID NO: 1973698 - RNA, 15 nt, Shigella flexneri 2a str. 301
gcccucagcccacau

SEQ ID NO: 1973699 - RNA, 14 nt, Shigella flexneri 2a str. 301
gcccucaaacaaca

SEQ ID NO: 1973700 - RNA, 17 nt, Shigella flexneri 2a str. 301
gcccucgccuuuuugcg

SEQ ID NO: 1973701 - RNA, 21 nt, Shigella flexneri 2a str. 301
gcccugcagcaucaccggaug

SEQ ID NO: 1973702 - RNA, 17 nt, Shigella flexneri 2a str. 301
gcccuggacaacauucc

SEQ ID NO: 1973703 - RNA, 18 nt, Shigella flexneri 2a str. 301
gcccuggacaacauuccu

SEQ ID NO: 1973704 - RNA, 19 nt, Shigella flexneri 2a str. 301
gcccuggauuucaauaacu

SEQ ID NO: 1973705 - RNA, 17 nt, Shigella flexneri 2a str. 301
gcccugucgaggccaau

SEQ ID NO: 1973706 - RNA, 12 nt, Shigella flexneri 2a str. 301
gccgacagagcg

SEQ ID NO: 1973707 - RNA, 15 nt, Shigella flexneri 2a str. 301
gccgaagcagcuacu

SEQ ID NO: 1973708 - RNA, 22 nt, Shigella flexneri 2a str. 301
gccgaacguacgcaauccucuu

SEQ ID NO: 1973709 - RNA, 20 nt, Shigella flexneri 2a str. 301
gccgaagaacauaaacagcg

SEQ ID NO: 1973710 - RNA, 16 nt, Shigella flexneri 2a str. 301
gccgaacuuugcaccc

SEQ ID NO: 1973711 - RNA, 19 nt, Shigella flexneri 2a str. 301
gccgaacuuugcaccccaa

SEQ ID NO: 1973712 - RNA, 23 nt, Shigella flexneri 2a str. 301
gccgaagaaauagaaacuggccc

SEQ ID NO: 1973713 - RNA, 20 nt, Shigella flexneri 2a str. 301
gcccuguuugguugccagcc

SEQ ID NO: 1973714 - RNA, 22 nt, Shigella flexneri 2a str. 301
gcccuuaauuacguuuccgcua

SEQ ID NO: 1973715 - RNA, 18 nt, Shigella flexneri 2a str. 301
gcccuucuggucaugaac

SEQ ID NO: 1973716 - RNA, 19 nt, Shigella flexneri 2a str. 301
gcccuugccaacgcaaacg

SEQ ID NO: 1973717 - RNA, 23 nt, Shigella flexneri 2a str. 301
gcccuugcuggacuugaaccagc

SEQ ID NO: 1973718 - RNA, 22 nt, Shigella flexneri 2a str. 301
gcccuuuguaggccagauaaga

SEQ ID NO: 1973719 - RNA, 22 nt, Shigella flexneri 2a str. 301
gcccuuuuucacgcuaaaagcg

SEQ ID NO: 1973720 - RNA, 17 nt, Shigella flexneri 2a str. 301
gcccuuugcuggcauga

SEQ ID NO: 1973721 - RNA, 15 nt, Shigella flexneri 2a str. 301
gcccuuugcgcauga

SEQ ID NO: 1973722 - RNA, 21 nt, Shigella flexneri 2a str. 301
gccgaacagcgccagacaaac

SEQ ID NO: 1973723 - RNA, 19 nt, Shigella flexneri 2a str. 301
gcccuuuuuucguaaguaa

SEQ ID NO: 1973724 - RNA, 17 nt, Shigella flexneri 2a str. 301
gccgauguugcaugauu

SEQ ID NO: 1973725 - RNA, 15 nt, Shigella flexneri 2a str. 301
gccgcaaaacuucca

SEQ ID NO: 1973726 - RNA, 15 nt, Shigella flexneri 2a str. 301
gccgcaaaacccagg

SEQ ID NO: 1973727 - RNA, 19 nt, Shigella flexneri 2a str. 301
gccgcaacuuuagccgguu

SEQ ID NO: 1973728 - RNA, 18 nt, Shigella flexneri 2a str. 301
gccgauaauaaagccuau

SEQ ID NO: 1973729 - RNA, 23 nt, Shigella flexneri 2a str. 301
gccgauaacaccgauuuuguaaa

SEQ ID NO: 1973730 - RNA, 14 nt, Shigella flexneri 2a str. 301
gccgauccgcguca

SEQ ID NO: 1973731 - RNA, 14 nt, Shigella flexneri 2a str. 301
gccgaucaucaucc

SEQ ID NO: 1973732 - RNA, 22 nt, Shigella flexneri 2a str. 301
gccgagguuggcucaucaagca

SEQ ID NO: 1973733 - RNA, 16 nt, Shigella flexneri 2a str. 301
gccgaguaaaaaaaca

SEQ ID NO: 1973734 - RNA, 21 nt, Shigella flexneri 2a str. 301
gccgauaaauacagcguuaaa

SEQ ID NO: 1973735 - RNA, 15 nt, Shigella flexneri 2a str. 301
gccgaggcacagcag

SEQ ID NO: 1973736 - RNA, 20 nt, Shigella flexneri 2a str. 301
gccgaggcacagcaggccaa

SEQ ID NO: 1973737 - RNA, 21 nt, Shigella flexneri 2a str. 301
gccgaggccaaacucaccauc

SEQ ID NO: 1973738 - RNA, 24 nt, Shigella flexneri 2a str. 301
gccgaggauuuaccggagcgauua

SEQ ID NO: 1973739 - RNA, 20 nt, Shigella flexneri 2a str. 301
gccgagacgagcauaaaagu

SEQ ID NO: 1973740 - RNA, 23 nt, Shigella flexneri 2a str. 301
gccgagacgagcauaaaaguuaa

SEQ ID NO: 1973741 - RNA, 19 nt, Shigella flexneri 2a str. 301
gccgagaauaaaacaggca

SEQ ID NO: 1973742 - RNA, 11 nt, Shigella flexneri 2a str. 301
gccgagcgcca

SEQ ID NO: 1973743 - RNA, 15 nt, Shigella flexneri 2a str. 301
gccgagcgccagcca

SEQ ID NO: 1973744 - RNA, 14 nt, Shigella flexneri 2a str. 301
gccgcgaggcaaau

SEQ ID NO: 1973745 - RNA, 20 nt, Shigella flexneri 2a str. 301
gccgcacaauacauagaaac

SEQ ID NO: 1973746 - RNA, 18 nt, Shigella flexneri 2a str. 301
gccgcaaucaucgacccc

SEQ ID NO: 1973747 - RNA, 17 nt, Shigella flexneri 2a str. 301
gccgccgcuggcgugca

SEQ ID NO: 1973748 - RNA, 22 nt, Shigella flexneri 2a str. 301
gccgccggauagacaugcccgg

SEQ ID NO: 1973749 - RNA, 13 nt, Shigella flexneri 2a str. 301
gccgcuuaaauuu

SEQ ID NO: 1973750 - RNA, 13 nt, Shigella flexneri 2a str. 301
gccggaaccugau

SEQ ID NO: 1973751 - RNA, 20 nt, Shigella flexneri 2a str. 301
gccgcuuggcaagcccagca

SEQ ID NO: 1973752 - RNA, 17 nt, Shigella flexneri 2a str. 301
gccgcuuccagcagacc

SEQ ID NO: 1973753 - RNA, 20 nt, Shigella flexneri 2a str. 301
gccgcuucgcccaaauccuu

SEQ ID NO: 1973754 - RNA, 14 nt, Shigella flexneri 2a str. 301
gccggaauuuuccu

SEQ ID NO: 1973755 - RNA, 16 nt, Shigella flexneri 2a str. 301
gccggaauuuuccuuc

SEQ ID NO: 1973756 - RNA, 14 nt, Shigella flexneri 2a str. 301
gccggaauggugcu

SEQ ID NO: 1973757 - RNA, 13 nt, Shigella flexneri 2a str. 301
gccggacgucagg

SEQ ID NO: 1973758 - RNA, 17 nt, Shigella flexneri 2a str. 301
gccggacguguuuucac

SEQ ID NO: 1973759 - RNA, 18 nt, Shigella flexneri 2a str. 301
gccggacugggcgcgcuc

SEQ ID NO: 1973760 - RNA, 12 nt, Shigella flexneri 2a str. 301
gccggaauaauc

SEQ ID NO: 1973761 - RNA, 13 nt, Shigella flexneri 2a str. 301
gccggaauaauca

SEQ ID NO: 1973762 - RNA, 15 nt, Shigella flexneri 2a str. 301
gccggaauuauccgg

SEQ ID NO: 1973763 - RNA, 17 nt, Shigella flexneri 2a str. 301
gccggaaucagaauccg

SEQ ID NO: 1973764 - RNA, 17 nt, Shigella flexneri 2a str. 301
gccggaaucaacggcaa

SEQ ID NO: 1973765 - RNA, 21 nt, Shigella flexneri 2a str. 301
gccggauguguugcauccggc

SEQ ID NO: 1973766 - RNA, 19 nt, Shigella flexneri 2a str. 301
gccggauguguugcauccg

SEQ ID NO: 1973767 - RNA, 18 nt, Shigella flexneri 2a str. 301
gccggaugucuggaacga

SEQ ID NO: 1973768 - RNA, 21 nt, Shigella flexneri 2a str. 301
gccggaugugaugcauccggc

SEQ ID NO: 1973769 - RNA, 23 nt, Shigella flexneri 2a str. 301
gccggauucacgccaaccagcug

SEQ ID NO: 1973770 - RNA, 21 nt, Shigella flexneri 2a str. 301
gccggaugcgaugcugacgca

SEQ ID NO: 1973771 - RNA, 22 nt, Shigella flexneri 2a str. 301
gccggaugcuguauguuccccu

SEQ ID NO: 1973772 - RNA, 20 nt, Shigella flexneri 2a str. 301
gccggauggaaacauccggc

SEQ ID NO: 1973773 - RNA, 17 nt, Shigella flexneri 2a str. 301
gccggagccagccguug

SEQ ID NO: 1973774 - RNA, 18 nt, Shigella flexneri 2a str. 301
gccgcgucuuauccggcc

SEQ ID NO: 1973775 - RNA, 19 nt, Shigella flexneri 2a str. 301
gccgcguguuuccgggccg

SEQ ID NO: 1973776 - RNA, 17 nt, Shigella flexneri 2a str. 301
gccgcuaucggcaagga

SEQ ID NO: 1973777 - RNA, 17 nt, Shigella flexneri 2a str. 301
gccgcucagucggcgcu

SEQ ID NO: 1973778 - RNA, 14 nt, Shigella flexneri 2a str. 301
gccgcuccagaauc

SEQ ID NO: 1973779 - RNA, 19 nt, Shigella flexneri 2a str. 301
gccggugaccaucagcaug

SEQ ID NO: 1973780 - RNA, 16 nt, Shigella flexneri 2a str. 301
gccggugaccaucagc

SEQ ID NO: 1973781 - RNA, 14 nt, Shigella flexneri 2a str. 301
gccggugcaugauu

SEQ ID NO: 1973782 - RNA, 23 nt, Shigella flexneri 2a str. 301
gccgguagucaccgcccagugca

SEQ ID NO: 1973783 - RNA, 22 nt, Shigella flexneri 2a str. 301
gccgggcuaaccgcuuuuccag

SEQ ID NO: 1973784 - RNA, 17 nt, Shigella flexneri 2a str. 301
gccggccagcgccacca

SEQ ID NO: 1973785 - RNA, 21 nt, Shigella flexneri 2a str. 301
gccgggaagcucucuuccagu

SEQ ID NO: 1973786 - RNA, 19 nt, Shigella flexneri 2a str. 301
gccguccugcguuucuucu

SEQ ID NO: 1973787 - RNA, 18 nt, Shigella flexneri 2a str. 301
gccgucgccacaaccagc

SEQ ID NO: 1973788 - RNA, 21 nt, Shigella flexneri 2a str. 301
gccguuauccugaucaagcac

SEQ ID NO: 1973789 - RNA, 19 nt, Shigella flexneri 2a str. 301
gccgugcugugugccgcga

SEQ ID NO: 1973790 - RNA, 18 nt, Shigella flexneri 2a str. 301
gccgugcugccagcgauu

SEQ ID NO: 1973791 - RNA, 18 nt, Shigella flexneri 2a str. 301
gccgugaacguggccaug

SEQ ID NO: 1973792 - RNA, 22 nt, Shigella flexneri 2a str. 301
gccgguuuaucuccgcuggagc

SEQ ID NO: 1973793 - RNA, 14 nt, Shigella flexneri 2a str. 301
gccgguuuaucucc

SEQ ID NO: 1973794 - RNA, 17 nt, Shigella flexneri 2a str. 301
gccgguuuugcaggaaa

SEQ ID NO: 1973795 - RNA, 22 nt, Shigella flexneri 2a str. 301
gccgguuuuacagaaucuggcc

SEQ ID NO: 1973796 - RNA, 17 nt, Shigella flexneri 2a str. 301
gccgguuugcgccgugc

SEQ ID NO: 1973797 - RNA, 18 nt, Shigella flexneri 2a str. 301
gccguaaaucccgccauu

SEQ ID NO: 1973798 - RNA, 14 nt, Shigella flexneri 2a str. 301
gccguacaggcagc

SEQ ID NO: 1973799 - RNA, 13 nt, Shigella flexneri 2a str. 301
gccgguuccagcu

SEQ ID NO: 1973800 - RNA, 20 nt, Shigella flexneri 2a str. 301
gccgucagccacuucuucca

SEQ ID NO: 1973801 - RNA, 17 nt, Shigella flexneri 2a str. 301
gccgucaucacaccgcg

SEQ ID NO: 1973802 - RNA, 22 nt, Shigella flexneri 2a str. 301
gccgucaccgccugcgauggug

SEQ ID NO: 1973803 - RNA, 18 nt, Shigella flexneri 2a str. 301
gccguaguuccacauaaa

SEQ ID NO: 1973804 - RNA, 23 nt, Shigella flexneri 2a str. 301
gcaucggcaaucacaucaccaua

SEQ ID NO: 1973805 - RNA, 13 nt, Shigella flexneri 2a str. 301
gcaucggcaucaa

SEQ ID NO: 1973806 - RNA, 14 nt, Shigella flexneri 2a str. 301
gcaucggcauaauc

SEQ ID NO: 1973807 - RNA, 23 nt, Shigella flexneri 2a str. 301
gcaucggcaaaacgguaguugaa

SEQ ID NO: 1973808 - RNA, 18 nt, Shigella flexneri 2a str. 301
gcaucggucagacccagu

SEQ ID NO: 1973809 - RNA, 17 nt, Shigella flexneri 2a str. 301
gcaucgggcagcaucgc

SEQ ID NO: 1973810 - RNA, 23 nt, Shigella flexneri 2a str. 301
gcaucgcgacagugcauaaauac

SEQ ID NO: 1973811 - RNA, 21 nt, Shigella flexneri 2a str. 301
gcaucgcgauuaugccgccga

SEQ ID NO: 1973812 - RNA, 18 nt, Shigella flexneri 2a str. 301
gcaucgccaguuuugcca

SEQ ID NO: 1973813 - RNA, 15 nt, Shigella flexneri 2a str. 301
gcaucgccauaauaa

SEQ ID NO: 1973814 - RNA, 20 nt, Shigella flexneri 2a str. 301
gcaucgccauaauaagcgcc

SEQ ID NO: 1973815 - RNA, 20 nt, Shigella flexneri 2a str. 301
gcaucgcaaaccagacgcgc

SEQ ID NO: 1973816 - RNA, 12 nt, Shigella flexneri 2a str. 301
gcaucgcaucaa

SEQ ID NO: 1973817 - RNA, 16 nt, Shigella flexneri 2a str. 301
gcaucgccaaacaggc

SEQ ID NO: 1973818 - RNA, 22 nt, Shigella flexneri 2a str. 301
gcaucgcaaaccagacgcgcgu

SEQ ID NO: 1973819 - RNA, 20 nt, Shigella flexneri 2a str. 301
gcaucgcaacaugcuggccu

SEQ ID NO: 1973820 - RNA, 20 nt, Shigella flexneri 2a str. 301
gcaucgccgggcuaaccgcu

SEQ ID NO: 1973821 - RNA, 18 nt, Shigella flexneri 2a str. 301
gcaucguaguuuuugccc

SEQ ID NO: 1973822 - RNA, 15 nt, Shigella flexneri 2a str. 301
gcaucguccgccagc

SEQ ID NO: 1973823 - RNA, 22 nt, Shigella flexneri 2a str. 301
gcaucguccgccagccuacaga

SEQ ID NO: 1973824 - RNA, 17 nt, Shigella flexneri 2a str. 301
gcaucuacgcucucuuc

SEQ ID NO: 1973825 - RNA, 19 nt, Shigella flexneri 2a str. 301
gcaucuacgcucucuucaa

SEQ ID NO: 1973826 - RNA, 20 nt, Shigella flexneri 2a str. 301
gcaucugguaagugccacac

SEQ ID NO: 1973827 - RNA, 14 nt, Shigella flexneri 2a str. 301
gcaucugcccccgc

SEQ ID NO: 1973828 - RNA, 20 nt, Shigella flexneri 2a str. 301
gcaucuggcauaaacaaagc

SEQ ID NO: 1973829 - RNA, 11 nt, Shigella flexneri 2a str. 301
gcaucuggaug

SEQ ID NO: 1973830 - RNA, 17 nt, Shigella flexneri 2a str. 301
gcaucugauaagcccag

SEQ ID NO: 1973831 - RNA, 12 nt, Shigella flexneri 2a str. 301
gcaucugaaacu

SEQ ID NO: 1973832 - RNA, 20 nt, Shigella flexneri 2a str. 301
gcaugccuaccaaaccugca

SEQ ID NO: 1973833 - RNA, 19 nt, Shigella flexneri 2a str. 301
gcaugcgaaugcagggccg

SEQ ID NO: 1973834 - RNA, 14 nt, Shigella flexneri 2a str. 301
gcaugcauaacaga

SEQ ID NO: 1973835 - RNA, 14 nt, Shigella flexneri 2a str. 301
gcaugcacccucaa

SEQ ID NO: 1973836 - RNA, 20 nt, Shigella flexneri 2a str. 301
gcaugauguaagaugaaaua

SEQ ID NO: 1973837 - RNA, 19 nt, Shigella flexneri 2a str. 301
gcaugauaccgauuacuca

SEQ ID NO: 1973838 - RNA, 21 nt, Shigella flexneri 2a str. 301
gcaugauagcccggauuucca

SEQ ID NO: 1973839 - RNA, 17 nt, Shigella flexneri 2a str. 301
gcaucuuauccagcaac

SEQ ID NO: 1973840 - RNA, 13 nt, Shigella flexneri 2a str. 301
gcaucuuccagcg

SEQ ID NO: 1973841 - RNA, 16 nt, Shigella flexneri 2a str. 301
gcaucuucuucauucc

SEQ ID NO: 1973842 - RNA, 19 nt, Shigella flexneri 2a str. 301
gcaucuucuucuaugccag

SEQ ID NO: 1973843 - RNA, 20 nt, Shigella flexneri 2a str. 301
gcaucuucgcgccaauccag

SEQ ID NO: 1973844 - RNA, 21 nt, Shigella flexneri 2a str. 301
gcaucuugauaccaaaauggc

SEQ ID NO: 1973845 - RNA, 16 nt, Shigella flexneri 2a str. 301
gcaucuugaacgcaaa

SEQ ID NO: 1973846 - RNA, 13 nt, Shigella flexneri 2a str. 301
gcaugacagcgcc

SEQ ID NO: 1973847 - RNA, 15 nt, Shigella flexneri 2a str. 301
gcaugaacaaagcgc

SEQ ID NO: 1973848 - RNA, 21 nt, Shigella flexneri 2a str. 301
gcaugucgguuguacaaaaaa

SEQ ID NO: 1973849 - RNA, 20 nt, Shigella flexneri 2a str. 301
gcauuaaggcaagaaaauua

SEQ ID NO: 1973850 - RNA, 19 nt, Shigella flexneri 2a str. 301
gcauuaagggugaucagcc

SEQ ID NO: 1973851 - RNA, 14 nt, Shigella flexneri 2a str. 301
gcauuaaucugcuc

SEQ ID NO: 1973852 - RNA, 22 nt, Shigella flexneri 2a str. 301
gcauuacuuucggugacuucaa

SEQ ID NO: 1973853 - RNA, 17 nt, Shigella flexneri 2a str. 301
gcauuacgcaauuguuc

SEQ ID NO: 1973854 - RNA, 21 nt, Shigella flexneri 2a str. 301
gcauuacgcucacugcaaaac

SEQ ID NO: 1973855 - RNA, 21 nt, Shigella flexneri 2a str. 301
gcaugguguucagauggccaa

SEQ ID NO: 1973856 - RNA, 23 nt, Shigella flexneri 2a str. 301
gcauggggucagggcuucaaagu

SEQ ID NO: 1973857 - RNA, 14 nt, Shigella flexneri 2a str. 301
gcauggggagaccc

SEQ ID NO: 1973858 - RNA, 11 nt, Shigella flexneri 2a str. 301
gcaugcucagu

SEQ ID NO: 1973859 - RNA, 17 nt, Shigella flexneri 2a str. 301
gcauggcaauaaccgcu

SEQ ID NO: 1973860 - RNA, 16 nt, Shigella flexneri 2a str. 301
gcauggcaauaaccgc

SEQ ID NO: 1973861 - RNA, 23 nt, Shigella flexneri 2a str. 301
gcauuaugagauugagcgauuua

SEQ ID NO: 1973862 - RNA, 21 nt, Shigella flexneri 2a str. 301
gcauucagacacgccgccaga

SEQ ID NO: 1973863 - RNA, 16 nt, Shigella flexneri 2a str. 301
gcauucagaguaucca

SEQ ID NO: 1973864 - RNA, 20 nt, Shigella flexneri 2a str. 301
gcauucagugcaaaugccag

SEQ ID NO: 1973865 - RNA, 14 nt, Shigella flexneri 2a str. 301
gcauucaugaacac

SEQ ID NO: 1973866 - RNA, 15 nt, Shigella flexneri 2a str. 301
gcauucgacauugaa

SEQ ID NO: 1973867 - RNA, 13 nt, Shigella flexneri 2a str. 301
gcauugacaagcu

SEQ ID NO: 1973868 - RNA, 22 nt, Shigella flexneri 2a str. 301
gcauugacgauaucgauaaaga

SEQ ID NO: 1973869 - RNA, 19 nt, Shigella flexneri 2a str. 301
gcauugaacucuucuuccg

SEQ ID NO: 1973870 - RNA, 24 nt, Shigella flexneri 2a str. 301
gcauucgaguaacguucugucucc

SEQ ID NO: 1973871 - RNA, 16 nt, Shigella flexneri 2a str. 301
gcauucggugcucaau

SEQ ID NO: 1973872 - RNA, 16 nt, Shigella flexneri 2a str. 301
gcauucugcuggccug

SEQ ID NO: 1973873 - RNA, 18 nt, Shigella flexneri 2a str. 301
gcauuguguugccgggcg

SEQ ID NO: 1973874 - RNA, 18 nt, Shigella flexneri 2a str. 301
gcauuguuugcaaaauca

SEQ ID NO: 1973875 - RNA, 18 nt, Shigella flexneri 2a str. 301
gcauugguugcuggaaag

SEQ ID NO: 1973876 - RNA, 14 nt, Shigella flexneri 2a str. 301
gcauugguugcugg

SEQ ID NO: 1973877 - RNA, 22 nt, Shigella flexneri 2a str. 301
gcauuuaugccauguucaucaa

SEQ ID NO: 1973878 - RNA, 20 nt, Shigella flexneri 2a str. 301
gcauuuauggugcuaguuau

SEQ ID NO: 1973879 - RNA, 17 nt, Shigella flexneri 2a str. 301
gcauuucccagcaagaa

SEQ ID NO: 1973880 - RNA, 14 nt, Shigella flexneri 2a str. 301
gcauugauaauguu

SEQ ID NO: 1973881 - RNA, 14 nt, Shigella flexneri 2a str. 301
gcauugcgccugca

SEQ ID NO: 1973882 - RNA, 16 nt, Shigella flexneri 2a str. 301
gcauugcgccugcagg

SEQ ID NO: 1973883 - RNA, 17 nt, Shigella flexneri 2a str. 301
gcauuggagacugauga

SEQ ID NO: 1973884 - RNA, 16 nt, Shigella flexneri 2a str. 301
gcauuggguauucauu

SEQ ID NO: 1973885 - RNA, 19 nt, Shigella flexneri 2a str. 301
gccaaauuuggugcucagu

SEQ ID NO: 1973886 - RNA, 21 nt, Shigella flexneri 2a str. 301
gccaaaucauccagacugcuc

SEQ ID NO: 1973887 - RNA, 21 nt, Shigella flexneri 2a str. 301
gccaaaucauccagaccgcuc

SEQ ID NO: 1973888 - RNA, 14 nt, Shigella flexneri 2a str. 301
gccaaaucauccag

SEQ ID NO: 1973889 - RNA, 17 nt, Shigella flexneri 2a str. 301
gccaaauccuuccagcu

SEQ ID NO: 1973890 - RNA, 20 nt, Shigella flexneri 2a str. 301
gccaacagcgacaucaaauu

SEQ ID NO: 1973891 - RNA, 15 nt, Shigella flexneri 2a str. 301
gccaacaaucucuuc

SEQ ID NO: 1973892 - RNA, 18 nt, Shigella flexneri 2a str. 301
gccaacaaucucuuccag

SEQ ID NO: 1973893 - RNA, 20 nt, Shigella flexneri 2a str. 301
gccaaccgucagauccgcca

SEQ ID NO: 1973894 - RNA, 21 nt, Shigella flexneri 2a str. 301
gccaaccccaauguagccgca

SEQ ID NO: 1973895 - RNA, 17 nt, Shigella flexneri 2a str. 301
gccaacccuucugcacg

SEQ ID NO: 1973896 - RNA, 19 nt, Shigella flexneri 2a str. 301
gccaacccuucugcacgcc

SEQ ID NO: 1973897 - RNA, 16 nt, Shigella flexneri 2a str. 301
gccaagauagaaccac

SEQ ID NO: 1973898 - RNA, 15 nt, Shigella flexneri 2a str. 301
gccaagcaccgcauu

SEQ ID NO: 1973899 - RNA, 17 nt, Shigella flexneri 2a str. 301
gccaagcaccgcauuga

SEQ ID NO: 1973900 - RNA, 15 nt, Shigella flexneri 2a str. 301
gccaagaaacaccag

SEQ ID NO: 1973901 - RNA, 14 nt, Shigella flexneri 2a str. 301
gccaagaaagagcg

SEQ ID NO: 1973902 - RNA, 15 nt, Shigella flexneri 2a str. 301
gccaagaaagagcgu

SEQ ID NO: 1973903 - RNA, 15 nt, Shigella flexneri 2a str. 301
gccaacgauaauuca

SEQ ID NO: 1973904 - RNA, 15 nt, Shigella flexneri 2a str. 301
gccaaaauaacuuaa

SEQ ID NO: 1973905 - RNA, 11 nt, Shigella flexneri 2a str. 301
gccaaaaugcc

SEQ ID NO: 1973906 - RNA, 15 nt, Shigella flexneri 2a str. 301
gccaaacgcucccug

SEQ ID NO: 1973907 - RNA, 14 nt, Shigella flexneri 2a str. 301
gccaaauaaaaucc

SEQ ID NO: 1973908 - RNA, 19 nt, Shigella flexneri 2a str. 301
gccaaaguuaucgagcugc

SEQ ID NO: 1973909 - RNA, 17 nt, Shigella flexneri 2a str. 301
gccaaagggcuggcaau

SEQ ID NO: 1973910 - RNA, 23 nt, Shigella flexneri 2a str. 301
gccaaagugacacaaucaaaucc

SEQ ID NO: 1973911 - RNA, 13 nt, Shigella flexneri 2a str. 301
gccaaagccgccg

SEQ ID NO: 1973912 - RNA, 16 nt, Shigella flexneri 2a str. 301
gccaaagccgccgagc

SEQ ID NO: 1973913 - RNA, 17 nt, Shigella flexneri 2a str. 301
gccaaagccgccgagca

SEQ ID NO: 1973914 - RNA, 19 nt, Shigella flexneri 2a str. 301
gccaaagcaccacuccuca

SEQ ID NO: 1973915 - RNA, 19 nt, Shigella flexneri 2a str. 301
gcauuuugcggaucugcuc

SEQ ID NO: 1973916 - RNA, 16 nt, Shigella flexneri 2a str. 301
gcauuuugcaguaaca

SEQ ID NO: 1973917 - RNA, 15 nt, Shigella flexneri 2a str. 301
gcauuuucugcgcau

SEQ ID NO: 1973918 - RNA, 19 nt, Shigella flexneri 2a str. 301
gcauuuuuucacauguuca

SEQ ID NO: 1973919 - RNA, 15 nt, Shigella flexneri 2a str. 301
gcauuuuuaucacgu

SEQ ID NO: 1973920 - RNA, 13 nt, Shigella flexneri 2a str. 301
gccaaaaaaauaa

SEQ ID NO: 1973921 - RNA, 19 nt, Shigella flexneri 2a str. 301
gcauuuccgccaaucaaga

SEQ ID NO: 1973922 - RNA, 21 nt, Shigella flexneri 2a str. 301
gcauuucuccgcguucaauac

SEQ ID NO: 1973923 - RNA, 17 nt, Shigella flexneri 2a str. 301
gcauuucgucuucauca

SEQ ID NO: 1973924 - RNA, 23 nt, Shigella flexneri 2a str. 301
gcauuucgguauaaauaaacccu

SEQ ID NO: 1973925 - RNA, 13 nt, Shigella flexneri 2a str. 301
gcauuuucgucaa

SEQ ID NO: 1973926 - RNA, 14 nt, Shigella flexneri 2a str. 301
gcauuuuacauccu

SEQ ID NO: 1973927 - RNA, 19 nt, Shigella flexneri 2a str. 301
gcauuugagcaggaugccu

SEQ ID NO: 1973928 - RNA, 21 nt, Shigella flexneri 2a str. 301
gccacaccgaggcauucagcc

SEQ ID NO: 1973929 - RNA, 13 nt, Shigella flexneri 2a str. 301
gccacagccagcc

SEQ ID NO: 1973930 - RNA, 16 nt, Shigella flexneri 2a str. 301
gccacagccagccaac

SEQ ID NO: 1973931 - RNA, 16 nt, Shigella flexneri 2a str. 301
gccacagcgccagaca

SEQ ID NO: 1973932 - RNA, 20 nt, Shigella flexneri 2a str. 301
gccacagcgccagacacugg

SEQ ID NO: 1973933 - RNA, 14 nt, Shigella flexneri 2a str. 301
gccacagccgagcg

SEQ ID NO: 1973934 - RNA, 20 nt, Shigella flexneri 2a str. 301
gccacagccgagcgccacca

SEQ ID NO: 1973935 - RNA, 20 nt, Shigella flexneri 2a str. 301
gccaccaauaaugaacgcca

SEQ ID NO: 1973936 - RNA, 16 nt, Shigella flexneri 2a str. 301
gccaccgcgccgggca

SEQ ID NO: 1973937 - RNA, 17 nt, Shigella flexneri 2a str. 301
gccacccugcggcugcu

SEQ ID NO: 1973938 - RNA, 18 nt, Shigella flexneri 2a str. 301
gccacccugcggcugcug

SEQ ID NO: 1973939 - RNA, 23 nt, Shigella flexneri 2a str. 301
gccaccauuuuacguccgcgcac

SEQ ID NO: 1973940 - RNA, 14 nt, Shigella flexneri 2a str. 301
gccaccaccagcac

SEQ ID NO: 1973941 - RNA, 15 nt, Shigella flexneri 2a str. 301
gccaccaccagcaca

SEQ ID NO: 1973942 - RNA, 14 nt, Shigella flexneri 2a str. 301
gccaccaccagcgu

SEQ ID NO: 1973943 - RNA, 19 nt, Shigella flexneri 2a str. 301
gccaauaaaaauaccggcg

SEQ ID NO: 1973944 - RNA, 20 nt, Shigella flexneri 2a str. 301
gccaaucccggaagccacca

SEQ ID NO: 1973945 - RNA, 21 nt, Shigella flexneri 2a str. 301
gccaauccagaacaccauaau

SEQ ID NO: 1973946 - RNA, 16 nt, Shigella flexneri 2a str. 301
gccaauccccagaccu

SEQ ID NO: 1973947 - RNA, 19 nt, Shigella flexneri 2a str. 301
gccaaucagcgcagcaccc

SEQ ID NO: 1973948 - RNA, 16 nt, Shigella flexneri 2a str. 301
gccaaucagcaauaaa

SEQ ID NO: 1973949 - RNA, 17 nt, Shigella flexneri 2a str. 301
gccaaucacucaccugc

SEQ ID NO: 1973950 - RNA, 19 nt, Shigella flexneri 2a str. 301
gccaauaucaaucuucucu

SEQ ID NO: 1973951 - RNA, 22 nt, Shigella flexneri 2a str. 301
gccaauacaaaauuuaacacca

SEQ ID NO: 1973952 - RNA, 17 nt, Shigella flexneri 2a str. 301
gccacaacuucaacguu

SEQ ID NO: 1973953 - RNA, 15 nt, Shigella flexneri 2a str. 301
gccacaauaaacgcg

SEQ ID NO: 1973954 - RNA, 20 nt, Shigella flexneri 2a str. 301
gccacaauaaagcgauaaau

SEQ ID NO: 1973955 - RNA, 19 nt, Shigella flexneri 2a str. 301
gccacaauacugaucauca

SEQ ID NO: 1973956 - RNA, 15 nt, Shigella flexneri 2a str. 301
gccacaaagcagggc

SEQ ID NO: 1973957 - RNA, 15 nt, Shigella flexneri 2a str. 301
gccaauuacgcaggc

SEQ ID NO: 1973958 - RNA, 23 nt, Shigella flexneri 2a str. 301
gccaauguguuuauaagccaugu

SEQ ID NO: 1973959 - RNA, 18 nt, Shigella flexneri 2a str. 301
gccacuuucacgccgcca

SEQ ID NO: 1973960 - RNA, 11 nt, Shigella flexneri 2a str. 301
gccacuucugc

SEQ ID NO: 1973961 - RNA, 17 nt, Shigella flexneri 2a str. 301
gccacuucuguuacucc

SEQ ID NO: 1973962 - RNA, 18 nt, Shigella flexneri 2a str. 301
gccacuucuuccagcggc

SEQ ID NO: 1973963 - RNA, 18 nt, Shigella flexneri 2a str. 301
gccacuucguaaccagcc

SEQ ID NO: 1973964 - RNA, 14 nt, Shigella flexneri 2a str. 301
gccacuuucggcag

SEQ ID NO: 1973965 - RNA, 21 nt, Shigella flexneri 2a str. 301
gccacuuuccuuagaagcacu

SEQ ID NO: 1973966 - RNA, 20 nt, Shigella flexneri 2a str. 301
gccagaaaaccuggcgcagu

SEQ ID NO: 1973967 - RNA, 13 nt, Shigella flexneri 2a str. 301
gccagaaagaacc

SEQ ID NO: 1973968 - RNA, 21 nt, Shigella flexneri 2a str. 301
gccagaaaguacggccacugg

SEQ ID NO: 1973969 - RNA, 13 nt, Shigella flexneri 2a str. 301
gccacugcgccau

SEQ ID NO: 1973970 - RNA, 17 nt, Shigella flexneri 2a str. 301
gccaccggcacauccag

SEQ ID NO: 1973971 - RNA, 11 nt, Shigella flexneri 2a str. 301
gccacuggccc

SEQ ID NO: 1973972 - RNA, 13 nt, Shigella flexneri 2a str. 301
gccacuggcuggg

SEQ ID NO: 1973973 - RNA, 14 nt, Shigella flexneri 2a str. 301
gccacugcggcuuu

SEQ ID NO: 1973974 - RNA, 21 nt, Shigella flexneri 2a str. 301
gccagcacagaucgcacuuaa

SEQ ID NO: 1973975 - RNA, 19 nt, Shigella flexneri 2a str. 301
gccagcaagagcaaauaaa

SEQ ID NO: 1973976 - RNA, 22 nt, Shigella flexneri 2a str. 301
gccagcaagagcaaauaaaaca

SEQ ID NO: 1973977 - RNA, 22 nt, Shigella flexneri 2a str. 301
gccagcaacugacugacuucaa

SEQ ID NO: 1973978 - RNA, 22 nt, Shigella flexneri 2a str. 301
gccagcaacaucaaaugcgcag

SEQ ID NO: 1973979 - RNA, 16 nt, Shigella flexneri 2a str. 301
gccagagcccaucaca

SEQ ID NO: 1973980 - RNA, 18 nt, Shigella flexneri 2a str. 301
gccagagcaucaguuaac

SEQ ID NO: 1973981 - RNA, 19 nt, Shigella flexneri 2a str. 301
gccagagcagcaacaagcc

SEQ ID NO: 1973982 - RNA, 14 nt, Shigella flexneri 2a str. 301
gccagcaacacaua

SEQ ID NO: 1973983 - RNA, 14 nt, Shigella flexneri 2a str. 301
gccagcaaauagau

SEQ ID NO: 1973984 - RNA, 20 nt, Shigella flexneri 2a str. 301
gccagaggagccaucaccau

SEQ ID NO: 1973985 - RNA, 15 nt, Shigella flexneri 2a str. 301
gccagagaagcgacu

SEQ ID NO: 1973986 - RNA, 20 nt, Shigella flexneri 2a str. 301
gccagacugcgcuaccagga

SEQ ID NO: 1973987 - RNA, 12 nt, Shigella flexneri 2a str. 301
gccagacgcuga

SEQ ID NO: 1973988 - RNA, 12 nt, Shigella flexneri 2a str. 301
gccagaaaucag

SEQ ID NO: 1973989 - RNA, 15 nt, Shigella flexneri 2a str. 301
gccagccaagcaugu

SEQ ID NO: 1973990 - RNA, 16 nt, Shigella flexneri 2a str. 301
gccagccacaccacuu

SEQ ID NO: 1973991 - RNA, 16 nt, Shigella flexneri 2a str. 301
gccagccacaggcuuu

SEQ ID NO: 1973992 - RNA, 16 nt, Shigella flexneri 2a str. 301
gccagccauucaaucu

SEQ ID NO: 1973993 - RNA, 19 nt, Shigella flexneri 2a str. 301
gccagccauccgucaucca

SEQ ID NO: 1973994 - RNA, 17 nt, Shigella flexneri 2a str. 301
gccagccgaacagcgcc

SEQ ID NO: 1973995 - RNA, 23 nt, Shigella flexneri 2a str. 301
gccagcagcgaaucagcccagcc

SEQ ID NO: 1973996 - RNA, 18 nt, Shigella flexneri 2a str. 301
gccagcagcgaaucagcc

SEQ ID NO: 1973997 - RNA, 14 nt, Shigella flexneri 2a str. 301
gccagcagccauuc

SEQ ID NO: 1973998 - RNA, 14 nt, Shigella flexneri 2a str. 301
gccagcaugacuac

SEQ ID NO: 1973999 - RNA, 14 nt, Shigella flexneri 2a str. 301
gccagcauccggca

SEQ ID NO: 1974000 - RNA, 14 nt, Shigella flexneri 2a str. 301
gccaggugcagccc

SEQ ID NO: 1974001 - RNA, 13 nt, Shigella flexneri 2a str. 301
gccaggguggcuc

SEQ ID NO: 1974002 - RNA, 19 nt, Shigella flexneri 2a str. 301
gccaggugauacguccacc

SEQ ID NO: 1974003 - RNA, 14 nt, Shigella flexneri 2a str. 301
gccagggugcuggc

SEQ ID NO: 1974004 - RNA, 17 nt, Shigella flexneri 2a str. 301
gccagggugcuggcgcu

SEQ ID NO: 1974005 - RNA, 13 nt, Shigella flexneri 2a str. 301
gccaggcuggcag

SEQ ID NO: 1974006 - RNA, 19 nt, Shigella flexneri 2a str. 301
gccaggcaccgcacuggcu

SEQ ID NO: 1974007 - RNA, 16 nt, Shigella flexneri 2a str. 301
gccaggcacgccgcgc

SEQ ID NO: 1974008 - RNA, 16 nt, Shigella flexneri 2a str. 301
gccaggcgcgaaugga

SEQ ID NO: 1974009 - RNA, 23 nt, Shigella flexneri 2a str. 301
gccaggcgcgaauggaaagcccg

SEQ ID NO: 1974010 - RNA, 15 nt, Shigella flexneri 2a str. 301
gccagcugcugugga

SEQ ID NO: 1974011 - RNA, 11 nt, Shigella flexneri 2a str. 301
gccagcuuagu

SEQ ID NO: 1974012 - RNA, 23 nt, Shigella flexneri 2a str. 301
gccaggcaacgaaaggugaagug

SEQ ID NO: 1974013 - RNA, 13 nt, Shigella flexneri 2a str. 301
gccagcgaagaag

SEQ ID NO: 1974014 - RNA, 15 nt, Shigella flexneri 2a str. 301
gccagcgaagccagc

SEQ ID NO: 1974015 - RNA, 18 nt, Shigella flexneri 2a str. 301
gccagcgcgaccagaaaa

SEQ ID NO: 1974016 - RNA, 20 nt, Shigella flexneri 2a str. 301
gccagcgccaguuuuuguuu

SEQ ID NO: 1974017 - RNA, 17 nt, Shigella flexneri 2a str. 301
gccagcucuuuaaacac

SEQ ID NO: 1974018 - RNA, 15 nt, Shigella flexneri 2a str. 301
gccagcgucugagca

SEQ ID NO: 1974019 - RNA, 14 nt, Shigella flexneri 2a str. 301
gccagcgucugagc

SEQ ID NO: 1974020 - RNA, 13 nt, Shigella flexneri 2a str. 301
gccauuaaacaac

SEQ ID NO: 1974021 - RNA, 12 nt, Shigella flexneri 2a str. 301
gccauuaaacaa

SEQ ID NO: 1974022 - RNA, 22 nt, Shigella flexneri 2a str. 301
gccauuagcaaauuauccccca

SEQ ID NO: 1974023 - RNA, 17 nt, Shigella flexneri 2a str. 301
gccauugaccagcugcc

SEQ ID NO: 1974024 - RNA, 19 nt, Shigella flexneri 2a str. 301
gccauugcccgaugcgcaa

SEQ ID NO: 1974025 - RNA, 22 nt, Shigella flexneri 2a str. 301
gccauuccuggggucaucagca

SEQ ID NO: 1974026 - RNA, 16 nt, Shigella flexneri 2a str. 301
gccauucacucuuuaa

SEQ ID NO: 1974027 - RNA, 22 nt, Shigella flexneri 2a str. 301
gccauggcuucucgccagccuc

SEQ ID NO: 1974028 - RNA, 21 nt, Shigella flexneri 2a str. 301
gccauggcugcgauaguggaa

SEQ ID NO: 1974029 - RNA, 22 nt, Shigella flexneri 2a str. 301
gccaugcuuugcaucccagaaa

SEQ ID NO: 1974030 - RNA, 15 nt, Shigella flexneri 2a str. 301
gccaucuucuugcag

SEQ ID NO: 1974031 - RNA, 15 nt, Shigella flexneri 2a str. 301
gccaucugccgauac

SEQ ID NO: 1974032 - RNA, 14 nt, Shigella flexneri 2a str. 301
gccaucugccugau

SEQ ID NO: 1974033 - RNA, 14 nt, Shigella flexneri 2a str. 301
gccaucuggcugac

SEQ ID NO: 1974034 - RNA, 17 nt, Shigella flexneri 2a str. 301
gccaucuggcugacggu

SEQ ID NO: 1974035 - RNA, 18 nt, Shigella flexneri 2a str. 301
gccaugaccgcuccgcca

SEQ ID NO: 1974036 - RNA, 18 nt, Shigella flexneri 2a str. 301
gccaucaucccuacaggu

SEQ ID NO: 1974037 - RNA, 12 nt, Shigella flexneri 2a str. 301
gccaucagcagc

SEQ ID NO: 1974038 - RNA, 21 nt, Shigella flexneri 2a str. 301
gccaucgcauagcgcaauaac

SEQ ID NO: 1974039 - RNA, 23 nt, Shigella flexneri 2a str. 301
gccaucucugcaacgucuucccg

SEQ ID NO: 1974040 - RNA, 14 nt, Shigella flexneri 2a str. 301
gccaucucuuccag

SEQ ID NO: 1974041 - RNA, 19 nt, Shigella flexneri 2a str. 301
gccaucgaguaccccuugu

SEQ ID NO: 1974042 - RNA, 17 nt, Shigella flexneri 2a str. 301
gccagucaguuaagcaa

SEQ ID NO: 1974043 - RNA, 15 nt, Shigella flexneri 2a str. 301
gccauauuucuccau

SEQ ID NO: 1974044 - RNA, 14 nt, Shigella flexneri 2a str. 301
gccaucaacacuuu

SEQ ID NO: 1974045 - RNA, 14 nt, Shigella flexneri 2a str. 301
gccaucaaauagcc

SEQ ID NO: 1974046 - RNA, 17 nt, Shigella flexneri 2a str. 301
gccaucaaugccgcaac

SEQ ID NO: 1974047 - RNA, 18 nt, Shigella flexneri 2a str. 301
gccaucaaugccgcaacu

SEQ ID NO: 1974048 - RNA, 17 nt, Shigella flexneri 2a str. 301
gcccaaucaucgcggca

SEQ ID NO: 1974049 - RNA, 20 nt, Shigella flexneri 2a str. 301
gcccacaccagucagcgaac

SEQ ID NO: 1974050 - RNA, 15 nt, Shigella flexneri 2a str. 301
gcccaacuguugauc

SEQ ID NO: 1974051 - RNA, 21 nt, Shigella flexneri 2a str. 301
gcccaacuguugauccaggag

SEQ ID NO: 1974052 - RNA, 22 nt, Shigella flexneri 2a str. 301
gcccaacgcauaaucuguuuca

SEQ ID NO: 1974053 - RNA, 12 nt, Shigella flexneri 2a str. 301
gcccaaaccacc

SEQ ID NO: 1974054 - RNA, 16 nt, Shigella flexneri 2a str. 301
gccauuugggcggcuu

SEQ ID NO: 1974055 - RNA, 20 nt, Shigella flexneri 2a str. 301
gccauuuccccaaucuucuc

SEQ ID NO: 1974056 - RNA, 20 nt, Shigella flexneri 2a str. 301
gccauugccggugauugcaa

SEQ ID NO: 1974057 - RNA, 22 nt, Shigella flexneri 2a str. 301
gccauuggcauaaauaauaaga

SEQ ID NO: 1974058 - RNA, 18 nt, Shigella flexneri 2a str. 301
gcccacgccgcccagaga

SEQ ID NO: 1974059 - RNA, 15 nt, Shigella flexneri 2a str. 301
gcccagaacaaauaa

SEQ ID NO: 1974060 - RNA, 18 nt, Shigella flexneri 2a str. 301
gcccacgccaucauaccc

SEQ ID NO: 1974061 - RNA, 13 nt, Shigella flexneri 2a str. 301
gcccacgccgccc

SEQ ID NO: 1974062 - RNA, 12 nt, Shigella flexneri 2a str. 301
gcccaccuggcu

SEQ ID NO: 1974063 - RNA, 17 nt, Shigella flexneri 2a str. 301
gcccaccuacaccggca

SEQ ID NO: 1974064 - RNA, 22 nt, Shigella flexneri 2a str. 301
gcccagaccugcguucagcagu

SEQ ID NO: 1974065 - RNA, 16 nt, Shigella flexneri 2a str. 301
gcccagacaaaugaac

SEQ ID NO: 1974066 - RNA, 19 nt, Shigella flexneri 2a str. 301
gcccagagaacuggcggca

SEQ ID NO: 1974067 - RNA, 17 nt, Shigella flexneri 2a str. 301
gcccagcgcaucaggca

SEQ ID NO: 1974068 - RNA, 20 nt, Shigella flexneri 2a str. 301
gcuacuuuuuucacccacac

SEQ ID NO: 1974069 - RNA, 21 nt, Shigella flexneri 2a str. 301
gcguuucacauucgccgccga

SEQ ID NO: 1974070 - RNA, 16 nt, Shigella flexneri 2a str. 301
gcguuucaacaaacga

SEQ ID NO: 1974071 - RNA, 17 nt, Shigella flexneri 2a str. 301
gcguuuaugaguauuua

SEQ ID NO: 1974072 - RNA, 15 nt, Shigella flexneri 2a str. 301
gcguuuaccugccug

SEQ ID NO: 1974073 - RNA, 19 nt, Shigella flexneri 2a str. 301
gcuagcuggcucgacaaaa

SEQ ID NO: 1974074 - RNA, 21 nt, Shigella flexneri 2a str. 301
gcuauaccccaccccgaaaug

SEQ ID NO: 1974075 - RNA, 14 nt, Shigella flexneri 2a str. 301
gcuaucuuucaaca

SEQ ID NO: 1974076 - RNA, 18 nt, Shigella flexneri 2a str. 301
gcuaugaaagaaaaucaa

SEQ ID NO: 1974077 - RNA, 20 nt, Shigella flexneri 2a str. 301
gcuaucgcugauauacccuu

SEQ ID NO: 1974078 - RNA, 23 nt, Shigella flexneri 2a str. 301
gcuaucccaugccagugagugaa

SEQ ID NO: 1974079 - RNA, 19 nt, Shigella flexneri 2a str. 301
gcuaucagcgccaccacaa

SEQ ID NO: 1974080 - RNA, 17 nt, Shigella flexneri 2a str. 301
gcuaucagcgccaccac

SEQ ID NO: 1974081 - RNA, 14 nt, Shigella flexneri 2a str. 301
gcuauaucgcugau

SEQ ID NO: 1974082 - RNA, 16 nt, Shigella flexneri 2a str. 301
gcuauuugcccaccug

SEQ ID NO: 1974083 - RNA, 17 nt, Shigella flexneri 2a str. 301
gcuauuugcccaccugc

SEQ ID NO: 1974084 - RNA, 16 nt, Shigella flexneri 2a str. 301
gcucaaaacaaaaacc

SEQ ID NO: 1974085 - RNA, 13 nt, Shigella flexneri 2a str. 301
gcuauuuaacagu

SEQ ID NO: 1974086 - RNA, 14 nt, Shigella flexneri 2a str. 301
gcuauugcggauga

SEQ ID NO: 1974087 - RNA, 13 nt, Shigella flexneri 2a str. 301
gcuauucagcagu

SEQ ID NO: 1974088 - RNA, 17 nt, Shigella flexneri 2a str. 301
gcuauuacgcacacuuu

SEQ ID NO: 1974089 - RNA, 15 nt, Shigella flexneri 2a str. 301
gcucacgcccaucag

SEQ ID NO: 1974090 - RNA, 14 nt, Shigella flexneri 2a str. 301
gcucacgcgcugcc

SEQ ID NO: 1974091 - RNA, 13 nt, Shigella flexneri 2a str. 301
gcucaccugcaca

SEQ ID NO: 1974092 - RNA, 14 nt, Shigella flexneri 2a str. 301
gcucaccugacugu

SEQ ID NO: 1974093 - RNA, 18 nt, Shigella flexneri 2a str. 301
gcucaagcguuucaucuu

SEQ ID NO: 1974094 - RNA, 13 nt, Shigella flexneri 2a str. 301
gcucaacaauaaa

SEQ ID NO: 1974095 - RNA, 10 nt, Shigella flexneri 2a str. 301
gcucaaaucc

SEQ ID NO: 1974096 - RNA, 17 nt, Shigella flexneri 2a str. 301
gcucaaauccaucagac

SEQ ID NO: 1974097 - RNA, 13 nt, Shigella flexneri 2a str. 301
gcucaaagauauu

SEQ ID NO: 1974098 - RNA, 22 nt, Shigella flexneri 2a str. 301
gcucaaaguaaucaagcccugg

SEQ ID NO: 1974099 - RNA, 22 nt, Shigella flexneri 2a str. 301
gcucaaagacgcgguaaaagcc

SEQ ID NO: 1974100 - RNA, 14 nt, Shigella flexneri 2a str. 301
gcucaaaccagcga

SEQ ID NO: 1974101 - RNA, 23 nt, Shigella flexneri 2a str. 301
gcucaacugccaguucccccugc

SEQ ID NO: 1974102 - RNA, 22 nt, Shigella flexneri 2a str. 301
gcucaacgcguggaucaagcaa

SEQ ID NO: 1974103 - RNA, 22 nt, Shigella flexneri 2a str. 301
gcuccugcauugacucgccuuc

SEQ ID NO: 1974104 - RNA, 21 nt, Shigella flexneri 2a str. 301
gcuccggcgggguuuuuugua

SEQ ID NO: 1974105 - RNA, 19 nt, Shigella flexneri 2a str. 301
gcuccgccaucuucuugca

SEQ ID NO: 1974106 - RNA, 18 nt, Shigella flexneri 2a str. 301
gcucccgcagccacuccu

SEQ ID NO: 1974107 - RNA, 16 nt, Shigella flexneri 2a str. 301
gcucgagagagaaaau

SEQ ID NO: 1974108 - RNA, 18 nt, Shigella flexneri 2a str. 301
gcucgacgagaauuuccu

SEQ ID NO: 1974109 - RNA, 17 nt, Shigella flexneri 2a str. 301
gcucgacgauaucggag

SEQ ID NO: 1974110 - RNA, 21 nt, Shigella flexneri 2a str. 301
gcuccuggcgguuaauaauga

SEQ ID NO: 1974111 - RNA, 19 nt, Shigella flexneri 2a str. 301
gcuccuguaugacccggua

SEQ ID NO: 1974112 - RNA, 20 nt, Shigella flexneri 2a str. 301
gcuccuggcgaaucaggacc

SEQ ID NO: 1974113 - RNA, 18 nt, Shigella flexneri 2a str. 301
gcuccuuaauaaaauacu

SEQ ID NO: 1974114 - RNA, 16 nt, Shigella flexneri 2a str. 301
gcucagcgcauccugc

SEQ ID NO: 1974115 - RNA, 18 nt, Shigella flexneri 2a str. 301
gcuccacaagcuccggcu

SEQ ID NO: 1974116 - RNA, 20 nt, Shigella flexneri 2a str. 301
gcucaucuaaugcaggggcg

SEQ ID NO: 1974117 - RNA, 21 nt, Shigella flexneri 2a str. 301
gcucaucggcauacagcgaca

SEQ ID NO: 1974118 - RNA, 12 nt, Shigella flexneri 2a str. 301
gcuccacgcugc

SEQ ID NO: 1974119 - RNA, 19 nt, Shigella flexneri 2a str. 301
gcucccaggcuccgccaga

SEQ ID NO: 1974120 - RNA, 20 nt, Shigella flexneri 2a str. 301
gcuccaguaccugcaaaccg

SEQ ID NO: 1974121 - RNA, 17 nt, Shigella flexneri 2a str. 301
gcuccagguccuccugu

SEQ ID NO: 1974122 - RNA, 16 nt, Shigella flexneri 2a str. 301
gcugacguagcagcuc

SEQ ID NO: 1974123 - RNA, 16 nt, Shigella flexneri 2a str. 301
gcugacguagcaguuc

SEQ ID NO: 1974124 - RNA, 21 nt, Shigella flexneri 2a str. 301
gcugacggugccagguaaaca

SEQ ID NO: 1974125 - RNA, 17 nt, Shigella flexneri 2a str. 301
gcugacuuugauccagc

SEQ ID NO: 1974126 - RNA, 22 nt, Shigella flexneri 2a str. 301
gcugacuccccgauuguugaug

SEQ ID NO: 1974127 - RNA, 21 nt, Shigella flexneri 2a str. 301
gcugagcaaacaguucugcag

SEQ ID NO: 1974128 - RNA, 18 nt, Shigella flexneri 2a str. 301
gcugagguuaugcaaacg

SEQ ID NO: 1974129 - RNA, 23 nt, Shigella flexneri 2a str. 301
gcugagcgugccccugaauaauc

SEQ ID NO: 1974130 - RNA, 22 nt, Shigella flexneri 2a str. 301
gcugauuaaaaccgaggggcug

SEQ ID NO: 1974131 - RNA, 19 nt, Shigella flexneri 2a str. 301
gcugauggcgccaguuauu

SEQ ID NO: 1974132 - RNA, 22 nt, Shigella flexneri 2a str. 301
gcugauggucagugccugcgcc

SEQ ID NO: 1974133 - RNA, 18 nt, Shigella flexneri 2a str. 301
gcugaugccaggcucgga

SEQ ID NO: 1974134 - RNA, 15 nt, Shigella flexneri 2a str. 301
gcugaugcaggcgau

SEQ ID NO: 1974135 - RNA, 16 nt, Shigella flexneri 2a str. 301
gcugaugcagcgauga

SEQ ID NO: 1974136 - RNA, 22 nt, Shigella flexneri 2a str. 301
gcugaugauuaacagcaaacag

SEQ ID NO: 1974137 - RNA, 12 nt, Shigella flexneri 2a str. 301
gcugaugacgcg

SEQ ID NO: 1974138 - RNA, 13 nt, Shigella flexneri 2a str. 301
gcugauauuuauc

SEQ ID NO: 1974139 - RNA, 19 nt, Shigella flexneri 2a str. 301
gcugauacuccaugaguaa

SEQ ID NO: 1974140 - RNA, 13 nt, Shigella flexneri 2a str. 301
gcugauaaacaag

SEQ ID NO: 1974141 - RNA, 19 nt, Shigella flexneri 2a str. 301
gcugauaaaacucucaucu

SEQ ID NO: 1974142 - RNA, 20 nt, Shigella flexneri 2a str. 301
gcugauaaaguguucuccau

SEQ ID NO: 1974143 - RNA, 22 nt, Shigella flexneri 2a str. 301
gcugaccagacuggagcacugc

SEQ ID NO: 1974144 - RNA, 16 nt, Shigella flexneri 2a str. 301
gcugaccagacuggag

SEQ ID NO: 1974145 - RNA, 22 nt, Shigella flexneri 2a str. 301
gcugacauaaacaccagcaaua

SEQ ID NO: 1974146 - RNA, 13 nt, Shigella flexneri 2a str. 301
gcugaccaccagc

SEQ ID NO: 1974147 - RNA, 18 nt, Shigella flexneri 2a str. 301
gcugacauaaacaccagc

SEQ ID NO: 1974148 - RNA, 17 nt, Shigella flexneri 2a str. 301
gcugacauaaacaccag

SEQ ID NO: 1974149 - RNA, 17 nt, Shigella flexneri 2a str. 301
gcugacaggcgcugaug

SEQ ID NO: 1974150 - RNA, 15 nt, Shigella flexneri 2a str. 301
gcugacgcaucuucu

SEQ ID NO: 1974151 - RNA, 19 nt, Shigella flexneri 2a str. 301
gcugacgauuguagaaaau

SEQ ID NO: 1974152 - RNA, 22 nt, Shigella flexneri 2a str. 301
gcugacgcaacugguccagccc

SEQ ID NO: 1974153 - RNA, 18 nt, Shigella flexneri 2a str. 301
gcugaccguacccgcugc

SEQ ID NO: 1974154 - RNA, 20 nt, Shigella flexneri 2a str. 301
gcugaccgucaaagcgccag

SEQ ID NO: 1974155 - RNA, 21 nt, Shigella flexneri 2a str. 301
gcugaccuucaaauccucaau

SEQ ID NO: 1974156 - RNA, 21 nt, Shigella flexneri 2a str. 301
gcugaaugaggcuuuaauacc

SEQ ID NO: 1974157 - RNA, 13 nt, Shigella flexneri 2a str. 301
gcugaauccccuu

SEQ ID NO: 1974158 - RNA, 19 nt, Shigella flexneri 2a str. 301
gcugaauggcgauuucaca

SEQ ID NO: 1974159 - RNA, 15 nt, Shigella flexneri 2a str. 301
gcugaaucaacaggc

SEQ ID NO: 1974160 - RNA, 16 nt, Shigella flexneri 2a str. 301
gcugaauaucuuucuc

SEQ ID NO: 1974161 - RNA, 15 nt, Shigella flexneri 2a str. 301
gcugaauaucuuucu

SEQ ID NO: 1974162 - RNA, 18 nt, Shigella flexneri 2a str. 301
gcugaaagggcaaauaau

SEQ ID NO: 1974163 - RNA, 13 nt, Shigella flexneri 2a str. 301
gcugaacaaagcc

SEQ ID NO: 1974164 - RNA, 14 nt, Shigella flexneri 2a str. 301
gcugaacaaagccg

SEQ ID NO: 1974165 - RNA, 17 nt, Shigella flexneri 2a str. 301
gcugaacgugcucugcg

SEQ ID NO: 1974166 - RNA, 19 nt, Shigella flexneri 2a str. 301
gcugaacugauugccaccc

SEQ ID NO: 1974167 - RNA, 22 nt, Shigella flexneri 2a str. 301
gcugaacugauugccacccugc

SEQ ID NO: 1974168 - RNA, 19 nt, Shigella flexneri 2a str. 301
gcucuccugaacuuucucc

SEQ ID NO: 1974169 - RNA, 11 nt, Shigella flexneri 2a str. 301
gcucucugcua

SEQ ID NO: 1974170 - RNA, 22 nt, Shigella flexneri 2a str. 301
gcucucacuuauuuguuauuac

SEQ ID NO: 1974171 - RNA, 15 nt, Shigella flexneri 2a str. 301
gcucucaaauaucug

SEQ ID NO: 1974172 - RNA, 17 nt, Shigella flexneri 2a str. 301
gcucuacaauauccuca

SEQ ID NO: 1974173 - RNA, 19 nt, Shigella flexneri 2a str. 301
gcucgucacaucaccaaca

SEQ ID NO: 1974174 - RNA, 17 nt, Shigella flexneri 2a str. 301
gcucguucagcggcccg

SEQ ID NO: 1974175 - RNA, 15 nt, Shigella flexneri 2a str. 301
gcucguuaaucagaa

SEQ ID NO: 1974176 - RNA, 16 nt, Shigella flexneri 2a str. 301
gcucuucaauggucag

SEQ ID NO: 1974177 - RNA, 23 nt, Shigella flexneri 2a str. 301
gcucuggcaggcuucaauuuuuu

SEQ ID NO: 1974178 - RNA, 19 nt, Shigella flexneri 2a str. 301
gcucuggcggagcucccag

SEQ ID NO: 1974179 - RNA, 18 nt, Shigella flexneri 2a str. 301
gcucuggugcggcaaaaa

SEQ ID NO: 1974180 - RNA, 19 nt, Shigella flexneri 2a str. 301
gcucugguucaccauucug

SEQ ID NO: 1974181 - RNA, 15 nt, Shigella flexneri 2a str. 301
gcucugguucaccau

SEQ ID NO: 1974182 - RNA, 17 nt, Shigella flexneri 2a str. 301
gcucugccagcaaauag

SEQ ID NO: 1974183 - RNA, 19 nt, Shigella flexneri 2a str. 301
gcucugccagcaaauagau

SEQ ID NO: 1974184 - RNA, 13 nt, Shigella flexneri 2a str. 301
gcucugaggcuga

SEQ ID NO: 1974185 - RNA, 19 nt, Shigella flexneri 2a str. 301
gcucugacaccaucaccca

SEQ ID NO: 1974186 - RNA, 18 nt, Shigella flexneri 2a str. 301
gcucucuuucucgcugac

SEQ ID NO: 1974187 - RNA, 19 nt, Shigella flexneri 2a str. 301
gcucucuuucaccagcgcg

SEQ ID NO: 1974188 - RNA, 22 nt, Shigella flexneri 2a str. 301
gcucuuuugacgcccccaaacu

SEQ ID NO: 1974189 - RNA, 15 nt, Shigella flexneri 2a str. 301
gcucuuuucugaagu

SEQ ID NO: 1974190 - RNA, 23 nt, Shigella flexneri 2a str. 301
gcugaaagaagcggugaaaaaau

SEQ ID NO: 1974191 - RNA, 21 nt, Shigella flexneri 2a str. 301
gcugaaaccgugcaucuguug

SEQ ID NO: 1974192 - RNA, 17 nt, Shigella flexneri 2a str. 301
gcucuucuggcaccagu

SEQ ID NO: 1974193 - RNA, 21 nt, Shigella flexneri 2a str. 301
gcucuucaugcagcaugguca

SEQ ID NO: 1974194 - RNA, 21 nt, Shigella flexneri 2a str. 301
gcucuucaucgcuaaaauacu

SEQ ID NO: 1974195 - RNA, 15 nt, Shigella flexneri 2a str. 301
gcucuuccuucagcu

SEQ ID NO: 1974196 - RNA, 13 nt, Shigella flexneri 2a str. 301
gcucuuccuucag

SEQ ID NO: 1974197 - RNA, 18 nt, Shigella flexneri 2a str. 301
gcgucgcugcucuucagu

SEQ ID NO: 1974198 - RNA, 21 nt, Shigella flexneri 2a str. 301
gcgugagaucgcgcgggagca

SEQ ID NO: 1974199 - RNA, 17 nt, Shigella flexneri 2a str. 301
gcgugagaacaccaccu

SEQ ID NO: 1974200 - RNA, 21 nt, Shigella flexneri 2a str. 301
gcgugacgcuggcagaaaguu

SEQ ID NO: 1974201 - RNA, 15 nt, Shigella flexneri 2a str. 301
gcgugacuaaaaccc

SEQ ID NO: 1974202 - RNA, 19 nt, Shigella flexneri 2a str. 301
gcgugccgugaauauggaa

SEQ ID NO: 1974203 - RNA, 17 nt, Shigella flexneri 2a str. 301
gcgucguucgcgccaac

SEQ ID NO: 1974204 - RNA, 23 nt, Shigella flexneri 2a str. 301
gcgucucaucuuuaucggugaga

SEQ ID NO: 1974205 - RNA, 14 nt, Shigella flexneri 2a str. 301
gcgucucaucuuua

SEQ ID NO: 1974206 - RNA, 20 nt, Shigella flexneri 2a str. 301
gcgugacgaaagucugggcc

SEQ ID NO: 1974207 - RNA, 23 nt, Shigella flexneri 2a str. 301
gcguggcgauaaucagcgccagc

SEQ ID NO: 1974208 - RNA, 16 nt, Shigella flexneri 2a str. 301
gcguggcgcagugccu

SEQ ID NO: 1974209 - RNA, 15 nt, Shigella flexneri 2a str. 301
gcgugucccacuggu

SEQ ID NO: 1974210 - RNA, 13 nt, Shigella flexneri 2a str. 301
gcgugucggacgg

SEQ ID NO: 1974211 - RNA, 13 nt, Shigella flexneri 2a str. 301
gcguguuccagag

SEQ ID NO: 1974212 - RNA, 13 nt, Shigella flexneri 2a str. 301
gcguguggugagg

SEQ ID NO: 1974213 - RNA, 21 nt, Shigella flexneri 2a str. 301
gcguuaacuguacaggcuccu

SEQ ID NO: 1974214 - RNA, 13 nt, Shigella flexneri 2a str. 301
gcguuaaaacagg

SEQ ID NO: 1974215 - RNA, 14 nt, Shigella flexneri 2a str. 301
gcguuuaaucacac

SEQ ID NO: 1974216 - RNA, 16 nt, Shigella flexneri 2a str. 301
gcguugcuaugcugaa

SEQ ID NO: 1974217 - RNA, 23 nt, Shigella flexneri 2a str. 301
gcguucacuguaguuauccgcaa

SEQ ID NO: 1974218 - RNA, 16 nt, Shigella flexneri 2a str. 301
gcguucaucaguucca

SEQ ID NO: 1974219 - RNA, 18 nt, Shigella flexneri 2a str. 301
gcguucauccugcuggug

SEQ ID NO: 1974220 - RNA, 19 nt, Shigella flexneri 2a str. 301
gcguuccauuggcggcguc

SEQ ID NO: 1974221 - RNA, 19 nt, Shigella flexneri 2a str. 301
gcguuccagcaucuccugc

SEQ ID NO: 1974222 - RNA, 23 nt, Shigella flexneri 2a str. 301
gcguuccaucagauucagcagcg

SEQ ID NO: 1974223 - RNA, 17 nt, Shigella flexneri 2a str. 301
gcgucauugacgcuggc

SEQ ID NO: 1974224 - RNA, 22 nt, Shigella flexneri 2a str. 301
gcgucauuuucaucgcuuucuu

SEQ ID NO: 1974225 - RNA, 15 nt, Shigella flexneri 2a str. 301
gcgucccaucggcaa

SEQ ID NO: 1974226 - RNA, 18 nt, Shigella flexneri 2a str. 301
gcgucccagauagcuguc

SEQ ID NO: 1974227 - RNA, 23 nt, Shigella flexneri 2a str. 301
gcguccccugcaauauuuugaau

SEQ ID NO: 1974228 - RNA, 17 nt, Shigella flexneri 2a str. 301
gcguccgguaauuuuua

SEQ ID NO: 1974229 - RNA, 18 nt, Shigella flexneri 2a str. 301
gcguccugccugggacgg

SEQ ID NO: 1974230 - RNA, 19 nt, Shigella flexneri 2a str. 301
gcgucgcaucaggcaucug

SEQ ID NO: 1974231 - RNA, 20 nt, Shigella flexneri 2a str. 301
gcguagcuaccuugcucggc

SEQ ID NO: 1974232 - RNA, 16 nt, Shigella flexneri 2a str. 301
gcguagauucgaaaug

SEQ ID NO: 1974233 - RNA, 22 nt, Shigella flexneri 2a str. 301
gcggugaucccaauauagacaa

SEQ ID NO: 1974234 - RNA, 17 nt, Shigella flexneri 2a str. 301
gcggugcaagcaccuua

SEQ ID NO: 1974235 - RNA, 14 nt, Shigella flexneri 2a str. 301
gcggugaugaugau

SEQ ID NO: 1974236 - RNA, 13 nt, Shigella flexneri 2a str. 301
gcgucagaaacag

SEQ ID NO: 1974237 - RNA, 16 nt, Shigella flexneri 2a str. 301
gcgucagccagaaaga

SEQ ID NO: 1974238 - RNA, 15 nt, Shigella flexneri 2a str. 301
gcgucagcuuucaga

SEQ ID NO: 1974239 - RNA, 18 nt, Shigella flexneri 2a str. 301
gcgucagcauaaaaauau

SEQ ID NO: 1974240 - RNA, 17 nt, Shigella flexneri 2a str. 301
gcgucagccugcucagu

SEQ ID NO: 1974241 - RNA, 23 nt, Shigella flexneri 2a str. 301
gcgucaucggauggucugguuua

SEQ ID NO: 1974242 - RNA, 18 nt, Shigella flexneri 2a str. 301
gcggcggacgugcaccgu

SEQ ID NO: 1974243 - RNA, 15 nt, Shigella flexneri 2a str. 301
gcggcggcaaaauca

SEQ ID NO: 1974244 - RNA, 20 nt, Shigella flexneri 2a str. 301
gcggcggauauguucucggu

SEQ ID NO: 1974245 - RNA, 14 nt, Shigella flexneri 2a str. 301
gcggcgauuaagaa

SEQ ID NO: 1974246 - RNA, 16 nt, Shigella flexneri 2a str. 301
gcggcgcaagcggcga

SEQ ID NO: 1974247 - RNA, 18 nt, Shigella flexneri 2a str. 301
gcggcgcaacccccacac

SEQ ID NO: 1974248 - RNA, 14 nt, Shigella flexneri 2a str. 301
gcggcgcaggcgcu

SEQ ID NO: 1974249 - RNA, 15 nt, Shigella flexneri 2a str. 301
gcggcuagccaggaa

SEQ ID NO: 1974250 - RNA, 15 nt, Shigella flexneri 2a str. 301
gcggcuaagcugggc

SEQ ID NO: 1974251 - RNA, 21 nt, Shigella flexneri 2a str. 301
gcggcuaagcugggcgguggc

SEQ ID NO: 1974252 - RNA, 13 nt, Shigella flexneri 2a str. 301
gcggcuaaaauau

SEQ ID NO: 1974253 - RNA, 23 nt, Shigella flexneri 2a str. 301
gcggcgugaacgccuaauccagc

SEQ ID NO: 1974254 - RNA, 20 nt, Shigella flexneri 2a str. 301
gcggcuuguacgccgccgca

SEQ ID NO: 1974255 - RNA, 12 nt, Shigella flexneri 2a str. 301
gcggcuggcugg

SEQ ID NO: 1974256 - RNA, 12 nt, Shigella flexneri 2a str. 301
gcggcuggcgca

SEQ ID NO: 1974257 - RNA, 13 nt, Shigella flexneri 2a str. 301
gcggcuccagaau

SEQ ID NO: 1974258 - RNA, 22 nt, Shigella flexneri 2a str. 301
gcggcucauugccauucgccag

SEQ ID NO: 1974259 - RNA, 15 nt, Shigella flexneri 2a str. 301
gcgguacucgcgcag

SEQ ID NO: 1974260 - RNA, 20 nt, Shigella flexneri 2a str. 301
gcgguaaagcgcggcaguga

SEQ ID NO: 1974261 - RNA, 16 nt, Shigella flexneri 2a str. 301
gcgguaaacugcauga

SEQ ID NO: 1974262 - RNA, 20 nt, Shigella flexneri 2a str. 301
gcgguaaauuuuuugaucaa

SEQ ID NO: 1974263 - RNA, 19 nt, Shigella flexneri 2a str. 301
gcgguaguuucuccccaug

SEQ ID NO: 1974264 - RNA, 15 nt, Shigella flexneri 2a str. 301
gcggugaccagcagc

SEQ ID NO: 1974265 - RNA, 23 nt, Shigella flexneri 2a str. 301
gcgggcgguaagccggagcuggc

SEQ ID NO: 1974266 - RNA, 14 nt, Shigella flexneri 2a str. 301
gcgccgcuuucucu

SEQ ID NO: 1974267 - RNA, 22 nt, Shigella flexneri 2a str. 301
gcgccggcucauacucugucug

SEQ ID NO: 1974268 - RNA, 16 nt, Shigella flexneri 2a str. 301
gcgccgccucagccag

SEQ ID NO: 1974269 - RNA, 18 nt, Shigella flexneri 2a str. 301
gcgccugcggccagcagc

SEQ ID NO: 1974270 - RNA, 12 nt, Shigella flexneri 2a str. 301
gcgccugggccg

SEQ ID NO: 1974271 - RNA, 19 nt, Shigella flexneri 2a str. 301
gcgccuucauucaggccaa

SEQ ID NO: 1974272 - RNA, 17 nt, Shigella flexneri 2a str. 301
gcgccuuauccugccug

SEQ ID NO: 1974273 - RNA, 15 nt, Shigella flexneri 2a str. 301
gcgccuuguuaccug

SEQ ID NO: 1974274 - RNA, 19 nt, Shigella flexneri 2a str. 301
gcgccuucgugcggcugca

SEQ ID NO: 1974275 - RNA, 18 nt, Shigella flexneri 2a str. 301
gcgccggucacaucuucc

SEQ ID NO: 1974276 - RNA, 21 nt, Shigella flexneri 2a str. 301
gcgccucaacgccuaaugcca

SEQ ID NO: 1974277 - RNA, 22 nt, Shigella flexneri 2a str. 301
gcgccucaacgccuaaugccag

SEQ ID NO: 1974278 - RNA, 11 nt, Shigella flexneri 2a str. 301
gcgccucccuu

SEQ ID NO: 1974279 - RNA, 22 nt, Shigella flexneri 2a str. 301
gcgccugaccauuaucaaacag

SEQ ID NO: 1974280 - RNA, 14 nt, Shigella flexneri 2a str. 301
gcgccugaucuucc

SEQ ID NO: 1974281 - RNA, 13 nt, Shigella flexneri 2a str. 301
gcgccugauaauc

SEQ ID NO: 1974282 - RNA, 18 nt, Shigella flexneri 2a str. 301
gcgcgggucaccgcggug

SEQ ID NO: 1974283 - RNA, 18 nt, Shigella flexneri 2a str. 301
gcgcgguaaagcgcggca

SEQ ID NO: 1974284 - RNA, 21 nt, Shigella flexneri 2a str. 301
gcgcggucauaaaauccguaa

SEQ ID NO: 1974285 - RNA, 14 nt, Shigella flexneri 2a str. 301
gcgcggcccacuuc

SEQ ID NO: 1974286 - RNA, 13 nt, Shigella flexneri 2a str. 301
gcgcgcguaaauu

SEQ ID NO: 1974287 - RNA, 23 nt, Shigella flexneri 2a str. 301
gcgcgcagugccgguggaagggc

SEQ ID NO: 1974288 - RNA, 22 nt, Shigella flexneri 2a str. 301
gcgcgaucgggaaccggcuggc

SEQ ID NO: 1974289 - RNA, 20 nt, Shigella flexneri 2a str. 301
gcgccuuuuuucgccgcagc

SEQ ID NO: 1974290 - RNA, 15 nt, Shigella flexneri 2a str. 301
gcgcgaugccgccgu

SEQ ID NO: 1974291 - RNA, 15 nt, Shigella flexneri 2a str. 301
gcgcguaaauaccuu

SEQ ID NO: 1974292 - RNA, 15 nt, Shigella flexneri 2a str. 301
gcgcucgacuuuagu

SEQ ID NO: 1974293 - RNA, 11 nt, Shigella flexneri 2a str. 301
gcgcuggcaau

SEQ ID NO: 1974294 - RNA, 23 nt, Shigella flexneri 2a str. 301
gcgcugaagaaaauggccagcca

SEQ ID NO: 1974295 - RNA, 14 nt, Shigella flexneri 2a str. 301
gcgcugaaggcaca

SEQ ID NO: 1974296 - RNA, 17 nt, Shigella flexneri 2a str. 301
gcgcugaaggcacagaa

SEQ ID NO: 1974297 - RNA, 20 nt, Shigella flexneri 2a str. 301
gcgcugaaggcacagaaaaa

SEQ ID NO: 1974298 - RNA, 23 nt, Shigella flexneri 2a str. 301
gcgcugacguuauugaucgccag

SEQ ID NO: 1974299 - RNA, 23 nt, Shigella flexneri 2a str. 301
gcgcugcuguagcaguuccagca

SEQ ID NO: 1974300 - RNA, 16 nt, Shigella flexneri 2a str. 301
gcggaaaucuccagau

SEQ ID NO: 1974301 - RNA, 23 nt, Shigella flexneri 2a str. 301
gcggaaauaucggcgucguugua

SEQ ID NO: 1974302 - RNA, 13 nt, Shigella flexneri 2a str. 301
gcgcuuucgccag

SEQ ID NO: 1974303 - RNA, 18 nt, Shigella flexneri 2a str. 301
gcggaacaucgccugccg

SEQ ID NO: 1974304 - RNA, 12 nt, Shigella flexneri 2a str. 301
gcggaacccagc

SEQ ID NO: 1974305 - RNA, 19 nt, Shigella flexneri 2a str. 301
gcggaagacccggcggcgc

SEQ ID NO: 1974306 - RNA, 21 nt, Shigella flexneri 2a str. 301
gcggaagacccggcggcgcgc

SEQ ID NO: 1974307 - RNA, 13 nt, Shigella flexneri 2a str. 301
gcgcuucugccac

SEQ ID NO: 1974308 - RNA, 22 nt, Shigella flexneri 2a str. 301
gcgcuuaaucaauugcaggaag

SEQ ID NO: 1974309 - RNA, 21 nt, Shigella flexneri 2a str. 301
gcgcuuaaucaauugcaggaa

SEQ ID NO: 1974310 - RNA, 17 nt, Shigella flexneri 2a str. 301
gcgcuuccugcagcuuc

SEQ ID NO: 1974311 - RNA, 12 nt, Shigella flexneri 2a str. 301
gcgcuuccagcu

SEQ ID NO: 1974312 - RNA, 16 nt, Shigella flexneri 2a str. 301
gcggcaacauggcaac

SEQ ID NO: 1974313 - RNA, 15 nt, Shigella flexneri 2a str. 301
gcggcaagcccagcc

SEQ ID NO: 1974314 - RNA, 22 nt, Shigella flexneri 2a str. 301
gcggcaaugaaagcgagcgagc

SEQ ID NO: 1974315 - RNA, 22 nt, Shigella flexneri 2a str. 301
gcggcaauucuuucucgcucag

SEQ ID NO: 1974316 - RNA, 14 nt, Shigella flexneri 2a str. 301
gcggcacagccagc

SEQ ID NO: 1974317 - RNA, 13 nt, Shigella flexneri 2a str. 301
gcggaugacccag

SEQ ID NO: 1974318 - RNA, 21 nt, Shigella flexneri 2a str. 301
gcggaugaggcguuaacagcg

SEQ ID NO: 1974319 - RNA, 19 nt, Shigella flexneri 2a str. 301
gcggauggaguggggcgga

SEQ ID NO: 1974320 - RNA, 18 nt, Shigella flexneri 2a str. 301
gcggauucgaugcccagc

SEQ ID NO: 1974321 - RNA, 21 nt, Shigella flexneri 2a str. 301
gcggauguuggguuagccaac

SEQ ID NO: 1974322 - RNA, 21 nt, Shigella flexneri 2a str. 301
gcggauggccucugccagcug

SEQ ID NO: 1974323 - RNA, 19 nt, Shigella flexneri 2a str. 301
gcggauggccucugccagc

SEQ ID NO: 1974324 - RNA, 20 nt, Shigella flexneri 2a str. 301
gcggacaauaauaucuuuuu

SEQ ID NO: 1974325 - RNA, 19 nt, Shigella flexneri 2a str. 301
gcggacaaugccuaccgca

SEQ ID NO: 1974326 - RNA, 12 nt, Shigella flexneri 2a str. 301
gcggaauaacgc

SEQ ID NO: 1974327 - RNA, 13 nt, Shigella flexneri 2a str. 301
gcggacaaccagc

SEQ ID NO: 1974328 - RNA, 15 nt, Shigella flexneri 2a str. 301
gcggacaaccagcuu

SEQ ID NO: 1974329 - RNA, 16 nt, Shigella flexneri 2a str. 301
gcggaccaacaaaaau

SEQ ID NO: 1974330 - RNA, 21 nt, Shigella flexneri 2a str. 301
gcggacgcacauagcgugaca

SEQ ID NO: 1974331 - RNA, 16 nt, Shigella flexneri 2a str. 301
gcggacgagagaguga

SEQ ID NO: 1974332 - RNA, 18 nt, Shigella flexneri 2a str. 301
gcggacugaacgcggccc

SEQ ID NO: 1974333 - RNA, 14 nt, Shigella flexneri 2a str. 301
gcggacgguucccu

SEQ ID NO: 1974334 - RNA, 22 nt, Shigella flexneri 2a str. 301
gcggagacucaaaccccgcagc

SEQ ID NO: 1974335 - RNA, 19 nt, Shigella flexneri 2a str. 301
gcggaggacguuaaagaaa

SEQ ID NO: 1974336 - RNA, 12 nt, Shigella flexneri 2a str. 301
gcgaaagaaaag

SEQ ID NO: 1974337 - RNA, 21 nt, Shigella flexneri 2a str. 301
gcgaaagcagaaaaagaagcc

SEQ ID NO: 1974338 - RNA, 17 nt, Shigella flexneri 2a str. 301
gcgaaacagggcuggaa

SEQ ID NO: 1974339 - RNA, 20 nt, Shigella flexneri 2a str. 301
gccguuuuuacccagcagca

SEQ ID NO: 1974340 - RNA, 11 nt, Shigella flexneri 2a str. 301
gccguuuucuu

SEQ ID NO: 1974341 - RNA, 16 nt, Shigella flexneri 2a str. 301
gccguuugcugcauga

SEQ ID NO: 1974342 - RNA, 13 nt, Shigella flexneri 2a str. 301
gccguuguucucg

SEQ ID NO: 1974343 - RNA, 17 nt, Shigella flexneri 2a str. 301
gcgaagcccacgccgcc

SEQ ID NO: 1974344 - RNA, 22 nt, Shigella flexneri 2a str. 301
gcgaagcgcauaccuucuugua

SEQ ID NO: 1974345 - RNA, 15 nt, Shigella flexneri 2a str. 301
gcgaauacuccccuu

SEQ ID NO: 1974346 - RNA, 15 nt, Shigella flexneri 2a str. 301
gcgaauccagcaugc

SEQ ID NO: 1974347 - RNA, 15 nt, Shigella flexneri 2a str. 301
gcgaauauggcggcg

SEQ ID NO: 1974348 - RNA, 22 nt, Shigella flexneri 2a str. 301
gcgaauaguuuccgcuucugcu

SEQ ID NO: 1974349 - RNA, 16 nt, Shigella flexneri 2a str. 301
gcgaacauccagcagc

SEQ ID NO: 1974350 - RNA, 21 nt, Shigella flexneri 2a str. 301
gcgaacauaaggaugcgggcg

SEQ ID NO: 1974351 - RNA, 15 nt, Shigella flexneri 2a str. 301
gcgaagagaaagaac

SEQ ID NO: 1974352 - RNA, 18 nt, Shigella flexneri 2a str. 301
gcgaauccagcaugcuca

SEQ ID NO: 1974353 - RNA, 20 nt, Shigella flexneri 2a str. 301
gcgaaucuacggacaguggc

SEQ ID NO: 1974354 - RNA, 18 nt, Shigella flexneri 2a str. 301
gcgaaugacaugcccggu

SEQ ID NO: 1974355 - RNA, 18 nt, Shigella flexneri 2a str. 301
gcgaaugcguuucagcca

SEQ ID NO: 1974356 - RNA, 22 nt, Shigella flexneri 2a str. 301
gcgaauucuugccuuuccuccu

SEQ ID NO: 1974357 - RNA, 13 nt, Shigella flexneri 2a str. 301
gcgaccaaucaaa

SEQ ID NO: 1974358 - RNA, 20 nt, Shigella flexneri 2a str. 301
gcgacagggaucucuuccag

SEQ ID NO: 1974359 - RNA, 14 nt, Shigella flexneri 2a str. 301
gcgacaggagccgc

SEQ ID NO: 1974360 - RNA, 16 nt, Shigella flexneri 2a str. 301
gcgacauauuccccuu

SEQ ID NO: 1974361 - RNA, 17 nt, Shigella flexneri 2a str. 301
gcgacaucaccgccgga

SEQ ID NO: 1974362 - RNA, 13 nt, Shigella flexneri 2a str. 301
gcgaccaccagcg

SEQ ID NO: 1974363 - RNA, 12 nt, Shigella flexneri 2a str. 301
gcgaccaccggg

SEQ ID NO: 1974364 - RNA, 14 nt, Shigella flexneri 2a str. 301
gcgaccagaaaagc

SEQ ID NO: 1974365 - RNA, 13 nt, Shigella flexneri 2a str. 301
gcgaccgccgcca

SEQ ID NO: 1974366 - RNA, 14 nt, Shigella flexneri 2a str. 301
gcgaccgaacagau

SEQ ID NO: 1974367 - RNA, 18 nt, Shigella flexneri 2a str. 301
gcgacgccucuauuaaaa

SEQ ID NO: 1974368 - RNA, 23 nt, Shigella flexneri 2a str. 301
gcgagacggcggaaagggccgca

SEQ ID NO: 1974369 - RNA, 21 nt, Shigella flexneri 2a str. 301
gcgacuugucgcccgucaguu

SEQ ID NO: 1974370 - RNA, 21 nt, Shigella flexneri 2a str. 301
gcgagcauaggcauuaaacau

SEQ ID NO: 1974371 - RNA, 21 nt, Shigella flexneri 2a str. 301
gcgagcgccuuauccugccug

SEQ ID NO: 1974372 - RNA, 24 nt, Shigella flexneri 2a str. 301
gcgacggaacuucauaugcgccag

SEQ ID NO: 1974373 - RNA, 21 nt, Shigella flexneri 2a str. 301
gcgacguucguuaacaacaac

SEQ ID NO: 1974374 - RNA, 16 nt, Shigella flexneri 2a str. 301
gcgacgugaggauuca

SEQ ID NO: 1974375 - RNA, 20 nt, Shigella flexneri 2a str. 301
gcgacuauucacugcgccuc

SEQ ID NO: 1974376 - RNA, 12 nt, Shigella flexneri 2a str. 301
gcgacgguucau

SEQ ID NO: 1974377 - RNA, 15 nt, Shigella flexneri 2a str. 301
gcgaucugcgcguca

SEQ ID NO: 1974378 - RNA, 20 nt, Shigella flexneri 2a str. 301
gcgaucuuccacgccugcau

SEQ ID NO: 1974379 - RNA, 12 nt, Shigella flexneri 2a str. 301
gcgaucuucccg

SEQ ID NO: 1974380 - RNA, 15 nt, Shigella flexneri 2a str. 301
gcgaugccuggcaau

SEQ ID NO: 1974381 - RNA, 17 nt, Shigella flexneri 2a str. 301
gcgaugcccccagcagc

SEQ ID NO: 1974382 - RNA, 15 nt, Shigella flexneri 2a str. 301
gcgaguggucuccug

SEQ ID NO: 1974383 - RNA, 16 nt, Shigella flexneri 2a str. 301
gcgaguguuaccuuca

SEQ ID NO: 1974384 - RNA, 14 nt, Shigella flexneri 2a str. 301
gcgagucgucaguu

SEQ ID NO: 1974385 - RNA, 22 nt, Shigella flexneri 2a str. 301
gcgauaaccuucaccgugaaug

SEQ ID NO: 1974386 - RNA, 17 nt, Shigella flexneri 2a str. 301
gcgauaaugcccagcaa

SEQ ID NO: 1974387 - RNA, 13 nt, Shigella flexneri 2a str. 301
gcgauaaaucuca

SEQ ID NO: 1974388 - RNA, 13 nt, Shigella flexneri 2a str. 301
gcgagcuggcgcu

SEQ ID NO: 1974389 - RNA, 17 nt, Shigella flexneri 2a str. 301
gcgagcuuucgaccagc

SEQ ID NO: 1974390 - RNA, 23 nt, Shigella flexneri 2a str. 301
gcgagcuuccuguauaacgcaaa

SEQ ID NO: 1974391 - RNA, 15 nt, Shigella flexneri 2a str. 301
gcgagguuaaaaagu

SEQ ID NO: 1974392 - RNA, 18 nt, Shigella flexneri 2a str. 301
gcgagguuauccgccagc

SEQ ID NO: 1974393 - RNA, 18 nt, Shigella flexneri 2a str. 301
gcgcaucggucagaccca

SEQ ID NO: 1974394 - RNA, 17 nt, Shigella flexneri 2a str. 301
gcgcaucuuauccggcc

SEQ ID NO: 1974395 - RNA, 21 nt, Shigella flexneri 2a str. 301
gcgcauggcguccgucaucga

SEQ ID NO: 1974396 - RNA, 13 nt, Shigella flexneri 2a str. 301
gcgcauggcggca

SEQ ID NO: 1974397 - RNA, 16 nt, Shigella flexneri 2a str. 301
gcgcauuaagccauga

SEQ ID NO: 1974398 - RNA, 17 nt, Shigella flexneri 2a str. 301
gcgcauuucccagcaag

SEQ ID NO: 1974399 - RNA, 12 nt, Shigella flexneri 2a str. 301
gcgcauugacga

SEQ ID NO: 1974400 - RNA, 12 nt, Shigella flexneri 2a str. 301
gcgccaccaccc

SEQ ID NO: 1974401 - RNA, 14 nt, Shigella flexneri 2a str. 301
gcgccaaucggcaa

SEQ ID NO: 1974402 - RNA, 20 nt, Shigella flexneri 2a str. 301
gcgccaaucggcaauucagu

SEQ ID NO: 1974403 - RNA, 18 nt, Shigella flexneri 2a str. 301
gcgccaaucagcgcagca

SEQ ID NO: 1974404 - RNA, 16 nt, Shigella flexneri 2a str. 301
gcgccaagcagcgcgc

SEQ ID NO: 1974405 - RNA, 20 nt, Shigella flexneri 2a str. 301
gcgcauuugcggcagggcaa

SEQ ID NO: 1974406 - RNA, 16 nt, Shigella flexneri 2a str. 301
gcgccacgcaacagac

SEQ ID NO: 1974407 - RNA, 22 nt, Shigella flexneri 2a str. 301
gcgccagcaagagcaaauaaaa

SEQ ID NO: 1974408 - RNA, 22 nt, Shigella flexneri 2a str. 301
gcgccagcaucgcauccggcaa

SEQ ID NO: 1974409 - RNA, 18 nt, Shigella flexneri 2a str. 301
gcgccauaccaugcacca

SEQ ID NO: 1974410 - RNA, 14 nt, Shigella flexneri 2a str. 301
gcgccauccauaau

SEQ ID NO: 1974411 - RNA, 14 nt, Shigella flexneri 2a str. 301
gcgccaucugcagg

SEQ ID NO: 1974412 - RNA, 21 nt, Shigella flexneri 2a str. 301
gcgaugcugacgcaucuucuc

SEQ ID NO: 1974413 - RNA, 16 nt, Shigella flexneri 2a str. 301
gcgcaacugaggcaau

SEQ ID NO: 1974414 - RNA, 17 nt, Shigella flexneri 2a str. 301
gcgcaacuugugcucgu

SEQ ID NO: 1974415 - RNA, 13 nt, Shigella flexneri 2a str. 301
gcgcacaucagga

SEQ ID NO: 1974416 - RNA, 18 nt, Shigella flexneri 2a str. 301
gcgcacauccgcgucggc

SEQ ID NO: 1974417 - RNA, 16 nt, Shigella flexneri 2a str. 301
gcgcaagggccgcagc

SEQ ID NO: 1974418 - RNA, 17 nt, Shigella flexneri 2a str. 301
gcgcacaauggcgguga

SEQ ID NO: 1974419 - RNA, 16 nt, Shigella flexneri 2a str. 301
gcgcagaacauaaaaa

SEQ ID NO: 1974420 - RNA, 18 nt, Shigella flexneri 2a str. 301
gcgcagaacauaaaaacc

SEQ ID NO: 1974421 - RNA, 22 nt, Shigella flexneri 2a str. 301
gcgcaccuuuaaugcaucagcc

SEQ ID NO: 1974422 - RNA, 14 nt, Shigella flexneri 2a str. 301
gcgcaguaccacgg

SEQ ID NO: 1974423 - RNA, 17 nt, Shigella flexneri 2a str. 301
gcgcaguaaauccgcca

SEQ ID NO: 1974424 - RNA, 18 nt, Shigella flexneri 2a str. 301
gcgcaggugauacugaca

SEQ ID NO: 1974425 - RNA, 16 nt, Shigella flexneri 2a str. 301
gcgcaguucgcacacc

SEQ ID NO: 1974426 - RNA, 16 nt, Shigella flexneri 2a str. 301
gcgcagucuggcggcu

SEQ ID NO: 1974427 - RNA, 19 nt, Shigella flexneri 2a str. 301
gcgcaucaaagccaggcag

SEQ ID NO: 1974428 - RNA, 20 nt, Shigella flexneri 2a str. 301
gcgcaguuuaaucguugaug

SEQ ID NO: 1974429 - RNA, 16 nt, Shigella flexneri 2a str. 301
gcgcaucagcuccggu

SEQ ID NO: 1974430 - RNA, 23 nt, Shigella flexneri 2a str. 301
gcugccggggagauauuccccag

SEQ ID NO: 1974431 - RNA, 17 nt, Shigella flexneri 2a str. 301
gcugccggggagauauu

SEQ ID NO: 1974432 - RNA, 22 nt, Shigella flexneri 2a str. 301
gcugccggaaggcagccuuucu

SEQ ID NO: 1974433 - RNA, 22 nt, Shigella flexneri 2a str. 301
gcugccggagcggacugcugcg

SEQ ID NO: 1974434 - RNA, 18 nt, Shigella flexneri 2a str. 301
gcugccggaccaucuucc

SEQ ID NO: 1974435 - RNA, 18 nt, Shigella flexneri 2a str. 301
gcugccguuuucaaaggu

SEQ ID NO: 1974436 - RNA, 14 nt, Shigella flexneri 2a str. 301
gcugccguuuucaa

SEQ ID NO: 1974437 - RNA, 12 nt, Shigella flexneri 2a str. 301
gcugccucgcug

SEQ ID NO: 1974438 - RNA, 17 nt, Shigella flexneri 2a str. 301
gcugccucgcugaagcu

SEQ ID NO: 1974439 - RNA, 19 nt, Shigella flexneri 2a str. 301
gcugccuucggcgucucca

SEQ ID NO: 1974440 - RNA, 15 nt, Shigella flexneri 2a str. 301
gcugccuuucgcucc

SEQ ID NO: 1974441 - RNA, 22 nt, Shigella flexneri 2a str. 301
gcugcgauaguggaacaaagaa

SEQ ID NO: 1974442 - RNA, 19 nt, Shigella flexneri 2a str. 301
gcugcgaucgcaaauccau

SEQ ID NO: 1974443 - RNA, 20 nt, Shigella flexneri 2a str. 301
gcugccgccaguucuuccag

SEQ ID NO: 1974444 - RNA, 20 nt, Shigella flexneri 2a str. 301
gcugcacauacugcaucagc

SEQ ID NO: 1974445 - RNA, 20 nt, Shigella flexneri 2a str. 301
gcugcacaauugccagcccu

SEQ ID NO: 1974446 - RNA, 19 nt, Shigella flexneri 2a str. 301
gcugcacaauugccagccc

SEQ ID NO: 1974447 - RNA, 18 nt, Shigella flexneri 2a str. 301
gcugcaaggugaaagcaa

SEQ ID NO: 1974448 - RNA, 19 nt, Shigella flexneri 2a str. 301
gcugcaccucgagaucauc

SEQ ID NO: 1974449 - RNA, 18 nt, Shigella flexneri 2a str. 301
gcugcacguuuucaaccg

SEQ ID NO: 1974450 - RNA, 13 nt, Shigella flexneri 2a str. 301
gcugcaauaaaau

SEQ ID NO: 1974451 - RNA, 17 nt, Shigella flexneri 2a str. 301
gcugcaccucgagauca

SEQ ID NO: 1974452 - RNA, 17 nt, Shigella flexneri 2a str. 301
gcugcaaagucugggcu

SEQ ID NO: 1974453 - RNA, 12 nt, Shigella flexneri 2a str. 301
gcugcaaagucu

SEQ ID NO: 1974454 - RNA, 13 nt, Shigella flexneri 2a str. 301
gcugcaaaaaauu

SEQ ID NO: 1974455 - RNA, 16 nt, Shigella flexneri 2a str. 301
gcugauuuuuuuucaa

SEQ ID NO: 1974456 - RNA, 20 nt, Shigella flexneri 2a str. 301
gcugauuuuuuuucaaccua

SEQ ID NO: 1974457 - RNA, 22 nt, Shigella flexneri 2a str. 301
gcugauuuuuuuucaaccuaaa

SEQ ID NO: 1974458 - RNA, 18 nt, Shigella flexneri 2a str. 301
gcugcaaagcauuuuuuc

SEQ ID NO: 1974459 - RNA, 19 nt, Shigella flexneri 2a str. 301
gcugauuaugucaucaucg

SEQ ID NO: 1974460 - RNA, 13 nt, Shigella flexneri 2a str. 301
gcugauuuuucug

SEQ ID NO: 1974461 - RNA, 21 nt, Shigella flexneri 2a str. 301
gcugauuuuucugcucguugc

SEQ ID NO: 1974462 - RNA, 22 nt, Shigella flexneri 2a str. 301
gcugcagcucaucuaaugcagg

SEQ ID NO: 1974463 - RNA, 16 nt, Shigella flexneri 2a str. 301
gcugcagccaggguca

SEQ ID NO: 1974464 - RNA, 14 nt, Shigella flexneri 2a str. 301
gcugcagccagggu

SEQ ID NO: 1974465 - RNA, 20 nt, Shigella flexneri 2a str. 301
gcugccagaucaucguuucc

SEQ ID NO: 1974466 - RNA, 13 nt, Shigella flexneri 2a str. 301
gcugccagcacuu

SEQ ID NO: 1974467 - RNA, 15 nt, Shigella flexneri 2a str. 301
gcugccagaaccgcu

SEQ ID NO: 1974468 - RNA, 20 nt, Shigella flexneri 2a str. 301
gcugcauuugccccuguuga

SEQ ID NO: 1974469 - RNA, 22 nt, Shigella flexneri 2a str. 301
gcugcugcacauacugcaucag

SEQ ID NO: 1974470 - RNA, 13 nt, Shigella flexneri 2a str. 301
gcugcuggaucug

SEQ ID NO: 1974471 - RNA, 21 nt, Shigella flexneri 2a str. 301
gcuggaagguaaggauaaaaa

SEQ ID NO: 1974472 - RNA, 23 nt, Shigella flexneri 2a str. 301
gcuggaaaugaccauaaaaggca

SEQ ID NO: 1974473 - RNA, 13 nt, Shigella flexneri 2a str. 301
gcugcuuuauauu

SEQ ID NO: 1974474 - RNA, 19 nt, Shigella flexneri 2a str. 301
gcugcuuuaucagaucacg

SEQ ID NO: 1974475 - RNA, 17 nt, Shigella flexneri 2a str. 301
gcugcuuguuccacuuc

SEQ ID NO: 1974476 - RNA, 13 nt, Shigella flexneri 2a str. 301
gcuggagcgggga

SEQ ID NO: 1974477 - RNA, 20 nt, Shigella flexneri 2a str. 301
gcuggagcggggaacaccuc

SEQ ID NO: 1974478 - RNA, 21 nt, Shigella flexneri 2a str. 301
gcuggaguggugaaacaggga

SEQ ID NO: 1974479 - RNA, 22 nt, Shigella flexneri 2a str. 301
gcuggauuaacgcuggggauag

SEQ ID NO: 1974480 - RNA, 23 nt, Shigella flexneri 2a str. 301
gcuggaucugcggguuagucugc

SEQ ID NO: 1974481 - RNA, 13 nt, Shigella flexneri 2a str. 301
gcuggcaaugacc

SEQ ID NO: 1974482 - RNA, 22 nt, Shigella flexneri 2a str. 301
gcuggcaccgcagaucagacca

SEQ ID NO: 1974483 - RNA, 17 nt, Shigella flexneri 2a str. 301
gcuggcaauaaagugau

SEQ ID NO: 1974484 - RNA, 19 nt, Shigella flexneri 2a str. 301
gcuggcaauaaagugaucc

SEQ ID NO: 1974485 - RNA, 13 nt, Shigella flexneri 2a str. 301
gcuggcacuggga

SEQ ID NO: 1974486 - RNA, 15 nt, Shigella flexneri 2a str. 301
gcuggcagaccugcu

SEQ ID NO: 1974487 - RNA, 18 nt, Shigella flexneri 2a str. 301
gcuggcaaauucaggagc

SEQ ID NO: 1974488 - RNA, 21 nt, Shigella flexneri 2a str. 301
gcuggcaaaaaugauagccag

SEQ ID NO: 1974489 - RNA, 13 nt, Shigella flexneri 2a str. 301
gcuggaucccaga

SEQ ID NO: 1974490 - RNA, 15 nt, Shigella flexneri 2a str. 301
gcugcgcgacggcga

SEQ ID NO: 1974491 - RNA, 13 nt, Shigella flexneri 2a str. 301
gcugcgccccaca

SEQ ID NO: 1974492 - RNA, 18 nt, Shigella flexneri 2a str. 301
gcugcgccccacaccacc

SEQ ID NO: 1974493 - RNA, 16 nt, Shigella flexneri 2a str. 301
gcugcuccugcggcug

SEQ ID NO: 1974494 - RNA, 23 nt, Shigella flexneri 2a str. 301
gcugcguuugcccuaaagcgcga

SEQ ID NO: 1974495 - RNA, 12 nt, Shigella flexneri 2a str. 301
gcugcuaauauu

SEQ ID NO: 1974496 - RNA, 12 nt, Shigella flexneri 2a str. 301
gcugcuauccag

SEQ ID NO: 1974497 - RNA, 14 nt, Shigella flexneri 2a str. 301
gcugcgugccuaau

SEQ ID NO: 1974498 - RNA, 17 nt, Shigella flexneri 2a str. 301
gcuguaguccuaacaga

SEQ ID NO: 1974499 - RNA, 15 nt, Shigella flexneri 2a str. 301
gcuguaucgccggug

SEQ ID NO: 1974500 - RNA, 16 nt, Shigella flexneri 2a str. 301
gcuguagccgaugccg

SEQ ID NO: 1974501 - RNA, 19 nt, Shigella flexneri 2a str. 301
gcugucaacugcgccacuc

SEQ ID NO: 1974502 - RNA, 19 nt, Shigella flexneri 2a str. 301
gcugucaccagugagugug

SEQ ID NO: 1974503 - RNA, 21 nt, Shigella flexneri 2a str. 301
gcuguccggugauuuaucuuc

SEQ ID NO: 1974504 - RNA, 17 nt, Shigella flexneri 2a str. 301
gcuguccgcuucaccac

SEQ ID NO: 1974505 - RNA, 18 nt, Shigella flexneri 2a str. 301
gcuguccgcuucaccacc

SEQ ID NO: 1974506 - RNA, 19 nt, Shigella flexneri 2a str. 301
gcuguccgcuucaccaccg

SEQ ID NO: 1974507 - RNA, 23 nt, Shigella flexneri 2a str. 301
gcugucgccaucccugucgucca

SEQ ID NO: 1974508 - RNA, 19 nt, Shigella flexneri 2a str. 301
gcuguccgcgucuuaucag

SEQ ID NO: 1974509 - RNA, 14 nt, Shigella flexneri 2a str. 301
gcuguaauuucaca

SEQ ID NO: 1974510 - RNA, 14 nt, Shigella flexneri 2a str. 301
gcuguacgccuuca

SEQ ID NO: 1974511 - RNA, 20 nt, Shigella flexneri 2a str. 301
gcuguagcaguuccagcauc

SEQ ID NO: 1974512 - RNA, 21 nt, Shigella flexneri 2a str. 301
gcuguaaaugccgacuuuguu

SEQ ID NO: 1974513 - RNA, 12 nt, Shigella flexneri 2a str. 301
gcugguggugca

SEQ ID NO: 1974514 - RNA, 16 nt, Shigella flexneri 2a str. 301
gcugguuaccaccugc

SEQ ID NO: 1974515 - RNA, 19 nt, Shigella flexneri 2a str. 301
gcuggugccaagcuccagc

SEQ ID NO: 1974516 - RNA, 18 nt, Shigella flexneri 2a str. 301
gcuguuucaggaacaccg

SEQ ID NO: 1974517 - RNA, 16 nt, Shigella flexneri 2a str. 301
gcuguuguuuuuucaa

SEQ ID NO: 1974518 - RNA, 20 nt, Shigella flexneri 2a str. 301
gcuguuguuuuuucaaccua

SEQ ID NO: 1974519 - RNA, 15 nt, Shigella flexneri 2a str. 301
gcuguuggugccaga

SEQ ID NO: 1974520 - RNA, 18 nt, Shigella flexneri 2a str. 301
gcuguuggugaacagcau

SEQ ID NO: 1974521 - RNA, 14 nt, Shigella flexneri 2a str. 301
gcuguuguucaaca

SEQ ID NO: 1974522 - RNA, 15 nt, Shigella flexneri 2a str. 301
gcuguuguucaacac

SEQ ID NO: 1974523 - RNA, 18 nt, Shigella flexneri 2a str. 301
gcuguuuucagcaccaga

SEQ ID NO: 1974524 - RNA, 16 nt, Shigella flexneri 2a str. 301
gcuguuuuccagcacc

SEQ ID NO: 1974525 - RNA, 15 nt, Shigella flexneri 2a str. 301
gcuguuuuucguuug

SEQ ID NO: 1974526 - RNA, 19 nt, Shigella flexneri 2a str. 301
gcuguuuuuucaggcccuc

SEQ ID NO: 1974527 - RNA, 15 nt, Shigella flexneri 2a str. 301
gcuguuccaucuuua

SEQ ID NO: 1974528 - RNA, 16 nt, Shigella flexneri 2a str. 301
gcuguuaucccagcag

SEQ ID NO: 1974529 - RNA, 17 nt, Shigella flexneri 2a str. 301
gcuguuccggcuuuguu

SEQ ID NO: 1974530 - RNA, 17 nt, Shigella flexneri 2a str. 301
gcuguugcuccuuaaua

SEQ ID NO: 1974531 - RNA, 18 nt, Shigella flexneri 2a str. 301
gcuguugcuugaggauca

SEQ ID NO: 1974532 - RNA, 20 nt, Shigella flexneri 2a str. 301
gcugugccguaaaucccagu

SEQ ID NO: 1974533 - RNA, 19 nt, Shigella flexneri 2a str. 301
gcugugcgauagcaacgag

SEQ ID NO: 1974534 - RNA, 13 nt, Shigella flexneri 2a str. 301
gcuguguaagaau

SEQ ID NO: 1974535 - RNA, 18 nt, Shigella flexneri 2a str. 301
gcugugccggaaggggcg

SEQ ID NO: 1974536 - RNA, 14 nt, Shigella flexneri 2a str. 301
gcugggaaaucacc

SEQ ID NO: 1974537 - RNA, 15 nt, Shigella flexneri 2a str. 301
gcuggcuggcacgcu

SEQ ID NO: 1974538 - RNA, 16 nt, Shigella flexneri 2a str. 301
gcuggcuggcacgcuc

SEQ ID NO: 1974539 - RNA, 14 nt, Shigella flexneri 2a str. 301
gcuggcuccugagc

SEQ ID NO: 1974540 - RNA, 18 nt, Shigella flexneri 2a str. 301
gcugggcgaucgccugaa

SEQ ID NO: 1974541 - RNA, 20 nt, Shigella flexneri 2a str. 301
gcugguaauccgagaaucgu

SEQ ID NO: 1974542 - RNA, 13 nt, Shigella flexneri 2a str. 301
gcugguagaagcu

SEQ ID NO: 1974543 - RNA, 15 nt, Shigella flexneri 2a str. 301
gcugguaaucaccac

SEQ ID NO: 1974544 - RNA, 14 nt, Shigella flexneri 2a str. 301
gcuggggccaauac

SEQ ID NO: 1974545 - RNA, 19 nt, Shigella flexneri 2a str. 301
gcuggguaaagacaucgcc

SEQ ID NO: 1974546 - RNA, 20 nt, Shigella flexneri 2a str. 301
gcuggucacugaccacuucg

SEQ ID NO: 1974547 - RNA, 14 nt, Shigella flexneri 2a str. 301
gcuggucaccaucu

SEQ ID NO: 1974548 - RNA, 22 nt, Shigella flexneri 2a str. 301
gcuggcgacgccucuauuaaaa

SEQ ID NO: 1974549 - RNA, 22 nt, Shigella flexneri 2a str. 301
gcuggcgcauguuggcgcggug

SEQ ID NO: 1974550 - RNA, 22 nt, Shigella flexneri 2a str. 301
gcuggcgcguuuaaucacacca

SEQ ID NO: 1974551 - RNA, 13 nt, Shigella flexneri 2a str. 301
gcuggcgucuggg

SEQ ID NO: 1974552 - RNA, 18 nt, Shigella flexneri 2a str. 301
gcuggcgucacgccgacc

SEQ ID NO: 1974553 - RNA, 17 nt, Shigella flexneri 2a str. 301
gcuggcguacccaucaa

SEQ ID NO: 1974554 - RNA, 19 nt, Shigella flexneri 2a str. 301
gcuggcgguucuauggucu

SEQ ID NO: 1974555 - RNA, 14 nt, Shigella flexneri 2a str. 301
gcuggccuggcugg

SEQ ID NO: 1974556 - RNA, 18 nt, Shigella flexneri 2a str. 301
gcuggcaucuugauacca

SEQ ID NO: 1974557 - RNA, 20 nt, Shigella flexneri 2a str. 301
gcuggcauuacaagaaucau

SEQ ID NO: 1974558 - RNA, 18 nt, Shigella flexneri 2a str. 301
gcuggccacaaaccuuaa

SEQ ID NO: 1974559 - RNA, 22 nt, Shigella flexneri 2a str. 301
gcuuacuugcugcucugaaggu

SEQ ID NO: 1974560 - RNA, 18 nt, Shigella flexneri 2a str. 301
gcuuacucuucguucuuc

SEQ ID NO: 1974561 - RNA, 21 nt, Shigella flexneri 2a str. 301
gcuuacucuucguucuucuuc

SEQ ID NO: 1974562 - RNA, 21 nt, Shigella flexneri 2a str. 301
gcuuacucaugaugucauaaa

SEQ ID NO: 1974563 - RNA, 18 nt, Shigella flexneri 2a str. 301
gcuuacguaacccaccac

SEQ ID NO: 1974564 - RNA, 23 nt, Shigella flexneri 2a str. 301
gcuuauuagggaucaucuuaacu

SEQ ID NO: 1974565 - RNA, 19 nt, Shigella flexneri 2a str. 301
gcuuaucgcccugcuccag

SEQ ID NO: 1974566 - RNA, 13 nt, Shigella flexneri 2a str. 301
gcuuaucgcccug

SEQ ID NO: 1974567 - RNA, 16 nt, Shigella flexneri 2a str. 301
gcuuaucgccagcgcc

SEQ ID NO: 1974568 - RNA, 17 nt, Shigella flexneri 2a str. 301
gcuuaucgccagcgcca

SEQ ID NO: 1974569 - RNA, 18 nt, Shigella flexneri 2a str. 301
gcuuaucccagccacgau

SEQ ID NO: 1974570 - RNA, 19 nt, Shigella flexneri 2a str. 301
gcuuaucaggccugcaaac

SEQ ID NO: 1974571 - RNA, 19 nt, Shigella flexneri 2a str. 301
gcuuaucaggccuacaaaa

SEQ ID NO: 1974572 - RNA, 14 nt, Shigella flexneri 2a str. 301
gcuuauauauuaau

SEQ ID NO: 1974573 - RNA, 21 nt, Shigella flexneri 2a str. 301
gcuuauauauuaaucaucauu

SEQ ID NO: 1974574 - RNA, 20 nt, Shigella flexneri 2a str. 301
gcuuaccguccucuucccag

SEQ ID NO: 1974575 - RNA, 23 nt, Shigella flexneri 2a str. 301
gcuuacgaagccguauucugacu

SEQ ID NO: 1974576 - RNA, 14 nt, Shigella flexneri 2a str. 301
gcuuacgccugcca

SEQ ID NO: 1974577 - RNA, 16 nt, Shigella flexneri 2a str. 301
gcuuacgccugccagc

SEQ ID NO: 1974578 - RNA, 16 nt, Shigella flexneri 2a str. 301
gcuuacccuaaauccg

SEQ ID NO: 1974579 - RNA, 19 nt, Shigella flexneri 2a str. 301
gcuuacccuaaauccgcca

SEQ ID NO: 1974580 - RNA, 16 nt, Shigella flexneri 2a str. 301
gcuuaauuacugccuu

SEQ ID NO: 1974581 - RNA, 14 nt, Shigella flexneri 2a str. 301
gcuuaaucaccagc

SEQ ID NO: 1974582 - RNA, 18 nt, Shigella flexneri 2a str. 301
gcuuaaggcagaaacaaa

SEQ ID NO: 1974583 - RNA, 16 nt, Shigella flexneri 2a str. 301
gcuuaagccaucauca

SEQ ID NO: 1974584 - RNA, 17 nt, Shigella flexneri 2a str. 301
gcuuaauguuaaccauc

SEQ ID NO: 1974585 - RNA, 13 nt, Shigella flexneri 2a str. 301
gcuuaauguugag

SEQ ID NO: 1974586 - RNA, 20 nt, Shigella flexneri 2a str. 301
gcuuaauguugagcggcagu

SEQ ID NO: 1974587 - RNA, 14 nt, Shigella flexneri 2a str. 301
gcuuaacugauauu

SEQ ID NO: 1974588 - RNA, 15 nt, Shigella flexneri 2a str. 301
gcuuccaccgccgga

SEQ ID NO: 1974589 - RNA, 14 nt, Shigella flexneri 2a str. 301
gcuuccagagcagc

SEQ ID NO: 1974590 - RNA, 19 nt, Shigella flexneri 2a str. 301
gcuuccaccguuucuuuuu

SEQ ID NO: 1974591 - RNA, 18 nt, Shigella flexneri 2a str. 301
gcuucaugcaucgguuuu

SEQ ID NO: 1974592 - RNA, 11 nt, Shigella flexneri 2a str. 301
gcuucauugac

SEQ ID NO: 1974593 - RNA, 11 nt, Shigella flexneri 2a str. 301
gcuucaucgcc

SEQ ID NO: 1974594 - RNA, 19 nt, Shigella flexneri 2a str. 301
gcuucauccagcagugacu

SEQ ID NO: 1974595 - RNA, 18 nt, Shigella flexneri 2a str. 301
gcuucauaggcuuccacu

SEQ ID NO: 1974596 - RNA, 12 nt, Shigella flexneri 2a str. 301
gcuucagccgga

SEQ ID NO: 1974597 - RNA, 17 nt, Shigella flexneri 2a str. 301
gcuucaggaauaagaca

SEQ ID NO: 1974598 - RNA, 16 nt, Shigella flexneri 2a str. 301
gcuucaggugcccaac

SEQ ID NO: 1974599 - RNA, 21 nt, Shigella flexneri 2a str. 301
gcuucaccaaucagaaaggcg

SEQ ID NO: 1974600 - RNA, 13 nt, Shigella flexneri 2a str. 301
gcuucacaugcca

SEQ ID NO: 1974601 - RNA, 19 nt, Shigella flexneri 2a str. 301
gcuucacccuugaugcaga

SEQ ID NO: 1974602 - RNA, 19 nt, Shigella flexneri 2a str. 301
gcuucaccgacaucuuucu

SEQ ID NO: 1974603 - RNA, 19 nt, Shigella flexneri 2a str. 301
gcuucaccgauauccgcca

SEQ ID NO: 1974604 - RNA, 16 nt, Shigella flexneri 2a str. 301
gcuucacgcgccagcu

SEQ ID NO: 1974605 - RNA, 21 nt, Shigella flexneri 2a str. 301
gcuucacgcggguugccaccg

SEQ ID NO: 1974606 - RNA, 20 nt, Shigella flexneri 2a str. 301
gcuucacucccugccccauc

SEQ ID NO: 1974607 - RNA, 14 nt, Shigella flexneri 2a str. 301
gcuucaauuuuuuc

SEQ ID NO: 1974608 - RNA, 15 nt, Shigella flexneri 2a str. 301
gcuucaauuuuuucu

SEQ ID NO: 1974609 - RNA, 23 nt, Shigella flexneri 2a str. 301
gcuucaaucugauauuuagccag

SEQ ID NO: 1974610 - RNA, 13 nt, Shigella flexneri 2a str. 301
gcuucaaucugau

SEQ ID NO: 1974611 - RNA, 23 nt, Shigella flexneri 2a str. 301
gcuucaauacgcucgaacagcug

SEQ ID NO: 1974612 - RNA, 21 nt, Shigella flexneri 2a str. 301
gcuucaaucaauaacagcgca

SEQ ID NO: 1974613 - RNA, 15 nt, Shigella flexneri 2a str. 301
gcuucaacacaggcc

SEQ ID NO: 1974614 - RNA, 13 nt, Shigella flexneri 2a str. 301
gcuucaaaguuug

SEQ ID NO: 1974615 - RNA, 22 nt, Shigella flexneri 2a str. 301
gcuuauuucugugacuuccgac

SEQ ID NO: 1974616 - RNA, 19 nt, Shigella flexneri 2a str. 301
gcuucuguuuuaccugcgc

SEQ ID NO: 1974617 - RNA, 13 nt, Shigella flexneri 2a str. 301
gcuucuuccagca

SEQ ID NO: 1974618 - RNA, 16 nt, Shigella flexneri 2a str. 301
gcuucuggcuggcgcu

SEQ ID NO: 1974619 - RNA, 11 nt, Shigella flexneri 2a str. 301
gcuucuuucuc

SEQ ID NO: 1974620 - RNA, 22 nt, Shigella flexneri 2a str. 301
gcuucuuucucaaucugcuugc

SEQ ID NO: 1974621 - RNA, 16 nt, Shigella flexneri 2a str. 301
gcuugaacgguaagaa

SEQ ID NO: 1974622 - RNA, 14 nt, Shigella flexneri 2a str. 301
gcuucuaccaugau

SEQ ID NO: 1974623 - RNA, 20 nt, Shigella flexneri 2a str. 301
gcuucucaggccuacccggu

SEQ ID NO: 1974624 - RNA, 12 nt, Shigella flexneri 2a str. 301
gcuucguccaug

SEQ ID NO: 1974625 - RNA, 16 nt, Shigella flexneri 2a str. 301
gcuucgucgucaccug

SEQ ID NO: 1974626 - RNA, 20 nt, Shigella flexneri 2a str. 301
gcuucgucgucaccugcguc

SEQ ID NO: 1974627 - RNA, 21 nt, Shigella flexneri 2a str. 301
gcuucugccuuauccagcaga

SEQ ID NO: 1974628 - RNA, 12 nt, Shigella flexneri 2a str. 301
gcuucugcagcu

SEQ ID NO: 1974629 - RNA, 19 nt, Shigella flexneri 2a str. 301
gcuucugccaguuguugcu

SEQ ID NO: 1974630 - RNA, 16 nt, Shigella flexneri 2a str. 301
gcuucugcuucagccg

SEQ ID NO: 1974631 - RNA, 16 nt, Shigella flexneri 2a str. 301
gcuucuggcggcggca

SEQ ID NO: 1974632 - RNA, 22 nt, Shigella flexneri 2a str. 301
gcuucgguuuucgcgccagcca

SEQ ID NO: 1974633 - RNA, 18 nt, Shigella flexneri 2a str. 301
gcuucgguaagcaaagcg

SEQ ID NO: 1974634 - RNA, 14 nt, Shigella flexneri 2a str. 301
gcuucguagacgcu

SEQ ID NO: 1974635 - RNA, 18 nt, Shigella flexneri 2a str. 301
gcuucgcuuaccaugcca

SEQ ID NO: 1974636 - RNA, 13 nt, Shigella flexneri 2a str. 301
gcuucgcuuccca

SEQ ID NO: 1974637 - RNA, 21 nt, Shigella flexneri 2a str. 301
gcuucgcucucuuucaccagc

SEQ ID NO: 1974638 - RNA, 19 nt, Shigella flexneri 2a str. 301
gcuucgcgaaucgccacaa

SEQ ID NO: 1974639 - RNA, 16 nt, Shigella flexneri 2a str. 301
gcuucgccugagcggc

SEQ ID NO: 1974640 - RNA, 16 nt, Shigella flexneri 2a str. 301
gcuuccuggcgcuggg

SEQ ID NO: 1974641 - RNA, 12 nt, Shigella flexneri 2a str. 301
gcuuccugcagc

SEQ ID NO: 1974642 - RNA, 19 nt, Shigella flexneri 2a str. 301
gcuuccugaacucgccagc

SEQ ID NO: 1974643 - RNA, 15 nt, Shigella flexneri 2a str. 301
gcuuccgccagcggc

SEQ ID NO: 1974644 - RNA, 16 nt, Shigella flexneri 2a str. 301
gcuuccggcaauggcu

SEQ ID NO: 1974645 - RNA, 12 nt, Shigella flexneri 2a str. 301
gcuuccagcucc

SEQ ID NO: 1974646 - RNA, 14 nt, Shigella flexneri 2a str. 301
gcuugacgugucuu

SEQ ID NO: 1974647 - RNA, 18 nt, Shigella flexneri 2a str. 301
gcuugacgugucuuauca

SEQ ID NO: 1974648 - RNA, 18 nt, Shigella flexneri 2a str. 301
gcuugacgcgucuuauca

SEQ ID NO: 1974649 - RNA, 20 nt, Shigella flexneri 2a str. 301
gcuugagcaggagcagcagg

SEQ ID NO: 1974650 - RNA, 22 nt, Shigella flexneri 2a str. 301
gcuugaucaauaacgccaugag

SEQ ID NO: 1974651 - RNA, 15 nt, Shigella flexneri 2a str. 301
gcuugccagagcagc

SEQ ID NO: 1974652 - RNA, 19 nt, Shigella flexneri 2a str. 301
gcuugccagauggcaucca

SEQ ID NO: 1974653 - RNA, 13 nt, Shigella flexneri 2a str. 301
gcuugcaggauca

SEQ ID NO: 1974654 - RNA, 13 nt, Shigella flexneri 2a str. 301
gcuugcagcgucu

SEQ ID NO: 1974655 - RNA, 17 nt, Shigella flexneri 2a str. 301
gcuugcgauauucuuca

SEQ ID NO: 1974656 - RNA, 18 nt, Shigella flexneri 2a str. 301
gcuugcgauauucuucag

SEQ ID NO: 1974657 - RNA, 17 nt, Shigella flexneri 2a str. 301
gcuugcgauccugcaga

SEQ ID NO: 1974658 - RNA, 16 nt, Shigella flexneri 2a str. 301
gcuugcgcgcaaucag

SEQ ID NO: 1974659 - RNA, 20 nt, Shigella flexneri 2a str. 301
gcuugcgcgcaaucagcacc

SEQ ID NO: 1974660 - RNA, 19 nt, Shigella flexneri 2a str. 301
gcuugcgucauccagcacu

SEQ ID NO: 1974661 - RNA, 20 nt, Shigella flexneri 2a str. 301
gcuugcgucauccagcacuu

SEQ ID NO: 1974662 - RNA, 14 nt, Shigella flexneri 2a str. 301
gcuugcucaaguug

SEQ ID NO: 1974663 - RNA, 15 nt, Shigella flexneri 2a str. 301
gcuugcuuuccagcu

SEQ ID NO: 1974664 - RNA, 15 nt, Shigella flexneri 2a str. 301
gcuuggcaagcccag

SEQ ID NO: 1974665 - RNA, 22 nt, Shigella flexneri 2a str. 301
gcuuguaaaugaacucaacgcc

SEQ ID NO: 1974666 - RNA, 11 nt, Shigella flexneri 2a str. 301
gcuugggcaga

SEQ ID NO: 1974667 - RNA, 16 nt, Shigella flexneri 2a str. 301
gcuugugcaccagcug

SEQ ID NO: 1974668 - RNA, 15 nt, Shigella flexneri 2a str. 301
gcuugguuuugccau

SEQ ID NO: 1974669 - RNA, 16 nt, Shigella flexneri 2a str. 301
gcuuguucaucaccau

SEQ ID NO: 1974670 - RNA, 14 nt, Shigella flexneri 2a str. 301
gcuuuaaagcaggc

SEQ ID NO: 1974671 - RNA, 15 nt, Shigella flexneri 2a str. 301
gcuuuacgcuuaucc

SEQ ID NO: 1974672 - RNA, 23 nt, Shigella flexneri 2a str. 301
gcuuuuuaguaucuauucaucaa

SEQ ID NO: 1974673 - RNA, 19 nt, Shigella flexneri 2a str. 301
gcuuuuuccaggcuggcag

SEQ ID NO: 1974674 - RNA, 19 nt, Shigella flexneri 2a str. 301
gcuuuuucccugguaaaaa

SEQ ID NO: 1974675 - RNA, 15 nt, Shigella flexneri 2a str. 301
gcuuuuucugcuucu

SEQ ID NO: 1974676 - RNA, 18 nt, Shigella flexneri 2a str. 301
gcuuuuucugcgcacaca

SEQ ID NO: 1974677 - RNA, 17 nt, Shigella flexneri 2a str. 301
gcuuuuccggucagcaa

SEQ ID NO: 1974678 - RNA, 15 nt, Shigella flexneri 2a str. 301
gcuuuucucaccuau

SEQ ID NO: 1974679 - RNA, 22 nt, Shigella flexneri 2a str. 301
gcuuuucuaccaccaaaaccac

SEQ ID NO: 1974680 - RNA, 20 nt, Shigella flexneri 2a str. 301
gcuuuuaccgcgucaucggc

SEQ ID NO: 1974681 - RNA, 15 nt, Shigella flexneri 2a str. 301
gcuuuuaccagcaua

SEQ ID NO: 1974682 - RNA, 19 nt, Shigella flexneri 2a str. 301
gcuuuuaccagcauacgaa

SEQ ID NO: 1974683 - RNA, 18 nt, Shigella flexneri 2a str. 301
gcuuuguuuaugccagau

SEQ ID NO: 1974684 - RNA, 16 nt, Shigella flexneri 2a str. 301
gcuuugugcuggaaag

SEQ ID NO: 1974685 - RNA, 16 nt, Shigella flexneri 2a str. 301
gcuuugcugauucucc

SEQ ID NO: 1974686 - RNA, 17 nt, Shigella flexneri 2a str. 301
gcuuugcuaccuuccuc

SEQ ID NO: 1974687 - RNA, 18 nt, Shigella flexneri 2a str. 301
gcuuuggcaaacuacaaa

SEQ ID NO: 1974688 - RNA, 21 nt, Shigella flexneri 2a str. 301
gcuuuggauuugcaaauuuug

SEQ ID NO: 1974689 - RNA, 12 nt, Shigella flexneri 2a str. 301
gcuuuggcaaac

SEQ ID NO: 1974690 - RNA, 19 nt, Shigella flexneri 2a str. 301
gcuuuggcaaacuacaaau

SEQ ID NO: 1974691 - RNA, 12 nt, Shigella flexneri 2a str. 301
gcuuuggcaaau

SEQ ID NO: 1974692 - RNA, 18 nt, Shigella flexneri 2a str. 301
gcuuuggugccagauuua

SEQ ID NO: 1974693 - RNA, 23 nt, Shigella flexneri 2a str. 301
gcuuuggcugccgccaguuuacu

SEQ ID NO: 1974694 - RNA, 15 nt, Shigella flexneri 2a str. 301
gcuuucagcacgaca

SEQ ID NO: 1974695 - RNA, 20 nt, Shigella flexneri 2a str. 301
gcuuucagcacuuaucucuu

SEQ ID NO: 1974696 - RNA, 15 nt, Shigella flexneri 2a str. 301
gcuuucacucugaaa

SEQ ID NO: 1974697 - RNA, 14 nt, Shigella flexneri 2a str. 301
gcuuucaccugcgc

SEQ ID NO: 1974698 - RNA, 12 nt, Shigella flexneri 2a str. 301
gcuuuauauucu

SEQ ID NO: 1974699 - RNA, 22 nt, Shigella flexneri 2a str. 301
gcuuuaucgccaccaacccgga

SEQ ID NO: 1974700 - RNA, 20 nt, Shigella flexneri 2a str. 301
gcuuuaucgacuaacuucug

SEQ ID NO: 1974701 - RNA, 14 nt, Shigella flexneri 2a str. 301
gcuuuccgcuggcg

SEQ ID NO: 1974702 - RNA, 22 nt, Shigella flexneri 2a str. 301
gcuuucccguuucagccccuug

SEQ ID NO: 1974703 - RNA, 16 nt, Shigella flexneri 2a str. 301
gcuuucauucgguuuu

SEQ ID NO: 1974704 - RNA, 17 nt, Shigella flexneri 2a str. 301
gcuuuccaacuguacca

SEQ ID NO: 1974705 - RNA, 19 nt, Shigella flexneri 2a str. 301
gcuuuccaggcaucagcaa

SEQ ID NO: 1974706 - RNA, 16 nt, Shigella flexneri 2a str. 301
gcuuucgcuuucucuu

SEQ ID NO: 1974707 - RNA, 20 nt, Shigella flexneri 2a str. 301
gcuuucggaaagaucgccac

SEQ ID NO: 1974708 - RNA, 21 nt, Shigella flexneri 2a str. 301
gcuuucgcuacuucaaacaaa

SEQ ID NO: 1974709 - RNA, 18 nt, Shigella flexneri 2a str. 301
gcuuucgugaagcuggca

SEQ ID NO: 1974710 - RNA, 16 nt, Shigella flexneri 2a str. 301
gcuuucgagcacgacu

SEQ ID NO: 1974711 - RNA, 21 nt, Shigella flexneri 2a str. 301
gcuuucgcaauaaucaucucu

SEQ ID NO: 1974712 - RNA, 22 nt, Shigella flexneri 2a str. 301
gcuuucgcaauaaucaucucuc

SEQ ID NO: 1974713 - RNA, 20 nt, Shigella flexneri 2a str. 301
gcuuucucugcaagaacuuu

SEQ ID NO: 1974714 - RNA, 22 nt, Shigella flexneri 2a str. 301
gcuuucguuuucuacuuuguaa

SEQ ID NO: 1974715 - RNA, 21 nt, Shigella flexneri 2a str. 301
gcuuucugggaugaucaccug

SEQ ID NO: 1974716 - RNA, 15 nt, Shigella flexneri 2a str. 301
gcuuucugaacugaa

SEQ ID NO: 1974717 - RNA, 21 nt, Shigella flexneri 2a str. 301
gcuuucugaacugaacaaaaa

SEQ ID NO: 1974718 - RNA, 14 nt, Shigella flexneri 2a str. 301
gcuuugaauaucuc

SEQ ID NO: 1974719 - RNA, 22 nt, Shigella flexneri 2a str. 301
gcuuugacgaugcuccacuccu

SEQ ID NO: 1974720 - RNA, 19 nt, Shigella flexneri 2a str. 301
gcuuugaauaucuccucug

SEQ ID NO: 1974721 - RNA, 15 nt, Shigella flexneri 2a str. 301
gcuuugcaggcuggu

SEQ ID NO: 1974722 - RNA, 17 nt, Shigella flexneri 2a str. 301
gcuuugccacugccggu

SEQ ID NO: 1974723 - RNA, 17 nt, Shigella flexneri 2a str. 301
ggaaacggagcaaaaaa

SEQ ID NO: 1974724 - RNA, 21 nt, Shigella flexneri 2a str. 301
ggaaaaucaucaggggcagca

SEQ ID NO: 1974725 - RNA, 22 nt, Shigella flexneri 2a str. 301
ggaaacagcaccauccgcccac

SEQ ID NO: 1974726 - RNA, 14 nt, Shigella flexneri 2a str. 301
ggaaaccaacucca

SEQ ID NO: 1974727 - RNA, 17 nt, Shigella flexneri 2a str. 301
ggaaaccaacuccagcg

SEQ ID NO: 1974728 - RNA, 18 nt, Shigella flexneri 2a str. 301
ggaaagcagauaacccag

SEQ ID NO: 1974729 - RNA, 17 nt, Shigella flexneri 2a str. 301
ggaaacucacgccagca

SEQ ID NO: 1974730 - RNA, 23 nt, Shigella flexneri 2a str. 301
ggaaacugucaauaaacgccugc

SEQ ID NO: 1974731 - RNA, 13 nt, Shigella flexneri 2a str. 301
ggaaacuccagcc

SEQ ID NO: 1974732 - RNA, 15 nt, Shigella flexneri 2a str. 301
ggaaacucucaaaac

SEQ ID NO: 1974733 - RNA, 16 nt, Shigella flexneri 2a str. 301
ggaaagcacaaaauca

SEQ ID NO: 1974734 - RNA, 23 nt, Shigella flexneri 2a str. 301
ggaaaacguuucaaacaggcugc

SEQ ID NO: 1974735 - RNA, 21 nt, Shigella flexneri 2a str. 301
ggaaaacagcgcaccagaaac

SEQ ID NO: 1974736 - RNA, 18 nt, Shigella flexneri 2a str. 301
gcuuuuuugauuacagcu

SEQ ID NO: 1974737 - RNA, 16 nt, Shigella flexneri 2a str. 301
gcuuuuuugagcagca

SEQ ID NO: 1974738 - RNA, 22 nt, Shigella flexneri 2a str. 301
gcuuuuuuagguacaaagccaa

SEQ ID NO: 1974739 - RNA, 18 nt, Shigella flexneri 2a str. 301
gcuuuuuuacaucaucag

SEQ ID NO: 1974740 - RNA, 17 nt, Shigella flexneri 2a str. 301
gcuuuuuuacaucauca

SEQ ID NO: 1974741 - RNA, 19 nt, Shigella flexneri 2a str. 301
ggaacaucccuugugcacu

SEQ ID NO: 1974742 - RNA, 19 nt, Shigella flexneri 2a str. 301
ggaacauaucaaaaagcug

SEQ ID NO: 1974743 - RNA, 14 nt, Shigella flexneri 2a str. 301
ggaacaccucuggc

SEQ ID NO: 1974744 - RNA, 20 nt, Shigella flexneri 2a str. 301
ggaacacucuuccagucgcc

SEQ ID NO: 1974745 - RNA, 19 nt, Shigella flexneri 2a str. 301
ggaacagccggaugucugg

SEQ ID NO: 1974746 - RNA, 21 nt, Shigella flexneri 2a str. 301
ggaacagccggaugucuggaa

SEQ ID NO: 1974747 - RNA, 20 nt, Shigella flexneri 2a str. 301
ggaaccuccauguccagcuu

SEQ ID NO: 1974748 - RNA, 16 nt, Shigella flexneri 2a str. 301
ggaaccugugacagca

SEQ ID NO: 1974749 - RNA, 15 nt, Shigella flexneri 2a str. 301
ggaaccuaacgcugu

SEQ ID NO: 1974750 - RNA, 19 nt, Shigella flexneri 2a str. 301
ggaacccggcuuucugcaa

SEQ ID NO: 1974751 - RNA, 13 nt, Shigella flexneri 2a str. 301
ggaaccaggcgcg

SEQ ID NO: 1974752 - RNA, 14 nt, Shigella flexneri 2a str. 301
ggaaccacagcgcc

SEQ ID NO: 1974753 - RNA, 16 nt, Shigella flexneri 2a str. 301
ggaaauaacaucccuu

SEQ ID NO: 1974754 - RNA, 21 nt, Shigella flexneri 2a str. 301
ggaaauccugccgcaguuucu

SEQ ID NO: 1974755 - RNA, 22 nt, Shigella flexneri 2a str. 301
ggaaauacgcuggcugaacauu

SEQ ID NO: 1974756 - RNA, 17 nt, Shigella flexneri 2a str. 301
ggaaaucaccaccagca

SEQ ID NO: 1974757 - RNA, 13 nt, Shigella flexneri 2a str. 301
ggaaauugccacu

SEQ ID NO: 1974758 - RNA, 21 nt, Shigella flexneri 2a str. 301
ggaaaugccggauggcagagu

SEQ ID NO: 1974759 - RNA, 22 nt, Shigella flexneri 2a str. 301
ggaaauuaccgcaaagcccacg

SEQ ID NO: 1974760 - RNA, 11 nt, Shigella flexneri 2a str. 301
ggaacaagggu

SEQ ID NO: 1974761 - RNA, 20 nt, Shigella flexneri 2a str. 301
ggaacaacagucccaggcag

SEQ ID NO: 1974762 - RNA, 23 nt, Shigella flexneri 2a str. 301
ggaaauugcacugcaucauggca

SEQ ID NO: 1974763 - RNA, 20 nt, Shigella flexneri 2a str. 301
ggaacaaaauuuucagcgug

SEQ ID NO: 1974764 - RNA, 15 nt, Shigella flexneri 2a str. 301
ggaagccaccacgcc

SEQ ID NO: 1974765 - RNA, 16 nt, Shigella flexneri 2a str. 301
ggaagcccaaaucaua

SEQ ID NO: 1974766 - RNA, 23 nt, Shigella flexneri 2a str. 301
ggaagccccuaagcgccggacca

SEQ ID NO: 1974767 - RNA, 23 nt, Shigella flexneri 2a str. 301
ggaagccuuccgcaaacaggcgc

SEQ ID NO: 1974768 - RNA, 20 nt, Shigella flexneri 2a str. 301
ggaagccggaauuuuccuuc

SEQ ID NO: 1974769 - RNA, 21 nt, Shigella flexneri 2a str. 301
ggaagcgauggugguggggga

SEQ ID NO: 1974770 - RNA, 20 nt, Shigella flexneri 2a str. 301
ggaaggaagacgcagcaugc

SEQ ID NO: 1974771 - RNA, 18 nt, Shigella flexneri 2a str. 301
ggaagcuuucgcaguaga

SEQ ID NO: 1974772 - RNA, 13 nt, Shigella flexneri 2a str. 301
ggaagaauuucau

SEQ ID NO: 1974773 - RNA, 17 nt, Shigella flexneri 2a str. 301
ggaagacguugauucac

SEQ ID NO: 1974774 - RNA, 21 nt, Shigella flexneri 2a str. 301
ggaagaauuugcuaccccuga

SEQ ID NO: 1974775 - RNA, 13 nt, Shigella flexneri 2a str. 301
ggaagagauggug

SEQ ID NO: 1974776 - RNA, 14 nt, Shigella flexneri 2a str. 301
ggaagaccugacug

SEQ ID NO: 1974777 - RNA, 21 nt, Shigella flexneri 2a str. 301
ggaagagcgacaaucccugca

SEQ ID NO: 1974778 - RNA, 20 nt, Shigella flexneri 2a str. 301
ggaagauguacgccagugcu

SEQ ID NO: 1974779 - RNA, 14 nt, Shigella flexneri 2a str. 301
ggaacgggcaagca

SEQ ID NO: 1974780 - RNA, 17 nt, Shigella flexneri 2a str. 301
ggaacggggguuuuacu

SEQ ID NO: 1974781 - RNA, 23 nt, Shigella flexneri 2a str. 301
ggaacgguccuuaccaugcugca

SEQ ID NO: 1974782 - RNA, 23 nt, Shigella flexneri 2a str. 301
ggaacgugcugcauuugccccug

SEQ ID NO: 1974783 - RNA, 18 nt, Shigella flexneri 2a str. 301
ggaacugugcugccgggg

SEQ ID NO: 1974784 - RNA, 14 nt, Shigella flexneri 2a str. 301
ggaaggucauccaa

SEQ ID NO: 1974785 - RNA, 19 nt, Shigella flexneri 2a str. 301
ggaaggguguucauccugg

SEQ ID NO: 1974786 - RNA, 20 nt, Shigella flexneri 2a str. 301
ggaagggcuuucacugccca

SEQ ID NO: 1974787 - RNA, 15 nt, Shigella flexneri 2a str. 301
ggaaugucaucauca

SEQ ID NO: 1974788 - RNA, 13 nt, Shigella flexneri 2a str. 301
ggaaucacucauc

SEQ ID NO: 1974789 - RNA, 18 nt, Shigella flexneri 2a str. 301
ggaauuuuacagcccugg

SEQ ID NO: 1974790 - RNA, 13 nt, Shigella flexneri 2a str. 301
ggaauuuuacagc

SEQ ID NO: 1974791 - RNA, 19 nt, Shigella flexneri 2a str. 301
ggaauuacgcaauuacaug

SEQ ID NO: 1974792 - RNA, 19 nt, Shigella flexneri 2a str. 301
ggacaauagcuaacgaaaa

SEQ ID NO: 1974793 - RNA, 13 nt, Shigella flexneri 2a str. 301
ggacacacuucau

SEQ ID NO: 1974794 - RNA, 14 nt, Shigella flexneri 2a str. 301
ggacauagcucugc

SEQ ID NO: 1974795 - RNA, 17 nt, Shigella flexneri 2a str. 301
ggacagugggauuaaaa

SEQ ID NO: 1974796 - RNA, 13 nt, Shigella flexneri 2a str. 301
ggacaggcggccc

SEQ ID NO: 1974797 - RNA, 15 nt, Shigella flexneri 2a str. 301
ggacguuuucagcca

SEQ ID NO: 1974798 - RNA, 16 nt, Shigella flexneri 2a str. 301
ggacgcugagcacguu

SEQ ID NO: 1974799 - RNA, 14 nt, Shigella flexneri 2a str. 301
ggagacagcuuaga

SEQ ID NO: 1974800 - RNA, 12 nt, Shigella flexneri 2a str. 301
ggagaacgcugc

SEQ ID NO: 1974801 - RNA, 22 nt, Shigella flexneri 2a str. 301
ggacuccgcaccgccguguucu

SEQ ID NO: 1974802 - RNA, 11 nt, Shigella flexneri 2a str. 301
ggacuccaccg

SEQ ID NO: 1974803 - RNA, 16 nt, Shigella flexneri 2a str. 301
ggagaacggacccgcg

SEQ ID NO: 1974804 - RNA, 13 nt, Shigella flexneri 2a str. 301
ggagagggccggg

SEQ ID NO: 1974805 - RNA, 15 nt, Shigella flexneri 2a str. 301
ggagagggccggggu

SEQ ID NO: 1974806 - RNA, 15 nt, Shigella flexneri 2a str. 301
ggagagagcccugga

SEQ ID NO: 1974807 - RNA, 13 nt, Shigella flexneri 2a str. 301
ggagagaaaagca

SEQ ID NO: 1974808 - RNA, 18 nt, Shigella flexneri 2a str. 301
ggagcuucacccgcagca

SEQ ID NO: 1974809 - RNA, 15 nt, Shigella flexneri 2a str. 301
ggaguugaucgccaa

SEQ ID NO: 1974810 - RNA, 16 nt, Shigella flexneri 2a str. 301
ggauaauauuuuugcg

SEQ ID NO: 1974811 - RNA, 18 nt, Shigella flexneri 2a str. 301
ggauaaacuuggcuauaa

SEQ ID NO: 1974812 - RNA, 13 nt, Shigella flexneri 2a str. 301
ggauaaagccccc

SEQ ID NO: 1974813 - RNA, 15 nt, Shigella flexneri 2a str. 301
ggaucaguuccagca

SEQ ID NO: 1974814 - RNA, 13 nt, Shigella flexneri 2a str. 301
ggaucaguuucag

SEQ ID NO: 1974815 - RNA, 16 nt, Shigella flexneri 2a str. 301
ggaucaggcaaacgaa

SEQ ID NO: 1974816 - RNA, 22 nt, Shigella flexneri 2a str. 301
ggaucagaaugcgcucuuccgg

SEQ ID NO: 1974817 - RNA, 21 nt, Shigella flexneri 2a str. 301
ggauaucuucaaucagaugug

SEQ ID NO: 1974818 - RNA, 16 nt, Shigella flexneri 2a str. 301
ggauaugugaaauuua

SEQ ID NO: 1974819 - RNA, 20 nt, Shigella flexneri 2a str. 301
ggauaauaauauccuuuccc

SEQ ID NO: 1974820 - RNA, 19 nt, Shigella flexneri 2a str. 301
ggauauccacccgcagcca

SEQ ID NO: 1974821 - RNA, 19 nt, Shigella flexneri 2a str. 301
ggauauaaaaaacccucac

SEQ ID NO: 1974822 - RNA, 23 nt, Shigella flexneri 2a str. 301
ggaucgcuguccgcuucaccacc

SEQ ID NO: 1974823 - RNA, 17 nt, Shigella flexneri 2a str. 301
ggauccugagcaaacag

SEQ ID NO: 1974824 - RNA, 16 nt, Shigella flexneri 2a str. 301
ggaugcggcguaaaug

SEQ ID NO: 1974825 - RNA, 13 nt, Shigella flexneri 2a str. 301
ggaugaagugaag

SEQ ID NO: 1974826 - RNA, 15 nt, Shigella flexneri 2a str. 301
ggaugaaaaaauccc

SEQ ID NO: 1974827 - RNA, 23 nt, Shigella flexneri 2a str. 301
ggaugaaaggcaagcacggcaac

SEQ ID NO: 1974828 - RNA, 22 nt, Shigella flexneri 2a str. 301
ggaugaaaucaccgcuauuugc

SEQ ID NO: 1974829 - RNA, 21 nt, Shigella flexneri 2a str. 301
ggaucuuugccagaucgccug

SEQ ID NO: 1974830 - RNA, 15 nt, Shigella flexneri 2a str. 301
ggaucuuuuucgaac

SEQ ID NO: 1974831 - RNA, 14 nt, Shigella flexneri 2a str. 301
ggaucgugauagua

SEQ ID NO: 1974832 - RNA, 16 nt, Shigella flexneri 2a str. 301
ggaucgguagaccgga

SEQ ID NO: 1974833 - RNA, 21 nt, Shigella flexneri 2a str. 301
ggaugucgcugcuagggcgcg

SEQ ID NO: 1974834 - RNA, 13 nt, Shigella flexneri 2a str. 301
ggaugugaugcau

SEQ ID NO: 1974835 - RNA, 19 nt, Shigella flexneri 2a str. 301
ggauguguuauucagcugg

SEQ ID NO: 1974836 - RNA, 19 nt, Shigella flexneri 2a str. 301
ggaugcucucaucacuaca

SEQ ID NO: 1974837 - RNA, 20 nt, Shigella flexneri 2a str. 301
ggaugcuuuugcaacaaggg

SEQ ID NO: 1974838 - RNA, 22 nt, Shigella flexneri 2a str. 301
ggauuccugcgcuuccagcucc

SEQ ID NO: 1974839 - RNA, 22 nt, Shigella flexneri 2a str. 301
ggcaaacaaacugcgauuuaac

SEQ ID NO: 1974840 - RNA, 15 nt, Shigella flexneri 2a str. 301
ggauugccagaugcg

SEQ ID NO: 1974841 - RNA, 18 nt, Shigella flexneri 2a str. 301
ggcaaaaugcaucggcau

SEQ ID NO: 1974842 - RNA, 23 nt, Shigella flexneri 2a str. 301
ggcaaaaucaucacucccuuucu

SEQ ID NO: 1974843 - RNA, 13 nt, Shigella flexneri 2a str. 301
ggccacggcgacc

SEQ ID NO: 1974844 - RNA, 11 nt, Shigella flexneri 2a str. 301
ggccagagcau

SEQ ID NO: 1974845 - RNA, 15 nt, Shigella flexneri 2a str. 301
ggccagcaaucccca

SEQ ID NO: 1974846 - RNA, 19 nt, Shigella flexneri 2a str. 301
ggcauguguuagcccuguc

SEQ ID NO: 1974847 - RNA, 22 nt, Shigella flexneri 2a str. 301
ggcaugucgguuguacaaaaaa

SEQ ID NO: 1974848 - RNA, 13 nt, Shigella flexneri 2a str. 301
ggcauuagauauu

SEQ ID NO: 1974849 - RNA, 17 nt, Shigella flexneri 2a str. 301
ggccauaaccacgcagc

SEQ ID NO: 1974850 - RNA, 22 nt, Shigella flexneri 2a str. 301
ggccauaaccacgcagcgccgc

SEQ ID NO: 1974851 - RNA, 14 nt, Shigella flexneri 2a str. 301
ggccaucagcagcg

SEQ ID NO: 1974852 - RNA, 15 nt, Shigella flexneri 2a str. 301
ggccaguuccgccgg

SEQ ID NO: 1974853 - RNA, 23 nt, Shigella flexneri 2a str. 301
ggccauugaauauuuuucgucag

SEQ ID NO: 1974854 - RNA, 15 nt, Shigella flexneri 2a str. 301
ggccaugcggcgagg

SEQ ID NO: 1974855 - RNA, 20 nt, Shigella flexneri 2a str. 301
ggccaucagcagcggagaaa

SEQ ID NO: 1974856 - RNA, 14 nt, Shigella flexneri 2a str. 301
ggcccaucgccagu

SEQ ID NO: 1974857 - RNA, 17 nt, Shigella flexneri 2a str. 301
ggcccauuuucucggcu

SEQ ID NO: 1974858 - RNA, 14 nt, Shigella flexneri 2a str. 301
ggcccagccgugaa

SEQ ID NO: 1974859 - RNA, 13 nt, Shigella flexneri 2a str. 301
ggccgaggcacag

SEQ ID NO: 1974860 - RNA, 18 nt, Shigella flexneri 2a str. 301
ggccgcaaaccagcgcau

SEQ ID NO: 1974861 - RNA, 21 nt, Shigella flexneri 2a str. 301
ggccgcaaaccagcgcauggc

SEQ ID NO: 1974862 - RNA, 16 nt, Shigella flexneri 2a str. 301
ggccgcaaaccagcgc

SEQ ID NO: 1974863 - RNA, 18 nt, Shigella flexneri 2a str. 301
ggccgaauaccggcgucc

SEQ ID NO: 1974864 - RNA, 17 nt, Shigella flexneri 2a str. 301
ggcccgcgugccggaag

SEQ ID NO: 1974865 - RNA, 21 nt, Shigella flexneri 2a str. 301
ggcccgcucggcggcuggcug

SEQ ID NO: 1974866 - RNA, 13 nt, Shigella flexneri 2a str. 301
ggcacgcccgcgc

SEQ ID NO: 1974867 - RNA, 13 nt, Shigella flexneri 2a str. 301
ggcaaacgcccuu

SEQ ID NO: 1974868 - RNA, 15 nt, Shigella flexneri 2a str. 301
ggcaaaccuuaaagc

SEQ ID NO: 1974869 - RNA, 18 nt, Shigella flexneri 2a str. 301
ggcaaacagcacggucag

SEQ ID NO: 1974870 - RNA, 20 nt, Shigella flexneri 2a str. 301
ggcaaacaguuucugcagcu

SEQ ID NO: 1974871 - RNA, 15 nt, Shigella flexneri 2a str. 301
ggcacagcaggccaa

SEQ ID NO: 1974872 - RNA, 20 nt, Shigella flexneri 2a str. 301
ggcacauccagauuuuucag

SEQ ID NO: 1974873 - RNA, 22 nt, Shigella flexneri 2a str. 301
ggcaccaaucaccgccagcaag

SEQ ID NO: 1974874 - RNA, 21 nt, Shigella flexneri 2a str. 301
ggcaccaaucaccgccagcaa

SEQ ID NO: 1974875 - RNA, 22 nt, Shigella flexneri 2a str. 301
ggcacaucgacggugacacuuu

SEQ ID NO: 1974876 - RNA, 16 nt, Shigella flexneri 2a str. 301
ggcacaguagcccacc

SEQ ID NO: 1974877 - RNA, 19 nt, Shigella flexneri 2a str. 301
ggcacagucgcgacgcuga

SEQ ID NO: 1974878 - RNA, 17 nt, Shigella flexneri 2a str. 301
ggcagagaaaccacauc

SEQ ID NO: 1974879 - RNA, 23 nt, Shigella flexneri 2a str. 301
ggcagcaaggcuauucagcaguu

SEQ ID NO: 1974880 - RNA, 15 nt, Shigella flexneri 2a str. 301
ggcagcaacuggcga

SEQ ID NO: 1974881 - RNA, 21 nt, Shigella flexneri 2a str. 301
ggcagaugcuuuaaucaucca

SEQ ID NO: 1974882 - RNA, 20 nt, Shigella flexneri 2a str. 301
ggcagaccugcuuuguucag

SEQ ID NO: 1974883 - RNA, 18 nt, Shigella flexneri 2a str. 301
ggcacucaacaaccagaa

SEQ ID NO: 1974884 - RNA, 15 nt, Shigella flexneri 2a str. 301
ggcagacaaaacaua

SEQ ID NO: 1974885 - RNA, 22 nt, Shigella flexneri 2a str. 301
ggcagccaguucgagaaaaaua

SEQ ID NO: 1974886 - RNA, 21 nt, Shigella flexneri 2a str. 301
ggcagccaguucgagaaaaau

SEQ ID NO: 1974887 - RNA, 14 nt, Shigella flexneri 2a str. 301
ggcagccaggcgcg

SEQ ID NO: 1974888 - RNA, 17 nt, Shigella flexneri 2a str. 301
ggcagccaccgccagcg

SEQ ID NO: 1974889 - RNA, 18 nt, Shigella flexneri 2a str. 301
ggcagcaaucgaccaggc

SEQ ID NO: 1974890 - RNA, 14 nt, Shigella flexneri 2a str. 301
ggcagcauccggca

SEQ ID NO: 1974891 - RNA, 15 nt, Shigella flexneri 2a str. 301
ggcaggccuaacaca

SEQ ID NO: 1974892 - RNA, 14 nt, Shigella flexneri 2a str. 301
ggcaggaacugcuc

SEQ ID NO: 1974893 - RNA, 13 nt, Shigella flexneri 2a str. 301
ggcagcuccagca

SEQ ID NO: 1974894 - RNA, 18 nt, Shigella flexneri 2a str. 301
ggcagcuccagcaaaaag

SEQ ID NO: 1974895 - RNA, 12 nt, Shigella flexneri 2a str. 301
ggcagccuuucu

SEQ ID NO: 1974896 - RNA, 20 nt, Shigella flexneri 2a str. 301
ggcauauccuauauagcccc

SEQ ID NO: 1974897 - RNA, 20 nt, Shigella flexneri 2a str. 301
ggcauauaggucugauuccg

SEQ ID NO: 1974898 - RNA, 21 nt, Shigella flexneri 2a str. 301
ggcauagccaccuggcugcgu

SEQ ID NO: 1974899 - RNA, 20 nt, Shigella flexneri 2a str. 301
ggcauaaauaauaagagcgu

SEQ ID NO: 1974900 - RNA, 16 nt, Shigella flexneri 2a str. 301
ggcauaagccgucccu

SEQ ID NO: 1974901 - RNA, 22 nt, Shigella flexneri 2a str. 301
ggcagucggcgcauaaugccug

SEQ ID NO: 1974902 - RNA, 14 nt, Shigella flexneri 2a str. 301
ggcaguaucggcaa

SEQ ID NO: 1974903 - RNA, 19 nt, Shigella flexneri 2a str. 301
ggcaguaaccaaaagcugg

SEQ ID NO: 1974904 - RNA, 15 nt, Shigella flexneri 2a str. 301
ggcaucggugcacaa

SEQ ID NO: 1974905 - RNA, 20 nt, Shigella flexneri 2a str. 301
ggcaugcagcguaccugggu

SEQ ID NO: 1974906 - RNA, 20 nt, Shigella flexneri 2a str. 301
ggcaucgccuucgcaaaaaa

SEQ ID NO: 1974907 - RNA, 20 nt, Shigella flexneri 2a str. 301
ggcaugggucacucaggcca

SEQ ID NO: 1974908 - RNA, 12 nt, Shigella flexneri 2a str. 301
ggcaugucacaa

SEQ ID NO: 1974909 - RNA, 17 nt, Shigella flexneri 2a str. 301
ggcaugucacaaauaga

SEQ ID NO: 1974910 - RNA, 22 nt, Shigella flexneri 2a str. 301
ggcauggggucaggugggacca

SEQ ID NO: 1974911 - RNA, 18 nt, Shigella flexneri 2a str. 301
uaaucgacaguugcugcg

SEQ ID NO: 1974912 - RNA, 20 nt, Shigella flexneri 2a str. 301
uaaugacaaaauugcuguua

SEQ ID NO: 1974913 - RNA, 23 nt, Shigella flexneri 2a str. 301
uaaugaacuccggagaguauuau

SEQ ID NO: 1974914 - RNA, 22 nt, Shigella flexneri 2a str. 301
uaaugauacuauaaguguaaaa

SEQ ID NO: 1974915 - RNA, 21 nt, Shigella flexneri 2a str. 301
uaaugacuuuuggaccacgga

SEQ ID NO: 1974916 - RNA, 16 nt, Shigella flexneri 2a str. 301
uaaugagaauaaucac

SEQ ID NO: 1974917 - RNA, 14 nt, Shigella flexneri 2a str. 301
uaaugacccacccc

SEQ ID NO: 1974918 - RNA, 20 nt, Shigella flexneri 2a str. 301
uaaugagcaccgcaccuaaa

SEQ ID NO: 1974919 - RNA, 19 nt, Shigella flexneri 2a str. 301
uaaugagaauaaucaccuu

SEQ ID NO: 1974920 - RNA, 16 nt, Shigella flexneri 2a str. 301
uaaugccucuccccag

SEQ ID NO: 1974921 - RNA, 21 nt, Shigella flexneri 2a str. 301
uaaugcccgaugaccuuguca

SEQ ID NO: 1974922 - RNA, 23 nt, Shigella flexneri 2a str. 301
uaaugcccaucucuucuucaagc

SEQ ID NO: 1974923 - RNA, 22 nt, Shigella flexneri 2a str. 301
uaaugccugggcgauuuccuuc

SEQ ID NO: 1974924 - RNA, 22 nt, Shigella flexneri 2a str. 301
uaaugccucuccccagcggaaa

SEQ ID NO: 1974925 - RNA, 14 nt, Shigella flexneri 2a str. 301
uaaugcgauuuuca

SEQ ID NO: 1974926 - RNA, 14 nt, Shigella flexneri 2a str. 301
uaaugcgcuuuuac

SEQ ID NO: 1974927 - RNA, 15 nt, Shigella flexneri 2a str. 301
uaaugcaaaaugccg

SEQ ID NO: 1974928 - RNA, 19 nt, Shigella flexneri 2a str. 301
uaaugcaggcagcacugcu

SEQ ID NO: 1974929 - RNA, 13 nt, Shigella flexneri 2a str. 301
uaaugcaucagcc

SEQ ID NO: 1974930 - RNA, 16 nt, Shigella flexneri 2a str. 301
uaaugauguaaaaaua

SEQ ID NO: 1974931 - RNA, 21 nt, Shigella flexneri 2a str. 301
uaaugcguaacguuucuuuca

SEQ ID NO: 1974932 - RNA, 13 nt, Shigella flexneri 2a str. 301
uaauggcgcgggu

SEQ ID NO: 1974933 - RNA, 19 nt, Shigella flexneri 2a str. 301
uaauggccuuuucgccacc

SEQ ID NO: 1974934 - RNA, 13 nt, Shigella flexneri 2a str. 301
uaauuaaaaauag

SEQ ID NO: 1974935 - RNA, 12 nt, Shigella flexneri 2a str. 301
uaauuacugaga

SEQ ID NO: 1974936 - RNA, 23 nt, Shigella flexneri 2a str. 301
uaauuaccguaaugaucgcgauc

SEQ ID NO: 1974937 - RNA, 11 nt, Shigella flexneri 2a str. 301
uaauuauuaac

SEQ ID NO: 1974938 - RNA, 15 nt, Shigella flexneri 2a str. 301
uaauuauuaacaaaa

SEQ ID NO: 1974939 - RNA, 19 nt, Shigella flexneri 2a str. 301
uaauucaggaaauuaccgc

SEQ ID NO: 1974940 - RNA, 12 nt, Shigella flexneri 2a str. 301
uaauucaggaaa

SEQ ID NO: 1974941 - RNA, 12 nt, Shigella flexneri 2a str. 301
uaauauaacagc

SEQ ID NO: 1974942 - RNA, 21 nt, Shigella flexneri 2a str. 301
uaauauacagccuuaacaaga

SEQ ID NO: 1974943 - RNA, 22 nt, Shigella flexneri 2a str. 301
uaauauauccccccaugaaaua

SEQ ID NO: 1974944 - RNA, 23 nt, Shigella flexneri 2a str. 301
uaauauauccccccaugaaauaa

SEQ ID NO: 1974945 - RNA, 23 nt, Shigella flexneri 2a str. 301
uaauauccugccguuuuuuauuu

SEQ ID NO: 1974946 - RNA, 14 nt, Shigella flexneri 2a str. 301
uaauauccuuuccc

SEQ ID NO: 1974947 - RNA, 22 nt, Shigella flexneri 2a str. 301
uaauauccccagccuaagccau

SEQ ID NO: 1974948 - RNA, 23 nt, Shigella flexneri 2a str. 301
uaauauccccagccuaagccauu

SEQ ID NO: 1974949 - RNA, 15 nt, Shigella flexneri 2a str. 301
uaauaucuccagcua

SEQ ID NO: 1974950 - RNA, 19 nt, Shigella flexneri 2a str. 301
uaauaucgcgcagaaauuc

SEQ ID NO: 1974951 - RNA, 14 nt, Shigella flexneri 2a str. 301
uaauagguaaacau

SEQ ID NO: 1974952 - RNA, 19 nt, Shigella flexneri 2a str. 301
uaacguugaaccgccccac

SEQ ID NO: 1974953 - RNA, 23 nt, Shigella flexneri 2a str. 301
uaauaguauuaagccaguucuca

SEQ ID NO: 1974954 - RNA, 22 nt, Shigella flexneri 2a str. 301
uaacggcagaagcugcaggacc

SEQ ID NO: 1974955 - RNA, 17 nt, Shigella flexneri 2a str. 301
uaacguuauaucccauu

SEQ ID NO: 1974956 - RNA, 23 nt, Shigella flexneri 2a str. 301
uaacguggugaaagcauagcucg

SEQ ID NO: 1974957 - RNA, 16 nt, Shigella flexneri 2a str. 301
uaauauugauauccgc

SEQ ID NO: 1974958 - RNA, 17 nt, Shigella flexneri 2a str. 301
uaauaucuuuucuuaac

SEQ ID NO: 1974959 - RNA, 21 nt, Shigella flexneri 2a str. 301
uaauauucaacgucacugggu

SEQ ID NO: 1974960 - RNA, 18 nt, Shigella flexneri 2a str. 301
uaaucaucccacaugaau

SEQ ID NO: 1974961 - RNA, 21 nt, Shigella flexneri 2a str. 301
uaaucacuucuucuuguucau

SEQ ID NO: 1974962 - RNA, 17 nt, Shigella flexneri 2a str. 301
uaaucagacuggcggca

SEQ ID NO: 1974963 - RNA, 12 nt, Shigella flexneri 2a str. 301
uaaucaccagcg

SEQ ID NO: 1974964 - RNA, 15 nt, Shigella flexneri 2a str. 301
uaaucgaaaacauca

SEQ ID NO: 1974965 - RNA, 21 nt, Shigella flexneri 2a str. 301
uaauccgguuuacccgcuuga

SEQ ID NO: 1974966 - RNA, 17 nt, Shigella flexneri 2a str. 301
uaauccacagcaaugca

SEQ ID NO: 1974967 - RNA, 12 nt, Shigella flexneri 2a str. 301
uacaacuuucuc

SEQ ID NO: 1974968 - RNA, 20 nt, Shigella flexneri 2a str. 301
uacaacucgcuuaagccauc

SEQ ID NO: 1974969 - RNA, 21 nt, Shigella flexneri 2a str. 301
uacaaguccguugaaaaugcu

SEQ ID NO: 1974970 - RNA, 17 nt, Shigella flexneri 2a str. 301
uacaagcguuuacccaa

SEQ ID NO: 1974971 - RNA, 19 nt, Shigella flexneri 2a str. 301
uacaagcaacuugcaaucu

SEQ ID NO: 1974972 - RNA, 21 nt, Shigella flexneri 2a str. 301
uacaagaaccaaagaaaucag

SEQ ID NO: 1974973 - RNA, 13 nt, Shigella flexneri 2a str. 301
uacaagcagagag

SEQ ID NO: 1974974 - RNA, 22 nt, Shigella flexneri 2a str. 301
uacaauguuucugcaauauauu

SEQ ID NO: 1974975 - RNA, 23 nt, Shigella flexneri 2a str. 301
uacaauuuacguuuuaaaccuac

SEQ ID NO: 1974976 - RNA, 14 nt, Shigella flexneri 2a str. 301
uacaccaaagcggu

SEQ ID NO: 1974977 - RNA, 14 nt, Shigella flexneri 2a str. 301
uacaccaucaugga

SEQ ID NO: 1974978 - RNA, 20 nt, Shigella flexneri 2a str. 301
uacaccgcagccgccacaau

SEQ ID NO: 1974979 - RNA, 20 nt, Shigella flexneri 2a str. 301
uacaccggcaacguuuucaa

SEQ ID NO: 1974980 - RNA, 21 nt, Shigella flexneri 2a str. 301
uacagcaguacgccgagaaua

SEQ ID NO: 1974981 - RNA, 23 nt, Shigella flexneri 2a str. 301
uacagccagccagcaccaggcuu

SEQ ID NO: 1974982 - RNA, 18 nt, Shigella flexneri 2a str. 301
uacagccaaaucaucagu

SEQ ID NO: 1974983 - RNA, 20 nt, Shigella flexneri 2a str. 301
uacagcagccauucauucaa

SEQ ID NO: 1974984 - RNA, 17 nt, Shigella flexneri 2a str. 301
uacacuucacacacuuu

SEQ ID NO: 1974985 - RNA, 22 nt, Shigella flexneri 2a str. 301
uacaccuuaaggcuguucccac

SEQ ID NO: 1974986 - RNA, 18 nt, Shigella flexneri 2a str. 301
uacacuaaacgucucacu

SEQ ID NO: 1974987 - RNA, 14 nt, Shigella flexneri 2a str. 301
uacacuauuuccuu

SEQ ID NO: 1974988 - RNA, 15 nt, Shigella flexneri 2a str. 301
uacacuauuuccuug

SEQ ID NO: 1974989 - RNA, 14 nt, Shigella flexneri 2a str. 301
uacacucaaauauc

SEQ ID NO: 1974990 - RNA, 22 nt, Shigella flexneri 2a str. 301
uacagcuucacgcgccagcuua

SEQ ID NO: 1974991 - RNA, 16 nt, Shigella flexneri 2a str. 301
uacagcuuagcgccuu

SEQ ID NO: 1974992 - RNA, 15 nt, Shigella flexneri 2a str. 301
uacaggaacagccac

SEQ ID NO: 1974993 - RNA, 20 nt, Shigella flexneri 2a str. 301
uacaggauauauuucaucaa

SEQ ID NO: 1974994 - RNA, 22 nt, Shigella flexneri 2a str. 301
uacaggauauauuucaucaacu

SEQ ID NO: 1974995 - RNA, 17 nt, Shigella flexneri 2a str. 301
uacaggauauauuucau

SEQ ID NO: 1974996 - RNA, 18 nt, Shigella flexneri 2a str. 301
uacagucuggcgaacucu

SEQ ID NO: 1974997 - RNA, 21 nt, Shigella flexneri 2a str. 301
uaauuuacagccugccagcau

SEQ ID NO: 1974998 - RNA, 20 nt, Shigella flexneri 2a str. 301
uaauucgcuuuuauaaaggg

SEQ ID NO: 1974999 - RNA, 16 nt, Shigella flexneri 2a str. 301
uaauucgcuaacaaaa

SEQ ID NO: 1975000 - RNA, 18 nt, Shigella flexneri 2a str. 301
uaauuucggcagcgcgcu

SEQ ID NO: 1975001 - RNA, 18 nt, Shigella flexneri 2a str. 301
uaauuuggcugagugaau

SEQ ID NO: 1975002 - RNA, 20 nt, Shigella flexneri 2a str. 301
uaauuucacaccaucaacaa

SEQ ID NO: 1975003 - RNA, 19 nt, Shigella flexneri 2a str. 301
uaauuucacaccaucaaca

SEQ ID NO: 1975004 - RNA, 11 nt, Shigella flexneri 2a str. 301
uaauuucacaa

SEQ ID NO: 1975005 - RNA, 19 nt, Shigella flexneri 2a str. 301
uaauuucagcaagacaaug

SEQ ID NO: 1975006 - RNA, 15 nt, Shigella flexneri 2a str. 301
uaauuucauuuugau

SEQ ID NO: 1975007 - RNA, 22 nt, Shigella flexneri 2a str. 301
uaauuucaucugccuuauugaa

SEQ ID NO: 1975008 - RNA, 13 nt, Shigella flexneri 2a str. 301
uaauuuccacgcc

SEQ ID NO: 1975009 - RNA, 23 nt, Shigella flexneri 2a str. 301
uaauuuccccaaaacguaaccau

SEQ ID NO: 1975010 - RNA, 15 nt, Shigella flexneri 2a str. 301
uaauuucgcuuucau

SEQ ID NO: 1975011 - RNA, 23 nt, Shigella flexneri 2a str. 301
uacaaaaucuugcaaauucaaua

SEQ ID NO: 1975012 - RNA, 23 nt, Shigella flexneri 2a str. 301
uacaaaaccacacuucuucagcc

SEQ ID NO: 1975013 - RNA, 14 nt, Shigella flexneri 2a str. 301
uacaaaaccugcac

SEQ ID NO: 1975014 - RNA, 16 nt, Shigella flexneri 2a str. 301
uacaaaagcaauaauu

SEQ ID NO: 1975015 - RNA, 15 nt, Shigella flexneri 2a str. 301
uacaaaaaaugugaa

SEQ ID NO: 1975016 - RNA, 22 nt, Shigella flexneri 2a str. 301
uacaaaaaaggccgcaggcugu

SEQ ID NO: 1975017 - RNA, 15 nt, Shigella flexneri 2a str. 301
uaauuuuuugcgcca

SEQ ID NO: 1975018 - RNA, 23 nt, Shigella flexneri 2a str. 301
uaauuuuuccagcauuucuucca

SEQ ID NO: 1975019 - RNA, 17 nt, Shigella flexneri 2a str. 301
uaauuuuuguuguuuaa

SEQ ID NO: 1975020 - RNA, 23 nt, Shigella flexneri 2a str. 301
uaauuuuuauauagccagccuca

SEQ ID NO: 1975021 - RNA, 19 nt, Shigella flexneri 2a str. 301
uaauuuuuaugcguuauac

SEQ ID NO: 1975022 - RNA, 18 nt, Shigella flexneri 2a str. 301
uaauuuuucaaacucuuc

SEQ ID NO: 1975023 - RNA, 14 nt, Shigella flexneri 2a str. 301
uaauuuuuccagca

SEQ ID NO: 1975024 - RNA, 13 nt, Shigella flexneri 2a str. 301
uaauuuuaaauau

SEQ ID NO: 1975025 - RNA, 19 nt, Shigella flexneri 2a str. 301
uacgagugcgcucuucaac

SEQ ID NO: 1975026 - RNA, 19 nt, Shigella flexneri 2a str. 301
uacgaaucgccggagacgu

SEQ ID NO: 1975027 - RNA, 16 nt, Shigella flexneri 2a str. 301
uacgauccugguggua

SEQ ID NO: 1975028 - RNA, 22 nt, Shigella flexneri 2a str. 301
uacgauccaccaccgcaaaaua

SEQ ID NO: 1975029 - RNA, 18 nt, Shigella flexneri 2a str. 301
uacgauacagaagcaccg

SEQ ID NO: 1975030 - RNA, 18 nt, Shigella flexneri 2a str. 301
uaccuuuuucuucaccaa

SEQ ID NO: 1975031 - RNA, 16 nt, Shigella flexneri 2a str. 301
uaccuaaggaauccag

SEQ ID NO: 1975032 - RNA, 17 nt, Shigella flexneri 2a str. 301
uaccuaacauuuuacuu

SEQ ID NO: 1975033 - RNA, 18 nt, Shigella flexneri 2a str. 301
uaccgguuucaauccagg

SEQ ID NO: 1975034 - RNA, 18 nt, Shigella flexneri 2a str. 301
uaccgguuuuggcaggcc

SEQ ID NO: 1975035 - RNA, 14 nt, Shigella flexneri 2a str. 301
uaccuugcugcucc

SEQ ID NO: 1975036 - RNA, 12 nt, Shigella flexneri 2a str. 301
uaccuucuuccc

SEQ ID NO: 1975037 - RNA, 12 nt, Shigella flexneri 2a str. 301
uaccuucuuccu

SEQ ID NO: 1975038 - RNA, 14 nt, Shigella flexneri 2a str. 301
uaccuucaucccuu

SEQ ID NO: 1975039 - RNA, 22 nt, Shigella flexneri 2a str. 301
uaccuucguuauauccaggcag

SEQ ID NO: 1975040 - RNA, 17 nt, Shigella flexneri 2a str. 301
uaccuuccacaauggca

SEQ ID NO: 1975041 - RNA, 14 nt, Shigella flexneri 2a str. 301
uaccuuccuccggc

SEQ ID NO: 1975042 - RNA, 19 nt, Shigella flexneri 2a str. 301
uacggacgcggcauuuuua

SEQ ID NO: 1975043 - RNA, 22 nt, Shigella flexneri 2a str. 301
uacggaaugauauuggucacca

SEQ ID NO: 1975044 - RNA, 18 nt, Shigella flexneri 2a str. 301
uacgcagauauucguuca

SEQ ID NO: 1975045 - RNA, 21 nt, Shigella flexneri 2a str. 301
uacgcaccgcuccaucgccuu

SEQ ID NO: 1975046 - RNA, 17 nt, Shigella flexneri 2a str. 301
uacgauguguggcaucg

SEQ ID NO: 1975047 - RNA, 17 nt, Shigella flexneri 2a str. 301
uacgcgcccgcgcagcu

SEQ ID NO: 1975048 - RNA, 20 nt, Shigella flexneri 2a str. 301
uacgcauaucuccauucuga

SEQ ID NO: 1975049 - RNA, 12 nt, Shigella flexneri 2a str. 301
uacggcagugaa

SEQ ID NO: 1975050 - RNA, 14 nt, Shigella flexneri 2a str. 301
uacggcuaaaaaaa

SEQ ID NO: 1975051 - RNA, 20 nt, Shigella flexneri 2a str. 301
uacggcuccgcaagcgaaug

SEQ ID NO: 1975052 - RNA, 16 nt, Shigella flexneri 2a str. 301
uacggcuggaagguga

SEQ ID NO: 1975053 - RNA, 21 nt, Shigella flexneri 2a str. 301
uacggauagcagaaaacucac

SEQ ID NO: 1975054 - RNA, 15 nt, Shigella flexneri 2a str. 301
uacggcacuccucuu

SEQ ID NO: 1975055 - RNA, 13 nt, Shigella flexneri 2a str. 301
uacggcauucugc

SEQ ID NO: 1975056 - RNA, 16 nt, Shigella flexneri 2a str. 301
uacgggcaaucuccug

SEQ ID NO: 1975057 - RNA, 19 nt, Shigella flexneri 2a str. 301
uacguaccacgcacagccc

SEQ ID NO: 1975058 - RNA, 13 nt, Shigella flexneri 2a str. 301
uacgucaucccaa

SEQ ID NO: 1975059 - RNA, 17 nt, Shigella flexneri 2a str. 301
uacgucagcgucauaca

SEQ ID NO: 1975060 - RNA, 22 nt, Shigella flexneri 2a str. 301
uacgucacuucaucgucauaau

SEQ ID NO: 1975061 - RNA, 15 nt, Shigella flexneri 2a str. 301
uacccaaacuuaaca

SEQ ID NO: 1975062 - RNA, 21 nt, Shigella flexneri 2a str. 301
uacccaaacuuaacacugaga

SEQ ID NO: 1975063 - RNA, 19 nt, Shigella flexneri 2a str. 301
uaccaggcgguaugguaaa

SEQ ID NO: 1975064 - RNA, 18 nt, Shigella flexneri 2a str. 301
uaccagcgaggucaaaau

SEQ ID NO: 1975065 - RNA, 20 nt, Shigella flexneri 2a str. 301
uaccagccuucuucauccag

SEQ ID NO: 1975066 - RNA, 14 nt, Shigella flexneri 2a str. 301
uaccagcgccgcca

SEQ ID NO: 1975067 - RNA, 19 nt, Shigella flexneri 2a str. 301
uaccagccagacacuguua

SEQ ID NO: 1975068 - RNA, 19 nt, Shigella flexneri 2a str. 301
uaccagauaaucaccugcc

SEQ ID NO: 1975069 - RNA, 21 nt, Shigella flexneri 2a str. 301
uaccagauaaucaccugccuu

SEQ ID NO: 1975070 - RNA, 15 nt, Shigella flexneri 2a str. 301
uaccagaaucaccuu

SEQ ID NO: 1975071 - RNA, 17 nt, Shigella flexneri 2a str. 301
uaccagaccgcacaccg

SEQ ID NO: 1975072 - RNA, 18 nt, Shigella flexneri 2a str. 301
uaccagaccgcacaccga

SEQ ID NO: 1975073 - RNA, 20 nt, Shigella flexneri 2a str. 301
uaccagcaacgcuucaacca

SEQ ID NO: 1975074 - RNA, 20 nt, Shigella flexneri 2a str. 301
uaccagcaacugauggccca

SEQ ID NO: 1975075 - RNA, 16 nt, Shigella flexneri 2a str. 301
uaccagauuaauuauu

SEQ ID NO: 1975076 - RNA, 18 nt, Shigella flexneri 2a str. 301
uaccagauuaauuauuga

SEQ ID NO: 1975077 - RNA, 19 nt, Shigella flexneri 2a str. 301
uaccacguugacaaacugc

SEQ ID NO: 1975078 - RNA, 15 nt, Shigella flexneri 2a str. 301
uaccacuuccagcag

SEQ ID NO: 1975079 - RNA, 22 nt, Shigella flexneri 2a str. 301
uaccaccuuacuuacacaucaa

SEQ ID NO: 1975080 - RNA, 21 nt, Shigella flexneri 2a str. 301
uaccaccuuacuuacacauca

SEQ ID NO: 1975081 - RNA, 16 nt, Shigella flexneri 2a str. 301
uaccacgcacagcccg

SEQ ID NO: 1975082 - RNA, 15 nt, Shigella flexneri 2a str. 301
uaccacgauuuugac

SEQ ID NO: 1975083 - RNA, 21 nt, Shigella flexneri 2a str. 301
uacauagccaucugccugauc

SEQ ID NO: 1975084 - RNA, 15 nt, Shigella flexneri 2a str. 301
uacauacugagaacc

SEQ ID NO: 1975085 - RNA, 13 nt, Shigella flexneri 2a str. 301
uacauacuuaaau

SEQ ID NO: 1975086 - RNA, 14 nt, Shigella flexneri 2a str. 301
uacauaacgcagcg

SEQ ID NO: 1975087 - RNA, 13 nt, Shigella flexneri 2a str. 301
uaccgggaugcug

SEQ ID NO: 1975088 - RNA, 14 nt, Shigella flexneri 2a str. 301
uaccgggcguccug

SEQ ID NO: 1975089 - RNA, 17 nt, Shigella flexneri 2a str. 301
uaccgcguaauacauca

SEQ ID NO: 1975090 - RNA, 16 nt, Shigella flexneri 2a str. 301
uaccgccucgcggcag

SEQ ID NO: 1975091 - RNA, 13 nt, Shigella flexneri 2a str. 301
uaccgcgguugau

SEQ ID NO: 1975092 - RNA, 14 nt, Shigella flexneri 2a str. 301
uaccgcgaagaaca

SEQ ID NO: 1975093 - RNA, 23 nt, Shigella flexneri 2a str. 301
uaccgcccgcgcgguaucaccac

SEQ ID NO: 1975094 - RNA, 12 nt, Shigella flexneri 2a str. 301
uaccgccacagc

SEQ ID NO: 1975095 - RNA, 14 nt, Shigella flexneri 2a str. 301
uaccgccagaccac

SEQ ID NO: 1975096 - RNA, 12 nt, Shigella flexneri 2a str. 301
uaccgccagacc

SEQ ID NO: 1975097 - RNA, 13 nt, Shigella flexneri 2a str. 301
uaccgcaccacca

SEQ ID NO: 1975098 - RNA, 19 nt, Shigella flexneri 2a str. 301
uaccgcaccuuccggaaua

SEQ ID NO: 1975099 - RNA, 17 nt, Shigella flexneri 2a str. 301
uaccgcaccaccagcag

SEQ ID NO: 1975100 - RNA, 17 nt, Shigella flexneri 2a str. 301
uacccuucgucaaucag

SEQ ID NO: 1975101 - RNA, 15 nt, Shigella flexneri 2a str. 301
uacccuuuauuuucu

SEQ ID NO: 1975102 - RNA, 13 nt, Shigella flexneri 2a str. 301
uacccugacccag

SEQ ID NO: 1975103 - RNA, 13 nt, Shigella flexneri 2a str. 301
uaccccagucagg

SEQ ID NO: 1975104 - RNA, 14 nt, Shigella flexneri 2a str. 301
uaccccugauuuug

SEQ ID NO: 1975105 - RNA, 19 nt, Shigella flexneri 2a str. 301
uaccccucuauccagcuca

SEQ ID NO: 1975106 - RNA, 19 nt, Shigella flexneri 2a str. 301
uaccccgucaccacuucac

SEQ ID NO: 1975107 - RNA, 20 nt, Shigella flexneri 2a str. 301
uacucagcaacuuccugcuu

SEQ ID NO: 1975108 - RNA, 18 nt, Shigella flexneri 2a str. 301
uacguuucgccugcaaau

SEQ ID NO: 1975109 - RNA, 13 nt, Shigella flexneri 2a str. 301
uacguuuuuauug

SEQ ID NO: 1975110 - RNA, 15 nt, Shigella flexneri 2a str. 301
uacgugaggcaucag

SEQ ID NO: 1975111 - RNA, 12 nt, Shigella flexneri 2a str. 301
uacuaaaaagcg

SEQ ID NO: 1975112 - RNA, 13 nt, Shigella flexneri 2a str. 301
uacuccuuagcaa

SEQ ID NO: 1975113 - RNA, 22 nt, Shigella flexneri 2a str. 301
uacucgaggcauuggcaaauuu

SEQ ID NO: 1975114 - RNA, 18 nt, Shigella flexneri 2a str. 301
uacucccgcuucagccgu

SEQ ID NO: 1975115 - RNA, 16 nt, Shigella flexneri 2a str. 301
uacuccaacccggcag

SEQ ID NO: 1975116 - RNA, 22 nt, Shigella flexneri 2a str. 301
uacugcugaaugaggcuuuaau

SEQ ID NO: 1975117 - RNA, 20 nt, Shigella flexneri 2a str. 301
uacugcuuuguucacgcguc

SEQ ID NO: 1975118 - RNA, 17 nt, Shigella flexneri 2a str. 301
uacugccccggagaaau

SEQ ID NO: 1975119 - RNA, 14 nt, Shigella flexneri 2a str. 301
uacugcccgcuugc

SEQ ID NO: 1975120 - RNA, 20 nt, Shigella flexneri 2a str. 301
uacugagaacgcaauggucg

SEQ ID NO: 1975121 - RNA, 13 nt, Shigella flexneri 2a str. 301
uacugagagaaaa

SEQ ID NO: 1975122 - RNA, 14 nt, Shigella flexneri 2a str. 301
uacugagcaaggca

SEQ ID NO: 1975123 - RNA, 23 nt, Shigella flexneri 2a str. 301
uacugaggccggaugucgcugcu

SEQ ID NO: 1975124 - RNA, 18 nt, Shigella flexneri 2a str. 301
uacugauaauuuuuucac

SEQ ID NO: 1975125 - RNA, 15 nt, Shigella flexneri 2a str. 301
uacugauaacuucac

SEQ ID NO: 1975126 - RNA, 13 nt, Shigella flexneri 2a str. 301
uacugaucaucau

SEQ ID NO: 1975127 - RNA, 14 nt, Shigella flexneri 2a str. 301
uacugaucaucauu

SEQ ID NO: 1975128 - RNA, 14 nt, Shigella flexneri 2a str. 301
uacugaugaauaaa

SEQ ID NO: 1975129 - RNA, 15 nt, Shigella flexneri 2a str. 301
uacugaugaauaaau

SEQ ID NO: 1975130 - RNA, 18 nt, Shigella flexneri 2a str. 301
uacugauggcuacguucu

SEQ ID NO: 1975131 - RNA, 16 nt, Shigella flexneri 2a str. 301
uacugauguuugucac

SEQ ID NO: 1975132 - RNA, 13 nt, Shigella flexneri 2a str. 301
uacugauuuuauu

SEQ ID NO: 1975133 - RNA, 13 nt, Shigella flexneri 2a str. 301
uacugcagccagc

SEQ ID NO: 1975134 - RNA, 23 nt, Shigella flexneri 2a str. 301
uacucuuaucaaacgacagcgug

SEQ ID NO: 1975135 - RNA, 15 nt, Shigella flexneri 2a str. 301
uacucugucugaucu

SEQ ID NO: 1975136 - RNA, 23 nt, Shigella flexneri 2a str. 301
uacucuccugcggcgacaaaugu

SEQ ID NO: 1975137 - RNA, 19 nt, Shigella flexneri 2a str. 301
uacugaaaguggaaaaaua

SEQ ID NO: 1975138 - RNA, 19 nt, Shigella flexneri 2a str. 301
uacucuuugaacagccaga

SEQ ID NO: 1975139 - RNA, 13 nt, Shigella flexneri 2a str. 301
uacucuuuccauu

SEQ ID NO: 1975140 - RNA, 21 nt, Shigella flexneri 2a str. 301
uacucuuucccggcaaucacc

SEQ ID NO: 1975141 - RNA, 23 nt, Shigella flexneri 2a str. 301
uacucuuucccggcaaucaccgc

SEQ ID NO: 1975142 - RNA, 16 nt, Shigella flexneri 2a str. 301
uacucuuugacaacau

SEQ ID NO: 1975143 - RNA, 21 nt, Shigella flexneri 2a str. 301
uacugaccccaaaaaguugga

SEQ ID NO: 1975144 - RNA, 17 nt, Shigella flexneri 2a str. 301
uacugaaucccugcgaa

SEQ ID NO: 1975145 - RNA, 16 nt, Shigella flexneri 2a str. 301
uacugacaucaaaccc

SEQ ID NO: 1975146 - RNA, 18 nt, Shigella flexneri 2a str. 301
uacugaaggcgcauugcu

SEQ ID NO: 1975147 - RNA, 14 nt, Shigella flexneri 2a str. 301
uacuuucacaaaaa

SEQ ID NO: 1975148 - RNA, 15 nt, Shigella flexneri 2a str. 301
uacuucugaccagga

SEQ ID NO: 1975149 - RNA, 18 nt, Shigella flexneri 2a str. 301
uacuuucacaaaaauaau

SEQ ID NO: 1975150 - RNA, 18 nt, Shigella flexneri 2a str. 301
uacuuuauuuauaucagu

SEQ ID NO: 1975151 - RNA, 12 nt, Shigella flexneri 2a str. 301
uacuuucaucaa

SEQ ID NO: 1975152 - RNA, 16 nt, Shigella flexneri 2a str. 301
uacuucaucugcuuca

SEQ ID NO: 1975153 - RNA, 17 nt, Shigella flexneri 2a str. 301
uacuuccgcuuccagcu

SEQ ID NO: 1975154 - RNA, 20 nt, Shigella flexneri 2a str. 301
uacuuccccggcagugcuuu

SEQ ID NO: 1975155 - RNA, 21 nt, Shigella flexneri 2a str. 301
uacuucagacggucagcgaga

SEQ ID NO: 1975156 - RNA, 23 nt, Shigella flexneri 2a str. 301
uacuucauaacguuuuuucguca

SEQ ID NO: 1975157 - RNA, 13 nt, Shigella flexneri 2a str. 301
uacuucaccaguu

SEQ ID NO: 1975158 - RNA, 14 nt, Shigella flexneri 2a str. 301
uacuucaccuucuu

SEQ ID NO: 1975159 - RNA, 15 nt, Shigella flexneri 2a str. 301
uacuucaacacauaa

SEQ ID NO: 1975160 - RNA, 14 nt, Shigella flexneri 2a str. 301
uacuuauaaaccac

SEQ ID NO: 1975161 - RNA, 15 nt, Shigella flexneri 2a str. 301
uacuuauaaaccacg

SEQ ID NO: 1975162 - RNA, 14 nt, Shigella flexneri 2a str. 301
uacuuaucuuuuac

SEQ ID NO: 1975163 - RNA, 19 nt, Shigella flexneri 2a str. 301
uacuguauacgggcuuuuu

SEQ ID NO: 1975164 - RNA, 23 nt, Shigella flexneri 2a str. 301
uacuguauacgggcuuuuuaauu

SEQ ID NO: 1975165 - RNA, 23 nt, Shigella flexneri 2a str. 301
uacuggcaccgaagcccaucagu

SEQ ID NO: 1975166 - RNA, 11 nt, Shigella flexneri 2a str. 301
uacuggcaaua

SEQ ID NO: 1975167 - RNA, 15 nt, Shigella flexneri 2a str. 301
uacuggaauuucauu

SEQ ID NO: 1975168 - RNA, 17 nt, Shigella flexneri 2a str. 301
uacuggcagggaucuga

SEQ ID NO: 1975169 - RNA, 17 nt, Shigella flexneri 2a str. 301
uacuggcgauugucauu

SEQ ID NO: 1975170 - RNA, 14 nt, Shigella flexneri 2a str. 301
uacuggauggaggg

SEQ ID NO: 1975171 - RNA, 23 nt, Shigella flexneri 2a str. 301
uacuggauggagggaaauuaaau

SEQ ID NO: 1975172 - RNA, 16 nt, Shigella flexneri 2a str. 301
uacuggcgguuuucuu

SEQ ID NO: 1975173 - RNA, 18 nt, Shigella flexneri 2a str. 301
uacuggugcaaaaccugg

SEQ ID NO: 1975174 - RNA, 14 nt, Shigella flexneri 2a str. 301
uaugauuuaaaaaa

SEQ ID NO: 1975175 - RNA, 15 nt, Shigella flexneri 2a str. 301
uaugauuuaaaaaau

SEQ ID NO: 1975176 - RNA, 13 nt, Shigella flexneri 2a str. 301
uaugauuuuccug

SEQ ID NO: 1975177 - RNA, 16 nt, Shigella flexneri 2a str. 301
uaugcaagauguuaau

SEQ ID NO: 1975178 - RNA, 15 nt, Shigella flexneri 2a str. 301
uaugcagugcaucca

SEQ ID NO: 1975179 - RNA, 20 nt, Shigella flexneri 2a str. 301
uaugcauaauuugcggaauu

SEQ ID NO: 1975180 - RNA, 20 nt, Shigella flexneri 2a str. 301
uaugagcgauuuuuuauagu

SEQ ID NO: 1975181 - RNA, 17 nt, Shigella flexneri 2a str. 301
uaugagucguaaacaac

SEQ ID NO: 1975182 - RNA, 23 nt, Shigella flexneri 2a str. 301
uaugagucgccugcucuaaccac

SEQ ID NO: 1975183 - RNA, 18 nt, Shigella flexneri 2a str. 301
uaugaggcacuaaggcga

SEQ ID NO: 1975184 - RNA, 21 nt, Shigella flexneri 2a str. 301
uaugauaggucauaucacaaa

SEQ ID NO: 1975185 - RNA, 18 nt, Shigella flexneri 2a str. 301
uaugaauuugcagccaua

SEQ ID NO: 1975186 - RNA, 21 nt, Shigella flexneri 2a str. 301
uaugaauuacuucucuuuccc

SEQ ID NO: 1975187 - RNA, 11 nt, Shigella flexneri 2a str. 301
uaucuggcaag

SEQ ID NO: 1975188 - RNA, 15 nt, Shigella flexneri 2a str. 301
uaucuggccuacaaa

SEQ ID NO: 1975189 - RNA, 17 nt, Shigella flexneri 2a str. 301
uaucugcugcuugcggu

SEQ ID NO: 1975190 - RNA, 19 nt, Shigella flexneri 2a str. 301
uaucugcugugguuugccc

SEQ ID NO: 1975191 - RNA, 20 nt, Shigella flexneri 2a str. 301
uaucugcuccguaaaacuca

SEQ ID NO: 1975192 - RNA, 20 nt, Shigella flexneri 2a str. 301
uaucuuugauugaagaaauc

SEQ ID NO: 1975193 - RNA, 16 nt, Shigella flexneri 2a str. 301
uaucuuucauauucaa

SEQ ID NO: 1975194 - RNA, 11 nt, Shigella flexneri 2a str. 301
uaugaaacaac

SEQ ID NO: 1975195 - RNA, 19 nt, Shigella flexneri 2a str. 301
uaugaaugauaaaauucau

SEQ ID NO: 1975196 - RNA, 17 nt, Shigella flexneri 2a str. 301
uaugaagaacaaguuca

SEQ ID NO: 1975197 - RNA, 17 nt, Shigella flexneri 2a str. 301
uaugguuagagaacaac

SEQ ID NO: 1975198 - RNA, 16 nt, Shigella flexneri 2a str. 301
uauguuuaucaggcca

SEQ ID NO: 1975199 - RNA, 15 nt, Shigella flexneri 2a str. 301
uauguuuauuagccc

SEQ ID NO: 1975200 - RNA, 22 nt, Shigella flexneri 2a str. 301
uauguucagauaaugcccgaug

SEQ ID NO: 1975201 - RNA, 13 nt, Shigella flexneri 2a str. 301
uauguuccccuca

SEQ ID NO: 1975202 - RNA, 13 nt, Shigella flexneri 2a str. 301
uauguugaaaagc

SEQ ID NO: 1975203 - RNA, 23 nt, Shigella flexneri 2a str. 301
uauuaaaagcguugcggcuauau

SEQ ID NO: 1975204 - RNA, 22 nt, Shigella flexneri 2a str. 301
uauguucaggauauuuauauuu

SEQ ID NO: 1975205 - RNA, 18 nt, Shigella flexneri 2a str. 301
uaugucuggcgagcucca

SEQ ID NO: 1975206 - RNA, 19 nt, Shigella flexneri 2a str. 301
uaugugacuggaaaucaaa

SEQ ID NO: 1975207 - RNA, 18 nt, Shigella flexneri 2a str. 301
uaugugcuucuaccauga

SEQ ID NO: 1975208 - RNA, 16 nt, Shigella flexneri 2a str. 301
uaugugguuaugccau

SEQ ID NO: 1975209 - RNA, 17 nt, Shigella flexneri 2a str. 301
uauggcaccuguugcca

SEQ ID NO: 1975210 - RNA, 14 nt, Shigella flexneri 2a str. 301
uauggcauugucug

SEQ ID NO: 1975211 - RNA, 17 nt, Shigella flexneri 2a str. 301
uauggcgaacuggucug

SEQ ID NO: 1975212 - RNA, 13 nt, Shigella flexneri 2a str. 301
uauggcucgccau

SEQ ID NO: 1975213 - RNA, 21 nt, Shigella flexneri 2a str. 301
uauggcaaucuuccucgccag

SEQ ID NO: 1975214 - RNA, 18 nt, Shigella flexneri 2a str. 301
uaugcugaaucgccaaaa

SEQ ID NO: 1975215 - RNA, 23 nt, Shigella flexneri 2a str. 301
uaugcugaaucgccaaaaacaua

SEQ ID NO: 1975216 - RNA, 13 nt, Shigella flexneri 2a str. 301
uaugcuuaauguu

SEQ ID NO: 1975217 - RNA, 20 nt, Shigella flexneri 2a str. 301
uaugcuggagaagauauugc

SEQ ID NO: 1975218 - RNA, 19 nt, Shigella flexneri 2a str. 301
uauggaaaaguugcuuugg

SEQ ID NO: 1975219 - RNA, 14 nt, Shigella flexneri 2a str. 301
uauggaaagcggcu

SEQ ID NO: 1975220 - RNA, 11 nt, Shigella flexneri 2a str. 301
uaugcgucagc

SEQ ID NO: 1975221 - RNA, 17 nt, Shigella flexneri 2a str. 301
uaugcgggcguuuugcu

SEQ ID NO: 1975222 - RNA, 15 nt, Shigella flexneri 2a str. 301
uaugcgccuuuacca

SEQ ID NO: 1975223 - RNA, 24 nt, Shigella flexneri 2a str. 301
uaugccacgugagcuuuucugcuu

SEQ ID NO: 1975224 - RNA, 15 nt, Shigella flexneri 2a str. 301
uaugccagccccagc

SEQ ID NO: 1975225 - RNA, 14 nt, Shigella flexneri 2a str. 301
uaugcccagcgcag

SEQ ID NO: 1975226 - RNA, 14 nt, Shigella flexneri 2a str. 301
uaugccucuuucag

SEQ ID NO: 1975227 - RNA, 13 nt, Shigella flexneri 2a str. 301
uaugcccagggca

SEQ ID NO: 1975228 - RNA, 17 nt, Shigella flexneri 2a str. 301
uaugcccagggcaaugu

SEQ ID NO: 1975229 - RNA, 14 nt, Shigella flexneri 2a str. 301
uauaaugacugccc

SEQ ID NO: 1975230 - RNA, 21 nt, Shigella flexneri 2a str. 301
uauaguaucguuaaauucuaa

SEQ ID NO: 1975231 - RNA, 22 nt, Shigella flexneri 2a str. 301
uauagugauccugcauacugac

SEQ ID NO: 1975232 - RNA, 21 nt, Shigella flexneri 2a str. 301
uauagugugcaaucacuuccu

SEQ ID NO: 1975233 - RNA, 17 nt, Shigella flexneri 2a str. 301
uauaucccauuuuugaa

SEQ ID NO: 1975234 - RNA, 14 nt, Shigella flexneri 2a str. 301
uauaucccauuuuu

SEQ ID NO: 1975235 - RNA, 13 nt, Shigella flexneri 2a str. 301
uauaucagugaua

SEQ ID NO: 1975236 - RNA, 13 nt, Shigella flexneri 2a str. 301
uauauacaccaac

SEQ ID NO: 1975237 - RNA, 18 nt, Shigella flexneri 2a str. 301
uauauaauuaaaaauagu

SEQ ID NO: 1975238 - RNA, 13 nt, Shigella flexneri 2a str. 301
uauauaauuaaaa

SEQ ID NO: 1975239 - RNA, 13 nt, Shigella flexneri 2a str. 301
uauauaaauuacc

SEQ ID NO: 1975240 - RNA, 18 nt, Shigella flexneri 2a str. 301
uaucacgaugcuaaaaac

SEQ ID NO: 1975241 - RNA, 20 nt, Shigella flexneri 2a str. 301
uaucacgaugcuaaaaacau

SEQ ID NO: 1975242 - RNA, 14 nt, Shigella flexneri 2a str. 301
uaucacgccaccag

SEQ ID NO: 1975243 - RNA, 15 nt, Shigella flexneri 2a str. 301
uaucaaacugaccuu

SEQ ID NO: 1975244 - RNA, 16 nt, Shigella flexneri 2a str. 301
uaucaaauucauugcg

SEQ ID NO: 1975245 - RNA, 13 nt, Shigella flexneri 2a str. 301
uauauuuuuaaau

SEQ ID NO: 1975246 - RNA, 15 nt, Shigella flexneri 2a str. 301
uauauuuuuaaauau

SEQ ID NO: 1975247 - RNA, 20 nt, Shigella flexneri 2a str. 301
uauauuuuuaaauauaaaac

SEQ ID NO: 1975248 - RNA, 15 nt, Shigella flexneri 2a str. 301
uaucaaacccuucca

SEQ ID NO: 1975249 - RNA, 12 nt, Shigella flexneri 2a str. 301
uaucaaacguga

SEQ ID NO: 1975250 - RNA, 21 nt, Shigella flexneri 2a str. 301
uauauuuccccuguugcaaac

SEQ ID NO: 1975251 - RNA, 21 nt, Shigella flexneri 2a str. 301
uauauuuccagacaucuguua

SEQ ID NO: 1975252 - RNA, 13 nt, Shigella flexneri 2a str. 301
uauauuucaucaa

SEQ ID NO: 1975253 - RNA, 17 nt, Shigella flexneri 2a str. 301
uauaugaugaaacugau

SEQ ID NO: 1975254 - RNA, 18 nt, Shigella flexneri 2a str. 301
uauaugauaauuauuaua

SEQ ID NO: 1975255 - RNA, 19 nt, Shigella flexneri 2a str. 301
uauccggcccacaucaacu

SEQ ID NO: 1975256 - RNA, 15 nt, Shigella flexneri 2a str. 301
uauccggccuacaca

SEQ ID NO: 1975257 - RNA, 14 nt, Shigella flexneri 2a str. 301
uauccggcuaacaa

SEQ ID NO: 1975258 - RNA, 16 nt, Shigella flexneri 2a str. 301
uauccguaccuaaccu

SEQ ID NO: 1975259 - RNA, 23 nt, Shigella flexneri 2a str. 301
uauccggugcaacugcuucaaaa

SEQ ID NO: 1975260 - RNA, 15 nt, Shigella flexneri 2a str. 301
uauccaguuucugcc

SEQ ID NO: 1975261 - RNA, 21 nt, Shigella flexneri 2a str. 301
uauccacgauacgcugcacaa

SEQ ID NO: 1975262 - RNA, 14 nt, Shigella flexneri 2a str. 301
uauccaccacccag

SEQ ID NO: 1975263 - RNA, 21 nt, Shigella flexneri 2a str. 301
uauccaccuccagcuccgcca

SEQ ID NO: 1975264 - RNA, 13 nt, Shigella flexneri 2a str. 301
uauccauauggcu

SEQ ID NO: 1975265 - RNA, 20 nt, Shigella flexneri 2a str. 301
uauccauuugugacauuaac

SEQ ID NO: 1975266 - RNA, 16 nt, Shigella flexneri 2a str. 301
uaucauuuugcugcca

SEQ ID NO: 1975267 - RNA, 18 nt, Shigella flexneri 2a str. 301
uaucauuuuacguugcau

SEQ ID NO: 1975268 - RNA, 15 nt, Shigella flexneri 2a str. 301
uauccaaaucgcagu

SEQ ID NO: 1975269 - RNA, 18 nt, Shigella flexneri 2a str. 301
uaucauugcgugguuuuu

SEQ ID NO: 1975270 - RNA, 21 nt, Shigella flexneri 2a str. 301
uaucauugcgugguuuuugcu

SEQ ID NO: 1975271 - RNA, 22 nt, Shigella flexneri 2a str. 301
uaucauugcgugguuuuugcug

SEQ ID NO: 1975272 - RNA, 12 nt, Shigella flexneri 2a str. 301
uaucagcaacuc

SEQ ID NO: 1975273 - RNA, 17 nt, Shigella flexneri 2a str. 301
uaucagcaaagcaaauu

SEQ ID NO: 1975274 - RNA, 21 nt, Shigella flexneri 2a str. 301
uaucagagauucuuuuccuuu

SEQ ID NO: 1975275 - RNA, 12 nt, Shigella flexneri 2a str. 301
uaucagagcccu

SEQ ID NO: 1975276 - RNA, 20 nt, Shigella flexneri 2a str. 301
uaucagagauaaccacguuc

SEQ ID NO: 1975277 - RNA, 17 nt, Shigella flexneri 2a str. 301
uaucagaagauuaagag

SEQ ID NO: 1975278 - RNA, 14 nt, Shigella flexneri 2a str. 301
uaucuccucugcuu

SEQ ID NO: 1975279 - RNA, 12 nt, Shigella flexneri 2a str. 301
uaucuccagcua

SEQ ID NO: 1975280 - RNA, 23 nt, Shigella flexneri 2a str. 301
uaucguagccccagucuuccugc

SEQ ID NO: 1975281 - RNA, 19 nt, Shigella flexneri 2a str. 301
uaucgugacaauaauaccc

SEQ ID NO: 1975282 - RNA, 24 nt, Shigella flexneri 2a str. 301
uaucgugccuacacauuaucucaa

SEQ ID NO: 1975283 - RNA, 21 nt, Shigella flexneri 2a str. 301
uaucgugcuggauuuguguca

SEQ ID NO: 1975284 - RNA, 15 nt, Shigella flexneri 2a str. 301
uaucgcauuaucaaa

SEQ ID NO: 1975285 - RNA, 15 nt, Shigella flexneri 2a str. 301
uaucgccagcgccac

SEQ ID NO: 1975286 - RNA, 19 nt, Shigella flexneri 2a str. 301
uaucgccaggccagccugg

SEQ ID NO: 1975287 - RNA, 21 nt, Shigella flexneri 2a str. 301
uaucgccacaauaacugccgg

SEQ ID NO: 1975288 - RNA, 21 nt, Shigella flexneri 2a str. 301
uauccugcccacuccagcuau

SEQ ID NO: 1975289 - RNA, 14 nt, Shigella flexneri 2a str. 301
uauccugauaaaaa

SEQ ID NO: 1975290 - RNA, 22 nt, Shigella flexneri 2a str. 301
uaucgcgucaacagggcagaca

SEQ ID NO: 1975291 - RNA, 18 nt, Shigella flexneri 2a str. 301
uaucgccguacauagcgu

SEQ ID NO: 1975292 - RNA, 23 nt, Shigella flexneri 2a str. 301
uaucgcugauauacccuucauca

SEQ ID NO: 1975293 - RNA, 15 nt, Shigella flexneri 2a str. 301
uaucgcuuuccugga

SEQ ID NO: 1975294 - RNA, 13 nt, Shigella flexneri 2a str. 301
uaucggcaaggaa

SEQ ID NO: 1975295 - RNA, 14 nt, Shigella flexneri 2a str. 301
uaucggccauaugu

SEQ ID NO: 1975296 - RNA, 23 nt, Shigella flexneri 2a str. 301
uaucggcgcugcuuuccugcugc

SEQ ID NO: 1975297 - RNA, 17 nt, Shigella flexneri 2a str. 301
uaguucgcguaacugcu

SEQ ID NO: 1975298 - RNA, 17 nt, Shigella flexneri 2a str. 301
uaguugauuaauuucau

SEQ ID NO: 1975299 - RNA, 19 nt, Shigella flexneri 2a str. 301
uaguugcauuccaguccac

SEQ ID NO: 1975300 - RNA, 19 nt, Shigella flexneri 2a str. 301
uaguugcugucgacaaagc

SEQ ID NO: 1975301 - RNA, 13 nt, Shigella flexneri 2a str. 301
uaguucauccccu

SEQ ID NO: 1975302 - RNA, 16 nt, Shigella flexneri 2a str. 301
uaguucauccccucuu

SEQ ID NO: 1975303 - RNA, 18 nt, Shigella flexneri 2a str. 301
uaguucauccccucuucc

SEQ ID NO: 1975304 - RNA, 16 nt, Shigella flexneri 2a str. 301
uaguucauccagugcu

SEQ ID NO: 1975305 - RNA, 14 nt, Shigella flexneri 2a str. 301
uagugccgucagca

SEQ ID NO: 1975306 - RNA, 11 nt, Shigella flexneri 2a str. 301
uagugccaacg

SEQ ID NO: 1975307 - RNA, 13 nt, Shigella flexneri 2a str. 301
uagugcaguacau

SEQ ID NO: 1975308 - RNA, 18 nt, Shigella flexneri 2a str. 301
uagugcggcaugguuccg

SEQ ID NO: 1975309 - RNA, 16 nt, Shigella flexneri 2a str. 301
uaguuguacaacugcu

SEQ ID NO: 1975310 - RNA, 17 nt, Shigella flexneri 2a str. 301
uauaaagaaaaucugaa

SEQ ID NO: 1975311 - RNA, 18 nt, Shigella flexneri 2a str. 301
uauaaccugaauauuagu

SEQ ID NO: 1975312 - RNA, 18 nt, Shigella flexneri 2a str. 301
uauaaccggcaacagaac

SEQ ID NO: 1975313 - RNA, 22 nt, Shigella flexneri 2a str. 301
uauaaguggcgcucucaagcca

SEQ ID NO: 1975314 - RNA, 15 nt, Shigella flexneri 2a str. 301
uauaaguguaaaauu

SEQ ID NO: 1975315 - RNA, 18 nt, Shigella flexneri 2a str. 301
uaguagguccugaccaaa

SEQ ID NO: 1975316 - RNA, 16 nt, Shigella flexneri 2a str. 301
uaguauuguuaaauau

SEQ ID NO: 1975317 - RNA, 11 nt, Shigella flexneri 2a str. 301
uaguauuuauc

SEQ ID NO: 1975318 - RNA, 15 nt, Shigella flexneri 2a str. 301
uagucaauuaaaaaa

SEQ ID NO: 1975319 - RNA, 14 nt, Shigella flexneri 2a str. 301
uaguauuaagccag

SEQ ID NO: 1975320 - RNA, 16 nt, Shigella flexneri 2a str. 301
uaguaucgcucaauau

SEQ ID NO: 1975321 - RNA, 20 nt, Shigella flexneri 2a str. 301
uaguauggagcaggaauaua

SEQ ID NO: 1975322 - RNA, 18 nt, Shigella flexneri 2a str. 301
uagucaucaucaggaaca

SEQ ID NO: 1975323 - RNA, 22 nt, Shigella flexneri 2a str. 301
uagugaugccauacuucauaac

SEQ ID NO: 1975324 - RNA, 19 nt, Shigella flexneri 2a str. 301
uagugacucuuuauuucau

SEQ ID NO: 1975325 - RNA, 15 nt, Shigella flexneri 2a str. 301
uagucccaaacagca

SEQ ID NO: 1975326 - RNA, 20 nt, Shigella flexneri 2a str. 301
uagucccuucgguagcagcu

SEQ ID NO: 1975327 - RNA, 15 nt, Shigella flexneri 2a str. 301
uagguggcaccugac

SEQ ID NO: 1975328 - RNA, 20 nt, Shigella flexneri 2a str. 301
uagguggcaaagaaauccac

SEQ ID NO: 1975329 - RNA, 19 nt, Shigella flexneri 2a str. 301
uagguccugaccaaagccc

SEQ ID NO: 1975330 - RNA, 20 nt, Shigella flexneri 2a str. 301
uagguccugaccaaagcccc

SEQ ID NO: 1975331 - RNA, 22 nt, Shigella flexneri 2a str. 301
uaguaaaugggccaacaccaga

SEQ ID NO: 1975332 - RNA, 17 nt, Shigella flexneri 2a str. 301
uaguacccgaucacaac

SEQ ID NO: 1975333 - RNA, 18 nt, Shigella flexneri 2a str. 301
uaguaccguuuuguagau

SEQ ID NO: 1975334 - RNA, 21 nt, Shigella flexneri 2a str. 301
uagcggacucaccgagcagca

SEQ ID NO: 1975335 - RNA, 18 nt, Shigella flexneri 2a str. 301
uagcgcuuguaggaauca

SEQ ID NO: 1975336 - RNA, 16 nt, Shigella flexneri 2a str. 301
uagcggcggcagauug

SEQ ID NO: 1975337 - RNA, 17 nt, Shigella flexneri 2a str. 301
uagcggucgaugaugau

SEQ ID NO: 1975338 - RNA, 18 nt, Shigella flexneri 2a str. 301
uagcguccggcugccagc

SEQ ID NO: 1975339 - RNA, 16 nt, Shigella flexneri 2a str. 301
uagcgugacaccagca

SEQ ID NO: 1975340 - RNA, 19 nt, Shigella flexneri 2a str. 301
uagcuaauuuuuguuguuu

SEQ ID NO: 1975341 - RNA, 13 nt, Shigella flexneri 2a str. 301
uagcgcaucacuu

SEQ ID NO: 1975342 - RNA, 14 nt, Shigella flexneri 2a str. 301
uagcgcaucaggca

SEQ ID NO: 1975343 - RNA, 23 nt, Shigella flexneri 2a str. 301
uagccgaccgcaaggaagccuga

SEQ ID NO: 1975344 - RNA, 22 nt, Shigella flexneri 2a str. 301
uagccgaccgcaaggaagccug

SEQ ID NO: 1975345 - RNA, 17 nt, Shigella flexneri 2a str. 301
uaggcaggauaaggcgu

SEQ ID NO: 1975346 - RNA, 23 nt, Shigella flexneri 2a str. 301
uaggcaauuggcgcaucaugccu

SEQ ID NO: 1975347 - RNA, 14 nt, Shigella flexneri 2a str. 301
uaggcaagccacaa

SEQ ID NO: 1975348 - RNA, 15 nt, Shigella flexneri 2a str. 301
uagcuauauuuugcc

SEQ ID NO: 1975349 - RNA, 18 nt, Shigella flexneri 2a str. 301
uagcugucccaagugauu

SEQ ID NO: 1975350 - RNA, 20 nt, Shigella flexneri 2a str. 301
uagcuucagccgggaagaau

SEQ ID NO: 1975351 - RNA, 21 nt, Shigella flexneri 2a str. 301
uagcuucaaauagugccuggc

SEQ ID NO: 1975352 - RNA, 18 nt, Shigella flexneri 2a str. 301
uagcuucgaaguuuucac

SEQ ID NO: 1975353 - RNA, 16 nt, Shigella flexneri 2a str. 301
uaggacgaaaaaucaa

SEQ ID NO: 1975354 - RNA, 21 nt, Shigella flexneri 2a str. 301
uaggacagcguugccagcucg

SEQ ID NO: 1975355 - RNA, 16 nt, Shigella flexneri 2a str. 301
uagcagcacaccacau

SEQ ID NO: 1975356 - RNA, 11 nt, Shigella flexneri 2a str. 301
uagcagcagcg

SEQ ID NO: 1975357 - RNA, 15 nt, Shigella flexneri 2a str. 301
uagcaacugauuuau

SEQ ID NO: 1975358 - RNA, 20 nt, Shigella flexneri 2a str. 301
uagcaaaguaauaaugauca

SEQ ID NO: 1975359 - RNA, 23 nt, Shigella flexneri 2a str. 301
uagcaaauuaucccccagcacuu

SEQ ID NO: 1975360 - RNA, 15 nt, Shigella flexneri 2a str. 301
uagcaacagcagcca

SEQ ID NO: 1975361 - RNA, 20 nt, Shigella flexneri 2a str. 301
uagcaaacuaucuguguaau

SEQ ID NO: 1975362 - RNA, 14 nt, Shigella flexneri 2a str. 301
uagcaucuuccagc

SEQ ID NO: 1975363 - RNA, 20 nt, Shigella flexneri 2a str. 301
uagcaucgcaucaggcaaug

SEQ ID NO: 1975364 - RNA, 16 nt, Shigella flexneri 2a str. 301
uagcaucgcgauggca

SEQ ID NO: 1975365 - RNA, 12 nt, Shigella flexneri 2a str. 301
uagcaucccaau

SEQ ID NO: 1975366 - RNA, 13 nt, Shigella flexneri 2a str. 301
uagcauccaccac

SEQ ID NO: 1975367 - RNA, 14 nt, Shigella flexneri 2a str. 301
uagcauccaccaca

SEQ ID NO: 1975368 - RNA, 15 nt, Shigella flexneri 2a str. 301
uagcccggauagcgu

SEQ ID NO: 1975369 - RNA, 15 nt, Shigella flexneri 2a str. 301
uagcccaccuacacc

SEQ ID NO: 1975370 - RNA, 16 nt, Shigella flexneri 2a str. 301
uagccauuugauucac

SEQ ID NO: 1975371 - RNA, 13 nt, Shigella flexneri 2a str. 301
uagauuuuuaaug

SEQ ID NO: 1975372 - RNA, 18 nt, Shigella flexneri 2a str. 301
uagauuuugaguaagcag

SEQ ID NO: 1975373 - RNA, 23 nt, Shigella flexneri 2a str. 301
uagauuuauuuauuauuaaagag

SEQ ID NO: 1975374 - RNA, 23 nt, Shigella flexneri 2a str. 301
uagauuuacuauuauuuuucaua

SEQ ID NO: 1975375 - RNA, 17 nt, Shigella flexneri 2a str. 301
uagauuuacgcucuucc

SEQ ID NO: 1975376 - RNA, 14 nt, Shigella flexneri 2a str. 301
uagauucaacauaa

SEQ ID NO: 1975377 - RNA, 21 nt, Shigella flexneri 2a str. 301
uagauuaauuucccaccacua

SEQ ID NO: 1975378 - RNA, 15 nt, Shigella flexneri 2a str. 301
uagaucuugauuuac

SEQ ID NO: 1975379 - RNA, 21 nt, Shigella flexneri 2a str. 301
uagaugaucgccgcacuuucu

SEQ ID NO: 1975380 - RNA, 18 nt, Shigella flexneri 2a str. 301
uagaugugcaguuccugc

SEQ ID NO: 1975381 - RNA, 19 nt, Shigella flexneri 2a str. 301
uagaugugcaguuccugca

SEQ ID NO: 1975382 - RNA, 18 nt, Shigella flexneri 2a str. 301
uagaugugggcaaucuca

SEQ ID NO: 1975383 - RNA, 22 nt, Shigella flexneri 2a str. 301
uagaugugggcaaucucacucc

SEQ ID NO: 1975384 - RNA, 16 nt, Shigella flexneri 2a str. 301
uagaugugcaguuccu

SEQ ID NO: 1975385 - RNA, 17 nt, Shigella flexneri 2a str. 301
ucagcaguucugccagg

SEQ ID NO: 1975386 - RNA, 16 nt, Shigella flexneri 2a str. 301
ucagcaguucugccag

SEQ ID NO: 1975387 - RNA, 14 nt, Shigella flexneri 2a str. 301
ucagcaguucagca

SEQ ID NO: 1975388 - RNA, 19 nt, Shigella flexneri 2a str. 301
ucagcauauaggaggccuc

SEQ ID NO: 1975389 - RNA, 15 nt, Shigella flexneri 2a str. 301
ucagcagugccagua

SEQ ID NO: 1975390 - RNA, 20 nt, Shigella flexneri 2a str. 301
ucagcaggaauguuguccag

SEQ ID NO: 1975391 - RNA, 15 nt, Shigella flexneri 2a str. 301
ucagcagcucaucaa

SEQ ID NO: 1975392 - RNA, 22 nt, Shigella flexneri 2a str. 301
ucagcagacggccaaaaucucu

SEQ ID NO: 1975393 - RNA, 17 nt, Shigella flexneri 2a str. 301
ucagcagcagacagccu

SEQ ID NO: 1975394 - RNA, 14 nt, Shigella flexneri 2a str. 301
ucagcagcaccacc

SEQ ID NO: 1975395 - RNA, 16 nt, Shigella flexneri 2a str. 301
ucagcaauguuucucu

SEQ ID NO: 1975396 - RNA, 15 nt, Shigella flexneri 2a str. 301
ucagcaauuucuccg

SEQ ID NO: 1975397 - RNA, 19 nt, Shigella flexneri 2a str. 301
ucagcaaucugaagccgca

SEQ ID NO: 1975398 - RNA, 18 nt, Shigella flexneri 2a str. 301
ucagcaaucgcgccagcc

SEQ ID NO: 1975399 - RNA, 17 nt, Shigella flexneri 2a str. 301
ucagcaaucgcgccagc

SEQ ID NO: 1975400 - RNA, 14 nt, Shigella flexneri 2a str. 301
ucagcaauacgcuu

SEQ ID NO: 1975401 - RNA, 13 nt, Shigella flexneri 2a str. 301
ucagcaacaugcc

SEQ ID NO: 1975402 - RNA, 12 nt, Shigella flexneri 2a str. 301
ucagcaccagau

SEQ ID NO: 1975403 - RNA, 19 nt, Shigella flexneri 2a str. 301
ucagcacgacauaagcgca

SEQ ID NO: 1975404 - RNA, 15 nt, Shigella flexneri 2a str. 301
ucagccgcaaaccug

SEQ ID NO: 1975405 - RNA, 14 nt, Shigella flexneri 2a str. 301
ucagccgcaaacuc

SEQ ID NO: 1975406 - RNA, 22 nt, Shigella flexneri 2a str. 301
ucagccgcccgcgauaaaaauc

SEQ ID NO: 1975407 - RNA, 14 nt, Shigella flexneri 2a str. 301
ucagcccgaugaua

SEQ ID NO: 1975408 - RNA, 17 nt, Shigella flexneri 2a str. 301
ucagccgucauccagga

SEQ ID NO: 1975409 - RNA, 20 nt, Shigella flexneri 2a str. 301
ucagccugcucaguugcauc

SEQ ID NO: 1975410 - RNA, 11 nt, Shigella flexneri 2a str. 301
ucagccucugc

SEQ ID NO: 1975411 - RNA, 16 nt, Shigella flexneri 2a str. 301
ucagccaaauccagcg

SEQ ID NO: 1975412 - RNA, 20 nt, Shigella flexneri 2a str. 301
ucagcauuuucuauuucuga

SEQ ID NO: 1975413 - RNA, 19 nt, Shigella flexneri 2a str. 301
ucagcauccauaucgccau

SEQ ID NO: 1975414 - RNA, 15 nt, Shigella flexneri 2a str. 301
ucagcaugacaaaaa

SEQ ID NO: 1975415 - RNA, 16 nt, Shigella flexneri 2a str. 301
ucagcaugacaaaaaa

SEQ ID NO: 1975416 - RNA, 19 nt, Shigella flexneri 2a str. 301
ucagcccaaagcagaguug

SEQ ID NO: 1975417 - RNA, 13 nt, Shigella flexneri 2a str. 301
ucagcccaaccac

SEQ ID NO: 1975418 - RNA, 13 nt, Shigella flexneri 2a str. 301
ucagccccuccac

SEQ ID NO: 1975419 - RNA, 14 nt, Shigella flexneri 2a str. 301
ucagccccuccaca

SEQ ID NO: 1975420 - RNA, 18 nt, Shigella flexneri 2a str. 301
ucagcccacauccaugug

SEQ ID NO: 1975421 - RNA, 17 nt, Shigella flexneri 2a str. 301
ucagccagaaagaaccg

SEQ ID NO: 1975422 - RNA, 14 nt, Shigella flexneri 2a str. 301
ucagccagaaagaa

SEQ ID NO: 1975423 - RNA, 13 nt, Shigella flexneri 2a str. 301
ucagccacuuccu

SEQ ID NO: 1975424 - RNA, 19 nt, Shigella flexneri 2a str. 301
ucagaucgguuuuuuucga

SEQ ID NO: 1975425 - RNA, 16 nt, Shigella flexneri 2a str. 301
ucagaucguugaccug

SEQ ID NO: 1975426 - RNA, 21 nt, Shigella flexneri 2a str. 301
ucagaucuaauguugguguga

SEQ ID NO: 1975427 - RNA, 18 nt, Shigella flexneri 2a str. 301
ucagaucgcgaccgccuu

SEQ ID NO: 1975428 - RNA, 23 nt, Shigella flexneri 2a str. 301
ucagauccgccaguuuguagcca

SEQ ID NO: 1975429 - RNA, 17 nt, Shigella flexneri 2a str. 301
ucagaucagccacuucc

SEQ ID NO: 1975430 - RNA, 20 nt, Shigella flexneri 2a str. 301
ucagaucagccacuuccugc

SEQ ID NO: 1975431 - RNA, 18 nt, Shigella flexneri 2a str. 301
ucagaucuuucacgaaca

SEQ ID NO: 1975432 - RNA, 22 nt, Shigella flexneri 2a str. 301
ucagaucguucgcaccaaaucc

SEQ ID NO: 1975433 - RNA, 21 nt, Shigella flexneri 2a str. 301
ucagauguuccgccauuuuaa

SEQ ID NO: 1975434 - RNA, 16 nt, Shigella flexneri 2a str. 301
ucagauggcggcuggc

SEQ ID NO: 1975435 - RNA, 18 nt, Shigella flexneri 2a str. 301
ucagcaaauagauaaaau

SEQ ID NO: 1975436 - RNA, 23 nt, Shigella flexneri 2a str. 301
ucagauuguugauuaacaggcug

SEQ ID NO: 1975437 - RNA, 16 nt, Shigella flexneri 2a str. 301
ucagauuguugauuaa

SEQ ID NO: 1975438 - RNA, 20 nt, Shigella flexneri 2a str. 301
ucagauuggcuucauugauu

SEQ ID NO: 1975439 - RNA, 22 nt, Shigella flexneri 2a str. 301
ucagauaauccccaaugaccuu

SEQ ID NO: 1975440 - RNA, 21 nt, Shigella flexneri 2a str. 301
ucagauaauccccaaugaccu

SEQ ID NO: 1975441 - RNA, 22 nt, Shigella flexneri 2a str. 301
ucagauaaugcccgaugaccuu

SEQ ID NO: 1975442 - RNA, 12 nt, Shigella flexneri 2a str. 301
ucagauaaaaua

SEQ ID NO: 1975443 - RNA, 18 nt, Shigella flexneri 2a str. 301
ucagagugccgaagaaca

SEQ ID NO: 1975444 - RNA, 20 nt, Shigella flexneri 2a str. 301
ucagagugccgaagaacaua

SEQ ID NO: 1975445 - RNA, 18 nt, Shigella flexneri 2a str. 301
ucagauaauccccaauga

SEQ ID NO: 1975446 - RNA, 18 nt, Shigella flexneri 2a str. 301
ucagauaauagguaaaca

SEQ ID NO: 1975447 - RNA, 15 nt, Shigella flexneri 2a str. 301
ucagauaaaauacac

SEQ ID NO: 1975448 - RNA, 20 nt, Shigella flexneri 2a str. 301
ucagauaaaucacgcuucac

SEQ ID NO: 1975449 - RNA, 13 nt, Shigella flexneri 2a str. 301
ucagauaaaugca

SEQ ID NO: 1975450 - RNA, 14 nt, Shigella flexneri 2a str. 301
ucagagagccagcc

SEQ ID NO: 1975451 - RNA, 13 nt, Shigella flexneri 2a str. 301
ucagagagccagc

SEQ ID NO: 1975452 - RNA, 15 nt, Shigella flexneri 2a str. 301
ucagaggcuguuccg

SEQ ID NO: 1975453 - RNA, 20 nt, Shigella flexneri 2a str. 301
ucagacucauauaaaaaccg

SEQ ID NO: 1975454 - RNA, 16 nt, Shigella flexneri 2a str. 301
ucagacucucauuuuu

SEQ ID NO: 1975455 - RNA, 19 nt, Shigella flexneri 2a str. 301
ucagacggcugucuuccug

SEQ ID NO: 1975456 - RNA, 18 nt, Shigella flexneri 2a str. 301
ucagacggcugucuuccu

SEQ ID NO: 1975457 - RNA, 18 nt, Shigella flexneri 2a str. 301
ucagaccggcaaccagca

SEQ ID NO: 1975458 - RNA, 20 nt, Shigella flexneri 2a str. 301
ucagacaaaugucacugcuu

SEQ ID NO: 1975459 - RNA, 13 nt, Shigella flexneri 2a str. 301
ucagacaccaguc

SEQ ID NO: 1975460 - RNA, 18 nt, Shigella flexneri 2a str. 301
ucagaaugcgcucuuccg

SEQ ID NO: 1975461 - RNA, 19 nt, Shigella flexneri 2a str. 301
ucagacccugcucuuucag

SEQ ID NO: 1975462 - RNA, 23 nt, Shigella flexneri 2a str. 301
ucagaccgcuucugcguucugau

SEQ ID NO: 1975463 - RNA, 19 nt, Shigella flexneri 2a str. 301
ucagacacgccgccagacc

SEQ ID NO: 1975464 - RNA, 19 nt, Shigella flexneri 2a str. 301
ucagaaaaaucaauauuuu

SEQ ID NO: 1975465 - RNA, 13 nt, Shigella flexneri 2a str. 301
ucacuuuuuuccg

SEQ ID NO: 1975466 - RNA, 22 nt, Shigella flexneri 2a str. 301
ucagaaacgcucauaaauugca

SEQ ID NO: 1975467 - RNA, 17 nt, Shigella flexneri 2a str. 301
ucagaaaguaauaugug

SEQ ID NO: 1975468 - RNA, 18 nt, Shigella flexneri 2a str. 301
ucagaaagcgccagcaag

SEQ ID NO: 1975469 - RNA, 20 nt, Shigella flexneri 2a str. 301
ucagaaagccgccgacaugu

SEQ ID NO: 1975470 - RNA, 20 nt, Shigella flexneri 2a str. 301
ucagaaaguaauuacacccu

SEQ ID NO: 1975471 - RNA, 21 nt, Shigella flexneri 2a str. 301
ucagaaaguaauuacacccuu

SEQ ID NO: 1975472 - RNA, 16 nt, Shigella flexneri 2a str. 301
ucagaaagugccacgc

SEQ ID NO: 1975473 - RNA, 22 nt, Shigella flexneri 2a str. 301
ucagaaauuuggcuccucugac

SEQ ID NO: 1975474 - RNA, 15 nt, Shigella flexneri 2a str. 301
ucagaagacgcucca

SEQ ID NO: 1975475 - RNA, 22 nt, Shigella flexneri 2a str. 301
ucagaacaguuuucagugcuuc

SEQ ID NO: 1975476 - RNA, 21 nt, Shigella flexneri 2a str. 301
ucagaauagacaaaaauuucu

SEQ ID NO: 1975477 - RNA, 15 nt, Shigella flexneri 2a str. 301
ucagaaguugcaccc

SEQ ID NO: 1975478 - RNA, 21 nt, Shigella flexneri 2a str. 301
ucagaaucacgccaacaaaca

SEQ ID NO: 1975479 - RNA, 12 nt, Shigella flexneri 2a str. 301
ucacgcuaaaag

SEQ ID NO: 1975480 - RNA, 12 nt, Shigella flexneri 2a str. 301
ucacgcgcugcc

SEQ ID NO: 1975481 - RNA, 13 nt, Shigella flexneri 2a str. 301
ucacggcaccagc

SEQ ID NO: 1975482 - RNA, 19 nt, Shigella flexneri 2a str. 301
ucacggaaucccguaaucc

SEQ ID NO: 1975483 - RNA, 22 nt, Shigella flexneri 2a str. 301
ucacgcuuaucgcccuggauuu

SEQ ID NO: 1975484 - RNA, 15 nt, Shigella flexneri 2a str. 301
ucacggcgcaugccu

SEQ ID NO: 1975485 - RNA, 19 nt, Shigella flexneri 2a str. 301
ucacggcgacggcuggcaa

SEQ ID NO: 1975486 - RNA, 18 nt, Shigella flexneri 2a str. 301
ucacggccacucugccug

SEQ ID NO: 1975487 - RNA, 23 nt, Shigella flexneri 2a str. 301
ucacgccgcauccgacauuugca

SEQ ID NO: 1975488 - RNA, 19 nt, Shigella flexneri 2a str. 301
ucacgccgcauccggcauu

SEQ ID NO: 1975489 - RNA, 16 nt, Shigella flexneri 2a str. 301
ucacgccgaccagacc

SEQ ID NO: 1975490 - RNA, 15 nt, Shigella flexneri 2a str. 301
ucacgcccgccccag

SEQ ID NO: 1975491 - RNA, 21 nt, Shigella flexneri 2a str. 301
ucacgccgggaaauuuuuccg

SEQ ID NO: 1975492 - RNA, 22 nt, Shigella flexneri 2a str. 301
ucacgccgggaaauuuuuccgu

SEQ ID NO: 1975493 - RNA, 15 nt, Shigella flexneri 2a str. 301
ucacgccgcaucugg

SEQ ID NO: 1975494 - RNA, 21 nt, Shigella flexneri 2a str. 301
ucacgccuugcggaaauucca

SEQ ID NO: 1975495 - RNA, 22 nt, Shigella flexneri 2a str. 301
ucacgccagucgcacacaacag

SEQ ID NO: 1975496 - RNA, 15 nt, Shigella flexneri 2a str. 301
ucacgccaauaaucg

SEQ ID NO: 1975497 - RNA, 13 nt, Shigella flexneri 2a str. 301
ucacgccaccagc

SEQ ID NO: 1975498 - RNA, 16 nt, Shigella flexneri 2a str. 301
ucacgcagcgucagca

SEQ ID NO: 1975499 - RNA, 13 nt, Shigella flexneri 2a str. 301
ucacgcaucacuu

SEQ ID NO: 1975500 - RNA, 13 nt, Shigella flexneri 2a str. 301
ucacgcccagucc

SEQ ID NO: 1975501 - RNA, 16 nt, Shigella flexneri 2a str. 301
ucacgcaaaacgcugc

SEQ ID NO: 1975502 - RNA, 15 nt, Shigella flexneri 2a str. 301
ucacgaucacagcag

SEQ ID NO: 1975503 - RNA, 17 nt, Shigella flexneri 2a str. 301
ucacgauuguuaaucac

SEQ ID NO: 1975504 - RNA, 21 nt, Shigella flexneri 2a str. 301
ucacgauuguuaaucacaucg

SEQ ID NO: 1975505 - RNA, 16 nt, Shigella flexneri 2a str. 301
ucacgcagcucacgca

SEQ ID NO: 1975506 - RNA, 18 nt, Shigella flexneri 2a str. 301
ucacgcagcuucucguga

SEQ ID NO: 1975507 - RNA, 23 nt, Shigella flexneri 2a str. 301
ucacgcagggugugcuccagucg

SEQ ID NO: 1975508 - RNA, 21 nt, Shigella flexneri 2a str. 301
ucaccuccagcgaaggaucac

SEQ ID NO: 1975509 - RNA, 18 nt, Shigella flexneri 2a str. 301
ucaccucaucaccacaga

SEQ ID NO: 1975510 - RNA, 15 nt, Shigella flexneri 2a str. 301
ucaccuacgcuggca

SEQ ID NO: 1975511 - RNA, 13 nt, Shigella flexneri 2a str. 301
ucaccugcacaug

SEQ ID NO: 1975512 - RNA, 17 nt, Shigella flexneri 2a str. 301
ucaccucuuuuuccacu

SEQ ID NO: 1975513 - RNA, 15 nt, Shigella flexneri 2a str. 301
ucaccugcccuccgg

SEQ ID NO: 1975514 - RNA, 21 nt, Shigella flexneri 2a str. 301
ucaccugcccgguauccauca

SEQ ID NO: 1975515 - RNA, 18 nt, Shigella flexneri 2a str. 301
ucaccugcgccugcgguu

SEQ ID NO: 1975516 - RNA, 17 nt, Shigella flexneri 2a str. 301
ucaccugcggugcagcc

SEQ ID NO: 1975517 - RNA, 23 nt, Shigella flexneri 2a str. 301
ucaccugcgucuuucgcggcaac

SEQ ID NO: 1975518 - RNA, 23 nt, Shigella flexneri 2a str. 301
ucaccuuacggcacuccucuuca

SEQ ID NO: 1975519 - RNA, 13 nt, Shigella flexneri 2a str. 301
ucaccuuuucggu

SEQ ID NO: 1975520 - RNA, 15 nt, Shigella flexneri 2a str. 301
ucaccuuuuuccaga

SEQ ID NO: 1975521 - RNA, 15 nt, Shigella flexneri 2a str. 301
ucaccuuuaaccucc

SEQ ID NO: 1975522 - RNA, 14 nt, Shigella flexneri 2a str. 301
ucacgaauccgcac

SEQ ID NO: 1975523 - RNA, 15 nt, Shigella flexneri 2a str. 301
ucacgaauauuuccc

SEQ ID NO: 1975524 - RNA, 15 nt, Shigella flexneri 2a str. 301
ucacgaaucuauuca

SEQ ID NO: 1975525 - RNA, 16 nt, Shigella flexneri 2a str. 301
ucacgaauccgcacca

SEQ ID NO: 1975526 - RNA, 15 nt, Shigella flexneri 2a str. 301
ucacgaagcucucug

SEQ ID NO: 1975527 - RNA, 21 nt, Shigella flexneri 2a str. 301
ucacgaagcucucugcuauuc

SEQ ID NO: 1975528 - RNA, 22 nt, Shigella flexneri 2a str. 301
ucacgaaaacagcgcagcucug

SEQ ID NO: 1975529 - RNA, 15 nt, Shigella flexneri 2a str. 301
ucacgauagccagaa

SEQ ID NO: 1975530 - RNA, 14 nt, Shigella flexneri 2a str. 301
ucacgauagccacg

SEQ ID NO: 1975531 - RNA, 14 nt, Shigella flexneri 2a str. 301
ucacgaugcuaaaa

SEQ ID NO: 1975532 - RNA, 18 nt, Shigella flexneri 2a str. 301
ucacgaaucuauucauuu

SEQ ID NO: 1975533 - RNA, 14 nt, Shigella flexneri 2a str. 301
ucacgagagauacg

SEQ ID NO: 1975534 - RNA, 19 nt, Shigella flexneri 2a str. 301
ucacuaaacccgaccacuu

SEQ ID NO: 1975535 - RNA, 19 nt, Shigella flexneri 2a str. 301
ucacuaaggguaaaacgac

SEQ ID NO: 1975536 - RNA, 20 nt, Shigella flexneri 2a str. 301
ucacuaagaauguccauuau

SEQ ID NO: 1975537 - RNA, 16 nt, Shigella flexneri 2a str. 301
ucacguugacgcauac

SEQ ID NO: 1975538 - RNA, 16 nt, Shigella flexneri 2a str. 301
ucacguaggccugaua

SEQ ID NO: 1975539 - RNA, 14 nt, Shigella flexneri 2a str. 301
ucacguaggccuga

SEQ ID NO: 1975540 - RNA, 16 nt, Shigella flexneri 2a str. 301
ucacgugacaaaaauu

SEQ ID NO: 1975541 - RNA, 19 nt, Shigella flexneri 2a str. 301
ucacguuaucaacuagcug

SEQ ID NO: 1975542 - RNA, 21 nt, Shigella flexneri 2a str. 301
ucacguucacccaucacuacc

SEQ ID NO: 1975543 - RNA, 23 nt, Shigella flexneri 2a str. 301
ucacuacgcgaccgugggcaauu

SEQ ID NO: 1975544 - RNA, 16 nt, Shigella flexneri 2a str. 301
ucacuaccuucuuccc

SEQ ID NO: 1975545 - RNA, 13 nt, Shigella flexneri 2a str. 301
ucacuacaaucag

SEQ ID NO: 1975546 - RNA, 16 nt, Shigella flexneri 2a str. 301
ucacuauacuccugau

SEQ ID NO: 1975547 - RNA, 13 nt, Shigella flexneri 2a str. 301
ucacucaaaauau

SEQ ID NO: 1975548 - RNA, 17 nt, Shigella flexneri 2a str. 301
ucacucaccgcagaaua

SEQ ID NO: 1975549 - RNA, 12 nt, Shigella flexneri 2a str. 301
ucacucaguguu

SEQ ID NO: 1975550 - RNA, 20 nt, Shigella flexneri 2a str. 301
ucacucauacucaccguuca

SEQ ID NO: 1975551 - RNA, 12 nt, Shigella flexneri 2a str. 301
ucacucaggcca

SEQ ID NO: 1975552 - RNA, 20 nt, Shigella flexneri 2a str. 301
ucacucaggccaaaugacau

SEQ ID NO: 1975553 - RNA, 14 nt, Shigella flexneri 2a str. 301
ucacuccggccaga

SEQ ID NO: 1975554 - RNA, 23 nt, Shigella flexneri 2a str. 301
ucacucccggauaaaucuccauu

SEQ ID NO: 1975555 - RNA, 16 nt, Shigella flexneri 2a str. 301
ucacucgacagcaccg

SEQ ID NO: 1975556 - RNA, 17 nt, Shigella flexneri 2a str. 301
ucacucggggcuuuucu

SEQ ID NO: 1975557 - RNA, 14 nt, Shigella flexneri 2a str. 301
ucacuugcuguaau

SEQ ID NO: 1975558 - RNA, 13 nt, Shigella flexneri 2a str. 301
ucacuucugaguu

SEQ ID NO: 1975559 - RNA, 18 nt, Shigella flexneri 2a str. 301
ucacuuucggugacagaa

SEQ ID NO: 1975560 - RNA, 17 nt, Shigella flexneri 2a str. 301
ucacuucgauccaguga

SEQ ID NO: 1975561 - RNA, 18 nt, Shigella flexneri 2a str. 301
ucacuucgauccagugau

SEQ ID NO: 1975562 - RNA, 22 nt, Shigella flexneri 2a str. 301
ucacuucgauccagugauucca

SEQ ID NO: 1975563 - RNA, 18 nt, Shigella flexneri 2a str. 301
ucacuuccaguacgcgca

SEQ ID NO: 1975564 - RNA, 16 nt, Shigella flexneri 2a str. 301
ucacuuccggcaaggc

SEQ ID NO: 1975565 - RNA, 23 nt, Shigella flexneri 2a str. 301
ucacuuaacccauuacaagcccg

SEQ ID NO: 1975566 - RNA, 12 nt, Shigella flexneri 2a str. 301
ucacuggcaaug

SEQ ID NO: 1975567 - RNA, 23 nt, Shigella flexneri 2a str. 301
ucacugcuuuggcucuucgcucc

SEQ ID NO: 1975568 - RNA, 22 nt, Shigella flexneri 2a str. 301
ucacugcgaaagcgucagcuuu

SEQ ID NO: 1975569 - RNA, 15 nt, Shigella flexneri 2a str. 301
ucacugccugcugau

SEQ ID NO: 1975570 - RNA, 21 nt, Shigella flexneri 2a str. 301
ucacugccagaauagccgcag

SEQ ID NO: 1975571 - RNA, 20 nt, Shigella flexneri 2a str. 301
ucacugaugacaagcguaug

SEQ ID NO: 1975572 - RNA, 13 nt, Shigella flexneri 2a str. 301
ucacugcaaauac

SEQ ID NO: 1975573 - RNA, 14 nt, Shigella flexneri 2a str. 301
ucacuggcgucaug

SEQ ID NO: 1975574 - RNA, 16 nt, Shigella flexneri 2a str. 301
ucacuggcaggauaaa

SEQ ID NO: 1975575 - RNA, 20 nt, Shigella flexneri 2a str. 301
ucacuggguucaaaaacuaa

SEQ ID NO: 1975576 - RNA, 14 nt, Shigella flexneri 2a str. 301
ucacugguucaaag

SEQ ID NO: 1975577 - RNA, 20 nt, Shigella flexneri 2a str. 301
ucacugugauggaccgugcc

SEQ ID NO: 1975578 - RNA, 19 nt, Shigella flexneri 2a str. 301
ucacugugacguugcgaca

SEQ ID NO: 1975579 - RNA, 17 nt, Shigella flexneri 2a str. 301
ucacuguugaagccgcc

SEQ ID NO: 1975580 - RNA, 16 nt, Shigella flexneri 2a str. 301
ucacugugcuuuacau

SEQ ID NO: 1975581 - RNA, 18 nt, Shigella flexneri 2a str. 301
ucacugucgaacuggcag

SEQ ID NO: 1975582 - RNA, 17 nt, Shigella flexneri 2a str. 301
ucaaucaccgcuucacu

SEQ ID NO: 1975583 - RNA, 14 nt, Shigella flexneri 2a str. 301
ucaauaugaauuaa

SEQ ID NO: 1975584 - RNA, 19 nt, Shigella flexneri 2a str. 301
ucaauauccugaccuuuac

SEQ ID NO: 1975585 - RNA, 13 nt, Shigella flexneri 2a str. 301
ucaauauauugca

SEQ ID NO: 1975586 - RNA, 18 nt, Shigella flexneri 2a str. 301
ucaauauauugcaaucuc

SEQ ID NO: 1975587 - RNA, 18 nt, Shigella flexneri 2a str. 301
ucaauagcuaacgaaaga

SEQ ID NO: 1975588 - RNA, 14 nt, Shigella flexneri 2a str. 301
ucaauagcaccauu

SEQ ID NO: 1975589 - RNA, 13 nt, Shigella flexneri 2a str. 301
ucaauaaucaacg

SEQ ID NO: 1975590 - RNA, 22 nt, Shigella flexneri 2a str. 301
ucaauaccgccugcaaauaaau

SEQ ID NO: 1975591 - RNA, 20 nt, Shigella flexneri 2a str. 301
ucaauaccgccugcaaauaa

SEQ ID NO: 1975592 - RNA, 19 nt, Shigella flexneri 2a str. 301
ucaauacuuucacaaaaau

SEQ ID NO: 1975593 - RNA, 22 nt, Shigella flexneri 2a str. 301
ucaauacuuuccagcauauguu

SEQ ID NO: 1975594 - RNA, 18 nt, Shigella flexneri 2a str. 301
ucaauacuuucacaaaaa

SEQ ID NO: 1975595 - RNA, 15 nt, Shigella flexneri 2a str. 301
ucaauaacagcgcaa

SEQ ID NO: 1975596 - RNA, 16 nt, Shigella flexneri 2a str. 301
ucaagcuguucuuccc

SEQ ID NO: 1975597 - RNA, 18 nt, Shigella flexneri 2a str. 301
ucaagcugugccugaaua

SEQ ID NO: 1975598 - RNA, 17 nt, Shigella flexneri 2a str. 301
ucaagcucgccaccauu

SEQ ID NO: 1975599 - RNA, 21 nt, Shigella flexneri 2a str. 301
ucaagcgucgcaucaggcaug

SEQ ID NO: 1975600 - RNA, 20 nt, Shigella flexneri 2a str. 301
ucaagcguuucaucuucagu

SEQ ID NO: 1975601 - RNA, 13 nt, Shigella flexneri 2a str. 301
ucaagcucaaaau

SEQ ID NO: 1975602 - RNA, 15 nt, Shigella flexneri 2a str. 301
ucaagcucaaaauaa

SEQ ID NO: 1975603 - RNA, 18 nt, Shigella flexneri 2a str. 301
ucaagcucaaaauaauac

SEQ ID NO: 1975604 - RNA, 20 nt, Shigella flexneri 2a str. 301
ucaaggauugcagcacugau

SEQ ID NO: 1975605 - RNA, 18 nt, Shigella flexneri 2a str. 301
ucaaggucaacaguucau

SEQ ID NO: 1975606 - RNA, 13 nt, Shigella flexneri 2a str. 301
ucaaguaaccuuu

SEQ ID NO: 1975607 - RNA, 16 nt, Shigella flexneri 2a str. 301
ucaagugcuacccacu

SEQ ID NO: 1975608 - RNA, 21 nt, Shigella flexneri 2a str. 301
ucaaguguggccgccagugau

SEQ ID NO: 1975609 - RNA, 19 nt, Shigella flexneri 2a str. 301
ucaaguugacucucaucca

SEQ ID NO: 1975610 - RNA, 23 nt, Shigella flexneri 2a str. 301
ucaagugacauacucuuuccauu

SEQ ID NO: 1975611 - RNA, 14 nt, Shigella flexneri 2a str. 301
ucaauaaaagaaau

SEQ ID NO: 1975612 - RNA, 17 nt, Shigella flexneri 2a str. 301
ucaauaaaaggaaacag

SEQ ID NO: 1975613 - RNA, 20 nt, Shigella flexneri 2a str. 301
ucaaugguggcaaucugaau

SEQ ID NO: 1975614 - RNA, 16 nt, Shigella flexneri 2a str. 301
ucaaugguguuuucca

SEQ ID NO: 1975615 - RNA, 14 nt, Shigella flexneri 2a str. 301
ucaaugucugucau

SEQ ID NO: 1975616 - RNA, 15 nt, Shigella flexneri 2a str. 301
ucaaugcuuuuugca

SEQ ID NO: 1975617 - RNA, 17 nt, Shigella flexneri 2a str. 301
ucaaugcuuuuugcauu

SEQ ID NO: 1975618 - RNA, 15 nt, Shigella flexneri 2a str. 301
ucaauggaugcaauc

SEQ ID NO: 1975619 - RNA, 16 nt, Shigella flexneri 2a str. 301
ucaauggucagcgcca

SEQ ID NO: 1975620 - RNA, 14 nt, Shigella flexneri 2a str. 301
ucaaugauaagccu

SEQ ID NO: 1975621 - RNA, 15 nt, Shigella flexneri 2a str. 301
ucaaugaaugcuucg

SEQ ID NO: 1975622 - RNA, 17 nt, Shigella flexneri 2a str. 301
ucaaugauuucugccag

SEQ ID NO: 1975623 - RNA, 17 nt, Shigella flexneri 2a str. 301
ucaaugcauuaaauugu

SEQ ID NO: 1975624 - RNA, 20 nt, Shigella flexneri 2a str. 301
ucaaugcauuaucagagauu

SEQ ID NO: 1975625 - RNA, 16 nt, Shigella flexneri 2a str. 301
ucaaugcccaucacua

SEQ ID NO: 1975626 - RNA, 15 nt, Shigella flexneri 2a str. 301
ucaaucgccaccaca

SEQ ID NO: 1975627 - RNA, 18 nt, Shigella flexneri 2a str. 301
ucaaucguaugaucaucc

SEQ ID NO: 1975628 - RNA, 14 nt, Shigella flexneri 2a str. 301
ucaaucucagcaag

SEQ ID NO: 1975629 - RNA, 14 nt, Shigella flexneri 2a str. 301
ucaaucucuucaca

SEQ ID NO: 1975630 - RNA, 18 nt, Shigella flexneri 2a str. 301
ucaaucucuucacagaca

SEQ ID NO: 1975631 - RNA, 16 nt, Shigella flexneri 2a str. 301
ucaaucucuuuuucca

SEQ ID NO: 1975632 - RNA, 21 nt, Shigella flexneri 2a str. 301
ucaaucucuuuuuccaccgca

SEQ ID NO: 1975633 - RNA, 15 nt, Shigella flexneri 2a str. 301
ucaaugaaauccauu

SEQ ID NO: 1975634 - RNA, 20 nt, Shigella flexneri 2a str. 301
ucaauccaguguaaaacagc

SEQ ID NO: 1975635 - RNA, 21 nt, Shigella flexneri 2a str. 301
ucaaucccagacguuucgcca

SEQ ID NO: 1975636 - RNA, 15 nt, Shigella flexneri 2a str. 301
ucaaucgcaaucugg

SEQ ID NO: 1975637 - RNA, 22 nt, Shigella flexneri 2a str. 301
ucaaucgcacccgccaucaucc

SEQ ID NO: 1975638 - RNA, 14 nt, Shigella flexneri 2a str. 301
ucaaucaggcuauc

SEQ ID NO: 1975639 - RNA, 14 nt, Shigella flexneri 2a str. 301
ucaaucaguucauu

SEQ ID NO: 1975640 - RNA, 22 nt, Shigella flexneri 2a str. 301
ucacaaaaauaauuuucguagu

SEQ ID NO: 1975641 - RNA, 18 nt, Shigella flexneri 2a str. 301
ucacaaaacgaauaauug

SEQ ID NO: 1975642 - RNA, 18 nt, Shigella flexneri 2a str. 301
ucacaaaacgugacagcu

SEQ ID NO: 1975643 - RNA, 17 nt, Shigella flexneri 2a str. 301
ucaauuucugcaaaaua

SEQ ID NO: 1975644 - RNA, 20 nt, Shigella flexneri 2a str. 301
ucaauugcguuaaaaucagc

SEQ ID NO: 1975645 - RNA, 16 nt, Shigella flexneri 2a str. 301
ucaauuccccuaguac

SEQ ID NO: 1975646 - RNA, 18 nt, Shigella flexneri 2a str. 301
ucaauucccgagcugcuc

SEQ ID NO: 1975647 - RNA, 23 nt, Shigella flexneri 2a str. 301
ucaauuaauucuccgcucucaau

SEQ ID NO: 1975648 - RNA, 15 nt, Shigella flexneri 2a str. 301
ucaauuaacauugca

SEQ ID NO: 1975649 - RNA, 19 nt, Shigella flexneri 2a str. 301
ucaauuaaaaaauuagcaa

SEQ ID NO: 1975650 - RNA, 18 nt, Shigella flexneri 2a str. 301
ucaauuagcuuuaaucca

SEQ ID NO: 1975651 - RNA, 17 nt, Shigella flexneri 2a str. 301
ucaauuagauuuaauaa

SEQ ID NO: 1975652 - RNA, 20 nt, Shigella flexneri 2a str. 301
ucaccccgcgcucacaccac

SEQ ID NO: 1975653 - RNA, 19 nt, Shigella flexneri 2a str. 301
ucaccccgccgggcuuacc

SEQ ID NO: 1975654 - RNA, 19 nt, Shigella flexneri 2a str. 301
ucacccggaucaauuaauc

SEQ ID NO: 1975655 - RNA, 23 nt, Shigella flexneri 2a str. 301
ucacccgugagaacugcugcauc

SEQ ID NO: 1975656 - RNA, 19 nt, Shigella flexneri 2a str. 301
ucaccgaugcacagaaccg

SEQ ID NO: 1975657 - RNA, 22 nt, Shigella flexneri 2a str. 301
ucaccgacguuugcgcccagcc

SEQ ID NO: 1975658 - RNA, 19 nt, Shigella flexneri 2a str. 301
ucaccgcaccacaccugau

SEQ ID NO: 1975659 - RNA, 15 nt, Shigella flexneri 2a str. 301
ucaccgccaccagcg

SEQ ID NO: 1975660 - RNA, 19 nt, Shigella flexneri 2a str. 301
ucaccgccacuaccaucag

SEQ ID NO: 1975661 - RNA, 14 nt, Shigella flexneri 2a str. 301
ucaccgccaccagc

SEQ ID NO: 1975662 - RNA, 14 nt, Shigella flexneri 2a str. 301
ucaccgccagcaag

SEQ ID NO: 1975663 - RNA, 21 nt, Shigella flexneri 2a str. 301
ucaccgcguaugcccagcgca

SEQ ID NO: 1975664 - RNA, 16 nt, Shigella flexneri 2a str. 301
ucaccgcgucuucgcu

SEQ ID NO: 1975665 - RNA, 16 nt, Shigella flexneri 2a str. 301
ucaccgcgaaauaauc

SEQ ID NO: 1975666 - RNA, 20 nt, Shigella flexneri 2a str. 301
ucaccgcgaaauaaucaaau

SEQ ID NO: 1975667 - RNA, 21 nt, Shigella flexneri 2a str. 301
ucaccgccgccuuuuacgcau

SEQ ID NO: 1975668 - RNA, 20 nt, Shigella flexneri 2a str. 301
ucaccgccgagacauccacu

SEQ ID NO: 1975669 - RNA, 12 nt, Shigella flexneri 2a str. 301
ucaccgccgccu

SEQ ID NO: 1975670 - RNA, 16 nt, Shigella flexneri 2a str. 301
ucaccgugauccccac

SEQ ID NO: 1975671 - RNA, 17 nt, Shigella flexneri 2a str. 301
ucaccguucgcuggaag

SEQ ID NO: 1975672 - RNA, 19 nt, Shigella flexneri 2a str. 301
ucaccguucaaagcgugcc

SEQ ID NO: 1975673 - RNA, 17 nt, Shigella flexneri 2a str. 301
ucaccauauucagcagc

SEQ ID NO: 1975674 - RNA, 16 nt, Shigella flexneri 2a str. 301
ucaccauauucagcag

SEQ ID NO: 1975675 - RNA, 13 nt, Shigella flexneri 2a str. 301
ucaccauaaauca

SEQ ID NO: 1975676 - RNA, 13 nt, Shigella flexneri 2a str. 301
ucaccauuagaca

SEQ ID NO: 1975677 - RNA, 22 nt, Shigella flexneri 2a str. 301
ucaccauuacgcaaugcguacu

SEQ ID NO: 1975678 - RNA, 14 nt, Shigella flexneri 2a str. 301
ucaccaucuucacu

SEQ ID NO: 1975679 - RNA, 14 nt, Shigella flexneri 2a str. 301
ucacccaacaugcc

SEQ ID NO: 1975680 - RNA, 13 nt, Shigella flexneri 2a str. 301
ucacccacacuuc

SEQ ID NO: 1975681 - RNA, 14 nt, Shigella flexneri 2a str. 301
ucaccauuggcauu

SEQ ID NO: 1975682 - RNA, 16 nt, Shigella flexneri 2a str. 301
ucaccauuccgcauga

SEQ ID NO: 1975683 - RNA, 23 nt, Shigella flexneri 2a str. 301
ucaccauucugcgcugacucuac

SEQ ID NO: 1975684 - RNA, 15 nt, Shigella flexneri 2a str. 301
ucacccagacaaaau

SEQ ID NO: 1975685 - RNA, 18 nt, Shigella flexneri 2a str. 301
ucacccacgguuacgcua

SEQ ID NO: 1975686 - RNA, 20 nt, Shigella flexneri 2a str. 301
ucacccaucacuaccugauu

SEQ ID NO: 1975687 - RNA, 15 nt, Shigella flexneri 2a str. 301
ucacccaugaagaau

SEQ ID NO: 1975688 - RNA, 20 nt, Shigella flexneri 2a str. 301
ucaccacgcugagagaagca

SEQ ID NO: 1975689 - RNA, 19 nt, Shigella flexneri 2a str. 301
ucaccacgcugagagaagc

SEQ ID NO: 1975690 - RNA, 17 nt, Shigella flexneri 2a str. 301
ucaccacgcagcagcca

SEQ ID NO: 1975691 - RNA, 19 nt, Shigella flexneri 2a str. 301
ucaccacgcagcagccaag

SEQ ID NO: 1975692 - RNA, 15 nt, Shigella flexneri 2a str. 301
ucaccaccuggguga

SEQ ID NO: 1975693 - RNA, 15 nt, Shigella flexneri 2a str. 301
ucaccacgaaaacag

SEQ ID NO: 1975694 - RNA, 22 nt, Shigella flexneri 2a str. 301
ucaccacuucggcaaaaaaguc

SEQ ID NO: 1975695 - RNA, 18 nt, Shigella flexneri 2a str. 301
ucaccacuucggcaaaaa

SEQ ID NO: 1975696 - RNA, 18 nt, Shigella flexneri 2a str. 301
ucaccagacaauggcccg

SEQ ID NO: 1975697 - RNA, 14 nt, Shigella flexneri 2a str. 301
ucaccagacaucaa

SEQ ID NO: 1975698 - RNA, 19 nt, Shigella flexneri 2a str. 301
ucaccacuuugucugucaa

SEQ ID NO: 1975699 - RNA, 12 nt, Shigella flexneri 2a str. 301
ucaccagcagcg

SEQ ID NO: 1975700 - RNA, 20 nt, Shigella flexneri 2a str. 301
ucaccagcaaauccagcggu

SEQ ID NO: 1975701 - RNA, 20 nt, Shigella flexneri 2a str. 301
ucaccaguaaggcaucuucu

SEQ ID NO: 1975702 - RNA, 22 nt, Shigella flexneri 2a str. 301
ucaccaacaguacgguaaagcc

SEQ ID NO: 1975703 - RNA, 18 nt, Shigella flexneri 2a str. 301
ucaccaaacuucagcccu

SEQ ID NO: 1975704 - RNA, 21 nt, Shigella flexneri 2a str. 301
ucaccaaugauaaguuucacu

SEQ ID NO: 1975705 - RNA, 22 nt, Shigella flexneri 2a str. 301
ucaccaaugaaagccccaccag

SEQ ID NO: 1975706 - RNA, 12 nt, Shigella flexneri 2a str. 301
ucaccacaucca

SEQ ID NO: 1975707 - RNA, 14 nt, Shigella flexneri 2a str. 301
ucacauuuaaacaa

SEQ ID NO: 1975708 - RNA, 21 nt, Shigella flexneri 2a str. 301
ucacaugcuggaaccacagcg

SEQ ID NO: 1975709 - RNA, 17 nt, Shigella flexneri 2a str. 301
ucacaugaguugcugga

SEQ ID NO: 1975710 - RNA, 14 nt, Shigella flexneri 2a str. 301
ucacaucagcgcau

SEQ ID NO: 1975711 - RNA, 13 nt, Shigella flexneri 2a str. 301
ucacaucaccaua

SEQ ID NO: 1975712 - RNA, 18 nt, Shigella flexneri 2a str. 301
ucacauccaguacgccuu

SEQ ID NO: 1975713 - RNA, 18 nt, Shigella flexneri 2a str. 301
ucacauaaucgaaaacau

SEQ ID NO: 1975714 - RNA, 22 nt, Shigella flexneri 2a str. 301
ucacaguaaugauuuaaaacca

SEQ ID NO: 1975715 - RNA, 15 nt, Shigella flexneri 2a str. 301
ucacaucaaaucccc

SEQ ID NO: 1975716 - RNA, 19 nt, Shigella flexneri 2a str. 301
ucacaucaccauaaaucag

SEQ ID NO: 1975717 - RNA, 15 nt, Shigella flexneri 2a str. 301
ucacaucaccauagc

SEQ ID NO: 1975718 - RNA, 17 nt, Shigella flexneri 2a str. 301
ucacaucaccgcaccac

SEQ ID NO: 1975719 - RNA, 15 nt, Shigella flexneri 2a str. 301
ucacauauugcagcu

SEQ ID NO: 1975720 - RNA, 21 nt, Shigella flexneri 2a str. 301
ucacagcuaaucaucaucagu

SEQ ID NO: 1975721 - RNA, 20 nt, Shigella flexneri 2a str. 301
ucacagcuaaucaucaucag

SEQ ID NO: 1975722 - RNA, 17 nt, Shigella flexneri 2a str. 301
ucacagaguauuuccag

SEQ ID NO: 1975723 - RNA, 19 nt, Shigella flexneri 2a str. 301
ucacagaguauuuccagcu

SEQ ID NO: 1975724 - RNA, 15 nt, Shigella flexneri 2a str. 301
ucacagaaggccagg

SEQ ID NO: 1975725 - RNA, 19 nt, Shigella flexneri 2a str. 301
ucacacucaugauccugga

SEQ ID NO: 1975726 - RNA, 15 nt, Shigella flexneri 2a str. 301
ucacacgccgaauuu

SEQ ID NO: 1975727 - RNA, 22 nt, Shigella flexneri 2a str. 301
ucacaccauugauaauccauca

SEQ ID NO: 1975728 - RNA, 15 nt, Shigella flexneri 2a str. 301
ucacaccauugagga

SEQ ID NO: 1975729 - RNA, 19 nt, Shigella flexneri 2a str. 301
ucacacccgguaucaaacc

SEQ ID NO: 1975730 - RNA, 16 nt, Shigella flexneri 2a str. 301
ucacaagacuguaaau

SEQ ID NO: 1975731 - RNA, 15 nt, Shigella flexneri 2a str. 301
ucacacaaccaugca

SEQ ID NO: 1975732 - RNA, 18 nt, Shigella flexneri 2a str. 301
ucacacacuuuuauuaac

SEQ ID NO: 1975733 - RNA, 12 nt, Shigella flexneri 2a str. 301
ucacacacaucg

SEQ ID NO: 1975734 - RNA, 17 nt, Shigella flexneri 2a str. 301
ucacaccacagcagcca

SEQ ID NO: 1975735 - RNA, 17 nt, Shigella flexneri 2a str. 301
ucacacagugaaucucu

SEQ ID NO: 1975736 - RNA, 18 nt, Shigella flexneri 2a str. 301
ucacaaucggcuuucacc

SEQ ID NO: 1975737 - RNA, 20 nt, Shigella flexneri 2a str. 301
ucacaaugccaccaauaaug

SEQ ID NO: 1975738 - RNA, 23 nt, Shigella flexneri 2a str. 301
ucacaauuacugagagaaaaaaa

SEQ ID NO: 1975739 - RNA, 17 nt, Shigella flexneri 2a str. 301
ucacaauucaucaucag

SEQ ID NO: 1975740 - RNA, 14 nt, Shigella flexneri 2a str. 301
uauucauaaaugcu

SEQ ID NO: 1975741 - RNA, 19 nt, Shigella flexneri 2a str. 301
uauucaucaauagcaacug

SEQ ID NO: 1975742 - RNA, 14 nt, Shigella flexneri 2a str. 301
uauucauugacuua

SEQ ID NO: 1975743 - RNA, 14 nt, Shigella flexneri 2a str. 301
uauuccauccugcu

SEQ ID NO: 1975744 - RNA, 17 nt, Shigella flexneri 2a str. 301
uauuccuuaugguucac

SEQ ID NO: 1975745 - RNA, 17 nt, Shigella flexneri 2a str. 301
uauuccucguaguucuu

SEQ ID NO: 1975746 - RNA, 23 nt, Shigella flexneri 2a str. 301
uauuccggcgugacgaucaccac

SEQ ID NO: 1975747 - RNA, 15 nt, Shigella flexneri 2a str. 301
uauucccguuuucuu

SEQ ID NO: 1975748 - RNA, 14 nt, Shigella flexneri 2a str. 301
uauucccuugcucu

SEQ ID NO: 1975749 - RNA, 19 nt, Shigella flexneri 2a str. 301
uauuccgcgugaaaugcca

SEQ ID NO: 1975750 - RNA, 21 nt, Shigella flexneri 2a str. 301
uauucaccgcaucaauauuaa

SEQ ID NO: 1975751 - RNA, 21 nt, Shigella flexneri 2a str. 301
uauucacuacggucacgccac

SEQ ID NO: 1975752 - RNA, 17 nt, Shigella flexneri 2a str. 301
uauucaaucucuucaca

SEQ ID NO: 1975753 - RNA, 11 nt, Shigella flexneri 2a str. 301
uauucagcaga

SEQ ID NO: 1975754 - RNA, 14 nt, Shigella flexneri 2a str. 301
uauucagcagcaga

SEQ ID NO: 1975755 - RNA, 18 nt, Shigella flexneri 2a str. 301
uauucacugcgccucgcc

SEQ ID NO: 1975756 - RNA, 16 nt, Shigella flexneri 2a str. 301
uauucaacgucacugg

SEQ ID NO: 1975757 - RNA, 13 nt, Shigella flexneri 2a str. 301
uauucaaaggcuc

SEQ ID NO: 1975758 - RNA, 12 nt, Shigella flexneri 2a str. 301
uauucuuauaaa

SEQ ID NO: 1975759 - RNA, 23 nt, Shigella flexneri 2a str. 301
uauucuugcugauacuccucauu

SEQ ID NO: 1975760 - RNA, 17 nt, Shigella flexneri 2a str. 301
uauucuuacuucaacac

SEQ ID NO: 1975761 - RNA, 17 nt, Shigella flexneri 2a str. 301
uauucuggguaguccau

SEQ ID NO: 1975762 - RNA, 17 nt, Shigella flexneri 2a str. 301
uauucugggaacuauau

SEQ ID NO: 1975763 - RNA, 12 nt, Shigella flexneri 2a str. 301
uauugaagcuca

SEQ ID NO: 1975764 - RNA, 19 nt, Shigella flexneri 2a str. 301
uauugaauuagcaauauuu

SEQ ID NO: 1975765 - RNA, 15 nt, Shigella flexneri 2a str. 301
uauugaaaucacuaa

SEQ ID NO: 1975766 - RNA, 15 nt, Shigella flexneri 2a str. 301
uauucgcugauuuuu

SEQ ID NO: 1975767 - RNA, 21 nt, Shigella flexneri 2a str. 301
uauucgcgcagaacauaaaaa

SEQ ID NO: 1975768 - RNA, 21 nt, Shigella flexneri 2a str. 301
uauucgccaucgcuuuuacca

SEQ ID NO: 1975769 - RNA, 15 nt, Shigella flexneri 2a str. 301
uauucggcuccagau

SEQ ID NO: 1975770 - RNA, 15 nt, Shigella flexneri 2a str. 301
uauucucaaaauaca

SEQ ID NO: 1975771 - RNA, 22 nt, Shigella flexneri 2a str. 301
uauuacgagucacaaacaucau

SEQ ID NO: 1975772 - RNA, 15 nt, Shigella flexneri 2a str. 301
uauuacguuccuuua

SEQ ID NO: 1975773 - RNA, 23 nt, Shigella flexneri 2a str. 301
uauuaccgaugugaacccugauu

SEQ ID NO: 1975774 - RNA, 21 nt, Shigella flexneri 2a str. 301
uauuaacccgcaacagcaaua

SEQ ID NO: 1975775 - RNA, 18 nt, Shigella flexneri 2a str. 301
uauuaacgaacucuuugc

SEQ ID NO: 1975776 - RNA, 13 nt, Shigella flexneri 2a str. 301
uauuaaucaucau

SEQ ID NO: 1975777 - RNA, 13 nt, Shigella flexneri 2a str. 301
uauuaaaccaccc

SEQ ID NO: 1975778 - RNA, 14 nt, Shigella flexneri 2a str. 301
uauuaaauuuuuuc

SEQ ID NO: 1975779 - RNA, 13 nt, Shigella flexneri 2a str. 301
uauuauauauaau

SEQ ID NO: 1975780 - RNA, 19 nt, Shigella flexneri 2a str. 301
uauuaucuucaucgauacu

SEQ ID NO: 1975781 - RNA, 20 nt, Shigella flexneri 2a str. 301
uauuaucugaucaauauaga

SEQ ID NO: 1975782 - RNA, 20 nt, Shigella flexneri 2a str. 301
uauuaugcgaccauaugaau

SEQ ID NO: 1975783 - RNA, 19 nt, Shigella flexneri 2a str. 301
uauuauuacuuaucccugu

SEQ ID NO: 1975784 - RNA, 18 nt, Shigella flexneri 2a str. 301
uauuauucauaaugccca

SEQ ID NO: 1975785 - RNA, 12 nt, Shigella flexneri 2a str. 301
uauuacugcaac

SEQ ID NO: 1975786 - RNA, 20 nt, Shigella flexneri 2a str. 301
uauuacuuaucccugucuaa

SEQ ID NO: 1975787 - RNA, 22 nt, Shigella flexneri 2a str. 301
uauuacuuaucccugucuaacc

SEQ ID NO: 1975788 - RNA, 20 nt, Shigella flexneri 2a str. 301
uauuagcgcaaucagagaua

SEQ ID NO: 1975789 - RNA, 17 nt, Shigella flexneri 2a str. 301
uauuaguggcaaccaca

SEQ ID NO: 1975790 - RNA, 13 nt, Shigella flexneri 2a str. 301
uauuuauuauuaa

SEQ ID NO: 1975791 - RNA, 15 nt, Shigella flexneri 2a str. 301
uauuuauuaauccag

SEQ ID NO: 1975792 - RNA, 14 nt, Shigella flexneri 2a str. 301
uauuuauacaguga

SEQ ID NO: 1975793 - RNA, 16 nt, Shigella flexneri 2a str. 301
uauuucacauaacugc

SEQ ID NO: 1975794 - RNA, 13 nt, Shigella flexneri 2a str. 301
uauuuauuuucag

SEQ ID NO: 1975795 - RNA, 13 nt, Shigella flexneri 2a str. 301
uauuuauuuucca

SEQ ID NO: 1975796 - RNA, 14 nt, Shigella flexneri 2a str. 301
uauuuauuuuccaa

SEQ ID NO: 1975797 - RNA, 15 nt, Shigella flexneri 2a str. 301
uauuuauuucagaac

SEQ ID NO: 1975798 - RNA, 16 nt, Shigella flexneri 2a str. 301
uauuucuauauccuca

SEQ ID NO: 1975799 - RNA, 21 nt, Shigella flexneri 2a str. 301
uauuucucggcaaauucauua

SEQ ID NO: 1975800 - RNA, 22 nt, Shigella flexneri 2a str. 301
uauuuccuuccuuggauauuuu

SEQ ID NO: 1975801 - RNA, 15 nt, Shigella flexneri 2a str. 301
uauuuccggcgacgu

SEQ ID NO: 1975802 - RNA, 18 nt, Shigella flexneri 2a str. 301
uauuuccggucgcaggca

SEQ ID NO: 1975803 - RNA, 15 nt, Shigella flexneri 2a str. 301
uauuuccagcucaac

SEQ ID NO: 1975804 - RNA, 17 nt, Shigella flexneri 2a str. 301
uauuuccaccucccccu

SEQ ID NO: 1975805 - RNA, 22 nt, Shigella flexneri 2a str. 301
uauuucauagauuaauuuccca

SEQ ID NO: 1975806 - RNA, 15 nt, Shigella flexneri 2a str. 301
uauuucauguuugaa

SEQ ID NO: 1975807 - RNA, 19 nt, Shigella flexneri 2a str. 301
uauuucacauaacugccuc

SEQ ID NO: 1975808 - RNA, 16 nt, Shigella flexneri 2a str. 301
uauuucaauaugauaa

SEQ ID NO: 1975809 - RNA, 20 nt, Shigella flexneri 2a str. 301
uauuucagaacaguuuucag

SEQ ID NO: 1975810 - RNA, 20 nt, Shigella flexneri 2a str. 301
uauuuguaguuugauaauuu

SEQ ID NO: 1975811 - RNA, 17 nt, Shigella flexneri 2a str. 301
uauuuuacauccggcaa

SEQ ID NO: 1975812 - RNA, 21 nt, Shigella flexneri 2a str. 301
uauuugccuaauaaaucuaaa

SEQ ID NO: 1975813 - RNA, 20 nt, Shigella flexneri 2a str. 301
uauuugcccaccugcggcac

SEQ ID NO: 1975814 - RNA, 19 nt, Shigella flexneri 2a str. 301
uauuugcgucagcucacaa

SEQ ID NO: 1975815 - RNA, 21 nt, Shigella flexneri 2a str. 301
uauuugcaccuaaagcgcgca

SEQ ID NO: 1975816 - RNA, 18 nt, Shigella flexneri 2a str. 301
uauuugcaaaguuccuau

SEQ ID NO: 1975817 - RNA, 18 nt, Shigella flexneri 2a str. 301
uauuugaguucacugccg

SEQ ID NO: 1975818 - RNA, 21 nt, Shigella flexneri 2a str. 301
uauuugaggaguuuaauaaau

SEQ ID NO: 1975819 - RNA, 23 nt, Shigella flexneri 2a str. 301
uauuugaggaguuuaauaaauuu

SEQ ID NO: 1975820 - RNA, 22 nt, Shigella flexneri 2a str. 301
uauuucuuuguagaugauuuuu

SEQ ID NO: 1975821 - RNA, 14 nt, Shigella flexneri 2a str. 301
uauuucuuuuacau

SEQ ID NO: 1975822 - RNA, 15 nt, Shigella flexneri 2a str. 301
uauuucuuuaucacc

SEQ ID NO: 1975823 - RNA, 16 nt, Shigella flexneri 2a str. 301
uauuucuguuugcguc

SEQ ID NO: 1975824 - RNA, 15 nt, Shigella flexneri 2a str. 301
uauuuacucuccugc

SEQ ID NO: 1975825 - RNA, 20 nt, Shigella flexneri 2a str. 301
uauuuaccgcaugcucacag

SEQ ID NO: 1975826 - RNA, 19 nt, Shigella flexneri 2a str. 301
uauuguuauucgccagacc

SEQ ID NO: 1975827 - RNA, 13 nt, Shigella flexneri 2a str. 301
uauuguuaaauau

SEQ ID NO: 1975828 - RNA, 23 nt, Shigella flexneri 2a str. 301
uauugugggucgauuaaauucac

SEQ ID NO: 1975829 - RNA, 14 nt, Shigella flexneri 2a str. 301
uauuguguagccag

SEQ ID NO: 1975830 - RNA, 13 nt, Shigella flexneri 2a str. 301
uauuguuggcaug

SEQ ID NO: 1975831 - RNA, 15 nt, Shigella flexneri 2a str. 301
uauugcuucucaggu

SEQ ID NO: 1975832 - RNA, 15 nt, Shigella flexneri 2a str. 301
uauugguguugugaa

SEQ ID NO: 1975833 - RNA, 17 nt, Shigella flexneri 2a str. 301
uauugcugaaauaacgu

SEQ ID NO: 1975834 - RNA, 17 nt, Shigella flexneri 2a str. 301
uauugcgcaugacacac

SEQ ID NO: 1975835 - RNA, 22 nt, Shigella flexneri 2a str. 301
uauugcguggcgauuugaguaa

SEQ ID NO: 1975836 - RNA, 21 nt, Shigella flexneri 2a str. 301
uauugcgcacaucaauuugcc

SEQ ID NO: 1975837 - RNA, 14 nt, Shigella flexneri 2a str. 301
uauugcgcaggcgc

SEQ ID NO: 1975838 - RNA, 18 nt, Shigella flexneri 2a str. 301
uauugcgaaguauggaaa

SEQ ID NO: 1975839 - RNA, 13 nt, Shigella flexneri 2a str. 301
uauugccccacac

SEQ ID NO: 1975840 - RNA, 22 nt, Shigella flexneri 2a str. 301
uauugcauuggguguaaacguu

SEQ ID NO: 1975841 - RNA, 14 nt, Shigella flexneri 2a str. 301
uauugcaaucaucu

SEQ ID NO: 1975842 - RNA, 17 nt, Shigella flexneri 2a str. 301
uauugauuuaacagcaa

SEQ ID NO: 1975843 - RNA, 12 nt, Shigella flexneri 2a str. 301
uauugaugcuca

SEQ ID NO: 1975844 - RNA, 16 nt, Shigella flexneri 2a str. 301
uauugaugggaagccu

SEQ ID NO: 1975845 - RNA, 21 nt, Shigella flexneri 2a str. 301
uauugacgaaaagcugaaaac

SEQ ID NO: 1975846 - RNA, 18 nt, Shigella flexneri 2a str. 301
uauugaauuagcaauauu

SEQ ID NO: 1975847 - RNA, 17 nt, Shigella flexneri 2a str. 301
ucaagaauacuguccau

SEQ ID NO: 1975848 - RNA, 23 nt, Shigella flexneri 2a str. 301
ucaagaaugcucgcuggcaggcc

SEQ ID NO: 1975849 - RNA, 15 nt, Shigella flexneri 2a str. 301
ucaagacaucaauaa

SEQ ID NO: 1975850 - RNA, 21 nt, Shigella flexneri 2a str. 301
ucaagacgaauaccuucuucc

SEQ ID NO: 1975851 - RNA, 16 nt, Shigella flexneri 2a str. 301
ucaacuuuaccuucau

SEQ ID NO: 1975852 - RNA, 13 nt, Shigella flexneri 2a str. 301
ucaagaauacugu

SEQ ID NO: 1975853 - RNA, 23 nt, Shigella flexneri 2a str. 301
ucaacuuuaccuucauccuggua

SEQ ID NO: 1975854 - RNA, 22 nt, Shigella flexneri 2a str. 301
ucaacuuuguuagcgaauaaag

SEQ ID NO: 1975855 - RNA, 15 nt, Shigella flexneri 2a str. 301
ucaacuuaagucucc

SEQ ID NO: 1975856 - RNA, 15 nt, Shigella flexneri 2a str. 301
ucaagauuagccccc

SEQ ID NO: 1975857 - RNA, 16 nt, Shigella flexneri 2a str. 301
ucaagcaaggccaggu

SEQ ID NO: 1975858 - RNA, 21 nt, Shigella flexneri 2a str. 301
ucaagcaaggccagguuuucu

SEQ ID NO: 1975859 - RNA, 19 nt, Shigella flexneri 2a str. 301
ucaagccccagcaggaugu

SEQ ID NO: 1975860 - RNA, 15 nt, Shigella flexneri 2a str. 301
ucaagccauagcgcc

SEQ ID NO: 1975861 - RNA, 22 nt, Shigella flexneri 2a str. 301
ucaagcaucguuguuacaacau

SEQ ID NO: 1975862 - RNA, 23 nt, Shigella flexneri 2a str. 301
ucaagcaugauauucacagggaa

SEQ ID NO: 1975863 - RNA, 15 nt, Shigella flexneri 2a str. 301
ucaagagacugcugg

SEQ ID NO: 1975864 - RNA, 14 nt, Shigella flexneri 2a str. 301
ucaagaucaucaaa

SEQ ID NO: 1975865 - RNA, 17 nt, Shigella flexneri 2a str. 301
ucaagauauuucaccag

SEQ ID NO: 1975866 - RNA, 19 nt, Shigella flexneri 2a str. 301
ucaacggauauuguuugcu

SEQ ID NO: 1975867 - RNA, 21 nt, Shigella flexneri 2a str. 301
ucaacgccgcuaucagauucg

SEQ ID NO: 1975868 - RNA, 22 nt, Shigella flexneri 2a str. 301
ucaacgcaccgacaaauuucau

SEQ ID NO: 1975869 - RNA, 19 nt, Shigella flexneri 2a str. 301
ucaaccugugcgccaggau

SEQ ID NO: 1975870 - RNA, 14 nt, Shigella flexneri 2a str. 301
ucaaccuuuccuug

SEQ ID NO: 1975871 - RNA, 22 nt, Shigella flexneri 2a str. 301
ucaaccgucgcgcccuccugca

SEQ ID NO: 1975872 - RNA, 20 nt, Shigella flexneri 2a str. 301
ucaaccguugcuggaaaacc

SEQ ID NO: 1975873 - RNA, 21 nt, Shigella flexneri 2a str. 301
ucaaccguuugauugaaaaau

SEQ ID NO: 1975874 - RNA, 22 nt, Shigella flexneri 2a str. 301
ucaacguuuacccaauccccca

SEQ ID NO: 1975875 - RNA, 18 nt, Shigella flexneri 2a str. 301
ucaacguugaauuucagg

SEQ ID NO: 1975876 - RNA, 14 nt, Shigella flexneri 2a str. 301
ucaacgugucuuuu

SEQ ID NO: 1975877 - RNA, 15 nt, Shigella flexneri 2a str. 301
ucaacguugaauuuc

SEQ ID NO: 1975878 - RNA, 19 nt, Shigella flexneri 2a str. 301
ucaacguuauucgcuuccu

SEQ ID NO: 1975879 - RNA, 21 nt, Shigella flexneri 2a str. 301
ucaacgucacuggguucaaaa

SEQ ID NO: 1975880 - RNA, 17 nt, Shigella flexneri 2a str. 301
ucaacgucacuggguuc

SEQ ID NO: 1975881 - RNA, 20 nt, Shigella flexneri 2a str. 301
ucaacgucauuaucugcaga

SEQ ID NO: 1975882 - RNA, 21 nt, Shigella flexneri 2a str. 301
ucaacggcaacaauucccgca

SEQ ID NO: 1975883 - RNA, 23 nt, Shigella flexneri 2a str. 301
ucaacuccccgcauuuacucuca

SEQ ID NO: 1975884 - RNA, 16 nt, Shigella flexneri 2a str. 301
ucaacugccaguuccc

SEQ ID NO: 1975885 - RNA, 23 nt, Shigella flexneri 2a str. 301
ucaaaucuuauaugaugaaacug

SEQ ID NO: 1975886 - RNA, 21 nt, Shigella flexneri 2a str. 301
ucaaaucgaaaucaacauguu

SEQ ID NO: 1975887 - RNA, 24 nt, Shigella flexneri 2a str. 301
ucaaauuacagcaccuuaugcggg

SEQ ID NO: 1975888 - RNA, 19 nt, Shigella flexneri 2a str. 301
ucaaauuacgauccaccac

SEQ ID NO: 1975889 - RNA, 20 nt, Shigella flexneri 2a str. 301
ucaaauguugcguucaucag

SEQ ID NO: 1975890 - RNA, 21 nt, Shigella flexneri 2a str. 301
ucaaauguugcguucaucagu

SEQ ID NO: 1975891 - RNA, 17 nt, Shigella flexneri 2a str. 301
ucaaauggcgcuuuaua

SEQ ID NO: 1975892 - RNA, 20 nt, Shigella flexneri 2a str. 301
ucaaaucaacaaccugcauu

SEQ ID NO: 1975893 - RNA, 21 nt, Shigella flexneri 2a str. 301
ucaaaucaacaaccugcauuu

SEQ ID NO: 1975894 - RNA, 17 nt, Shigella flexneri 2a str. 301
ucaaauaucuauauaca

SEQ ID NO: 1975895 - RNA, 23 nt, Shigella flexneri 2a str. 301
ucaaauaucuauauacaaucaca

SEQ ID NO: 1975896 - RNA, 23 nt, Shigella flexneri 2a str. 301
ucaaaucaccauauucagcagca

SEQ ID NO: 1975897 - RNA, 23 nt, Shigella flexneri 2a str. 301
ucaaauuugucgccaacuucaug

SEQ ID NO: 1975898 - RNA, 20 nt, Shigella flexneri 2a str. 301
ucaaauuacgauccaccacc

SEQ ID NO: 1975899 - RNA, 13 nt, Shigella flexneri 2a str. 301
ucaaauucauugu

SEQ ID NO: 1975900 - RNA, 17 nt, Shigella flexneri 2a str. 301
ucaacaaccagaaggug

SEQ ID NO: 1975901 - RNA, 16 nt, Shigella flexneri 2a str. 301
ucaacaaccuugcguu

SEQ ID NO: 1975902 - RNA, 13 nt, Shigella flexneri 2a str. 301
ucaacaaaccaaa

SEQ ID NO: 1975903 - RNA, 19 nt, Shigella flexneri 2a str. 301
ucaacaaaguugcacacuu

SEQ ID NO: 1975904 - RNA, 18 nt, Shigella flexneri 2a str. 301
ucaacagguuuuguugcc

SEQ ID NO: 1975905 - RNA, 23 nt, Shigella flexneri 2a str. 301
ucaacagcggcauuacgcgcccc

SEQ ID NO: 1975906 - RNA, 20 nt, Shigella flexneri 2a str. 301
ucaacacacugaauaaaaau

SEQ ID NO: 1975907 - RNA, 22 nt, Shigella flexneri 2a str. 301
ucaacacagugaugaaaacgaa

SEQ ID NO: 1975908 - RNA, 15 nt, Shigella flexneri 2a str. 301
ucaacaccgaugcaa

SEQ ID NO: 1975909 - RNA, 19 nt, Shigella flexneri 2a str. 301
ucaacaccgggugcagaca

SEQ ID NO: 1975910 - RNA, 23 nt, Shigella flexneri 2a str. 301
ucaaccauaucgcauaccaucca

SEQ ID NO: 1975911 - RNA, 19 nt, Shigella flexneri 2a str. 301
ucaacccuuuuuuaaacau

SEQ ID NO: 1975912 - RNA, 23 nt, Shigella flexneri 2a str. 301
ucaaccgagagggcuuuuucaau

SEQ ID NO: 1975913 - RNA, 13 nt, Shigella flexneri 2a str. 301
ucaacccuuucca

SEQ ID NO: 1975914 - RNA, 14 nt, Shigella flexneri 2a str. 301
ucaacccuuuccag

SEQ ID NO: 1975915 - RNA, 18 nt, Shigella flexneri 2a str. 301
ucaaccagcacaaagugg

SEQ ID NO: 1975916 - RNA, 19 nt, Shigella flexneri 2a str. 301
ucaaccaccggcaccacuu

SEQ ID NO: 1975917 - RNA, 14 nt, Shigella flexneri 2a str. 301
ucaacaugaaaaua

SEQ ID NO: 1975918 - RNA, 20 nt, Shigella flexneri 2a str. 301
ucaacauaacgcaucccguu

SEQ ID NO: 1975919 - RNA, 12 nt, Shigella flexneri 2a str. 301
ucaacaucaucu

SEQ ID NO: 1975920 - RNA, 13 nt, Shigella flexneri 2a str. 301
ucaacaucaucuu

SEQ ID NO: 1975921 - RNA, 14 nt, Shigella flexneri 2a str. 301
ucaacauauuaaaa

SEQ ID NO: 1975922 - RNA, 18 nt, Shigella flexneri 2a str. 301
ucaaagucuccuuugcca

SEQ ID NO: 1975923 - RNA, 14 nt, Shigella flexneri 2a str. 301
ucaaaguaauauuc

SEQ ID NO: 1975924 - RNA, 14 nt, Shigella flexneri 2a str. 301
ucaaaguaaucaag

SEQ ID NO: 1975925 - RNA, 21 nt, Shigella flexneri 2a str. 301
ucaaaguaauuuuugaagguu

SEQ ID NO: 1975926 - RNA, 15 nt, Shigella flexneri 2a str. 301
ucaaaggcuucaacg

SEQ ID NO: 1975927 - RNA, 20 nt, Shigella flexneri 2a str. 301
ucaaaggccgacagcaggcu

SEQ ID NO: 1975928 - RNA, 23 nt, Shigella flexneri 2a str. 301
ucaaaggcauuaaacgcauacau

SEQ ID NO: 1975929 - RNA, 22 nt, Shigella flexneri 2a str. 301
ucaaauaaaaagguccuguaau

SEQ ID NO: 1975930 - RNA, 14 nt, Shigella flexneri 2a str. 301
ucaaauaaaaauac

SEQ ID NO: 1975931 - RNA, 18 nt, Shigella flexneri 2a str. 301
ucaaauaacggcaacggu

SEQ ID NO: 1975932 - RNA, 17 nt, Shigella flexneri 2a str. 301
ucaaagaugaugucaca

SEQ ID NO: 1975933 - RNA, 20 nt, Shigella flexneri 2a str. 301
ucaaagaugaugucacagcc

SEQ ID NO: 1975934 - RNA, 16 nt, Shigella flexneri 2a str. 301
ucaaagacguuaaaaa

SEQ ID NO: 1975935 - RNA, 15 nt, Shigella flexneri 2a str. 301
ucaaagcgugccccc

SEQ ID NO: 1975936 - RNA, 20 nt, Shigella flexneri 2a str. 301
ucaaagcgugcccccguuuu

SEQ ID NO: 1975937 - RNA, 17 nt, Shigella flexneri 2a str. 301
ucaaagcgaucauguac

SEQ ID NO: 1975938 - RNA, 18 nt, Shigella flexneri 2a str. 301
ucaaacuuuuaaauugaa

SEQ ID NO: 1975939 - RNA, 21 nt, Shigella flexneri 2a str. 301
ucaaacuucgucacagcggcu

SEQ ID NO: 1975940 - RNA, 14 nt, Shigella flexneri 2a str. 301
ucaaacucuucaca

SEQ ID NO: 1975941 - RNA, 17 nt, Shigella flexneri 2a str. 301
ucaaacucggcuucgcu

SEQ ID NO: 1975942 - RNA, 20 nt, Shigella flexneri 2a str. 301
ucaaacugaccuuuagcgcg

SEQ ID NO: 1975943 - RNA, 14 nt, Shigella flexneri 2a str. 301
ucaaacucaauuac

SEQ ID NO: 1975944 - RNA, 14 nt, Shigella flexneri 2a str. 301
ucaaacgccacagc

SEQ ID NO: 1975945 - RNA, 16 nt, Shigella flexneri 2a str. 301
ucaaacgaagcggcug

SEQ ID NO: 1975946 - RNA, 20 nt, Shigella flexneri 2a str. 301
ucaaacgcugacggugccag

SEQ ID NO: 1975947 - RNA, 17 nt, Shigella flexneri 2a str. 301
ucaaacgcacgucugau

SEQ ID NO: 1975948 - RNA, 19 nt, Shigella flexneri 2a str. 301
ucaaacggcguuuucucau

SEQ ID NO: 1975949 - RNA, 21 nt, Shigella flexneri 2a str. 301
ucaaacggcgcuuccagcaaa

SEQ ID NO: 1975950 - RNA, 22 nt, Shigella flexneri 2a str. 301
ucaaaccaauggcauuggcaga

SEQ ID NO: 1975951 - RNA, 22 nt, Shigella flexneri 2a str. 301
ucaaacagggcaauuaaaaauu

SEQ ID NO: 1975952 - RNA, 12 nt, Shigella flexneri 2a str. 301
ucaaacccuucc

SEQ ID NO: 1975953 - RNA, 17 nt, Shigella flexneri 2a str. 301
ucaaacccuucuucaau

SEQ ID NO: 1975954 - RNA, 22 nt, Shigella flexneri 2a str. 301
ucaaaccauucccugcuuugca

SEQ ID NO: 1975955 - RNA, 22 nt, Shigella flexneri 2a str. 301
ucaaaccauuuugcaaggcuuc

SEQ ID NO: 1975956 - RNA, 21 nt, Shigella flexneri 2a str. 301
ucaaaccacuuaauuauuaac

SEQ ID NO: 1975957 - RNA, 15 nt, Shigella flexneri 2a str. 301
ucaaaccacuuaauu

SEQ ID NO: 1975958 - RNA, 17 nt, Shigella flexneri 2a str. 301
ucaaaccacuuaauuau

SEQ ID NO: 1975959 - RNA, 13 nt, Shigella flexneri 2a str. 301
ucaaacaauuuuc

SEQ ID NO: 1975960 - RNA, 18 nt, Shigella flexneri 2a str. 301
ucaaacaacggcacuuca

SEQ ID NO: 1975961 - RNA, 15 nt, Shigella flexneri 2a str. 301
ucaaaauuaacaccu

SEQ ID NO: 1975962 - RNA, 23 nt, Shigella flexneri 2a str. 301
ucaaaauauccguagugaaaaag

SEQ ID NO: 1975963 - RNA, 20 nt, Shigella flexneri 2a str. 301
ucaaaauaucgacauucaau

SEQ ID NO: 1975964 - RNA, 16 nt, Shigella flexneri 2a str. 301
ucaaaaucaucaucuu

SEQ ID NO: 1975965 - RNA, 20 nt, Shigella flexneri 2a str. 301
ucaaaaucaucaucuuuaua

SEQ ID NO: 1975966 - RNA, 22 nt, Shigella flexneri 2a str. 301
ucaaaaucaucaucuuuauaua

SEQ ID NO: 1975967 - RNA, 17 nt, Shigella flexneri 2a str. 301
ucaaaaucaucauugcu

SEQ ID NO: 1975968 - RNA, 20 nt, Shigella flexneri 2a str. 301
uauuuuccgagguuaauauu

SEQ ID NO: 1975969 - RNA, 20 nt, Shigella flexneri 2a str. 301
uauuuugccggacgcugagc

SEQ ID NO: 1975970 - RNA, 17 nt, Shigella flexneri 2a str. 301
uauuuugguaaugacuc

SEQ ID NO: 1975971 - RNA, 13 nt, Shigella flexneri 2a str. 301
uauuuucugaaac

SEQ ID NO: 1975972 - RNA, 20 nt, Shigella flexneri 2a str. 301
uauuuuuguugaaauaauac

SEQ ID NO: 1975973 - RNA, 13 nt, Shigella flexneri 2a str. 301
uauuuuucccuga

SEQ ID NO: 1975974 - RNA, 21 nt, Shigella flexneri 2a str. 301
uauuuuucacccuucaauccc

SEQ ID NO: 1975975 - RNA, 15 nt, Shigella flexneri 2a str. 301
ucaaaacaaaaaccg

SEQ ID NO: 1975976 - RNA, 13 nt, Shigella flexneri 2a str. 301
ucaaaacaacaca

SEQ ID NO: 1975977 - RNA, 14 nt, Shigella flexneri 2a str. 301
ucaaaauaauacac

SEQ ID NO: 1975978 - RNA, 17 nt, Shigella flexneri 2a str. 301
ucaaaauaauacacaca

SEQ ID NO: 1975979 - RNA, 14 nt, Shigella flexneri 2a str. 301
ucaaaaaagucaga

SEQ ID NO: 1975980 - RNA, 22 nt, Shigella flexneri 2a str. 301
ucaaaaaaggcugacaaaucag

SEQ ID NO: 1975981 - RNA, 19 nt, Shigella flexneri 2a str. 301
ucaaaaaacuggaaaaaua

SEQ ID NO: 1975982 - RNA, 16 nt, Shigella flexneri 2a str. 301
ucaaaaaaacggcgcu

SEQ ID NO: 1975983 - RNA, 22 nt, Shigella flexneri 2a str. 301
uauuuuuuuucaggaaauaaau

SEQ ID NO: 1975984 - RNA, 22 nt, Shigella flexneri 2a str. 301
uauuuuuuugauaaucuucuuc

SEQ ID NO: 1975985 - RNA, 16 nt, Shigella flexneri 2a str. 301
ucaaaaacuaauucac

SEQ ID NO: 1975986 - RNA, 14 nt, Shigella flexneri 2a str. 301
ucaaaaacaaagaa

SEQ ID NO: 1975987 - RNA, 15 nt, Shigella flexneri 2a str. 301
ucaaaaacaaagaac

SEQ ID NO: 1975988 - RNA, 22 nt, Shigella flexneri 2a str. 301
guuucauagugcaaauccacuc

SEQ ID NO: 1975989 - RNA, 17 nt, Shigella flexneri 2a str. 301
guuucauagcgucccag

SEQ ID NO: 1975990 - RNA, 19 nt, Shigella flexneri 2a str. 301
guuucaguaauccuuucuc

SEQ ID NO: 1975991 - RNA, 17 nt, Shigella flexneri 2a str. 301
guuucagccucugccgc

SEQ ID NO: 1975992 - RNA, 16 nt, Shigella flexneri 2a str. 301
guuucacguaccagau

SEQ ID NO: 1975993 - RNA, 15 nt, Shigella flexneri 2a str. 301
guuucagcagcggca

SEQ ID NO: 1975994 - RNA, 15 nt, Shigella flexneri 2a str. 301
guuucgugcaucaug

SEQ ID NO: 1975995 - RNA, 13 nt, Shigella flexneri 2a str. 301
guuucggcguuca

SEQ ID NO: 1975996 - RNA, 11 nt, Shigella flexneri 2a str. 301
guuuccagcag

SEQ ID NO: 1975997 - RNA, 18 nt, Shigella flexneri 2a str. 301
guuuccagauuuugcuua

SEQ ID NO: 1975998 - RNA, 23 nt, Shigella flexneri 2a str. 301
guuucaacggaccaauaaacgcc

SEQ ID NO: 1975999 - RNA, 21 nt, Shigella flexneri 2a str. 301
guuucaacgacccagccagac

SEQ ID NO: 1976000 - RNA, 19 nt, Shigella flexneri 2a str. 301
guuucaaugauaagccuuc

SEQ ID NO: 1976001 - RNA, 15 nt, Shigella flexneri 2a str. 301
guuucaauccaggua

SEQ ID NO: 1976002 - RNA, 22 nt, Shigella flexneri 2a str. 301
guuucaccagcaguaaaccgcu

SEQ ID NO: 1976003 - RNA, 19 nt, Shigella flexneri 2a str. 301
guuucaccuuuuuccagau

SEQ ID NO: 1976004 - RNA, 15 nt, Shigella flexneri 2a str. 301
guuucaccaaacuuc

SEQ ID NO: 1976005 - RNA, 16 nt, Shigella flexneri 2a str. 301
guuucaaacaggcugc

SEQ ID NO: 1976006 - RNA, 15 nt, Shigella flexneri 2a str. 301
guuucaacacaggau

SEQ ID NO: 1976007 - RNA, 20 nt, Shigella flexneri 2a str. 301
guuucaacaucaucucccac

SEQ ID NO: 1976008 - RNA, 16 nt, Shigella flexneri 2a str. 301
guuuauuugacagccc

SEQ ID NO: 1976009 - RNA, 16 nt, Shigella flexneri 2a str. 301
guuucaaaaacaaaga

SEQ ID NO: 1976010 - RNA, 15 nt, Shigella flexneri 2a str. 301
guuuauuaugccaca

SEQ ID NO: 1976011 - RNA, 14 nt, Shigella flexneri 2a str. 301
guuuaaggaaaaac

SEQ ID NO: 1976012 - RNA, 19 nt, Shigella flexneri 2a str. 301
guugugcuaacucaucacc

SEQ ID NO: 1976013 - RNA, 16 nt, Shigella flexneri 2a str. 301
guuguuaaccaccagu

SEQ ID NO: 1976014 - RNA, 21 nt, Shigella flexneri 2a str. 301
guuuacugucugcuucugccu

SEQ ID NO: 1976015 - RNA, 22 nt, Shigella flexneri 2a str. 301
guuuacgcguuuuucagaacuu

SEQ ID NO: 1976016 - RNA, 15 nt, Shigella flexneri 2a str. 301
guuuacgcagcucac

SEQ ID NO: 1976017 - RNA, 17 nt, Shigella flexneri 2a str. 301
guuuacgcuuuccagca

SEQ ID NO: 1976018 - RNA, 14 nt, Shigella flexneri 2a str. 301
guuuaauaaauuua

SEQ ID NO: 1976019 - RNA, 19 nt, Shigella flexneri 2a str. 301
guucugugucuuauuggca

SEQ ID NO: 1976020 - RNA, 20 nt, Shigella flexneri 2a str. 301
guucugucgauaaacucaug

SEQ ID NO: 1976021 - RNA, 23 nt, Shigella flexneri 2a str. 301
guucuuaggggguaucuuugacu

SEQ ID NO: 1976022 - RNA, 22 nt, Shigella flexneri 2a str. 301
guucugcguuaagacuuuuuuc

SEQ ID NO: 1976023 - RNA, 17 nt, Shigella flexneri 2a str. 301
guucuggccguacccag

SEQ ID NO: 1976024 - RNA, 18 nt, Shigella flexneri 2a str. 301
guugucucagcuucagau

SEQ ID NO: 1976025 - RNA, 17 nt, Shigella flexneri 2a str. 301
guugucuuuccagacuc

SEQ ID NO: 1976026 - RNA, 20 nt, Shigella flexneri 2a str. 301
guugucgacacccucgacca

SEQ ID NO: 1976027 - RNA, 18 nt, Shigella flexneri 2a str. 301
guugucaucggucagauc

SEQ ID NO: 1976028 - RNA, 12 nt, Shigella flexneri 2a str. 301
guuugccauuuu

SEQ ID NO: 1976029 - RNA, 15 nt, Shigella flexneri 2a str. 301
guuugcauccagcuc

SEQ ID NO: 1976030 - RNA, 14 nt, Shigella flexneri 2a str. 301
guuugcauccagcu

SEQ ID NO: 1976031 - RNA, 21 nt, Shigella flexneri 2a str. 301
guuugcagugaucgugugcca

SEQ ID NO: 1976032 - RNA, 23 nt, Shigella flexneri 2a str. 301
guuugcaggguuaauugaugguu

SEQ ID NO: 1976033 - RNA, 18 nt, Shigella flexneri 2a str. 301
guuugcgguguguggcug

SEQ ID NO: 1976034 - RNA, 12 nt, Shigella flexneri 2a str. 301
guuugcugcaug

SEQ ID NO: 1976035 - RNA, 22 nt, Shigella flexneri 2a str. 301
guuugccguaccacgccacugc

SEQ ID NO: 1976036 - RNA, 22 nt, Shigella flexneri 2a str. 301
guuugccuuucggcgcagucac

SEQ ID NO: 1976037 - RNA, 18 nt, Shigella flexneri 2a str. 301
guuucugcauuauccagc

SEQ ID NO: 1976038 - RNA, 17 nt, Shigella flexneri 2a str. 301
guuucuggaugauccug

SEQ ID NO: 1976039 - RNA, 16 nt, Shigella flexneri 2a str. 301
guuucuggucauugcc

SEQ ID NO: 1976040 - RNA, 19 nt, Shigella flexneri 2a str. 301
guuugcugccuucacggcu

SEQ ID NO: 1976041 - RNA, 11 nt, Shigella flexneri 2a str. 301
guuuggcaaau

SEQ ID NO: 1976042 - RNA, 13 nt, Shigella flexneri 2a str. 301
guuuggcaaauac

SEQ ID NO: 1976043 - RNA, 24 nt, Shigella flexneri 2a str. 301
guuuggccaauaguuccacuauuu

SEQ ID NO: 1976044 - RNA, 13 nt, Shigella flexneri 2a str. 301
guuuguagcagaa

SEQ ID NO: 1976045 - RNA, 17 nt, Shigella flexneri 2a str. 301
guuuguuacgauagaau

SEQ ID NO: 1976046 - RNA, 13 nt, Shigella flexneri 2a str. 301
guuuguuauccac

SEQ ID NO: 1976047 - RNA, 20 nt, Shigella flexneri 2a str. 301
guuuucuacuuuguaaacga

SEQ ID NO: 1976048 - RNA, 17 nt, Shigella flexneri 2a str. 301
guuuucuaacucauuuu

SEQ ID NO: 1976049 - RNA, 12 nt, Shigella flexneri 2a str. 301
guuuuccuucag

SEQ ID NO: 1976050 - RNA, 16 nt, Shigella flexneri 2a str. 301
guuuucgcugccacac

SEQ ID NO: 1976051 - RNA, 14 nt, Shigella flexneri 2a str. 301
guuuucgccacauc

SEQ ID NO: 1976052 - RNA, 16 nt, Shigella flexneri 2a str. 301
guuuucagaugaaaac

SEQ ID NO: 1976053 - RNA, 16 nt, Shigella flexneri 2a str. 301
guuuucagcaccagau

SEQ ID NO: 1976054 - RNA, 17 nt, Shigella flexneri 2a str. 301
guuuucagaagcaugaa

SEQ ID NO: 1976055 - RNA, 20 nt, Shigella flexneri 2a str. 301
guuuucagaccagacugcuc

SEQ ID NO: 1976056 - RNA, 20 nt, Shigella flexneri 2a str. 301
guuuucaccgcggauuucac

SEQ ID NO: 1976057 - RNA, 11 nt, Shigella flexneri 2a str. 301
guuuucaacgg

SEQ ID NO: 1976058 - RNA, 15 nt, Shigella flexneri 2a str. 301
guuuucaacggcggc

SEQ ID NO: 1976059 - RNA, 15 nt, Shigella flexneri 2a str. 301
guuuuaauuccuauc

SEQ ID NO: 1976060 - RNA, 16 nt, Shigella flexneri 2a str. 301
guuuuaauuccuaucg

SEQ ID NO: 1976061 - RNA, 15 nt, Shigella flexneri 2a str. 301
guuuuacaacguauu

SEQ ID NO: 1976062 - RNA, 21 nt, Shigella flexneri 2a str. 301
guuuuacaacgcuguugcgua

SEQ ID NO: 1976063 - RNA, 14 nt, Shigella flexneri 2a str. 301
guuuuacuccaacu

SEQ ID NO: 1976064 - RNA, 17 nt, Shigella flexneri 2a str. 301
guuuuacgcauaucucc

SEQ ID NO: 1976065 - RNA, 13 nt, Shigella flexneri 2a str. 301
guuuuaguaacaa

SEQ ID NO: 1976066 - RNA, 21 nt, Shigella flexneri 2a str. 301
guuuuacuuuuuaacuuuaau

SEQ ID NO: 1976067 - RNA, 14 nt, Shigella flexneri 2a str. 301
guuuuaucagaccg

SEQ ID NO: 1976068 - RNA, 20 nt, Shigella flexneri 2a str. 301
guuuuauagcgggaaauacu

SEQ ID NO: 1976069 - RNA, 19 nt, Shigella flexneri 2a str. 301
guuuuauuauuccauccug

SEQ ID NO: 1976070 - RNA, 12 nt, Shigella flexneri 2a str. 301
uaaaagcaaaaa

SEQ ID NO: 1976071 - RNA, 20 nt, Shigella flexneri 2a str. 301
uaaaacgcagucuucccagc

SEQ ID NO: 1976072 - RNA, 18 nt, Shigella flexneri 2a str. 301
uaaaacgcagucuuccca

SEQ ID NO: 1976073 - RNA, 18 nt, Shigella flexneri 2a str. 301
uaaaacgaucgcccagac

SEQ ID NO: 1976074 - RNA, 14 nt, Shigella flexneri 2a str. 301
uaaaaacaucauga

SEQ ID NO: 1976075 - RNA, 21 nt, Shigella flexneri 2a str. 301
uaaaaacagcaucaauaauca

SEQ ID NO: 1976076 - RNA, 15 nt, Shigella flexneri 2a str. 301
uaaaaacagccagca

SEQ ID NO: 1976077 - RNA, 15 nt, Shigella flexneri 2a str. 301
uaaaaacagcaucaa

SEQ ID NO: 1976078 - RNA, 12 nt, Shigella flexneri 2a str. 301
uaaaaaauuuau

SEQ ID NO: 1976079 - RNA, 13 nt, Shigella flexneri 2a str. 301
uaaaaauauuucu

SEQ ID NO: 1976080 - RNA, 21 nt, Shigella flexneri 2a str. 301
uaaaagcgugaaacaaaucac

SEQ ID NO: 1976081 - RNA, 20 nt, Shigella flexneri 2a str. 301
uaaaagcgcgcccaacagua

SEQ ID NO: 1976082 - RNA, 20 nt, Shigella flexneri 2a str. 301
uaaaagccaggagccaacac

SEQ ID NO: 1976083 - RNA, 21 nt, Shigella flexneri 2a str. 301
uaaaagcacagaaucuaagau

SEQ ID NO: 1976084 - RNA, 17 nt, Shigella flexneri 2a str. 301
uaaaagaaaucagacca

SEQ ID NO: 1976085 - RNA, 20 nt, Shigella flexneri 2a str. 301
guuuuuuuauaucucagaua

SEQ ID NO: 1976086 - RNA, 17 nt, Shigella flexneri 2a str. 301
guuuuuuuauagcuuau

SEQ ID NO: 1976087 - RNA, 12 nt, Shigella flexneri 2a str. 301
guuuuuucaacc

SEQ ID NO: 1976088 - RNA, 16 nt, Shigella flexneri 2a str. 301
guuuuuucaaccuaaa

SEQ ID NO: 1976089 - RNA, 21 nt, Shigella flexneri 2a str. 301
guuuuuuaaaggaaaguaaau

SEQ ID NO: 1976090 - RNA, 15 nt, Shigella flexneri 2a str. 301
guuuuuguugauaaa

SEQ ID NO: 1976091 - RNA, 21 nt, Shigella flexneri 2a str. 301
uaaaaaaaacgccagcaacac

SEQ ID NO: 1976092 - RNA, 20 nt, Shigella flexneri 2a str. 301
uaaaaaaacaucauaauaau

SEQ ID NO: 1976093 - RNA, 17 nt, Shigella flexneri 2a str. 301
uaaaaaagggugcugca

SEQ ID NO: 1976094 - RNA, 17 nt, Shigella flexneri 2a str. 301
uaaaaaauuaacaaaac

SEQ ID NO: 1976095 - RNA, 19 nt, Shigella flexneri 2a str. 301
uaaaaaauuaacaaaacaa

SEQ ID NO: 1976096 - RNA, 20 nt, Shigella flexneri 2a str. 301
uaaaaaagaaggaaaauaca

SEQ ID NO: 1976097 - RNA, 17 nt, Shigella flexneri 2a str. 301
guuuugccagucagcuc

SEQ ID NO: 1976098 - RNA, 18 nt, Shigella flexneri 2a str. 301
guuuugcauggcaacuaa

SEQ ID NO: 1976099 - RNA, 17 nt, Shigella flexneri 2a str. 301
guuuugcaucaacugcg

SEQ ID NO: 1976100 - RNA, 17 nt, Shigella flexneri 2a str. 301
guuuugcggcgugaccu

SEQ ID NO: 1976101 - RNA, 19 nt, Shigella flexneri 2a str. 301
guuuugcuauccaguacau

SEQ ID NO: 1976102 - RNA, 20 nt, Shigella flexneri 2a str. 301
guuuuggccgugaauuacug

SEQ ID NO: 1976103 - RNA, 22 nt, Shigella flexneri 2a str. 301
guuuugguuaacugaauauucc

SEQ ID NO: 1976104 - RNA, 19 nt, Shigella flexneri 2a str. 301
guuuuggugaagugagaau

SEQ ID NO: 1976105 - RNA, 18 nt, Shigella flexneri 2a str. 301
guuuucucgcuccauucc

SEQ ID NO: 1976106 - RNA, 14 nt, Shigella flexneri 2a str. 301
guuuucuccagcgc

SEQ ID NO: 1976107 - RNA, 11 nt, Shigella flexneri 2a str. 301
guuuucucucu

SEQ ID NO: 1976108 - RNA, 13 nt, Shigella flexneri 2a str. 301
guuuugaugaauc

SEQ ID NO: 1976109 - RNA, 16 nt, Shigella flexneri 2a str. 301
guuuuugcuguuguuc

SEQ ID NO: 1976110 - RNA, 12 nt, Shigella flexneri 2a str. 301
guuuuucuuuuu

SEQ ID NO: 1976111 - RNA, 16 nt, Shigella flexneri 2a str. 301
guuuuuccccugccag

SEQ ID NO: 1976112 - RNA, 16 nt, Shigella flexneri 2a str. 301
guuuuuccaaaacugg

SEQ ID NO: 1976113 - RNA, 22 nt, Shigella flexneri 2a str. 301
guuuuguugcccagcgcaucag

SEQ ID NO: 1976114 - RNA, 13 nt, Shigella flexneri 2a str. 301
guuuuuacagauu

SEQ ID NO: 1976115 - RNA, 17 nt, Shigella flexneri 2a str. 301
guuuuuacccagcagca

SEQ ID NO: 1976116 - RNA, 19 nt, Shigella flexneri 2a str. 301
guuuuucagcgccagcgcg

SEQ ID NO: 1976117 - RNA, 22 nt, Shigella flexneri 2a str. 301
guuuuucaguagacucaagcag

SEQ ID NO: 1976118 - RNA, 21 nt, Shigella flexneri 2a str. 301
uaacccggcaccaacaaagcc

SEQ ID NO: 1976119 - RNA, 21 nt, Shigella flexneri 2a str. 301
uaacccgcagcuuaaugaacu

SEQ ID NO: 1976120 - RNA, 18 nt, Shigella flexneri 2a str. 301
uaacccggcaccaacaaa

SEQ ID NO: 1976121 - RNA, 21 nt, Shigella flexneri 2a str. 301
uaaccauccauauuuggcaug

SEQ ID NO: 1976122 - RNA, 15 nt, Shigella flexneri 2a str. 301
uaaccaucgcacagc

SEQ ID NO: 1976123 - RNA, 12 nt, Shigella flexneri 2a str. 301
uaaccaucccuu

SEQ ID NO: 1976124 - RNA, 21 nt, Shigella flexneri 2a str. 301
uaaccauauaugauaauuauu

SEQ ID NO: 1976125 - RNA, 12 nt, Shigella flexneri 2a str. 301
uaaccaucagcu

SEQ ID NO: 1976126 - RNA, 15 nt, Shigella flexneri 2a str. 301
uaaccaucagcugug

SEQ ID NO: 1976127 - RNA, 20 nt, Shigella flexneri 2a str. 301
uaaccauccauauuuggcau

SEQ ID NO: 1976128 - RNA, 23 nt, Shigella flexneri 2a str. 301
uaacauuuuacuuacuucagcaa

SEQ ID NO: 1976129 - RNA, 19 nt, Shigella flexneri 2a str. 301
uaaccagucggaaacauga

SEQ ID NO: 1976130 - RNA, 14 nt, Shigella flexneri 2a str. 301
uaacauuuuacuua

SEQ ID NO: 1976131 - RNA, 16 nt, Shigella flexneri 2a str. 301
uaacauugcaagauuu

SEQ ID NO: 1976132 - RNA, 16 nt, Shigella flexneri 2a str. 301
uaacagcaucgcauca

SEQ ID NO: 1976133 - RNA, 18 nt, Shigella flexneri 2a str. 301
uaacagcgaaaucgccuu

SEQ ID NO: 1976134 - RNA, 21 nt, Shigella flexneri 2a str. 301
uaacauguuuuuugaugucau

SEQ ID NO: 1976135 - RNA, 13 nt, Shigella flexneri 2a str. 301
uaacauggcggua

SEQ ID NO: 1976136 - RNA, 20 nt, Shigella flexneri 2a str. 301
uaacaccagccagaauuacc

SEQ ID NO: 1976137 - RNA, 13 nt, Shigella flexneri 2a str. 301
uaacaccaucagu

SEQ ID NO: 1976138 - RNA, 15 nt, Shigella flexneri 2a str. 301
uaacaccaucauauu

SEQ ID NO: 1976139 - RNA, 14 nt, Shigella flexneri 2a str. 301
uaacagcagcagcg

SEQ ID NO: 1976140 - RNA, 11 nt, Shigella flexneri 2a str. 301
uaacagcagca

SEQ ID NO: 1976141 - RNA, 16 nt, Shigella flexneri 2a str. 301
uaacagcaaaacgccc

SEQ ID NO: 1976142 - RNA, 21 nt, Shigella flexneri 2a str. 301
uaacagcaaucccaaaauaau

SEQ ID NO: 1976143 - RNA, 17 nt, Shigella flexneri 2a str. 301
uaacagcaauuuuguca

SEQ ID NO: 1976144 - RNA, 20 nt, Shigella flexneri 2a str. 301
uaacagagccgcgauaaaau

SEQ ID NO: 1976145 - RNA, 14 nt, Shigella flexneri 2a str. 301
uaacagauaaauca

SEQ ID NO: 1976146 - RNA, 16 nt, Shigella flexneri 2a str. 301
uaacgcuucucccagc

SEQ ID NO: 1976147 - RNA, 17 nt, Shigella flexneri 2a str. 301
uaacgcuucucccagcc

SEQ ID NO: 1976148 - RNA, 18 nt, Shigella flexneri 2a str. 301
uaacgcuggcagcaagug

SEQ ID NO: 1976149 - RNA, 14 nt, Shigella flexneri 2a str. 301
uaacgcgucucaug

SEQ ID NO: 1976150 - RNA, 20 nt, Shigella flexneri 2a str. 301
uaacgcagaaucuucuucuc

SEQ ID NO: 1976151 - RNA, 23 nt, Shigella flexneri 2a str. 301
uaacgaccaccaccgcaguaauc

SEQ ID NO: 1976152 - RNA, 20 nt, Shigella flexneri 2a str. 301
uaaccuuugcgguuaaaaau

SEQ ID NO: 1976153 - RNA, 20 nt, Shigella flexneri 2a str. 301
uaacgaacgcagugauaacu

SEQ ID NO: 1976154 - RNA, 17 nt, Shigella flexneri 2a str. 301
uaacgaaagaacaguua

SEQ ID NO: 1976155 - RNA, 18 nt, Shigella flexneri 2a str. 301
uaaccgugggaaacagua

SEQ ID NO: 1976156 - RNA, 14 nt, Shigella flexneri 2a str. 301
uaaccguugaccag

SEQ ID NO: 1976157 - RNA, 19 nt, Shigella flexneri 2a str. 301
uaaccguuucuaauauuag

SEQ ID NO: 1976158 - RNA, 20 nt, Shigella flexneri 2a str. 301
uaaccuauuguuuuaaugac

SEQ ID NO: 1976159 - RNA, 14 nt, Shigella flexneri 2a str. 301
uaaccuuuaaucag

SEQ ID NO: 1976160 - RNA, 22 nt, Shigella flexneri 2a str. 301
uaaccuuuaucgcgcagcagau

SEQ ID NO: 1976161 - RNA, 15 nt, Shigella flexneri 2a str. 301
uaaccgggagauuuu

SEQ ID NO: 1976162 - RNA, 22 nt, Shigella flexneri 2a str. 301
uaaccgcuuuuucaauuuccag

SEQ ID NO: 1976163 - RNA, 22 nt, Shigella flexneri 2a str. 301
uaaccggaggauaugcaucaug

SEQ ID NO: 1976164 - RNA, 23 nt, Shigella flexneri 2a str. 301
uaaccgcuucgcuggcagcugcu

SEQ ID NO: 1976165 - RNA, 16 nt, Shigella flexneri 2a str. 301
uaaccgcugcaaaaaa

SEQ ID NO: 1976166 - RNA, 17 nt, Shigella flexneri 2a str. 301
uaaccgccuaauuacau

SEQ ID NO: 1976167 - RNA, 17 nt, Shigella flexneri 2a str. 301
uaaccgcggcuaagcug

SEQ ID NO: 1976168 - RNA, 13 nt, Shigella flexneri 2a str. 301
uaacccuuccaga

SEQ ID NO: 1976169 - RNA, 20 nt, Shigella flexneri 2a str. 301
uaaccgcaguguaguucugg

SEQ ID NO: 1976170 - RNA, 14 nt, Shigella flexneri 2a str. 301
uaaauuuaauaaua

SEQ ID NO: 1976171 - RNA, 23 nt, Shigella flexneri 2a str. 301
uaaauuuacguucuuacauuccg

SEQ ID NO: 1976172 - RNA, 17 nt, Shigella flexneri 2a str. 301
uaaauuuaaaacugccu

SEQ ID NO: 1976173 - RNA, 21 nt, Shigella flexneri 2a str. 301
uaaauugcaaaccucaggaau

SEQ ID NO: 1976174 - RNA, 17 nt, Shigella flexneri 2a str. 301
uaaauucuaauguuaaa

SEQ ID NO: 1976175 - RNA, 21 nt, Shigella flexneri 2a str. 301
uaaauucgcugcggacaaaac

SEQ ID NO: 1976176 - RNA, 15 nt, Shigella flexneri 2a str. 301
uaaauugcagcgauu

SEQ ID NO: 1976177 - RNA, 17 nt, Shigella flexneri 2a str. 301
uaaauugagcugcgcga

SEQ ID NO: 1976178 - RNA, 23 nt, Shigella flexneri 2a str. 301
uaaauuaacugcgcgauuaucau

SEQ ID NO: 1976179 - RNA, 15 nt, Shigella flexneri 2a str. 301
uaaauuacccuuuau

SEQ ID NO: 1976180 - RNA, 21 nt, Shigella flexneri 2a str. 301
uaaauuacugagcaauugcuc

SEQ ID NO: 1976181 - RNA, 13 nt, Shigella flexneri 2a str. 301
uaaauuccacgcg

SEQ ID NO: 1976182 - RNA, 18 nt, Shigella flexneri 2a str. 301
uaaauuccagguagaagu

SEQ ID NO: 1976183 - RNA, 20 nt, Shigella flexneri 2a str. 301
uaacaauucccgauagucuu

SEQ ID NO: 1976184 - RNA, 19 nt, Shigella flexneri 2a str. 301
uaacaaaugugccauuaau

SEQ ID NO: 1976185 - RNA, 12 nt, Shigella flexneri 2a str. 301
uaacacaugcaa

SEQ ID NO: 1976186 - RNA, 14 nt, Shigella flexneri 2a str. 301
uaacacacaauuac

SEQ ID NO: 1976187 - RNA, 19 nt, Shigella flexneri 2a str. 301
uaacacagaggcagcaucu

SEQ ID NO: 1976188 - RNA, 17 nt, Shigella flexneri 2a str. 301
uaaauuugccaucucug

SEQ ID NO: 1976189 - RNA, 17 nt, Shigella flexneri 2a str. 301
uaaauuugcuuuucaua

SEQ ID NO: 1976190 - RNA, 14 nt, Shigella flexneri 2a str. 301
uaaauuucccacuc

SEQ ID NO: 1976191 - RNA, 20 nt, Shigella flexneri 2a str. 301
uaaauuuauagucaucggua

SEQ ID NO: 1976192 - RNA, 17 nt, Shigella flexneri 2a str. 301
uaaauuuaucaaugcau

SEQ ID NO: 1976193 - RNA, 21 nt, Shigella flexneri 2a str. 301
uaaauuucacugcuuaauauu

SEQ ID NO: 1976194 - RNA, 19 nt, Shigella flexneri 2a str. 301
uaaauuugcuuuucauaca

SEQ ID NO: 1976195 - RNA, 21 nt, Shigella flexneri 2a str. 301
uaacaaaaucgugaaaaauca

SEQ ID NO: 1976196 - RNA, 14 nt, Shigella flexneri 2a str. 301
uaaacguuuaaaaa

SEQ ID NO: 1976197 - RNA, 15 nt, Shigella flexneri 2a str. 301
uaaacgucucacuaa

SEQ ID NO: 1976198 - RNA, 23 nt, Shigella flexneri 2a str. 301
uaaaccucucugcuagcuggcuc

SEQ ID NO: 1976199 - RNA, 13 nt, Shigella flexneri 2a str. 301
uaaaccuccagca

SEQ ID NO: 1976200 - RNA, 15 nt, Shigella flexneri 2a str. 301
uaaaaucuucacuaa

SEQ ID NO: 1976201 - RNA, 21 nt, Shigella flexneri 2a str. 301
uaaaaucuucacuaaaaucau

SEQ ID NO: 1976202 - RNA, 16 nt, Shigella flexneri 2a str. 301
uaaaccgucagcacca

SEQ ID NO: 1976203 - RNA, 17 nt, Shigella flexneri 2a str. 301
uaaaccgcucgucacau

SEQ ID NO: 1976204 - RNA, 14 nt, Shigella flexneri 2a str. 301
uaaaccacagaccg

SEQ ID NO: 1976205 - RNA, 20 nt, Shigella flexneri 2a str. 301
uaaaccacccaccagcgccg

SEQ ID NO: 1976206 - RNA, 23 nt, Shigella flexneri 2a str. 301
uaaaccacugacacaggcagcaa

SEQ ID NO: 1976207 - RNA, 23 nt, Shigella flexneri 2a str. 301
uaaagcauuuucauccauuacca

SEQ ID NO: 1976208 - RNA, 19 nt, Shigella flexneri 2a str. 301
uaaagcacugucuaacaac

SEQ ID NO: 1976209 - RNA, 14 nt, Shigella flexneri 2a str. 301
uaaaggucaucaca

SEQ ID NO: 1976210 - RNA, 15 nt, Shigella flexneri 2a str. 301
uaaaggucaucacau

SEQ ID NO: 1976211 - RNA, 23 nt, Shigella flexneri 2a str. 301
uaaagcgcgcaguuugucuucaa

SEQ ID NO: 1976212 - RNA, 17 nt, Shigella flexneri 2a str. 301
uaaagcgguuacacaug

SEQ ID NO: 1976213 - RNA, 17 nt, Shigella flexneri 2a str. 301
uaaagccuauccagaag

SEQ ID NO: 1976214 - RNA, 22 nt, Shigella flexneri 2a str. 301
uaaagccggugcggucaggcau

SEQ ID NO: 1976215 - RNA, 21 nt, Shigella flexneri 2a str. 301
uaaagccugcuucaaacgcug

SEQ ID NO: 1976216 - RNA, 21 nt, Shigella flexneri 2a str. 301
uaaagaagauaccgaacauac

SEQ ID NO: 1976217 - RNA, 17 nt, Shigella flexneri 2a str. 301
uaaagaagguaagucca

SEQ ID NO: 1976218 - RNA, 20 nt, Shigella flexneri 2a str. 301
uaaagaaggcauaacucccc

SEQ ID NO: 1976219 - RNA, 19 nt, Shigella flexneri 2a str. 301
uaaacuucacuuccccgag

SEQ ID NO: 1976220 - RNA, 12 nt, Shigella flexneri 2a str. 301
uaaacuuucaua

SEQ ID NO: 1976221 - RNA, 22 nt, Shigella flexneri 2a str. 301
uaaagacguuaacuacaaucac

SEQ ID NO: 1976222 - RNA, 21 nt, Shigella flexneri 2a str. 301
uaaagagaacucuuuuuuccg

SEQ ID NO: 1976223 - RNA, 22 nt, Shigella flexneri 2a str. 301
uaaagaccauugaugcucuccg

SEQ ID NO: 1976224 - RNA, 17 nt, Shigella flexneri 2a str. 301
uaaaguacucuuugaac

SEQ ID NO: 1976225 - RNA, 19 nt, Shigella flexneri 2a str. 301
uaaaguugcucucaaagac

SEQ ID NO: 1976226 - RNA, 18 nt, Shigella flexneri 2a str. 301
uaaaguacgcuuucccuu

SEQ ID NO: 1976227 - RNA, 23 nt, Shigella flexneri 2a str. 301
uaaaguacguguggucuuuucaa

SEQ ID NO: 1976228 - RNA, 14 nt, Shigella flexneri 2a str. 301
uaaaguuuuauccc

SEQ ID NO: 1976229 - RNA, 16 nt, Shigella flexneri 2a str. 301
uaaauaaacucucuau

SEQ ID NO: 1976230 - RNA, 16 nt, Shigella flexneri 2a str. 301
uaaauagaggaaucug

SEQ ID NO: 1976231 - RNA, 17 nt, Shigella flexneri 2a str. 301
uaaauagaggaaucuga

SEQ ID NO: 1976232 - RNA, 19 nt, Shigella flexneri 2a str. 301
uaaauagaggaaucugauu

SEQ ID NO: 1976233 - RNA, 14 nt, Shigella flexneri 2a str. 301
uaaauaaucgaucg

SEQ ID NO: 1976234 - RNA, 20 nt, Shigella flexneri 2a str. 301
uaaauaaucgcauucaggac

SEQ ID NO: 1976235 - RNA, 15 nt, Shigella flexneri 2a str. 301
uaaaugcugcagcca

SEQ ID NO: 1976236 - RNA, 15 nt, Shigella flexneri 2a str. 301
uaaaugguuaacaug

SEQ ID NO: 1976237 - RNA, 16 nt, Shigella flexneri 2a str. 301
uaaaucuuugcccgca

SEQ ID NO: 1976238 - RNA, 18 nt, Shigella flexneri 2a str. 301
uaaaugccgcguggccug

SEQ ID NO: 1976239 - RNA, 20 nt, Shigella flexneri 2a str. 301
uaaaucaagcgccgccaguc

SEQ ID NO: 1976240 - RNA, 15 nt, Shigella flexneri 2a str. 301
uaaaucuguucaucu

SEQ ID NO: 1976241 - RNA, 14 nt, Shigella flexneri 2a str. 301
gucugccccgccgc

SEQ ID NO: 1976242 - RNA, 18 nt, Shigella flexneri 2a str. 301
gucugccgggaagcucuc

SEQ ID NO: 1976243 - RNA, 16 nt, Shigella flexneri 2a str. 301
gucugauaaaaaaccc

SEQ ID NO: 1976244 - RNA, 18 nt, Shigella flexneri 2a str. 301
gucugagccgaaaaagag

SEQ ID NO: 1976245 - RNA, 13 nt, Shigella flexneri 2a str. 301
gucugaauccauc

SEQ ID NO: 1976246 - RNA, 15 nt, Shigella flexneri 2a str. 301
gucugaccauaaccc

SEQ ID NO: 1976247 - RNA, 21 nt, Shigella flexneri 2a str. 301
gucugcagauauucaugcagg

SEQ ID NO: 1976248 - RNA, 19 nt, Shigella flexneri 2a str. 301
gucucuugccgguuuugca

SEQ ID NO: 1976249 - RNA, 23 nt, Shigella flexneri 2a str. 301
gucucucuccguuaucacagcag

SEQ ID NO: 1976250 - RNA, 21 nt, Shigella flexneri 2a str. 301
gucucugccggguucgcacua

SEQ ID NO: 1976251 - RNA, 17 nt, Shigella flexneri 2a str. 301
gucucuuuucguuuugg

SEQ ID NO: 1976252 - RNA, 18 nt, Shigella flexneri 2a str. 301
gucuguaccaccagaauc

SEQ ID NO: 1976253 - RNA, 13 nt, Shigella flexneri 2a str. 301
gucuguaugacaa

SEQ ID NO: 1976254 - RNA, 18 nt, Shigella flexneri 2a str. 301
gucuguacggcagugaac

SEQ ID NO: 1976255 - RNA, 17 nt, Shigella flexneri 2a str. 301
gucugguguaucugcug

SEQ ID NO: 1976256 - RNA, 17 nt, Shigella flexneri 2a str. 301
gucugggcguugcaaua

SEQ ID NO: 1976257 - RNA, 14 nt, Shigella flexneri 2a str. 301
gucuggaacggcag

SEQ ID NO: 1976258 - RNA, 16 nt, Shigella flexneri 2a str. 301
gucugcugaccaccug

SEQ ID NO: 1976259 - RNA, 16 nt, Shigella flexneri 2a str. 301
gucuggauuuggcugc

SEQ ID NO: 1976260 - RNA, 21 nt, Shigella flexneri 2a str. 301
gucuggcagauccugaaauuc

SEQ ID NO: 1976261 - RNA, 14 nt, Shigella flexneri 2a str. 301
gucuucaaccgcag

SEQ ID NO: 1976262 - RNA, 13 nt, Shigella flexneri 2a str. 301
gucuuaucuggca

SEQ ID NO: 1976263 - RNA, 14 nt, Shigella flexneri 2a str. 301
gucuuccagcaaau

SEQ ID NO: 1976264 - RNA, 19 nt, Shigella flexneri 2a str. 301
gucuguucgccccaaaaaa

SEQ ID NO: 1976265 - RNA, 21 nt, Shigella flexneri 2a str. 301
gucuuaucaggccuacaaguc

SEQ ID NO: 1976266 - RNA, 19 nt, Shigella flexneri 2a str. 301
gucuuaucaggccuacaac

SEQ ID NO: 1976267 - RNA, 19 nt, Shigella flexneri 2a str. 301
gucuuggguauaaaacuca

SEQ ID NO: 1976268 - RNA, 18 nt, Shigella flexneri 2a str. 301
gucuucucaccgccgccu

SEQ ID NO: 1976269 - RNA, 13 nt, Shigella flexneri 2a str. 301
gucuucugguugc

SEQ ID NO: 1976270 - RNA, 17 nt, Shigella flexneri 2a str. 301
gucuucugguuuuucug

SEQ ID NO: 1976271 - RNA, 10 nt, Shigella flexneri 2a str. 301
gucuucccug

SEQ ID NO: 1976272 - RNA, 12 nt, Shigella flexneri 2a str. 301
gucuuccugugg

SEQ ID NO: 1976273 - RNA, 20 nt, Shigella flexneri 2a str. 301
gucuucgauagcaaauugcu

SEQ ID NO: 1976274 - RNA, 14 nt, Shigella flexneri 2a str. 301
gucuuuuuucacug

SEQ ID NO: 1976275 - RNA, 16 nt, Shigella flexneri 2a str. 301
gucuuuuuucaacuuu

SEQ ID NO: 1976276 - RNA, 14 nt, Shigella flexneri 2a str. 301
gugaaaauguggua

SEQ ID NO: 1976277 - RNA, 18 nt, Shigella flexneri 2a str. 301
gugaaaaauggcgcccau

SEQ ID NO: 1976278 - RNA, 16 nt, Shigella flexneri 2a str. 301
gucuuuacuaaacggu

SEQ ID NO: 1976279 - RNA, 18 nt, Shigella flexneri 2a str. 301
gucuuugugccacgcugg

SEQ ID NO: 1976280 - RNA, 15 nt, Shigella flexneri 2a str. 301
gucuuguuacuggcu

SEQ ID NO: 1976281 - RNA, 13 nt, Shigella flexneri 2a str. 301
gugaacgccuuau

SEQ ID NO: 1976282 - RNA, 22 nt, Shigella flexneri 2a str. 301
gugaacgagaaaaugacgauga

SEQ ID NO: 1976283 - RNA, 20 nt, Shigella flexneri 2a str. 301
gugaacgagaaaaugacgau

SEQ ID NO: 1976284 - RNA, 16 nt, Shigella flexneri 2a str. 301
gugaaauacaguuauc

SEQ ID NO: 1976285 - RNA, 13 nt, Shigella flexneri 2a str. 301
gugaaaguaaaaa

SEQ ID NO: 1976286 - RNA, 16 nt, Shigella flexneri 2a str. 301
gugaaauuaaacuguc

SEQ ID NO: 1976287 - RNA, 17 nt, Shigella flexneri 2a str. 301
gugaaaucugaaaucau

SEQ ID NO: 1976288 - RNA, 12 nt, Shigella flexneri 2a str. 301
gugacacaauca

SEQ ID NO: 1976289 - RNA, 15 nt, Shigella flexneri 2a str. 301
gugaauucagcgacu

SEQ ID NO: 1976290 - RNA, 13 nt, Shigella flexneri 2a str. 301
gugaaugccuuau

SEQ ID NO: 1976291 - RNA, 15 nt, Shigella flexneri 2a str. 301
gugaaucacuccauc

SEQ ID NO: 1976292 - RNA, 16 nt, Shigella flexneri 2a str. 301
gugaauaugauuuucu

SEQ ID NO: 1976293 - RNA, 21 nt, Shigella flexneri 2a str. 301
gugaauauuccuuaugguuca

SEQ ID NO: 1976294 - RNA, 15 nt, Shigella flexneri 2a str. 301
gugagggggcguuca

SEQ ID NO: 1976295 - RNA, 21 nt, Shigella flexneri 2a str. 301
gugaguaugauacguuuauua

SEQ ID NO: 1976296 - RNA, 21 nt, Shigella flexneri 2a str. 301
gugagccgaaauauggcucug

SEQ ID NO: 1976297 - RNA, 18 nt, Shigella flexneri 2a str. 301
gugagcgggcgaaccagg

SEQ ID NO: 1976298 - RNA, 16 nt, Shigella flexneri 2a str. 301
gugagcgguuucgccu

SEQ ID NO: 1976299 - RNA, 17 nt, Shigella flexneri 2a str. 301
gugagcuacacgggcau

SEQ ID NO: 1976300 - RNA, 20 nt, Shigella flexneri 2a str. 301
gugagcguuuucucaaaaaa

SEQ ID NO: 1976301 - RNA, 14 nt, Shigella flexneri 2a str. 301
gugaggaucaccag

SEQ ID NO: 1976302 - RNA, 23 nt, Shigella flexneri 2a str. 301
gugagaucauuauuaaacagaca

SEQ ID NO: 1976303 - RNA, 22 nt, Shigella flexneri 2a str. 301
gugagccaggacgauaaaccag

SEQ ID NO: 1976304 - RNA, 13 nt, Shigella flexneri 2a str. 301
gugauacuucuuc

SEQ ID NO: 1976305 - RNA, 21 nt, Shigella flexneri 2a str. 301
gugauaaaacgcagucuuccc

SEQ ID NO: 1976306 - RNA, 18 nt, Shigella flexneri 2a str. 301
gugauccgccgcgcggug

SEQ ID NO: 1976307 - RNA, 19 nt, Shigella flexneri 2a str. 301
gugaucccaauauagacaa

SEQ ID NO: 1976308 - RNA, 21 nt, Shigella flexneri 2a str. 301
gugauccgccgcugucgcagc

SEQ ID NO: 1976309 - RNA, 17 nt, Shigella flexneri 2a str. 301
gugaucguggccaugac

SEQ ID NO: 1976310 - RNA, 12 nt, Shigella flexneri 2a str. 301
gugagaacacca

SEQ ID NO: 1976311 - RNA, 20 nt, Shigella flexneri 2a str. 301
gugacuucugccagcugcug

SEQ ID NO: 1976312 - RNA, 21 nt, Shigella flexneri 2a str. 301
gugacguugcgacacuccuga

SEQ ID NO: 1976313 - RNA, 19 nt, Shigella flexneri 2a str. 301
gugacguugucacguuauc

SEQ ID NO: 1976314 - RNA, 15 nt, Shigella flexneri 2a str. 301
gugacuucugccagc

SEQ ID NO: 1976315 - RNA, 18 nt, Shigella flexneri 2a str. 301
gugacuucugccagcugc

SEQ ID NO: 1976316 - RNA, 22 nt, Shigella flexneri 2a str. 301
gugacucccacuuuuauuucac

SEQ ID NO: 1976317 - RNA, 15 nt, Shigella flexneri 2a str. 301
gugacgacaccaucu

SEQ ID NO: 1976318 - RNA, 14 nt, Shigella flexneri 2a str. 301
gugacgaucaccac

SEQ ID NO: 1976319 - RNA, 16 nt, Shigella flexneri 2a str. 301
gugacgcgggcagcag

SEQ ID NO: 1976320 - RNA, 17 nt, Shigella flexneri 2a str. 301
gugaccuuucagugggu

SEQ ID NO: 1976321 - RNA, 22 nt, Shigella flexneri 2a str. 301
gugacgaaagucugggccgaua

SEQ ID NO: 1976322 - RNA, 15 nt, Shigella flexneri 2a str. 301
gugaccuguccugua

SEQ ID NO: 1976323 - RNA, 22 nt, Shigella flexneri 2a str. 301
gugaccgaaccuguuuucaccg

SEQ ID NO: 1976324 - RNA, 13 nt, Shigella flexneri 2a str. 301
gugacauuaacca

SEQ ID NO: 1976325 - RNA, 20 nt, Shigella flexneri 2a str. 301
gugacaguguuauucccaac

SEQ ID NO: 1976326 - RNA, 11 nt, Shigella flexneri 2a str. 301
gugacauucug

SEQ ID NO: 1976327 - RNA, 17 nt, Shigella flexneri 2a str. 301
gugaccagcagcauuuc

SEQ ID NO: 1976328 - RNA, 18 nt, Shigella flexneri 2a str. 301
gugaccaguugcuccagc

SEQ ID NO: 1976329 - RNA, 13 nt, Shigella flexneri 2a str. 301
gugaccaucuucc

SEQ ID NO: 1976330 - RNA, 23 nt, Shigella flexneri 2a str. 301
gugacaucgugcugguagaagcu

SEQ ID NO: 1976331 - RNA, 12 nt, Shigella flexneri 2a str. 301
gugacagcagcg

SEQ ID NO: 1976332 - RNA, 13 nt, Shigella flexneri 2a str. 301
gugacagcgguga

SEQ ID NO: 1976333 - RNA, 17 nt, Shigella flexneri 2a str. 301
gugccugcauaaacgcc

SEQ ID NO: 1976334 - RNA, 22 nt, Shigella flexneri 2a str. 301
gugccugagccggaguugcaga

SEQ ID NO: 1976335 - RNA, 19 nt, Shigella flexneri 2a str. 301
gugccgucugccccgccgc

SEQ ID NO: 1976336 - RNA, 23 nt, Shigella flexneri 2a str. 301
gugccguaaaucccagugccugc

SEQ ID NO: 1976337 - RNA, 22 nt, Shigella flexneri 2a str. 301
gugccuaacaauucgccagggc

SEQ ID NO: 1976338 - RNA, 20 nt, Shigella flexneri 2a str. 301
gugccgggguagaccgcgcu

SEQ ID NO: 1976339 - RNA, 19 nt, Shigella flexneri 2a str. 301
gugccgagaguaacacauu

SEQ ID NO: 1976340 - RNA, 16 nt, Shigella flexneri 2a str. 301
gugccaucgauaauca

SEQ ID NO: 1976341 - RNA, 19 nt, Shigella flexneri 2a str. 301
gugccgcuggcauacaguu

SEQ ID NO: 1976342 - RNA, 15 nt, Shigella flexneri 2a str. 301
gugccggaaggggcg

SEQ ID NO: 1976343 - RNA, 13 nt, Shigella flexneri 2a str. 301
gugccgcagcuuc

SEQ ID NO: 1976344 - RNA, 23 nt, Shigella flexneri 2a str. 301
gugccgcaccgacacaaauggca

SEQ ID NO: 1976345 - RNA, 20 nt, Shigella flexneri 2a str. 301
gugccgcacauagcaccacc

SEQ ID NO: 1976346 - RNA, 15 nt, Shigella flexneri 2a str. 301
gugccgcauugacgc

SEQ ID NO: 1976347 - RNA, 17 nt, Shigella flexneri 2a str. 301
gugcaggcaccagcccc

SEQ ID NO: 1976348 - RNA, 15 nt, Shigella flexneri 2a str. 301
gugcaucaacauaua

SEQ ID NO: 1976349 - RNA, 14 nt, Shigella flexneri 2a str. 301
gugcauccagcagc

SEQ ID NO: 1976350 - RNA, 15 nt, Shigella flexneri 2a str. 301
gugcaucauggaagc

SEQ ID NO: 1976351 - RNA, 18 nt, Shigella flexneri 2a str. 301
gugcaguggcuccagcgc

SEQ ID NO: 1976352 - RNA, 21 nt, Shigella flexneri 2a str. 301
gugcauaaauaccggcauguu

SEQ ID NO: 1976353 - RNA, 17 nt, Shigella flexneri 2a str. 301
gugcaaaugccagauaa

SEQ ID NO: 1976354 - RNA, 21 nt, Shigella flexneri 2a str. 301
gugcaaauugcaccauccauu

SEQ ID NO: 1976355 - RNA, 23 nt, Shigella flexneri 2a str. 301
gugauuuccccuaacucuuucaa

SEQ ID NO: 1976356 - RNA, 17 nt, Shigella flexneri 2a str. 301
gugcaaaaccugguugg

SEQ ID NO: 1976357 - RNA, 13 nt, Shigella flexneri 2a str. 301
gugcaaaaucaaa

SEQ ID NO: 1976358 - RNA, 15 nt, Shigella flexneri 2a str. 301
gugcacgugccagau

SEQ ID NO: 1976359 - RNA, 19 nt, Shigella flexneri 2a str. 301
gugcacgaaccagagacag

SEQ ID NO: 1976360 - RNA, 15 nt, Shigella flexneri 2a str. 301
gugcacuuacaaggu

SEQ ID NO: 1976361 - RNA, 20 nt, Shigella flexneri 2a str. 301
guucaauuuccaguuucaca

SEQ ID NO: 1976362 - RNA, 16 nt, Shigella flexneri 2a str. 301
guucaauaucuuccug

SEQ ID NO: 1976363 - RNA, 16 nt, Shigella flexneri 2a str. 301
guucaaugauaguuca

SEQ ID NO: 1976364 - RNA, 13 nt, Shigella flexneri 2a str. 301
guucaagaugucu

SEQ ID NO: 1976365 - RNA, 18 nt, Shigella flexneri 2a str. 301
guuauuuguucagcaaau

SEQ ID NO: 1976366 - RNA, 11 nt, Shigella flexneri 2a str. 301
guuauuuccag

SEQ ID NO: 1976367 - RNA, 12 nt, Shigella flexneri 2a str. 301
guucaaaaaaau

SEQ ID NO: 1976368 - RNA, 23 nt, Shigella flexneri 2a str. 301
guucaacaauauuaaucccugcu

SEQ ID NO: 1976369 - RNA, 15 nt, Shigella flexneri 2a str. 301
guucaacgaccagau

SEQ ID NO: 1976370 - RNA, 13 nt, Shigella flexneri 2a str. 301
guuaugccucaac

SEQ ID NO: 1976371 - RNA, 13 nt, Shigella flexneri 2a str. 301
guuaugcucggca

SEQ ID NO: 1976372 - RNA, 16 nt, Shigella flexneri 2a str. 301
guuauggcgugagcug

SEQ ID NO: 1976373 - RNA, 16 nt, Shigella flexneri 2a str. 301
guuaucgucugcgcca

SEQ ID NO: 1976374 - RNA, 22 nt, Shigella flexneri 2a str. 301
guuauugucgggcguuucgcca

SEQ ID NO: 1976375 - RNA, 22 nt, Shigella flexneri 2a str. 301
guuauuacugcguauuuccugc

SEQ ID NO: 1976376 - RNA, 13 nt, Shigella flexneri 2a str. 301
guuaucaaauuca

SEQ ID NO: 1976377 - RNA, 20 nt, Shigella flexneri 2a str. 301
guuauaucccauuuuugaau

SEQ ID NO: 1976378 - RNA, 18 nt, Shigella flexneri 2a str. 301
guuauccgccagcgccau

SEQ ID NO: 1976379 - RNA, 21 nt, Shigella flexneri 2a str. 301
guuauaaacgcucggcaacac

SEQ ID NO: 1976380 - RNA, 15 nt, Shigella flexneri 2a str. 301
guuauacagaguguu

SEQ ID NO: 1976381 - RNA, 14 nt, Shigella flexneri 2a str. 301
guuauaccagucca

SEQ ID NO: 1976382 - RNA, 16 nt, Shigella flexneri 2a str. 301
guuauaucaauuauua

SEQ ID NO: 1976383 - RNA, 20 nt, Shigella flexneri 2a str. 301
guuaccccucuauccagcuc

SEQ ID NO: 1976384 - RNA, 21 nt, Shigella flexneri 2a str. 301
guuaccgacugcggccugagu

SEQ ID NO: 1976385 - RNA, 14 nt, Shigella flexneri 2a str. 301
guuaccgauuucac

SEQ ID NO: 1976386 - RNA, 15 nt, Shigella flexneri 2a str. 301
guuaccgaucgccag

SEQ ID NO: 1976387 - RNA, 15 nt, Shigella flexneri 2a str. 301
guuaccgcuauuugc

SEQ ID NO: 1976388 - RNA, 13 nt, Shigella flexneri 2a str. 301
guuacccagcacg

SEQ ID NO: 1976389 - RNA, 23 nt, Shigella flexneri 2a str. 301
guuagucaucaucaggaacaucc

SEQ ID NO: 1976390 - RNA, 17 nt, Shigella flexneri 2a str. 301
guuagucugcauuuucu

SEQ ID NO: 1976391 - RNA, 17 nt, Shigella flexneri 2a str. 301
guuagugucuuaucugg

SEQ ID NO: 1976392 - RNA, 20 nt, Shigella flexneri 2a str. 301
guuaguccacacgccaggcc

SEQ ID NO: 1976393 - RNA, 18 nt, Shigella flexneri 2a str. 301
guuagcggcgguaaaauc

SEQ ID NO: 1976394 - RNA, 19 nt, Shigella flexneri 2a str. 301
guuagcugcguacauugcc

SEQ ID NO: 1976395 - RNA, 22 nt, Shigella flexneri 2a str. 301
guuccgccagagcuucaaccgu

SEQ ID NO: 1976396 - RNA, 13 nt, Shigella flexneri 2a str. 301
guuccauucaaac

SEQ ID NO: 1976397 - RNA, 14 nt, Shigella flexneri 2a str. 301
guuccauucaaacg

SEQ ID NO: 1976398 - RNA, 23 nt, Shigella flexneri 2a str. 301
guuccauugggcuguuaucccag

SEQ ID NO: 1976399 - RNA, 14 nt, Shigella flexneri 2a str. 301
guucccaacaacag

SEQ ID NO: 1976400 - RNA, 14 nt, Shigella flexneri 2a str. 301
guuccagcaucucc

SEQ ID NO: 1976401 - RNA, 22 nt, Shigella flexneri 2a str. 301
guuccauaaucgccugaccgau

SEQ ID NO: 1976402 - RNA, 13 nt, Shigella flexneri 2a str. 301
guuccaucaccag

SEQ ID NO: 1976403 - RNA, 18 nt, Shigella flexneri 2a str. 301
guuccagggccuccugca

SEQ ID NO: 1976404 - RNA, 20 nt, Shigella flexneri 2a str. 301
guuccagggccuccugcagc

SEQ ID NO: 1976405 - RNA, 17 nt, Shigella flexneri 2a str. 301
guuccagugcguaccca

SEQ ID NO: 1976406 - RNA, 21 nt, Shigella flexneri 2a str. 301
guuccagugcguacccagcgu

SEQ ID NO: 1976407 - RNA, 16 nt, Shigella flexneri 2a str. 301
guucauccugcuggug

SEQ ID NO: 1976408 - RNA, 18 nt, Shigella flexneri 2a str. 301
guuccagaccauauuuuc

SEQ ID NO: 1976409 - RNA, 15 nt, Shigella flexneri 2a str. 301
guuccacucuuucag

SEQ ID NO: 1976410 - RNA, 20 nt, Shigella flexneri 2a str. 301
guuccacugguuucgaucug

SEQ ID NO: 1976411 - RNA, 14 nt, Shigella flexneri 2a str. 301
guucacgcagcuuc

SEQ ID NO: 1976412 - RNA, 22 nt, Shigella flexneri 2a str. 301
guucacgccaucaucggcaaac

SEQ ID NO: 1976413 - RNA, 16 nt, Shigella flexneri 2a str. 301
guucaccacgacuucu

SEQ ID NO: 1976414 - RNA, 15 nt, Shigella flexneri 2a str. 301
guucugaccggccag

SEQ ID NO: 1976415 - RNA, 14 nt, Shigella flexneri 2a str. 301
guucugaucuuucu

SEQ ID NO: 1976416 - RNA, 16 nt, Shigella flexneri 2a str. 301
guucugauaguuaaaa

SEQ ID NO: 1976417 - RNA, 14 nt, Shigella flexneri 2a str. 301
guucucuucugcuu

SEQ ID NO: 1976418 - RNA, 13 nt, Shigella flexneri 2a str. 301
guucucuuuaaaa

SEQ ID NO: 1976419 - RNA, 17 nt, Shigella flexneri 2a str. 301
guucugcccugaauggu

SEQ ID NO: 1976420 - RNA, 22 nt, Shigella flexneri 2a str. 301
guucugcggguuagucugcauu

SEQ ID NO: 1976421 - RNA, 18 nt, Shigella flexneri 2a str. 301
guucugcggcguaacgca

SEQ ID NO: 1976422 - RNA, 16 nt, Shigella flexneri 2a str. 301
guucugccuggcgcag

SEQ ID NO: 1976423 - RNA, 16 nt, Shigella flexneri 2a str. 301
guucugcgccaaacag

SEQ ID NO: 1976424 - RNA, 21 nt, Shigella flexneri 2a str. 301
guucucccauaggaugagguu

SEQ ID NO: 1976425 - RNA, 22 nt, Shigella flexneri 2a str. 301
guucuccuggcccggaauggug

SEQ ID NO: 1976426 - RNA, 23 nt, Shigella flexneri 2a str. 301
guucuccuggcccggaauggugc

SEQ ID NO: 1976427 - RNA, 20 nt, Shigella flexneri 2a str. 301
guucgguauuaaucugccag

SEQ ID NO: 1976428 - RNA, 13 nt, Shigella flexneri 2a str. 301
guucgagcaucac

SEQ ID NO: 1976429 - RNA, 15 nt, Shigella flexneri 2a str. 301
guucgagaaaaccga

SEQ ID NO: 1976430 - RNA, 17 nt, Shigella flexneri 2a str. 301
guuccuugcgcuuucuu

SEQ ID NO: 1976431 - RNA, 16 nt, Shigella flexneri 2a str. 301
guguggagugcagcau

SEQ ID NO: 1976432 - RNA, 14 nt, Shigella flexneri 2a str. 301
guguggccaguucc

SEQ ID NO: 1976433 - RNA, 23 nt, Shigella flexneri 2a str. 301
gugugcucaaucugauagugauc

SEQ ID NO: 1976434 - RNA, 17 nt, Shigella flexneri 2a str. 301
gugucguuacgccgcag

SEQ ID NO: 1976435 - RNA, 14 nt, Shigella flexneri 2a str. 301
guguccuguugaug

SEQ ID NO: 1976436 - RNA, 19 nt, Shigella flexneri 2a str. 301
guguccagcggcauaaaac

SEQ ID NO: 1976437 - RNA, 17 nt, Shigella flexneri 2a str. 301
guguaucuucagcugca

SEQ ID NO: 1976438 - RNA, 12 nt, Shigella flexneri 2a str. 301
guguaucuucau

SEQ ID NO: 1976439 - RNA, 23 nt, Shigella flexneri 2a str. 301
guguaguauuugaguucacugcc

SEQ ID NO: 1976440 - RNA, 16 nt, Shigella flexneri 2a str. 301
guguccagccagucca

SEQ ID NO: 1976441 - RNA, 18 nt, Shigella flexneri 2a str. 301
gugucaauucccgagcug

SEQ ID NO: 1976442 - RNA, 14 nt, Shigella flexneri 2a str. 301
guguuccucugcuc

SEQ ID NO: 1976443 - RNA, 18 nt, Shigella flexneri 2a str. 301
guguucaauaucgaaaug

SEQ ID NO: 1976444 - RNA, 16 nt, Shigella flexneri 2a str. 301
gugugggcacucgaag

SEQ ID NO: 1976445 - RNA, 19 nt, Shigella flexneri 2a str. 301
guguuuuuuuaugguagug

SEQ ID NO: 1976446 - RNA, 16 nt, Shigella flexneri 2a str. 301
guuaaaaacagccagc

SEQ ID NO: 1976447 - RNA, 17 nt, Shigella flexneri 2a str. 301
guuaaaaacagccagca

SEQ ID NO: 1976448 - RNA, 17 nt, Shigella flexneri 2a str. 301
guuaaaaacauuuucau

SEQ ID NO: 1976449 - RNA, 17 nt, Shigella flexneri 2a str. 301
guuaaaacgcacgcugu

SEQ ID NO: 1976450 - RNA, 12 nt, Shigella flexneri 2a str. 301
guuaacaacaac

SEQ ID NO: 1976451 - RNA, 18 nt, Shigella flexneri 2a str. 301
guuaaccccaguaauuca

SEQ ID NO: 1976452 - RNA, 23 nt, Shigella flexneri 2a str. 301
guuaaccggaggauaugcaucau

SEQ ID NO: 1976453 - RNA, 18 nt, Shigella flexneri 2a str. 301
guuaacgugucauaacug

SEQ ID NO: 1976454 - RNA, 15 nt, Shigella flexneri 2a str. 301
guuaacucccccuuu

SEQ ID NO: 1976455 - RNA, 19 nt, Shigella flexneri 2a str. 301
guuaauccacagcaaugca

SEQ ID NO: 1976456 - RNA, 17 nt, Shigella flexneri 2a str. 301
guuaagcccaguucagc

SEQ ID NO: 1976457 - RNA, 12 nt, Shigella flexneri 2a str. 301
guuaagaagauc

SEQ ID NO: 1976458 - RNA, 19 nt, Shigella flexneri 2a str. 301
guggagcaacacgccagcg

SEQ ID NO: 1976459 - RNA, 21 nt, Shigella flexneri 2a str. 301
guggacucuauggcuggcaau

SEQ ID NO: 1976460 - RNA, 14 nt, Shigella flexneri 2a str. 301
guggacuggcugcg

SEQ ID NO: 1976461 - RNA, 16 nt, Shigella flexneri 2a str. 301
guggcaaucguagccc

SEQ ID NO: 1976462 - RNA, 19 nt, Shigella flexneri 2a str. 301
guggcaaucguagcccagc

SEQ ID NO: 1976463 - RNA, 21 nt, Shigella flexneri 2a str. 301
guggcaauggcgacuucugcu

SEQ ID NO: 1976464 - RNA, 16 nt, Shigella flexneri 2a str. 301
guggauagacgcaggu

SEQ ID NO: 1976465 - RNA, 18 nt, Shigella flexneri 2a str. 301
guggaucaagcaacauaa

SEQ ID NO: 1976466 - RNA, 13 nt, Shigella flexneri 2a str. 301
guggcagggcagc

SEQ ID NO: 1976467 - RNA, 15 nt, Shigella flexneri 2a str. 301
guggcagggcagcga

SEQ ID NO: 1976468 - RNA, 12 nt, Shigella flexneri 2a str. 301
guggaaaccuug

SEQ ID NO: 1976469 - RNA, 23 nt, Shigella flexneri 2a str. 301
guggaauaugcgccacaccacug

SEQ ID NO: 1976470 - RNA, 19 nt, Shigella flexneri 2a str. 301
gugcgcaaacuucuucagu

SEQ ID NO: 1976471 - RNA, 18 nt, Shigella flexneri 2a str. 301
gugcgcaauacguugcaa

SEQ ID NO: 1976472 - RNA, 14 nt, Shigella flexneri 2a str. 301
gugcgccacagaca

SEQ ID NO: 1976473 - RNA, 13 nt, Shigella flexneri 2a str. 301
gugggcaggagaa

SEQ ID NO: 1976474 - RNA, 19 nt, Shigella flexneri 2a str. 301
gugguccacauccguccuc

SEQ ID NO: 1976475 - RNA, 20 nt, Shigella flexneri 2a str. 301
guggcguuugccaccugugc

SEQ ID NO: 1976476 - RNA, 15 nt, Shigella flexneri 2a str. 301
guggcguuuccagca

SEQ ID NO: 1976477 - RNA, 18 nt, Shigella flexneri 2a str. 301
gugggaauaaccauggca

SEQ ID NO: 1976478 - RNA, 13 nt, Shigella flexneri 2a str. 301
guaaucaccaccc

SEQ ID NO: 1976479 - RNA, 22 nt, Shigella flexneri 2a str. 301
guaaucacgaucucgccaguga

SEQ ID NO: 1976480 - RNA, 16 nt, Shigella flexneri 2a str. 301
guaauacggcucucac

SEQ ID NO: 1976481 - RNA, 17 nt, Shigella flexneri 2a str. 301
guaaucaacauauuccc

SEQ ID NO: 1976482 - RNA, 14 nt, Shigella flexneri 2a str. 301
guaaucauauuaaa

SEQ ID NO: 1976483 - RNA, 21 nt, Shigella flexneri 2a str. 301
guaauccucuuugcuuccuga

SEQ ID NO: 1976484 - RNA, 23 nt, Shigella flexneri 2a str. 301
guaauccucuuugcuuccugagu

SEQ ID NO: 1976485 - RNA, 23 nt, Shigella flexneri 2a str. 301
guaauccgggugaacugccacac

SEQ ID NO: 1976486 - RNA, 18 nt, Shigella flexneri 2a str. 301
guaauacaaccugcugga

SEQ ID NO: 1976487 - RNA, 13 nt, Shigella flexneri 2a str. 301
guaaaaggagaua

SEQ ID NO: 1976488 - RNA, 20 nt, Shigella flexneri 2a str. 301
guaauuggccugacagguga

SEQ ID NO: 1976489 - RNA, 17 nt, Shigella flexneri 2a str. 301
guaauuaguggcuaacc

SEQ ID NO: 1976490 - RNA, 14 nt, Shigella flexneri 2a str. 301
guaauucaguaacg

SEQ ID NO: 1976491 - RNA, 23 nt, Shigella flexneri 2a str. 301
guaaugcggucguaaucgcccgc

SEQ ID NO: 1976492 - RNA, 21 nt, Shigella flexneri 2a str. 301
guaaugaacuccggagaguau

SEQ ID NO: 1976493 - RNA, 19 nt, Shigella flexneri 2a str. 301
guaaugacuccaacuuacu

SEQ ID NO: 1976494 - RNA, 14 nt, Shigella flexneri 2a str. 301
guacaccaacauca

SEQ ID NO: 1976495 - RNA, 11 nt, Shigella flexneri 2a str. 301
guacaccaaca

SEQ ID NO: 1976496 - RNA, 17 nt, Shigella flexneri 2a str. 301
guacacaacaugcagcc

SEQ ID NO: 1976497 - RNA, 18 nt, Shigella flexneri 2a str. 301
guacaaccgcaaagguug

SEQ ID NO: 1976498 - RNA, 13 nt, Shigella flexneri 2a str. 301
guacaacuuucuc

SEQ ID NO: 1976499 - RNA, 17 nt, Shigella flexneri 2a str. 301
guacaaagccaacagca

SEQ ID NO: 1976500 - RNA, 21 nt, Shigella flexneri 2a str. 301
guacaaaauuagaaagggaag

SEQ ID NO: 1976501 - RNA, 23 nt, Shigella flexneri 2a str. 301
guaauuugccguuaaucccagac

SEQ ID NO: 1976502 - RNA, 11 nt, Shigella flexneri 2a str. 301
guaauuucaau

SEQ ID NO: 1976503 - RNA, 19 nt, Shigella flexneri 2a str. 301
guaauuuaacaacucacca

SEQ ID NO: 1976504 - RNA, 18 nt, Shigella flexneri 2a str. 301
guacaggauauauuucau

SEQ ID NO: 1976505 - RNA, 16 nt, Shigella flexneri 2a str. 301
guacaggcagcuuaga

SEQ ID NO: 1976506 - RNA, 14 nt, Shigella flexneri 2a str. 301
guacagccgccaga

SEQ ID NO: 1976507 - RNA, 15 nt, Shigella flexneri 2a str. 301
guacagccgccagac

SEQ ID NO: 1976508 - RNA, 20 nt, Shigella flexneri 2a str. 301
guacauagccaucugccuga

SEQ ID NO: 1976509 - RNA, 18 nt, Shigella flexneri 2a str. 301
guacagagggcaggcaac

SEQ ID NO: 1976510 - RNA, 12 nt, Shigella flexneri 2a str. 301
guacagaaucug

SEQ ID NO: 1976511 - RNA, 16 nt, Shigella flexneri 2a str. 301
guacagagcaauaaaa

SEQ ID NO: 1976512 - RNA, 18 nt, Shigella flexneri 2a str. 301
guacagcauaaggcacac

SEQ ID NO: 1976513 - RNA, 15 nt, Shigella flexneri 2a str. 301
guacacuuuccuggu

SEQ ID NO: 1976514 - RNA, 15 nt, Shigella flexneri 2a str. 301
guacaccaacaucac

SEQ ID NO: 1976515 - RNA, 22 nt, Shigella flexneri 2a str. 301
guacucggcuacgaaccgagcg

SEQ ID NO: 1976516 - RNA, 21 nt, Shigella flexneri 2a str. 301
guacgcggcaauccccgccag

SEQ ID NO: 1976517 - RNA, 19 nt, Shigella flexneri 2a str. 301
guacgccuucaugugcggg

SEQ ID NO: 1976518 - RNA, 17 nt, Shigella flexneri 2a str. 301
guacgcgccccacugga

SEQ ID NO: 1976519 - RNA, 14 nt, Shigella flexneri 2a str. 301
guacgccaaucugc

SEQ ID NO: 1976520 - RNA, 12 nt, Shigella flexneri 2a str. 301
guacuuucaaca

SEQ ID NO: 1976521 - RNA, 19 nt, Shigella flexneri 2a str. 301
guacuuuuacugucugcuc

SEQ ID NO: 1976522 - RNA, 16 nt, Shigella flexneri 2a str. 301
guacuuuugaaugagu

SEQ ID NO: 1976523 - RNA, 24 nt, Shigella flexneri 2a str. 301
guacugaccgucgccuucaacgua

SEQ ID NO: 1976524 - RNA, 21 nt, Shigella flexneri 2a str. 301
guacugacggcguucuuuaca

SEQ ID NO: 1976525 - RNA, 12 nt, Shigella flexneri 2a str. 301
guacugagagau

SEQ ID NO: 1976526 - RNA, 12 nt, Shigella flexneri 2a str. 301
guacugaugaau

SEQ ID NO: 1976527 - RNA, 13 nt, Shigella flexneri 2a str. 301
guacugcauaaag

SEQ ID NO: 1976528 - RNA, 16 nt, Shigella flexneri 2a str. 301
guacgauacagaagca

SEQ ID NO: 1976529 - RNA, 20 nt, Shigella flexneri 2a str. 301
guacgauuuaaagcggccag

SEQ ID NO: 1976530 - RNA, 19 nt, Shigella flexneri 2a str. 301
guaccugugaagugaaaaa

SEQ ID NO: 1976531 - RNA, 11 nt, Shigella flexneri 2a str. 301
guaccaccgga

SEQ ID NO: 1976532 - RNA, 21 nt, Shigella flexneri 2a str. 301
guaccacgcacagcccgccgc

SEQ ID NO: 1976533 - RNA, 19 nt, Shigella flexneri 2a str. 301
guacaucaauaccauuauc

SEQ ID NO: 1976534 - RNA, 17 nt, Shigella flexneri 2a str. 301
guaccagacgcgggcaa

SEQ ID NO: 1976535 - RNA, 20 nt, Shigella flexneri 2a str. 301
guaccagaccaacauaguua

SEQ ID NO: 1976536 - RNA, 12 nt, Shigella flexneri 2a str. 301
guaccagcagcg

SEQ ID NO: 1976537 - RNA, 16 nt, Shigella flexneri 2a str. 301
guagaaauuauuucuu

SEQ ID NO: 1976538 - RNA, 19 nt, Shigella flexneri 2a str. 301
guagauugcacuugcuuaa

SEQ ID NO: 1976539 - RNA, 18 nt, Shigella flexneri 2a str. 301
guagauggggccaugauu

SEQ ID NO: 1976540 - RNA, 22 nt, Shigella flexneri 2a str. 301
guagcagguaaucugccauauu

SEQ ID NO: 1976541 - RNA, 15 nt, Shigella flexneri 2a str. 301
guagcagcuuucagc

SEQ ID NO: 1976542 - RNA, 18 nt, Shigella flexneri 2a str. 301
guagcacgucaucugcac

SEQ ID NO: 1976543 - RNA, 13 nt, Shigella flexneri 2a str. 301
guagcaugaacca

SEQ ID NO: 1976544 - RNA, 17 nt, Shigella flexneri 2a str. 301
guagccauuugauucac

SEQ ID NO: 1976545 - RNA, 23 nt, Shigella flexneri 2a str. 301
guagccauuugauucacaaggcc

SEQ ID NO: 1976546 - RNA, 20 nt, Shigella flexneri 2a str. 301
guagccaugaugaacaaccc

SEQ ID NO: 1976547 - RNA, 21 nt, Shigella flexneri 2a str. 301
guagccccaauguucguccau

SEQ ID NO: 1976548 - RNA, 18 nt, Shigella flexneri 2a str. 301
guagccccagucuuccug

SEQ ID NO: 1976549 - RNA, 13 nt, Shigella flexneri 2a str. 301
guaucaaacacag

SEQ ID NO: 1976550 - RNA, 22 nt, Shigella flexneri 2a str. 301
guaucaacaauaaaaccaguaa

SEQ ID NO: 1976551 - RNA, 11 nt, Shigella flexneri 2a str. 301
guaucaaagcg

SEQ ID NO: 1976552 - RNA, 22 nt, Shigella flexneri 2a str. 301
guaucaugcaguaccagauaau

SEQ ID NO: 1976553 - RNA, 22 nt, Shigella flexneri 2a str. 301
guaucaucauuauuaauauuca

SEQ ID NO: 1976554 - RNA, 16 nt, Shigella flexneri 2a str. 301
guaucaccccgcccga

SEQ ID NO: 1976555 - RNA, 19 nt, Shigella flexneri 2a str. 301
guaucagcgucauuaccca

SEQ ID NO: 1976556 - RNA, 22 nt, Shigella flexneri 2a str. 301
guaucccagaucgcuuucccag

SEQ ID NO: 1976557 - RNA, 20 nt, Shigella flexneri 2a str. 301
guaucccaguucgauuuccc

SEQ ID NO: 1976558 - RNA, 21 nt, Shigella flexneri 2a str. 301
guauccuguuuuuaagugaug

SEQ ID NO: 1976559 - RNA, 17 nt, Shigella flexneri 2a str. 301
guauccugucauacgcg

SEQ ID NO: 1976560 - RNA, 19 nt, Shigella flexneri 2a str. 301
guauccgggcauccaggcc

SEQ ID NO: 1976561 - RNA, 23 nt, Shigella flexneri 2a str. 301
guauuaaucugccagcguaaauc

SEQ ID NO: 1976562 - RNA, 12 nt, Shigella flexneri 2a str. 301
guauuacagagg

SEQ ID NO: 1976563 - RNA, 17 nt, Shigella flexneri 2a str. 301
guaugguuacugucguu

SEQ ID NO: 1976564 - RNA, 18 nt, Shigella flexneri 2a str. 301
guaugccuggcauuucug

SEQ ID NO: 1976565 - RNA, 14 nt, Shigella flexneri 2a str. 301
guaugccucuuuca

SEQ ID NO: 1976566 - RNA, 12 nt, Shigella flexneri 2a str. 301
guaugccuggca

SEQ ID NO: 1976567 - RNA, 17 nt, Shigella flexneri 2a str. 301
guaugcagccaggccau

SEQ ID NO: 1976568 - RNA, 19 nt, Shigella flexneri 2a str. 301
guauggagcaggaauauac

SEQ ID NO: 1976569 - RNA, 18 nt, Shigella flexneri 2a str. 301
guauggaucccucuuucu

SEQ ID NO: 1976570 - RNA, 16 nt, Shigella flexneri 2a str. 301
guauggaaaucaccca

SEQ ID NO: 1976571 - RNA, 20 nt, Shigella flexneri 2a str. 301
guaugcgccacaggucagca

SEQ ID NO: 1976572 - RNA, 21 nt, Shigella flexneri 2a str. 301
guaugcgucagcaacaugccg

SEQ ID NO: 1976573 - RNA, 18 nt, Shigella flexneri 2a str. 301
guaucuaccacugccuga

SEQ ID NO: 1976574 - RNA, 16 nt, Shigella flexneri 2a str. 301
guaucgggcaguuuac

SEQ ID NO: 1976575 - RNA, 15 nt, Shigella flexneri 2a str. 301
guaucguggcgcagc

SEQ ID NO: 1976576 - RNA, 15 nt, Shigella flexneri 2a str. 301
guaucgcugaaagau

SEQ ID NO: 1976577 - RNA, 17 nt, Shigella flexneri 2a str. 301
guaucgaguggcgcagu

SEQ ID NO: 1976578 - RNA, 14 nt, Shigella flexneri 2a str. 301
guauccuguuuuua

SEQ ID NO: 1976579 - RNA, 19 nt, Shigella flexneri 2a str. 301
guaucgcgaaaaaaaagau

SEQ ID NO: 1976580 - RNA, 12 nt, Shigella flexneri 2a str. 301
guaucuauucau

SEQ ID NO: 1976581 - RNA, 12 nt, Shigella flexneri 2a str. 301
guaucuauucac

SEQ ID NO: 1976582 - RNA, 12 nt, Shigella flexneri 2a str. 301
guaucugcagau

SEQ ID NO: 1976583 - RNA, 15 nt, Shigella flexneri 2a str. 301
guaucugaaucaaaa

SEQ ID NO: 1976584 - RNA, 18 nt, Shigella flexneri 2a str. 301
guaucugaaucaaaauca

SEQ ID NO: 1976585 - RNA, 19 nt, Shigella flexneri 2a str. 301
guaucuucccagccaaugc

SEQ ID NO: 1976586 - RNA, 17 nt, Shigella flexneri 2a str. 301
guaucuucaugcuccag

SEQ ID NO: 1976587 - RNA, 16 nt, Shigella flexneri 2a str. 301
guaucuggcaagcagg

SEQ ID NO: 1976588 - RNA, 13 nt, Shigella flexneri 2a str. 301
guaugaauuugca

SEQ ID NO: 1976589 - RNA, 17 nt, Shigella flexneri 2a str. 301
guaugacaacuuucauc

SEQ ID NO: 1976590 - RNA, 16 nt, Shigella flexneri 2a str. 301
guaucuuuauaaccac

SEQ ID NO: 1976591 - RNA, 23 nt, Shigella flexneri 2a str. 301
gucaaaugaccgggcuuuccgcu

SEQ ID NO: 1976592 - RNA, 21 nt, Shigella flexneri 2a str. 301
gucaaaguaaccuuugaacaa

SEQ ID NO: 1976593 - RNA, 14 nt, Shigella flexneri 2a str. 301
gucacagaagagag

SEQ ID NO: 1976594 - RNA, 16 nt, Shigella flexneri 2a str. 301
gucacaccuuauuuac

SEQ ID NO: 1976595 - RNA, 16 nt, Shigella flexneri 2a str. 301
gucacaggccaucaca

SEQ ID NO: 1976596 - RNA, 23 nt, Shigella flexneri 2a str. 301
gucaauauuaucgauuuucugcu

SEQ ID NO: 1976597 - RNA, 22 nt, Shigella flexneri 2a str. 301
gucaauacuuucacaaaaauaa

SEQ ID NO: 1976598 - RNA, 16 nt, Shigella flexneri 2a str. 301
gucaccacauccagcu

SEQ ID NO: 1976599 - RNA, 22 nt, Shigella flexneri 2a str. 301
gucaccacggccagguuaacca

SEQ ID NO: 1976600 - RNA, 15 nt, Shigella flexneri 2a str. 301
gucaccacccugccc

SEQ ID NO: 1976601 - RNA, 17 nt, Shigella flexneri 2a str. 301
gucaccagcaucaacaa

SEQ ID NO: 1976602 - RNA, 12 nt, Shigella flexneri 2a str. 301
gucacaucuucc

SEQ ID NO: 1976603 - RNA, 15 nt, Shigella flexneri 2a str. 301
gucacaucaggccau

SEQ ID NO: 1976604 - RNA, 16 nt, Shigella flexneri 2a str. 301
gucacaucaggccauc

SEQ ID NO: 1976605 - RNA, 16 nt, Shigella flexneri 2a str. 301
gucaccuucuggcgac

SEQ ID NO: 1976606 - RNA, 17 nt, Shigella flexneri 2a str. 301
gucaccuucuggcgacc

SEQ ID NO: 1976607 - RNA, 15 nt, Shigella flexneri 2a str. 301
gucacccaacaugcc

SEQ ID NO: 1976608 - RNA, 17 nt, Shigella flexneri 2a str. 301
guauuaucgauaaacgc

SEQ ID NO: 1976609 - RNA, 14 nt, Shigella flexneri 2a str. 301
guauucaaccguuu

SEQ ID NO: 1976610 - RNA, 19 nt, Shigella flexneri 2a str. 301
guauucaaccguuuccagu

SEQ ID NO: 1976611 - RNA, 14 nt, Shigella flexneri 2a str. 301
guauuauauauaau

SEQ ID NO: 1976612 - RNA, 18 nt, Shigella flexneri 2a str. 301
guauuagaugcuaguuau

SEQ ID NO: 1976613 - RNA, 15 nt, Shigella flexneri 2a str. 301
guauuacuccagaua

SEQ ID NO: 1976614 - RNA, 14 nt, Shigella flexneri 2a str. 301
guauucauugccug

SEQ ID NO: 1976615 - RNA, 17 nt, Shigella flexneri 2a str. 301
guauucaugcccugccc

SEQ ID NO: 1976616 - RNA, 15 nt, Shigella flexneri 2a str. 301
guauucagcaauucu

SEQ ID NO: 1976617 - RNA, 17 nt, Shigella flexneri 2a str. 301
guauugccaugcacgca

SEQ ID NO: 1976618 - RNA, 21 nt, Shigella flexneri 2a str. 301
guauugcucaacuucgcuaaa

SEQ ID NO: 1976619 - RNA, 19 nt, Shigella flexneri 2a str. 301
guauugcugguauaaaaua

SEQ ID NO: 1976620 - RNA, 22 nt, Shigella flexneri 2a str. 301
guauuggaagguuaauaaauau

SEQ ID NO: 1976621 - RNA, 15 nt, Shigella flexneri 2a str. 301
guauuguuaaauauu

SEQ ID NO: 1976622 - RNA, 16 nt, Shigella flexneri 2a str. 301
guauuugauauuuauu

SEQ ID NO: 1976623 - RNA, 21 nt, Shigella flexneri 2a str. 301
guauuuauuuuccaaaauaaa

SEQ ID NO: 1976624 - RNA, 11 nt, Shigella flexneri 2a str. 301
guauuuccagg

SEQ ID NO: 1976625 - RNA, 12 nt, Shigella flexneri 2a str. 301
guauuuccaggg

SEQ ID NO: 1976626 - RNA, 23 nt, Shigella flexneri 2a str. 301
guauuuugucagcccuuuuggca

SEQ ID NO: 1976627 - RNA, 12 nt, Shigella flexneri 2a str. 301
guauuuuuauug

SEQ ID NO: 1976628 - RNA, 21 nt, Shigella flexneri 2a str. 301
gucaucggaucauuagucaca

SEQ ID NO: 1976629 - RNA, 15 nt, Shigella flexneri 2a str. 301
gucauggcugacugu

SEQ ID NO: 1976630 - RNA, 15 nt, Shigella flexneri 2a str. 301
gucaugguaaugauc

SEQ ID NO: 1976631 - RNA, 22 nt, Shigella flexneri 2a str. 301
gucauggcauuaauaugcucaa

SEQ ID NO: 1976632 - RNA, 14 nt, Shigella flexneri 2a str. 301
gucaucgacaucaa

SEQ ID NO: 1976633 - RNA, 22 nt, Shigella flexneri 2a str. 301
gucauccguggcgacagaggug

SEQ ID NO: 1976634 - RNA, 17 nt, Shigella flexneri 2a str. 301
gucaucgaugagaugac

SEQ ID NO: 1976635 - RNA, 20 nt, Shigella flexneri 2a str. 301
gucauccggcacgcuaccau

SEQ ID NO: 1976636 - RNA, 14 nt, Shigella flexneri 2a str. 301
gucauccagcagcg

SEQ ID NO: 1976637 - RNA, 14 nt, Shigella flexneri 2a str. 301
gucauccagcacuu

SEQ ID NO: 1976638 - RNA, 20 nt, Shigella flexneri 2a str. 301
gucaucagcgccaacccgcu

SEQ ID NO: 1976639 - RNA, 22 nt, Shigella flexneri 2a str. 301
gucauccauaccacgaccucaa

SEQ ID NO: 1976640 - RNA, 12 nt, Shigella flexneri 2a str. 301
gucauccauacc

SEQ ID NO: 1976641 - RNA, 13 nt, Shigella flexneri 2a str. 301
gucauccauacca

SEQ ID NO: 1976642 - RNA, 16 nt, Shigella flexneri 2a str. 301
gucauccaggaacucc

SEQ ID NO: 1976643 - RNA, 14 nt, Shigella flexneri 2a str. 301
gucauccaggaacu

SEQ ID NO: 1976644 - RNA, 23 nt, Shigella flexneri 2a str. 301
gucauccaaaucgcccagcaaau

SEQ ID NO: 1976645 - RNA, 18 nt, Shigella flexneri 2a str. 301
gucaucauagacuucccu

SEQ ID NO: 1976646 - RNA, 14 nt, Shigella flexneri 2a str. 301
gucaucaguuucaa

SEQ ID NO: 1976647 - RNA, 21 nt, Shigella flexneri 2a str. 301
gucaucaccggcuucucgccu

SEQ ID NO: 1976648 - RNA, 13 nt, Shigella flexneri 2a str. 301
gucaucaaaauca

SEQ ID NO: 1976649 - RNA, 22 nt, Shigella flexneri 2a str. 301
gucaucaaacggcauaugccau

SEQ ID NO: 1976650 - RNA, 21 nt, Shigella flexneri 2a str. 301
gucauauagccgcgcaguuuc

SEQ ID NO: 1976651 - RNA, 16 nt, Shigella flexneri 2a str. 301
guccaccgcgaugcug

SEQ ID NO: 1976652 - RNA, 15 nt, Shigella flexneri 2a str. 301
guccaccccagcaga

SEQ ID NO: 1976653 - RNA, 14 nt, Shigella flexneri 2a str. 301
guccacgccgccga

SEQ ID NO: 1976654 - RNA, 22 nt, Shigella flexneri 2a str. 301
guccaguuugccuucacaggcc

SEQ ID NO: 1976655 - RNA, 18 nt, Shigella flexneri 2a str. 301
guccaguucccaaccauu

SEQ ID NO: 1976656 - RNA, 21 nt, Shigella flexneri 2a str. 301
guccaugcugucggcugccag

SEQ ID NO: 1976657 - RNA, 15 nt, Shigella flexneri 2a str. 301
guccauggugucuga

SEQ ID NO: 1976658 - RNA, 21 nt, Shigella flexneri 2a str. 301
guccagucgcaaaccuggcau

SEQ ID NO: 1976659 - RNA, 18 nt, Shigella flexneri 2a str. 301
guccaggacaagcgggug

SEQ ID NO: 1976660 - RNA, 18 nt, Shigella flexneri 2a str. 301
guccagcuccguccagcc

SEQ ID NO: 1976661 - RNA, 12 nt, Shigella flexneri 2a str. 301
guccagcgccug

SEQ ID NO: 1976662 - RNA, 12 nt, Shigella flexneri 2a str. 301
gucgacacagau

SEQ ID NO: 1976663 - RNA, 21 nt, Shigella flexneri 2a str. 301
gucgagauacacggugcucca

SEQ ID NO: 1976664 - RNA, 17 nt, Shigella flexneri 2a str. 301
gucgacuucagauaaau

SEQ ID NO: 1976665 - RNA, 15 nt, Shigella flexneri 2a str. 301
gucgaacauacacaa

SEQ ID NO: 1976666 - RNA, 20 nt, Shigella flexneri 2a str. 301
gucgaacucauacaccagcg

SEQ ID NO: 1976667 - RNA, 17 nt, Shigella flexneri 2a str. 301
guccucgccguuuucug

SEQ ID NO: 1976668 - RNA, 22 nt, Shigella flexneri 2a str. 301
gucccggcaagauuccagugcc

SEQ ID NO: 1976669 - RNA, 22 nt, Shigella flexneri 2a str. 301
gucccaaccuuguuucugagca

SEQ ID NO: 1976670 - RNA, 11 nt, Shigella flexneri 2a str. 301
gucccucccug

SEQ ID NO: 1976671 - RNA, 15 nt, Shigella flexneri 2a str. 301
gucccguacccagca

SEQ ID NO: 1976672 - RNA, 12 nt, Shigella flexneri 2a str. 301
gucccuuucagg

SEQ ID NO: 1976673 - RNA, 14 nt, Shigella flexneri 2a str. 301
guccgccguagccg

SEQ ID NO: 1976674 - RNA, 22 nt, Shigella flexneri 2a str. 301
guccguacccgguugacugcug

SEQ ID NO: 1976675 - RNA, 13 nt, Shigella flexneri 2a str. 301
guccgugaagaaa

SEQ ID NO: 1976676 - RNA, 15 nt, Shigella flexneri 2a str. 301
guccgggcaucagca

SEQ ID NO: 1976677 - RNA, 22 nt, Shigella flexneri 2a str. 301
gucgaugaugcagccagugauu

SEQ ID NO: 1976678 - RNA, 15 nt, Shigella flexneri 2a str. 301
gucggauaagacgcc

SEQ ID NO: 1976679 - RNA, 13 nt, Shigella flexneri 2a str. 301
gucggcagauaac

SEQ ID NO: 1976680 - RNA, 16 nt, Shigella flexneri 2a str. 301
gucggaaccacaacuc

SEQ ID NO: 1976681 - RNA, 11 nt, Shigella flexneri 2a str. 301
gucgcuuugac

SEQ ID NO: 1976682 - RNA, 18 nt, Shigella flexneri 2a str. 301
gucgcuccugccacauau

SEQ ID NO: 1976683 - RNA, 22 nt, Shigella flexneri 2a str. 301
gucgcugaaaggauuucgcaac

SEQ ID NO: 1976684 - RNA, 22 nt, Shigella flexneri 2a str. 301
gucgcgguugcugucggcggcg

SEQ ID NO: 1976685 - RNA, 24 nt, Shigella flexneri 2a str. 301
gucgggcuuuuggagaucacgcca

SEQ ID NO: 1976686 - RNA, 21 nt, Shigella flexneri 2a str. 301
gucgggugcgacaggagccgc

SEQ ID NO: 1976687 - RNA, 14 nt, Shigella flexneri 2a str. 301
gucggcuuucucau

SEQ ID NO: 1976688 - RNA, 18 nt, Shigella flexneri 2a str. 301
gucggcgucagcgccauc

SEQ ID NO: 1976689 - RNA, 16 nt, Shigella flexneri 2a str. 301
gucggcauuaaccagu

SEQ ID NO: 1976690 - RNA, 21 nt, Shigella flexneri 2a str. 301
gucgucugucgggaacacuuu

SEQ ID NO: 1976691 - RNA, 13 nt, Shigella flexneri 2a str. 301
gucguuauauaaa

SEQ ID NO: 1976692 - RNA, 22 nt, Shigella flexneri 2a str. 301
gucguccgguacgacaaucuca

SEQ ID NO: 1976693 - RNA, 15 nt, Shigella flexneri 2a str. 301
gucguccggcagcag

SEQ ID NO: 1976694 - RNA, 20 nt, Shigella flexneri 2a str. 301
gucguccggcagcagaaagc

SEQ ID NO: 1976695 - RNA, 19 nt, Shigella flexneri 2a str. 301
gucguaaacaacuggcgcu

SEQ ID NO: 1976696 - RNA, 15 nt, Shigella flexneri 2a str. 301
gucguaaacaacugg

SEQ ID NO: 1976697 - RNA, 21 nt, Shigella flexneri 2a str. 301
gucguauucucaauaaaagga

SEQ ID NO: 1976698 - RNA, 18 nt, Shigella flexneri 2a str. 301
gucguauuucagccccag

SEQ ID NO: 1976699 - RNA, 20 nt, Shigella flexneri 2a str. 301
gucgucagcaguucacgcag

SEQ ID NO: 1976700 - RNA, 20 nt, Shigella flexneri 2a str. 301
gucgguaauuucacaaguug

SEQ ID NO: 1976701 - RNA, 17 nt, Shigella flexneri 2a str. 301
gucgguguccacuuccg

SEQ ID NO: 1976702 - RNA, 19 nt, Shigella flexneri 2a str. 301
gucucaauuaguaaugaua

SEQ ID NO: 1976703 - RNA, 15 nt, Shigella flexneri 2a str. 301
gucucagauucagau

SEQ ID NO: 1976704 - RNA, 19 nt, Shigella flexneri 2a str. 301
gucucagcaccgucuggca

SEQ ID NO: 1976705 - RNA, 15 nt, Shigella flexneri 2a str. 301
gucucagcuucagau

SEQ ID NO: 1976706 - RNA, 12 nt, Shigella flexneri 2a str. 301
gucucaucuuua

SEQ ID NO: 1976707 - RNA, 23 nt, Shigella flexneri 2a str. 301
gucuccgcugagacgcgcuugca

SEQ ID NO: 1976708 - RNA, 15 nt, Shigella flexneri 2a str. 301
gucuccgguccaguc

SEQ ID NO: 1976709 - RNA, 18 nt, Shigella flexneri 2a str. 301
gucuccaccuuaucgaca

SEQ ID NO: 1976710 - RNA, 15 nt, Shigella flexneri 2a str. 301
gucguucaggcgcug

SEQ ID NO: 1976711 - RNA, 15 nt, Shigella flexneri 2a str. 301
gucuaaauuuugcau

SEQ ID NO: 1976712 - RNA, 16 nt, Shigella flexneri 2a str. 301
gucuaguaaagcagac

SEQ ID NO: 1976713 - RNA, 17 nt, Shigella flexneri 2a str. 301
gucuaccagcaccugcu

SEQ ID NO: 1976714 - RNA, 15 nt, Shigella flexneri 2a str. 301
gucuacaaaaacugc

SEQ ID NO: 1976715 - RNA, 16 nt, Shigella flexneri 2a str. 301
gucuacaaaaacugcc

SEQ ID NO: 1976716 - RNA, 12 nt, Shigella flexneri 2a str. 301
gggaccagcauu

SEQ ID NO: 1976717 - RNA, 18 nt, Shigella flexneri 2a str. 301
gggaauucgaagcuguag

SEQ ID NO: 1976718 - RNA, 17 nt, Shigella flexneri 2a str. 301
gggaauugugcuuucag

SEQ ID NO: 1976719 - RNA, 17 nt, Shigella flexneri 2a str. 301
gggacuuuucaggcuag

SEQ ID NO: 1976720 - RNA, 15 nt, Shigella flexneri 2a str. 301
gggacgcagacugga

SEQ ID NO: 1976721 - RNA, 21 nt, Shigella flexneri 2a str. 301
ggcuuuguuacccccauccac

SEQ ID NO: 1976722 - RNA, 23 nt, Shigella flexneri 2a str. 301
ggcuuucuucuggguugccugau

SEQ ID NO: 1976723 - RNA, 14 nt, Shigella flexneri 2a str. 301
gggaacuuaucauc

SEQ ID NO: 1976724 - RNA, 15 nt, Shigella flexneri 2a str. 301
gggaagggagcgccg

SEQ ID NO: 1976725 - RNA, 22 nt, Shigella flexneri 2a str. 301
gggaaggcccuuucccuucucg

SEQ ID NO: 1976726 - RNA, 12 nt, Shigella flexneri 2a str. 301
gggaagcggggc

SEQ ID NO: 1976727 - RNA, 19 nt, Shigella flexneri 2a str. 301
gggaagggucuuuuaaauc

SEQ ID NO: 1976728 - RNA, 22 nt, Shigella flexneri 2a str. 301
gggaauagcguuaauggcagau

SEQ ID NO: 1976729 - RNA, 14 nt, Shigella flexneri 2a str. 301
gggaauccagcaau

SEQ ID NO: 1976730 - RNA, 16 nt, Shigella flexneri 2a str. 301
ggcugucauccagcag

SEQ ID NO: 1976731 - RNA, 22 nt, Shigella flexneri 2a str. 301
ggcuucaucuuuccaaaccuca

SEQ ID NO: 1976732 - RNA, 22 nt, Shigella flexneri 2a str. 301
ggcuucauccagcagugacuca

SEQ ID NO: 1976733 - RNA, 23 nt, Shigella flexneri 2a str. 301
ggcuucaucccgguuauuaaaac

SEQ ID NO: 1976734 - RNA, 14 nt, Shigella flexneri 2a str. 301
ggcuucugccuuau

SEQ ID NO: 1976735 - RNA, 22 nt, Shigella flexneri 2a str. 301
ggcuucaaucaauaacagcgca

SEQ ID NO: 1976736 - RNA, 15 nt, Shigella flexneri 2a str. 301
ggcuuauccggcaug

SEQ ID NO: 1976737 - RNA, 15 nt, Shigella flexneri 2a str. 301
ggcuuuaucacugag

SEQ ID NO: 1976738 - RNA, 20 nt, Shigella flexneri 2a str. 301
ggcuugcugaugcacgcaga

SEQ ID NO: 1976739 - RNA, 22 nt, Shigella flexneri 2a str. 301
ggcuuucaucacuugauccaua

SEQ ID NO: 1976740 - RNA, 12 nt, Shigella flexneri 2a str. 301
gggccagcggcu

SEQ ID NO: 1976741 - RNA, 18 nt, Shigella flexneri 2a str. 301
gggccgaacaucagauaa

SEQ ID NO: 1976742 - RNA, 20 nt, Shigella flexneri 2a str. 301
gggccgaacaucagauaauc

SEQ ID NO: 1976743 - RNA, 21 nt, Shigella flexneri 2a str. 301
gggcaagcgccuaaauccacc

SEQ ID NO: 1976744 - RNA, 21 nt, Shigella flexneri 2a str. 301
gggcaaauucuucacggaaaa

SEQ ID NO: 1976745 - RNA, 22 nt, Shigella flexneri 2a str. 301
gggcagacgccacaaucucacc

SEQ ID NO: 1976746 - RNA, 17 nt, Shigella flexneri 2a str. 301
gggagaccucacugaaa

SEQ ID NO: 1976747 - RNA, 14 nt, Shigella flexneri 2a str. 301
gggagagggccggg

SEQ ID NO: 1976748 - RNA, 14 nt, Shigella flexneri 2a str. 301
gggagcaggccggg

SEQ ID NO: 1976749 - RNA, 19 nt, Shigella flexneri 2a str. 301
gggaucaccuguucguccc

SEQ ID NO: 1976750 - RNA, 17 nt, Shigella flexneri 2a str. 301
gggauccaguccccccc

SEQ ID NO: 1976751 - RNA, 19 nt, Shigella flexneri 2a str. 301
gggauuaaagcgcuccaga

SEQ ID NO: 1976752 - RNA, 17 nt, Shigella flexneri 2a str. 301
gggauuauugccgcagc

SEQ ID NO: 1976753 - RNA, 20 nt, Shigella flexneri 2a str. 301
ggggucagggcuucaaaguu

SEQ ID NO: 1976754 - RNA, 13 nt, Shigella flexneri 2a str. 301
ggggucagcaggu

SEQ ID NO: 1976755 - RNA, 19 nt, Shigella flexneri 2a str. 301
gggguaucuuugacuacga

SEQ ID NO: 1976756 - RNA, 23 nt, Shigella flexneri 2a str. 301
ggggguucaaguccccccccucg

SEQ ID NO: 1976757 - RNA, 18 nt, Shigella flexneri 2a str. 301
ggggguucaagucccccc

SEQ ID NO: 1976758 - RNA, 20 nt, Shigella flexneri 2a str. 301
gggggcuaaucuugaaacca

SEQ ID NO: 1976759 - RNA, 18 nt, Shigella flexneri 2a str. 301
gggggauccagucccccc

SEQ ID NO: 1976760 - RNA, 14 nt, Shigella flexneri 2a str. 301
ggggcuucuuccgg

SEQ ID NO: 1976761 - RNA, 21 nt, Shigella flexneri 2a str. 301
ggggcuuucccguuucagccc

SEQ ID NO: 1976762 - RNA, 23 nt, Shigella flexneri 2a str. 301
gggugcaaucaacaccacugcca

SEQ ID NO: 1976763 - RNA, 15 nt, Shigella flexneri 2a str. 301
gggugcaaucaacac

SEQ ID NO: 1976764 - RNA, 14 nt, Shigella flexneri 2a str. 301
gggucaggccagga

SEQ ID NO: 1976765 - RNA, 17 nt, Shigella flexneri 2a str. 301
gggucgccagaagguga

SEQ ID NO: 1976766 - RNA, 14 nt, Shigella flexneri 2a str. 301
ggguaagggaggau

SEQ ID NO: 1976767 - RNA, 16 nt, Shigella flexneri 2a str. 301
gggguugcagaaacaa

SEQ ID NO: 1976768 - RNA, 13 nt, Shigella flexneri 2a str. 301
gggcggcgggcga

SEQ ID NO: 1976769 - RNA, 20 nt, Shigella flexneri 2a str. 301
gggcuauauacccuucucag

SEQ ID NO: 1976770 - RNA, 20 nt, Shigella flexneri 2a str. 301
gggcucgggcaaauccacug

SEQ ID NO: 1976771 - RNA, 11 nt, Shigella flexneri 2a str. 301
gggccgucccc

SEQ ID NO: 1976772 - RNA, 23 nt, Shigella flexneri 2a str. 301
gggccguuuucguuacuccgcca

SEQ ID NO: 1976773 - RNA, 23 nt, Shigella flexneri 2a str. 301
gggcggagaugcggaaauaucgg

SEQ ID NO: 1976774 - RNA, 22 nt, Shigella flexneri 2a str. 301
gggcgcuggcuccugagcgcca

SEQ ID NO: 1976775 - RNA, 23 nt, Shigella flexneri 2a str. 301
ggggauuuucacugugcuuuaca

SEQ ID NO: 1976776 - RNA, 21 nt, Shigella flexneri 2a str. 301
ggggauccagucccccccacu

SEQ ID NO: 1976777 - RNA, 12 nt, Shigella flexneri 2a str. 301
gggcuucaaagu

SEQ ID NO: 1976778 - RNA, 14 nt, Shigella flexneri 2a str. 301
gggcuuaccacggg

SEQ ID NO: 1976779 - RNA, 21 nt, Shigella flexneri 2a str. 301
gggcugacauuaucagacacc

SEQ ID NO: 1976780 - RNA, 21 nt, Shigella flexneri 2a str. 301
gggcugacguuaagaaaacgg

SEQ ID NO: 1976781 - RNA, 19 nt, Shigella flexneri 2a str. 301
gggcuguagcuuuucaugu

SEQ ID NO: 1976782 - RNA, 16 nt, Shigella flexneri 2a str. 301
ggggccaauugcugug

SEQ ID NO: 1976783 - RNA, 19 nt, Shigella flexneri 2a str. 301
ggggcacugaaagccgcag

SEQ ID NO: 1976784 - RNA, 22 nt, Shigella flexneri 2a str. 301
ggucaaaugaccgggcuuuccg

SEQ ID NO: 1976785 - RNA, 13 nt, Shigella flexneri 2a str. 301
gguauuggugaaa

SEQ ID NO: 1976786 - RNA, 15 nt, Shigella flexneri 2a str. 301
gguauugcuucucag

SEQ ID NO: 1976787 - RNA, 21 nt, Shigella flexneri 2a str. 301
ggucaaacggcgcuuccagca

SEQ ID NO: 1976788 - RNA, 21 nt, Shigella flexneri 2a str. 301
ggucaaaauccauuuucuauu

SEQ ID NO: 1976789 - RNA, 18 nt, Shigella flexneri 2a str. 301
gguauagaagccauccag

SEQ ID NO: 1976790 - RNA, 12 nt, Shigella flexneri 2a str. 301
gguagcggguga

SEQ ID NO: 1976791 - RNA, 13 nt, Shigella flexneri 2a str. 301
gguaucaaacaca

SEQ ID NO: 1976792 - RNA, 16 nt, Shigella flexneri 2a str. 301
gguagcgcauaagcca

SEQ ID NO: 1976793 - RNA, 22 nt, Shigella flexneri 2a str. 301
ggucauuuucuucagcaguuca

SEQ ID NO: 1976794 - RNA, 14 nt, Shigella flexneri 2a str. 301
ggucauuuucuuca

SEQ ID NO: 1976795 - RNA, 18 nt, Shigella flexneri 2a str. 301
gguccccucgcuccucug

SEQ ID NO: 1976796 - RNA, 13 nt, Shigella flexneri 2a str. 301
ggucagacccagu

SEQ ID NO: 1976797 - RNA, 11 nt, Shigella flexneri 2a str. 301
ggucagacaac

SEQ ID NO: 1976798 - RNA, 16 nt, Shigella flexneri 2a str. 301
ggucagacaacuuccc

SEQ ID NO: 1976799 - RNA, 13 nt, Shigella flexneri 2a str. 301
ggucagagaaucg

SEQ ID NO: 1976800 - RNA, 14 nt, Shigella flexneri 2a str. 301
ggucagagaaucga

SEQ ID NO: 1976801 - RNA, 16 nt, Shigella flexneri 2a str. 301
ggucagauuucaaucu

SEQ ID NO: 1976802 - RNA, 23 nt, Shigella flexneri 2a str. 301
ggucagcagcuuucuuuauaucu

SEQ ID NO: 1976803 - RNA, 21 nt, Shigella flexneri 2a str. 301
ggucagcaggagcagccccug

SEQ ID NO: 1976804 - RNA, 20 nt, Shigella flexneri 2a str. 301
ggucaucacaucccagcaga

SEQ ID NO: 1976805 - RNA, 20 nt, Shigella flexneri 2a str. 301
ggucaucaaucauuuuuuga

SEQ ID NO: 1976806 - RNA, 16 nt, Shigella flexneri 2a str. 301
ggucauaggccgcuga

SEQ ID NO: 1976807 - RNA, 12 nt, Shigella flexneri 2a str. 301
ggucauccaaau

SEQ ID NO: 1976808 - RNA, 14 nt, Shigella flexneri 2a str. 301
ggugaugguuucau

SEQ ID NO: 1976809 - RNA, 23 nt, Shigella flexneri 2a str. 301
ggugauuuugccugugcaaccuu

SEQ ID NO: 1976810 - RNA, 19 nt, Shigella flexneri 2a str. 301
ggugaugaucgcgcugauu

SEQ ID NO: 1976811 - RNA, 20 nt, Shigella flexneri 2a str. 301
ggugccauugaccagcugcc

SEQ ID NO: 1976812 - RNA, 22 nt, Shigella flexneri 2a str. 301
ggugcaucggggaauugugcuu

SEQ ID NO: 1976813 - RNA, 22 nt, Shigella flexneri 2a str. 301
ggugaagguaaguuguugauaa

SEQ ID NO: 1976814 - RNA, 13 nt, Shigella flexneri 2a str. 301
ggucuggcgacgg

SEQ ID NO: 1976815 - RNA, 18 nt, Shigella flexneri 2a str. 301
ggucugguguaucugcug

SEQ ID NO: 1976816 - RNA, 17 nt, Shigella flexneri 2a str. 301
ggucuggaacuggcugc

SEQ ID NO: 1976817 - RNA, 18 nt, Shigella flexneri 2a str. 301
ggucuggcaaaaauaagg

SEQ ID NO: 1976818 - RNA, 14 nt, Shigella flexneri 2a str. 301
ggucugccaacuuu

SEQ ID NO: 1976819 - RNA, 18 nt, Shigella flexneri 2a str. 301
ggucugcaugacggcuga

SEQ ID NO: 1976820 - RNA, 19 nt, Shigella flexneri 2a str. 301
gguccuaacaaccaucccc

SEQ ID NO: 1976821 - RNA, 15 nt, Shigella flexneri 2a str. 301
ggucccugaugcauc

SEQ ID NO: 1976822 - RNA, 20 nt, Shigella flexneri 2a str. 301
ggucccugaugcaucaguca

SEQ ID NO: 1976823 - RNA, 14 nt, Shigella flexneri 2a str. 301
ggucccuucaaucu

SEQ ID NO: 1976824 - RNA, 19 nt, Shigella flexneri 2a str. 301
ggucccucaacaacagucu

SEQ ID NO: 1976825 - RNA, 22 nt, Shigella flexneri 2a str. 301
gguuuucaaucgacuuuucaua

SEQ ID NO: 1976826 - RNA, 21 nt, Shigella flexneri 2a str. 301
gguuuucaacgugucuuuuac

SEQ ID NO: 1976827 - RNA, 14 nt, Shigella flexneri 2a str. 301
gguuuguuauccac

SEQ ID NO: 1976828 - RNA, 19 nt, Shigella flexneri 2a str. 301
gguuugacauaaauuccgc

SEQ ID NO: 1976829 - RNA, 11 nt, Shigella flexneri 2a str. 301
gguuucuuuuu

SEQ ID NO: 1976830 - RNA, 16 nt, Shigella flexneri 2a str. 301
gguuugaaaaaaccug

SEQ ID NO: 1976831 - RNA, 18 nt, Shigella flexneri 2a str. 301
gguuucccgccguaacug

SEQ ID NO: 1976832 - RNA, 17 nt, Shigella flexneri 2a str. 301
gguuuccggaucgccaa

SEQ ID NO: 1976833 - RNA, 15 nt, Shigella flexneri 2a str. 301
gguuucgccugccag

SEQ ID NO: 1976834 - RNA, 19 nt, Shigella flexneri 2a str. 301
gguuucgugaaacucagca

SEQ ID NO: 1976835 - RNA, 20 nt, Shigella flexneri 2a str. 301
gguuucaagauuagcccccg

SEQ ID NO: 1976836 - RNA, 20 nt, Shigella flexneri 2a str. 301
gguuucaaauuacgauccac

SEQ ID NO: 1976837 - RNA, 23 nt, Shigella flexneri 2a str. 301
gguuucaaagauuuuaccaaugg

SEQ ID NO: 1976838 - RNA, 14 nt, Shigella flexneri 2a str. 301
gguuuauccccaag

SEQ ID NO: 1976839 - RNA, 17 nt, Shigella flexneri 2a str. 301
gguuucacggcaccagc

SEQ ID NO: 1976840 - RNA, 21 nt, Shigella flexneri 2a str. 301
guaaaaccgcgaugaccaaaa

SEQ ID NO: 1976841 - RNA, 12 nt, Shigella flexneri 2a str. 301
guaaaaccugac

SEQ ID NO: 1976842 - RNA, 15 nt, Shigella flexneri 2a str. 301
guaaaaagaaaguuu

SEQ ID NO: 1976843 - RNA, 20 nt, Shigella flexneri 2a str. 301
guaaaaagaaaguuugcaga

SEQ ID NO: 1976844 - RNA, 22 nt, Shigella flexneri 2a str. 301
gguuuuuugaacagaccacauu

SEQ ID NO: 1976845 - RNA, 20 nt, Shigella flexneri 2a str. 301
gguuuuuuauuuaagcuggg

SEQ ID NO: 1976846 - RNA, 22 nt, Shigella flexneri 2a str. 301
gguuuuuuauuaauucuaaaac

SEQ ID NO: 1976847 - RNA, 20 nt, Shigella flexneri 2a str. 301
gguuuuuguuuugagcacuc

SEQ ID NO: 1976848 - RNA, 17 nt, Shigella flexneri 2a str. 301
gguuuugcuauccagua

SEQ ID NO: 1976849 - RNA, 13 nt, Shigella flexneri 2a str. 301
gguucuuuuuuga

SEQ ID NO: 1976850 - RNA, 22 nt, Shigella flexneri 2a str. 301
gguucuuuuuugagaauaaccu

SEQ ID NO: 1976851 - RNA, 13 nt, Shigella flexneri 2a str. 301
gguugacugcuga

SEQ ID NO: 1976852 - RNA, 12 nt, Shigella flexneri 2a str. 301
gguugacugaaa

SEQ ID NO: 1976853 - RNA, 20 nt, Shigella flexneri 2a str. 301
gguucucuuuuauuucugcu

SEQ ID NO: 1976854 - RNA, 16 nt, Shigella flexneri 2a str. 301
gguugguacuguggca

SEQ ID NO: 1976855 - RNA, 21 nt, Shigella flexneri 2a str. 301
gguuuaaacagagauuacuuu

SEQ ID NO: 1976856 - RNA, 14 nt, Shigella flexneri 2a str. 301
gguuuaaacagaga

SEQ ID NO: 1976857 - RNA, 21 nt, Shigella flexneri 2a str. 301
gguuuacccgcuugaguauuu

SEQ ID NO: 1976858 - RNA, 16 nt, Shigella flexneri 2a str. 301
gguucaauaucuuccu

SEQ ID NO: 1976859 - RNA, 23 nt, Shigella flexneri 2a str. 301
gguucaucgugcuguuugaaaug

SEQ ID NO: 1976860 - RNA, 19 nt, Shigella flexneri 2a str. 301
gguucauugagcgcaaaug

SEQ ID NO: 1976861 - RNA, 21 nt, Shigella flexneri 2a str. 301
gguuccccccacaaucagcca

SEQ ID NO: 1976862 - RNA, 11 nt, Shigella flexneri 2a str. 301
gguuccagcuu

SEQ ID NO: 1976863 - RNA, 16 nt, Shigella flexneri 2a str. 301
gguucgcacuaaguuc

SEQ ID NO: 1976864 - RNA, 23 nt, Shigella flexneri 2a str. 301
gguucgacugcccgcgagcgugg

SEQ ID NO: 1976865 - RNA, 10 nt, Shigella flexneri 2a str. 301
gguucaaagu

SEQ ID NO: 1976866 - RNA, 22 nt, Shigella flexneri 2a str. 301
gguuauuuguaguuugauaauu

SEQ ID NO: 1976867 - RNA, 21 nt, Shigella flexneri 2a str. 301
gguuauuucauuauuaauuuc

SEQ ID NO: 1976868 - RNA, 22 nt, Shigella flexneri 2a str. 301
gguuaguaugaagaacaaguuc

SEQ ID NO: 1976869 - RNA, 21 nt, Shigella flexneri 2a str. 301
gguuagucugcauuuucucgc

SEQ ID NO: 1976870 - RNA, 19 nt, Shigella flexneri 2a str. 301
gguuaggcugugaaccgca

SEQ ID NO: 1976871 - RNA, 16 nt, Shigella flexneri 2a str. 301
gguguuuaaccaacac

SEQ ID NO: 1976872 - RNA, 17 nt, Shigella flexneri 2a str. 301
gguuaacuguggcguua

SEQ ID NO: 1976873 - RNA, 13 nt, Shigella flexneri 2a str. 301
gguguugaagaaa

SEQ ID NO: 1976874 - RNA, 22 nt, Shigella flexneri 2a str. 301
gguguugcguuuuuaucuucac

SEQ ID NO: 1976875 - RNA, 17 nt, Shigella flexneri 2a str. 301
gguuaauuaccuuauca

SEQ ID NO: 1976876 - RNA, 19 nt, Shigella flexneri 2a str. 301
gguuagaauaccugccugu

SEQ ID NO: 1976877 - RNA, 21 nt, Shigella flexneri 2a str. 301
gguguaaugccagucaguuaa

SEQ ID NO: 1976878 - RNA, 16 nt, Shigella flexneri 2a str. 301
ggugggcuacggcaug

SEQ ID NO: 1976879 - RNA, 18 nt, Shigella flexneri 2a str. 301
gguguaucuucagcugca

SEQ ID NO: 1976880 - RNA, 14 nt, Shigella flexneri 2a str. 301
cuccaccagcacca

SEQ ID NO: 1976881 - RNA, 20 nt, Shigella flexneri 2a str. 301
cuccacaagaaugccugcca

SEQ ID NO: 1976882 - RNA, 13 nt, Shigella flexneri 2a str. 301
cuccacaccggca

SEQ ID NO: 1976883 - RNA, 21 nt, Shigella flexneri 2a str. 301
cuccacaccggcaccauggcu

SEQ ID NO: 1976884 - RNA, 22 nt, Shigella flexneri 2a str. 301
cuccaaggucuccgcccagcgu

SEQ ID NO: 1976885 - RNA, 20 nt, Shigella flexneri 2a str. 301
cuccacgauguucugagcga

SEQ ID NO: 1976886 - RNA, 19 nt, Shigella flexneri 2a str. 301
cuccacgauguucugagcg

SEQ ID NO: 1976887 - RNA, 17 nt, Shigella flexneri 2a str. 301
cuccacgcugcaucgcc

SEQ ID NO: 1976888 - RNA, 20 nt, Shigella flexneri 2a str. 301
cuccacgcccagcgcaggaa

SEQ ID NO: 1976889 - RNA, 17 nt, Shigella flexneri 2a str. 301
cuccacgcccagcgcag

SEQ ID NO: 1976890 - RNA, 18 nt, Shigella flexneri 2a str. 301
cuccacgcuuaacaaccc

SEQ ID NO: 1976891 - RNA, 16 nt, Shigella flexneri 2a str. 301
cuccacuauaaaaaaa

SEQ ID NO: 1976892 - RNA, 17 nt, Shigella flexneri 2a str. 301
cuccacuucaccgcgaa

SEQ ID NO: 1976893 - RNA, 14 nt, Shigella flexneri 2a str. 301
cuccacuuccugcc

SEQ ID NO: 1976894 - RNA, 11 nt, Shigella flexneri 2a str. 301
cuccacuuccu

SEQ ID NO: 1976895 - RNA, 13 nt, Shigella flexneri 2a str. 301
cuccacuuccugc

SEQ ID NO: 1976896 - RNA, 17 nt, Shigella flexneri 2a str. 301
cuccacuuccugccagu

SEQ ID NO: 1976897 - RNA, 19 nt, Shigella flexneri 2a str. 301
cuccagacaccgcugcuuc

SEQ ID NO: 1976898 - RNA, 12 nt, Shigella flexneri 2a str. 301
cuccagcaaugu

SEQ ID NO: 1976899 - RNA, 13 nt, Shigella flexneri 2a str. 301
cuccagcagacca

SEQ ID NO: 1976900 - RNA, 14 nt, Shigella flexneri 2a str. 301
cuccagcagaccag

SEQ ID NO: 1976901 - RNA, 23 nt, Shigella flexneri 2a str. 301
cuccagauccauaagguccucca

SEQ ID NO: 1976902 - RNA, 22 nt, Shigella flexneri 2a str. 301
cuccagauccauaagguccucc

SEQ ID NO: 1976903 - RNA, 14 nt, Shigella flexneri 2a str. 301
cucauuuacagaaa

SEQ ID NO: 1976904 - RNA, 15 nt, Shigella flexneri 2a str. 301
cucauuguuagaugu

SEQ ID NO: 1976905 - RNA, 20 nt, Shigella flexneri 2a str. 301
cucauugguccaucuuuuug

SEQ ID NO: 1976906 - RNA, 15 nt, Shigella flexneri 2a str. 301
cucaggcgcacgccg

SEQ ID NO: 1976907 - RNA, 23 nt, Shigella flexneri 2a str. 301
cucaggcgcacgccgacaaagau

SEQ ID NO: 1976908 - RNA, 16 nt, Shigella flexneri 2a str. 301
cucaggccuacaaaau

SEQ ID NO: 1976909 - RNA, 22 nt, Shigella flexneri 2a str. 301
cucaggccuacaaaaucuugca

SEQ ID NO: 1976910 - RNA, 23 nt, Shigella flexneri 2a str. 301
cucaggccgauuucaugaagcug

SEQ ID NO: 1976911 - RNA, 19 nt, Shigella flexneri 2a str. 301
cucaggccgauuucaugaa

SEQ ID NO: 1976912 - RNA, 18 nt, Shigella flexneri 2a str. 301
cucaggcaguacgcggcg

SEQ ID NO: 1976913 - RNA, 16 nt, Shigella flexneri 2a str. 301
cucaggccaaaugaca

SEQ ID NO: 1976914 - RNA, 13 nt, Shigella flexneri 2a str. 301
cucauuauuugcc

SEQ ID NO: 1976915 - RNA, 21 nt, Shigella flexneri 2a str. 301
cucauuaagacuguaaauaaa

SEQ ID NO: 1976916 - RNA, 16 nt, Shigella flexneri 2a str. 301
cuccauuccaucgccu

SEQ ID NO: 1976917 - RNA, 13 nt, Shigella flexneri 2a str. 301
cuccauugaagag

SEQ ID NO: 1976918 - RNA, 22 nt, Shigella flexneri 2a str. 301
cucccaguugugggugcccaca

SEQ ID NO: 1976919 - RNA, 14 nt, Shigella flexneri 2a str. 301
cuccagcgcaauug

SEQ ID NO: 1976920 - RNA, 16 nt, Shigella flexneri 2a str. 301
cucccggcaaugcgcc

SEQ ID NO: 1976921 - RNA, 15 nt, Shigella flexneri 2a str. 301
cucccgucgcccaca

SEQ ID NO: 1976922 - RNA, 12 nt, Shigella flexneri 2a str. 301
cuccccccucug

SEQ ID NO: 1976923 - RNA, 13 nt, Shigella flexneri 2a str. 301
cuccccccucuga

SEQ ID NO: 1976924 - RNA, 14 nt, Shigella flexneri 2a str. 301
cuccccccucugau

SEQ ID NO: 1976925 - RNA, 18 nt, Shigella flexneri 2a str. 301
cuccccagaauccaggaa

SEQ ID NO: 1976926 - RNA, 19 nt, Shigella flexneri 2a str. 301
cuccccagggaacauuucu

SEQ ID NO: 1976927 - RNA, 14 nt, Shigella flexneri 2a str. 301
cuccguaaaccccg

SEQ ID NO: 1976928 - RNA, 21 nt, Shigella flexneri 2a str. 301
cuccgguuugcggaucaacuu

SEQ ID NO: 1976929 - RNA, 22 nt, Shigella flexneri 2a str. 301
cuccguaaaacucaggcuggca

SEQ ID NO: 1976930 - RNA, 17 nt, Shigella flexneri 2a str. 301
cuccgugguagcaauuc

SEQ ID NO: 1976931 - RNA, 18 nt, Shigella flexneri 2a str. 301
cuccgucaacguuaacuu

SEQ ID NO: 1976932 - RNA, 20 nt, Shigella flexneri 2a str. 301
cuccgucaucuuuaacgugg

SEQ ID NO: 1976933 - RNA, 18 nt, Shigella flexneri 2a str. 301
cuccgcugagacgcgcuu

SEQ ID NO: 1976934 - RNA, 19 nt, Shigella flexneri 2a str. 301
cuccgcucucaaucucuuu

SEQ ID NO: 1976935 - RNA, 23 nt, Shigella flexneri 2a str. 301
cuccggaaauuuggggccguccc

SEQ ID NO: 1976936 - RNA, 14 nt, Shigella flexneri 2a str. 301
cuccggacuccgca

SEQ ID NO: 1976937 - RNA, 21 nt, Shigella flexneri 2a str. 301
cuccggcuuuuuacuucucag

SEQ ID NO: 1976938 - RNA, 22 nt, Shigella flexneri 2a str. 301
cuccgggaaaacgcuggcagca

SEQ ID NO: 1976939 - RNA, 13 nt, Shigella flexneri 2a str. 301
cuccgaccagaag

SEQ ID NO: 1976940 - RNA, 15 nt, Shigella flexneri 2a str. 301
cuccgaccagaagcg

SEQ ID NO: 1976941 - RNA, 15 nt, Shigella flexneri 2a str. 301
cucgcgaaccgccug

SEQ ID NO: 1976942 - RNA, 16 nt, Shigella flexneri 2a str. 301
cucgcgaaccgccugg

SEQ ID NO: 1976943 - RNA, 23 nt, Shigella flexneri 2a str. 301
cucgcgaccucaagcucgccacc

SEQ ID NO: 1976944 - RNA, 13 nt, Shigella flexneri 2a str. 301
cucgcgcucuucu

SEQ ID NO: 1976945 - RNA, 15 nt, Shigella flexneri 2a str. 301
cucgcgcucuucuuc

SEQ ID NO: 1976946 - RNA, 18 nt, Shigella flexneri 2a str. 301
cucgcgcuugcggaagca

SEQ ID NO: 1976947 - RNA, 14 nt, Shigella flexneri 2a str. 301
cucgccccuccggg

SEQ ID NO: 1976948 - RNA, 14 nt, Shigella flexneri 2a str. 301
cucgccgcagagau

SEQ ID NO: 1976949 - RNA, 19 nt, Shigella flexneri 2a str. 301
cucgccggaugaaaaguca

SEQ ID NO: 1976950 - RNA, 19 nt, Shigella flexneri 2a str. 301
cucgccccgagaaaaauag

SEQ ID NO: 1976951 - RNA, 15 nt, Shigella flexneri 2a str. 301
cucgccagccaccau

SEQ ID NO: 1976952 - RNA, 18 nt, Shigella flexneri 2a str. 301
cucgccacgucacucuuu

SEQ ID NO: 1976953 - RNA, 16 nt, Shigella flexneri 2a str. 301
cucgcaucagggcgcu

SEQ ID NO: 1976954 - RNA, 24 nt, Shigella flexneri 2a str. 301
cucgcaagccgaauaacggcucaa

SEQ ID NO: 1976955 - RNA, 14 nt, Shigella flexneri 2a str. 301
cucgcaaaacgucg

SEQ ID NO: 1976956 - RNA, 16 nt, Shigella flexneri 2a str. 301
cucgcaagccacgccg

SEQ ID NO: 1976957 - RNA, 21 nt, Shigella flexneri 2a str. 301
cuccucaguuucgacgccuuc

SEQ ID NO: 1976958 - RNA, 20 nt, Shigella flexneri 2a str. 301
cucgguaaaacuaacgccag

SEQ ID NO: 1976959 - RNA, 20 nt, Shigella flexneri 2a str. 301
cucgguaaaaucaacgccgc

SEQ ID NO: 1976960 - RNA, 19 nt, Shigella flexneri 2a str. 301
cucggcggcuggcuggaug

SEQ ID NO: 1976961 - RNA, 20 nt, Shigella flexneri 2a str. 301
cucgggcgguuaugggauau

SEQ ID NO: 1976962 - RNA, 14 nt, Shigella flexneri 2a str. 301
cucggcuauuuccg

SEQ ID NO: 1976963 - RNA, 11 nt, Shigella flexneri 2a str. 301
cucgcggcgga

SEQ ID NO: 1976964 - RNA, 15 nt, Shigella flexneri 2a str. 301
cucgcggacugccug

SEQ ID NO: 1976965 - RNA, 17 nt, Shigella flexneri 2a str. 301
cucgcggacugccuggc

SEQ ID NO: 1976966 - RNA, 13 nt, Shigella flexneri 2a str. 301
cucuaaaaucauc

SEQ ID NO: 1976967 - RNA, 18 nt, Shigella flexneri 2a str. 301
cucguuucgcccugccuu

SEQ ID NO: 1976968 - RNA, 13 nt, Shigella flexneri 2a str. 301
cucuaaucaggaa

SEQ ID NO: 1976969 - RNA, 18 nt, Shigella flexneri 2a str. 301
cucuaacccuuccagauu

SEQ ID NO: 1976970 - RNA, 17 nt, Shigella flexneri 2a str. 301
cucgugccaccagugca

SEQ ID NO: 1976971 - RNA, 23 nt, Shigella flexneri 2a str. 301
cucguucacauauugcagcuucu

SEQ ID NO: 1976972 - RNA, 14 nt, Shigella flexneri 2a str. 301
cucguuauuggugg

SEQ ID NO: 1976973 - RNA, 14 nt, Shigella flexneri 2a str. 301
cucguucacauauu

SEQ ID NO: 1976974 - RNA, 18 nt, Shigella flexneri 2a str. 301
cucguuaccagcgccgcc

SEQ ID NO: 1976975 - RNA, 23 nt, Shigella flexneri 2a str. 301
cucgucggcgguuuucaucaucc

SEQ ID NO: 1976976 - RNA, 18 nt, Shigella flexneri 2a str. 301
cucgucguagaaguucag

SEQ ID NO: 1976977 - RNA, 17 nt, Shigella flexneri 2a str. 301
cucgugauaguccagcc

SEQ ID NO: 1976978 - RNA, 22 nt, Shigella flexneri 2a str. 301
cucgguuuugcgguauuuguau

SEQ ID NO: 1976979 - RNA, 17 nt, Shigella flexneri 2a str. 301
cucgguuugcggcagga

SEQ ID NO: 1976980 - RNA, 20 nt, Shigella flexneri 2a str. 301
cuauuuuccuauugcugcug

SEQ ID NO: 1976981 - RNA, 22 nt, Shigella flexneri 2a str. 301
cuauuuccccggaaccugaacu

SEQ ID NO: 1976982 - RNA, 14 nt, Shigella flexneri 2a str. 301
cuauuugcgccugg

SEQ ID NO: 1976983 - RNA, 20 nt, Shigella flexneri 2a str. 301
cuauuuuuggaggugaaggu

SEQ ID NO: 1976984 - RNA, 19 nt, Shigella flexneri 2a str. 301
cuauuuccaccucccccuu

SEQ ID NO: 1976985 - RNA, 17 nt, Shigella flexneri 2a str. 301
cuauuucaauaugauaa

SEQ ID NO: 1976986 - RNA, 21 nt, Shigella flexneri 2a str. 301
cuauugcggaugaaagugguu

SEQ ID NO: 1976987 - RNA, 18 nt, Shigella flexneri 2a str. 301
cuaucugcugcuugcggu

SEQ ID NO: 1976988 - RNA, 14 nt, Shigella flexneri 2a str. 301
cuaucuguuugcca

SEQ ID NO: 1976989 - RNA, 18 nt, Shigella flexneri 2a str. 301
cuaucuucgauaaacuca

SEQ ID NO: 1976990 - RNA, 17 nt, Shigella flexneri 2a str. 301
cuaugaaagaaaaucaa

SEQ ID NO: 1976991 - RNA, 17 nt, Shigella flexneri 2a str. 301
cuaugaaaauaaaugug

SEQ ID NO: 1976992 - RNA, 15 nt, Shigella flexneri 2a str. 301
cuaucuuucaacagu

SEQ ID NO: 1976993 - RNA, 17 nt, Shigella flexneri 2a str. 301
cuaugggauauuuuuuu

SEQ ID NO: 1976994 - RNA, 16 nt, Shigella flexneri 2a str. 301
cuauggcuggcaauac

SEQ ID NO: 1976995 - RNA, 17 nt, Shigella flexneri 2a str. 301
cuaugagaaaauuucau

SEQ ID NO: 1976996 - RNA, 17 nt, Shigella flexneri 2a str. 301
cuauucagcucuuccuu

SEQ ID NO: 1976997 - RNA, 12 nt, Shigella flexneri 2a str. 301
cuauucagcagu

SEQ ID NO: 1976998 - RNA, 20 nt, Shigella flexneri 2a str. 301
cuauuccguuacucuccgga

SEQ ID NO: 1976999 - RNA, 17 nt, Shigella flexneri 2a str. 301
cuauuauuauuuuugug

SEQ ID NO: 1977000 - RNA, 23 nt, Shigella flexneri 2a str. 301
cuauucacgaaucuauucauuua

SEQ ID NO: 1977001 - RNA, 17 nt, Shigella flexneri 2a str. 301
cucaaaccggcuccaga

SEQ ID NO: 1977002 - RNA, 18 nt, Shigella flexneri 2a str. 301
cucaaacuucgucacagc

SEQ ID NO: 1977003 - RNA, 22 nt, Shigella flexneri 2a str. 301
cucaaacacgccgauaucgcug

SEQ ID NO: 1977004 - RNA, 15 nt, Shigella flexneri 2a str. 301
cucaaaccauuuugc

SEQ ID NO: 1977005 - RNA, 22 nt, Shigella flexneri 2a str. 301
cucaaagacgcgguaaaagccc

SEQ ID NO: 1977006 - RNA, 15 nt, Shigella flexneri 2a str. 301
cucaaagccgaauuu

SEQ ID NO: 1977007 - RNA, 11 nt, Shigella flexneri 2a str. 301
cucaaaacuac

SEQ ID NO: 1977008 - RNA, 14 nt, Shigella flexneri 2a str. 301
cucaaaaucacugg

SEQ ID NO: 1977009 - RNA, 15 nt, Shigella flexneri 2a str. 301
cucaaaacaacacaa

SEQ ID NO: 1977010 - RNA, 19 nt, Shigella flexneri 2a str. 301
cucaaaguaaucaagcccu

SEQ ID NO: 1977011 - RNA, 14 nt, Shigella flexneri 2a str. 301
cucaaucccuuucu

SEQ ID NO: 1977012 - RNA, 20 nt, Shigella flexneri 2a str. 301
cucaauccgccaaaacaucu

SEQ ID NO: 1977013 - RNA, 22 nt, Shigella flexneri 2a str. 301
cucaauccgggcgauccggcaa

SEQ ID NO: 1977014 - RNA, 19 nt, Shigella flexneri 2a str. 301
cucaaucccuuucucuuca

SEQ ID NO: 1977015 - RNA, 22 nt, Shigella flexneri 2a str. 301
cucaaucgagauacgacugaua

SEQ ID NO: 1977016 - RNA, 15 nt, Shigella flexneri 2a str. 301
cucaauggauuuacc

SEQ ID NO: 1977017 - RNA, 14 nt, Shigella flexneri 2a str. 301
cucaaugccugaug

SEQ ID NO: 1977018 - RNA, 21 nt, Shigella flexneri 2a str. 301
cucaaugagccggaccucuuu

SEQ ID NO: 1977019 - RNA, 19 nt, Shigella flexneri 2a str. 301
cucaaugagccggaccucu

SEQ ID NO: 1977020 - RNA, 21 nt, Shigella flexneri 2a str. 301
cucaaugagcaccuuuuuucu

SEQ ID NO: 1977021 - RNA, 18 nt, Shigella flexneri 2a str. 301
cucaaucucuuuuuccac

SEQ ID NO: 1977022 - RNA, 20 nt, Shigella flexneri 2a str. 301
cucaaucugauagugaucca

SEQ ID NO: 1977023 - RNA, 11 nt, Shigella flexneri 2a str. 301
cucaauuacca

SEQ ID NO: 1977024 - RNA, 21 nt, Shigella flexneri 2a str. 301
cucaauuaacauugcaagauu

SEQ ID NO: 1977025 - RNA, 20 nt, Shigella flexneri 2a str. 301
cucaaugguguuuuccaccg

SEQ ID NO: 1977026 - RNA, 18 nt, Shigella flexneri 2a str. 301
cucaaugguguuuuccac

SEQ ID NO: 1977027 - RNA, 14 nt, Shigella flexneri 2a str. 301
cucaauggcauccg

SEQ ID NO: 1977028 - RNA, 22 nt, Shigella flexneri 2a str. 301
cucaauugacaguuuauuuucu

SEQ ID NO: 1977029 - RNA, 17 nt, Shigella flexneri 2a str. 301
cucacaaccccggcaaa

SEQ ID NO: 1977030 - RNA, 16 nt, Shigella flexneri 2a str. 301
cucacgcgcugccucu

SEQ ID NO: 1977031 - RNA, 14 nt, Shigella flexneri 2a str. 301
cucacgcauccucu

SEQ ID NO: 1977032 - RNA, 21 nt, Shigella flexneri 2a str. 301
cucacgcagggugugcuccag

SEQ ID NO: 1977033 - RNA, 13 nt, Shigella flexneri 2a str. 301
cucaccaucaagu

SEQ ID NO: 1977034 - RNA, 21 nt, Shigella flexneri 2a str. 301
cucaccagacaucccagugca

SEQ ID NO: 1977035 - RNA, 20 nt, Shigella flexneri 2a str. 301
cucaccacgcuccaucaugu

SEQ ID NO: 1977036 - RNA, 21 nt, Shigella flexneri 2a str. 301
cucaccagauuauaagccagu

SEQ ID NO: 1977037 - RNA, 15 nt, Shigella flexneri 2a str. 301
cucagcccacaucca

SEQ ID NO: 1977038 - RNA, 22 nt, Shigella flexneri 2a str. 301
cucagcauggaaauguuccggc

SEQ ID NO: 1977039 - RNA, 14 nt, Shigella flexneri 2a str. 301
cucagccugagcga

SEQ ID NO: 1977040 - RNA, 16 nt, Shigella flexneri 2a str. 301
cucagcuccucuuuca

SEQ ID NO: 1977041 - RNA, 13 nt, Shigella flexneri 2a str. 301
cucaggaauagcg

SEQ ID NO: 1977042 - RNA, 23 nt, Shigella flexneri 2a str. 301
cucaggaauagcggcaagcccag

SEQ ID NO: 1977043 - RNA, 13 nt, Shigella flexneri 2a str. 301
cucaggaaaagca

SEQ ID NO: 1977044 - RNA, 24 nt, Shigella flexneri 2a str. 301
cucagcgccgcuuuccaggcugug

SEQ ID NO: 1977045 - RNA, 19 nt, Shigella flexneri 2a str. 301
cucacgcgcugccucucuu

SEQ ID NO: 1977046 - RNA, 15 nt, Shigella flexneri 2a str. 301
cucacuguucacuuu

SEQ ID NO: 1977047 - RNA, 18 nt, Shigella flexneri 2a str. 301
cucacuguucacuuuugc

SEQ ID NO: 1977048 - RNA, 14 nt, Shigella flexneri 2a str. 301
cucacuguucacuu

SEQ ID NO: 1977049 - RNA, 21 nt, Shigella flexneri 2a str. 301
cucacuguucacuuuugcugc

SEQ ID NO: 1977050 - RNA, 13 nt, Shigella flexneri 2a str. 301
cucacuuccuuuu

SEQ ID NO: 1977051 - RNA, 15 nt, Shigella flexneri 2a str. 301
cucagcagacugaua

SEQ ID NO: 1977052 - RNA, 13 nt, Shigella flexneri 2a str. 301
cucacuuuuccgc

SEQ ID NO: 1977053 - RNA, 14 nt, Shigella flexneri 2a str. 301
cucacuuuucaccg

SEQ ID NO: 1977054 - RNA, 14 nt, Shigella flexneri 2a str. 301
cuaguguacccuuc

SEQ ID NO: 1977055 - RNA, 23 nt, Shigella flexneri 2a str. 301
cuagugcagauaguugauuaauu

SEQ ID NO: 1977056 - RNA, 19 nt, Shigella flexneri 2a str. 301
cuaggaagccuuccgcaaa

SEQ ID NO: 1977057 - RNA, 22 nt, Shigella flexneri 2a str. 301
cuaggacgcacaucgcugugcu

SEQ ID NO: 1977058 - RNA, 18 nt, Shigella flexneri 2a str. 301
cuauaacaaaacugagag

SEQ ID NO: 1977059 - RNA, 21 nt, Shigella flexneri 2a str. 301
cuauaacguugccggauauac

SEQ ID NO: 1977060 - RNA, 14 nt, Shigella flexneri 2a str. 301
cuauaaccguaaua

SEQ ID NO: 1977061 - RNA, 21 nt, Shigella flexneri 2a str. 301
cuauaaguguaaaauucuaca

SEQ ID NO: 1977062 - RNA, 14 nt, Shigella flexneri 2a str. 301
cuauaaaaaaaccg

SEQ ID NO: 1977063 - RNA, 16 nt, Shigella flexneri 2a str. 301
cuacgcgcccgcgcag

SEQ ID NO: 1977064 - RNA, 17 nt, Shigella flexneri 2a str. 301
cuacgcguuaaagagcc

SEQ ID NO: 1977065 - RNA, 14 nt, Shigella flexneri 2a str. 301
cuacggcaaaagaa

SEQ ID NO: 1977066 - RNA, 15 nt, Shigella flexneri 2a str. 301
cuacggcaaaagaau

SEQ ID NO: 1977067 - RNA, 20 nt, Shigella flexneri 2a str. 301
cuacggcaaaagaauaucag

SEQ ID NO: 1977068 - RNA, 23 nt, Shigella flexneri 2a str. 301
cuacggacaguggcucuuguucg

SEQ ID NO: 1977069 - RNA, 19 nt, Shigella flexneri 2a str. 301
cuacgcuuaucaggccuac

SEQ ID NO: 1977070 - RNA, 15 nt, Shigella flexneri 2a str. 301
cuacggucacgccac

SEQ ID NO: 1977071 - RNA, 16 nt, Shigella flexneri 2a str. 301
cuacgugcgcuaugug

SEQ ID NO: 1977072 - RNA, 19 nt, Shigella flexneri 2a str. 301
cuacgugcgcuauguguua

SEQ ID NO: 1977073 - RNA, 15 nt, Shigella flexneri 2a str. 301
cuacgucucaauuca

SEQ ID NO: 1977074 - RNA, 23 nt, Shigella flexneri 2a str. 301
cuacguggaucgaucaauuuauu

SEQ ID NO: 1977075 - RNA, 20 nt, Shigella flexneri 2a str. 301
cuacguuucuggugugcagc

SEQ ID NO: 1977076 - RNA, 19 nt, Shigella flexneri 2a str. 301
cuagacagcgacucucuga

SEQ ID NO: 1977077 - RNA, 19 nt, Shigella flexneri 2a str. 301
cuagaaaucauucaauacu

SEQ ID NO: 1977078 - RNA, 24 nt, Shigella flexneri 2a str. 301
cuagagcaucaugaauauauaauu

SEQ ID NO: 1977079 - RNA, 17 nt, Shigella flexneri 2a str. 301
cuagccucccugccucc

SEQ ID NO: 1977080 - RNA, 15 nt, Shigella flexneri 2a str. 301
cuagccucagguguu

SEQ ID NO: 1977081 - RNA, 14 nt, Shigella flexneri 2a str. 301
cuagccugcucccu

SEQ ID NO: 1977082 - RNA, 15 nt, Shigella flexneri 2a str. 301
cuagccugcucccuu

SEQ ID NO: 1977083 - RNA, 14 nt, Shigella flexneri 2a str. 301
cuacacccagcccc

SEQ ID NO: 1977084 - RNA, 20 nt, Shigella flexneri 2a str. 301
cuacacgcuaccaaaaaauc

SEQ ID NO: 1977085 - RNA, 14 nt, Shigella flexneri 2a str. 301
cuacacuauuuccu

SEQ ID NO: 1977086 - RNA, 22 nt, Shigella flexneri 2a str. 301
cuacagaggaaucgcuguugag

SEQ ID NO: 1977087 - RNA, 21 nt, Shigella flexneri 2a str. 301
cuacagaggaaucgcuguuga

SEQ ID NO: 1977088 - RNA, 23 nt, Shigella flexneri 2a str. 301
cuacacagacgguuuuucaaguc

SEQ ID NO: 1977089 - RNA, 21 nt, Shigella flexneri 2a str. 301
cuacacauuaucucaacacac

SEQ ID NO: 1977090 - RNA, 17 nt, Shigella flexneri 2a str. 301
cuacaccaugccgguga

SEQ ID NO: 1977091 - RNA, 14 nt, Shigella flexneri 2a str. 301
cuacagcauauaau

SEQ ID NO: 1977092 - RNA, 19 nt, Shigella flexneri 2a str. 301
cuacagguuugugccgaac

SEQ ID NO: 1977093 - RNA, 20 nt, Shigella flexneri 2a str. 301
cuaccuuaacgguaucuuuc

SEQ ID NO: 1977094 - RNA, 14 nt, Shigella flexneri 2a str. 301
cuaccugccgccac

SEQ ID NO: 1977095 - RNA, 16 nt, Shigella flexneri 2a str. 301
cuaccguguucagcgu

SEQ ID NO: 1977096 - RNA, 15 nt, Shigella flexneri 2a str. 301
cuacccggugaaucg

SEQ ID NO: 1977097 - RNA, 16 nt, Shigella flexneri 2a str. 301
cuaccgcgcaggguaa

SEQ ID NO: 1977098 - RNA, 17 nt, Shigella flexneri 2a str. 301
cuaccgcgaugacccaa

SEQ ID NO: 1977099 - RNA, 19 nt, Shigella flexneri 2a str. 301
cuaccgauccggcaccaau

SEQ ID NO: 1977100 - RNA, 14 nt, Shigella flexneri 2a str. 301
cuaccgccagccag

SEQ ID NO: 1977101 - RNA, 14 nt, Shigella flexneri 2a str. 301
cuaccgcuuugcca

SEQ ID NO: 1977102 - RNA, 15 nt, Shigella flexneri 2a str. 301
cuaccgcuuugccac

SEQ ID NO: 1977103 - RNA, 15 nt, Shigella flexneri 2a str. 301
cuacccauauuuaau

SEQ ID NO: 1977104 - RNA, 16 nt, Shigella flexneri 2a str. 301
cuacccauauuuaauc

SEQ ID NO: 1977105 - RNA, 19 nt, Shigella flexneri 2a str. 301
cuaccauuuguucuuuuuu

SEQ ID NO: 1977106 - RNA, 12 nt, Shigella flexneri 2a str. 301
cuaccagcucau

SEQ ID NO: 1977107 - RNA, 14 nt, Shigella flexneri 2a str. 301
cuaccagcgcggca

SEQ ID NO: 1977108 - RNA, 20 nt, Shigella flexneri 2a str. 301
cuaccagguuucgcaauaac

SEQ ID NO: 1977109 - RNA, 13 nt, Shigella flexneri 2a str. 301
cuaccaucaaugg

SEQ ID NO: 1977110 - RNA, 12 nt, Shigella flexneri 2a str. 301
cuaccacaugau

SEQ ID NO: 1977111 - RNA, 14 nt, Shigella flexneri 2a str. 301
cuaccacaugauua

SEQ ID NO: 1977112 - RNA, 11 nt, Shigella flexneri 2a str. 301
cuaccagcacc

SEQ ID NO: 1977113 - RNA, 17 nt, Shigella flexneri 2a str. 301
cguaccauuaucaccaa

SEQ ID NO: 1977114 - RNA, 16 nt, Shigella flexneri 2a str. 301
cguacccagcagcgcc

SEQ ID NO: 1977115 - RNA, 13 nt, Shigella flexneri 2a str. 301
cguaccuucaggc

SEQ ID NO: 1977116 - RNA, 17 nt, Shigella flexneri 2a str. 301
cguaccucacguuccag

SEQ ID NO: 1977117 - RNA, 24 nt, Shigella flexneri 2a str. 301
cguacgcaauccucuuuuccgaac

SEQ ID NO: 1977118 - RNA, 16 nt, Shigella flexneri 2a str. 301
cguacgacguucaggc

SEQ ID NO: 1977119 - RNA, 16 nt, Shigella flexneri 2a str. 301
cguacguuaacagccu

SEQ ID NO: 1977120 - RNA, 19 nt, Shigella flexneri 2a str. 301
cguacgggucgggcugugu

SEQ ID NO: 1977121 - RNA, 22 nt, Shigella flexneri 2a str. 301
cguacuggcaaucgccagcggc

SEQ ID NO: 1977122 - RNA, 12 nt, Shigella flexneri 2a str. 301
cguacugcugaa

SEQ ID NO: 1977123 - RNA, 15 nt, Shigella flexneri 2a str. 301
cguacugcugaauga

SEQ ID NO: 1977124 - RNA, 16 nt, Shigella flexneri 2a str. 301
cguaccagccuugcca

SEQ ID NO: 1977125 - RNA, 20 nt, Shigella flexneri 2a str. 301
cguaccaucauuggagaguu

SEQ ID NO: 1977126 - RNA, 22 nt, Shigella flexneri 2a str. 301
cguacaugcagggcaaacucug

SEQ ID NO: 1977127 - RNA, 15 nt, Shigella flexneri 2a str. 301
cguacaugcagggca

SEQ ID NO: 1977128 - RNA, 23 nt, Shigella flexneri 2a str. 301
cguaccaaucagacucauauaaa

SEQ ID NO: 1977129 - RNA, 20 nt, Shigella flexneri 2a str. 301
cguacauugccgacauggca

SEQ ID NO: 1977130 - RNA, 13 nt, Shigella flexneri 2a str. 301
cguacaggcacau

SEQ ID NO: 1977131 - RNA, 20 nt, Shigella flexneri 2a str. 301
cguaauggcagcauucaggu

SEQ ID NO: 1977132 - RNA, 20 nt, Shigella flexneri 2a str. 301
cguaaugcuucuaccgucug

SEQ ID NO: 1977133 - RNA, 18 nt, Shigella flexneri 2a str. 301
cguaaugauguaaaaaua

SEQ ID NO: 1977134 - RNA, 19 nt, Shigella flexneri 2a str. 301
cguaaugauguaaaaauac

SEQ ID NO: 1977135 - RNA, 17 nt, Shigella flexneri 2a str. 301
cggcguacgacguucag

SEQ ID NO: 1977136 - RNA, 23 nt, Shigella flexneri 2a str. 301
cguaauuaguggcuaaccgucug

SEQ ID NO: 1977137 - RNA, 19 nt, Shigella flexneri 2a str. 301
cguaauguugaguggaagc

SEQ ID NO: 1977138 - RNA, 14 nt, Shigella flexneri 2a str. 301
cguacaaauuuauc

SEQ ID NO: 1977139 - RNA, 16 nt, Shigella flexneri 2a str. 301
cguaauuggccugaca

SEQ ID NO: 1977140 - RNA, 17 nt, Shigella flexneri 2a str. 301
cguaucaccccgcccga

SEQ ID NO: 1977141 - RNA, 19 nt, Shigella flexneri 2a str. 301
cguaucgaccagaauaagu

SEQ ID NO: 1977142 - RNA, 18 nt, Shigella flexneri 2a str. 301
cguaggucggauaagacg

SEQ ID NO: 1977143 - RNA, 15 nt, Shigella flexneri 2a str. 301
cguaggcccagccgu

SEQ ID NO: 1977144 - RNA, 14 nt, Shigella flexneri 2a str. 301
cguaggccugauaa

SEQ ID NO: 1977145 - RNA, 21 nt, Shigella flexneri 2a str. 301
cguaggccagauaagacgcgc

SEQ ID NO: 1977146 - RNA, 14 nt, Shigella flexneri 2a str. 301
cguaggccaaccgu

SEQ ID NO: 1977147 - RNA, 14 nt, Shigella flexneri 2a str. 301
cguagacugcagcg

SEQ ID NO: 1977148 - RNA, 15 nt, Shigella flexneri 2a str. 301
cguagaccgggcgaa

SEQ ID NO: 1977149 - RNA, 14 nt, Shigella flexneri 2a str. 301
cguagccaccaucu

SEQ ID NO: 1977150 - RNA, 19 nt, Shigella flexneri 2a str. 301
cguagccccagucuuccug

SEQ ID NO: 1977151 - RNA, 21 nt, Shigella flexneri 2a str. 301
cguagccaugaugaacaaccc

SEQ ID NO: 1977152 - RNA, 14 nt, Shigella flexneri 2a str. 301
cguccagcagcaau

SEQ ID NO: 1977153 - RNA, 20 nt, Shigella flexneri 2a str. 301
cguccagaugcgagaugucc

SEQ ID NO: 1977154 - RNA, 21 nt, Shigella flexneri 2a str. 301
cgucccggugaagcgcccugc

SEQ ID NO: 1977155 - RNA, 13 nt, Shigella flexneri 2a str. 301
cguccgcacgcug

SEQ ID NO: 1977156 - RNA, 21 nt, Shigella flexneri 2a str. 301
cgucaugguauagagauagca

SEQ ID NO: 1977157 - RNA, 13 nt, Shigella flexneri 2a str. 301
cgucauuaucugc

SEQ ID NO: 1977158 - RNA, 22 nt, Shigella flexneri 2a str. 301
cguccacggugcgacacugcgu

SEQ ID NO: 1977159 - RNA, 13 nt, Shigella flexneri 2a str. 301
cguccacacggca

SEQ ID NO: 1977160 - RNA, 22 nt, Shigella flexneri 2a str. 301
cgucagcucgcugccaucaacu

SEQ ID NO: 1977161 - RNA, 20 nt, Shigella flexneri 2a str. 301
cgucagcgucgcaucuggca

SEQ ID NO: 1977162 - RNA, 13 nt, Shigella flexneri 2a str. 301
cgucagaaacagu

SEQ ID NO: 1977163 - RNA, 16 nt, Shigella flexneri 2a str. 301
cgucacugguucaaag

SEQ ID NO: 1977164 - RNA, 22 nt, Shigella flexneri 2a str. 301
cgucaucucgcucaaaaaucca

SEQ ID NO: 1977165 - RNA, 18 nt, Shigella flexneri 2a str. 301
cgucauccagcacuugca

SEQ ID NO: 1977166 - RNA, 19 nt, Shigella flexneri 2a str. 301
cgucauccauaccgcgacc

SEQ ID NO: 1977167 - RNA, 14 nt, Shigella flexneri 2a str. 301
cgucaucccagucu

SEQ ID NO: 1977168 - RNA, 19 nt, Shigella flexneri 2a str. 301
cgucaucccagucuucauc

SEQ ID NO: 1977169 - RNA, 17 nt, Shigella flexneri 2a str. 301
cgucauccguggcgaca

SEQ ID NO: 1977170 - RNA, 16 nt, Shigella flexneri 2a str. 301
cgucauccagcacuug

SEQ ID NO: 1977171 - RNA, 22 nt, Shigella flexneri 2a str. 301
cguauucggcaagcguaacgug

SEQ ID NO: 1977172 - RNA, 21 nt, Shigella flexneri 2a str. 301
cguauucgcgcagaacauaaa

SEQ ID NO: 1977173 - RNA, 14 nt, Shigella flexneri 2a str. 301
cguauugcgccggu

SEQ ID NO: 1977174 - RNA, 21 nt, Shigella flexneri 2a str. 301
cguauucugacugucagaugc

SEQ ID NO: 1977175 - RNA, 18 nt, Shigella flexneri 2a str. 301
cguauugguacauaacac

SEQ ID NO: 1977176 - RNA, 15 nt, Shigella flexneri 2a str. 301
cguauuucagcccca

SEQ ID NO: 1977177 - RNA, 14 nt, Shigella flexneri 2a str. 301
cguauuuauuuucc

SEQ ID NO: 1977178 - RNA, 21 nt, Shigella flexneri 2a str. 301
cgucacuggugugucaucugc

SEQ ID NO: 1977179 - RNA, 14 nt, Shigella flexneri 2a str. 301
cgucacgaucgcgc

SEQ ID NO: 1977180 - RNA, 22 nt, Shigella flexneri 2a str. 301
cgucacgaagcauugcgccugc

SEQ ID NO: 1977181 - RNA, 15 nt, Shigella flexneri 2a str. 301
cgucaccuugccagu

SEQ ID NO: 1977182 - RNA, 14 nt, Shigella flexneri 2a str. 301
cgucaccugcccgg

SEQ ID NO: 1977183 - RNA, 14 nt, Shigella flexneri 2a str. 301
cgugccgcagcuuc

SEQ ID NO: 1977184 - RNA, 16 nt, Shigella flexneri 2a str. 301
cgugcucgaacauccc

SEQ ID NO: 1977185 - RNA, 17 nt, Shigella flexneri 2a str. 301
cgugaucguggccauga

SEQ ID NO: 1977186 - RNA, 22 nt, Shigella flexneri 2a str. 301
cgugaucgucuucaaccgcagu

SEQ ID NO: 1977187 - RNA, 20 nt, Shigella flexneri 2a str. 301
cgugagggaaacaacaccgu

SEQ ID NO: 1977188 - RNA, 11 nt, Shigella flexneri 2a str. 301
cgugagcuggg

SEQ ID NO: 1977189 - RNA, 21 nt, Shigella flexneri 2a str. 301
cgugagcguauuggugaauug

SEQ ID NO: 1977190 - RNA, 17 nt, Shigella flexneri 2a str. 301
cgugcagcuuucccuuc

SEQ ID NO: 1977191 - RNA, 17 nt, Shigella flexneri 2a str. 301
cgugcagcgcaaucgcc

SEQ ID NO: 1977192 - RNA, 22 nt, Shigella flexneri 2a str. 301
cgucuucugguugcgaaaaaau

SEQ ID NO: 1977193 - RNA, 13 nt, Shigella flexneri 2a str. 301
cgugaagcuggca

SEQ ID NO: 1977194 - RNA, 19 nt, Shigella flexneri 2a str. 301
cgucuuugcguuccaucag

SEQ ID NO: 1977195 - RNA, 11 nt, Shigella flexneri 2a str. 301
cgugaagaugc

SEQ ID NO: 1977196 - RNA, 18 nt, Shigella flexneri 2a str. 301
cgugaagaugccaacugg

SEQ ID NO: 1977197 - RNA, 17 nt, Shigella flexneri 2a str. 301
cgucuuugguauaguga

SEQ ID NO: 1977198 - RNA, 20 nt, Shigella flexneri 2a str. 301
cgugaauuuuaggaugcugc

SEQ ID NO: 1977199 - RNA, 21 nt, Shigella flexneri 2a str. 301
cgugaaugccguaggcccagc

SEQ ID NO: 1977200 - RNA, 15 nt, Shigella flexneri 2a str. 301
cgugaagcagagcag

SEQ ID NO: 1977201 - RNA, 16 nt, Shigella flexneri 2a str. 301
cgugaagguugcgccu

SEQ ID NO: 1977202 - RNA, 15 nt, Shigella flexneri 2a str. 301
cgugacuaaaacccu

SEQ ID NO: 1977203 - RNA, 14 nt, Shigella flexneri 2a str. 301
cgugacuaaaaccc

SEQ ID NO: 1977204 - RNA, 15 nt, Shigella flexneri 2a str. 301
cgucucaaucaccac

SEQ ID NO: 1977205 - RNA, 22 nt, Shigella flexneri 2a str. 301
cgucucaaucaccaccagcgga

SEQ ID NO: 1977206 - RNA, 23 nt, Shigella flexneri 2a str. 301
cgucucagcgccgcuuuccaggc

SEQ ID NO: 1977207 - RNA, 14 nt, Shigella flexneri 2a str. 301
cgucuacaaaaacu

SEQ ID NO: 1977208 - RNA, 14 nt, Shigella flexneri 2a str. 301
cgucucccgaugcc

SEQ ID NO: 1977209 - RNA, 16 nt, Shigella flexneri 2a str. 301
cgucuccugccgagcg

SEQ ID NO: 1977210 - RNA, 23 nt, Shigella flexneri 2a str. 301
cgucugguaucgcgccagccagu

SEQ ID NO: 1977211 - RNA, 18 nt, Shigella flexneri 2a str. 301
cgucuggcagauccugaa

SEQ ID NO: 1977212 - RNA, 19 nt, Shigella flexneri 2a str. 301
cgucggcgucaucgacauc

SEQ ID NO: 1977213 - RNA, 17 nt, Shigella flexneri 2a str. 301
cgucggcuuucagcgcg

SEQ ID NO: 1977214 - RNA, 17 nt, Shigella flexneri 2a str. 301
cgucgguguccacuucc

SEQ ID NO: 1977215 - RNA, 23 nt, Shigella flexneri 2a str. 301
cgucgguucagggcaucaucauu

SEQ ID NO: 1977216 - RNA, 20 nt, Shigella flexneri 2a str. 301
cgucgucagcaguucacgca

SEQ ID NO: 1977217 - RNA, 15 nt, Shigella flexneri 2a str. 301
cgucgucccuuccgc

SEQ ID NO: 1977218 - RNA, 15 nt, Shigella flexneri 2a str. 301
cgucgucgugaagca

SEQ ID NO: 1977219 - RNA, 19 nt, Shigella flexneri 2a str. 301
cgucguuacugucgcgcag

SEQ ID NO: 1977220 - RNA, 14 nt, Shigella flexneri 2a str. 301
cgucgugaagcaga

SEQ ID NO: 1977221 - RNA, 19 nt, Shigella flexneri 2a str. 301
cgucguggcaaaaugcauc

SEQ ID NO: 1977222 - RNA, 14 nt, Shigella flexneri 2a str. 301
cgucgcccgaugca

SEQ ID NO: 1977223 - RNA, 18 nt, Shigella flexneri 2a str. 301
cgucgcaucaggcauugu

SEQ ID NO: 1977224 - RNA, 16 nt, Shigella flexneri 2a str. 301
cgucgcaucaggcaug

SEQ ID NO: 1977225 - RNA, 19 nt, Shigella flexneri 2a str. 301
cgucgccgcuuucggcgca

SEQ ID NO: 1977226 - RNA, 21 nt, Shigella flexneri 2a str. 301
cgucgcuuaauugaccugccg

SEQ ID NO: 1977227 - RNA, 12 nt, Shigella flexneri 2a str. 301
cgucgcuuuaua

SEQ ID NO: 1977228 - RNA, 17 nt, Shigella flexneri 2a str. 301
cuaaccgcuuuuccagc

SEQ ID NO: 1977229 - RNA, 15 nt, Shigella flexneri 2a str. 301
cuaacgaaagaacag

SEQ ID NO: 1977230 - RNA, 19 nt, Shigella flexneri 2a str. 301
cuaacggugcacgcuuuau

SEQ ID NO: 1977231 - RNA, 20 nt, Shigella flexneri 2a str. 301
cuaacgcgucuuaucuggcc

SEQ ID NO: 1977232 - RNA, 20 nt, Shigella flexneri 2a str. 301
cuaacucauuuuuuaauaug

SEQ ID NO: 1977233 - RNA, 15 nt, Shigella flexneri 2a str. 301
cuaacuucuuuuucg

SEQ ID NO: 1977234 - RNA, 14 nt, Shigella flexneri 2a str. 301
cuaacugacuuccg

SEQ ID NO: 1977235 - RNA, 20 nt, Shigella flexneri 2a str. 301
cuaacagaacaauaauaacu

SEQ ID NO: 1977236 - RNA, 16 nt, Shigella flexneri 2a str. 301
cuaacagagccgcgau

SEQ ID NO: 1977237 - RNA, 19 nt, Shigella flexneri 2a str. 301
cuaacacaugcaagucgaa

SEQ ID NO: 1977238 - RNA, 17 nt, Shigella flexneri 2a str. 301
cuaacccucuccccaag

SEQ ID NO: 1977239 - RNA, 19 nt, Shigella flexneri 2a str. 301
cuaacccucuccccaaggg

SEQ ID NO: 1977240 - RNA, 15 nt, Shigella flexneri 2a str. 301
cuaacccucucccca

SEQ ID NO: 1977241 - RNA, 15 nt, Shigella flexneri 2a str. 301
cuaaccgaauucaaa

SEQ ID NO: 1977242 - RNA, 20 nt, Shigella flexneri 2a str. 301
cuaacccgcgucugcgugcg

SEQ ID NO: 1977243 - RNA, 23 nt, Shigella flexneri 2a str. 301
cuaaccauuauuaaauuuaauaa

SEQ ID NO: 1977244 - RNA, 17 nt, Shigella flexneri 2a str. 301
cuaagcugcguagcuca

SEQ ID NO: 1977245 - RNA, 17 nt, Shigella flexneri 2a str. 301
cuaaggucaccaguuca

SEQ ID NO: 1977246 - RNA, 24 nt, Shigella flexneri 2a str. 301
cuaagcgcacuuugucaucagucu

SEQ ID NO: 1977247 - RNA, 19 nt, Shigella flexneri 2a str. 301
cuaagcgccaccgucagug

SEQ ID NO: 1977248 - RNA, 16 nt, Shigella flexneri 2a str. 301
cuaagccgugcauaac

SEQ ID NO: 1977249 - RNA, 14 nt, Shigella flexneri 2a str. 301
cuaagcgaacuguu

SEQ ID NO: 1977250 - RNA, 15 nt, Shigella flexneri 2a str. 301
cuaagaagucauugg

SEQ ID NO: 1977251 - RNA, 19 nt, Shigella flexneri 2a str. 301
cuaagaagccuuuaucugg

SEQ ID NO: 1977252 - RNA, 15 nt, Shigella flexneri 2a str. 301
cuaauggugaacuga

SEQ ID NO: 1977253 - RNA, 15 nt, Shigella flexneri 2a str. 301
cuaauuuuucccgac

SEQ ID NO: 1977254 - RNA, 22 nt, Shigella flexneri 2a str. 301
cuaauuucgccgaggcgcuggc

SEQ ID NO: 1977255 - RNA, 15 nt, Shigella flexneri 2a str. 301
cuaauuuuuguuguu

SEQ ID NO: 1977256 - RNA, 13 nt, Shigella flexneri 2a str. 301
cuacaaaaccugc

SEQ ID NO: 1977257 - RNA, 18 nt, Shigella flexneri 2a str. 301
cuacaaacguugcugacu

SEQ ID NO: 1977258 - RNA, 15 nt, Shigella flexneri 2a str. 301
cuacaaauuugugca

SEQ ID NO: 1977259 - RNA, 22 nt, Shigella flexneri 2a str. 301
cuacaaauuugugcaaauucaa

SEQ ID NO: 1977260 - RNA, 23 nt, Shigella flexneri 2a str. 301
cuacaaauuugugcaaauucaau

SEQ ID NO: 1977261 - RNA, 14 nt, Shigella flexneri 2a str. 301
cuacaagcagagag

SEQ ID NO: 1977262 - RNA, 22 nt, Shigella flexneri 2a str. 301
cuacaacuccguugaaauugcu

SEQ ID NO: 1977263 - RNA, 17 nt, Shigella flexneri 2a str. 301
cuaauaauugccccuug

SEQ ID NO: 1977264 - RNA, 15 nt, Shigella flexneri 2a str. 301
cuaauaaugagcaga

SEQ ID NO: 1977265 - RNA, 16 nt, Shigella flexneri 2a str. 301
cuaauaaugagcagaa

SEQ ID NO: 1977266 - RNA, 15 nt, Shigella flexneri 2a str. 301
cuaauaaaucuaaaa

SEQ ID NO: 1977267 - RNA, 16 nt, Shigella flexneri 2a str. 301
cuaauacaccaucaug

SEQ ID NO: 1977268 - RNA, 15 nt, Shigella flexneri 2a str. 301
cuaaucaucaucagu

SEQ ID NO: 1977269 - RNA, 23 nt, Shigella flexneri 2a str. 301
cuaaucaucuguugugccacauc

SEQ ID NO: 1977270 - RNA, 15 nt, Shigella flexneri 2a str. 301
cuaaucagcuuuucc

SEQ ID NO: 1977271 - RNA, 16 nt, Shigella flexneri 2a str. 301
cuaaucaauuuuucau

SEQ ID NO: 1977272 - RNA, 15 nt, Shigella flexneri 2a str. 301
cuaaugccugagaca

SEQ ID NO: 1977273 - RNA, 17 nt, Shigella flexneri 2a str. 301
cuaaucucuucaccaua

SEQ ID NO: 1977274 - RNA, 11 nt, Shigella flexneri 2a str. 301
cuaaucugaau

SEQ ID NO: 1977275 - RNA, 15 nt, Shigella flexneri 2a str. 301
cuaaucgcacaaaau

SEQ ID NO: 1977276 - RNA, 15 nt, Shigella flexneri 2a str. 301
cuaauccugaagacg

SEQ ID NO: 1977277 - RNA, 23 nt, Shigella flexneri 2a str. 301
cuaaucguccgauuaaaaacccu

SEQ ID NO: 1977278 - RNA, 17 nt, Shigella flexneri 2a str. 301
cguugugcgcgacauac

SEQ ID NO: 1977279 - RNA, 17 nt, Shigella flexneri 2a str. 301
cguugugcgauccacgc

SEQ ID NO: 1977280 - RNA, 18 nt, Shigella flexneri 2a str. 301
cguugugacuuugugaag

SEQ ID NO: 1977281 - RNA, 20 nt, Shigella flexneri 2a str. 301
cguugcaauacuuccgcuuc

SEQ ID NO: 1977282 - RNA, 21 nt, Shigella flexneri 2a str. 301
cguugauuuugucauggcgca

SEQ ID NO: 1977283 - RNA, 19 nt, Shigella flexneri 2a str. 301
cguugauucacuuucugaa

SEQ ID NO: 1977284 - RNA, 19 nt, Shigella flexneri 2a str. 301
cguugcaggaaccgcauac

SEQ ID NO: 1977285 - RNA, 20 nt, Shigella flexneri 2a str. 301
cguuuggggguaacccaccg

SEQ ID NO: 1977286 - RNA, 13 nt, Shigella flexneri 2a str. 301
cguuugucaucag

SEQ ID NO: 1977287 - RNA, 19 nt, Shigella flexneri 2a str. 301
cguuuuacgcgucacgccu

SEQ ID NO: 1977288 - RNA, 20 nt, Shigella flexneri 2a str. 301
cguuucgaauuacacagcca

SEQ ID NO: 1977289 - RNA, 11 nt, Shigella flexneri 2a str. 301
cguuucccugu

SEQ ID NO: 1977290 - RNA, 16 nt, Shigella flexneri 2a str. 301
cguuuuuugaaacagg

SEQ ID NO: 1977291 - RNA, 13 nt, Shigella flexneri 2a str. 301
cguuuuuuuucug

SEQ ID NO: 1977292 - RNA, 21 nt, Shigella flexneri 2a str. 301
cguuuuuaucuucacacacau

SEQ ID NO: 1977293 - RNA, 14 nt, Shigella flexneri 2a str. 301
cguuuuacagcaac

SEQ ID NO: 1977294 - RNA, 15 nt, Shigella flexneri 2a str. 301
cguuuuaguaacaac

SEQ ID NO: 1977295 - RNA, 22 nt, Shigella flexneri 2a str. 301
cguuuuauaacggcuggccaca

SEQ ID NO: 1977296 - RNA, 22 nt, Shigella flexneri 2a str. 301
cguuuucagguuacgcccuuca

SEQ ID NO: 1977297 - RNA, 17 nt, Shigella flexneri 2a str. 301
cguuuucaaccagccga

SEQ ID NO: 1977298 - RNA, 19 nt, Shigella flexneri 2a str. 301
cguuuucguuacuccgcca

SEQ ID NO: 1977299 - RNA, 20 nt, Shigella flexneri 2a str. 301
cuaaaaaauuaacaaaacaa

SEQ ID NO: 1977300 - RNA, 12 nt, Shigella flexneri 2a str. 301
cuaaaaaauccc

SEQ ID NO: 1977301 - RNA, 13 nt, Shigella flexneri 2a str. 301
cuaaaaaaugacg

SEQ ID NO: 1977302 - RNA, 20 nt, Shigella flexneri 2a str. 301
cuaaaagcgauuauuuauuc

SEQ ID NO: 1977303 - RNA, 18 nt, Shigella flexneri 2a str. 301
cuaaaaguuuuagcaugc

SEQ ID NO: 1977304 - RNA, 15 nt, Shigella flexneri 2a str. 301
cguuacccagcacgg

SEQ ID NO: 1977305 - RNA, 20 nt, Shigella flexneri 2a str. 301
cguuaccacaaugcaauaau

SEQ ID NO: 1977306 - RNA, 16 nt, Shigella flexneri 2a str. 301
cguuaauuucuuuuca

SEQ ID NO: 1977307 - RNA, 23 nt, Shigella flexneri 2a str. 301
cguggaugcgauguucccccagc

SEQ ID NO: 1977308 - RNA, 13 nt, Shigella flexneri 2a str. 301
cguggaugggacu

SEQ ID NO: 1977309 - RNA, 22 nt, Shigella flexneri 2a str. 301
cgugcugguggucagcagcuuu

SEQ ID NO: 1977310 - RNA, 22 nt, Shigella flexneri 2a str. 301
cgugcuguuaauaucuuucugc

SEQ ID NO: 1977311 - RNA, 18 nt, Shigella flexneri 2a str. 301
cguggcaugacgcagguc

SEQ ID NO: 1977312 - RNA, 15 nt, Shigella flexneri 2a str. 301
cguggcaucgggcac

SEQ ID NO: 1977313 - RNA, 18 nt, Shigella flexneri 2a str. 301
cguuacgccccaacacaa

SEQ ID NO: 1977314 - RNA, 22 nt, Shigella flexneri 2a str. 301
cguuacuacagaggguuuuuua

SEQ ID NO: 1977315 - RNA, 16 nt, Shigella flexneri 2a str. 301
cguuacucuccggacu

SEQ ID NO: 1977316 - RNA, 16 nt, Shigella flexneri 2a str. 301
cguuacugucgcgcag

SEQ ID NO: 1977317 - RNA, 21 nt, Shigella flexneri 2a str. 301
cguuacgacgcaaucaaaaaa

SEQ ID NO: 1977318 - RNA, 13 nt, Shigella flexneri 2a str. 301
cguuacgcagcau

SEQ ID NO: 1977319 - RNA, 16 nt, Shigella flexneri 2a str. 301
cguuaccggguguucu

SEQ ID NO: 1977320 - RNA, 22 nt, Shigella flexneri 2a str. 301
cguuagaaaacgccugcuccuc

SEQ ID NO: 1977321 - RNA, 19 nt, Shigella flexneri 2a str. 301
cguuauaucccauuuuuga

SEQ ID NO: 1977322 - RNA, 18 nt, Shigella flexneri 2a str. 301
cguuagugucuuaucugg

SEQ ID NO: 1977323 - RNA, 12 nt, Shigella flexneri 2a str. 301
cguuagugucuu

SEQ ID NO: 1977324 - RNA, 13 nt, Shigella flexneri 2a str. 301
cguuaguguggcc

SEQ ID NO: 1977325 - RNA, 19 nt, Shigella flexneri 2a str. 301
cguuaucccaucccacuca

SEQ ID NO: 1977326 - RNA, 13 nt, Shigella flexneri 2a str. 301
cguuaucacagca

SEQ ID NO: 1977327 - RNA, 12 nt, Shigella flexneri 2a str. 301
cguuaucaccug

SEQ ID NO: 1977328 - RNA, 20 nt, Shigella flexneri 2a str. 301
cguuauccggcuaacaaaau

SEQ ID NO: 1977329 - RNA, 22 nt, Shigella flexneri 2a str. 301
cguuauggcgugagcugccucg

SEQ ID NO: 1977330 - RNA, 16 nt, Shigella flexneri 2a str. 301
cguuauguaacaacug

SEQ ID NO: 1977331 - RNA, 15 nt, Shigella flexneri 2a str. 301
cguuaugucucccgc

SEQ ID NO: 1977332 - RNA, 21 nt, Shigella flexneri 2a str. 301
cguucaaaacggcuggugauu

SEQ ID NO: 1977333 - RNA, 15 nt, Shigella flexneri 2a str. 301
cguucaaaacggcug

SEQ ID NO: 1977334 - RNA, 21 nt, Shigella flexneri 2a str. 301
cguucaccgaagacgugcgcc

SEQ ID NO: 1977335 - RNA, 11 nt, Shigella flexneri 2a str. 301
cguucacgccg

SEQ ID NO: 1977336 - RNA, 13 nt, Shigella flexneri 2a str. 301
cguucacugccac

SEQ ID NO: 1977337 - RNA, 23 nt, Shigella flexneri 2a str. 301
cguuccccagaagcuuuccaucg

SEQ ID NO: 1977338 - RNA, 23 nt, Shigella flexneri 2a str. 301
cguuccccaggguuucuccguca

SEQ ID NO: 1977339 - RNA, 15 nt, Shigella flexneri 2a str. 301
cguucauccaacaau

SEQ ID NO: 1977340 - RNA, 11 nt, Shigella flexneri 2a str. 301
cguucauccca

SEQ ID NO: 1977341 - RNA, 13 nt, Shigella flexneri 2a str. 301
cguucauccugcu

SEQ ID NO: 1977342 - RNA, 17 nt, Shigella flexneri 2a str. 301
cguucagccauacguug

SEQ ID NO: 1977343 - RNA, 15 nt, Shigella flexneri 2a str. 301
cguucagucgccggg

SEQ ID NO: 1977344 - RNA, 19 nt, Shigella flexneri 2a str. 301
cguucauauggagcaaaag

SEQ ID NO: 1977345 - RNA, 19 nt, Shigella flexneri 2a str. 301
cguuccuucaggacccuua

SEQ ID NO: 1977346 - RNA, 11 nt, Shigella flexneri 2a str. 301
cguuccuggcu

SEQ ID NO: 1977347 - RNA, 22 nt, Shigella flexneri 2a str. 301
cguugauaaacguacauccaug

SEQ ID NO: 1977348 - RNA, 13 nt, Shigella flexneri 2a str. 301
cguugaucgcuuu

SEQ ID NO: 1977349 - RNA, 22 nt, Shigella flexneri 2a str. 301
cguugaggauggcgucgauaau

SEQ ID NO: 1977350 - RNA, 21 nt, Shigella flexneri 2a str. 301
cugacagauguaaacuuuuuc

SEQ ID NO: 1977351 - RNA, 21 nt, Shigella flexneri 2a str. 301
cugacauaaacaccagcaaua

SEQ ID NO: 1977352 - RNA, 13 nt, Shigella flexneri 2a str. 301
cugacauaaacac

SEQ ID NO: 1977353 - RNA, 16 nt, Shigella flexneri 2a str. 301
cugaauuucagcgccu

SEQ ID NO: 1977354 - RNA, 19 nt, Shigella flexneri 2a str. 301
cugaauuucagcgccugau

SEQ ID NO: 1977355 - RNA, 21 nt, Shigella flexneri 2a str. 301
cugaauuucagcgccugauac

SEQ ID NO: 1977356 - RNA, 14 nt, Shigella flexneri 2a str. 301
cugaauuugaccuu

SEQ ID NO: 1977357 - RNA, 14 nt, Shigella flexneri 2a str. 301
cugacccuugaugu

SEQ ID NO: 1977358 - RNA, 17 nt, Shigella flexneri 2a str. 301
cugacauuaucagacac

SEQ ID NO: 1977359 - RNA, 15 nt, Shigella flexneri 2a str. 301
cugaccgcacacccc

SEQ ID NO: 1977360 - RNA, 18 nt, Shigella flexneri 2a str. 301
cugacgaccaaugacagc

SEQ ID NO: 1977361 - RNA, 20 nt, Shigella flexneri 2a str. 301
cugacgaccacccagcaucu

SEQ ID NO: 1977362 - RNA, 20 nt, Shigella flexneri 2a str. 301
cugaccgucaccccauugaa

SEQ ID NO: 1977363 - RNA, 14 nt, Shigella flexneri 2a str. 301
cugaccguacccgc

SEQ ID NO: 1977364 - RNA, 18 nt, Shigella flexneri 2a str. 301
cugaccggauugaucggu

SEQ ID NO: 1977365 - RNA, 13 nt, Shigella flexneri 2a str. 301
cugacguagcagc

SEQ ID NO: 1977366 - RNA, 19 nt, Shigella flexneri 2a str. 301
cugacggugauacagcaaa

SEQ ID NO: 1977367 - RNA, 14 nt, Shigella flexneri 2a str. 301
cugacgugauuuag

SEQ ID NO: 1977368 - RNA, 14 nt, Shigella flexneri 2a str. 301
cugacguaacgacc

SEQ ID NO: 1977369 - RNA, 21 nt, Shigella flexneri 2a str. 301
cugacuguguuagccuggaag

SEQ ID NO: 1977370 - RNA, 22 nt, Shigella flexneri 2a str. 301
cugacuguguuagccuggaagu

SEQ ID NO: 1977371 - RNA, 15 nt, Shigella flexneri 2a str. 301
cugacugcgggcgaa

SEQ ID NO: 1977372 - RNA, 17 nt, Shigella flexneri 2a str. 301
cugacugucgcagccag

SEQ ID NO: 1977373 - RNA, 19 nt, Shigella flexneri 2a str. 301
cugacggugauaaucaucc

SEQ ID NO: 1977374 - RNA, 22 nt, Shigella flexneri 2a str. 301
cugacgaggcgucagcguucca

SEQ ID NO: 1977375 - RNA, 17 nt, Shigella flexneri 2a str. 301
cugaaugauaacuucua

SEQ ID NO: 1977376 - RNA, 21 nt, Shigella flexneri 2a str. 301
cugaaugccccuuuaaauacc

SEQ ID NO: 1977377 - RNA, 16 nt, Shigella flexneri 2a str. 301
cugaaugcucugaggc

SEQ ID NO: 1977378 - RNA, 23 nt, Shigella flexneri 2a str. 301
cugaauggcgauuucacaagacu

SEQ ID NO: 1977379 - RNA, 23 nt, Shigella flexneri 2a str. 301
cugaauaugagucguaaacaacu

SEQ ID NO: 1977380 - RNA, 15 nt, Shigella flexneri 2a str. 301
cugaauaucuuucuc

SEQ ID NO: 1977381 - RNA, 17 nt, Shigella flexneri 2a str. 301
cugaauauccugacuuu

SEQ ID NO: 1977382 - RNA, 16 nt, Shigella flexneri 2a str. 301
cugaauauguaagauc

SEQ ID NO: 1977383 - RNA, 24 nt, Shigella flexneri 2a str. 301
cugaauauucggcuccagauuacu

SEQ ID NO: 1977384 - RNA, 15 nt, Shigella flexneri 2a str. 301
cugaaugauaacuuc

SEQ ID NO: 1977385 - RNA, 16 nt, Shigella flexneri 2a str. 301
cugaaucacgccgccc

SEQ ID NO: 1977386 - RNA, 18 nt, Shigella flexneri 2a str. 301
cugaauccaucuguaucc

SEQ ID NO: 1977387 - RNA, 16 nt, Shigella flexneri 2a str. 301
cucuacagcgcccgcc

SEQ ID NO: 1977388 - RNA, 14 nt, Shigella flexneri 2a str. 301
cucuacaggaaugg

SEQ ID NO: 1977389 - RNA, 21 nt, Shigella flexneri 2a str. 301
cucuacaauauccucaagcgu

SEQ ID NO: 1977390 - RNA, 19 nt, Shigella flexneri 2a str. 301
cugaauaacaccagccaga

SEQ ID NO: 1977391 - RNA, 11 nt, Shigella flexneri 2a str. 301
cugaauaaucg

SEQ ID NO: 1977392 - RNA, 19 nt, Shigella flexneri 2a str. 301
cugaauaaacucaccaaau

SEQ ID NO: 1977393 - RNA, 12 nt, Shigella flexneri 2a str. 301
cugaauacgcug

SEQ ID NO: 1977394 - RNA, 15 nt, Shigella flexneri 2a str. 301
cugauuugcuucaau

SEQ ID NO: 1977395 - RNA, 18 nt, Shigella flexneri 2a str. 301
cugauuuucaucuucuuc

SEQ ID NO: 1977396 - RNA, 12 nt, Shigella flexneri 2a str. 301
cugauuuuccuc

SEQ ID NO: 1977397 - RNA, 17 nt, Shigella flexneri 2a str. 301
cugauuuuccuccagca

SEQ ID NO: 1977398 - RNA, 22 nt, Shigella flexneri 2a str. 301
cugauuuuccuccagcagcaca

SEQ ID NO: 1977399 - RNA, 17 nt, Shigella flexneri 2a str. 301
cugauuuugcaacaacu

SEQ ID NO: 1977400 - RNA, 19 nt, Shigella flexneri 2a str. 301
cugauucaaaaccgguucu

SEQ ID NO: 1977401 - RNA, 19 nt, Shigella flexneri 2a str. 301
cugauucaugaacuguaca

SEQ ID NO: 1977402 - RNA, 22 nt, Shigella flexneri 2a str. 301
cugauuauccgcaucacuccac

SEQ ID NO: 1977403 - RNA, 17 nt, Shigella flexneri 2a str. 301
cugauuaccgugaauca

SEQ ID NO: 1977404 - RNA, 20 nt, Shigella flexneri 2a str. 301
cugauuacgcaccgggcagg

SEQ ID NO: 1977405 - RNA, 17 nt, Shigella flexneri 2a str. 301
cugauguuguuucucuu

SEQ ID NO: 1977406 - RNA, 19 nt, Shigella flexneri 2a str. 301
cugaugugacgcugucuua

SEQ ID NO: 1977407 - RNA, 16 nt, Shigella flexneri 2a str. 301
cugauggacauucucc

SEQ ID NO: 1977408 - RNA, 16 nt, Shigella flexneri 2a str. 301
cugaugauauuuuucc

SEQ ID NO: 1977409 - RNA, 23 nt, Shigella flexneri 2a str. 301
cugauggcuguuuucagcaccag

SEQ ID NO: 1977410 - RNA, 21 nt, Shigella flexneri 2a str. 301
cugauggcggcugguuaaaua

SEQ ID NO: 1977411 - RNA, 18 nt, Shigella flexneri 2a str. 301
cugauggcgggaugugua

SEQ ID NO: 1977412 - RNA, 16 nt, Shigella flexneri 2a str. 301
cugaugggaugggcau

SEQ ID NO: 1977413 - RNA, 22 nt, Shigella flexneri 2a str. 301
cugaugggaugggcauuucugc

SEQ ID NO: 1977414 - RNA, 20 nt, Shigella flexneri 2a str. 301
cugauguaaucaacuccgcc

SEQ ID NO: 1977415 - RNA, 21 nt, Shigella flexneri 2a str. 301
cugaugacuaaagucuaaaaa

SEQ ID NO: 1977416 - RNA, 22 nt, Shigella flexneri 2a str. 301
cugaugacgcgcuagugcauug

SEQ ID NO: 1977417 - RNA, 20 nt, Shigella flexneri 2a str. 301
cugaugaacgcgcaggucau

SEQ ID NO: 1977418 - RNA, 16 nt, Shigella flexneri 2a str. 301
cugaugaauaaauaca

SEQ ID NO: 1977419 - RNA, 15 nt, Shigella flexneri 2a str. 301
cugauaguuaaaauu

SEQ ID NO: 1977420 - RNA, 22 nt, Shigella flexneri 2a str. 301
cugauagugauccaucagguag

SEQ ID NO: 1977421 - RNA, 17 nt, Shigella flexneri 2a str. 301
cugauaucucaccagau

SEQ ID NO: 1977422 - RNA, 13 nt, Shigella flexneri 2a str. 301
cugagccugccau

SEQ ID NO: 1977423 - RNA, 20 nt, Shigella flexneri 2a str. 301
cugacuuugccccagcggga

SEQ ID NO: 1977424 - RNA, 15 nt, Shigella flexneri 2a str. 301
cugagaaaaagcgaa

SEQ ID NO: 1977425 - RNA, 13 nt, Shigella flexneri 2a str. 301
cugacuuuauacc

SEQ ID NO: 1977426 - RNA, 15 nt, Shigella flexneri 2a str. 301
cugacuuuauaccuu

SEQ ID NO: 1977427 - RNA, 17 nt, Shigella flexneri 2a str. 301
cugagcggcgggcuuua

SEQ ID NO: 1977428 - RNA, 19 nt, Shigella flexneri 2a str. 301
cugagcggccuuuuccuuu

SEQ ID NO: 1977429 - RNA, 13 nt, Shigella flexneri 2a str. 301
cugaggccgccac

SEQ ID NO: 1977430 - RNA, 13 nt, Shigella flexneri 2a str. 301
cugaggcaauaau

SEQ ID NO: 1977431 - RNA, 15 nt, Shigella flexneri 2a str. 301
cugaggcaauaauga

SEQ ID NO: 1977432 - RNA, 16 nt, Shigella flexneri 2a str. 301
cugaggcaauaaugac

SEQ ID NO: 1977433 - RNA, 12 nt, Shigella flexneri 2a str. 301
cugagcuggcag

SEQ ID NO: 1977434 - RNA, 18 nt, Shigella flexneri 2a str. 301
cugagcuggcagaccugc

SEQ ID NO: 1977435 - RNA, 18 nt, Shigella flexneri 2a str. 301
cugagcuccugcauugac

SEQ ID NO: 1977436 - RNA, 21 nt, Shigella flexneri 2a str. 301
cugauaaaaaccauucaggcu

SEQ ID NO: 1977437 - RNA, 14 nt, Shigella flexneri 2a str. 301
cugagucagaaacu

SEQ ID NO: 1977438 - RNA, 13 nt, Shigella flexneri 2a str. 301
cugauaaaucccg

SEQ ID NO: 1977439 - RNA, 17 nt, Shigella flexneri 2a str. 301
cugauaacgugcagcuu

SEQ ID NO: 1977440 - RNA, 19 nt, Shigella flexneri 2a str. 301
cugauaacgugcagcuuuc

SEQ ID NO: 1977441 - RNA, 20 nt, Shigella flexneri 2a str. 301
cugauaagacgcgccagcgu

SEQ ID NO: 1977442 - RNA, 15 nt, Shigella flexneri 2a str. 301
cugauaggauuucug

SEQ ID NO: 1977443 - RNA, 21 nt, Shigella flexneri 2a str. 301
cugauagcguagcgccucagg

SEQ ID NO: 1977444 - RNA, 13 nt, Shigella flexneri 2a str. 301
cugcacgccagga

SEQ ID NO: 1977445 - RNA, 17 nt, Shigella flexneri 2a str. 301
cugcacgccaucuggcu

SEQ ID NO: 1977446 - RNA, 18 nt, Shigella flexneri 2a str. 301
cugcacgccaucuggcug

SEQ ID NO: 1977447 - RNA, 19 nt, Shigella flexneri 2a str. 301
cugcacgccaucuggcuga

SEQ ID NO: 1977448 - RNA, 19 nt, Shigella flexneri 2a str. 301
cugcacgguuuuuccagcu

SEQ ID NO: 1977449 - RNA, 19 nt, Shigella flexneri 2a str. 301
cugcacggugugcggcagg

SEQ ID NO: 1977450 - RNA, 20 nt, Shigella flexneri 2a str. 301
cugcacggucacaucgcuga

SEQ ID NO: 1977451 - RNA, 24 nt, Shigella flexneri 2a str. 301
cugcacggcuucccacgucagacc

SEQ ID NO: 1977452 - RNA, 20 nt, Shigella flexneri 2a str. 301
cugcacgucauacugcucag

SEQ ID NO: 1977453 - RNA, 19 nt, Shigella flexneri 2a str. 301
cugcaccauugcugccgcc

SEQ ID NO: 1977454 - RNA, 13 nt, Shigella flexneri 2a str. 301
cugcaccauugcu

SEQ ID NO: 1977455 - RNA, 14 nt, Shigella flexneri 2a str. 301
cugcaaaucaccac

SEQ ID NO: 1977456 - RNA, 20 nt, Shigella flexneri 2a str. 301
cugcaaaucgaucucaauga

SEQ ID NO: 1977457 - RNA, 15 nt, Shigella flexneri 2a str. 301
cugauuuuuuuucaa

SEQ ID NO: 1977458 - RNA, 22 nt, Shigella flexneri 2a str. 301
cugcaaaucugcgccuacggca

SEQ ID NO: 1977459 - RNA, 15 nt, Shigella flexneri 2a str. 301
cugcaaauucaauaa

SEQ ID NO: 1977460 - RNA, 14 nt, Shigella flexneri 2a str. 301
cugcaccaggcggg

SEQ ID NO: 1977461 - RNA, 14 nt, Shigella flexneri 2a str. 301
cugcagcaucaccg

SEQ ID NO: 1977462 - RNA, 19 nt, Shigella flexneri 2a str. 301
cugcagcagccugcgcuuc

SEQ ID NO: 1977463 - RNA, 23 nt, Shigella flexneri 2a str. 301
cugcagcagccugcgcuucuuuu

SEQ ID NO: 1977464 - RNA, 21 nt, Shigella flexneri 2a str. 301
cugcacuuaacaggaucuggu

SEQ ID NO: 1977465 - RNA, 13 nt, Shigella flexneri 2a str. 301
cugcacucaggua

SEQ ID NO: 1977466 - RNA, 21 nt, Shigella flexneri 2a str. 301
cugcacuuugugucagcgcca

SEQ ID NO: 1977467 - RNA, 23 nt, Shigella flexneri 2a str. 301
cugcagcucaucuaaugcagggg

SEQ ID NO: 1977468 - RNA, 22 nt, Shigella flexneri 2a str. 301
cugcagcuccaguuucuuuugc

SEQ ID NO: 1977469 - RNA, 23 nt, Shigella flexneri 2a str. 301
cugcagcgcggcgagagcuuucg

SEQ ID NO: 1977470 - RNA, 16 nt, Shigella flexneri 2a str. 301
cugcaggaccauacug

SEQ ID NO: 1977471 - RNA, 13 nt, Shigella flexneri 2a str. 301
cugcaucaaccaa

SEQ ID NO: 1977472 - RNA, 12 nt, Shigella flexneri 2a str. 301
cugcaucaccau

SEQ ID NO: 1977473 - RNA, 20 nt, Shigella flexneri 2a str. 301
cugccguacaggcagcuuag

SEQ ID NO: 1977474 - RNA, 23 nt, Shigella flexneri 2a str. 301
cugccguacaggcagcuuagaaa

SEQ ID NO: 1977475 - RNA, 15 nt, Shigella flexneri 2a str. 301
cugccguacaggcag

SEQ ID NO: 1977476 - RNA, 23 nt, Shigella flexneri 2a str. 301
cugccguaauagauccuuuuucc

SEQ ID NO: 1977477 - RNA, 17 nt, Shigella flexneri 2a str. 301
cugccggaaccagccag

SEQ ID NO: 1977478 - RNA, 15 nt, Shigella flexneri 2a str. 301
cugccggaacgugca

SEQ ID NO: 1977479 - RNA, 19 nt, Shigella flexneri 2a str. 301
cugccggaacugccugcuc

SEQ ID NO: 1977480 - RNA, 11 nt, Shigella flexneri 2a str. 301
cugccgcuuca

SEQ ID NO: 1977481 - RNA, 19 nt, Shigella flexneri 2a str. 301
cugccggagggauguggcc

SEQ ID NO: 1977482 - RNA, 20 nt, Shigella flexneri 2a str. 301
cugccggacguucgcccacu

SEQ ID NO: 1977483 - RNA, 21 nt, Shigella flexneri 2a str. 301
cugccggcacaggcaucacuu

SEQ ID NO: 1977484 - RNA, 16 nt, Shigella flexneri 2a str. 301
cugccgccuuaaaccu

SEQ ID NO: 1977485 - RNA, 21 nt, Shigella flexneri 2a str. 301
cugccgcgcacgucagccucg

SEQ ID NO: 1977486 - RNA, 21 nt, Shigella flexneri 2a str. 301
cugccgcgcaggaugcagaaa

SEQ ID NO: 1977487 - RNA, 17 nt, Shigella flexneri 2a str. 301
cugccgcgccagaucag

SEQ ID NO: 1977488 - RNA, 18 nt, Shigella flexneri 2a str. 301
cugcccuugccaacgcaa

SEQ ID NO: 1977489 - RNA, 18 nt, Shigella flexneri 2a str. 301
cugccgagcgugcgggca

SEQ ID NO: 1977490 - RNA, 18 nt, Shigella flexneri 2a str. 301
cugcccguugccaggacc

SEQ ID NO: 1977491 - RNA, 19 nt, Shigella flexneri 2a str. 301
cugccauuggcaggcucug

SEQ ID NO: 1977492 - RNA, 12 nt, Shigella flexneri 2a str. 301
cugcccaaccgu

SEQ ID NO: 1977493 - RNA, 20 nt, Shigella flexneri 2a str. 301
cugcccccgcaugccuacca

SEQ ID NO: 1977494 - RNA, 23 nt, Shigella flexneri 2a str. 301
cugccacuuucucacucaccgca

SEQ ID NO: 1977495 - RNA, 13 nt, Shigella flexneri 2a str. 301
cugccagaaccgc

SEQ ID NO: 1977496 - RNA, 13 nt, Shigella flexneri 2a str. 301
cugccagcccgcc

SEQ ID NO: 1977497 - RNA, 15 nt, Shigella flexneri 2a str. 301
cugccagcucucaga

SEQ ID NO: 1977498 - RNA, 15 nt, Shigella flexneri 2a str. 301
cugccaggagcacgc

SEQ ID NO: 1977499 - RNA, 13 nt, Shigella flexneri 2a str. 301
cugcaucaccauc

SEQ ID NO: 1977500 - RNA, 11 nt, Shigella flexneri 2a str. 301
cugccaccagu

SEQ ID NO: 1977501 - RNA, 13 nt, Shigella flexneri 2a str. 301
cugccacgccacg

SEQ ID NO: 1977502 - RNA, 15 nt, Shigella flexneri 2a str. 301
cugccagaacaacca

SEQ ID NO: 1977503 - RNA, 23 nt, Shigella flexneri 2a str. 301
cugccagaacaaccagagcgccg

SEQ ID NO: 1977504 - RNA, 15 nt, Shigella flexneri 2a str. 301
cugccacuacccgca

SEQ ID NO: 1977505 - RNA, 16 nt, Shigella flexneri 2a str. 301
cugcggaaaaaagaaa

SEQ ID NO: 1977506 - RNA, 18 nt, Shigella flexneri 2a str. 301
cugcggaaucaccggcaa

SEQ ID NO: 1977507 - RNA, 21 nt, Shigella flexneri 2a str. 301
cugcggaauugccgguacagc

SEQ ID NO: 1977508 - RNA, 17 nt, Shigella flexneri 2a str. 301
cugcggacaaaacguga

SEQ ID NO: 1977509 - RNA, 16 nt, Shigella flexneri 2a str. 301
cugcggacgcaccgcg

SEQ ID NO: 1977510 - RNA, 23 nt, Shigella flexneri 2a str. 301
cugcggcaagaauuacuucuuga

SEQ ID NO: 1977511 - RNA, 21 nt, Shigella flexneri 2a str. 301
cugcgaccggcguaacggcca

SEQ ID NO: 1977512 - RNA, 15 nt, Shigella flexneri 2a str. 301
cugcgaccagaccag

SEQ ID NO: 1977513 - RNA, 20 nt, Shigella flexneri 2a str. 301
cugcgacagggaucucuucc

SEQ ID NO: 1977514 - RNA, 21 nt, Shigella flexneri 2a str. 301
cugcgacagggaucucuucca

SEQ ID NO: 1977515 - RNA, 21 nt, Shigella flexneri 2a str. 301
cugcgaauugagaugacgcca

SEQ ID NO: 1977516 - RNA, 17 nt, Shigella flexneri 2a str. 301
cugcgaaucgcuucauu

SEQ ID NO: 1977517 - RNA, 14 nt, Shigella flexneri 2a str. 301
cugcggguuagucu

SEQ ID NO: 1977518 - RNA, 16 nt, Shigella flexneri 2a str. 301
cugcggguuagucugc

SEQ ID NO: 1977519 - RNA, 22 nt, Shigella flexneri 2a str. 301
cugcggcgaugaccgccacggu

SEQ ID NO: 1977520 - RNA, 18 nt, Shigella flexneri 2a str. 301
cugcgggcgaccaaucaa

SEQ ID NO: 1977521 - RNA, 19 nt, Shigella flexneri 2a str. 301
cugcgucgacauagccauc

SEQ ID NO: 1977522 - RNA, 18 nt, Shigella flexneri 2a str. 301
cugcgucgcgcguaacau

SEQ ID NO: 1977523 - RNA, 19 nt, Shigella flexneri 2a str. 301
cugcgucgcuuuccagucg

SEQ ID NO: 1977524 - RNA, 13 nt, Shigella flexneri 2a str. 301
cugcuccagugca

SEQ ID NO: 1977525 - RNA, 21 nt, Shigella flexneri 2a str. 301
cugcucauugguccaucuuuu

SEQ ID NO: 1977526 - RNA, 15 nt, Shigella flexneri 2a str. 301
cugcucaucagcggu

SEQ ID NO: 1977527 - RNA, 22 nt, Shigella flexneri 2a str. 301
cugcuagggcgcguccggcguc

SEQ ID NO: 1977528 - RNA, 14 nt, Shigella flexneri 2a str. 301
cugcuagcuggcuc

SEQ ID NO: 1977529 - RNA, 19 nt, Shigella flexneri 2a str. 301
cugcuagcuggcucgacaa

SEQ ID NO: 1977530 - RNA, 22 nt, Shigella flexneri 2a str. 301
cugcuagcuggcucgacaaaau

SEQ ID NO: 1977531 - RNA, 21 nt, Shigella flexneri 2a str. 301
cugcuacggcaauucccagaa

SEQ ID NO: 1977532 - RNA, 17 nt, Shigella flexneri 2a str. 301
cugcguggcgcgcguca

SEQ ID NO: 1977533 - RNA, 15 nt, Shigella flexneri 2a str. 301
cugcguggaauuugu

SEQ ID NO: 1977534 - RNA, 16 nt, Shigella flexneri 2a str. 301
cugcguggaauuuguc

SEQ ID NO: 1977535 - RNA, 12 nt, Shigella flexneri 2a str. 301
cugcuaauuuau

SEQ ID NO: 1977536 - RNA, 23 nt, Shigella flexneri 2a str. 301
cugcugacgcagauccugauuua

SEQ ID NO: 1977537 - RNA, 19 nt, Shigella flexneri 2a str. 301
cugcugacgcagauccuga

SEQ ID NO: 1977538 - RNA, 23 nt, Shigella flexneri 2a str. 301
aaacuaucccagccuauaacgaa

SEQ ID NO: 1977539 - RNA, 14 nt, Shigella flexneri 2a str. 301
cugcucgcuggaag

SEQ ID NO: 1977540 - RNA, 23 nt, Shigella flexneri 2a str. 301
cugcucgcgguuaaguuccguga

SEQ ID NO: 1977541 - RNA, 18 nt, Shigella flexneri 2a str. 301
cugcuguacuuuuuccuu

SEQ ID NO: 1977542 - RNA, 24 nt, Shigella flexneri 2a str. 301
cugcuuccuuaaucccuggauuug

SEQ ID NO: 1977543 - RNA, 22 nt, Shigella flexneri 2a str. 301
cugcugguucggcaucgccgcu

SEQ ID NO: 1977544 - RNA, 14 nt, Shigella flexneri 2a str. 301
cugcugguucugcg

SEQ ID NO: 1977545 - RNA, 14 nt, Shigella flexneri 2a str. 301
cugcuggugaugga

SEQ ID NO: 1977546 - RNA, 19 nt, Shigella flexneri 2a str. 301
cugcuggggccaauaccug

SEQ ID NO: 1977547 - RNA, 16 nt, Shigella flexneri 2a str. 301
cugcugauccagcuuc

SEQ ID NO: 1977548 - RNA, 23 nt, Shigella flexneri 2a str. 301
cugcugaugcgccgcuaacgucu

SEQ ID NO: 1977549 - RNA, 11 nt, Shigella flexneri 2a str. 301
cugcuggccug

SEQ ID NO: 1977550 - RNA, 15 nt, Shigella flexneri 2a str. 301
cugcuggccuggcug

SEQ ID NO: 1977551 - RNA, 22 nt, Shigella flexneri 2a str. 301
cugcuggcuguaaaauuauccu

SEQ ID NO: 1977552 - RNA, 12 nt, Shigella flexneri 2a str. 301
cugcuucugccg

SEQ ID NO: 1977553 - RNA, 22 nt, Shigella flexneri 2a str. 301
cugcuucugccaguuguugcug

SEQ ID NO: 1977554 - RNA, 20 nt, Shigella flexneri 2a str. 301
cugcuugcucuggucugcca

SEQ ID NO: 1977555 - RNA, 17 nt, Shigella flexneri 2a str. 301
cugcuugcccagcaaaa

SEQ ID NO: 1977556 - RNA, 20 nt, Shigella flexneri 2a str. 301
cuggaagagcgacaaucccu

SEQ ID NO: 1977557 - RNA, 20 nt, Shigella flexneri 2a str. 301
cuggaagaaguaaacgccga

SEQ ID NO: 1977558 - RNA, 15 nt, Shigella flexneri 2a str. 301
cuggaacgaacccga

SEQ ID NO: 1977559 - RNA, 15 nt, Shigella flexneri 2a str. 301
cuggaacugguggau

SEQ ID NO: 1977560 - RNA, 18 nt, Shigella flexneri 2a str. 301
cugcuuguuccacuucau

SEQ ID NO: 1977561 - RNA, 18 nt, Shigella flexneri 2a str. 301
cuggauaaucacaauggu

SEQ ID NO: 1977562 - RNA, 21 nt, Shigella flexneri 2a str. 301
cuggauaaucacaauggucaa

SEQ ID NO: 1977563 - RNA, 22 nt, Shigella flexneri 2a str. 301
cuggauaaggcguuuacgccgc

SEQ ID NO: 1977564 - RNA, 15 nt, Shigella flexneri 2a str. 301
cuggaugccagcgaa

SEQ ID NO: 1977565 - RNA, 18 nt, Shigella flexneri 2a str. 301
cuggauauugcggaacau

SEQ ID NO: 1977566 - RNA, 13 nt, Shigella flexneri 2a str. 301
cuggcaaugaccc

SEQ ID NO: 1977567 - RNA, 13 nt, Shigella flexneri 2a str. 301
cuggcaaucgcca

SEQ ID NO: 1977568 - RNA, 15 nt, Shigella flexneri 2a str. 301
cuggcaauccagcuc

SEQ ID NO: 1977569 - RNA, 14 nt, Shigella flexneri 2a str. 301
cuggcacaacucgg

SEQ ID NO: 1977570 - RNA, 19 nt, Shigella flexneri 2a str. 301
cuggcacaacucggcggcu

SEQ ID NO: 1977571 - RNA, 13 nt, Shigella flexneri 2a str. 301
cuggauggcucug

SEQ ID NO: 1977572 - RNA, 22 nt, Shigella flexneri 2a str. 301
cuggauuucaauaacuccaucu

SEQ ID NO: 1977573 - RNA, 15 nt, Shigella flexneri 2a str. 301
cuggauuucaauaac

SEQ ID NO: 1977574 - RNA, 19 nt, Shigella flexneri 2a str. 301
cuggauuucaauaacucca

SEQ ID NO: 1977575 - RNA, 22 nt, Shigella flexneri 2a str. 301
cuggaagguaaggauaaaaaag

SEQ ID NO: 1977576 - RNA, 17 nt, Shigella flexneri 2a str. 301
cuggaaggguugaaaua

SEQ ID NO: 1977577 - RNA, 14 nt, Shigella flexneri 2a str. 301
cuggaagauucccc

SEQ ID NO: 1977578 - RNA, 23 nt, Shigella flexneri 2a str. 301
cuggaauggaaacagcaccaucc

SEQ ID NO: 1977579 - RNA, 23 nt, Shigella flexneri 2a str. 301
cuggaguuaaauuaauaaucaca

SEQ ID NO: 1977580 - RNA, 15 nt, Shigella flexneri 2a str. 301
cuggagcaaaaagcg

SEQ ID NO: 1977581 - RNA, 18 nt, Shigella flexneri 2a str. 301
cuggcgggcagaggcaau

SEQ ID NO: 1977582 - RNA, 20 nt, Shigella flexneri 2a str. 301
cuggcgggaauaaaagccag

SEQ ID NO: 1977583 - RNA, 19 nt, Shigella flexneri 2a str. 301
cuggcguacagagggcagg

SEQ ID NO: 1977584 - RNA, 21 nt, Shigella flexneri 2a str. 301
aaacuccgccgcaucuuccca

SEQ ID NO: 1977585 - RNA, 22 nt, Shigella flexneri 2a str. 301
aaacuccgccgcaucuucccag

SEQ ID NO: 1977586 - RNA, 20 nt, Shigella flexneri 2a str. 301
aaacucgcugccagcacuuu

SEQ ID NO: 1977587 - RNA, 17 nt, Shigella flexneri 2a str. 301
cuggcggcuuauauauu

SEQ ID NO: 1977588 - RNA, 19 nt, Shigella flexneri 2a str. 301
cuggcgggaauaaaagcca

SEQ ID NO: 1977589 - RNA, 23 nt, Shigella flexneri 2a str. 301
cuggcugagcaaacaguucugca

SEQ ID NO: 1977590 - RNA, 23 nt, Shigella flexneri 2a str. 301
cuggcugacauaaacaccagcaa

SEQ ID NO: 1977591 - RNA, 16 nt, Shigella flexneri 2a str. 301
cuggcugcauggcaau

SEQ ID NO: 1977592 - RNA, 21 nt, Shigella flexneri 2a str. 301
cuggcugauaaaacucucauc

SEQ ID NO: 1977593 - RNA, 17 nt, Shigella flexneri 2a str. 301
cuggcugcgcucugacu

SEQ ID NO: 1977594 - RNA, 16 nt, Shigella flexneri 2a str. 301
cuggcugcuuucuuug

SEQ ID NO: 1977595 - RNA, 14 nt, Shigella flexneri 2a str. 301
cuggcguguuucau

SEQ ID NO: 1977596 - RNA, 22 nt, Shigella flexneri 2a str. 301
cuggcguguuucauuagcccgg

SEQ ID NO: 1977597 - RNA, 17 nt, Shigella flexneri 2a str. 301
cuggcguuuuuccaaaa

SEQ ID NO: 1977598 - RNA, 22 nt, Shigella flexneri 2a str. 301
cuggcguuucucgccacuaaag

SEQ ID NO: 1977599 - RNA, 18 nt, Shigella flexneri 2a str. 301
cuggcucaucgccuucca

SEQ ID NO: 1977600 - RNA, 23 nt, Shigella flexneri 2a str. 301
cuggcuaagaagccuuuaucugg

SEQ ID NO: 1977601 - RNA, 14 nt, Shigella flexneri 2a str. 301
cuggcucaagcacc

SEQ ID NO: 1977602 - RNA, 16 nt, Shigella flexneri 2a str. 301
cugggacgcagacugg

SEQ ID NO: 1977603 - RNA, 16 nt, Shigella flexneri 2a str. 301
cugggaaaccuggaua

SEQ ID NO: 1977604 - RNA, 16 nt, Shigella flexneri 2a str. 301
cugggaaaucaccacc

SEQ ID NO: 1977605 - RNA, 18 nt, Shigella flexneri 2a str. 301
cugggaaaucaccaccag

SEQ ID NO: 1977606 - RNA, 12 nt, Shigella flexneri 2a str. 301
cuggcuggauga

SEQ ID NO: 1977607 - RNA, 19 nt, Shigella flexneri 2a str. 301
cuggcugucgaucuccggc

SEQ ID NO: 1977608 - RNA, 20 nt, Shigella flexneri 2a str. 301
cuggcuguuucgcuucuuca

SEQ ID NO: 1977609 - RNA, 16 nt, Shigella flexneri 2a str. 301
cuggcuucccggcaau

SEQ ID NO: 1977610 - RNA, 14 nt, Shigella flexneri 2a str. 301
cuggcuucgcuguu

SEQ ID NO: 1977611 - RNA, 18 nt, Shigella flexneri 2a str. 301
cugggcauugaaggcagc

SEQ ID NO: 1977612 - RNA, 15 nt, Shigella flexneri 2a str. 301
cugggcgaaacagag

SEQ ID NO: 1977613 - RNA, 18 nt, Shigella flexneri 2a str. 301
cugggcgaagguggcgga

SEQ ID NO: 1977614 - RNA, 15 nt, Shigella flexneri 2a str. 301
cugggauggcaaaac

SEQ ID NO: 1977615 - RNA, 20 nt, Shigella flexneri 2a str. 301
cugggagaacggacccgcga

SEQ ID NO: 1977616 - RNA, 14 nt, Shigella flexneri 2a str. 301
cugggcaacaaaac

SEQ ID NO: 1977617 - RNA, 14 nt, Shigella flexneri 2a str. 301
cugggcaaugcugu

SEQ ID NO: 1977618 - RNA, 17 nt, Shigella flexneri 2a str. 301
cuggcgaaucaggaccg

SEQ ID NO: 1977619 - RNA, 14 nt, Shigella flexneri 2a str. 301
cuggcgagauccgg

SEQ ID NO: 1977620 - RNA, 19 nt, Shigella flexneri 2a str. 301
cuggcgauauugccgcgau

SEQ ID NO: 1977621 - RNA, 17 nt, Shigella flexneri 2a str. 301
cuggcgaacgugcagga

SEQ ID NO: 1977622 - RNA, 16 nt, Shigella flexneri 2a str. 301
cuggccguacccagcu

SEQ ID NO: 1977623 - RNA, 23 nt, Shigella flexneri 2a str. 301
cuggcaucaccgcgaaauaauca

SEQ ID NO: 1977624 - RNA, 19 nt, Shigella flexneri 2a str. 301
cuggcagcaagugcggcgc

SEQ ID NO: 1977625 - RNA, 19 nt, Shigella flexneri 2a str. 301
cuggcagauaaauuacugc

SEQ ID NO: 1977626 - RNA, 20 nt, Shigella flexneri 2a str. 301
cuggcaccuguaccagcccg

SEQ ID NO: 1977627 - RNA, 18 nt, Shigella flexneri 2a str. 301
cuggcggagcucccaggc

SEQ ID NO: 1977628 - RNA, 18 nt, Shigella flexneri 2a str. 301
cuggcgcguuuaaucaca

SEQ ID NO: 1977629 - RNA, 12 nt, Shigella flexneri 2a str. 301
cuggcggcagca

SEQ ID NO: 1977630 - RNA, 13 nt, Shigella flexneri 2a str. 301
cuggcggcagcag

SEQ ID NO: 1977631 - RNA, 17 nt, Shigella flexneri 2a str. 301
cuggcggcaaugaaagc

SEQ ID NO: 1977632 - RNA, 13 nt, Shigella flexneri 2a str. 301
aaacucacgcagg

SEQ ID NO: 1977633 - RNA, 16 nt, Shigella flexneri 2a str. 301
aaacucacgccugaaa

SEQ ID NO: 1977634 - RNA, 15 nt, Shigella flexneri 2a str. 301
cuggcggcggcaacg

SEQ ID NO: 1977635 - RNA, 12 nt, Shigella flexneri 2a str. 301
cuggcgcagcaa

SEQ ID NO: 1977636 - RNA, 20 nt, Shigella flexneri 2a str. 301
cuggcgcacguucugucgcu

SEQ ID NO: 1977637 - RNA, 13 nt, Shigella flexneri 2a str. 301
cuggcgaugcccc

SEQ ID NO: 1977638 - RNA, 16 nt, Shigella flexneri 2a str. 301
cuggcgcgaacagcac

SEQ ID NO: 1977639 - RNA, 19 nt, Shigella flexneri 2a str. 301
cuggcgcauuaacggcaag

SEQ ID NO: 1977640 - RNA, 15 nt, Shigella flexneri 2a str. 301
cuguucauuaaagcc

SEQ ID NO: 1977641 - RNA, 19 nt, Shigella flexneri 2a str. 301
cuguucaguacgaaauaac

SEQ ID NO: 1977642 - RNA, 21 nt, Shigella flexneri 2a str. 301
cuguucuuuuaacgcaugcac

SEQ ID NO: 1977643 - RNA, 18 nt, Shigella flexneri 2a str. 301
cuguucuggcguaacagc

SEQ ID NO: 1977644 - RNA, 23 nt, Shigella flexneri 2a str. 301
cuguugaagccgccgguagucac

SEQ ID NO: 1977645 - RNA, 15 nt, Shigella flexneri 2a str. 301
cuguugaaauuauug

SEQ ID NO: 1977646 - RNA, 17 nt, Shigella flexneri 2a str. 301
cuguuaaggaaauccug

SEQ ID NO: 1977647 - RNA, 20 nt, Shigella flexneri 2a str. 301
cuguguaaacccagccgcgu

SEQ ID NO: 1977648 - RNA, 20 nt, Shigella flexneri 2a str. 301
cugugucaggccggcauaua

SEQ ID NO: 1977649 - RNA, 16 nt, Shigella flexneri 2a str. 301
cuguggugucuuucuc

SEQ ID NO: 1977650 - RNA, 14 nt, Shigella flexneri 2a str. 301
cugugguagcggcu

SEQ ID NO: 1977651 - RNA, 22 nt, Shigella flexneri 2a str. 301
cuguuggaaucacucaucaugc

SEQ ID NO: 1977652 - RNA, 21 nt, Shigella flexneri 2a str. 301
cuguugcaagacgaugacauu

SEQ ID NO: 1977653 - RNA, 19 nt, Shigella flexneri 2a str. 301
cuguuuuaccugcgccggu

SEQ ID NO: 1977654 - RNA, 18 nt, Shigella flexneri 2a str. 301
cuguuugcgucagcuuca

SEQ ID NO: 1977655 - RNA, 15 nt, Shigella flexneri 2a str. 301
cuguugguucagugg

SEQ ID NO: 1977656 - RNA, 22 nt, Shigella flexneri 2a str. 301
cuguuugccucguucuucccuc

SEQ ID NO: 1977657 - RNA, 19 nt, Shigella flexneri 2a str. 301
cuguuggugccagauagcc

SEQ ID NO: 1977658 - RNA, 14 nt, Shigella flexneri 2a str. 301
cuguuguaaugauu

SEQ ID NO: 1977659 - RNA, 23 nt, Shigella flexneri 2a str. 301
aaacugguagcuguagguaaaac

SEQ ID NO: 1977660 - RNA, 21 nt, Shigella flexneri 2a str. 301
aaacuggguuuugaucuccag

SEQ ID NO: 1977661 - RNA, 23 nt, Shigella flexneri 2a str. 301
aaacuguaguguugcaguaaauu

SEQ ID NO: 1977662 - RNA, 22 nt, Shigella flexneri 2a str. 301
aaacugguggcggguucuuuuu

SEQ ID NO: 1977663 - RNA, 17 nt, Shigella flexneri 2a str. 301
cuuaaacaguacgagag

SEQ ID NO: 1977664 - RNA, 20 nt, Shigella flexneri 2a str. 301
aaacuggcugauaaaacucu

SEQ ID NO: 1977665 - RNA, 13 nt, Shigella flexneri 2a str. 301
aaacuggcugugc

SEQ ID NO: 1977666 - RNA, 19 nt, Shigella flexneri 2a str. 301
cuguuuuccagcaccacuu

SEQ ID NO: 1977667 - RNA, 16 nt, Shigella flexneri 2a str. 301
cuuagacagcgccgcu

SEQ ID NO: 1977668 - RNA, 18 nt, Shigella flexneri 2a str. 301
cuuauaaggaaccuccau

SEQ ID NO: 1977669 - RNA, 20 nt, Shigella flexneri 2a str. 301
cuuauaaaccacgcaauaaa

SEQ ID NO: 1977670 - RNA, 21 nt, Shigella flexneri 2a str. 301
cuuauaaagaaaaucugaauu

SEQ ID NO: 1977671 - RNA, 17 nt, Shigella flexneri 2a str. 301
cuuauaaagaaaaucug

SEQ ID NO: 1977672 - RNA, 22 nt, Shigella flexneri 2a str. 301
cuuaucaggccaauugaacucu

SEQ ID NO: 1977673 - RNA, 13 nt, Shigella flexneri 2a str. 301
cuuaucaggccua

SEQ ID NO: 1977674 - RNA, 12 nt, Shigella flexneri 2a str. 301
cuuaucaggccu

SEQ ID NO: 1977675 - RNA, 13 nt, Shigella flexneri 2a str. 301
cuuauagaaagca

SEQ ID NO: 1977676 - RNA, 18 nt, Shigella flexneri 2a str. 301
cuuaucaggccuacaagu

SEQ ID NO: 1977677 - RNA, 17 nt, Shigella flexneri 2a str. 301
cuuaucaggccuacaaa

SEQ ID NO: 1977678 - RNA, 22 nt, Shigella flexneri 2a str. 301
cuuaucaggccuacaguuuuac

SEQ ID NO: 1977679 - RNA, 20 nt, Shigella flexneri 2a str. 301
cuuaucaggccuaccaauaa

SEQ ID NO: 1977680 - RNA, 11 nt, Shigella flexneri 2a str. 301
cuuaucuggca

SEQ ID NO: 1977681 - RNA, 19 nt, Shigella flexneri 2a str. 301
cuuaucuggauuuaacgau

SEQ ID NO: 1977682 - RNA, 18 nt, Shigella flexneri 2a str. 301
cuuauucaaucucuucac

SEQ ID NO: 1977683 - RNA, 14 nt, Shigella flexneri 2a str. 301
cuuacacacccggc

SEQ ID NO: 1977684 - RNA, 15 nt, Shigella flexneri 2a str. 301
cuuacacucaaauau

SEQ ID NO: 1977685 - RNA, 20 nt, Shigella flexneri 2a str. 301
cuuacacucaaauaucuaua

SEQ ID NO: 1977686 - RNA, 17 nt, Shigella flexneri 2a str. 301
cuuacgccgacuaauuu

SEQ ID NO: 1977687 - RNA, 18 nt, Shigella flexneri 2a str. 301
cuuacgcguucauacuuu

SEQ ID NO: 1977688 - RNA, 18 nt, Shigella flexneri 2a str. 301
cuuacggauaauuauuua

SEQ ID NO: 1977689 - RNA, 19 nt, Shigella flexneri 2a str. 301
cuuacggcacuccucuuca

SEQ ID NO: 1977690 - RNA, 17 nt, Shigella flexneri 2a str. 301
cuuacguaauuuauaau

SEQ ID NO: 1977691 - RNA, 17 nt, Shigella flexneri 2a str. 301
cuuacggcugcggaugu

SEQ ID NO: 1977692 - RNA, 16 nt, Shigella flexneri 2a str. 301
cuuacggcuuuuaauc

SEQ ID NO: 1977693 - RNA, 13 nt, Shigella flexneri 2a str. 301
cuuacuucaacac

SEQ ID NO: 1977694 - RNA, 15 nt, Shigella flexneri 2a str. 301
cuuacuuacgaaaaa

SEQ ID NO: 1977695 - RNA, 20 nt, Shigella flexneri 2a str. 301
cuuaacuucgcagcuuauuu

SEQ ID NO: 1977696 - RNA, 14 nt, Shigella flexneri 2a str. 301
cuuaaggucacaga

SEQ ID NO: 1977697 - RNA, 22 nt, Shigella flexneri 2a str. 301
cuuaagccgcuguguguaggcc

SEQ ID NO: 1977698 - RNA, 19 nt, Shigella flexneri 2a str. 301
cuuaauugcccgaagccaa

SEQ ID NO: 1977699 - RNA, 23 nt, Shigella flexneri 2a str. 301
cuucagcccuuuaauggcuuuca

SEQ ID NO: 1977700 - RNA, 21 nt, Shigella flexneri 2a str. 301
cuucacuuccccgagcucaau

SEQ ID NO: 1977701 - RNA, 15 nt, Shigella flexneri 2a str. 301
cuucacuucuuaccg

SEQ ID NO: 1977702 - RNA, 15 nt, Shigella flexneri 2a str. 301
cuucauacaccacua

SEQ ID NO: 1977703 - RNA, 14 nt, Shigella flexneri 2a str. 301
cuucauacuaccug

SEQ ID NO: 1977704 - RNA, 15 nt, Shigella flexneri 2a str. 301
cuucauagguaaaca

SEQ ID NO: 1977705 - RNA, 22 nt, Shigella flexneri 2a str. 301
cuucauagauagccagcaacau

SEQ ID NO: 1977706 - RNA, 19 nt, Shigella flexneri 2a str. 301
cuucagcguccauccacag

SEQ ID NO: 1977707 - RNA, 20 nt, Shigella flexneri 2a str. 301
cuucaguuuuucccgcuucg

SEQ ID NO: 1977708 - RNA, 16 nt, Shigella flexneri 2a str. 301
cuucagcguaucccag

SEQ ID NO: 1977709 - RNA, 22 nt, Shigella flexneri 2a str. 301
cuucagcgcuaccgccgaucuc

SEQ ID NO: 1977710 - RNA, 13 nt, Shigella flexneri 2a str. 301
cuucauuaccuuc

SEQ ID NO: 1977711 - RNA, 15 nt, Shigella flexneri 2a str. 301
cuucauuaccuuuuu

SEQ ID NO: 1977712 - RNA, 16 nt, Shigella flexneri 2a str. 301
cuucauuaaccacgau

SEQ ID NO: 1977713 - RNA, 17 nt, Shigella flexneri 2a str. 301
cuucauggggaugcuga

SEQ ID NO: 1977714 - RNA, 18 nt, Shigella flexneri 2a str. 301
cuucaugcgcagcauaau

SEQ ID NO: 1977715 - RNA, 19 nt, Shigella flexneri 2a str. 301
cuucaugaguuccacuggu

SEQ ID NO: 1977716 - RNA, 13 nt, Shigella flexneri 2a str. 301
cuucaugaccuuc

SEQ ID NO: 1977717 - RNA, 17 nt, Shigella flexneri 2a str. 301
cuucaucgugcucgcuu

SEQ ID NO: 1977718 - RNA, 22 nt, Shigella flexneri 2a str. 301
cuucaucgccguugcggguggc

SEQ ID NO: 1977719 - RNA, 23 nt, Shigella flexneri 2a str. 301
cuucaucccuuucgcuucaagua

SEQ ID NO: 1977720 - RNA, 18 nt, Shigella flexneri 2a str. 301
cuucauccggauacagcc

SEQ ID NO: 1977721 - RNA, 21 nt, Shigella flexneri 2a str. 301
cuucauccuucacacugccuc

SEQ ID NO: 1977722 - RNA, 14 nt, Shigella flexneri 2a str. 301
cuucauccgccccg

SEQ ID NO: 1977723 - RNA, 20 nt, Shigella flexneri 2a str. 301
cuucaaguguggccgccagu

SEQ ID NO: 1977724 - RNA, 19 nt, Shigella flexneri 2a str. 301
cuucaaguguggccgccag

SEQ ID NO: 1977725 - RNA, 14 nt, Shigella flexneri 2a str. 301
cuucaaccacauuc

SEQ ID NO: 1977726 - RNA, 21 nt, Shigella flexneri 2a str. 301
cuucaaaucgacgcgugaaaa

SEQ ID NO: 1977727 - RNA, 19 nt, Shigella flexneri 2a str. 301
cuucaaauagugccuggcu

SEQ ID NO: 1977728 - RNA, 15 nt, Shigella flexneri 2a str. 301
cuucaaauccucaau

SEQ ID NO: 1977729 - RNA, 13 nt, Shigella flexneri 2a str. 301
cuucaaacgcuga

SEQ ID NO: 1977730 - RNA, 21 nt, Shigella flexneri 2a str. 301
cuucaaagcagaaacccauug

SEQ ID NO: 1977731 - RNA, 16 nt, Shigella flexneri 2a str. 301
cuucacaaucagcgcg

SEQ ID NO: 1977732 - RNA, 19 nt, Shigella flexneri 2a str. 301
cuucacacacuuuuauuaa

SEQ ID NO: 1977733 - RNA, 21 nt, Shigella flexneri 2a str. 301
cuucacacugaugacaggcua

SEQ ID NO: 1977734 - RNA, 19 nt, Shigella flexneri 2a str. 301
cuucaccgcuaaagcgguu

SEQ ID NO: 1977735 - RNA, 14 nt, Shigella flexneri 2a str. 301
cuucacaucaccau

SEQ ID NO: 1977736 - RNA, 22 nt, Shigella flexneri 2a str. 301
cuucaauuuuuucuggcgaacc

SEQ ID NO: 1977737 - RNA, 14 nt, Shigella flexneri 2a str. 301
cuucaauauaugca

SEQ ID NO: 1977738 - RNA, 17 nt, Shigella flexneri 2a str. 301
cuucacugacauugccu

SEQ ID NO: 1977739 - RNA, 18 nt, Shigella flexneri 2a str. 301
cuucacgcggguugccac

SEQ ID NO: 1977740 - RNA, 19 nt, Shigella flexneri 2a str. 301
cuucacgcuaauaccggau

SEQ ID NO: 1977741 - RNA, 20 nt, Shigella flexneri 2a str. 301
cuucacgcuaauaccggaug

SEQ ID NO: 1977742 - RNA, 18 nt, Shigella flexneri 2a str. 301
cuucacgcgcuccaggag

SEQ ID NO: 1977743 - RNA, 14 nt, Shigella flexneri 2a str. 301
cuucacgcgcucca

SEQ ID NO: 1977744 - RNA, 17 nt, Shigella flexneri 2a str. 301
cuucacgcccgccccag

SEQ ID NO: 1977745 - RNA, 20 nt, Shigella flexneri 2a str. 301
cuucaccuucuuuacugccc

SEQ ID NO: 1977746 - RNA, 15 nt, Shigella flexneri 2a str. 301
cuucacgcaguuuau

SEQ ID NO: 1977747 - RNA, 18 nt, Shigella flexneri 2a str. 301
cuuccacaccacuuccga

SEQ ID NO: 1977748 - RNA, 15 nt, Shigella flexneri 2a str. 301
cuuccagauucaguu

SEQ ID NO: 1977749 - RNA, 23 nt, Shigella flexneri 2a str. 301
cuuccagaucaccgcagaagcga

SEQ ID NO: 1977750 - RNA, 15 nt, Shigella flexneri 2a str. 301
cuuccagcaaaucca

SEQ ID NO: 1977751 - RNA, 11 nt, Shigella flexneri 2a str. 301
cuuccagcaga

SEQ ID NO: 1977752 - RNA, 19 nt, Shigella flexneri 2a str. 301
cuuccagcagaccagcaau

SEQ ID NO: 1977753 - RNA, 20 nt, Shigella flexneri 2a str. 301
cuuccauugagaaagcccug

SEQ ID NO: 1977754 - RNA, 14 nt, Shigella flexneri 2a str. 301
cuuccauugccgcu

SEQ ID NO: 1977755 - RNA, 20 nt, Shigella flexneri 2a str. 301
cuuccauugccgcuuuccag

SEQ ID NO: 1977756 - RNA, 22 nt, Shigella flexneri 2a str. 301
cuuccauugccgcuuuccaggc

SEQ ID NO: 1977757 - RNA, 19 nt, Shigella flexneri 2a str. 301
cuuccauguguuuaucuau

SEQ ID NO: 1977758 - RNA, 19 nt, Shigella flexneri 2a str. 301
cuuccaucgcaucuucgcc

SEQ ID NO: 1977759 - RNA, 18 nt, Shigella flexneri 2a str. 301
cuuccagcgcaucugccg

SEQ ID NO: 1977760 - RNA, 14 nt, Shigella flexneri 2a str. 301
cuuccagcgauaau

SEQ ID NO: 1977761 - RNA, 13 nt, Shigella flexneri 2a str. 301
cuuccaucacaaa

SEQ ID NO: 1977762 - RNA, 15 nt, Shigella flexneri 2a str. 301
cuucccaguguucug

SEQ ID NO: 1977763 - RNA, 19 nt, Shigella flexneri 2a str. 301
cuucccagguuucaaugcc

SEQ ID NO: 1977764 - RNA, 20 nt, Shigella flexneri 2a str. 301
cuucccaauugcacauauuu

SEQ ID NO: 1977765 - RNA, 21 nt, Shigella flexneri 2a str. 301
cuuccugagugaauauuuaac

SEQ ID NO: 1977766 - RNA, 21 nt, Shigella flexneri 2a str. 301
cuuccugcaacgagugcaucu

SEQ ID NO: 1977767 - RNA, 12 nt, Shigella flexneri 2a str. 301
cuuccugcaacg

SEQ ID NO: 1977768 - RNA, 23 nt, Shigella flexneri 2a str. 301
cuuccucguuucgcccugccuuu

SEQ ID NO: 1977769 - RNA, 18 nt, Shigella flexneri 2a str. 301
cuuccuugcuaagcccuc

SEQ ID NO: 1977770 - RNA, 18 nt, Shigella flexneri 2a str. 301
cuuccuugcguacaccaa

SEQ ID NO: 1977771 - RNA, 16 nt, Shigella flexneri 2a str. 301
cuuccuuuuuuauuua

SEQ ID NO: 1977772 - RNA, 22 nt, Shigella flexneri 2a str. 301
cuuccuccagcgguuuaucaau

SEQ ID NO: 1977773 - RNA, 18 nt, Shigella flexneri 2a str. 301
cuuccgcgccaaacauuu

SEQ ID NO: 1977774 - RNA, 21 nt, Shigella flexneri 2a str. 301
cuuccgcaauacagccagcca

SEQ ID NO: 1977775 - RNA, 22 nt, Shigella flexneri 2a str. 301
cuuccgcaauacagccagccag

SEQ ID NO: 1977776 - RNA, 17 nt, Shigella flexneri 2a str. 301
cuuccgcaauacagcca

SEQ ID NO: 1977777 - RNA, 22 nt, Shigella flexneri 2a str. 301
cuucgcccuucgggucguugcc

SEQ ID NO: 1977778 - RNA, 23 nt, Shigella flexneri 2a str. 301
cuucgccauugaaaccgcugccu

SEQ ID NO: 1977779 - RNA, 14 nt, Shigella flexneri 2a str. 301
cuucgccaaugacc

SEQ ID NO: 1977780 - RNA, 22 nt, Shigella flexneri 2a str. 301
cuucgccagacguugauaacca

SEQ ID NO: 1977781 - RNA, 17 nt, Shigella flexneri 2a str. 301
cuucgcacacacugcuu

SEQ ID NO: 1977782 - RNA, 12 nt, Shigella flexneri 2a str. 301
cuucgcaaaaaa

SEQ ID NO: 1977783 - RNA, 18 nt, Shigella flexneri 2a str. 301
cuucgauguguugcaaau

SEQ ID NO: 1977784 - RNA, 15 nt, Shigella flexneri 2a str. 301
cuucgauccagugau

SEQ ID NO: 1977785 - RNA, 18 nt, Shigella flexneri 2a str. 301
cuucgaaaguagaagcaa

SEQ ID NO: 1977786 - RNA, 19 nt, Shigella flexneri 2a str. 301
cuggugggcggcgugauug

SEQ ID NO: 1977787 - RNA, 22 nt, Shigella flexneri 2a str. 301
cuggugucagcgugacuggcag

SEQ ID NO: 1977788 - RNA, 16 nt, Shigella flexneri 2a str. 301
cugguguaucugcugu

SEQ ID NO: 1977789 - RNA, 22 nt, Shigella flexneri 2a str. 301
cuggugcaauuucagcguccug

SEQ ID NO: 1977790 - RNA, 21 nt, Shigella flexneri 2a str. 301
cuggugauugcaccgacuggc

SEQ ID NO: 1977791 - RNA, 18 nt, Shigella flexneri 2a str. 301
cuggugccaagcuccagc

SEQ ID NO: 1977792 - RNA, 17 nt, Shigella flexneri 2a str. 301
cuggugcuaacagcaau

SEQ ID NO: 1977793 - RNA, 14 nt, Shigella flexneri 2a str. 301
cuggugcuuuuuca

SEQ ID NO: 1977794 - RNA, 17 nt, Shigella flexneri 2a str. 301
cugguggaaaggacagu

SEQ ID NO: 1977795 - RNA, 21 nt, Shigella flexneri 2a str. 301
cugguuuuucgauuuaaauga

SEQ ID NO: 1977796 - RNA, 20 nt, Shigella flexneri 2a str. 301
cugguuuucagcgaaacagc

SEQ ID NO: 1977797 - RNA, 22 nt, Shigella flexneri 2a str. 301
cugguuucggcguucauccugc

SEQ ID NO: 1977798 - RNA, 13 nt, Shigella flexneri 2a str. 301
cugguuucucuuc

SEQ ID NO: 1977799 - RNA, 18 nt, Shigella flexneri 2a str. 301
cugguugauucauggcau

SEQ ID NO: 1977800 - RNA, 21 nt, Shigella flexneri 2a str. 301
cugguuaucuuccaccaccac

SEQ ID NO: 1977801 - RNA, 22 nt, Shigella flexneri 2a str. 301
cugguuaguuuuagcgcgggga

SEQ ID NO: 1977802 - RNA, 15 nt, Shigella flexneri 2a str. 301
cugguuauauuuccc

SEQ ID NO: 1977803 - RNA, 16 nt, Shigella flexneri 2a str. 301
cugguuauauuucccc

SEQ ID NO: 1977804 - RNA, 23 nt, Shigella flexneri 2a str. 301
cugguuauauuuccccuguugca

SEQ ID NO: 1977805 - RNA, 16 nt, Shigella flexneri 2a str. 301
cugguuaccaccugcu

SEQ ID NO: 1977806 - RNA, 23 nt, Shigella flexneri 2a str. 301
cugguuaccggcauauccaccac

SEQ ID NO: 1977807 - RNA, 19 nt, Shigella flexneri 2a str. 301
cugguguugcuccccagaa

SEQ ID NO: 1977808 - RNA, 22 nt, Shigella flexneri 2a str. 301
cugguguucgauaaccaucccu

SEQ ID NO: 1977809 - RNA, 19 nt, Shigella flexneri 2a str. 301
cugguguucggcauucugc

SEQ ID NO: 1977810 - RNA, 23 nt, Shigella flexneri 2a str. 301
cugguucugcggguuagucugca

SEQ ID NO: 1977811 - RNA, 15 nt, Shigella flexneri 2a str. 301
cugguucugcggguu

SEQ ID NO: 1977812 - RNA, 17 nt, Shigella flexneri 2a str. 301
cugguucccaacaacag

SEQ ID NO: 1977813 - RNA, 17 nt, Shigella flexneri 2a str. 301
cugguuccugacuccug

SEQ ID NO: 1977814 - RNA, 21 nt, Shigella flexneri 2a str. 301
cuguaacggagguacaaccgc

SEQ ID NO: 1977815 - RNA, 17 nt, Shigella flexneri 2a str. 301
cuguaaccagcgcagac

SEQ ID NO: 1977816 - RNA, 22 nt, Shigella flexneri 2a str. 301
cuguaaagagugugaauauuca

SEQ ID NO: 1977817 - RNA, 22 nt, Shigella flexneri 2a str. 301
cuguaaauucucaauaucauca

SEQ ID NO: 1977818 - RNA, 20 nt, Shigella flexneri 2a str. 301
cuguaaauucucaauaucau

SEQ ID NO: 1977819 - RNA, 19 nt, Shigella flexneri 2a str. 301
cuguaaaugcugcuccagc

SEQ ID NO: 1977820 - RNA, 22 nt, Shigella flexneri 2a str. 301
cuguaaaacgcgcccucagccc

SEQ ID NO: 1977821 - RNA, 21 nt, Shigella flexneri 2a str. 301
cuguaaaacgcgcccucagcc

SEQ ID NO: 1977822 - RNA, 20 nt, Shigella flexneri 2a str. 301
cuguaaaaggcgccauuuuc

SEQ ID NO: 1977823 - RNA, 20 nt, Shigella flexneri 2a str. 301
cuguaaaauuauccucuuca

SEQ ID NO: 1977824 - RNA, 12 nt, Shigella flexneri 2a str. 301
cuguaccaccag

SEQ ID NO: 1977825 - RNA, 22 nt, Shigella flexneri 2a str. 301
cuguaccaccagaaucgccagc

SEQ ID NO: 1977826 - RNA, 16 nt, Shigella flexneri 2a str. 301
cuguaccccugauaau

SEQ ID NO: 1977827 - RNA, 16 nt, Shigella flexneri 2a str. 301
cuguaccagcccgccu

SEQ ID NO: 1977828 - RNA, 21 nt, Shigella flexneri 2a str. 301
cuguaccagcggcuuccagca

SEQ ID NO: 1977829 - RNA, 12 nt, Shigella flexneri 2a str. 301
cuguaccugguu

SEQ ID NO: 1977830 - RNA, 17 nt, Shigella flexneri 2a str. 301
cuguacgacaaaagaau

SEQ ID NO: 1977831 - RNA, 19 nt, Shigella flexneri 2a str. 301
cuguaauuaccagcgccgg

SEQ ID NO: 1977832 - RNA, 19 nt, Shigella flexneri 2a str. 301
cuguaauuucacaccauca

SEQ ID NO: 1977833 - RNA, 23 nt, Shigella flexneri 2a str. 301
cuguaauugagaaccacaaugaa

SEQ ID NO: 1977834 - RNA, 14 nt, Shigella flexneri 2a str. 301
cuguaauccucuuu

SEQ ID NO: 1977835 - RNA, 14 nt, Shigella flexneri 2a str. 301
cuguaccacaaccu

SEQ ID NO: 1977836 - RNA, 18 nt, Shigella flexneri 2a str. 301
cuguacagauccgccauu

SEQ ID NO: 1977837 - RNA, 17 nt, Shigella flexneri 2a str. 301
cuguacaggcuccugua

SEQ ID NO: 1977838 - RNA, 20 nt, Shigella flexneri 2a str. 301
cuggguaaaaauagggugcg

SEQ ID NO: 1977839 - RNA, 12 nt, Shigella flexneri 2a str. 301
cuggguaacacc

SEQ ID NO: 1977840 - RNA, 15 nt, Shigella flexneri 2a str. 301
cuggguaguccauga

SEQ ID NO: 1977841 - RNA, 20 nt, Shigella flexneri 2a str. 301
cugguaaaaaaugauuuccu

SEQ ID NO: 1977842 - RNA, 20 nt, Shigella flexneri 2a str. 301
cuggguuucgccugccagau

SEQ ID NO: 1977843 - RNA, 21 nt, Shigella flexneri 2a str. 301
cuggguuggguucacuuuccc

SEQ ID NO: 1977844 - RNA, 22 nt, Shigella flexneri 2a str. 301
cuggggauagaaacagucugga

SEQ ID NO: 1977845 - RNA, 16 nt, Shigella flexneri 2a str. 301
cugggcgauuuccuuc

SEQ ID NO: 1977846 - RNA, 14 nt, Shigella flexneri 2a str. 301
cugguaguccagga

SEQ ID NO: 1977847 - RNA, 13 nt, Shigella flexneri 2a str. 301
cuggucaccaucu

SEQ ID NO: 1977848 - RNA, 17 nt, Shigella flexneri 2a str. 301
cuggucaccaucuuugu

SEQ ID NO: 1977849 - RNA, 14 nt, Shigella flexneri 2a str. 301
cugguaccagcacc

SEQ ID NO: 1977850 - RNA, 12 nt, Shigella flexneri 2a str. 301
cugguaauccgu

SEQ ID NO: 1977851 - RNA, 15 nt, Shigella flexneri 2a str. 301
cugguaacagugcac

SEQ ID NO: 1977852 - RNA, 14 nt, Shigella flexneri 2a str. 301
cugguaaucaccac

SEQ ID NO: 1977853 - RNA, 18 nt, Shigella flexneri 2a str. 301
cugguaacuggugccagg

SEQ ID NO: 1977854 - RNA, 17 nt, Shigella flexneri 2a str. 301
cugguacuggugcaaaa

SEQ ID NO: 1977855 - RNA, 21 nt, Shigella flexneri 2a str. 301
cugguacgauucgcccgcagc

SEQ ID NO: 1977856 - RNA, 18 nt, Shigella flexneri 2a str. 301
cugguacucaaccgccac

SEQ ID NO: 1977857 - RNA, 14 nt, Shigella flexneri 2a str. 301
cugguagauaagca

SEQ ID NO: 1977858 - RNA, 21 nt, Shigella flexneri 2a str. 301
cuggucggcaaacugcugaug

SEQ ID NO: 1977859 - RNA, 16 nt, Shigella flexneri 2a str. 301
cugguccuucaucuuc

SEQ ID NO: 1977860 - RNA, 18 nt, Shigella flexneri 2a str. 301
cugguccuucaucuucaa

SEQ ID NO: 1977861 - RNA, 20 nt, Shigella flexneri 2a str. 301
cuggugauacaacgaccggc

SEQ ID NO: 1977862 - RNA, 19 nt, Shigella flexneri 2a str. 301
cuggugacuuuugcccggc

SEQ ID NO: 1977863 - RNA, 16 nt, Shigella flexneri 2a str. 301
cuggucugaaucaaca

SEQ ID NO: 1977864 - RNA, 22 nt, Shigella flexneri 2a str. 301
cugugccguaaaucccagugcc

SEQ ID NO: 1977865 - RNA, 19 nt, Shigella flexneri 2a str. 301
cugugccguaaaucccagu

SEQ ID NO: 1977866 - RNA, 14 nt, Shigella flexneri 2a str. 301
cugugccggaaggg

SEQ ID NO: 1977867 - RNA, 19 nt, Shigella flexneri 2a str. 301
cugugcucugggccaugau

SEQ ID NO: 1977868 - RNA, 17 nt, Shigella flexneri 2a str. 301
cugugggguauuuccag

SEQ ID NO: 1977869 - RNA, 16 nt, Shigella flexneri 2a str. 301
cuguggauguuuuacu

SEQ ID NO: 1977870 - RNA, 15 nt, Shigella flexneri 2a str. 301
cuguggauucagcac

SEQ ID NO: 1977871 - RNA, 20 nt, Shigella flexneri 2a str. 301
cugugcugguacuggugcaa

SEQ ID NO: 1977872 - RNA, 16 nt, Shigella flexneri 2a str. 301
cuguggaacaucaccc

SEQ ID NO: 1977873 - RNA, 17 nt, Shigella flexneri 2a str. 301
cuguggaacgugcugca

SEQ ID NO: 1977874 - RNA, 21 nt, Shigella flexneri 2a str. 301
cugugcuuuacaccaugccac

SEQ ID NO: 1977875 - RNA, 17 nt, Shigella flexneri 2a str. 301
cugugacgacuuuuucc

SEQ ID NO: 1977876 - RNA, 17 nt, Shigella flexneri 2a str. 301
cugugacaacacuucau

SEQ ID NO: 1977877 - RNA, 16 nt, Shigella flexneri 2a str. 301
cugugcaaucgccgcu

SEQ ID NO: 1977878 - RNA, 18 nt, Shigella flexneri 2a str. 301
cugugcagccaaaaauga

SEQ ID NO: 1977879 - RNA, 16 nt, Shigella flexneri 2a str. 301
cugugcaaccuuuucc

SEQ ID NO: 1977880 - RNA, 23 nt, Shigella flexneri 2a str. 301
cugugcauuuggcgcaucgguca

SEQ ID NO: 1977881 - RNA, 19 nt, Shigella flexneri 2a str. 301
cugugccagcucgugcaga

SEQ ID NO: 1977882 - RNA, 14 nt, Shigella flexneri 2a str. 301
cugugccagugcca

SEQ ID NO: 1977883 - RNA, 13 nt, Shigella flexneri 2a str. 301
cugugccagugcc

SEQ ID NO: 1977884 - RNA, 18 nt, Shigella flexneri 2a str. 301
cugugccacggcuuugca

SEQ ID NO: 1977885 - RNA, 17 nt, Shigella flexneri 2a str. 301
cugugcccguaaaaaau

SEQ ID NO: 1977886 - RNA, 15 nt, Shigella flexneri 2a str. 301
cugugccgcugacau

SEQ ID NO: 1977887 - RNA, 15 nt, Shigella flexneri 2a str. 301
cugugccgccgccac

SEQ ID NO: 1977888 - RNA, 14 nt, Shigella flexneri 2a str. 301
cugucgcagccagc

SEQ ID NO: 1977889 - RNA, 15 nt, Shigella flexneri 2a str. 301
cugucgcuucacgca

SEQ ID NO: 1977890 - RNA, 19 nt, Shigella flexneri 2a str. 301
cugucggguaagcgccaca

SEQ ID NO: 1977891 - RNA, 20 nt, Shigella flexneri 2a str. 301
cugucggcacugaccaccac

SEQ ID NO: 1977892 - RNA, 22 nt, Shigella flexneri 2a str. 301
cugucggcacugaccaccacca

SEQ ID NO: 1977893 - RNA, 13 nt, Shigella flexneri 2a str. 301
cugucgaggccaa

SEQ ID NO: 1977894 - RNA, 16 nt, Shigella flexneri 2a str. 301
cugucgauaaacucau

SEQ ID NO: 1977895 - RNA, 23 nt, Shigella flexneri 2a str. 301
cugucgacaaagccgcaggcgug

SEQ ID NO: 1977896 - RNA, 22 nt, Shigella flexneri 2a str. 301
cuguccucuucagcaucaauga

SEQ ID NO: 1977897 - RNA, 22 nt, Shigella flexneri 2a str. 301
cugucugcuucugccugggccu

SEQ ID NO: 1977898 - RNA, 19 nt, Shigella flexneri 2a str. 301
cugucuggcgucuccugcc

SEQ ID NO: 1977899 - RNA, 12 nt, Shigella flexneri 2a str. 301
cugucugcuucu

SEQ ID NO: 1977900 - RNA, 21 nt, Shigella flexneri 2a str. 301
cugucuuaacgcaccaugcac

SEQ ID NO: 1977901 - RNA, 15 nt, Shigella flexneri 2a str. 301
cugucugauaaaaaa

SEQ ID NO: 1977902 - RNA, 16 nt, Shigella flexneri 2a str. 301
cugucuguuauuuauu

SEQ ID NO: 1977903 - RNA, 12 nt, Shigella flexneri 2a str. 301
cugucuucccug

SEQ ID NO: 1977904 - RNA, 12 nt, Shigella flexneri 2a str. 301
cugucuuccugu

SEQ ID NO: 1977905 - RNA, 14 nt, Shigella flexneri 2a str. 301
cugucuaccagcac

SEQ ID NO: 1977906 - RNA, 14 nt, Shigella flexneri 2a str. 301
cugucuccacuaua

SEQ ID NO: 1977907 - RNA, 17 nt, Shigella flexneri 2a str. 301
cugucuccacuauaaaa

SEQ ID NO: 1977908 - RNA, 19 nt, Shigella flexneri 2a str. 301
cugucuccacuauaaaaaa

SEQ ID NO: 1977909 - RNA, 16 nt, Shigella flexneri 2a str. 301
cugucuaauggugaac

SEQ ID NO: 1977910 - RNA, 20 nt, Shigella flexneri 2a str. 301
cugucguuaaugcgccaagc

SEQ ID NO: 1977911 - RNA, 21 nt, Shigella flexneri 2a str. 301
cugucgggugcuuuuuucaau

SEQ ID NO: 1977912 - RNA, 17 nt, Shigella flexneri 2a str. 301
cugucgggugcuuuuuu

SEQ ID NO: 1977913 - RNA, 14 nt, Shigella flexneri 2a str. 301
cugucguccggcag

SEQ ID NO: 1977914 - RNA, 15 nt, Shigella flexneri 2a str. 301
cuguccagcacgccg

SEQ ID NO: 1977915 - RNA, 20 nt, Shigella flexneri 2a str. 301
cuguccauaccggacuccag

SEQ ID NO: 1977916 - RNA, 15 nt, Shigella flexneri 2a str. 301
cuguccaccacgcug

SEQ ID NO: 1977917 - RNA, 12 nt, Shigella flexneri 2a str. 301
cuguccacaccc

SEQ ID NO: 1977918 - RNA, 15 nt, Shigella flexneri 2a str. 301
cuguccacacccaga

SEQ ID NO: 1977919 - RNA, 22 nt, Shigella flexneri 2a str. 301
cuguccaaauccuucagcaacu

SEQ ID NO: 1977920 - RNA, 16 nt, Shigella flexneri 2a str. 301
cuguccggcgcacugg

SEQ ID NO: 1977921 - RNA, 13 nt, Shigella flexneri 2a str. 301
cuguccggcacca

SEQ ID NO: 1977922 - RNA, 19 nt, Shigella flexneri 2a str. 301
cuguccgggcacauuuuua

SEQ ID NO: 1977923 - RNA, 16 nt, Shigella flexneri 2a str. 301
cuguccgcuucaccac

SEQ ID NO: 1977924 - RNA, 18 nt, Shigella flexneri 2a str. 301
cuguccgcuucaccaccg

SEQ ID NO: 1977925 - RNA, 14 nt, Shigella flexneri 2a str. 301
cugucauauuaucu

SEQ ID NO: 1977926 - RNA, 20 nt, Shigella flexneri 2a str. 301
cugucaguggacgauaagca

SEQ ID NO: 1977927 - RNA, 13 nt, Shigella flexneri 2a str. 301
cugucauaacaca

SEQ ID NO: 1977928 - RNA, 22 nt, Shigella flexneri 2a str. 301
cugucaauaaacgccugcuuau

SEQ ID NO: 1977929 - RNA, 13 nt, Shigella flexneri 2a str. 301
cugucaauaaacg

SEQ ID NO: 1977930 - RNA, 13 nt, Shigella flexneri 2a str. 301
cugucaccaauca

SEQ ID NO: 1977931 - RNA, 20 nt, Shigella flexneri 2a str. 301
aaacucucuauuccaccauc

SEQ ID NO: 1977932 - RNA, 20 nt, Shigella flexneri 2a str. 301
aaacucucaucuuugaaauc

SEQ ID NO: 1977933 - RNA, 15 nt, Shigella flexneri 2a str. 301
aaacucucaaaacaa

SEQ ID NO: 1977934 - RNA, 19 nt, Shigella flexneri 2a str. 301
aaacucucaaaacaacaca

SEQ ID NO: 1977935 - RNA, 14 nt, Shigella flexneri 2a str. 301
cuguauuugucuca

SEQ ID NO: 1977936 - RNA, 11 nt, Shigella flexneri 2a str. 301
cuguauuuugc

SEQ ID NO: 1977937 - RNA, 20 nt, Shigella flexneri 2a str. 301
cuguauuuugcguuucugcu

SEQ ID NO: 1977938 - RNA, 20 nt, Shigella flexneri 2a str. 301
cuguaucaugcaguaccaga

SEQ ID NO: 1977939 - RNA, 14 nt, Shigella flexneri 2a str. 301
cuguaucaggcuga

SEQ ID NO: 1977940 - RNA, 13 nt, Shigella flexneri 2a str. 301
cuguagaagcuga

SEQ ID NO: 1977941 - RNA, 14 nt, Shigella flexneri 2a str. 301
cuguacggcaguga

SEQ ID NO: 1977942 - RNA, 18 nt, Shigella flexneri 2a str. 301
cuguacgguaauggcaaa

SEQ ID NO: 1977943 - RNA, 13 nt, Shigella flexneri 2a str. 301
cuguacuuccugu

SEQ ID NO: 1977944 - RNA, 23 nt, Shigella flexneri 2a str. 301
cuguagauaaaacacucuuuuug

SEQ ID NO: 1977945 - RNA, 21 nt, Shigella flexneri 2a str. 301
cuguagagcuaccggcaggaa

SEQ ID NO: 1977946 - RNA, 18 nt, Shigella flexneri 2a str. 301
cuguagagcuaccggcag

SEQ ID NO: 1977947 - RNA, 18 nt, Shigella flexneri 2a str. 301
cuguaguuguuaauguga

SEQ ID NO: 1977948 - RNA, 14 nt, Shigella flexneri 2a str. 301
gaagaaaccgauga

SEQ ID NO: 1977949 - RNA, 20 nt, Shigella flexneri 2a str. 301
gaacuucauaugcgccagac

SEQ ID NO: 1977950 - RNA, 15 nt, Shigella flexneri 2a str. 301
gaacuguagacaaaa

SEQ ID NO: 1977951 - RNA, 12 nt, Shigella flexneri 2a str. 301
gaagaaagcaau

SEQ ID NO: 1977952 - RNA, 16 nt, Shigella flexneri 2a str. 301
aaagagggcauggcgc

SEQ ID NO: 1977953 - RNA, 19 nt, Shigella flexneri 2a str. 301
gaagaggaucugcucuucu

SEQ ID NO: 1977954 - RNA, 13 nt, Shigella flexneri 2a str. 301
gaagccauccagc

SEQ ID NO: 1977955 - RNA, 23 nt, Shigella flexneri 2a str. 301
gaagcacguucaucccacucuga

SEQ ID NO: 1977956 - RNA, 20 nt, Shigella flexneri 2a str. 301
gaagcagaucuggaagcagg

SEQ ID NO: 1977957 - RNA, 20 nt, Shigella flexneri 2a str. 301
gaagauauugcgcaugacac

SEQ ID NO: 1977958 - RNA, 20 nt, Shigella flexneri 2a str. 301
gaagcggccgucagaucgcc

SEQ ID NO: 1977959 - RNA, 20 nt, Shigella flexneri 2a str. 301
gaagcgggggagucgcuggu

SEQ ID NO: 1977960 - RNA, 20 nt, Shigella flexneri 2a str. 301
gaagcccaucaguacaccac

SEQ ID NO: 1977961 - RNA, 22 nt, Shigella flexneri 2a str. 301
gaagcccauuucaguauugagc

SEQ ID NO: 1977962 - RNA, 19 nt, Shigella flexneri 2a str. 301
gaagcgccgguuccacauc

SEQ ID NO: 1977963 - RNA, 17 nt, Shigella flexneri 2a str. 301
gaaguaauaaucaacgc

SEQ ID NO: 1977964 - RNA, 14 nt, Shigella flexneri 2a str. 301
gaaguacagcccag

SEQ ID NO: 1977965 - RNA, 18 nt, Shigella flexneri 2a str. 301
gaaguacagcccaggcac

SEQ ID NO: 1977966 - RNA, 15 nt, Shigella flexneri 2a str. 301
gaaguacuccugcuc

SEQ ID NO: 1977967 - RNA, 20 nt, Shigella flexneri 2a str. 301
gaaguacuccugcucgccga

SEQ ID NO: 1977968 - RNA, 21 nt, Shigella flexneri 2a str. 301
gaagguuucugcauuauccag

SEQ ID NO: 1977969 - RNA, 17 nt, Shigella flexneri 2a str. 301
gaaguaaacgccgagcu

SEQ ID NO: 1977970 - RNA, 21 nt, Shigella flexneri 2a str. 301
gaaggguauugccgaugaacg

SEQ ID NO: 1977971 - RNA, 19 nt, Shigella flexneri 2a str. 301
gaagggucuuuuaaauccu

SEQ ID NO: 1977972 - RNA, 21 nt, Shigella flexneri 2a str. 301
gaagguaaggauaaaaaaggg

SEQ ID NO: 1977973 - RNA, 22 nt, Shigella flexneri 2a str. 301
gaagggggauuacguagcacaa

SEQ ID NO: 1977974 - RNA, 11 nt, Shigella flexneri 2a str. 301
gaaggcggcga

SEQ ID NO: 1977975 - RNA, 20 nt, Shigella flexneri 2a str. 301
gaaggcgcacugauucauga

SEQ ID NO: 1977976 - RNA, 21 nt, Shigella flexneri 2a str. 301
gaaggcgauguucuggucacu

SEQ ID NO: 1977977 - RNA, 20 nt, Shigella flexneri 2a str. 301
gaagcuuuccacgcaggcau

SEQ ID NO: 1977978 - RNA, 15 nt, Shigella flexneri 2a str. 301
gaaguuuuccucagu

SEQ ID NO: 1977979 - RNA, 19 nt, Shigella flexneri 2a str. 301
gaaguuuugucgcugauuu

SEQ ID NO: 1977980 - RNA, 18 nt, Shigella flexneri 2a str. 301
gaaguucaggguuaaauc

SEQ ID NO: 1977981 - RNA, 17 nt, Shigella flexneri 2a str. 301
aaagaucgaucauuuuu

SEQ ID NO: 1977982 - RNA, 23 nt, Shigella flexneri 2a str. 301
aaagauauuggggguaauucccu

SEQ ID NO: 1977983 - RNA, 21 nt, Shigella flexneri 2a str. 301
gaagucgcagaccaaacucuu

SEQ ID NO: 1977984 - RNA, 14 nt, Shigella flexneri 2a str. 301
gaauaauccccaua

SEQ ID NO: 1977985 - RNA, 15 nt, Shigella flexneri 2a str. 301
gaauaauccccauau

SEQ ID NO: 1977986 - RNA, 22 nt, Shigella flexneri 2a str. 301
gaauaccaacgaggagacugca

SEQ ID NO: 1977987 - RNA, 18 nt, Shigella flexneri 2a str. 301
gaauaccguauucaacga

SEQ ID NO: 1977988 - RNA, 13 nt, Shigella flexneri 2a str. 301
gaauaccgacauc

SEQ ID NO: 1977989 - RNA, 15 nt, Shigella flexneri 2a str. 301
gaauaaaacagaaac

SEQ ID NO: 1977990 - RNA, 22 nt, Shigella flexneri 2a str. 301
gaauaaacguuccccaggguuu

SEQ ID NO: 1977991 - RNA, 15 nt, Shigella flexneri 2a str. 301
gaauaccuucuuccu

SEQ ID NO: 1977992 - RNA, 13 nt, Shigella flexneri 2a str. 301
gaauaccuucuuc

SEQ ID NO: 1977993 - RNA, 21 nt, Shigella flexneri 2a str. 301
aaagauuacugacaauuugcc

SEQ ID NO: 1977994 - RNA, 22 nt, Shigella flexneri 2a str. 301
aaagauguugucauuacaacaa

SEQ ID NO: 1977995 - RNA, 23 nt, Shigella flexneri 2a str. 301
aaagauguugucauuacaacaag

SEQ ID NO: 1977996 - RNA, 20 nt, Shigella flexneri 2a str. 301
gaauagccuuuagcgagcga

SEQ ID NO: 1977997 - RNA, 16 nt, Shigella flexneri 2a str. 301
gaauauuuccaguuca

SEQ ID NO: 1977998 - RNA, 17 nt, Shigella flexneri 2a str. 301
gaauauuucuauauccu

SEQ ID NO: 1977999 - RNA, 21 nt, Shigella flexneri 2a str. 301
gaaucaugguuuauuucccag

SEQ ID NO: 1978000 - RNA, 18 nt, Shigella flexneri 2a str. 301
gaaucaugccgaucgucu

SEQ ID NO: 1978001 - RNA, 22 nt, Shigella flexneri 2a str. 301
gaaucaugguuuauuucccaga

SEQ ID NO: 1978002 - RNA, 15 nt, Shigella flexneri 2a str. 301
gaaucauuguuauau

SEQ ID NO: 1978003 - RNA, 21 nt, Shigella flexneri 2a str. 301
gaaucaguaaugauucgggcu

SEQ ID NO: 1978004 - RNA, 21 nt, Shigella flexneri 2a str. 301
gaaucaucguucauauauucc

SEQ ID NO: 1978005 - RNA, 19 nt, Shigella flexneri 2a str. 301
gaaucauaaauacaaggcc

SEQ ID NO: 1978006 - RNA, 14 nt, Shigella flexneri 2a str. 301
gaaucagcaguuca

SEQ ID NO: 1978007 - RNA, 15 nt, Shigella flexneri 2a str. 301
gaaucuuuucaucgc

SEQ ID NO: 1978008 - RNA, 19 nt, Shigella flexneri 2a str. 301
gaaugacaacugcauuuuc

SEQ ID NO: 1978009 - RNA, 16 nt, Shigella flexneri 2a str. 301
gaaugacauaaugcaa

SEQ ID NO: 1978010 - RNA, 23 nt, Shigella flexneri 2a str. 301
gaaucgcaaagccgauaccuucc

SEQ ID NO: 1978011 - RNA, 23 nt, Shigella flexneri 2a str. 301
gaaucgccagcaucggcagcgcc

SEQ ID NO: 1978012 - RNA, 18 nt, Shigella flexneri 2a str. 301
gaaucgccagcaucggca

SEQ ID NO: 1978013 - RNA, 21 nt, Shigella flexneri 2a str. 301
gaauguggcaaugagugguga

SEQ ID NO: 1978014 - RNA, 14 nt, Shigella flexneri 2a str. 301
gaauguggcagcaa

SEQ ID NO: 1978015 - RNA, 18 nt, Shigella flexneri 2a str. 301
gaaugucggaugcagaac

SEQ ID NO: 1978016 - RNA, 20 nt, Shigella flexneri 2a str. 301
gaauguuccaucaccagauu

SEQ ID NO: 1978017 - RNA, 14 nt, Shigella flexneri 2a str. 301
gaauguuccauacc

SEQ ID NO: 1978018 - RNA, 11 nt, Shigella flexneri 2a str. 301
gaauguuccau

SEQ ID NO: 1978019 - RNA, 19 nt, Shigella flexneri 2a str. 301
gaaugcgguuaaaccgaaa

SEQ ID NO: 1978020 - RNA, 17 nt, Shigella flexneri 2a str. 301
gaaugccggguaauuuc

SEQ ID NO: 1978021 - RNA, 18 nt, Shigella flexneri 2a str. 301
gaaugaguacugaugaau

SEQ ID NO: 1978022 - RNA, 19 nt, Shigella flexneri 2a str. 301
gaaugaguacugaugaaua

SEQ ID NO: 1978023 - RNA, 14 nt, Shigella flexneri 2a str. 301
gaaugagcaucuac

SEQ ID NO: 1978024 - RNA, 21 nt, Shigella flexneri 2a str. 301
gaaugccgcagcacccugagu

SEQ ID NO: 1978025 - RNA, 19 nt, Shigella flexneri 2a str. 301
gaauuaagaauguuaaaua

SEQ ID NO: 1978026 - RNA, 21 nt, Shigella flexneri 2a str. 301
gaauuaaaacagguacuggcg

SEQ ID NO: 1978027 - RNA, 16 nt, Shigella flexneri 2a str. 301
gaauuaugcagccuuc

SEQ ID NO: 1978028 - RNA, 18 nt, Shigella flexneri 2a str. 301
gaauugcagauaccacau

SEQ ID NO: 1978029 - RNA, 12 nt, Shigella flexneri 2a str. 301
gaauugauucau

SEQ ID NO: 1978030 - RNA, 15 nt, Shigella flexneri 2a str. 301
gaauugcgagccugu

SEQ ID NO: 1978031 - RNA, 14 nt, Shigella flexneri 2a str. 301
gaauugccaccauc

SEQ ID NO: 1978032 - RNA, 19 nt, Shigella flexneri 2a str. 301
gaauuguuuuauaaagaac

SEQ ID NO: 1978033 - RNA, 10 nt, Shigella flexneri 2a str. 301
gaauuuaccc

SEQ ID NO: 1978034 - RNA, 14 nt, Shigella flexneri 2a str. 301
gaauugguagacgc

SEQ ID NO: 1978035 - RNA, 13 nt, Shigella flexneri 2a str. 301
gaauugguagacg

SEQ ID NO: 1978036 - RNA, 15 nt, Shigella flexneri 2a str. 301
gacaaaaauaccacc

SEQ ID NO: 1978037 - RNA, 14 nt, Shigella flexneri 2a str. 301
gacaaaaauaccac

SEQ ID NO: 1978038 - RNA, 21 nt, Shigella flexneri 2a str. 301
gacaaaaaaggugcugaaacu

SEQ ID NO: 1978039 - RNA, 14 nt, Shigella flexneri 2a str. 301
gaauuuuuccguug

SEQ ID NO: 1978040 - RNA, 17 nt, Shigella flexneri 2a str. 301
gaauuucaucaccagcu

SEQ ID NO: 1978041 - RNA, 11 nt, Shigella flexneri 2a str. 301
gacaacaucau

SEQ ID NO: 1978042 - RNA, 20 nt, Shigella flexneri 2a str. 301
gacaaacuugauagaacaaa

SEQ ID NO: 1978043 - RNA, 15 nt, Shigella flexneri 2a str. 301
gacaaagacaucaaa

SEQ ID NO: 1978044 - RNA, 19 nt, Shigella flexneri 2a str. 301
gacaaacagggugcagcga

SEQ ID NO: 1978045 - RNA, 23 nt, Shigella flexneri 2a str. 301
gacaaacacgguuaguucaaugc

SEQ ID NO: 1978046 - RNA, 21 nt, Shigella flexneri 2a str. 301
gacaaacacaauauucauagu

SEQ ID NO: 1978047 - RNA, 20 nt, Shigella flexneri 2a str. 301
gacaaacaccgaaccagaga

SEQ ID NO: 1978048 - RNA, 13 nt, Shigella flexneri 2a str. 301
gacaaaauguucg

SEQ ID NO: 1978049 - RNA, 12 nt, Shigella flexneri 2a str. 301
gacaaaauccug

SEQ ID NO: 1978050 - RNA, 17 nt, Shigella flexneri 2a str. 301
gacaaaaucggaaacaa

SEQ ID NO: 1978051 - RNA, 14 nt, Shigella flexneri 2a str. 301
gacaaggcaucaga

SEQ ID NO: 1978052 - RNA, 23 nt, Shigella flexneri 2a str. 301
gacaaggcguugauuggcgcagg

SEQ ID NO: 1978053 - RNA, 19 nt, Shigella flexneri 2a str. 301
gacaacgcuuuuugguuca

SEQ ID NO: 1978054 - RNA, 21 nt, Shigella flexneri 2a str. 301
gacaaccugaccuuuuuucag

SEQ ID NO: 1978055 - RNA, 11 nt, Shigella flexneri 2a str. 301
gacaaccgcaa

SEQ ID NO: 1978056 - RNA, 22 nt, Shigella flexneri 2a str. 301
gacaauaauaucuuuuuugcgu

SEQ ID NO: 1978057 - RNA, 13 nt, Shigella flexneri 2a str. 301
gacaauaaucaac

SEQ ID NO: 1978058 - RNA, 16 nt, Shigella flexneri 2a str. 301
gacaccccuucauuca

SEQ ID NO: 1978059 - RNA, 17 nt, Shigella flexneri 2a str. 301
gacaccccuucauucag

SEQ ID NO: 1978060 - RNA, 18 nt, Shigella flexneri 2a str. 301
gacaccccacagcucuug

SEQ ID NO: 1978061 - RNA, 18 nt, Shigella flexneri 2a str. 301
gacaccagcucagugacc

SEQ ID NO: 1978062 - RNA, 16 nt, Shigella flexneri 2a str. 301
gacaccagcacaucau

SEQ ID NO: 1978063 - RNA, 12 nt, Shigella flexneri 2a str. 301
gacaccaaacag

SEQ ID NO: 1978064 - RNA, 17 nt, Shigella flexneri 2a str. 301
gacaccaaggaacugug

SEQ ID NO: 1978065 - RNA, 13 nt, Shigella flexneri 2a str. 301
gacaauuugccca

SEQ ID NO: 1978066 - RNA, 22 nt, Shigella flexneri 2a str. 301
gacacaaauggcaguaucggca

SEQ ID NO: 1978067 - RNA, 18 nt, Shigella flexneri 2a str. 301
gacuacgccaacagaagu

SEQ ID NO: 1978068 - RNA, 15 nt, Shigella flexneri 2a str. 301
gacuacgccaacaga

SEQ ID NO: 1978069 - RNA, 15 nt, Shigella flexneri 2a str. 301
gacuaccauccgagu

SEQ ID NO: 1978070 - RNA, 23 nt, Shigella flexneri 2a str. 301
gacuacgacgccaagaaagagcg

SEQ ID NO: 1978071 - RNA, 15 nt, Shigella flexneri 2a str. 301
gacuaauuucucgcc

SEQ ID NO: 1978072 - RNA, 17 nt, Shigella flexneri 2a str. 301
gacuagcgccauaauaa

SEQ ID NO: 1978073 - RNA, 18 nt, Shigella flexneri 2a str. 301
gacuagcucaauaaaaga

SEQ ID NO: 1978074 - RNA, 14 nt, Shigella flexneri 2a str. 301
gacuauuacucaac

SEQ ID NO: 1978075 - RNA, 16 nt, Shigella flexneri 2a str. 301
gacuaucgacgauaau

SEQ ID NO: 1978076 - RNA, 23 nt, Shigella flexneri 2a str. 301
gacuauauaaauuacccuuuauu

SEQ ID NO: 1978077 - RNA, 15 nt, Shigella flexneri 2a str. 301
gacguuaagaaaacg

SEQ ID NO: 1978078 - RNA, 19 nt, Shigella flexneri 2a str. 301
gacguucaccgucaccccu

SEQ ID NO: 1978079 - RNA, 22 nt, Shigella flexneri 2a str. 301
gacguggggguucaaguccccc

SEQ ID NO: 1978080 - RNA, 18 nt, Shigella flexneri 2a str. 301
gacguauaaccggaugac

SEQ ID NO: 1978081 - RNA, 18 nt, Shigella flexneri 2a str. 301
gacguagugaaaucgcca

SEQ ID NO: 1978082 - RNA, 18 nt, Shigella flexneri 2a str. 301
gacgucacaggccaucac

SEQ ID NO: 1978083 - RNA, 17 nt, Shigella flexneri 2a str. 301
gacguggggguucaagu

SEQ ID NO: 1978084 - RNA, 12 nt, Shigella flexneri 2a str. 301
gacguucagcca

SEQ ID NO: 1978085 - RNA, 17 nt, Shigella flexneri 2a str. 301
gacguucaugccggucg

SEQ ID NO: 1978086 - RNA, 18 nt, Shigella flexneri 2a str. 301
gacggccguugugacuuu

SEQ ID NO: 1978087 - RNA, 20 nt, Shigella flexneri 2a str. 301
gacggccagucauugagcuu

SEQ ID NO: 1978088 - RNA, 17 nt, Shigella flexneri 2a str. 301
gacgcuguuguuuuuuc

SEQ ID NO: 1978089 - RNA, 19 nt, Shigella flexneri 2a str. 301
gacggaaaucgggagagau

SEQ ID NO: 1978090 - RNA, 18 nt, Shigella flexneri 2a str. 301
gaccugggaaauccaaca

SEQ ID NO: 1978091 - RNA, 15 nt, Shigella flexneri 2a str. 301
gaccugcgccugcac

SEQ ID NO: 1978092 - RNA, 19 nt, Shigella flexneri 2a str. 301
gaccugcaaauucaauaaa

SEQ ID NO: 1978093 - RNA, 16 nt, Shigella flexneri 2a str. 301
gaccugauuuugcaac

SEQ ID NO: 1978094 - RNA, 15 nt, Shigella flexneri 2a str. 301
gaccugauacauagc

SEQ ID NO: 1978095 - RNA, 18 nt, Shigella flexneri 2a str. 301
gaccugccgcagauauug

SEQ ID NO: 1978096 - RNA, 16 nt, Shigella flexneri 2a str. 301
gaccugacuguuccag

SEQ ID NO: 1978097 - RNA, 19 nt, Shigella flexneri 2a str. 301
gaccugaauuugcuccaga

SEQ ID NO: 1978098 - RNA, 18 nt, Shigella flexneri 2a str. 301
gaccggaaaagguguuca

SEQ ID NO: 1978099 - RNA, 17 nt, Shigella flexneri 2a str. 301
gaccuguaaaguacaau

SEQ ID NO: 1978100 - RNA, 21 nt, Shigella flexneri 2a str. 301
gaccugucggggccagcgcau

SEQ ID NO: 1978101 - RNA, 14 nt, Shigella flexneri 2a str. 301
gaccugguugcugg

SEQ ID NO: 1978102 - RNA, 19 nt, Shigella flexneri 2a str. 301
gaccuuucaguuugccgcu

SEQ ID NO: 1978103 - RNA, 17 nt, Shigella flexneri 2a str. 301
gacgaaaaaucaauaaa

SEQ ID NO: 1978104 - RNA, 18 nt, Shigella flexneri 2a str. 301
gaccuuucgaacccaacc

SEQ ID NO: 1978105 - RNA, 17 nt, Shigella flexneri 2a str. 301
gacgaaagucugggccg

SEQ ID NO: 1978106 - RNA, 18 nt, Shigella flexneri 2a str. 301
gacgaacguuuaauaaaa

SEQ ID NO: 1978107 - RNA, 13 nt, Shigella flexneri 2a str. 301
gacgaaccggcac

SEQ ID NO: 1978108 - RNA, 23 nt, Shigella flexneri 2a str. 301
gacgaagauguuguacagcgaaa

SEQ ID NO: 1978109 - RNA, 16 nt, Shigella flexneri 2a str. 301
gacgaagcaaccgcca

SEQ ID NO: 1978110 - RNA, 21 nt, Shigella flexneri 2a str. 301
gacgcaggcgcgcuguggugu

SEQ ID NO: 1978111 - RNA, 12 nt, Shigella flexneri 2a str. 301
gacgcaguccag

SEQ ID NO: 1978112 - RNA, 15 nt, Shigella flexneri 2a str. 301
gacgacuuuuuccau

SEQ ID NO: 1978113 - RNA, 15 nt, Shigella flexneri 2a str. 301
gacgacgguuuccac

SEQ ID NO: 1978114 - RNA, 21 nt, Shigella flexneri 2a str. 301
gacgcccguuaaccgcucugc

SEQ ID NO: 1978115 - RNA, 14 nt, Shigella flexneri 2a str. 301
gacgcccccaaacu

SEQ ID NO: 1978116 - RNA, 21 nt, Shigella flexneri 2a str. 301
gacgccccggccuugccuguu

SEQ ID NO: 1978117 - RNA, 17 nt, Shigella flexneri 2a str. 301
gacgcccuggaagaaaa

SEQ ID NO: 1978118 - RNA, 20 nt, Shigella flexneri 2a str. 301
gacgccacaaucugauaauc

SEQ ID NO: 1978119 - RNA, 12 nt, Shigella flexneri 2a str. 301
gacgccaagaaa

SEQ ID NO: 1978120 - RNA, 12 nt, Shigella flexneri 2a str. 301
gacgccagcgcu

SEQ ID NO: 1978121 - RNA, 20 nt, Shigella flexneri 2a str. 301
gaccccgaacucaucucucg

SEQ ID NO: 1978122 - RNA, 20 nt, Shigella flexneri 2a str. 301
gacccgacagaugcucgcca

SEQ ID NO: 1978123 - RNA, 14 nt, Shigella flexneri 2a str. 301
gaccgaaugcaguc

SEQ ID NO: 1978124 - RNA, 14 nt, Shigella flexneri 2a str. 301
gaccgccaccggcc

SEQ ID NO: 1978125 - RNA, 16 nt, Shigella flexneri 2a str. 301
gaccgcccgcuaugag

SEQ ID NO: 1978126 - RNA, 14 nt, Shigella flexneri 2a str. 301
gaccgccagcgcca

SEQ ID NO: 1978127 - RNA, 15 nt, Shigella flexneri 2a str. 301
gaccaucccaccacc

SEQ ID NO: 1978128 - RNA, 21 nt, Shigella flexneri 2a str. 301
gaccaucccaccaccagcaau

SEQ ID NO: 1978129 - RNA, 19 nt, Shigella flexneri 2a str. 301
gaccauacagcagcaacga

SEQ ID NO: 1978130 - RNA, 12 nt, Shigella flexneri 2a str. 301
gaccauaaaagg

SEQ ID NO: 1978131 - RNA, 19 nt, Shigella flexneri 2a str. 301
gaccaucuccuuacugccc

SEQ ID NO: 1978132 - RNA, 21 nt, Shigella flexneri 2a str. 301
gaccauugccaguaacagaac

SEQ ID NO: 1978133 - RNA, 17 nt, Shigella flexneri 2a str. 301
gaccaccgaaugcgccu

SEQ ID NO: 1978134 - RNA, 20 nt, Shigella flexneri 2a str. 301
gaccaccgaccaucccacca

SEQ ID NO: 1978135 - RNA, 13 nt, Shigella flexneri 2a str. 301
gaccaccgcgcua

SEQ ID NO: 1978136 - RNA, 20 nt, Shigella flexneri 2a str. 301
gaccagcgucgcaucaggca

SEQ ID NO: 1978137 - RNA, 18 nt, Shigella flexneri 2a str. 301
gaccagcuccagcagacc

SEQ ID NO: 1978138 - RNA, 16 nt, Shigella flexneri 2a str. 301
gaccagcuccagcaga

SEQ ID NO: 1978139 - RNA, 17 nt, Shigella flexneri 2a str. 301
gacaguguuauucccaa

SEQ ID NO: 1978140 - RNA, 16 nt, Shigella flexneri 2a str. 301
gacaguuauuaucuga

SEQ ID NO: 1978141 - RNA, 14 nt, Shigella flexneri 2a str. 301
gacauccaugcacu

SEQ ID NO: 1978142 - RNA, 18 nt, Shigella flexneri 2a str. 301
gacaucccggcagagaaa

SEQ ID NO: 1978143 - RNA, 12 nt, Shigella flexneri 2a str. 301
gacaucaucgcc

SEQ ID NO: 1978144 - RNA, 13 nt, Shigella flexneri 2a str. 301
gacaugguuggcc

SEQ ID NO: 1978145 - RNA, 12 nt, Shigella flexneri 2a str. 301
gacaugauucau

SEQ ID NO: 1978146 - RNA, 15 nt, Shigella flexneri 2a str. 301
gacauccugcguuaa

SEQ ID NO: 1978147 - RNA, 14 nt, Shigella flexneri 2a str. 301
gaccaaugacagcc

SEQ ID NO: 1978148 - RNA, 18 nt, Shigella flexneri 2a str. 301
gaccaauaaacgccaggu

SEQ ID NO: 1978149 - RNA, 13 nt, Shigella flexneri 2a str. 301
gaccaccagcacg

SEQ ID NO: 1978150 - RNA, 13 nt, Shigella flexneri 2a str. 301
gacauuuucucua

SEQ ID NO: 1978151 - RNA, 14 nt, Shigella flexneri 2a str. 301
gacauuuuggacaa

SEQ ID NO: 1978152 - RNA, 21 nt, Shigella flexneri 2a str. 301
gaccaaaacgugcagcugccu

SEQ ID NO: 1978153 - RNA, 16 nt, Shigella flexneri 2a str. 301
gaccaaagaaugacac

SEQ ID NO: 1978154 - RNA, 14 nt, Shigella flexneri 2a str. 301
gacauguggauuaa

SEQ ID NO: 1978155 - RNA, 21 nt, Shigella flexneri 2a str. 301
gacauguggauuaaauugcgc

SEQ ID NO: 1978156 - RNA, 14 nt, Shigella flexneri 2a str. 301
gacauguuuuccag

SEQ ID NO: 1978157 - RNA, 21 nt, Shigella flexneri 2a str. 301
gacauugugugaaaucagcac

SEQ ID NO: 1978158 - RNA, 22 nt, Shigella flexneri 2a str. 301
gacagagauucgguaaccaucc

SEQ ID NO: 1978159 - RNA, 20 nt, Shigella flexneri 2a str. 301
gacagagguggucgcagcgg

SEQ ID NO: 1978160 - RNA, 21 nt, Shigella flexneri 2a str. 301
gacagccauaaagaaaucacc

SEQ ID NO: 1978161 - RNA, 20 nt, Shigella flexneri 2a str. 301
gacagccauccgucauccau

SEQ ID NO: 1978162 - RNA, 15 nt, Shigella flexneri 2a str. 301
gacagauucaugcug

SEQ ID NO: 1978163 - RNA, 18 nt, Shigella flexneri 2a str. 301
gacaccgcccaacagacg

SEQ ID NO: 1978164 - RNA, 19 nt, Shigella flexneri 2a str. 301
gacagaccaaaacgugcag

SEQ ID NO: 1978165 - RNA, 16 nt, Shigella flexneri 2a str. 301
gacaccgcccaacaga

SEQ ID NO: 1978166 - RNA, 18 nt, Shigella flexneri 2a str. 301
gacaccgauauucgccgc

SEQ ID NO: 1978167 - RNA, 17 nt, Shigella flexneri 2a str. 301
gacagccgaaaagguag

SEQ ID NO: 1978168 - RNA, 18 nt, Shigella flexneri 2a str. 301
gacagggaucucuuccag

SEQ ID NO: 1978169 - RNA, 19 nt, Shigella flexneri 2a str. 301
gacaggcggcccagugaau

SEQ ID NO: 1978170 - RNA, 14 nt, Shigella flexneri 2a str. 301
gacaggugaugcau

SEQ ID NO: 1978171 - RNA, 15 nt, Shigella flexneri 2a str. 301
gacaggucaaaguaa

SEQ ID NO: 1978172 - RNA, 22 nt, Shigella flexneri 2a str. 301
gacaggucagcgccuggcugca

SEQ ID NO: 1978173 - RNA, 19 nt, Shigella flexneri 2a str. 301
gacagggugagcagggcac

SEQ ID NO: 1978174 - RNA, 19 nt, Shigella flexneri 2a str. 301
gacagggaucucuuccagu

SEQ ID NO: 1978175 - RNA, 18 nt, Shigella flexneri 2a str. 301
gacaguaccagcaguaca

SEQ ID NO: 1978176 - RNA, 16 nt, Shigella flexneri 2a str. 301
gacaguacccagauuc

SEQ ID NO: 1978177 - RNA, 19 nt, Shigella flexneri 2a str. 301
gacaguagccuuuaucugu

SEQ ID NO: 1978178 - RNA, 21 nt, Shigella flexneri 2a str. 301
gacaguaugguuacugucguu

SEQ ID NO: 1978179 - RNA, 20 nt, Shigella flexneri 2a str. 301
gaaagcgucagcuuucagag

SEQ ID NO: 1978180 - RNA, 19 nt, Shigella flexneri 2a str. 301
gaaagcgucagcuuucaga

SEQ ID NO: 1978181 - RNA, 20 nt, Shigella flexneri 2a str. 301
gaaagcggaucaguuccagc

SEQ ID NO: 1978182 - RNA, 23 nt, Shigella flexneri 2a str. 301
gaaagcggaucaguuccagcagc

SEQ ID NO: 1978183 - RNA, 15 nt, Shigella flexneri 2a str. 301
gaaagcggcguuuug

SEQ ID NO: 1978184 - RNA, 14 nt, Shigella flexneri 2a str. 301
gaaaguaaaaaaga

SEQ ID NO: 1978185 - RNA, 19 nt, Shigella flexneri 2a str. 301
gaaaguaaaaaagaaggaa

SEQ ID NO: 1978186 - RNA, 20 nt, Shigella flexneri 2a str. 301
gaaaguaaaaaagaaggaaa

SEQ ID NO: 1978187 - RNA, 16 nt, Shigella flexneri 2a str. 301
gaaagcuucaggcacc

SEQ ID NO: 1978188 - RNA, 22 nt, Shigella flexneri 2a str. 301
gaaagcugcugaccaccagcac

SEQ ID NO: 1978189 - RNA, 21 nt, Shigella flexneri 2a str. 301
gaaauaaucgggaauacagaa

SEQ ID NO: 1978190 - RNA, 22 nt, Shigella flexneri 2a str. 301
gaaaguacuucacaaucagcgc

SEQ ID NO: 1978191 - RNA, 17 nt, Shigella flexneri 2a str. 301
gaaauccucaaccggug

SEQ ID NO: 1978192 - RNA, 22 nt, Shigella flexneri 2a str. 301
gaaauccggcaccugucagacu

SEQ ID NO: 1978193 - RNA, 21 nt, Shigella flexneri 2a str. 301
gaaaucaccaccagcaccgcg

SEQ ID NO: 1978194 - RNA, 16 nt, Shigella flexneri 2a str. 301
gaaaucaccaccagca

SEQ ID NO: 1978195 - RNA, 12 nt, Shigella flexneri 2a str. 301
gaaaucaaguua

SEQ ID NO: 1978196 - RNA, 14 nt, Shigella flexneri 2a str. 301
gaaauaccagguug

SEQ ID NO: 1978197 - RNA, 17 nt, Shigella flexneri 2a str. 301
gaaauagaaacuggccc

SEQ ID NO: 1978198 - RNA, 17 nt, Shigella flexneri 2a str. 301
gaaacucacgccagcag

SEQ ID NO: 1978199 - RNA, 15 nt, Shigella flexneri 2a str. 301
gaaacucacgccagc

SEQ ID NO: 1978200 - RNA, 18 nt, Shigella flexneri 2a str. 301
gaaaauggccagccagca

SEQ ID NO: 1978201 - RNA, 15 nt, Shigella flexneri 2a str. 301
gaaaauggccagcca

SEQ ID NO: 1978202 - RNA, 17 nt, Shigella flexneri 2a str. 301
gaaaaugccgcacauca

SEQ ID NO: 1978203 - RNA, 23 nt, Shigella flexneri 2a str. 301
gaaaaugaguauucaguaugacu

SEQ ID NO: 1978204 - RNA, 18 nt, Shigella flexneri 2a str. 301
gaaacuucacaucaccau

SEQ ID NO: 1978205 - RNA, 13 nt, Shigella flexneri 2a str. 301
gaaacuggcccuc

SEQ ID NO: 1978206 - RNA, 15 nt, Shigella flexneri 2a str. 301
gaaacucauaugcag

SEQ ID NO: 1978207 - RNA, 12 nt, Shigella flexneri 2a str. 301
gaaacuuguaac

SEQ ID NO: 1978208 - RNA, 16 nt, Shigella flexneri 2a str. 301
gaaagcaccugcgcag

SEQ ID NO: 1978209 - RNA, 17 nt, Shigella flexneri 2a str. 301
gaaagcaccugcgcagg

SEQ ID NO: 1978210 - RNA, 20 nt, Shigella flexneri 2a str. 301
gaaagcaccugcgcaggcau

SEQ ID NO: 1978211 - RNA, 20 nt, Shigella flexneri 2a str. 301
gaaagcaauuaacagugaca

SEQ ID NO: 1978212 - RNA, 18 nt, Shigella flexneri 2a str. 301
gaaagcagcauguagaug

SEQ ID NO: 1978213 - RNA, 16 nt, Shigella flexneri 2a str. 301
gaaagcagauaaccca

SEQ ID NO: 1978214 - RNA, 17 nt, Shigella flexneri 2a str. 301
gaaagcagggcggcagg

SEQ ID NO: 1978215 - RNA, 18 nt, Shigella flexneri 2a str. 301
gaaauuccagcggcagga

SEQ ID NO: 1978216 - RNA, 13 nt, Shigella flexneri 2a str. 301
gaaauuccugaga

SEQ ID NO: 1978217 - RNA, 19 nt, Shigella flexneri 2a str. 301
gaaauucagcaguuuuugc

SEQ ID NO: 1978218 - RNA, 21 nt, Shigella flexneri 2a str. 301
gaaauucagcaguuuuugcaa

SEQ ID NO: 1978219 - RNA, 13 nt, Shigella flexneri 2a str. 301
gaaauucacuguc

SEQ ID NO: 1978220 - RNA, 19 nt, Shigella flexneri 2a str. 301
aaagagcagcugauugaaa

SEQ ID NO: 1978221 - RNA, 19 nt, Shigella flexneri 2a str. 301
gaaauuauuucuuuuacau

SEQ ID NO: 1978222 - RNA, 12 nt, Shigella flexneri 2a str. 301
gaaauugcacug

SEQ ID NO: 1978223 - RNA, 16 nt, Shigella flexneri 2a str. 301
gaaauuacaggcagua

SEQ ID NO: 1978224 - RNA, 19 nt, Shigella flexneri 2a str. 301
gaaaugcagcguuuccagc

SEQ ID NO: 1978225 - RNA, 14 nt, Shigella flexneri 2a str. 301
gaaaugaaaaaaua

SEQ ID NO: 1978226 - RNA, 13 nt, Shigella flexneri 2a str. 301
aaagagacagaau

SEQ ID NO: 1978227 - RNA, 21 nt, Shigella flexneri 2a str. 301
gaaauccugccgcaguuucug

SEQ ID NO: 1978228 - RNA, 14 nt, Shigella flexneri 2a str. 301
gaaauccugccgca

SEQ ID NO: 1978229 - RNA, 17 nt, Shigella flexneri 2a str. 301
gaaaugaaaaucaccau

SEQ ID NO: 1978230 - RNA, 21 nt, Shigella flexneri 2a str. 301
gaaaugagauauuucagagcu

SEQ ID NO: 1978231 - RNA, 13 nt, Shigella flexneri 2a str. 301
gaacaggcgcagg

SEQ ID NO: 1978232 - RNA, 15 nt, Shigella flexneri 2a str. 301
gaacacucuuccagu

SEQ ID NO: 1978233 - RNA, 18 nt, Shigella flexneri 2a str. 301
gaacaaggguaagggagg

SEQ ID NO: 1978234 - RNA, 14 nt, Shigella flexneri 2a str. 301
gaacaaaaucuuaa

SEQ ID NO: 1978235 - RNA, 16 nt, Shigella flexneri 2a str. 301
gaacaauacaggacgc

SEQ ID NO: 1978236 - RNA, 15 nt, Shigella flexneri 2a str. 301
gaacaauuggauagu

SEQ ID NO: 1978237 - RNA, 15 nt, Shigella flexneri 2a str. 301
gaacacgaucucacg

SEQ ID NO: 1978238 - RNA, 23 nt, Shigella flexneri 2a str. 301
gaacacgguaguuaaacuuucau

SEQ ID NO: 1978239 - RNA, 22 nt, Shigella flexneri 2a str. 301
gaacacgacauacaccgcagcc

SEQ ID NO: 1978240 - RNA, 13 nt, Shigella flexneri 2a str. 301
gaacggcggcggc

SEQ ID NO: 1978241 - RNA, 15 nt, Shigella flexneri 2a str. 301
gaacggcggcggcgc

SEQ ID NO: 1978242 - RNA, 15 nt, Shigella flexneri 2a str. 301
gaacggcagagaaac

SEQ ID NO: 1978243 - RNA, 20 nt, Shigella flexneri 2a str. 301
gaacggauaucgagaaucac

SEQ ID NO: 1978244 - RNA, 20 nt, Shigella flexneri 2a str. 301
gaacggcuucgccuccuguu

SEQ ID NO: 1978245 - RNA, 19 nt, Shigella flexneri 2a str. 301
gaacguaacaguacaauau

SEQ ID NO: 1978246 - RNA, 23 nt, Shigella flexneri 2a str. 301
gaacggugaaaacccuauuuuug

SEQ ID NO: 1978247 - RNA, 20 nt, Shigella flexneri 2a str. 301
gaacgguaacaggaagcagc

SEQ ID NO: 1978248 - RNA, 15 nt, Shigella flexneri 2a str. 301
gaacgguaagaacaa

SEQ ID NO: 1978249 - RNA, 13 nt, Shigella flexneri 2a str. 301
gaacgugcauauu

SEQ ID NO: 1978250 - RNA, 19 nt, Shigella flexneri 2a str. 301
gaacgugccaggguggcuc

SEQ ID NO: 1978251 - RNA, 20 nt, Shigella flexneri 2a str. 301
gaacguuacaaucugcgcug

SEQ ID NO: 1978252 - RNA, 15 nt, Shigella flexneri 2a str. 301
gaacgccuaauccag

SEQ ID NO: 1978253 - RNA, 14 nt, Shigella flexneri 2a str. 301
gaacgccugugucc

SEQ ID NO: 1978254 - RNA, 17 nt, Shigella flexneri 2a str. 301
gaacgccuuauccgccc

SEQ ID NO: 1978255 - RNA, 14 nt, Shigella flexneri 2a str. 301
gaacgcguaucuuu

SEQ ID NO: 1978256 - RNA, 17 nt, Shigella flexneri 2a str. 301
gaacgcguaucuuuaua

SEQ ID NO: 1978257 - RNA, 16 nt, Shigella flexneri 2a str. 301
gaacgcguucacugcc

SEQ ID NO: 1978258 - RNA, 18 nt, Shigella flexneri 2a str. 301
gaacgcguucacugccgu

SEQ ID NO: 1978259 - RNA, 22 nt, Shigella flexneri 2a str. 301
gaacgcccacggcguggcauca

SEQ ID NO: 1978260 - RNA, 14 nt, Shigella flexneri 2a str. 301
gaacgcccacggcg

SEQ ID NO: 1978261 - RNA, 13 nt, Shigella flexneri 2a str. 301
gaacgccaguuca

SEQ ID NO: 1978262 - RNA, 20 nt, Shigella flexneri 2a str. 301
gaacgcaccgaccaucggca

SEQ ID NO: 1978263 - RNA, 17 nt, Shigella flexneri 2a str. 301
gaacgccaaauucuuua

SEQ ID NO: 1978264 - RNA, 14 nt, Shigella flexneri 2a str. 301
gaacucaaaccauu

SEQ ID NO: 1978265 - RNA, 17 nt, Shigella flexneri 2a str. 301
gaacuauuaaaauuuca

SEQ ID NO: 1978266 - RNA, 19 nt, Shigella flexneri 2a str. 301
gaacuauauucucaaaaua

SEQ ID NO: 1978267 - RNA, 15 nt, Shigella flexneri 2a str. 301
gaacucacagggcug

SEQ ID NO: 1978268 - RNA, 14 nt, Shigella flexneri 2a str. 301
gaacucacagggcu

SEQ ID NO: 1978269 - RNA, 18 nt, Shigella flexneri 2a str. 301
gaacuauuggucuggaac

SEQ ID NO: 1978270 - RNA, 15 nt, Shigella flexneri 2a str. 301
gaacucaggcugcca

SEQ ID NO: 1978271 - RNA, 22 nt, Shigella flexneri 2a str. 301
gaacucaggcugccagaucauc

SEQ ID NO: 1978272 - RNA, 12 nt, Shigella flexneri 2a str. 301
gaacucgccagc

SEQ ID NO: 1978273 - RNA, 17 nt, Shigella flexneri 2a str. 301
gaacucgccagccacca

SEQ ID NO: 1978274 - RNA, 22 nt, Shigella flexneri 2a str. 301
gaacucgacgcccuggaagaaa

SEQ ID NO: 1978275 - RNA, 16 nt, Shigella flexneri 2a str. 301
gaacuggcguguuuca

SEQ ID NO: 1978276 - RNA, 19 nt, Shigella flexneri 2a str. 301
gaacuggcguguuucauua

SEQ ID NO: 1978277 - RNA, 15 nt, Shigella flexneri 2a str. 301
gaacuggcaggaaac

SEQ ID NO: 1978278 - RNA, 19 nt, Shigella flexneri 2a str. 301
gaacuggcuguagaagcug

SEQ ID NO: 1978279 - RNA, 20 nt, Shigella flexneri 2a str. 301
gaacuggcuguagaagcuga

SEQ ID NO: 1978280 - RNA, 15 nt, Shigella flexneri 2a str. 301
gaacugggcgcggcc

SEQ ID NO: 1978281 - RNA, 15 nt, Shigella flexneri 2a str. 301
gaacugcaacucacc

SEQ ID NO: 1978282 - RNA, 17 nt, Shigella flexneri 2a str. 301
gaacugcaacucaccuu

SEQ ID NO: 1978283 - RNA, 14 nt, Shigella flexneri 2a str. 301
gaacugcaacucac

SEQ ID NO: 1978284 - RNA, 21 nt, Shigella flexneri 2a str. 301
gaacugauaacgcauuucaug

SEQ ID NO: 1978285 - RNA, 14 nt, Shigella flexneri 2a str. 301
gaacugauugccac

SEQ ID NO: 1978286 - RNA, 16 nt, Shigella flexneri 2a str. 301
gaacugauugccaccc

SEQ ID NO: 1978287 - RNA, 21 nt, Shigella flexneri 2a str. 301
gaacugauugccacccugcgg

SEQ ID NO: 1978288 - RNA, 23 nt, Shigella flexneri 2a str. 301
gaacucguucagcgcauuccagu

SEQ ID NO: 1978289 - RNA, 22 nt, Shigella flexneri 2a str. 301
gaacucguucagcgcauuccag

SEQ ID NO: 1978290 - RNA, 14 nt, Shigella flexneri 2a str. 301
gaacucuuccggca

SEQ ID NO: 1978291 - RNA, 14 nt, Shigella flexneri 2a str. 301
gaacugacagccaa

SEQ ID NO: 1978292 - RNA, 18 nt, Shigella flexneri 2a str. 301
gaacugaacaaaaaagag

SEQ ID NO: 1978293 - RNA, 19 nt, Shigella flexneri 2a str. 301
gaacugacuuccacuuccu

SEQ ID NO: 1978294 - RNA, 17 nt, Shigella flexneri 2a str. 301
gaacaucaauccaaaca

SEQ ID NO: 1978295 - RNA, 14 nt, Shigella flexneri 2a str. 301
gaacaucauucccg

SEQ ID NO: 1978296 - RNA, 15 nt, Shigella flexneri 2a str. 301
gaacauccagcagca

SEQ ID NO: 1978297 - RNA, 15 nt, Shigella flexneri 2a str. 301
gaacaucacugcaaa

SEQ ID NO: 1978298 - RNA, 13 nt, Shigella flexneri 2a str. 301
gaacauuggauua

SEQ ID NO: 1978299 - RNA, 23 nt, Shigella flexneri 2a str. 301
gaacauuguuauucuccuucacg

SEQ ID NO: 1978300 - RNA, 16 nt, Shigella flexneri 2a str. 301
gaacauuacuuuccgu

SEQ ID NO: 1978301 - RNA, 15 nt, Shigella flexneri 2a str. 301
gaacauuacuuuccg

SEQ ID NO: 1978302 - RNA, 21 nt, Shigella flexneri 2a str. 301
gaaccacggaauaaccagcga

SEQ ID NO: 1978303 - RNA, 18 nt, Shigella flexneri 2a str. 301
gaaccaaaauagauaauc

SEQ ID NO: 1978304 - RNA, 21 nt, Shigella flexneri 2a str. 301
gaaccauuauccgucagccac

SEQ ID NO: 1978305 - RNA, 18 nt, Shigella flexneri 2a str. 301
gaaccagugcuccaccuu

SEQ ID NO: 1978306 - RNA, 13 nt, Shigella flexneri 2a str. 301
gaaccaucaccuc

SEQ ID NO: 1978307 - RNA, 13 nt, Shigella flexneri 2a str. 301
gaaccaugcaauu

SEQ ID NO: 1978308 - RNA, 19 nt, Shigella flexneri 2a str. 301
gaaccauuucgauagacuc

SEQ ID NO: 1978309 - RNA, 20 nt, Shigella flexneri 2a str. 301
gaaccagacugcacauggcg

SEQ ID NO: 1978310 - RNA, 16 nt, Shigella flexneri 2a str. 301
gaaccagugaauacug

SEQ ID NO: 1978311 - RNA, 19 nt, Shigella flexneri 2a str. 301
gaaccagggaaaaaagccc

SEQ ID NO: 1978312 - RNA, 17 nt, Shigella flexneri 2a str. 301
gaacccguuggcacagg

SEQ ID NO: 1978313 - RNA, 21 nt, Shigella flexneri 2a str. 301
gaaccgauaguauggagcagg

SEQ ID NO: 1978314 - RNA, 16 nt, Shigella flexneri 2a str. 301
gaaccgacgauuaaac

SEQ ID NO: 1978315 - RNA, 15 nt, Shigella flexneri 2a str. 301
gaaccggaccagcaa

SEQ ID NO: 1978316 - RNA, 15 nt, Shigella flexneri 2a str. 301
gaaccguaaacagau

SEQ ID NO: 1978317 - RNA, 23 nt, Shigella flexneri 2a str. 301
gaaccugaacucgccgcacaggc

SEQ ID NO: 1978318 - RNA, 19 nt, Shigella flexneri 2a str. 301
gaaccuccauguccagcuu

SEQ ID NO: 1978319 - RNA, 23 nt, Shigella flexneri 2a str. 301
gaaccucacagaggucuuuucuc

SEQ ID NO: 1978320 - RNA, 22 nt, Shigella flexneri 2a str. 301
gaaccguaggccguauccggca

SEQ ID NO: 1978321 - RNA, 16 nt, Shigella flexneri 2a str. 301
gaacgagaaaaugacg

SEQ ID NO: 1978322 - RNA, 19 nt, Shigella flexneri 2a str. 301
gaacgacauggcccagccc

SEQ ID NO: 1978323 - RNA, 18 nt, Shigella flexneri 2a str. 301
gaaccuuuaucacuguga

SEQ ID NO: 1978324 - RNA, 18 nt, Shigella flexneri 2a str. 301
gaaccugugacagcagcg

SEQ ID NO: 1978325 - RNA, 19 nt, Shigella flexneri 2a str. 301
gaaccugugacagcagcgg

SEQ ID NO: 1978326 - RNA, 15 nt, Shigella flexneri 2a str. 301
gaaccuguuuucacc

SEQ ID NO: 1978327 - RNA, 18 nt, Shigella flexneri 2a str. 301
gaaccugaacgccggguu

SEQ ID NO: 1978328 - RNA, 23 nt, Shigella flexneri 2a str. 301
cuuuucuuucgcccaauaaaaaa

SEQ ID NO: 1978329 - RNA, 20 nt, Shigella flexneri 2a str. 301
aaagacguuaaaaaaggugc

SEQ ID NO: 1978330 - RNA, 20 nt, Shigella flexneri 2a str. 301
cuuuucgcccuggacaacau

SEQ ID NO: 1978331 - RNA, 21 nt, Shigella flexneri 2a str. 301
cuuuucugaaguacacauaaa

SEQ ID NO: 1978332 - RNA, 16 nt, Shigella flexneri 2a str. 301
cuuuucugaaguacac

SEQ ID NO: 1978333 - RNA, 15 nt, Shigella flexneri 2a str. 301
aaagaccugaccaga

SEQ ID NO: 1978334 - RNA, 20 nt, Shigella flexneri 2a str. 301
aaagacggcggcaacauggc

SEQ ID NO: 1978335 - RNA, 17 nt, Shigella flexneri 2a str. 301
aaagacgaagauuuuac

SEQ ID NO: 1978336 - RNA, 16 nt, Shigella flexneri 2a str. 301
cuuuucauauuauuug

SEQ ID NO: 1978337 - RNA, 21 nt, Shigella flexneri 2a str. 301
cuuuucaucagaucgcgaccg

SEQ ID NO: 1978338 - RNA, 20 nt, Shigella flexneri 2a str. 301
cuuuucaguuggcugacaaa

SEQ ID NO: 1978339 - RNA, 20 nt, Shigella flexneri 2a str. 301
cuuuucauaaucacgcuuua

SEQ ID NO: 1978340 - RNA, 20 nt, Shigella flexneri 2a str. 301
cuuuucaggcuagccgccag

SEQ ID NO: 1978341 - RNA, 21 nt, Shigella flexneri 2a str. 301
cuuuucaucagguuggaucaa

SEQ ID NO: 1978342 - RNA, 17 nt, Shigella flexneri 2a str. 301
cuuuucaucgcaucgau

SEQ ID NO: 1978343 - RNA, 15 nt, Shigella flexneri 2a str. 301
cuuuuccgaaccgga

SEQ ID NO: 1978344 - RNA, 23 nt, Shigella flexneri 2a str. 301
cuuuuccagcauaaugugcgcac

SEQ ID NO: 1978345 - RNA, 18 nt, Shigella flexneri 2a str. 301
cuuuuccauaucaagcau

SEQ ID NO: 1978346 - RNA, 18 nt, Shigella flexneri 2a str. 301
cuuuuccucucaugagca

SEQ ID NO: 1978347 - RNA, 12 nt, Shigella flexneri 2a str. 301
cuuuuauuguua

SEQ ID NO: 1978348 - RNA, 11 nt, Shigella flexneri 2a str. 301
cuuuuaucugu

SEQ ID NO: 1978349 - RNA, 14 nt, Shigella flexneri 2a str. 301
cuuuuacauuaucc

SEQ ID NO: 1978350 - RNA, 19 nt, Shigella flexneri 2a str. 301
cuuuuaccugcuuaaucau

SEQ ID NO: 1978351 - RNA, 17 nt, Shigella flexneri 2a str. 301
cuuuuacaucuacaaaa

SEQ ID NO: 1978352 - RNA, 18 nt, Shigella flexneri 2a str. 301
cuuuuacaucuacaaaaa

SEQ ID NO: 1978353 - RNA, 20 nt, Shigella flexneri 2a str. 301
cuuuuacaucuacaaaaaac

SEQ ID NO: 1978354 - RNA, 20 nt, Shigella flexneri 2a str. 301
cuuuuacaugcgcgacaaaa

SEQ ID NO: 1978355 - RNA, 21 nt, Shigella flexneri 2a str. 301
cuuuuacaugcgcgacaaaaa

SEQ ID NO: 1978356 - RNA, 22 nt, Shigella flexneri 2a str. 301
cuuuuuuuugccaaauaucuua

SEQ ID NO: 1978357 - RNA, 21 nt, Shigella flexneri 2a str. 301
gaaaaaaaauuacaaaaagug

SEQ ID NO: 1978358 - RNA, 13 nt, Shigella flexneri 2a str. 301
gaaaaaaaagaag

SEQ ID NO: 1978359 - RNA, 16 nt, Shigella flexneri 2a str. 301
cuuuuuuugccccaga

SEQ ID NO: 1978360 - RNA, 20 nt, Shigella flexneri 2a str. 301
cuuuuuucaauucucuaauc

SEQ ID NO: 1978361 - RNA, 12 nt, Shigella flexneri 2a str. 301
gaaaaaaacugc

SEQ ID NO: 1978362 - RNA, 13 nt, Shigella flexneri 2a str. 301
gaaaaaaccagaa

SEQ ID NO: 1978363 - RNA, 12 nt, Shigella flexneri 2a str. 301
gaaaaaacaaau

SEQ ID NO: 1978364 - RNA, 18 nt, Shigella flexneri 2a str. 301
gaaaaaaaucaugcaaua

SEQ ID NO: 1978365 - RNA, 18 nt, Shigella flexneri 2a str. 301
gaaaaagagcagcugauu

SEQ ID NO: 1978366 - RNA, 13 nt, Shigella flexneri 2a str. 301
gaaaaagagcauc

SEQ ID NO: 1978367 - RNA, 16 nt, Shigella flexneri 2a str. 301
gaaaaagagcaucagc

SEQ ID NO: 1978368 - RNA, 22 nt, Shigella flexneri 2a str. 301
gaaaaaguugcacgccaggcac

SEQ ID NO: 1978369 - RNA, 23 nt, Shigella flexneri 2a str. 301
gaaaaauaaaagcgugaaacaaa

SEQ ID NO: 1978370 - RNA, 20 nt, Shigella flexneri 2a str. 301
cuuuuugaacggugaugcuc

SEQ ID NO: 1978371 - RNA, 20 nt, Shigella flexneri 2a str. 301
cuuuuugaacggguugcggu

SEQ ID NO: 1978372 - RNA, 12 nt, Shigella flexneri 2a str. 301
cuuuuuuaaaca

SEQ ID NO: 1978373 - RNA, 19 nt, Shigella flexneri 2a str. 301
cuuuuguuuguucuucucg

SEQ ID NO: 1978374 - RNA, 15 nt, Shigella flexneri 2a str. 301
cuuuuguuucccgau

SEQ ID NO: 1978375 - RNA, 20 nt, Shigella flexneri 2a str. 301
gaaaacguuucaaacaggcu

SEQ ID NO: 1978376 - RNA, 21 nt, Shigella flexneri 2a str. 301
gaaaacguuucaaacaggcug

SEQ ID NO: 1978377 - RNA, 17 nt, Shigella flexneri 2a str. 301
gaaaagauccguaaugc

SEQ ID NO: 1978378 - RNA, 19 nt, Shigella flexneri 2a str. 301
gaaaauacagcaauggaaa

SEQ ID NO: 1978379 - RNA, 23 nt, Shigella flexneri 2a str. 301
gaaaauaaccauauaugauaauu

SEQ ID NO: 1978380 - RNA, 17 nt, Shigella flexneri 2a str. 301
gaaaauaaaucaaaguc

SEQ ID NO: 1978381 - RNA, 16 nt, Shigella flexneri 2a str. 301
gaaaaucaccucauca

SEQ ID NO: 1978382 - RNA, 20 nt, Shigella flexneri 2a str. 301
gaaaauagacguucuucuuc

SEQ ID NO: 1978383 - RNA, 14 nt, Shigella flexneri 2a str. 301
gaaaaucagcauca

SEQ ID NO: 1978384 - RNA, 14 nt, Shigella flexneri 2a str. 301
gaaaacgcccggca

SEQ ID NO: 1978385 - RNA, 13 nt, Shigella flexneri 2a str. 301
gaaaacgcuggca

SEQ ID NO: 1978386 - RNA, 22 nt, Shigella flexneri 2a str. 301
gaaaacgucaugguuauuucac

SEQ ID NO: 1978387 - RNA, 19 nt, Shigella flexneri 2a str. 301
gaaaacgcauaccagucua

SEQ ID NO: 1978388 - RNA, 11 nt, Shigella flexneri 2a str. 301
gaaaaccgcac

SEQ ID NO: 1978389 - RNA, 14 nt, Shigella flexneri 2a str. 301
gaaaaccacuccug

SEQ ID NO: 1978390 - RNA, 22 nt, Shigella flexneri 2a str. 301
gaaaacagcgcaccagaaacaa

SEQ ID NO: 1978391 - RNA, 23 nt, Shigella flexneri 2a str. 301
gaaaacagcgcaccagaaacaau

SEQ ID NO: 1978392 - RNA, 14 nt, Shigella flexneri 2a str. 301
cuuuacccagcgga

SEQ ID NO: 1978393 - RNA, 13 nt, Shigella flexneri 2a str. 301
cuuuacgcaaaau

SEQ ID NO: 1978394 - RNA, 23 nt, Shigella flexneri 2a str. 301
cuuuaccucgaaaaccacuccug

SEQ ID NO: 1978395 - RNA, 22 nt, Shigella flexneri 2a str. 301
cuuuaccgugguugcgccuggg

SEQ ID NO: 1978396 - RNA, 14 nt, Shigella flexneri 2a str. 301
cuuuaccucgaaaa

SEQ ID NO: 1978397 - RNA, 20 nt, Shigella flexneri 2a str. 301
cuuuacgaucaucacguugg

SEQ ID NO: 1978398 - RNA, 23 nt, Shigella flexneri 2a str. 301
cuuuaaguucagccaguugaucu

SEQ ID NO: 1978399 - RNA, 15 nt, Shigella flexneri 2a str. 301
cuuuaauaccugccu

SEQ ID NO: 1978400 - RNA, 15 nt, Shigella flexneri 2a str. 301
cuuuaaugacacgaa

SEQ ID NO: 1978401 - RNA, 20 nt, Shigella flexneri 2a str. 301
cuuuaaaugcugcuuuauau

SEQ ID NO: 1978402 - RNA, 23 nt, Shigella flexneri 2a str. 301
aaagacaucgcccgauucacaua

SEQ ID NO: 1978403 - RNA, 19 nt, Shigella flexneri 2a str. 301
cuucggcggcguugcuuuu

SEQ ID NO: 1978404 - RNA, 21 nt, Shigella flexneri 2a str. 301
cuucgcuguacgccuucaugu

SEQ ID NO: 1978405 - RNA, 21 nt, Shigella flexneri 2a str. 301
cuucgcuucaccgacaucuuu

SEQ ID NO: 1978406 - RNA, 19 nt, Shigella flexneri 2a str. 301
cuucgcuuacgccugccag

SEQ ID NO: 1978407 - RNA, 18 nt, Shigella flexneri 2a str. 301
cuucggacguuugccaug

SEQ ID NO: 1978408 - RNA, 17 nt, Shigella flexneri 2a str. 301
cuucggcacugaccacu

SEQ ID NO: 1978409 - RNA, 21 nt, Shigella flexneri 2a str. 301
cuucgcucauguuaucaagau

SEQ ID NO: 1978410 - RNA, 21 nt, Shigella flexneri 2a str. 301
cuuucaaugcuuuuugcauuu

SEQ ID NO: 1978411 - RNA, 13 nt, Shigella flexneri 2a str. 301
cuuuauugcaaac

SEQ ID NO: 1978412 - RNA, 15 nt, Shigella flexneri 2a str. 301
cuuuauugaguacca

SEQ ID NO: 1978413 - RNA, 14 nt, Shigella flexneri 2a str. 301
cuuucacaaaaaua

SEQ ID NO: 1978414 - RNA, 16 nt, Shigella flexneri 2a str. 301
cuuucacaaaaauaau

SEQ ID NO: 1978415 - RNA, 20 nt, Shigella flexneri 2a str. 301
cuuucacccggcgcuaauuc

SEQ ID NO: 1978416 - RNA, 23 nt, Shigella flexneri 2a str. 301
cuuucaccaucgcgaucaucagu

SEQ ID NO: 1978417 - RNA, 21 nt, Shigella flexneri 2a str. 301
cuuucauaugauaggcuucca

SEQ ID NO: 1978418 - RNA, 14 nt, Shigella flexneri 2a str. 301
cuuucauacugccg

SEQ ID NO: 1978419 - RNA, 16 nt, Shigella flexneri 2a str. 301
cuuucaggccgcgcag

SEQ ID NO: 1978420 - RNA, 13 nt, Shigella flexneri 2a str. 301
cuuucagcacuua

SEQ ID NO: 1978421 - RNA, 21 nt, Shigella flexneri 2a str. 301
cuuucagcaguucagucagca

SEQ ID NO: 1978422 - RNA, 19 nt, Shigella flexneri 2a str. 301
cuuuauagugugcaaucac

SEQ ID NO: 1978423 - RNA, 18 nt, Shigella flexneri 2a str. 301
cuuuagccgguuuuucaa

SEQ ID NO: 1978424 - RNA, 18 nt, Shigella flexneri 2a str. 301
cuuuaucgccgcuggaaa

SEQ ID NO: 1978425 - RNA, 19 nt, Shigella flexneri 2a str. 301
cuuuaucgccgcuggaaau

SEQ ID NO: 1978426 - RNA, 13 nt, Shigella flexneri 2a str. 301
cuuuauccugacu

SEQ ID NO: 1978427 - RNA, 15 nt, Shigella flexneri 2a str. 301
cuuuaucaccaauga

SEQ ID NO: 1978428 - RNA, 17 nt, Shigella flexneri 2a str. 301
cuuuauuauuuucaaua

SEQ ID NO: 1978429 - RNA, 20 nt, Shigella flexneri 2a str. 301
cuuuauucaccaguaaggca

SEQ ID NO: 1978430 - RNA, 17 nt, Shigella flexneri 2a str. 301
cuuuaucggcgcugcuu

SEQ ID NO: 1978431 - RNA, 17 nt, Shigella flexneri 2a str. 301
cuuugcagguucugcuc

SEQ ID NO: 1978432 - RNA, 19 nt, Shigella flexneri 2a str. 301
cuuugauugaagaaaucag

SEQ ID NO: 1978433 - RNA, 17 nt, Shigella flexneri 2a str. 301
cuuugcuaccuuccucc

SEQ ID NO: 1978434 - RNA, 17 nt, Shigella flexneri 2a str. 301
cuuugcugauucucccu

SEQ ID NO: 1978435 - RNA, 21 nt, Shigella flexneri 2a str. 301
cuuugaucucaaacgguucuu

SEQ ID NO: 1978436 - RNA, 21 nt, Shigella flexneri 2a str. 301
cuuugacugcuuuuacaaaau

SEQ ID NO: 1978437 - RNA, 15 nt, Shigella flexneri 2a str. 301
cuuugauuaaccguu

SEQ ID NO: 1978438 - RNA, 23 nt, Shigella flexneri 2a str. 301
cuuugauguacgcugccgcuucu

SEQ ID NO: 1978439 - RNA, 16 nt, Shigella flexneri 2a str. 301
cuuugacauguugcug

SEQ ID NO: 1978440 - RNA, 21 nt, Shigella flexneri 2a str. 301
cuuugacauguugcugaccuu

SEQ ID NO: 1978441 - RNA, 19 nt, Shigella flexneri 2a str. 301
cuuugacgaugcuccacuc

SEQ ID NO: 1978442 - RNA, 13 nt, Shigella flexneri 2a str. 301
cuuugcuggcaug

SEQ ID NO: 1978443 - RNA, 14 nt, Shigella flexneri 2a str. 301
cuuugcuggcuggc

SEQ ID NO: 1978444 - RNA, 13 nt, Shigella flexneri 2a str. 301
cuuuguagaugau

SEQ ID NO: 1978445 - RNA, 21 nt, Shigella flexneri 2a str. 301
cuuugucauuaaagccgccaa

SEQ ID NO: 1978446 - RNA, 16 nt, Shigella flexneri 2a str. 301
cuuuguauuuauuuuc

SEQ ID NO: 1978447 - RNA, 23 nt, Shigella flexneri 2a str. 301
cuuugucaaaaaucuaaccuacu

SEQ ID NO: 1978448 - RNA, 18 nt, Shigella flexneri 2a str. 301
cuuuguuaaacagugccc

SEQ ID NO: 1978449 - RNA, 14 nt, Shigella flexneri 2a str. 301
cuuuguucugaauc

SEQ ID NO: 1978450 - RNA, 15 nt, Shigella flexneri 2a str. 301
cuuuguucugaauca

SEQ ID NO: 1978451 - RNA, 22 nt, Shigella flexneri 2a str. 301
cuuugucgauaauauugagcac

SEQ ID NO: 1978452 - RNA, 17 nt, Shigella flexneri 2a str. 301
cuuuguuagcgaauaaa

SEQ ID NO: 1978453 - RNA, 14 nt, Shigella flexneri 2a str. 301
cuuugugcuucagu

SEQ ID NO: 1978454 - RNA, 21 nt, Shigella flexneri 2a str. 301
cuuucuauaagauacuggaua

SEQ ID NO: 1978455 - RNA, 17 nt, Shigella flexneri 2a str. 301
cuuucucauuuuuuaaa

SEQ ID NO: 1978456 - RNA, 19 nt, Shigella flexneri 2a str. 301
cuuucugaaggauuagccg

SEQ ID NO: 1978457 - RNA, 16 nt, Shigella flexneri 2a str. 301
cuuucucuucaucuau

SEQ ID NO: 1978458 - RNA, 21 nt, Shigella flexneri 2a str. 301
cuuucugaacugaacaaaaaa

SEQ ID NO: 1978459 - RNA, 14 nt, Shigella flexneri 2a str. 301
cuuucugaaggauu

SEQ ID NO: 1978460 - RNA, 17 nt, Shigella flexneri 2a str. 301
cuuugaaaauaacaucg

SEQ ID NO: 1978461 - RNA, 23 nt, Shigella flexneri 2a str. 301
cuuucugagauucaauuauagua

SEQ ID NO: 1978462 - RNA, 11 nt, Shigella flexneri 2a str. 301
cuuucuucugg

SEQ ID NO: 1978463 - RNA, 20 nt, Shigella flexneri 2a str. 301
cuuucugagcggccuuuucc

SEQ ID NO: 1978464 - RNA, 16 nt, Shigella flexneri 2a str. 301
cuuucguuaaauucuu

SEQ ID NO: 1978465 - RNA, 21 nt, Shigella flexneri 2a str. 301
cuuucguggugagggcaaaca

SEQ ID NO: 1978466 - RNA, 18 nt, Shigella flexneri 2a str. 301
cuuucguuaaauucuucu

SEQ ID NO: 1978467 - RNA, 22 nt, Shigella flexneri 2a str. 301
cuuucguuaaauucuucugaau

SEQ ID NO: 1978468 - RNA, 22 nt, Shigella flexneri 2a str. 301
cuuucccuucacucugcugcca

SEQ ID NO: 1978469 - RNA, 14 nt, Shigella flexneri 2a str. 301
cuuucccuggcgcu

SEQ ID NO: 1978470 - RNA, 17 nt, Shigella flexneri 2a str. 301
cuuuccggcaucacauc

SEQ ID NO: 1978471 - RNA, 20 nt, Shigella flexneri 2a str. 301
cuuucgucugguucgccaaa

SEQ ID NO: 1978472 - RNA, 19 nt, Shigella flexneri 2a str. 301
cuuucguggugagggcaaa

SEQ ID NO: 1978473 - RNA, 19 nt, Shigella flexneri 2a str. 301
cuuuccgcuggcgucuggg

SEQ ID NO: 1978474 - RNA, 21 nt, Shigella flexneri 2a str. 301
cuuuccggcagaagcaaucau

SEQ ID NO: 1978475 - RNA, 16 nt, Shigella flexneri 2a str. 301
cuuuccaucuuuccuc

SEQ ID NO: 1978476 - RNA, 18 nt, Shigella flexneri 2a str. 301
cuuuccaaaccucagagu

SEQ ID NO: 1978477 - RNA, 17 nt, Shigella flexneri 2a str. 301
cuuucauuuucggcagu

SEQ ID NO: 1978478 - RNA, 20 nt, Shigella flexneri 2a str. 301
cuuucccgcgcccgugcauc

SEQ ID NO: 1978479 - RNA, 20 nt, Shigella flexneri 2a str. 301
cuuucauuucaauaaauucc

SEQ ID NO: 1978480 - RNA, 18 nt, Shigella flexneri 2a str. 301
gauaugcaucaugaaaac

SEQ ID NO: 1978481 - RNA, 18 nt, Shigella flexneri 2a str. 301
gauaugcaguaaggaaau

SEQ ID NO: 1978482 - RNA, 13 nt, Shigella flexneri 2a str. 301
gauaugcaucaug

SEQ ID NO: 1978483 - RNA, 18 nt, Shigella flexneri 2a str. 301
gauaguguugguaaauaa

SEQ ID NO: 1978484 - RNA, 14 nt, Shigella flexneri 2a str. 301
gauauagaaaaugg

SEQ ID NO: 1978485 - RNA, 16 nt, Shigella flexneri 2a str. 301
gauagucaugaugacg

SEQ ID NO: 1978486 - RNA, 20 nt, Shigella flexneri 2a str. 301
gauagcaagcgcugagacgc

SEQ ID NO: 1978487 - RNA, 14 nt, Shigella flexneri 2a str. 301
gauaggaauuaaaa

SEQ ID NO: 1978488 - RNA, 22 nt, Shigella flexneri 2a str. 301
gauaagaugguuauccagcuuc

SEQ ID NO: 1978489 - RNA, 17 nt, Shigella flexneri 2a str. 301
gauaagaugcuacaaca

SEQ ID NO: 1978490 - RNA, 16 nt, Shigella flexneri 2a str. 301
gauaacucaaaaauaa

SEQ ID NO: 1978491 - RNA, 15 nt, Shigella flexneri 2a str. 301
gauaagccccaguuc

SEQ ID NO: 1978492 - RNA, 20 nt, Shigella flexneri 2a str. 301
gauacgaccguuccauucaa

SEQ ID NO: 1978493 - RNA, 19 nt, Shigella flexneri 2a str. 301
gauacgaccguuccauuca

SEQ ID NO: 1978494 - RNA, 15 nt, Shigella flexneri 2a str. 301
gauacgcccuggaua

SEQ ID NO: 1978495 - RNA, 19 nt, Shigella flexneri 2a str. 301
gauacgcugcacaauugcc

SEQ ID NO: 1978496 - RNA, 15 nt, Shigella flexneri 2a str. 301
gauacgccccgguua

SEQ ID NO: 1978497 - RNA, 15 nt, Shigella flexneri 2a str. 301
gauagaauauuucua

SEQ ID NO: 1978498 - RNA, 22 nt, Shigella flexneri 2a str. 301
gauagaauauuucuauauccuc

SEQ ID NO: 1978499 - RNA, 19 nt, Shigella flexneri 2a str. 301
gauagaaccacgcaaaggc

SEQ ID NO: 1978500 - RNA, 18 nt, Shigella flexneri 2a str. 301
gauagaaugccaaguaau

SEQ ID NO: 1978501 - RNA, 20 nt, Shigella flexneri 2a str. 301
gauagagagcagucagguuc

SEQ ID NO: 1978502 - RNA, 16 nt, Shigella flexneri 2a str. 301
gauagagcaaccaccu

SEQ ID NO: 1978503 - RNA, 20 nt, Shigella flexneri 2a str. 301
gauacugaugaacgcgcagg

SEQ ID NO: 1978504 - RNA, 21 nt, Shigella flexneri 2a str. 301
gauacugaugaacgcgcaggu

SEQ ID NO: 1978505 - RNA, 16 nt, Shigella flexneri 2a str. 301
gauacggcccagaccc

SEQ ID NO: 1978506 - RNA, 20 nt, Shigella flexneri 2a str. 301
gauacggaauaucgcuggcc

SEQ ID NO: 1978507 - RNA, 17 nt, Shigella flexneri 2a str. 301
gauacgcuugccggaca

SEQ ID NO: 1978508 - RNA, 20 nt, Shigella flexneri 2a str. 301
gauacugcauucccaucgca

SEQ ID NO: 1978509 - RNA, 12 nt, Shigella flexneri 2a str. 301
gaucagcauuuc

SEQ ID NO: 1978510 - RNA, 19 nt, Shigella flexneri 2a str. 301
gaucagcauccauaucgcc

SEQ ID NO: 1978511 - RNA, 16 nt, Shigella flexneri 2a str. 301
gaucagagugguggau

SEQ ID NO: 1978512 - RNA, 17 nt, Shigella flexneri 2a str. 301
gaucagaguugaaaaac

SEQ ID NO: 1978513 - RNA, 13 nt, Shigella flexneri 2a str. 301
gaucacugcaacu

SEQ ID NO: 1978514 - RNA, 15 nt, Shigella flexneri 2a str. 301
gaucaccugcacaug

SEQ ID NO: 1978515 - RNA, 15 nt, Shigella flexneri 2a str. 301
gaucaacagcaucau

SEQ ID NO: 1978516 - RNA, 22 nt, Shigella flexneri 2a str. 301
gaucaaccgcuacauacuuaaa

SEQ ID NO: 1978517 - RNA, 14 nt, Shigella flexneri 2a str. 301
gaucaacgcuggca

SEQ ID NO: 1978518 - RNA, 19 nt, Shigella flexneri 2a str. 301
gauauggucaaugauuucu

SEQ ID NO: 1978519 - RNA, 19 nt, Shigella flexneri 2a str. 301
gaucaccaguccaucggca

SEQ ID NO: 1978520 - RNA, 19 nt, Shigella flexneri 2a str. 301
gaucaagcacaugcugaca

SEQ ID NO: 1978521 - RNA, 17 nt, Shigella flexneri 2a str. 301
gaucaagccccagcagg

SEQ ID NO: 1978522 - RNA, 18 nt, Shigella flexneri 2a str. 301
gaucaacuuuguucugaa

SEQ ID NO: 1978523 - RNA, 19 nt, Shigella flexneri 2a str. 301
gaucaaggcauauaccaca

SEQ ID NO: 1978524 - RNA, 11 nt, Shigella flexneri 2a str. 301
gaucaguaaac

SEQ ID NO: 1978525 - RNA, 15 nt, Shigella flexneri 2a str. 301
gaucaggcaaacgaa

SEQ ID NO: 1978526 - RNA, 20 nt, Shigella flexneri 2a str. 301
gaucaucaaggcuuccuucg

SEQ ID NO: 1978527 - RNA, 11 nt, Shigella flexneri 2a str. 301
gaucaucagca

SEQ ID NO: 1978528 - RNA, 15 nt, Shigella flexneri 2a str. 301
gaucaucagcaaacg

SEQ ID NO: 1978529 - RNA, 15 nt, Shigella flexneri 2a str. 301
gaucaucauccagca

SEQ ID NO: 1978530 - RNA, 22 nt, Shigella flexneri 2a str. 301
gaucauagagcacggcauccca

SEQ ID NO: 1978531 - RNA, 17 nt, Shigella flexneri 2a str. 301
gaucauacugaacuuau

SEQ ID NO: 1978532 - RNA, 12 nt, Shigella flexneri 2a str. 301
gaucauccgccu

SEQ ID NO: 1978533 - RNA, 20 nt, Shigella flexneri 2a str. 301
gaucaucgacaguaccagca

SEQ ID NO: 1978534 - RNA, 15 nt, Shigella flexneri 2a str. 301
gaucauuagcccaau

SEQ ID NO: 1978535 - RNA, 15 nt, Shigella flexneri 2a str. 301
gaucauucaccagcc

SEQ ID NO: 1978536 - RNA, 16 nt, Shigella flexneri 2a str. 301
gaucauucaccagccc

SEQ ID NO: 1978537 - RNA, 13 nt, Shigella flexneri 2a str. 301
gaucucaaacggu

SEQ ID NO: 1978538 - RNA, 12 nt, Shigella flexneri 2a str. 301
gaucucaccacg

SEQ ID NO: 1978539 - RNA, 20 nt, Shigella flexneri 2a str. 301
gaucuaugucgcauccggca

SEQ ID NO: 1978540 - RNA, 16 nt, Shigella flexneri 2a str. 301
gaucuaccgcuucccu

SEQ ID NO: 1978541 - RNA, 12 nt, Shigella flexneri 2a str. 301
gaucucuuccag

SEQ ID NO: 1978542 - RNA, 15 nt, Shigella flexneri 2a str. 301
gaucugauggaaaau

SEQ ID NO: 1978543 - RNA, 23 nt, Shigella flexneri 2a str. 301
gaucugauuuuccuccagcagca

SEQ ID NO: 1978544 - RNA, 18 nt, Shigella flexneri 2a str. 301
gaucugcgucgcuuucca

SEQ ID NO: 1978545 - RNA, 18 nt, Shigella flexneri 2a str. 301
gaucuggaauggaaacag

SEQ ID NO: 1978546 - RNA, 21 nt, Shigella flexneri 2a str. 301
gaucuggaauggaaacagcac

SEQ ID NO: 1978547 - RNA, 15 nt, Shigella flexneri 2a str. 301
gaucugcgccugcac

SEQ ID NO: 1978548 - RNA, 22 nt, Shigella flexneri 2a str. 301
gaucguguggauaauccauccc

SEQ ID NO: 1978549 - RNA, 14 nt, Shigella flexneri 2a str. 301
gaucgugcucgaca

SEQ ID NO: 1978550 - RNA, 22 nt, Shigella flexneri 2a str. 301
gaucguaagaauaaucaucggc

SEQ ID NO: 1978551 - RNA, 14 nt, Shigella flexneri 2a str. 301
gaucgucagguuuu

SEQ ID NO: 1978552 - RNA, 18 nt, Shigella flexneri 2a str. 301
gaucggcguacuggcaau

SEQ ID NO: 1978553 - RNA, 15 nt, Shigella flexneri 2a str. 301
gaucggcaggcaggu

SEQ ID NO: 1978554 - RNA, 14 nt, Shigella flexneri 2a str. 301
gaucgcgccgccgc

SEQ ID NO: 1978555 - RNA, 18 nt, Shigella flexneri 2a str. 301
gaucgcgcaaacagugac

SEQ ID NO: 1978556 - RNA, 20 nt, Shigella flexneri 2a str. 301
gaucgcuuucgcuuucucuu

SEQ ID NO: 1978557 - RNA, 20 nt, Shigella flexneri 2a str. 301
gaucgcugaacgcaccuucc

SEQ ID NO: 1978558 - RNA, 21 nt, Shigella flexneri 2a str. 301
gaucggacuucaugcgcagca

SEQ ID NO: 1978559 - RNA, 13 nt, Shigella flexneri 2a str. 301
gaucggcaaugag

SEQ ID NO: 1978560 - RNA, 20 nt, Shigella flexneri 2a str. 301
gaucgccugguaccagcacc

SEQ ID NO: 1978561 - RNA, 15 nt, Shigella flexneri 2a str. 301
gaucgcgaccgccuu

SEQ ID NO: 1978562 - RNA, 14 nt, Shigella flexneri 2a str. 301
gaucgccauauuuc

SEQ ID NO: 1978563 - RNA, 13 nt, Shigella flexneri 2a str. 301
gaucgccauauuu

SEQ ID NO: 1978564 - RNA, 13 nt, Shigella flexneri 2a str. 301
gaucgccagcagg

SEQ ID NO: 1978565 - RNA, 14 nt, Shigella flexneri 2a str. 301
gaucgccacugcug

SEQ ID NO: 1978566 - RNA, 13 nt, Shigella flexneri 2a str. 301
gaucgccacugcu

SEQ ID NO: 1978567 - RNA, 13 nt, Shigella flexneri 2a str. 301
gaucgccagguua

SEQ ID NO: 1978568 - RNA, 14 nt, Shigella flexneri 2a str. 301
aaagcccaucaucc

SEQ ID NO: 1978569 - RNA, 20 nt, Shigella flexneri 2a str. 301
aaagccgccaucucuuccag

SEQ ID NO: 1978570 - RNA, 22 nt, Shigella flexneri 2a str. 301
aaagccgagacgagcauaaaag

SEQ ID NO: 1978571 - RNA, 16 nt, Shigella flexneri 2a str. 301
aaagccccaccagcaa

SEQ ID NO: 1978572 - RNA, 17 nt, Shigella flexneri 2a str. 301
aaagcccauaccacagc

SEQ ID NO: 1978573 - RNA, 12 nt, Shigella flexneri 2a str. 301
gauccugaaauu

SEQ ID NO: 1978574 - RNA, 16 nt, Shigella flexneri 2a str. 301
gauccugcacuuucag

SEQ ID NO: 1978575 - RNA, 16 nt, Shigella flexneri 2a str. 301
gauccgggcauauuuc

SEQ ID NO: 1978576 - RNA, 15 nt, Shigella flexneri 2a str. 301
gaucgccaauaucaa

SEQ ID NO: 1978577 - RNA, 13 nt, Shigella flexneri 2a str. 301
gaucgauggcagu

SEQ ID NO: 1978578 - RNA, 21 nt, Shigella flexneri 2a str. 301
aaagccgccaucucuuccagc

SEQ ID NO: 1978579 - RNA, 15 nt, Shigella flexneri 2a str. 301
gauccuucuguucuu

SEQ ID NO: 1978580 - RNA, 14 nt, Shigella flexneri 2a str. 301
gaucgaacagcagc

SEQ ID NO: 1978581 - RNA, 20 nt, Shigella flexneri 2a str. 301
gauccacaacgugggccugg

SEQ ID NO: 1978582 - RNA, 13 nt, Shigella flexneri 2a str. 301
gaucauuuccggu

SEQ ID NO: 1978583 - RNA, 16 nt, Shigella flexneri 2a str. 301
gauccauacucuuucc

SEQ ID NO: 1978584 - RNA, 14 nt, Shigella flexneri 2a str. 301
gauccagucccccc

SEQ ID NO: 1978585 - RNA, 17 nt, Shigella flexneri 2a str. 301
gauccaggagcuccagg

SEQ ID NO: 1978586 - RNA, 16 nt, Shigella flexneri 2a str. 301
gauccagcucuucuuc

SEQ ID NO: 1978587 - RNA, 18 nt, Shigella flexneri 2a str. 301
gauccagcucuucuucac

SEQ ID NO: 1978588 - RNA, 23 nt, Shigella flexneri 2a str. 301
gaucccacggcggugucgccaga

SEQ ID NO: 1978589 - RNA, 12 nt, Shigella flexneri 2a str. 301
gaucccaguuuu

SEQ ID NO: 1978590 - RNA, 22 nt, Shigella flexneri 2a str. 301
gauccgcgauaagucuuugacu

SEQ ID NO: 1978591 - RNA, 17 nt, Shigella flexneri 2a str. 301
gaucccuucgccgccgc

SEQ ID NO: 1978592 - RNA, 17 nt, Shigella flexneri 2a str. 301
gauccggaucccaccag

SEQ ID NO: 1978593 - RNA, 22 nt, Shigella flexneri 2a str. 301
gauccccugcgcggcgacuucc

SEQ ID NO: 1978594 - RNA, 14 nt, Shigella flexneri 2a str. 301
gaucccucuuucug

SEQ ID NO: 1978595 - RNA, 23 nt, Shigella flexneri 2a str. 301
gaggagagugcaaugaaaaaccg

SEQ ID NO: 1978596 - RNA, 14 nt, Shigella flexneri 2a str. 301
gaggaguuuaauaa

SEQ ID NO: 1978597 - RNA, 13 nt, Shigella flexneri 2a str. 301
gaggccaaaacca

SEQ ID NO: 1978598 - RNA, 20 nt, Shigella flexneri 2a str. 301
gaggccgcggcucaggcgca

SEQ ID NO: 1978599 - RNA, 13 nt, Shigella flexneri 2a str. 301
gaggccgccacac

SEQ ID NO: 1978600 - RNA, 14 nt, Shigella flexneri 2a str. 301
gaggaagacaacca

SEQ ID NO: 1978601 - RNA, 12 nt, Shigella flexneri 2a str. 301
gagcugcaacca

SEQ ID NO: 1978602 - RNA, 22 nt, Shigella flexneri 2a str. 301
gagcuuuuuuaauguggcuggg

SEQ ID NO: 1978603 - RNA, 17 nt, Shigella flexneri 2a str. 301
gaguaauagaugauagu

SEQ ID NO: 1978604 - RNA, 11 nt, Shigella flexneri 2a str. 301
gaguaauauau

SEQ ID NO: 1978605 - RNA, 14 nt, Shigella flexneri 2a str. 301
gaguaaucgccagc

SEQ ID NO: 1978606 - RNA, 15 nt, Shigella flexneri 2a str. 301
gaguaaugccaguca

SEQ ID NO: 1978607 - RNA, 12 nt, Shigella flexneri 2a str. 301
gaguacauccac

SEQ ID NO: 1978608 - RNA, 20 nt, Shigella flexneri 2a str. 301
gaguaacgggcacguaaauc

SEQ ID NO: 1978609 - RNA, 23 nt, Shigella flexneri 2a str. 301
gaguaaagcccgccaucgcccau

SEQ ID NO: 1978610 - RNA, 19 nt, Shigella flexneri 2a str. 301
gaguaaaauaacagcggca

SEQ ID NO: 1978611 - RNA, 13 nt, Shigella flexneri 2a str. 301
gaguaaagcccgc

SEQ ID NO: 1978612 - RNA, 17 nt, Shigella flexneri 2a str. 301
gagguacaaccaucccu

SEQ ID NO: 1978613 - RNA, 21 nt, Shigella flexneri 2a str. 301
gagguacacaacaugcagccc

SEQ ID NO: 1978614 - RNA, 14 nt, Shigella flexneri 2a str. 301
gagguaaaaccuga

SEQ ID NO: 1978615 - RNA, 19 nt, Shigella flexneri 2a str. 301
gaggguaaacaacaugcua

SEQ ID NO: 1978616 - RNA, 20 nt, Shigella flexneri 2a str. 301
gaggcggggccaauugcugu

SEQ ID NO: 1978617 - RNA, 19 nt, Shigella flexneri 2a str. 301
gaggggcugacgcaacugg

SEQ ID NO: 1978618 - RNA, 22 nt, Shigella flexneri 2a str. 301
gaggcgcuggcgcauguuggcg

SEQ ID NO: 1978619 - RNA, 16 nt, Shigella flexneri 2a str. 301
gauaaaacuucccgug

SEQ ID NO: 1978620 - RNA, 16 nt, Shigella flexneri 2a str. 301
gauaaaagccaucccu

SEQ ID NO: 1978621 - RNA, 18 nt, Shigella flexneri 2a str. 301
gauaaaauacacuuuaau

SEQ ID NO: 1978622 - RNA, 13 nt, Shigella flexneri 2a str. 301
gauaaaauacuua

SEQ ID NO: 1978623 - RNA, 15 nt, Shigella flexneri 2a str. 301
gauaaaaucccauaa

SEQ ID NO: 1978624 - RNA, 21 nt, Shigella flexneri 2a str. 301
gauaaaaccuuccucaccguu

SEQ ID NO: 1978625 - RNA, 16 nt, Shigella flexneri 2a str. 301
gaguuugccgcugucc

SEQ ID NO: 1978626 - RNA, 18 nt, Shigella flexneri 2a str. 301
gaguucgucgaguuuaua

SEQ ID NO: 1978627 - RNA, 19 nt, Shigella flexneri 2a str. 301
gauaaaccuccagcaucag

SEQ ID NO: 1978628 - RNA, 17 nt, Shigella flexneri 2a str. 301
gauaaacggcaggagau

SEQ ID NO: 1978629 - RNA, 21 nt, Shigella flexneri 2a str. 301
gauaaacguauaguggaauug

SEQ ID NO: 1978630 - RNA, 15 nt, Shigella flexneri 2a str. 301
gauaacccagcagcc

SEQ ID NO: 1978631 - RNA, 21 nt, Shigella flexneri 2a str. 301
gauaacguugaugcaggcagu

SEQ ID NO: 1978632 - RNA, 23 nt, Shigella flexneri 2a str. 301
gauaacguguuccaguugcauac

SEQ ID NO: 1978633 - RNA, 13 nt, Shigella flexneri 2a str. 301
gauaaccuucuuc

SEQ ID NO: 1978634 - RNA, 23 nt, Shigella flexneri 2a str. 301
gauaacgccuagaaaucauucaa

SEQ ID NO: 1978635 - RNA, 18 nt, Shigella flexneri 2a str. 301
gagugauacguaaaccac

SEQ ID NO: 1978636 - RNA, 23 nt, Shigella flexneri 2a str. 301
gagugauacguaaaccacugaca

SEQ ID NO: 1978637 - RNA, 19 nt, Shigella flexneri 2a str. 301
gagugacaguucaaucucc

SEQ ID NO: 1978638 - RNA, 19 nt, Shigella flexneri 2a str. 301
gagugaccgccaauaaccg

SEQ ID NO: 1978639 - RNA, 19 nt, Shigella flexneri 2a str. 301
gagugaaaaugccucagag

SEQ ID NO: 1978640 - RNA, 20 nt, Shigella flexneri 2a str. 301
gaguggugaaaaaaaggcga

SEQ ID NO: 1978641 - RNA, 17 nt, Shigella flexneri 2a str. 301
gaguggcgaaauuggua

SEQ ID NO: 1978642 - RNA, 17 nt, Shigella flexneri 2a str. 301
gaguauucuugcugaua

SEQ ID NO: 1978643 - RNA, 16 nt, Shigella flexneri 2a str. 301
gaguauuuccagcuca

SEQ ID NO: 1978644 - RNA, 19 nt, Shigella flexneri 2a str. 301
gaguauguuaccugugaau

SEQ ID NO: 1978645 - RNA, 19 nt, Shigella flexneri 2a str. 301
gagucaauuucugcaaaau

SEQ ID NO: 1978646 - RNA, 22 nt, Shigella flexneri 2a str. 301
gagccgaaauauggcucugcgg

SEQ ID NO: 1978647 - RNA, 19 nt, Shigella flexneri 2a str. 301
gagccugccaauggcaggc

SEQ ID NO: 1978648 - RNA, 17 nt, Shigella flexneri 2a str. 301
gagccugaauaaacgcc

SEQ ID NO: 1978649 - RNA, 16 nt, Shigella flexneri 2a str. 301
gagcgcaaauugcugg

SEQ ID NO: 1978650 - RNA, 15 nt, Shigella flexneri 2a str. 301
gagcgagggagaaaa

SEQ ID NO: 1978651 - RNA, 22 nt, Shigella flexneri 2a str. 301
gagcgauacaucaucacugcca

SEQ ID NO: 1978652 - RNA, 16 nt, Shigella flexneri 2a str. 301
gagcgaucggcagcug

SEQ ID NO: 1978653 - RNA, 15 nt, Shigella flexneri 2a str. 301
gagcgauuaucgcca

SEQ ID NO: 1978654 - RNA, 22 nt, Shigella flexneri 2a str. 301
gagcgccauuucuucuccggca

SEQ ID NO: 1978655 - RNA, 16 nt, Shigella flexneri 2a str. 301
gagcgccagcauggca

SEQ ID NO: 1978656 - RNA, 14 nt, Shigella flexneri 2a str. 301
gagcgccaccaccc

SEQ ID NO: 1978657 - RNA, 19 nt, Shigella flexneri 2a str. 301
gagcgccauaaacagggcu

SEQ ID NO: 1978658 - RNA, 15 nt, Shigella flexneri 2a str. 301
gagcgcgagcaggcc

SEQ ID NO: 1978659 - RNA, 19 nt, Shigella flexneri 2a str. 301
gagcgggacaacaaacgca

SEQ ID NO: 1978660 - RNA, 13 nt, Shigella flexneri 2a str. 301
gagcggccagggc

SEQ ID NO: 1978661 - RNA, 17 nt, Shigella flexneri 2a str. 301
gagcgcgguauugccug

SEQ ID NO: 1978662 - RNA, 15 nt, Shigella flexneri 2a str. 301
gagcuaccggcagga

SEQ ID NO: 1978663 - RNA, 14 nt, Shigella flexneri 2a str. 301
gagcguuucaaaaa

SEQ ID NO: 1978664 - RNA, 22 nt, Shigella flexneri 2a str. 301
gagcguuucaaaaacaaagaac

SEQ ID NO: 1978665 - RNA, 14 nt, Shigella flexneri 2a str. 301
gagcuccagguccu

SEQ ID NO: 1978666 - RNA, 16 nt, Shigella flexneri 2a str. 301
gagcucaauacaaccc

SEQ ID NO: 1978667 - RNA, 23 nt, Shigella flexneri 2a str. 301
gagcgucauauagccgccuuguu

SEQ ID NO: 1978668 - RNA, 18 nt, Shigella flexneri 2a str. 301
gagcgucuggaagaagua

SEQ ID NO: 1978669 - RNA, 19 nt, Shigella flexneri 2a str. 301
gagcguuacccgcagccau

SEQ ID NO: 1978670 - RNA, 12 nt, Shigella flexneri 2a str. 301
aaagcacaaaau

SEQ ID NO: 1978671 - RNA, 13 nt, Shigella flexneri 2a str. 301
gagcaggccgggu

SEQ ID NO: 1978672 - RNA, 19 nt, Shigella flexneri 2a str. 301
aaagcacagaaucuaagau

SEQ ID NO: 1978673 - RNA, 22 nt, Shigella flexneri 2a str. 301
aaagcacuuuuuguaauuuuuu

SEQ ID NO: 1978674 - RNA, 21 nt, Shigella flexneri 2a str. 301
aaagcagacaacccacacauu

SEQ ID NO: 1978675 - RNA, 20 nt, Shigella flexneri 2a str. 301
aaagcagacuuuuugcggca

SEQ ID NO: 1978676 - RNA, 16 nt, Shigella flexneri 2a str. 301
aaagcagauaacccag

SEQ ID NO: 1978677 - RNA, 17 nt, Shigella flexneri 2a str. 301
aaagcagauaacccagc

SEQ ID NO: 1978678 - RNA, 12 nt, Shigella flexneri 2a str. 301
gagcaaauaaaa

SEQ ID NO: 1978679 - RNA, 18 nt, Shigella flexneri 2a str. 301
gagcaaagcgcagccguc

SEQ ID NO: 1978680 - RNA, 21 nt, Shigella flexneri 2a str. 301
gagcaauagacaguucuuccu

SEQ ID NO: 1978681 - RNA, 22 nt, Shigella flexneri 2a str. 301
gagcaaugcgcaucaaagccag

SEQ ID NO: 1978682 - RNA, 13 nt, Shigella flexneri 2a str. 301
gagcagcacaaug

SEQ ID NO: 1978683 - RNA, 17 nt, Shigella flexneri 2a str. 301
gagcagcauuaccugcc

SEQ ID NO: 1978684 - RNA, 17 nt, Shigella flexneri 2a str. 301
gagcagcagucaggcgc

SEQ ID NO: 1978685 - RNA, 17 nt, Shigella flexneri 2a str. 301
gagaggcgugccaggua

SEQ ID NO: 1978686 - RNA, 20 nt, Shigella flexneri 2a str. 301
gagaggcgugccagguagug

SEQ ID NO: 1978687 - RNA, 19 nt, Shigella flexneri 2a str. 301
gagaggguuagggugaggg

SEQ ID NO: 1978688 - RNA, 15 nt, Shigella flexneri 2a str. 301
gagaggccuucgccu

SEQ ID NO: 1978689 - RNA, 21 nt, Shigella flexneri 2a str. 301
gagauuacuuuauuuauauca

SEQ ID NO: 1978690 - RNA, 13 nt, Shigella flexneri 2a str. 301
gagaucggccagc

SEQ ID NO: 1978691 - RNA, 22 nt, Shigella flexneri 2a str. 301
gagaucgaccggguuagucugg

SEQ ID NO: 1978692 - RNA, 16 nt, Shigella flexneri 2a str. 301
gagcaaaccacaggcc

SEQ ID NO: 1978693 - RNA, 18 nt, Shigella flexneri 2a str. 301
gagauucgguaaccaucc

SEQ ID NO: 1978694 - RNA, 17 nt, Shigella flexneri 2a str. 301
gaugagguggugcgaug

SEQ ID NO: 1978695 - RNA, 13 nt, Shigella flexneri 2a str. 301
gaugauaaaucca

SEQ ID NO: 1978696 - RNA, 14 nt, Shigella flexneri 2a str. 301
gaugauauggucaa

SEQ ID NO: 1978697 - RNA, 17 nt, Shigella flexneri 2a str. 301
gaugauaguuuucuaug

SEQ ID NO: 1978698 - RNA, 15 nt, Shigella flexneri 2a str. 301
gaugauauguagacg

SEQ ID NO: 1978699 - RNA, 19 nt, Shigella flexneri 2a str. 301
gaugaucaacagcaucauc

SEQ ID NO: 1978700 - RNA, 23 nt, Shigella flexneri 2a str. 301
gaugaucaacagcaucaucgcaa

SEQ ID NO: 1978701 - RNA, 12 nt, Shigella flexneri 2a str. 301
aaagccugcuuc

SEQ ID NO: 1978702 - RNA, 23 nt, Shigella flexneri 2a str. 301
aaagccgcuuaacgguguuuagu

SEQ ID NO: 1978703 - RNA, 16 nt, Shigella flexneri 2a str. 301
gaugaugcuguagcug

SEQ ID NO: 1978704 - RNA, 17 nt, Shigella flexneri 2a str. 301
gaugaugcaaacaugga

SEQ ID NO: 1978705 - RNA, 19 nt, Shigella flexneri 2a str. 301
gaugaugcaaacauggaaa

SEQ ID NO: 1978706 - RNA, 12 nt, Shigella flexneri 2a str. 301
gaugagcaucgu

SEQ ID NO: 1978707 - RNA, 20 nt, Shigella flexneri 2a str. 301
gaucuuuaucaaucaccgcu

SEQ ID NO: 1978708 - RNA, 13 nt, Shigella flexneri 2a str. 301
gaucuuucacgcc

SEQ ID NO: 1978709 - RNA, 19 nt, Shigella flexneri 2a str. 301
gaucuuugacugaaauuua

SEQ ID NO: 1978710 - RNA, 17 nt, Shigella flexneri 2a str. 301
gaucuuaugauguaaau

SEQ ID NO: 1978711 - RNA, 21 nt, Shigella flexneri 2a str. 301
gaucuugcgaccgcucuuuuu

SEQ ID NO: 1978712 - RNA, 19 nt, Shigella flexneri 2a str. 301
gaugaaguccacgcgguag

SEQ ID NO: 1978713 - RNA, 13 nt, Shigella flexneri 2a str. 301
gaugaauaaaauu

SEQ ID NO: 1978714 - RNA, 12 nt, Shigella flexneri 2a str. 301
gaugacagacuc

SEQ ID NO: 1978715 - RNA, 22 nt, Shigella flexneri 2a str. 301
gaugacaaacuugauagaacaa

SEQ ID NO: 1978716 - RNA, 14 nt, Shigella flexneri 2a str. 301
gaugaaagaaaaaa

SEQ ID NO: 1978717 - RNA, 15 nt, Shigella flexneri 2a str. 301
gaugcucgccaggcg

SEQ ID NO: 1978718 - RNA, 22 nt, Shigella flexneri 2a str. 301
gaugcucgccaggcguuugaaa

SEQ ID NO: 1978719 - RNA, 21 nt, Shigella flexneri 2a str. 301
gaugcuccacgcugcaucgcc

SEQ ID NO: 1978720 - RNA, 12 nt, Shigella flexneri 2a str. 301
gaugcucuccgc

SEQ ID NO: 1978721 - RNA, 17 nt, Shigella flexneri 2a str. 301
gaugcucuuuucugaag

SEQ ID NO: 1978722 - RNA, 12 nt, Shigella flexneri 2a str. 301
gaugcugauuuu

SEQ ID NO: 1978723 - RNA, 13 nt, Shigella flexneri 2a str. 301
gaugcguucaccu

SEQ ID NO: 1978724 - RNA, 14 nt, Shigella flexneri 2a str. 301
gaugcuaaaaacau

SEQ ID NO: 1978725 - RNA, 21 nt, Shigella flexneri 2a str. 301
gaugcggcguaaacgccuuau

SEQ ID NO: 1978726 - RNA, 20 nt, Shigella flexneri 2a str. 301
gaugcguaccucacguucca

SEQ ID NO: 1978727 - RNA, 18 nt, Shigella flexneri 2a str. 301
gaugcgggucaggccagg

SEQ ID NO: 1978728 - RNA, 14 nt, Shigella flexneri 2a str. 301
gaugcgauguaauc

SEQ ID NO: 1978729 - RNA, 19 nt, Shigella flexneri 2a str. 301
gaugcgacggcaccacauu

SEQ ID NO: 1978730 - RNA, 17 nt, Shigella flexneri 2a str. 301
gaugccuugugggccug

SEQ ID NO: 1978731 - RNA, 13 nt, Shigella flexneri 2a str. 301
gaugcgccagcau

SEQ ID NO: 1978732 - RNA, 15 nt, Shigella flexneri 2a str. 301
gaugccgugcagcac

SEQ ID NO: 1978733 - RNA, 18 nt, Shigella flexneri 2a str. 301
gaugccggaugcggcgug

SEQ ID NO: 1978734 - RNA, 21 nt, Shigella flexneri 2a str. 301
gaugccggaaucaaccauggu

SEQ ID NO: 1978735 - RNA, 19 nt, Shigella flexneri 2a str. 301
gaugccgccguagaaaaug

SEQ ID NO: 1978736 - RNA, 21 nt, Shigella flexneri 2a str. 301
gaugcccgacuugagcgcagu

SEQ ID NO: 1978737 - RNA, 17 nt, Shigella flexneri 2a str. 301
gaugccauuugccagac

SEQ ID NO: 1978738 - RNA, 21 nt, Shigella flexneri 2a str. 301
gaugccagcgagguacaacca

SEQ ID NO: 1978739 - RNA, 14 nt, Shigella flexneri 2a str. 301
gaugcaacuguuuu

SEQ ID NO: 1978740 - RNA, 21 nt, Shigella flexneri 2a str. 301
gaugauuugguggcccuugcu

SEQ ID NO: 1978741 - RNA, 21 nt, Shigella flexneri 2a str. 301
gaugcacugggagaacgcugc

SEQ ID NO: 1978742 - RNA, 15 nt, Shigella flexneri 2a str. 301
aaagcgacuuugccu

SEQ ID NO: 1978743 - RNA, 16 nt, Shigella flexneri 2a str. 301
aaagccuuuugccagu

SEQ ID NO: 1978744 - RNA, 18 nt, Shigella flexneri 2a str. 301
gauggcgcaaugccaucc

SEQ ID NO: 1978745 - RNA, 19 nt, Shigella flexneri 2a str. 301
gauggcgcgcagaaagagg

SEQ ID NO: 1978746 - RNA, 21 nt, Shigella flexneri 2a str. 301
gauggcgcaaugccauccagc

SEQ ID NO: 1978747 - RNA, 21 nt, Shigella flexneri 2a str. 301
gauggcgcgcggcaggaagug

SEQ ID NO: 1978748 - RNA, 19 nt, Shigella flexneri 2a str. 301
gauggcauaccauccggca

SEQ ID NO: 1978749 - RNA, 19 nt, Shigella flexneri 2a str. 301
gauggcaauauguggcuug

SEQ ID NO: 1978750 - RNA, 13 nt, Shigella flexneri 2a str. 301
gauggcccggcgg

SEQ ID NO: 1978751 - RNA, 21 nt, Shigella flexneri 2a str. 301
gauggcccacgacgucuccau

SEQ ID NO: 1978752 - RNA, 22 nt, Shigella flexneri 2a str. 301
gauggccgguuuguuauccacc

SEQ ID NO: 1978753 - RNA, 17 nt, Shigella flexneri 2a str. 301
gaugcuuugaccucccg

SEQ ID NO: 1978754 - RNA, 13 nt, Shigella flexneri 2a str. 301
gaugcuuucccac

SEQ ID NO: 1978755 - RNA, 22 nt, Shigella flexneri 2a str. 301
gauggaacaaaauuuucagcgu

SEQ ID NO: 1978756 - RNA, 23 nt, Shigella flexneri 2a str. 301
gauggcaaagugcaucucaccgu

SEQ ID NO: 1978757 - RNA, 13 nt, Shigella flexneri 2a str. 301
gauggauugcuga

SEQ ID NO: 1978758 - RNA, 14 nt, Shigella flexneri 2a str. 301
gauggacauucucc

SEQ ID NO: 1978759 - RNA, 15 nt, Shigella flexneri 2a str. 301
gauggagauuuuccg

SEQ ID NO: 1978760 - RNA, 19 nt, Shigella flexneri 2a str. 301
gauggcuugcgucauccag

SEQ ID NO: 1978761 - RNA, 16 nt, Shigella flexneri 2a str. 301
gauggcuacguucugc

SEQ ID NO: 1978762 - RNA, 23 nt, Shigella flexneri 2a str. 301
gauggcuauuacuuuaagccuuc

SEQ ID NO: 1978763 - RNA, 22 nt, Shigella flexneri 2a str. 301
gauggcucugauugauucaggg

SEQ ID NO: 1978764 - RNA, 21 nt, Shigella flexneri 2a str. 301
gaugggcgccauuuuucacug

SEQ ID NO: 1978765 - RNA, 18 nt, Shigella flexneri 2a str. 301
gauggucagcuucaccuu

SEQ ID NO: 1978766 - RNA, 15 nt, Shigella flexneri 2a str. 301
gaugguauucaucgc

SEQ ID NO: 1978767 - RNA, 19 nt, Shigella flexneri 2a str. 301
gaugguaugcgaagguggc

SEQ ID NO: 1978768 - RNA, 18 nt, Shigella flexneri 2a str. 301
gaugguacuucaaucgcc

SEQ ID NO: 1978769 - RNA, 14 nt, Shigella flexneri 2a str. 301
gauggucgucaauc

SEQ ID NO: 1978770 - RNA, 22 nt, Shigella flexneri 2a str. 301
gauguacgcugccgcuucuucu

SEQ ID NO: 1978771 - RNA, 13 nt, Shigella flexneri 2a str. 301
gaugucagcacuu

SEQ ID NO: 1978772 - RNA, 17 nt, Shigella flexneri 2a str. 301
gauguaauuaagcgcaa

SEQ ID NO: 1978773 - RNA, 15 nt, Shigella flexneri 2a str. 301
gauguaauucagcca

SEQ ID NO: 1978774 - RNA, 19 nt, Shigella flexneri 2a str. 301
gaugguugcccugcuggug

SEQ ID NO: 1978775 - RNA, 18 nt, Shigella flexneri 2a str. 301
gaugguuauccagcuuca

SEQ ID NO: 1978776 - RNA, 16 nt, Shigella flexneri 2a str. 301
gaugguuuugcuuuau

SEQ ID NO: 1978777 - RNA, 21 nt, Shigella flexneri 2a str. 301
gauuacauggacgaaaucuac

SEQ ID NO: 1978778 - RNA, 14 nt, Shigella flexneri 2a str. 301
gauuaccauuucac

SEQ ID NO: 1978779 - RNA, 13 nt, Shigella flexneri 2a str. 301
gauuaauuacaca

SEQ ID NO: 1978780 - RNA, 19 nt, Shigella flexneri 2a str. 301
gauuacuguacagauccgc

SEQ ID NO: 1978781 - RNA, 14 nt, Shigella flexneri 2a str. 301
gauuacuuccuuca

SEQ ID NO: 1978782 - RNA, 23 nt, Shigella flexneri 2a str. 301
gauuagccuucaugcgacgacgg

SEQ ID NO: 1978783 - RNA, 22 nt, Shigella flexneri 2a str. 301
gauuacucgccuuucacacgcu

SEQ ID NO: 1978784 - RNA, 22 nt, Shigella flexneri 2a str. 301
gauuaccuuccucaauuaacau

SEQ ID NO: 1978785 - RNA, 20 nt, Shigella flexneri 2a str. 301
gauuagcccccguuuuguug

SEQ ID NO: 1978786 - RNA, 17 nt, Shigella flexneri 2a str. 301
gauuagucuuuaucugc

SEQ ID NO: 1978787 - RNA, 12 nt, Shigella flexneri 2a str. 301
gauuaucuucac

SEQ ID NO: 1978788 - RNA, 16 nt, Shigella flexneri 2a str. 301
gauuaucuucgcacuu

SEQ ID NO: 1978789 - RNA, 20 nt, Shigella flexneri 2a str. 301
gauuaugcgcggcauacagc

SEQ ID NO: 1978790 - RNA, 14 nt, Shigella flexneri 2a str. 301
gauuaugaucgcca

SEQ ID NO: 1978791 - RNA, 15 nt, Shigella flexneri 2a str. 301
gauuaugaucgccac

SEQ ID NO: 1978792 - RNA, 22 nt, Shigella flexneri 2a str. 301
gauuauugcuugaucaggaaau

SEQ ID NO: 1978793 - RNA, 22 nt, Shigella flexneri 2a str. 301
gauuauuggacgguaaaaagaa

SEQ ID NO: 1978794 - RNA, 23 nt, Shigella flexneri 2a str. 301
gauuauuggacgguaaaaagaaa

SEQ ID NO: 1978795 - RNA, 20 nt, Shigella flexneri 2a str. 301
gauuauugauauccaccucc

SEQ ID NO: 1978796 - RNA, 18 nt, Shigella flexneri 2a str. 301
gauucaaaagaugagaaa

SEQ ID NO: 1978797 - RNA, 23 nt, Shigella flexneri 2a str. 301
gauuauuucgcugcggauuguca

SEQ ID NO: 1978798 - RNA, 16 nt, Shigella flexneri 2a str. 301
gaugucgcuuccauug

SEQ ID NO: 1978799 - RNA, 21 nt, Shigella flexneri 2a str. 301
gaugugaugcccggucgcucc

SEQ ID NO: 1978800 - RNA, 19 nt, Shigella flexneri 2a str. 301
gauguggugcaaggaaaua

SEQ ID NO: 1978801 - RNA, 20 nt, Shigella flexneri 2a str. 301
gaugugcgguggcuucgccu

SEQ ID NO: 1978802 - RNA, 13 nt, Shigella flexneri 2a str. 301
gauguuccgccau

SEQ ID NO: 1978803 - RNA, 19 nt, Shigella flexneri 2a str. 301
gauguugucauuacaacaa

SEQ ID NO: 1978804 - RNA, 18 nt, Shigella flexneri 2a str. 301
gauguuguuuuuaaccaa

SEQ ID NO: 1978805 - RNA, 18 nt, Shigella flexneri 2a str. 301
gauuaauaaaauuaucca

SEQ ID NO: 1978806 - RNA, 13 nt, Shigella flexneri 2a str. 301
gauuaacagcgcc

SEQ ID NO: 1978807 - RNA, 22 nt, Shigella flexneri 2a str. 301
gauuaacuggggcaaaugguuu

SEQ ID NO: 1978808 - RNA, 16 nt, Shigella flexneri 2a str. 301
gauuaaauucaccagu

SEQ ID NO: 1978809 - RNA, 15 nt, Shigella flexneri 2a str. 301
gauuaaaaucagaau

SEQ ID NO: 1978810 - RNA, 18 nt, Shigella flexneri 2a str. 301
gauuaaacuucaccagca

SEQ ID NO: 1978811 - RNA, 23 nt, Shigella flexneri 2a str. 301
gauucuguguaaaugccuuucuc

SEQ ID NO: 1978812 - RNA, 15 nt, Shigella flexneri 2a str. 301
gauucugauccugca

SEQ ID NO: 1978813 - RNA, 10 nt, Shigella flexneri 2a str. 301
gauugcuucu

SEQ ID NO: 1978814 - RNA, 22 nt, Shigella flexneri 2a str. 301
gauuggcaucgggaugcugguu

SEQ ID NO: 1978815 - RNA, 19 nt, Shigella flexneri 2a str. 301
gauugccgauauaaaccau

SEQ ID NO: 1978816 - RNA, 19 nt, Shigella flexneri 2a str. 301
gauugcaggggagcugcaa

SEQ ID NO: 1978817 - RNA, 19 nt, Shigella flexneri 2a str. 301
gauugcacuugcuuaaaau

SEQ ID NO: 1978818 - RNA, 18 nt, Shigella flexneri 2a str. 301
gauugcacuugcuuaaaa

SEQ ID NO: 1978819 - RNA, 13 nt, Shigella flexneri 2a str. 301
gauugauuuauca

SEQ ID NO: 1978820 - RNA, 19 nt, Shigella flexneri 2a str. 301
gauugaucucuaaggcaug

SEQ ID NO: 1978821 - RNA, 13 nt, Shigella flexneri 2a str. 301
gauucccgggcac

SEQ ID NO: 1978822 - RNA, 14 nt, Shigella flexneri 2a str. 301
gauucccccaggcc

SEQ ID NO: 1978823 - RNA, 13 nt, Shigella flexneri 2a str. 301
gauucgcccgcag

SEQ ID NO: 1978824 - RNA, 24 nt, Shigella flexneri 2a str. 301
gauuccugcgcuuccagcuccauc

SEQ ID NO: 1978825 - RNA, 21 nt, Shigella flexneri 2a str. 301
gauucggguucauguucagau

SEQ ID NO: 1978826 - RNA, 15 nt, Shigella flexneri 2a str. 301
gauucgcccgcagcc

SEQ ID NO: 1978827 - RNA, 21 nt, Shigella flexneri 2a str. 301
gauucgccugaacaugcccuu

SEQ ID NO: 1978828 - RNA, 17 nt, Shigella flexneri 2a str. 301
gauucguuuuucuucag

SEQ ID NO: 1978829 - RNA, 19 nt, Shigella flexneri 2a str. 301
gauucguugguaaugacuc

SEQ ID NO: 1978830 - RNA, 19 nt, Shigella flexneri 2a str. 301
gauucaugcugcggcuguc

SEQ ID NO: 1978831 - RNA, 16 nt, Shigella flexneri 2a str. 301
gauucaucucuucuuc

SEQ ID NO: 1978832 - RNA, 21 nt, Shigella flexneri 2a str. 301
gauucaugcggguauucaucc

SEQ ID NO: 1978833 - RNA, 15 nt, Shigella flexneri 2a str. 301
gauucccccggugcc

SEQ ID NO: 1978834 - RNA, 22 nt, Shigella flexneri 2a str. 301
gauucagcccgagguuauuuug

SEQ ID NO: 1978835 - RNA, 17 nt, Shigella flexneri 2a str. 301
gauucagauaaucccca

SEQ ID NO: 1978836 - RNA, 23 nt, Shigella flexneri 2a str. 301
gauucagauaauccccaaugacc

SEQ ID NO: 1978837 - RNA, 17 nt, Shigella flexneri 2a str. 301
gauucacuuucugaagg

SEQ ID NO: 1978838 - RNA, 17 nt, Shigella flexneri 2a str. 301
gauucacauuuaaacaa

SEQ ID NO: 1978839 - RNA, 18 nt, Shigella flexneri 2a str. 301
gauucacgccaaccagcu

SEQ ID NO: 1978840 - RNA, 19 nt, Shigella flexneri 2a str. 301
gauucaagauuagccugaa

SEQ ID NO: 1978841 - RNA, 18 nt, Shigella flexneri 2a str. 301
gauucacacaguucuucu

SEQ ID NO: 1978842 - RNA, 18 nt, Shigella flexneri 2a str. 301
gauugucguuguacaaca

SEQ ID NO: 1978843 - RNA, 13 nt, Shigella flexneri 2a str. 301
gauuguuaaucac

SEQ ID NO: 1978844 - RNA, 22 nt, Shigella flexneri 2a str. 301
gauuguuucuucgauggcuggg

SEQ ID NO: 1978845 - RNA, 19 nt, Shigella flexneri 2a str. 301
gauuguugauuaacaggcu

SEQ ID NO: 1978846 - RNA, 14 nt, Shigella flexneri 2a str. 301
gauuuaacaucucc

SEQ ID NO: 1978847 - RNA, 22 nt, Shigella flexneri 2a str. 301
gauuuaaccaacaauaaaauug

SEQ ID NO: 1978848 - RNA, 22 nt, Shigella flexneri 2a str. 301
gauuuaccguuaagcuggaaau

SEQ ID NO: 1978849 - RNA, 16 nt, Shigella flexneri 2a str. 301
gauuuacgcucuucca

SEQ ID NO: 1978850 - RNA, 13 nt, Shigella flexneri 2a str. 301
gauuuaaugccaa

SEQ ID NO: 1978851 - RNA, 19 nt, Shigella flexneri 2a str. 301
gauuuaaucuguaucaggc

SEQ ID NO: 1978852 - RNA, 18 nt, Shigella flexneri 2a str. 301
gauuuacagucugcuccc

SEQ ID NO: 1978853 - RNA, 13 nt, Shigella flexneri 2a str. 301
gauuuaauaacaa

SEQ ID NO: 1978854 - RNA, 17 nt, Shigella flexneri 2a str. 301
gauuuccaucuccagcu

SEQ ID NO: 1978855 - RNA, 22 nt, Shigella flexneri 2a str. 301
gauuuccguuaaccuaaagccu

SEQ ID NO: 1978856 - RNA, 19 nt, Shigella flexneri 2a str. 301
gauuucauaacugauggca

SEQ ID NO: 1978857 - RNA, 17 nt, Shigella flexneri 2a str. 301
gauuucagcaccgcgcu

SEQ ID NO: 1978858 - RNA, 22 nt, Shigella flexneri 2a str. 301
gauuuccaagcgcggcaggcau

SEQ ID NO: 1978859 - RNA, 16 nt, Shigella flexneri 2a str. 301
gauuuaugauauuuuu

SEQ ID NO: 1978860 - RNA, 14 nt, Shigella flexneri 2a str. 301
gauuuauaaaagaa

SEQ ID NO: 1978861 - RNA, 17 nt, Shigella flexneri 2a str. 301
gauuuaccguuaagcug

SEQ ID NO: 1978862 - RNA, 21 nt, Shigella flexneri 2a str. 301
gauuuauguaccgucaucgcc

SEQ ID NO: 1978863 - RNA, 21 nt, Shigella flexneri 2a str. 301
gauuucaccaauuccgcagcg

SEQ ID NO: 1978864 - RNA, 17 nt, Shigella flexneri 2a str. 301
gauuugauggucucgcc

SEQ ID NO: 1978865 - RNA, 13 nt, Shigella flexneri 2a str. 301
gauuuggcugccg

SEQ ID NO: 1978866 - RNA, 17 nt, Shigella flexneri 2a str. 301
gauuugcggaaguaguu

SEQ ID NO: 1978867 - RNA, 23 nt, Shigella flexneri 2a str. 301
gauuugcggaaguaguucaucaa

SEQ ID NO: 1978868 - RNA, 22 nt, Shigella flexneri 2a str. 301
gauuucuucauuaaauuuccgc

SEQ ID NO: 1978869 - RNA, 16 nt, Shigella flexneri 2a str. 301
gauuucuccccccucu

SEQ ID NO: 1978870 - RNA, 20 nt, Shigella flexneri 2a str. 301
gauuucguugugucgccagc

SEQ ID NO: 1978871 - RNA, 19 nt, Shigella flexneri 2a str. 301
gauuugucgccugcaucac

SEQ ID NO: 1978872 - RNA, 15 nt, Shigella flexneri 2a str. 301
gauuuucaucuucuu

SEQ ID NO: 1978873 - RNA, 16 nt, Shigella flexneri 2a str. 301
gauuuucaucuucuuc

SEQ ID NO: 1978874 - RNA, 19 nt, Shigella flexneri 2a str. 301
gauuuucuacuucuuucac

SEQ ID NO: 1978875 - RNA, 14 nt, Shigella flexneri 2a str. 301
gauuuugcaauaau

SEQ ID NO: 1978876 - RNA, 13 nt, Shigella flexneri 2a str. 301
gauuuugcaauaa

SEQ ID NO: 1978877 - RNA, 14 nt, Shigella flexneri 2a str. 301
gauuuugccagcau

SEQ ID NO: 1978878 - RNA, 15 nt, Shigella flexneri 2a str. 301
gauuuugcugugcuu

SEQ ID NO: 1978879 - RNA, 18 nt, Shigella flexneri 2a str. 301
gauuuuuuauaguacuuc

SEQ ID NO: 1978880 - RNA, 14 nt, Shigella flexneri 2a str. 301
gauuuuucugcucg

SEQ ID NO: 1978881 - RNA, 17 nt, Shigella flexneri 2a str. 301
gauuuuuaauagagaua

SEQ ID NO: 1978882 - RNA, 19 nt, Shigella flexneri 2a str. 301
gauuuuuuuucaaccuaaa

SEQ ID NO: 1978883 - RNA, 16 nt, Shigella flexneri 2a str. 301
gauuuuuuuauuuuuu

SEQ ID NO: 1978884 - RNA, 13 nt, Shigella flexneri 2a str. 301
gcaaaaauaagcg

SEQ ID NO: 1978885 - RNA, 21 nt, Shigella flexneri 2a str. 301
gcaaaaaauugcgucaguauu

SEQ ID NO: 1978886 - RNA, 19 nt, Shigella flexneri 2a str. 301
gcaaaaucguaagcaggag

SEQ ID NO: 1978887 - RNA, 22 nt, Shigella flexneri 2a str. 301
gcaaaaugcaucggcauaauca

SEQ ID NO: 1978888 - RNA, 20 nt, Shigella flexneri 2a str. 301
gcaaaauuuucauugccgca

SEQ ID NO: 1978889 - RNA, 19 nt, Shigella flexneri 2a str. 301
gcaaaaucaucacucccuu

SEQ ID NO: 1978890 - RNA, 15 nt, Shigella flexneri 2a str. 301
gcaaaaucaccauca

SEQ ID NO: 1978891 - RNA, 13 nt, Shigella flexneri 2a str. 301
gcaaaaucaccau

SEQ ID NO: 1978892 - RNA, 19 nt, Shigella flexneri 2a str. 301
gcaaaauagucaucucuuc

SEQ ID NO: 1978893 - RNA, 13 nt, Shigella flexneri 2a str. 301
gcaaaaucaaaua

SEQ ID NO: 1978894 - RNA, 15 nt, Shigella flexneri 2a str. 301
gcaaaauacaugacc

SEQ ID NO: 1978895 - RNA, 19 nt, Shigella flexneri 2a str. 301
gcaaaaccaucaauccacu

SEQ ID NO: 1978896 - RNA, 14 nt, Shigella flexneri 2a str. 301
gcaaaacccaggcu

SEQ ID NO: 1978897 - RNA, 14 nt, Shigella flexneri 2a str. 301
gcaaaaccugguug

SEQ ID NO: 1978898 - RNA, 21 nt, Shigella flexneri 2a str. 301
gcaaacuucuucaguuuuucc

SEQ ID NO: 1978899 - RNA, 23 nt, Shigella flexneri 2a str. 301
gcaaacugcugauguuguuucuc

SEQ ID NO: 1978900 - RNA, 12 nt, Shigella flexneri 2a str. 301
gcaaagcaggcc

SEQ ID NO: 1978901 - RNA, 16 nt, Shigella flexneri 2a str. 301
gcaaagcggucuucug

SEQ ID NO: 1978902 - RNA, 21 nt, Shigella flexneri 2a str. 301
gcaaagcgugcaaauauacau

SEQ ID NO: 1978903 - RNA, 14 nt, Shigella flexneri 2a str. 301
gcaaaggccagcca

SEQ ID NO: 1978904 - RNA, 14 nt, Shigella flexneri 2a str. 301
gcaaagagagaagc

SEQ ID NO: 1978905 - RNA, 10 nt, Shigella flexneri 2a str. 301
gcaaagcgac

SEQ ID NO: 1978906 - RNA, 15 nt, Shigella flexneri 2a str. 301
gcaaacgccaccugu

SEQ ID NO: 1978907 - RNA, 19 nt, Shigella flexneri 2a str. 301
gcaaacuacaaauccaaca

SEQ ID NO: 1978908 - RNA, 15 nt, Shigella flexneri 2a str. 301
gcaaacuaucccagc

SEQ ID NO: 1978909 - RNA, 15 nt, Shigella flexneri 2a str. 301
gcaaacugaguggag

SEQ ID NO: 1978910 - RNA, 19 nt, Shigella flexneri 2a str. 301
gcaaacugccguugcugcc

SEQ ID NO: 1978911 - RNA, 23 nt, Shigella flexneri 2a str. 301
gcaaaccaugacgcacuuucgcu

SEQ ID NO: 1978912 - RNA, 14 nt, Shigella flexneri 2a str. 301
gcaaaccaaaccaa

SEQ ID NO: 1978913 - RNA, 13 nt, Shigella flexneri 2a str. 301
gcaaacaguuucu

SEQ ID NO: 1978914 - RNA, 17 nt, Shigella flexneri 2a str. 301
gcaaacaggugcuccag

SEQ ID NO: 1978915 - RNA, 19 nt, Shigella flexneri 2a str. 301
gcaaaucacgcugcugauu

SEQ ID NO: 1978916 - RNA, 21 nt, Shigella flexneri 2a str. 301
gcaaaucaauagugaacugac

SEQ ID NO: 1978917 - RNA, 16 nt, Shigella flexneri 2a str. 301
gcaaauauuaauaaua

SEQ ID NO: 1978918 - RNA, 12 nt, Shigella flexneri 2a str. 301
gcaaauauuaau

SEQ ID NO: 1978919 - RNA, 14 nt, Shigella flexneri 2a str. 301
gcaaauauuaauaa

SEQ ID NO: 1978920 - RNA, 15 nt, Shigella flexneri 2a str. 301
gcaaauauugcauug

SEQ ID NO: 1978921 - RNA, 22 nt, Shigella flexneri 2a str. 301
gcaaauaccggacacacuucau

SEQ ID NO: 1978922 - RNA, 17 nt, Shigella flexneri 2a str. 301
gcaaauacccaaaaaau

SEQ ID NO: 1978923 - RNA, 21 nt, Shigella flexneri 2a str. 301
gcaaagugaauacagaacagu

SEQ ID NO: 1978924 - RNA, 13 nt, Shigella flexneri 2a str. 301
gcaaagugccccc

SEQ ID NO: 1978925 - RNA, 15 nt, Shigella flexneri 2a str. 301
gcaaagugcccccaa

SEQ ID NO: 1978926 - RNA, 22 nt, Shigella flexneri 2a str. 301
gcaaaguggcgcagagccugaa

SEQ ID NO: 1978927 - RNA, 17 nt, Shigella flexneri 2a str. 301
gcaaaguuugugaucuu

SEQ ID NO: 1978928 - RNA, 13 nt, Shigella flexneri 2a str. 301
gcaaauaaaacau

SEQ ID NO: 1978929 - RNA, 15 nt, Shigella flexneri 2a str. 301
gcaaauaacguaaaa

SEQ ID NO: 1978930 - RNA, 15 nt, Shigella flexneri 2a str. 301
gcaaaguagagcgaa

SEQ ID NO: 1978931 - RNA, 19 nt, Shigella flexneri 2a str. 301
gcaaaguaauaaugaucag

SEQ ID NO: 1978932 - RNA, 15 nt, Shigella flexneri 2a str. 301
gcaaaguagcgggcu

SEQ ID NO: 1978933 - RNA, 19 nt, Shigella flexneri 2a str. 301
gcaaagugaauacagaaca

SEQ ID NO: 1978934 - RNA, 15 nt, Shigella flexneri 2a str. 301
gcaaauccgcacuca

SEQ ID NO: 1978935 - RNA, 22 nt, Shigella flexneri 2a str. 301
gcaaaucgacgccacaaucuga

SEQ ID NO: 1978936 - RNA, 17 nt, Shigella flexneri 2a str. 301
gcaaauccacguuccag

SEQ ID NO: 1978937 - RNA, 18 nt, Shigella flexneri 2a str. 301
gcaaaucgcugaauaucu

SEQ ID NO: 1978938 - RNA, 23 nt, Shigella flexneri 2a str. 301
gcaaaucguauccggcauuauca

SEQ ID NO: 1978939 - RNA, 19 nt, Shigella flexneri 2a str. 301
gcaaaucgaucucaaugag

SEQ ID NO: 1978940 - RNA, 16 nt, Shigella flexneri 2a str. 301
gcaaaugaugcaccac

SEQ ID NO: 1978941 - RNA, 22 nt, Shigella flexneri 2a str. 301
gcaaaugaugcaccaccugauu

SEQ ID NO: 1978942 - RNA, 14 nt, Shigella flexneri 2a str. 301
gcaaauguggcggu

SEQ ID NO: 1978943 - RNA, 18 nt, Shigella flexneri 2a str. 301
gcaaaugcagcauugccu

SEQ ID NO: 1978944 - RNA, 11 nt, Shigella flexneri 2a str. 301
gcaaaugccag

SEQ ID NO: 1978945 - RNA, 13 nt, Shigella flexneri 2a str. 301
gcaaaugcggaga

SEQ ID NO: 1978946 - RNA, 15 nt, Shigella flexneri 2a str. 301
gcaaaugcagcauug

SEQ ID NO: 1978947 - RNA, 19 nt, Shigella flexneri 2a str. 301
gcaaauucaauaaauugca

SEQ ID NO: 1978948 - RNA, 16 nt, Shigella flexneri 2a str. 301
gcaaauucauuaccaa

SEQ ID NO: 1978949 - RNA, 19 nt, Shigella flexneri 2a str. 301
gcaacaaaacguagaaacc

SEQ ID NO: 1978950 - RNA, 15 nt, Shigella flexneri 2a str. 301
gcaaauuuauuaucu

SEQ ID NO: 1978951 - RNA, 22 nt, Shigella flexneri 2a str. 301
gcaacauuaaauacagcuuaau

SEQ ID NO: 1978952 - RNA, 15 nt, Shigella flexneri 2a str. 301
gcaacauguugaauc

SEQ ID NO: 1978953 - RNA, 19 nt, Shigella flexneri 2a str. 301
gcaacaugucagcaaucac

SEQ ID NO: 1978954 - RNA, 16 nt, Shigella flexneri 2a str. 301
gcaaccacaaccgccg

SEQ ID NO: 1978955 - RNA, 14 nt, Shigella flexneri 2a str. 301
gcaaccacaacgca

SEQ ID NO: 1978956 - RNA, 19 nt, Shigella flexneri 2a str. 301
gcaaccaacgccagcagca

SEQ ID NO: 1978957 - RNA, 22 nt, Shigella flexneri 2a str. 301
gcaaccaacgccagcagcagcg

SEQ ID NO: 1978958 - RNA, 22 nt, Shigella flexneri 2a str. 301
gcaacauugcgccucaccggau

SEQ ID NO: 1978959 - RNA, 18 nt, Shigella flexneri 2a str. 301
gcaaccagcggcugcuga

SEQ ID NO: 1978960 - RNA, 14 nt, Shigella flexneri 2a str. 301
gcaaccacacccac

SEQ ID NO: 1978961 - RNA, 23 nt, Shigella flexneri 2a str. 301
gcaaccagcccaugaaucagcaa

SEQ ID NO: 1978962 - RNA, 15 nt, Shigella flexneri 2a str. 301
gcaaccagcggcugc

SEQ ID NO: 1978963 - RNA, 13 nt, Shigella flexneri 2a str. 301
gcaaccagcaccg

SEQ ID NO: 1978964 - RNA, 13 nt, Shigella flexneri 2a str. 301
gcaacccccacac

SEQ ID NO: 1978965 - RNA, 17 nt, Shigella flexneri 2a str. 301
gcaacccagaagaaagc

SEQ ID NO: 1978966 - RNA, 12 nt, Shigella flexneri 2a str. 301
gcaacaggcugu

SEQ ID NO: 1978967 - RNA, 12 nt, Shigella flexneri 2a str. 301
gcaacaggccag

SEQ ID NO: 1978968 - RNA, 15 nt, Shigella flexneri 2a str. 301
gcaacagguugcgcu

SEQ ID NO: 1978969 - RNA, 20 nt, Shigella flexneri 2a str. 301
gcaacagaaacgccauccag

SEQ ID NO: 1978970 - RNA, 17 nt, Shigella flexneri 2a str. 301
gcaacagaacgcgccuu

SEQ ID NO: 1978971 - RNA, 14 nt, Shigella flexneri 2a str. 301
gcaacaacagcgcg

SEQ ID NO: 1978972 - RNA, 20 nt, Shigella flexneri 2a str. 301
gcaacaaugccacgccacag

SEQ ID NO: 1978973 - RNA, 19 nt, Shigella flexneri 2a str. 301
gcaacaauggcauuuaucu

SEQ ID NO: 1978974 - RNA, 18 nt, Shigella flexneri 2a str. 301
gcccggaauggugcuggu

SEQ ID NO: 1978975 - RNA, 15 nt, Shigella flexneri 2a str. 301
gcccggagcagcagu

SEQ ID NO: 1978976 - RNA, 19 nt, Shigella flexneri 2a str. 301
gcccgcgcugucgggcagc

SEQ ID NO: 1978977 - RNA, 16 nt, Shigella flexneri 2a str. 301
gcccggcauucaccuc

SEQ ID NO: 1978978 - RNA, 19 nt, Shigella flexneri 2a str. 301
gcccggcaugacgccgggc

SEQ ID NO: 1978979 - RNA, 20 nt, Shigella flexneri 2a str. 301
gcccggaucguucacaugag

SEQ ID NO: 1978980 - RNA, 21 nt, Shigella flexneri 2a str. 301
gcccggauauccacccgcagc

SEQ ID NO: 1978981 - RNA, 15 nt, Shigella flexneri 2a str. 301
gcccggacuagcgcu

SEQ ID NO: 1978982 - RNA, 17 nt, Shigella flexneri 2a str. 301
gcccgcccccgggccuc

SEQ ID NO: 1978983 - RNA, 14 nt, Shigella flexneri 2a str. 301
gcccgcccccgggc

SEQ ID NO: 1978984 - RNA, 21 nt, Shigella flexneri 2a str. 301
gcccgaugaccuugucaugca

SEQ ID NO: 1978985 - RNA, 20 nt, Shigella flexneri 2a str. 301
gcccgauagaaaccaugucc

SEQ ID NO: 1978986 - RNA, 15 nt, Shigella flexneri 2a str. 301
gccccgguuucucuu

SEQ ID NO: 1978987 - RNA, 17 nt, Shigella flexneri 2a str. 301
gccccggguuuccugga

SEQ ID NO: 1978988 - RNA, 21 nt, Shigella flexneri 2a str. 301
gcccgacgaggcgcuggcgca

SEQ ID NO: 1978989 - RNA, 18 nt, Shigella flexneri 2a str. 301
gcccgacuugagcgcagu

SEQ ID NO: 1978990 - RNA, 16 nt, Shigella flexneri 2a str. 301
gccccuucggggagag

SEQ ID NO: 1978991 - RNA, 23 nt, Shigella flexneri 2a str. 301
gccccgcgaacggggcugccagc

SEQ ID NO: 1978992 - RNA, 20 nt, Shigella flexneri 2a str. 301
gccccggcgaucccagagcg

SEQ ID NO: 1978993 - RNA, 19 nt, Shigella flexneri 2a str. 301
gccccggcugcgcgacggc

SEQ ID NO: 1978994 - RNA, 18 nt, Shigella flexneri 2a str. 301
gccccgaaaaagagccag

SEQ ID NO: 1978995 - RNA, 21 nt, Shigella flexneri 2a str. 301
gcccccucacaugaguugcug

SEQ ID NO: 1978996 - RNA, 20 nt, Shigella flexneri 2a str. 301
gccccaucgaaccaucggcu

SEQ ID NO: 1978997 - RNA, 19 nt, Shigella flexneri 2a str. 301
gcccauuauugacagaccg

SEQ ID NO: 1978998 - RNA, 21 nt, Shigella flexneri 2a str. 301
gccccauggacauacgcaccu

SEQ ID NO: 1978999 - RNA, 14 nt, Shigella flexneri 2a str. 301
gcccacgccgccca

SEQ ID NO: 1979000 - RNA, 23 nt, Shigella flexneri 2a str. 301
gcccacgcgcauucccagcgcgu

SEQ ID NO: 1979001 - RNA, 20 nt, Shigella flexneri 2a str. 301
gcccacggcguggcaucaau

SEQ ID NO: 1979002 - RNA, 19 nt, Shigella flexneri 2a str. 301
gcccacgggugaucuucau

SEQ ID NO: 1979003 - RNA, 14 nt, Shigella flexneri 2a str. 301
gcccagaacaaaua

SEQ ID NO: 1979004 - RNA, 21 nt, Shigella flexneri 2a str. 301
gcccacuuucaggccagcggc

SEQ ID NO: 1979005 - RNA, 17 nt, Shigella flexneri 2a str. 301
gcccacuuucugcgcaa

SEQ ID NO: 1979006 - RNA, 13 nt, Shigella flexneri 2a str. 301
gcccacuccagcu

SEQ ID NO: 1979007 - RNA, 13 nt, Shigella flexneri 2a str. 301
gcccaccaccagc

SEQ ID NO: 1979008 - RNA, 21 nt, Shigella flexneri 2a str. 301
gcccaccaccagcgaaaucac

SEQ ID NO: 1979009 - RNA, 21 nt, Shigella flexneri 2a str. 301
gcccacaucaacucugcaaug

SEQ ID NO: 1979010 - RNA, 23 nt, Shigella flexneri 2a str. 301
gcccaccgacgcagucaugcgag

SEQ ID NO: 1979011 - RNA, 22 nt, Shigella flexneri 2a str. 301
gcccagcguuccggcguccacc

SEQ ID NO: 1979012 - RNA, 14 nt, Shigella flexneri 2a str. 301
gcccagaccagaau

SEQ ID NO: 1979013 - RNA, 15 nt, Shigella flexneri 2a str. 301
gcccauccaggguuu

SEQ ID NO: 1979014 - RNA, 18 nt, Shigella flexneri 2a str. 301
gcccaucaugcgccaggu

SEQ ID NO: 1979015 - RNA, 16 nt, Shigella flexneri 2a str. 301
gcccaucgccagugcc

SEQ ID NO: 1979016 - RNA, 19 nt, Shigella flexneri 2a str. 301
gcccaucgcauaacagagc

SEQ ID NO: 1979017 - RNA, 21 nt, Shigella flexneri 2a str. 301
gcccaucgccacgccuguacc

SEQ ID NO: 1979018 - RNA, 17 nt, Shigella flexneri 2a str. 301
gcccauccuucugugga

SEQ ID NO: 1979019 - RNA, 21 nt, Shigella flexneri 2a str. 301
gcccaucacaauggcacaaau

SEQ ID NO: 1979020 - RNA, 19 nt, Shigella flexneri 2a str. 301
gcccaucagcaucccaccu

SEQ ID NO: 1979021 - RNA, 17 nt, Shigella flexneri 2a str. 301
gcccauaaauacgucuu

SEQ ID NO: 1979022 - RNA, 17 nt, Shigella flexneri 2a str. 301
gcccaguugaucaccag

SEQ ID NO: 1979023 - RNA, 13 nt, Shigella flexneri 2a str. 301
gccauuaaacgca

SEQ ID NO: 1979024 - RNA, 18 nt, Shigella flexneri 2a str. 301
gccaugcccgugcugaca

SEQ ID NO: 1979025 - RNA, 17 nt, Shigella flexneri 2a str. 301
gccaucuuucgcagauu

SEQ ID NO: 1979026 - RNA, 15 nt, Shigella flexneri 2a str. 301
gccaugcgaaugcca

SEQ ID NO: 1979027 - RNA, 23 nt, Shigella flexneri 2a str. 301
gcccaaccacggaguugaccagc

SEQ ID NO: 1979028 - RNA, 22 nt, Shigella flexneri 2a str. 301
gcccaacauacuguaacugcgu

SEQ ID NO: 1979029 - RNA, 18 nt, Shigella flexneri 2a str. 301
gcccaacaguagacaauu

SEQ ID NO: 1979030 - RNA, 16 nt, Shigella flexneri 2a str. 301
gcccacaccagucagc

SEQ ID NO: 1979031 - RNA, 12 nt, Shigella flexneri 2a str. 301
gccauuggcuuu

SEQ ID NO: 1979032 - RNA, 20 nt, Shigella flexneri 2a str. 301
gcccaaaccacccagcagcg

SEQ ID NO: 1979033 - RNA, 19 nt, Shigella flexneri 2a str. 301
gccaggcgcugauugggaa

SEQ ID NO: 1979034 - RNA, 19 nt, Shigella flexneri 2a str. 301
gccauauguguuugugcug

SEQ ID NO: 1979035 - RNA, 20 nt, Shigella flexneri 2a str. 301
gccauauuguuucaacacag

SEQ ID NO: 1979036 - RNA, 17 nt, Shigella flexneri 2a str. 301
gccauauuuaaagaaga

SEQ ID NO: 1979037 - RNA, 17 nt, Shigella flexneri 2a str. 301
gccaucauacgauggcc

SEQ ID NO: 1979038 - RNA, 16 nt, Shigella flexneri 2a str. 301
gccauccgucauccau

SEQ ID NO: 1979039 - RNA, 19 nt, Shigella flexneri 2a str. 301
gccauccgucauccauacc

SEQ ID NO: 1979040 - RNA, 15 nt, Shigella flexneri 2a str. 301
gccauccgucaucca

SEQ ID NO: 1979041 - RNA, 13 nt, Shigella flexneri 2a str. 301
gccaucagcagcg

SEQ ID NO: 1979042 - RNA, 23 nt, Shigella flexneri 2a str. 301
gccaucagggcggccgccagaaa

SEQ ID NO: 1979043 - RNA, 15 nt, Shigella flexneri 2a str. 301
gccaucagugccagu

SEQ ID NO: 1979044 - RNA, 17 nt, Shigella flexneri 2a str. 301
gccaucugccagcaagc

SEQ ID NO: 1979045 - RNA, 22 nt, Shigella flexneri 2a str. 301
gccaucugaauaaacggcucau

SEQ ID NO: 1979046 - RNA, 16 nt, Shigella flexneri 2a str. 301
gccaucgccagcagcc

SEQ ID NO: 1979047 - RNA, 13 nt, Shigella flexneri 2a str. 301
gccaucuggcuga

SEQ ID NO: 1979048 - RNA, 20 nt, Shigella flexneri 2a str. 301
gccgagcgggaucgccgcgu

SEQ ID NO: 1979049 - RNA, 14 nt, Shigella flexneri 2a str. 301
gccgagcuggaaca

SEQ ID NO: 1979050 - RNA, 22 nt, Shigella flexneri 2a str. 301
gccgagaagauuuuuugccagc

SEQ ID NO: 1979051 - RNA, 14 nt, Shigella flexneri 2a str. 301
gccgaucgucuggg

SEQ ID NO: 1979052 - RNA, 21 nt, Shigella flexneri 2a str. 301
gccgauaaucaacgcgccgcc

SEQ ID NO: 1979053 - RNA, 13 nt, Shigella flexneri 2a str. 301
gccgauaauacuc

SEQ ID NO: 1979054 - RNA, 16 nt, Shigella flexneri 2a str. 301
gccgaggcgcuggcag

SEQ ID NO: 1979055 - RNA, 20 nt, Shigella flexneri 2a str. 301
gccgcaaaucguauccggca

SEQ ID NO: 1979056 - RNA, 23 nt, Shigella flexneri 2a str. 301
gccgcaaacgacacugcucgcag

SEQ ID NO: 1979057 - RNA, 17 nt, Shigella flexneri 2a str. 301
gccgcaacuaccagcag

SEQ ID NO: 1979058 - RNA, 18 nt, Shigella flexneri 2a str. 301
gccgcaacuaccagcagu

SEQ ID NO: 1979059 - RNA, 18 nt, Shigella flexneri 2a str. 301
gccgaugaacggcggcgg

SEQ ID NO: 1979060 - RNA, 20 nt, Shigella flexneri 2a str. 301
gccgauuuugccuucauacu

SEQ ID NO: 1979061 - RNA, 14 nt, Shigella flexneri 2a str. 301
gccgcaaaacccag

SEQ ID NO: 1979062 - RNA, 18 nt, Shigella flexneri 2a str. 301
gccgcacuuugagcagcu

SEQ ID NO: 1979063 - RNA, 20 nt, Shigella flexneri 2a str. 301
gccgcagaaaaagagcauca

SEQ ID NO: 1979064 - RNA, 19 nt, Shigella flexneri 2a str. 301
gccgcauggaaccaguuca

SEQ ID NO: 1979065 - RNA, 16 nt, Shigella flexneri 2a str. 301
gccgccacugccacca

SEQ ID NO: 1979066 - RNA, 22 nt, Shigella flexneri 2a str. 301
gccgcauccggcaauucucucu

SEQ ID NO: 1979067 - RNA, 20 nt, Shigella flexneri 2a str. 301
gccgcauccggcagccgugc

SEQ ID NO: 1979068 - RNA, 15 nt, Shigella flexneri 2a str. 301
gccgcagccaucagc

SEQ ID NO: 1979069 - RNA, 18 nt, Shigella flexneri 2a str. 301
gcccugcggcugaccacc

SEQ ID NO: 1979070 - RNA, 22 nt, Shigella flexneri 2a str. 301
gcccuggacaacauuccugcug

SEQ ID NO: 1979071 - RNA, 15 nt, Shigella flexneri 2a str. 301
gcccuggaugcaguc

SEQ ID NO: 1979072 - RNA, 23 nt, Shigella flexneri 2a str. 301
gcccuggaagaaaaacuggcgca

SEQ ID NO: 1979073 - RNA, 13 nt, Shigella flexneri 2a str. 301
gcccugcuccagc

SEQ ID NO: 1979074 - RNA, 14 nt, Shigella flexneri 2a str. 301
gcccugcuaugcaa

SEQ ID NO: 1979075 - RNA, 16 nt, Shigella flexneri 2a str. 301
gccgacuggcgcgagc

SEQ ID NO: 1979076 - RNA, 13 nt, Shigella flexneri 2a str. 301
gccgacggucagg

SEQ ID NO: 1979077 - RNA, 21 nt, Shigella flexneri 2a str. 301
gccgaccgcaaggaagccuga

SEQ ID NO: 1979078 - RNA, 12 nt, Shigella flexneri 2a str. 301
gccgacaaagau

SEQ ID NO: 1979079 - RNA, 16 nt, Shigella flexneri 2a str. 301
gccgacaaaugcaguu

SEQ ID NO: 1979080 - RNA, 13 nt, Shigella flexneri 2a str. 301
gccgaccagaccg

SEQ ID NO: 1979081 - RNA, 18 nt, Shigella flexneri 2a str. 301
gccgaaccagugcuccac

SEQ ID NO: 1979082 - RNA, 18 nt, Shigella flexneri 2a str. 301
gccgcuggccauuucugc

SEQ ID NO: 1979083 - RNA, 19 nt, Shigella flexneri 2a str. 301
gccgcuucaguugcgccug

SEQ ID NO: 1979084 - RNA, 20 nt, Shigella flexneri 2a str. 301
gccgcuguguguaggccagc

SEQ ID NO: 1979085 - RNA, 17 nt, Shigella flexneri 2a str. 301
gccgcucuuuuguucgc

SEQ ID NO: 1979086 - RNA, 20 nt, Shigella flexneri 2a str. 301
gccgcugaacugauugccac

SEQ ID NO: 1979087 - RNA, 23 nt, Shigella flexneri 2a str. 301
gccgcugaacugauugccacccu

SEQ ID NO: 1979088 - RNA, 18 nt, Shigella flexneri 2a str. 301
gccgcugaacuggcgaag

SEQ ID NO: 1979089 - RNA, 15 nt, Shigella flexneri 2a str. 301
gccgcguagagaaaa

SEQ ID NO: 1979090 - RNA, 16 nt, Shigella flexneri 2a str. 301
gccgcuaacuuccugc

SEQ ID NO: 1979091 - RNA, 14 nt, Shigella flexneri 2a str. 301
gccgcuaacagcag

SEQ ID NO: 1979092 - RNA, 15 nt, Shigella flexneri 2a str. 301
gccgcuaccgcccug

SEQ ID NO: 1979093 - RNA, 16 nt, Shigella flexneri 2a str. 301
gccgcguuugcgcagc

SEQ ID NO: 1979094 - RNA, 18 nt, Shigella flexneri 2a str. 301
gccgcguuggcaaugucg

SEQ ID NO: 1979095 - RNA, 20 nt, Shigella flexneri 2a str. 301
aaagcugcaaggugaaagca

SEQ ID NO: 1979096 - RNA, 15 nt, Shigella flexneri 2a str. 301
aaagcugcaagguga

SEQ ID NO: 1979097 - RNA, 14 nt, Shigella flexneri 2a str. 301
aaagcugauuucug

SEQ ID NO: 1979098 - RNA, 22 nt, Shigella flexneri 2a str. 301
aaagcucuuuugacgcccccaa

SEQ ID NO: 1979099 - RNA, 13 nt, Shigella flexneri 2a str. 301
aaagcucuucaug

SEQ ID NO: 1979100 - RNA, 14 nt, Shigella flexneri 2a str. 301
gccgccagcaacau

SEQ ID NO: 1979101 - RNA, 18 nt, Shigella flexneri 2a str. 301
gccgcgauagcaagcgcu

SEQ ID NO: 1979102 - RNA, 16 nt, Shigella flexneri 2a str. 301
gccgccguuagcuuca

SEQ ID NO: 1979103 - RNA, 16 nt, Shigella flexneri 2a str. 301
gccgcgcggguggugc

SEQ ID NO: 1979104 - RNA, 22 nt, Shigella flexneri 2a str. 301
gccagacgaauaaaacagaaac

SEQ ID NO: 1979105 - RNA, 13 nt, Shigella flexneri 2a str. 301
gccagacucgcca

SEQ ID NO: 1979106 - RNA, 16 nt, Shigella flexneri 2a str. 301
gccagagcagcaacaa

SEQ ID NO: 1979107 - RNA, 13 nt, Shigella flexneri 2a str. 301
gccagacugcgcu

SEQ ID NO: 1979108 - RNA, 12 nt, Shigella flexneri 2a str. 301
gccagagagcga

SEQ ID NO: 1979109 - RNA, 21 nt, Shigella flexneri 2a str. 301
gccagaauaacgugaucgaac

SEQ ID NO: 1979110 - RNA, 17 nt, Shigella flexneri 2a str. 301
gccagaauagccgcagc

SEQ ID NO: 1979111 - RNA, 15 nt, Shigella flexneri 2a str. 301
gccagacaaaccacg

SEQ ID NO: 1979112 - RNA, 13 nt, Shigella flexneri 2a str. 301
gccagaaucccca

SEQ ID NO: 1979113 - RNA, 12 nt, Shigella flexneri 2a str. 301
gccagaccacug

SEQ ID NO: 1979114 - RNA, 19 nt, Shigella flexneri 2a str. 301
gccagaccacugcgccgcu

SEQ ID NO: 1979115 - RNA, 20 nt, Shigella flexneri 2a str. 301
gccagaccacugcgccgcuc

SEQ ID NO: 1979116 - RNA, 16 nt, Shigella flexneri 2a str. 301
gccagaccgcagaagc

SEQ ID NO: 1979117 - RNA, 22 nt, Shigella flexneri 2a str. 301
gccagacaccccuucauucagg

SEQ ID NO: 1979118 - RNA, 14 nt, Shigella flexneri 2a str. 301
gccagacagcauca

SEQ ID NO: 1979119 - RNA, 16 nt, Shigella flexneri 2a str. 301
gccagacauuauaaau

SEQ ID NO: 1979120 - RNA, 17 nt, Shigella flexneri 2a str. 301
gccagaccaaacagcau

SEQ ID NO: 1979121 - RNA, 18 nt, Shigella flexneri 2a str. 301
gccagaaaaccuggcgca

SEQ ID NO: 1979122 - RNA, 21 nt, Shigella flexneri 2a str. 301
gccagaaaaccuggcgcagug

SEQ ID NO: 1979123 - RNA, 14 nt, Shigella flexneri 2a str. 301
gccagaaaaccugg

SEQ ID NO: 1979124 - RNA, 16 nt, Shigella flexneri 2a str. 301
gccacuuuuugcucaa

SEQ ID NO: 1979125 - RNA, 16 nt, Shigella flexneri 2a str. 301
gccagaaacagugacc

SEQ ID NO: 1979126 - RNA, 12 nt, Shigella flexneri 2a str. 301
gccagaaaguac

SEQ ID NO: 1979127 - RNA, 22 nt, Shigella flexneri 2a str. 301
gccacuuucucacucaccgcag

SEQ ID NO: 1979128 - RNA, 21 nt, Shigella flexneri 2a str. 301
gccacuuuucggcaaccgcau

SEQ ID NO: 1979129 - RNA, 20 nt, Shigella flexneri 2a str. 301
gccagaacacuguuaccgcu

SEQ ID NO: 1979130 - RNA, 21 nt, Shigella flexneri 2a str. 301
gccagaaauccaggcccgcau

SEQ ID NO: 1979131 - RNA, 18 nt, Shigella flexneri 2a str. 301
gccagaaauggcccaaaa

SEQ ID NO: 1979132 - RNA, 13 nt, Shigella flexneri 2a str. 301
gccagaaauccag

SEQ ID NO: 1979133 - RNA, 19 nt, Shigella flexneri 2a str. 301
gccagaacagcuacagcau

SEQ ID NO: 1979134 - RNA, 18 nt, Shigella flexneri 2a str. 301
gccacgcuucaaucugau

SEQ ID NO: 1979135 - RNA, 15 nt, Shigella flexneri 2a str. 301
gccacgcuucaaucu

SEQ ID NO: 1979136 - RNA, 23 nt, Shigella flexneri 2a str. 301
gccacuucuuccagcggcaggcc

SEQ ID NO: 1979137 - RNA, 20 nt, Shigella flexneri 2a str. 301
gccacuucuuccagcggcag

SEQ ID NO: 1979138 - RNA, 23 nt, Shigella flexneri 2a str. 301
gccacggauauauccguggcuuu

SEQ ID NO: 1979139 - RNA, 13 nt, Shigella flexneri 2a str. 301
gccacgcgucguc

SEQ ID NO: 1979140 - RNA, 13 nt, Shigella flexneri 2a str. 301
gccacgcguuugg

SEQ ID NO: 1979141 - RNA, 20 nt, Shigella flexneri 2a str. 301
gccacgcugccgcgcaggga

SEQ ID NO: 1979142 - RNA, 17 nt, Shigella flexneri 2a str. 301
gccagcaacugacugac

SEQ ID NO: 1979143 - RNA, 18 nt, Shigella flexneri 2a str. 301
gccagcaaggcgcuaaaa

SEQ ID NO: 1979144 - RNA, 15 nt, Shigella flexneri 2a str. 301
gccagcaauccccag

SEQ ID NO: 1979145 - RNA, 18 nt, Shigella flexneri 2a str. 301
gccagcaauccccagaca

SEQ ID NO: 1979146 - RNA, 18 nt, Shigella flexneri 2a str. 301
gccagauggcuuugcccu

SEQ ID NO: 1979147 - RNA, 12 nt, Shigella flexneri 2a str. 301
gccagaugggau

SEQ ID NO: 1979148 - RNA, 14 nt, Shigella flexneri 2a str. 301
gccagauguugucu

SEQ ID NO: 1979149 - RNA, 20 nt, Shigella flexneri 2a str. 301
gccagaucggccaucaguac

SEQ ID NO: 1979150 - RNA, 17 nt, Shigella flexneri 2a str. 301
gccagaugccuugccaa

SEQ ID NO: 1979151 - RNA, 15 nt, Shigella flexneri 2a str. 301
gccagaggagccauc

SEQ ID NO: 1979152 - RNA, 13 nt, Shigella flexneri 2a str. 301
gccagauaagaca

SEQ ID NO: 1979153 - RNA, 15 nt, Shigella flexneri 2a str. 301
gccagauaagacacu

SEQ ID NO: 1979154 - RNA, 21 nt, Shigella flexneri 2a str. 301
gccagauaaauauuauuggca

SEQ ID NO: 1979155 - RNA, 22 nt, Shigella flexneri 2a str. 301
gccagaguggauuaucuucacc

SEQ ID NO: 1979156 - RNA, 23 nt, Shigella flexneri 2a str. 301
gccagauauugauucaucucuuc

SEQ ID NO: 1979157 - RNA, 16 nt, Shigella flexneri 2a str. 301
gccagauaauggcugu

SEQ ID NO: 1979158 - RNA, 17 nt, Shigella flexneri 2a str. 301
gccagauaauggcuguu

SEQ ID NO: 1979159 - RNA, 16 nt, Shigella flexneri 2a str. 301
gccaccagggauaaag

SEQ ID NO: 1979160 - RNA, 18 nt, Shigella flexneri 2a str. 301
gccaccagugcaggcacc

SEQ ID NO: 1979161 - RNA, 18 nt, Shigella flexneri 2a str. 301
gccaccagcgccgcgcca

SEQ ID NO: 1979162 - RNA, 23 nt, Shigella flexneri 2a str. 301
gccaccgcgcguuugaucgacag

SEQ ID NO: 1979163 - RNA, 12 nt, Shigella flexneri 2a str. 301
gccaccgcgcca

SEQ ID NO: 1979164 - RNA, 13 nt, Shigella flexneri 2a str. 301
gccaccugaucca

SEQ ID NO: 1979165 - RNA, 13 nt, Shigella flexneri 2a str. 301
gccaccucuuuca

SEQ ID NO: 1979166 - RNA, 15 nt, Shigella flexneri 2a str. 301
gccacgccacgcugc

SEQ ID NO: 1979167 - RNA, 13 nt, Shigella flexneri 2a str. 301
gccacgcaaacuu

SEQ ID NO: 1979168 - RNA, 20 nt, Shigella flexneri 2a str. 301
gccacgccuguaccagcggc

SEQ ID NO: 1979169 - RNA, 20 nt, Shigella flexneri 2a str. 301
gccaaagcaccacuccucaa

SEQ ID NO: 1979170 - RNA, 18 nt, Shigella flexneri 2a str. 301
gccaaagcggcaguuaaa

SEQ ID NO: 1979171 - RNA, 20 nt, Shigella flexneri 2a str. 301
gccaaaguacggacgcggca

SEQ ID NO: 1979172 - RNA, 21 nt, Shigella flexneri 2a str. 301
gccaaauauuucuuuaucacc

SEQ ID NO: 1979173 - RNA, 15 nt, Shigella flexneri 2a str. 301
gccaaauccagcgcc

SEQ ID NO: 1979174 - RNA, 15 nt, Shigella flexneri 2a str. 301
gccaaauccagcgca

SEQ ID NO: 1979175 - RNA, 19 nt, Shigella flexneri 2a str. 301
gccaaaucauccagaccgc

SEQ ID NO: 1979176 - RNA, 23 nt, Shigella flexneri 2a str. 301
gccaaauccuuccagcuccagcc

SEQ ID NO: 1979177 - RNA, 19 nt, Shigella flexneri 2a str. 301
gccaaauccggcaaauaac

SEQ ID NO: 1979178 - RNA, 14 nt, Shigella flexneri 2a str. 301
gccacaagggcaua

SEQ ID NO: 1979179 - RNA, 14 nt, Shigella flexneri 2a str. 301
gccacaacuucaac

SEQ ID NO: 1979180 - RNA, 22 nt, Shigella flexneri 2a str. 301
gccacaaucgcagcgcaagcug

SEQ ID NO: 1979181 - RNA, 18 nt, Shigella flexneri 2a str. 301
gccaaaugucagcugcca

SEQ ID NO: 1979182 - RNA, 19 nt, Shigella flexneri 2a str. 301
gccaaaugucaccagccga

SEQ ID NO: 1979183 - RNA, 13 nt, Shigella flexneri 2a str. 301
gccacaacuucaa

SEQ ID NO: 1979184 - RNA, 22 nt, Shigella flexneri 2a str. 301
gccacacacgauccugcacggu

SEQ ID NO: 1979185 - RNA, 19 nt, Shigella flexneri 2a str. 301
gccacagggugaucaccag

SEQ ID NO: 1979186 - RNA, 17 nt, Shigella flexneri 2a str. 301
gccacaggucagcagga

SEQ ID NO: 1979187 - RNA, 16 nt, Shigella flexneri 2a str. 301
gccacaccacugcgca

SEQ ID NO: 1979188 - RNA, 18 nt, Shigella flexneri 2a str. 301
gccacaccaacugugccg

SEQ ID NO: 1979189 - RNA, 17 nt, Shigella flexneri 2a str. 301
gccaccacgccaagaaa

SEQ ID NO: 1979190 - RNA, 13 nt, Shigella flexneri 2a str. 301
gccaccaccagcg

SEQ ID NO: 1979191 - RNA, 15 nt, Shigella flexneri 2a str. 301
gccaccacuugcagc

SEQ ID NO: 1979192 - RNA, 17 nt, Shigella flexneri 2a str. 301
gccacauuccucuguca

SEQ ID NO: 1979193 - RNA, 22 nt, Shigella flexneri 2a str. 301
gccaccaauaaugaacgccacc

SEQ ID NO: 1979194 - RNA, 13 nt, Shigella flexneri 2a str. 301
gccacauccggca

SEQ ID NO: 1979195 - RNA, 13 nt, Shigella flexneri 2a str. 301
gccacauccggcu

SEQ ID NO: 1979196 - RNA, 15 nt, Shigella flexneri 2a str. 301
gccacauccggcuuu

SEQ ID NO: 1979197 - RNA, 19 nt, Shigella flexneri 2a str. 301
gccacaggucagcaggagc

SEQ ID NO: 1979198 - RNA, 18 nt, Shigella flexneri 2a str. 301
gccacauaugaucggaag

SEQ ID NO: 1979199 - RNA, 13 nt, Shigella flexneri 2a str. 301
gccagccccagcg

SEQ ID NO: 1979200 - RNA, 22 nt, Shigella flexneri 2a str. 301
gccagccccagcgucagcauca

SEQ ID NO: 1979201 - RNA, 19 nt, Shigella flexneri 2a str. 301
gccagccgaugcagguugg

SEQ ID NO: 1979202 - RNA, 19 nt, Shigella flexneri 2a str. 301
gccagcccuuuggcuguca

SEQ ID NO: 1979203 - RNA, 13 nt, Shigella flexneri 2a str. 301
gccagccuucacg

SEQ ID NO: 1979204 - RNA, 14 nt, Shigella flexneri 2a str. 301
gccagccuucacga

SEQ ID NO: 1979205 - RNA, 11 nt, Shigella flexneri 2a str. 301
gccagccuccc

SEQ ID NO: 1979206 - RNA, 10 nt, Shigella flexneri 2a str. 301
gccagccuca

SEQ ID NO: 1979207 - RNA, 15 nt, Shigella flexneri 2a str. 301
gccagccucccagcc

SEQ ID NO: 1979208 - RNA, 14 nt, Shigella flexneri 2a str. 301
gccagccucaucca

SEQ ID NO: 1979209 - RNA, 19 nt, Shigella flexneri 2a str. 301
gccagcgccgacagcagcc

SEQ ID NO: 1979210 - RNA, 16 nt, Shigella flexneri 2a str. 301
gccagcgaagccagcu

SEQ ID NO: 1979211 - RNA, 21 nt, Shigella flexneri 2a str. 301
gccagcgauuuugccagccgc

SEQ ID NO: 1979212 - RNA, 14 nt, Shigella flexneri 2a str. 301
gccagcgcaccagc

SEQ ID NO: 1979213 - RNA, 17 nt, Shigella flexneri 2a str. 301
gccagcaugaccaccgg

SEQ ID NO: 1979214 - RNA, 17 nt, Shigella flexneri 2a str. 301
gccagcaugcauaacag

SEQ ID NO: 1979215 - RNA, 22 nt, Shigella flexneri 2a str. 301
gccagcauuggcguuugaccaa

SEQ ID NO: 1979216 - RNA, 23 nt, Shigella flexneri 2a str. 301
gccagcauaaucaccaucagcag

SEQ ID NO: 1979217 - RNA, 17 nt, Shigella flexneri 2a str. 301
gccagcaguuucuucug

SEQ ID NO: 1979218 - RNA, 15 nt, Shigella flexneri 2a str. 301
gccagcauacagcuu

SEQ ID NO: 1979219 - RNA, 21 nt, Shigella flexneri 2a str. 301
gccagcauaaucaccaucagc

SEQ ID NO: 1979220 - RNA, 11 nt, Shigella flexneri 2a str. 301
gccagccagaa

SEQ ID NO: 1979221 - RNA, 21 nt, Shigella flexneri 2a str. 301
gccagccaagcaugucauaca

SEQ ID NO: 1979222 - RNA, 21 nt, Shigella flexneri 2a str. 301
gccagcauucccgccagcggc

SEQ ID NO: 1979223 - RNA, 16 nt, Shigella flexneri 2a str. 301
gccagccagcaccagg

SEQ ID NO: 1979224 - RNA, 12 nt, Shigella flexneri 2a str. 301
gccagccagcca

SEQ ID NO: 1979225 - RNA, 22 nt, Shigella flexneri 2a str. 301
gccagcagagggauaucuuccc

SEQ ID NO: 1979226 - RNA, 21 nt, Shigella flexneri 2a str. 301
gccaggaaucgcaaaccacgg

SEQ ID NO: 1979227 - RNA, 23 nt, Shigella flexneri 2a str. 301
gccaggaaccaccgaugcacagc

SEQ ID NO: 1979228 - RNA, 17 nt, Shigella flexneri 2a str. 301
gccagcuuucaccugcg

SEQ ID NO: 1979229 - RNA, 22 nt, Shigella flexneri 2a str. 301
gccagcuugccgcgcucugcca

SEQ ID NO: 1979230 - RNA, 21 nt, Shigella flexneri 2a str. 301
gccagcuugcgauccugcaga

SEQ ID NO: 1979231 - RNA, 22 nt, Shigella flexneri 2a str. 301
gccaggagccaacacuuucacu

SEQ ID NO: 1979232 - RNA, 21 nt, Shigella flexneri 2a str. 301
gccaggagacgcgcaaaucag

SEQ ID NO: 1979233 - RNA, 16 nt, Shigella flexneri 2a str. 301
gccaggcaucgaugga

SEQ ID NO: 1979234 - RNA, 19 nt, Shigella flexneri 2a str. 301
gccaggcagagcucaacca

SEQ ID NO: 1979235 - RNA, 20 nt, Shigella flexneri 2a str. 301
gccagcgucugagcaggcgg

SEQ ID NO: 1979236 - RNA, 15 nt, Shigella flexneri 2a str. 301
gccagcgucacccag

SEQ ID NO: 1979237 - RNA, 18 nt, Shigella flexneri 2a str. 301
gccagcuccgggcugguu

SEQ ID NO: 1979238 - RNA, 20 nt, Shigella flexneri 2a str. 301
gccagcucaaccuguggugc

SEQ ID NO: 1979239 - RNA, 13 nt, Shigella flexneri 2a str. 301
gccagcggcagcu

SEQ ID NO: 1979240 - RNA, 17 nt, Shigella flexneri 2a str. 301
gccagcggcagcucgcg

SEQ ID NO: 1979241 - RNA, 10 nt, Shigella flexneri 2a str. 301
gccagcggcg

SEQ ID NO: 1979242 - RNA, 18 nt, Shigella flexneri 2a str. 301
gccagcgcgaugcaggcc

SEQ ID NO: 1979243 - RNA, 23 nt, Shigella flexneri 2a str. 301
gccagcgcgccuucauucaggcc

SEQ ID NO: 1979244 - RNA, 12 nt, Shigella flexneri 2a str. 301
gcauuuucucgc

SEQ ID NO: 1979245 - RNA, 16 nt, Shigella flexneri 2a str. 301
gcauuuguaggcagga

SEQ ID NO: 1979246 - RNA, 17 nt, Shigella flexneri 2a str. 301
gccaaagaccaggaaac

SEQ ID NO: 1979247 - RNA, 11 nt, Shigella flexneri 2a str. 301
gcauuuugcag

SEQ ID NO: 1979248 - RNA, 22 nt, Shigella flexneri 2a str. 301
gccaaacuggaacugaaaggcg

SEQ ID NO: 1979249 - RNA, 16 nt, Shigella flexneri 2a str. 301
gcauuucccagcaaga

SEQ ID NO: 1979250 - RNA, 17 nt, Shigella flexneri 2a str. 301
gcauuuccgcugauuca

SEQ ID NO: 1979251 - RNA, 18 nt, Shigella flexneri 2a str. 301
gcauuuccgcugauucaa

SEQ ID NO: 1979252 - RNA, 17 nt, Shigella flexneri 2a str. 301
gcauuucgccaaaccaa

SEQ ID NO: 1979253 - RNA, 15 nt, Shigella flexneri 2a str. 301
gcauuucugcgcaac

SEQ ID NO: 1979254 - RNA, 21 nt, Shigella flexneri 2a str. 301
gcauuacuacgguaauacaac

SEQ ID NO: 1979255 - RNA, 13 nt, Shigella flexneri 2a str. 301
gcauuacuacggu

SEQ ID NO: 1979256 - RNA, 13 nt, Shigella flexneri 2a str. 301
gcauuacaagaau

SEQ ID NO: 1979257 - RNA, 17 nt, Shigella flexneri 2a str. 301
gcauucccgccagcggc

SEQ ID NO: 1979258 - RNA, 15 nt, Shigella flexneri 2a str. 301
gcauugcuaaugcug

SEQ ID NO: 1979259 - RNA, 19 nt, Shigella flexneri 2a str. 301
gcauugcucacuuccuuuu

SEQ ID NO: 1979260 - RNA, 17 nt, Shigella flexneri 2a str. 301
gcauugcucccugcggc

SEQ ID NO: 1979261 - RNA, 19 nt, Shigella flexneri 2a str. 301
gcauugagggcauuauucg

SEQ ID NO: 1979262 - RNA, 23 nt, Shigella flexneri 2a str. 301
gcauucgucguauagaucacuuu

SEQ ID NO: 1979263 - RNA, 21 nt, Shigella flexneri 2a str. 301
gcauugcauuucgcuaccacc

SEQ ID NO: 1979264 - RNA, 12 nt, Shigella flexneri 2a str. 301
gcaugcauaaca

SEQ ID NO: 1979265 - RNA, 16 nt, Shigella flexneri 2a str. 301
gcaugcaucccgccgu

SEQ ID NO: 1979266 - RNA, 22 nt, Shigella flexneri 2a str. 301
gcaucuguuucgaucagcaauu

SEQ ID NO: 1979267 - RNA, 21 nt, Shigella flexneri 2a str. 301
gcaucuguuucgaucagcaau

SEQ ID NO: 1979268 - RNA, 20 nt, Shigella flexneri 2a str. 301
gcaucugguaacccauccag

SEQ ID NO: 1979269 - RNA, 21 nt, Shigella flexneri 2a str. 301
gcaucuuccguggaacaaaau

SEQ ID NO: 1979270 - RNA, 13 nt, Shigella flexneri 2a str. 301
gcaucuucuucau

SEQ ID NO: 1979271 - RNA, 18 nt, Shigella flexneri 2a str. 301
gcauuaaugcgcccagcg

SEQ ID NO: 1979272 - RNA, 18 nt, Shigella flexneri 2a str. 301
gcauuaaggcaagaaaau

SEQ ID NO: 1979273 - RNA, 18 nt, Shigella flexneri 2a str. 301
gcaugguuaacuccuucu

SEQ ID NO: 1979274 - RNA, 17 nt, Shigella flexneri 2a str. 301
gcaugucacaaauagag

SEQ ID NO: 1979275 - RNA, 14 nt, Shigella flexneri 2a str. 301
gcauguagaugccg

SEQ ID NO: 1979276 - RNA, 15 nt, Shigella flexneri 2a str. 301
gcauggcauuuugca

SEQ ID NO: 1979277 - RNA, 16 nt, Shigella flexneri 2a str. 301
gcauggaucgccgcgg

SEQ ID NO: 1979278 - RNA, 16 nt, Shigella flexneri 2a str. 301
gcauggcaccugcgga

SEQ ID NO: 1979279 - RNA, 19 nt, Shigella flexneri 2a str. 301
gcauaacgccgguauuuuu

SEQ ID NO: 1979280 - RNA, 21 nt, Shigella flexneri 2a str. 301
gcauaaucaccaucagcagca

SEQ ID NO: 1979281 - RNA, 22 nt, Shigella flexneri 2a str. 301
gcauaaucaccaucagcagcaa

SEQ ID NO: 1979282 - RNA, 14 nt, Shigella flexneri 2a str. 301
gcauaaugcagcca

SEQ ID NO: 1979283 - RNA, 21 nt, Shigella flexneri 2a str. 301
gcauaaugugcgcacauugcc

SEQ ID NO: 1979284 - RNA, 18 nt, Shigella flexneri 2a str. 301
gcauaauuucagcaagac

SEQ ID NO: 1979285 - RNA, 18 nt, Shigella flexneri 2a str. 301
gcauaauccacuuucuua

SEQ ID NO: 1979286 - RNA, 13 nt, Shigella flexneri 2a str. 301
gcauaggcauuaa

SEQ ID NO: 1979287 - RNA, 17 nt, Shigella flexneri 2a str. 301
gcauaggcauuaaacau

SEQ ID NO: 1979288 - RNA, 16 nt, Shigella flexneri 2a str. 301
gcauagcgcaauaaca

SEQ ID NO: 1979289 - RNA, 16 nt, Shigella flexneri 2a str. 301
gcauagccccagcgca

SEQ ID NO: 1979290 - RNA, 20 nt, Shigella flexneri 2a str. 301
gcauagagacuuuuccagcc

SEQ ID NO: 1979291 - RNA, 19 nt, Shigella flexneri 2a str. 301
gcaucaaacgguugauaaa

SEQ ID NO: 1979292 - RNA, 16 nt, Shigella flexneri 2a str. 301
gcauaugcuuugccgu

SEQ ID NO: 1979293 - RNA, 18 nt, Shigella flexneri 2a str. 301
gcauaugcgggcguuuug

SEQ ID NO: 1979294 - RNA, 14 nt, Shigella flexneri 2a str. 301
gcaucaggcaaucu

SEQ ID NO: 1979295 - RNA, 16 nt, Shigella flexneri 2a str. 301
gcaucagggcgcuggc

SEQ ID NO: 1979296 - RNA, 22 nt, Shigella flexneri 2a str. 301
gcaucaguucggaaacagugcu

SEQ ID NO: 1979297 - RNA, 23 nt, Shigella flexneri 2a str. 301
gcaucaggcguucgcggcggcac

SEQ ID NO: 1979298 - RNA, 18 nt, Shigella flexneri 2a str. 301
gcaucaggcaacccagaa

SEQ ID NO: 1979299 - RNA, 21 nt, Shigella flexneri 2a str. 301
gcaucaagaaugcucgcuggc

SEQ ID NO: 1979300 - RNA, 21 nt, Shigella flexneri 2a str. 301
gcaucaacgaucagcguggca

SEQ ID NO: 1979301 - RNA, 19 nt, Shigella flexneri 2a str. 301
gcaucgccaguuuugccag

SEQ ID NO: 1979302 - RNA, 22 nt, Shigella flexneri 2a str. 301
gcaucgcccaggcgaccaggcc

SEQ ID NO: 1979303 - RNA, 19 nt, Shigella flexneri 2a str. 301
gcaucgauaucaaccaguu

SEQ ID NO: 1979304 - RNA, 15 nt, Shigella flexneri 2a str. 301
gcaucgugaauuuua

SEQ ID NO: 1979305 - RNA, 17 nt, Shigella flexneri 2a str. 301
gcaucgcccccaucgcc

SEQ ID NO: 1979306 - RNA, 16 nt, Shigella flexneri 2a str. 301
gcaucucuacagcgcc

SEQ ID NO: 1979307 - RNA, 18 nt, Shigella flexneri 2a str. 301
gcaucucgcgcucuucuu

SEQ ID NO: 1979308 - RNA, 15 nt, Shigella flexneri 2a str. 301
gcaucuccuguuuca

SEQ ID NO: 1979309 - RNA, 14 nt, Shigella flexneri 2a str. 301
gcaucugauaagcc

SEQ ID NO: 1979310 - RNA, 20 nt, Shigella flexneri 2a str. 301
gcaucugagcaugaugccug

SEQ ID NO: 1979311 - RNA, 15 nt, Shigella flexneri 2a str. 301
gcaucugaccagaug

SEQ ID NO: 1979312 - RNA, 14 nt, Shigella flexneri 2a str. 301
gcaucuccugcaac

SEQ ID NO: 1979313 - RNA, 17 nt, Shigella flexneri 2a str. 301
gcaucuccugauuuucu

SEQ ID NO: 1979314 - RNA, 18 nt, Shigella flexneri 2a str. 301
gcaucgacaguuucaccu

SEQ ID NO: 1979315 - RNA, 13 nt, Shigella flexneri 2a str. 301
gcaucgaccagga

SEQ ID NO: 1979316 - RNA, 24 nt, Shigella flexneri 2a str. 301
gcaucgacggcggagucauucucc

SEQ ID NO: 1979317 - RNA, 20 nt, Shigella flexneri 2a str. 301
gcauccuggggguucaucac

SEQ ID NO: 1979318 - RNA, 21 nt, Shigella flexneri 2a str. 301
gcauccuggcuguuacucaac

SEQ ID NO: 1979319 - RNA, 16 nt, Shigella flexneri 2a str. 301
gcaucauggcauuuca

SEQ ID NO: 1979320 - RNA, 20 nt, Shigella flexneri 2a str. 301
gcaucauuacgcgggccugu

SEQ ID NO: 1979321 - RNA, 18 nt, Shigella flexneri 2a str. 301
gcauccaggccaaaagcu

SEQ ID NO: 1979322 - RNA, 20 nt, Shigella flexneri 2a str. 301
gcagcguuucgcgcgcgccu

SEQ ID NO: 1979323 - RNA, 23 nt, Shigella flexneri 2a str. 301
gcagcuccaguuucuuuugcgcc

SEQ ID NO: 1979324 - RNA, 12 nt, Shigella flexneri 2a str. 301
gcagcuccagcc

SEQ ID NO: 1979325 - RNA, 18 nt, Shigella flexneri 2a str. 301
gcagcugcgcuucaauac

SEQ ID NO: 1979326 - RNA, 16 nt, Shigella flexneri 2a str. 301
gcagcguuuccagcca

SEQ ID NO: 1979327 - RNA, 14 nt, Shigella flexneri 2a str. 301
gcagcgucagcacc

SEQ ID NO: 1979328 - RNA, 19 nt, Shigella flexneri 2a str. 301
gcagcguacguuggcaaag

SEQ ID NO: 1979329 - RNA, 20 nt, Shigella flexneri 2a str. 301
gcagcggucggcuucccugc

SEQ ID NO: 1979330 - RNA, 14 nt, Shigella flexneri 2a str. 301
gcaaccgagcgccc

SEQ ID NO: 1979331 - RNA, 18 nt, Shigella flexneri 2a str. 301
gcagcuuaaucauaaugu

SEQ ID NO: 1979332 - RNA, 14 nt, Shigella flexneri 2a str. 301
gcagcuuagaaauu

SEQ ID NO: 1979333 - RNA, 18 nt, Shigella flexneri 2a str. 301
gcagcuuaucuuuuucgg

SEQ ID NO: 1979334 - RNA, 13 nt, Shigella flexneri 2a str. 301
gcagcuucacaaa

SEQ ID NO: 1979335 - RNA, 17 nt, Shigella flexneri 2a str. 301
gcaggaauaaucagcaa

SEQ ID NO: 1979336 - RNA, 23 nt, Shigella flexneri 2a str. 301
gcagcuuugcccgaucaucaaaa

SEQ ID NO: 1979337 - RNA, 16 nt, Shigella flexneri 2a str. 301
gcagcuuugugcuuca

SEQ ID NO: 1979338 - RNA, 16 nt, Shigella flexneri 2a str. 301
gcagcuuucagcagcg

SEQ ID NO: 1979339 - RNA, 18 nt, Shigella flexneri 2a str. 301
gcaggaaaaucagcauca

SEQ ID NO: 1979340 - RNA, 19 nt, Shigella flexneri 2a str. 301
gcaggaaaaucagcaucaa

SEQ ID NO: 1979341 - RNA, 21 nt, Shigella flexneri 2a str. 301
gcaggagcgauuaugaaacaa

SEQ ID NO: 1979342 - RNA, 18 nt, Shigella flexneri 2a str. 301
gcaggacgcgcgcgccuu

SEQ ID NO: 1979343 - RNA, 18 nt, Shigella flexneri 2a str. 301
gcaggaauguuguccagg

SEQ ID NO: 1979344 - RNA, 23 nt, Shigella flexneri 2a str. 301
gcaggaucgacugcaaaccauga

SEQ ID NO: 1979345 - RNA, 15 nt, Shigella flexneri 2a str. 301
gcaggccguggauca

SEQ ID NO: 1979346 - RNA, 13 nt, Shigella flexneri 2a str. 301
gcaggccggagac

SEQ ID NO: 1979347 - RNA, 15 nt, Shigella flexneri 2a str. 301
gcaggcuauuucugg

SEQ ID NO: 1979348 - RNA, 14 nt, Shigella flexneri 2a str. 301
gcagggccaccagc

SEQ ID NO: 1979349 - RNA, 23 nt, Shigella flexneri 2a str. 301
gcaguggguaagccagaccaccc

SEQ ID NO: 1979350 - RNA, 18 nt, Shigella flexneri 2a str. 301
gcaguggguaagccagac

SEQ ID NO: 1979351 - RNA, 19 nt, Shigella flexneri 2a str. 301
gcagugguuaacaaucaca

SEQ ID NO: 1979352 - RNA, 17 nt, Shigella flexneri 2a str. 301
gcagugggccagaaaaa

SEQ ID NO: 1979353 - RNA, 22 nt, Shigella flexneri 2a str. 301
gcaguggcaaacugaguggagu

SEQ ID NO: 1979354 - RNA, 21 nt, Shigella flexneri 2a str. 301
gcaguucgucgcguuugcccg

SEQ ID NO: 1979355 - RNA, 14 nt, Shigella flexneri 2a str. 301
gcaguucgacaaaa

SEQ ID NO: 1979356 - RNA, 16 nt, Shigella flexneri 2a str. 301
gcaguucccuacucuc

SEQ ID NO: 1979357 - RNA, 23 nt, Shigella flexneri 2a str. 301
gcaguguuuguuaaaacuuucca

SEQ ID NO: 1979358 - RNA, 18 nt, Shigella flexneri 2a str. 301
gcaguuaaacgccuugcg

SEQ ID NO: 1979359 - RNA, 21 nt, Shigella flexneri 2a str. 301
gcauaacagcccgccaaccac

SEQ ID NO: 1979360 - RNA, 15 nt, Shigella flexneri 2a str. 301
gcauaacagagcgaa

SEQ ID NO: 1979361 - RNA, 15 nt, Shigella flexneri 2a str. 301
gcaguuucugauacu

SEQ ID NO: 1979362 - RNA, 12 nt, Shigella flexneri 2a str. 301
gcaguuuauaaa

SEQ ID NO: 1979363 - RNA, 18 nt, Shigella flexneri 2a str. 301
gcaguucuggcaccggac

SEQ ID NO: 1979364 - RNA, 21 nt, Shigella flexneri 2a str. 301
gcaguucugccaggcuggcag

SEQ ID NO: 1979365 - RNA, 19 nt, Shigella flexneri 2a str. 301
gcaguaagugcgcaacaaa

SEQ ID NO: 1979366 - RNA, 18 nt, Shigella flexneri 2a str. 301
gcaguaauaccagaccuu

SEQ ID NO: 1979367 - RNA, 17 nt, Shigella flexneri 2a str. 301
gcagucaccugcccucc

SEQ ID NO: 1979368 - RNA, 17 nt, Shigella flexneri 2a str. 301
gcagucacaccagcgau

SEQ ID NO: 1979369 - RNA, 14 nt, Shigella flexneri 2a str. 301
gcagucaacaagca

SEQ ID NO: 1979370 - RNA, 16 nt, Shigella flexneri 2a str. 301
gcaguaucagagauaa

SEQ ID NO: 1979371 - RNA, 16 nt, Shigella flexneri 2a str. 301
gcaguaagcgccaggg

SEQ ID NO: 1979372 - RNA, 18 nt, Shigella flexneri 2a str. 301
gcaguaaggaaauguucc

SEQ ID NO: 1979373 - RNA, 12 nt, Shigella flexneri 2a str. 301
gcaguaaaucgu

SEQ ID NO: 1979374 - RNA, 16 nt, Shigella flexneri 2a str. 301
gcaguaaauauugucu

SEQ ID NO: 1979375 - RNA, 19 nt, Shigella flexneri 2a str. 301
gcaguaaaccacccaccag

SEQ ID NO: 1979376 - RNA, 20 nt, Shigella flexneri 2a str. 301
gcaguaaaccacccaccagc

SEQ ID NO: 1979377 - RNA, 13 nt, Shigella flexneri 2a str. 301
gcaguaaaccgcu

SEQ ID NO: 1979378 - RNA, 22 nt, Shigella flexneri 2a str. 301
gcaguaaaccgucagcaccagg

SEQ ID NO: 1979379 - RNA, 13 nt, Shigella flexneri 2a str. 301
gcaguaaaccacc

SEQ ID NO: 1979380 - RNA, 14 nt, Shigella flexneri 2a str. 301
gcaguaaaccaccc

SEQ ID NO: 1979381 - RNA, 15 nt, Shigella flexneri 2a str. 301
gcagguuuaaccauc

SEQ ID NO: 1979382 - RNA, 15 nt, Shigella flexneri 2a str. 301
gcaggggaauuucaa

SEQ ID NO: 1979383 - RNA, 17 nt, Shigella flexneri 2a str. 301
gcagggcuguuuaucgu

SEQ ID NO: 1979384 - RNA, 14 nt, Shigella flexneri 2a str. 301
gcagggcggcaggc

SEQ ID NO: 1979385 - RNA, 20 nt, Shigella flexneri 2a str. 301
gcagggcggcaggcagcgcc

SEQ ID NO: 1979386 - RNA, 15 nt, Shigella flexneri 2a str. 301
gcagucauaaccagu

SEQ ID NO: 1979387 - RNA, 19 nt, Shigella flexneri 2a str. 301
gcagucaccugcggugcag

SEQ ID NO: 1979388 - RNA, 16 nt, Shigella flexneri 2a str. 301
gcagucauaaaaucaa

SEQ ID NO: 1979389 - RNA, 14 nt, Shigella flexneri 2a str. 301
gcagucccuuuccc

SEQ ID NO: 1979390 - RNA, 16 nt, Shigella flexneri 2a str. 301
gcagucccuuucccac

SEQ ID NO: 1979391 - RNA, 23 nt, Shigella flexneri 2a str. 301
gcagucuggacaaagagcuuuca

SEQ ID NO: 1979392 - RNA, 18 nt, Shigella flexneri 2a str. 301
gcagugcacgaaccagag

SEQ ID NO: 1979393 - RNA, 23 nt, Shigella flexneri 2a str. 301
gcagugcacgaaccagagacaga

SEQ ID NO: 1979394 - RNA, 14 nt, Shigella flexneri 2a str. 301
gcagugacucacga

SEQ ID NO: 1979395 - RNA, 15 nt, Shigella flexneri 2a str. 301
gcgcugcugcacaua

SEQ ID NO: 1979396 - RNA, 13 nt, Shigella flexneri 2a str. 301
gcgcugccggagc

SEQ ID NO: 1979397 - RNA, 20 nt, Shigella flexneri 2a str. 301
gcgcucugguagauaagcaa

SEQ ID NO: 1979398 - RNA, 18 nt, Shigella flexneri 2a str. 301
gcgcucugccagcaaaua

SEQ ID NO: 1979399 - RNA, 21 nt, Shigella flexneri 2a str. 301
gcggaacgcacuauacaacca

SEQ ID NO: 1979400 - RNA, 20 nt, Shigella flexneri 2a str. 301
gcggaaaucacgauugcugc

SEQ ID NO: 1979401 - RNA, 19 nt, Shigella flexneri 2a str. 301
gcggaaaucacgcaucacu

SEQ ID NO: 1979402 - RNA, 14 nt, Shigella flexneri 2a str. 301
gcgcuuaucgccag

SEQ ID NO: 1979403 - RNA, 15 nt, Shigella flexneri 2a str. 301
gcgcuuaucgccagc

SEQ ID NO: 1979404 - RNA, 14 nt, Shigella flexneri 2a str. 301
gcgcuuauccggcc

SEQ ID NO: 1979405 - RNA, 23 nt, Shigella flexneri 2a str. 301
gcggaaaagagaauaagcgcagc

SEQ ID NO: 1979406 - RNA, 17 nt, Shigella flexneri 2a str. 301
gcgcuuuuuuccugccg

SEQ ID NO: 1979407 - RNA, 18 nt, Shigella flexneri 2a str. 301
gcgcugguaaucaccacc

SEQ ID NO: 1979408 - RNA, 11 nt, Shigella flexneri 2a str. 301
gcggauuucac

SEQ ID NO: 1979409 - RNA, 14 nt, Shigella flexneri 2a str. 301
gcggauuuccccac

SEQ ID NO: 1979410 - RNA, 18 nt, Shigella flexneri 2a str. 301
gcggcaaaaucgccggug

SEQ ID NO: 1979411 - RNA, 20 nt, Shigella flexneri 2a str. 301
gcggcacccauuuauccagc

SEQ ID NO: 1979412 - RNA, 14 nt, Shigella flexneri 2a str. 301
gcggcagcuccagc

SEQ ID NO: 1979413 - RNA, 17 nt, Shigella flexneri 2a str. 301
gcggcagcucgcguucg

SEQ ID NO: 1979414 - RNA, 15 nt, Shigella flexneri 2a str. 301
gcggcaggccgugga

SEQ ID NO: 1979415 - RNA, 21 nt, Shigella flexneri 2a str. 301
gcggcagcuuguacugcucgc

SEQ ID NO: 1979416 - RNA, 13 nt, Shigella flexneri 2a str. 301
gcggaucugcucc

SEQ ID NO: 1979417 - RNA, 20 nt, Shigella flexneri 2a str. 301
gcggaucucuucguuuucaa

SEQ ID NO: 1979418 - RNA, 22 nt, Shigella flexneri 2a str. 301
gcggccccauuuauuucucacu

SEQ ID NO: 1979419 - RNA, 22 nt, Shigella flexneri 2a str. 301
gcggcuggcgaagcccagaaug

SEQ ID NO: 1979420 - RNA, 15 nt, Shigella flexneri 2a str. 301
gcgggaacagcgacc

SEQ ID NO: 1979421 - RNA, 21 nt, Shigella flexneri 2a str. 301
gcggcucguuagacggcgcug

SEQ ID NO: 1979422 - RNA, 23 nt, Shigella flexneri 2a str. 301
gcggcucguuagacggcgcugcc

SEQ ID NO: 1979423 - RNA, 12 nt, Shigella flexneri 2a str. 301
gcggcucucagc

SEQ ID NO: 1979424 - RNA, 21 nt, Shigella flexneri 2a str. 301
gcggcugcccaucaucgucgu

SEQ ID NO: 1979425 - RNA, 19 nt, Shigella flexneri 2a str. 301
gcggcucucuuucuccagc

SEQ ID NO: 1979426 - RNA, 13 nt, Shigella flexneri 2a str. 301
gcggcugcgcagc

SEQ ID NO: 1979427 - RNA, 21 nt, Shigella flexneri 2a str. 301
gcggcugcugauguucgccag

SEQ ID NO: 1979428 - RNA, 22 nt, Shigella flexneri 2a str. 301
gcgggcgaaucaacuccagaau

SEQ ID NO: 1979429 - RNA, 13 nt, Shigella flexneri 2a str. 301
gcgggaggaacaa

SEQ ID NO: 1979430 - RNA, 18 nt, Shigella flexneri 2a str. 301
gcgggcgcgcaggcgcug

SEQ ID NO: 1979431 - RNA, 20 nt, Shigella flexneri 2a str. 301
gcgggcguagugcccgcagu

SEQ ID NO: 1979432 - RNA, 17 nt, Shigella flexneri 2a str. 301
gcgggcguagugcccgc

SEQ ID NO: 1979433 - RNA, 17 nt, Shigella flexneri 2a str. 301
gcgggcugaccgcccgc

SEQ ID NO: 1979434 - RNA, 13 nt, Shigella flexneri 2a str. 301
gcgguaaauuuuu

SEQ ID NO: 1979435 - RNA, 18 nt, Shigella flexneri 2a str. 301
gcgguaaaguuuggcugu

SEQ ID NO: 1979436 - RNA, 18 nt, Shigella flexneri 2a str. 301
gcgguaaaauggucagcc

SEQ ID NO: 1979437 - RNA, 15 nt, Shigella flexneri 2a str. 301
gcgguaaccuggcag

SEQ ID NO: 1979438 - RNA, 15 nt, Shigella flexneri 2a str. 301
gcgggucaggccagg

SEQ ID NO: 1979439 - RNA, 15 nt, Shigella flexneri 2a str. 301
gcgggucaguauucc

SEQ ID NO: 1979440 - RNA, 22 nt, Shigella flexneri 2a str. 301
gcggguaucuuuaaucgagaua

SEQ ID NO: 1979441 - RNA, 20 nt, Shigella flexneri 2a str. 301
gcgggugacuucccgcacgc

SEQ ID NO: 1979442 - RNA, 11 nt, Shigella flexneri 2a str. 301
gcggcggcaga

SEQ ID NO: 1979443 - RNA, 16 nt, Shigella flexneri 2a str. 301
gcggcgcuaauggcac

SEQ ID NO: 1979444 - RNA, 22 nt, Shigella flexneri 2a str. 301
gcggccgccagaaacagugacc

SEQ ID NO: 1979445 - RNA, 21 nt, Shigella flexneri 2a str. 301
gcggcguaucgacaaucacca

SEQ ID NO: 1979446 - RNA, 14 nt, Shigella flexneri 2a str. 301
gcggcuaucccaaa

SEQ ID NO: 1979447 - RNA, 19 nt, Shigella flexneri 2a str. 301
gcggcggguuaaccagcac

SEQ ID NO: 1979448 - RNA, 15 nt, Shigella flexneri 2a str. 301
gcggcggucuucuca

SEQ ID NO: 1979449 - RNA, 21 nt, Shigella flexneri 2a str. 301
gcgcgaucgcuaccuaaggaa

SEQ ID NO: 1979450 - RNA, 22 nt, Shigella flexneri 2a str. 301
gcgcgaucggcuucgcucggcu

SEQ ID NO: 1979451 - RNA, 15 nt, Shigella flexneri 2a str. 301
gcgcgccaagcccgu

SEQ ID NO: 1979452 - RNA, 15 nt, Shigella flexneri 2a str. 301
gcgcgcagugccggu

SEQ ID NO: 1979453 - RNA, 22 nt, Shigella flexneri 2a str. 301
gcgccuuuaauauuaacgccag

SEQ ID NO: 1979454 - RNA, 21 nt, Shigella flexneri 2a str. 301
gcgccuuuuuucgccgcagca

SEQ ID NO: 1979455 - RNA, 18 nt, Shigella flexneri 2a str. 301
gcgcgaaaacaacuggca

SEQ ID NO: 1979456 - RNA, 23 nt, Shigella flexneri 2a str. 301
gcgccuuuuguuuguucuucucg

SEQ ID NO: 1979457 - RNA, 19 nt, Shigella flexneri 2a str. 301
gcgcgaccaaugucagggc

SEQ ID NO: 1979458 - RNA, 13 nt, Shigella flexneri 2a str. 301
gcgcgaccaaugu

SEQ ID NO: 1979459 - RNA, 22 nt, Shigella flexneri 2a str. 301
gcgcgaccaucggaucggccau

SEQ ID NO: 1979460 - RNA, 13 nt, Shigella flexneri 2a str. 301
gcgcgaacagcac

SEQ ID NO: 1979461 - RNA, 21 nt, Shigella flexneri 2a str. 301
gcgccuucauucaggccaaag

SEQ ID NO: 1979462 - RNA, 23 nt, Shigella flexneri 2a str. 301
gcgccuucauucaggccaaagcc

SEQ ID NO: 1979463 - RNA, 14 nt, Shigella flexneri 2a str. 301
gcgccuucauucag

SEQ ID NO: 1979464 - RNA, 18 nt, Shigella flexneri 2a str. 301
gcgccuucuacagcuuca

SEQ ID NO: 1979465 - RNA, 13 nt, Shigella flexneri 2a str. 301
gcgcgccaggaga

SEQ ID NO: 1979466 - RNA, 15 nt, Shigella flexneri 2a str. 301
gcgcgcggcaggaag

SEQ ID NO: 1979467 - RNA, 16 nt, Shigella flexneri 2a str. 301
gcgcgcggcaggaagu

SEQ ID NO: 1979468 - RNA, 14 nt, Shigella flexneri 2a str. 301
gcgcgcgcagcacg

SEQ ID NO: 1979469 - RNA, 22 nt, Shigella flexneri 2a str. 301
gcgcggcaauuagcggcuggcu

SEQ ID NO: 1979470 - RNA, 16 nt, Shigella flexneri 2a str. 301
gcgcggcgcaggcgcu

SEQ ID NO: 1979471 - RNA, 22 nt, Shigella flexneri 2a str. 301
gcgccugcggccagcagcugua

SEQ ID NO: 1979472 - RNA, 21 nt, Shigella flexneri 2a str. 301
gcgccugucaccgccuccacc

SEQ ID NO: 1979473 - RNA, 23 nt, Shigella flexneri 2a str. 301
gcgccugucaccgccuccaccug

SEQ ID NO: 1979474 - RNA, 22 nt, Shigella flexneri 2a str. 301
gcgccgugucggugcucaucag

SEQ ID NO: 1979475 - RNA, 20 nt, Shigella flexneri 2a str. 301
gcgccgugcaacugcggcgc

SEQ ID NO: 1979476 - RNA, 23 nt, Shigella flexneri 2a str. 301
gcgccucccuuuuucaagcucaa

SEQ ID NO: 1979477 - RNA, 14 nt, Shigella flexneri 2a str. 301
gcgccgucuucccc

SEQ ID NO: 1979478 - RNA, 21 nt, Shigella flexneri 2a str. 301
gcgccgccucccuucgcugcu

SEQ ID NO: 1979479 - RNA, 22 nt, Shigella flexneri 2a str. 301
gcgccgcuuuuugugcggaagu

SEQ ID NO: 1979480 - RNA, 20 nt, Shigella flexneri 2a str. 301
gcgccgcaucguccugcgca

SEQ ID NO: 1979481 - RNA, 13 nt, Shigella flexneri 2a str. 301
gcgccgccaaccc

SEQ ID NO: 1979482 - RNA, 19 nt, Shigella flexneri 2a str. 301
gcgccgacugcgccaauac

SEQ ID NO: 1979483 - RNA, 23 nt, Shigella flexneri 2a str. 301
gcgccgagcaauaaaaacuccgc

SEQ ID NO: 1979484 - RNA, 13 nt, Shigella flexneri 2a str. 301
gcgcccuuucagc

SEQ ID NO: 1979485 - RNA, 12 nt, Shigella flexneri 2a str. 301
gcgcccuguucu

SEQ ID NO: 1979486 - RNA, 17 nt, Shigella flexneri 2a str. 301
gcgcccaacacuucccc

SEQ ID NO: 1979487 - RNA, 20 nt, Shigella flexneri 2a str. 301
gcgccauugauguaauuauc

SEQ ID NO: 1979488 - RNA, 13 nt, Shigella flexneri 2a str. 301
gcgccauuuucau

SEQ ID NO: 1979489 - RNA, 22 nt, Shigella flexneri 2a str. 301
gcgccaguugcuuauccagcac

SEQ ID NO: 1979490 - RNA, 18 nt, Shigella flexneri 2a str. 301
gcgccaguuuuuguuucu

SEQ ID NO: 1979491 - RNA, 21 nt, Shigella flexneri 2a str. 301
gcgccagguguuuaaccaaca

SEQ ID NO: 1979492 - RNA, 17 nt, Shigella flexneri 2a str. 301
gcgccagcugcauuuca

SEQ ID NO: 1979493 - RNA, 13 nt, Shigella flexneri 2a str. 301
gcgccaggcgcug

SEQ ID NO: 1979494 - RNA, 16 nt, Shigella flexneri 2a str. 301
gcgccccacaccacca

SEQ ID NO: 1979495 - RNA, 23 nt, Shigella flexneri 2a str. 301
gcgccccuggucauaggccgcug

SEQ ID NO: 1979496 - RNA, 13 nt, Shigella flexneri 2a str. 301
gcgcccaucggcg

SEQ ID NO: 1979497 - RNA, 21 nt, Shigella flexneri 2a str. 301
gcgcccgucugggcgcggcuc

SEQ ID NO: 1979498 - RNA, 21 nt, Shigella flexneri 2a str. 301
gcgcccggaaacgggcgcuga

SEQ ID NO: 1979499 - RNA, 19 nt, Shigella flexneri 2a str. 301
gcgcccgcuuuucgccagc

SEQ ID NO: 1979500 - RNA, 22 nt, Shigella flexneri 2a str. 301
gcgagaaacuucacaucaccau

SEQ ID NO: 1979501 - RNA, 14 nt, Shigella flexneri 2a str. 301
gcgagaagagaggc

SEQ ID NO: 1979502 - RNA, 19 nt, Shigella flexneri 2a str. 301
gcgacuauucacugcgccu

SEQ ID NO: 1979503 - RNA, 20 nt, Shigella flexneri 2a str. 301
gcgagccauaaacugagcca

SEQ ID NO: 1979504 - RNA, 16 nt, Shigella flexneri 2a str. 301
gcgagacugcgcgccg

SEQ ID NO: 1979505 - RNA, 16 nt, Shigella flexneri 2a str. 301
gcgaagggcugucggu

SEQ ID NO: 1979506 - RNA, 16 nt, Shigella flexneri 2a str. 301
gcgaauaaaaagccua

SEQ ID NO: 1979507 - RNA, 22 nt, Shigella flexneri 2a str. 301
gcgaagucguucagaucuuuca

SEQ ID NO: 1979508 - RNA, 15 nt, Shigella flexneri 2a str. 301
gcgaagcuggucagc

SEQ ID NO: 1979509 - RNA, 16 nt, Shigella flexneri 2a str. 301
gcgaaggcgcacugau

SEQ ID NO: 1979510 - RNA, 15 nt, Shigella flexneri 2a str. 301
gcgaaggccagaacc

SEQ ID NO: 1979511 - RNA, 22 nt, Shigella flexneri 2a str. 301
gcgacggcgaaucaaccgcgcc

SEQ ID NO: 1979512 - RNA, 15 nt, Shigella flexneri 2a str. 301
gcgacguugcuucuc

SEQ ID NO: 1979513 - RNA, 18 nt, Shigella flexneri 2a str. 301
gcgaguuuuucaguccac

SEQ ID NO: 1979514 - RNA, 21 nt, Shigella flexneri 2a str. 301
gcgauaaaaauccuguuccau

SEQ ID NO: 1979515 - RNA, 16 nt, Shigella flexneri 2a str. 301
gcgauaacgccccaau

SEQ ID NO: 1979516 - RNA, 13 nt, Shigella flexneri 2a str. 301
gcgauaaccgcac

SEQ ID NO: 1979517 - RNA, 17 nt, Shigella flexneri 2a str. 301
gcgauaaccgcaccuuc

SEQ ID NO: 1979518 - RNA, 23 nt, Shigella flexneri 2a str. 301
gcgagcuuucgaccagccaggcc

SEQ ID NO: 1979519 - RNA, 20 nt, Shigella flexneri 2a str. 301
gcgaucgucgcuccaugaga

SEQ ID NO: 1979520 - RNA, 22 nt, Shigella flexneri 2a str. 301
gcgauauguuuaucaggccacg

SEQ ID NO: 1979521 - RNA, 17 nt, Shigella flexneri 2a str. 301
gcgaugcccagugacca

SEQ ID NO: 1979522 - RNA, 14 nt, Shigella flexneri 2a str. 301
gcgaugccuggcaa

SEQ ID NO: 1979523 - RNA, 20 nt, Shigella flexneri 2a str. 301
gcgaugaugccaagccgaua

SEQ ID NO: 1979524 - RNA, 15 nt, Shigella flexneri 2a str. 301
gcgaugccaguaauc

SEQ ID NO: 1979525 - RNA, 19 nt, Shigella flexneri 2a str. 301
gcgaugacuguacagaucc

SEQ ID NO: 1979526 - RNA, 13 nt, Shigella flexneri 2a str. 301
gcgaugguggugg

SEQ ID NO: 1979527 - RNA, 20 nt, Shigella flexneri 2a str. 301
gcgauggguuaacaucaugu

SEQ ID NO: 1979528 - RNA, 20 nt, Shigella flexneri 2a str. 301
gcgauugcagauauggaaag

SEQ ID NO: 1979529 - RNA, 17 nt, Shigella flexneri 2a str. 301
gcgauugugacacgcgc

SEQ ID NO: 1979530 - RNA, 13 nt, Shigella flexneri 2a str. 301
gcgauuuccuuca

SEQ ID NO: 1979531 - RNA, 20 nt, Shigella flexneri 2a str. 301
gcgauugugacacgcgcgca

SEQ ID NO: 1979532 - RNA, 21 nt, Shigella flexneri 2a str. 301
gcgcaaauccacguuccagau

SEQ ID NO: 1979533 - RNA, 13 nt, Shigella flexneri 2a str. 301
gcgcaaagaaacg

SEQ ID NO: 1979534 - RNA, 19 nt, Shigella flexneri 2a str. 301
gcgauguucaauaaaagca

SEQ ID NO: 1979535 - RNA, 21 nt, Shigella flexneri 2a str. 301
gcgauuaauaaaauuauccag

SEQ ID NO: 1979536 - RNA, 22 nt, Shigella flexneri 2a str. 301
gcgauucauaugcgccagcugc

SEQ ID NO: 1979537 - RNA, 18 nt, Shigella flexneri 2a str. 301
gcgauucauaugcgccag

SEQ ID NO: 1979538 - RNA, 19 nt, Shigella flexneri 2a str. 301
gcgauucauaugcgccagc

SEQ ID NO: 1979539 - RNA, 15 nt, Shigella flexneri 2a str. 301
gcgauucggcuccgu

SEQ ID NO: 1979540 - RNA, 21 nt, Shigella flexneri 2a str. 301
gcgauucguugguaaugacuc

SEQ ID NO: 1979541 - RNA, 17 nt, Shigella flexneri 2a str. 301
gcgcaagggccgcagcu

SEQ ID NO: 1979542 - RNA, 19 nt, Shigella flexneri 2a str. 301
gcgcaaugccauccagcuu

SEQ ID NO: 1979543 - RNA, 16 nt, Shigella flexneri 2a str. 301
gcgcaaucgcccagcg

SEQ ID NO: 1979544 - RNA, 13 nt, Shigella flexneri 2a str. 301
gcgcaaucgccag

SEQ ID NO: 1979545 - RNA, 22 nt, Shigella flexneri 2a str. 301
gcgcaauaccgauaucgccauu

SEQ ID NO: 1979546 - RNA, 12 nt, Shigella flexneri 2a str. 301
gcgcaauaauca

SEQ ID NO: 1979547 - RNA, 16 nt, Shigella flexneri 2a str. 301
gcgcaacuugcagauc

SEQ ID NO: 1979548 - RNA, 15 nt, Shigella flexneri 2a str. 301
gcgcaacgcuuuccc

SEQ ID NO: 1979549 - RNA, 22 nt, Shigella flexneri 2a str. 301
gcgcaacauauuccgcaccugc

SEQ ID NO: 1979550 - RNA, 17 nt, Shigella flexneri 2a str. 301
gcgcaaaggccagcaau

SEQ ID NO: 1979551 - RNA, 13 nt, Shigella flexneri 2a str. 301
gcgcacaggcugc

SEQ ID NO: 1979552 - RNA, 24 nt, Shigella flexneri 2a str. 301
gcgcaauggcuggccccgucagca

SEQ ID NO: 1979553 - RNA, 17 nt, Shigella flexneri 2a str. 301
gcgcaauucgcgucggc

SEQ ID NO: 1979554 - RNA, 18 nt, Shigella flexneri 2a str. 301
gcgcacacacgcccagcu

SEQ ID NO: 1979555 - RNA, 19 nt, Shigella flexneri 2a str. 301
gcgcaguucgcacaccgcu

SEQ ID NO: 1979556 - RNA, 20 nt, Shigella flexneri 2a str. 301
gcgcaguucacgccagaagc

SEQ ID NO: 1979557 - RNA, 19 nt, Shigella flexneri 2a str. 301
gcgcagugccuucugguga

SEQ ID NO: 1979558 - RNA, 20 nt, Shigella flexneri 2a str. 301
gcgcagucuggcggcuauuc

SEQ ID NO: 1979559 - RNA, 22 nt, Shigella flexneri 2a str. 301
gcgcagugugguuuucgcggcg

SEQ ID NO: 1979560 - RNA, 17 nt, Shigella flexneri 2a str. 301
gcgcagucaccagcauc

SEQ ID NO: 1979561 - RNA, 13 nt, Shigella flexneri 2a str. 301
gcgcagucaccag

SEQ ID NO: 1979562 - RNA, 20 nt, Shigella flexneri 2a str. 301
gcgcaggguuugcaucgcca

SEQ ID NO: 1979563 - RNA, 21 nt, Shigella flexneri 2a str. 301
gcgcaggguuugcaucgccau

SEQ ID NO: 1979564 - RNA, 15 nt, Shigella flexneri 2a str. 301
gcgcagcggugagcc

SEQ ID NO: 1979565 - RNA, 21 nt, Shigella flexneri 2a str. 301
gcgcaggaugcuaagcgcggu

SEQ ID NO: 1979566 - RNA, 19 nt, Shigella flexneri 2a str. 301
gcgcagaguuuccaggcug

SEQ ID NO: 1979567 - RNA, 22 nt, Shigella flexneri 2a str. 301
gcgcagcaagucggcaucgcca

SEQ ID NO: 1979568 - RNA, 17 nt, Shigella flexneri 2a str. 301
gcgcacugucgccgcgg

SEQ ID NO: 1979569 - RNA, 23 nt, Shigella flexneri 2a str. 301
gcgcacguacaucccgcgaacga

SEQ ID NO: 1979570 - RNA, 23 nt, Shigella flexneri 2a str. 301
gcgcaccggccccugaucggcca

SEQ ID NO: 1979571 - RNA, 16 nt, Shigella flexneri 2a str. 301
gcgccagacaaaccac

SEQ ID NO: 1979572 - RNA, 15 nt, Shigella flexneri 2a str. 301
gcgccagaagggaca

SEQ ID NO: 1979573 - RNA, 17 nt, Shigella flexneri 2a str. 301
gcgccacgguguuguug

SEQ ID NO: 1979574 - RNA, 15 nt, Shigella flexneri 2a str. 301
gcgccaccaccagca

SEQ ID NO: 1979575 - RNA, 14 nt, Shigella flexneri 2a str. 301
gcgccaccacccug

SEQ ID NO: 1979576 - RNA, 11 nt, Shigella flexneri 2a str. 301
gcgccaccagc

SEQ ID NO: 1979577 - RNA, 24 nt, Shigella flexneri 2a str. 301
gcgccacauaagaucaucggccag

SEQ ID NO: 1979578 - RNA, 15 nt, Shigella flexneri 2a str. 301
gcgccacaggucagc

SEQ ID NO: 1979579 - RNA, 19 nt, Shigella flexneri 2a str. 301
gcgccaccucuuucaccaa

SEQ ID NO: 1979580 - RNA, 21 nt, Shigella flexneri 2a str. 301
gcgccagcgggcuccacggaa

SEQ ID NO: 1979581 - RNA, 13 nt, Shigella flexneri 2a str. 301
gcgccagcgcgga

SEQ ID NO: 1979582 - RNA, 19 nt, Shigella flexneri 2a str. 301
gcgccagcaagagcaaaua

SEQ ID NO: 1979583 - RNA, 13 nt, Shigella flexneri 2a str. 301
gcgccagauggca

SEQ ID NO: 1979584 - RNA, 11 nt, Shigella flexneri 2a str. 301
gcgccagcaag

SEQ ID NO: 1979585 - RNA, 17 nt, Shigella flexneri 2a str. 301
gcgccagccaccacaau

SEQ ID NO: 1979586 - RNA, 21 nt, Shigella flexneri 2a str. 301
gcgccagccaguuuacccagc

SEQ ID NO: 1979587 - RNA, 13 nt, Shigella flexneri 2a str. 301
gcgccagccagcc

SEQ ID NO: 1979588 - RNA, 21 nt, Shigella flexneri 2a str. 301
gcgccaaucagcgcagcaccc

SEQ ID NO: 1979589 - RNA, 17 nt, Shigella flexneri 2a str. 301
gcgccaagauagaacca

SEQ ID NO: 1979590 - RNA, 19 nt, Shigella flexneri 2a str. 301
gcgccaagcagcgcgcaga

SEQ ID NO: 1979591 - RNA, 15 nt, Shigella flexneri 2a str. 301
gcgccaaaugucagc

SEQ ID NO: 1979592 - RNA, 19 nt, Shigella flexneri 2a str. 301
gcgcauuucccagcaagaa

SEQ ID NO: 1979593 - RNA, 22 nt, Shigella flexneri 2a str. 301
gcgcauuucccagcaagaacca

SEQ ID NO: 1979594 - RNA, 16 nt, Shigella flexneri 2a str. 301
gcgcauuucccagcaa

SEQ ID NO: 1979595 - RNA, 19 nt, Shigella flexneri 2a str. 301
gcgcauuacgcucacugca

SEQ ID NO: 1979596 - RNA, 17 nt, Shigella flexneri 2a str. 301
gcgcauguuggcgcggu

SEQ ID NO: 1979597 - RNA, 14 nt, Shigella flexneri 2a str. 301
gcgcaucagcuccg

SEQ ID NO: 1979598 - RNA, 15 nt, Shigella flexneri 2a str. 301
gcgcaucagcuccgg

SEQ ID NO: 1979599 - RNA, 13 nt, Shigella flexneri 2a str. 301
gcgcaucaaagcc

SEQ ID NO: 1979600 - RNA, 14 nt, Shigella flexneri 2a str. 301
gcgcaucaggcaau

SEQ ID NO: 1979601 - RNA, 19 nt, Shigella flexneri 2a str. 301
gcgcaucaggcaaugcuuc

SEQ ID NO: 1979602 - RNA, 19 nt, Shigella flexneri 2a str. 301
gcgcauccaguuccuucaa

SEQ ID NO: 1979603 - RNA, 17 nt, Shigella flexneri 2a str. 301
gcgcaucccauuucucc

SEQ ID NO: 1979604 - RNA, 16 nt, Shigella flexneri 2a str. 301
gcgcauccgacuuauc

SEQ ID NO: 1979605 - RNA, 12 nt, Shigella flexneri 2a str. 301
gcgcauauugcc

SEQ ID NO: 1979606 - RNA, 12 nt, Shigella flexneri 2a str. 301
gcgcauccggca

SEQ ID NO: 1979607 - RNA, 19 nt, Shigella flexneri 2a str. 301
gcgcaucggucagacccag

SEQ ID NO: 1979608 - RNA, 16 nt, Shigella flexneri 2a str. 301
gccguauguucucugg

SEQ ID NO: 1979609 - RNA, 20 nt, Shigella flexneri 2a str. 301
gccggaacguuaagagcugg

SEQ ID NO: 1979610 - RNA, 18 nt, Shigella flexneri 2a str. 301
gccguauaauaucuuuuc

SEQ ID NO: 1979611 - RNA, 18 nt, Shigella flexneri 2a str. 301
gccggaaauuugcagugc

SEQ ID NO: 1979612 - RNA, 20 nt, Shigella flexneri 2a str. 301
gccggaaauaucaaccggcu

SEQ ID NO: 1979613 - RNA, 22 nt, Shigella flexneri 2a str. 301
gccgcuuuaugugcuucuacca

SEQ ID NO: 1979614 - RNA, 15 nt, Shigella flexneri 2a str. 301
gccgcuuuccaggca

SEQ ID NO: 1979615 - RNA, 16 nt, Shigella flexneri 2a str. 301
gccgcuuuccaggcau

SEQ ID NO: 1979616 - RNA, 22 nt, Shigella flexneri 2a str. 301
gccggaaacauaaauaguggca

SEQ ID NO: 1979617 - RNA, 20 nt, Shigella flexneri 2a str. 301
gccgcuuuuucugcgcacac

SEQ ID NO: 1979618 - RNA, 13 nt, Shigella flexneri 2a str. 301
gccgcuuuuucug

SEQ ID NO: 1979619 - RNA, 18 nt, Shigella flexneri 2a str. 301
gccgcuucuggcggcggc

SEQ ID NO: 1979620 - RNA, 17 nt, Shigella flexneri 2a str. 301
gccgucugccccgccgc

SEQ ID NO: 1979621 - RNA, 20 nt, Shigella flexneri 2a str. 301
gccguccugcguuucuucua

SEQ ID NO: 1979622 - RNA, 16 nt, Shigella flexneri 2a str. 301
gccguuuaccgccauc

SEQ ID NO: 1979623 - RNA, 12 nt, Shigella flexneri 2a str. 301
gccguuguucuc

SEQ ID NO: 1979624 - RNA, 14 nt, Shigella flexneri 2a str. 301
gccguuuucaaagg

SEQ ID NO: 1979625 - RNA, 20 nt, Shigella flexneri 2a str. 301
gccuacaacuccguugaaau

SEQ ID NO: 1979626 - RNA, 19 nt, Shigella flexneri 2a str. 301
gccuaauuacauaacacua

SEQ ID NO: 1979627 - RNA, 17 nt, Shigella flexneri 2a str. 301
gccuacaaaaucuauug

SEQ ID NO: 1979628 - RNA, 12 nt, Shigella flexneri 2a str. 301
gccuacaggauu

SEQ ID NO: 1979629 - RNA, 21 nt, Shigella flexneri 2a str. 301
gccuacacauuaucucaacac

SEQ ID NO: 1979630 - RNA, 13 nt, Shigella flexneri 2a str. 301
gccuagaugcuca

SEQ ID NO: 1979631 - RNA, 14 nt, Shigella flexneri 2a str. 301
gccuacagaugauu

SEQ ID NO: 1979632 - RNA, 13 nt, Shigella flexneri 2a str. 301
gccguuagcuuca

SEQ ID NO: 1979633 - RNA, 20 nt, Shigella flexneri 2a str. 301
gccguuaccuucggccccau

SEQ ID NO: 1979634 - RNA, 22 nt, Shigella flexneri 2a str. 301
gccguuaccguaccaaccgcaa

SEQ ID NO: 1979635 - RNA, 13 nt, Shigella flexneri 2a str. 301
gccgugaauuacu

SEQ ID NO: 1979636 - RNA, 15 nt, Shigella flexneri 2a str. 301
gccgugacugggugc

SEQ ID NO: 1979637 - RNA, 15 nt, Shigella flexneri 2a str. 301
gccucccuucgcugc

SEQ ID NO: 1979638 - RNA, 14 nt, Shigella flexneri 2a str. 301
gccucccugccucc

SEQ ID NO: 1979639 - RNA, 17 nt, Shigella flexneri 2a str. 301
gccucagguaccagcau

SEQ ID NO: 1979640 - RNA, 18 nt, Shigella flexneri 2a str. 301
gccuaguccguaggcagg

SEQ ID NO: 1979641 - RNA, 18 nt, Shigella flexneri 2a str. 301
gccuauccagaagccugc

SEQ ID NO: 1979642 - RNA, 14 nt, Shigella flexneri 2a str. 301
gccucaugcaggcg

SEQ ID NO: 1979643 - RNA, 12 nt, Shigella flexneri 2a str. 301
gccucaucaucg

SEQ ID NO: 1979644 - RNA, 17 nt, Shigella flexneri 2a str. 301
gccucgccgaaacgcuu

SEQ ID NO: 1979645 - RNA, 16 nt, Shigella flexneri 2a str. 301
gccucgcuacgccagc

SEQ ID NO: 1979646 - RNA, 18 nt, Shigella flexneri 2a str. 301
gccucgcguccgcguccg

SEQ ID NO: 1979647 - RNA, 18 nt, Shigella flexneri 2a str. 301
gccucgggcuuugcuaca

SEQ ID NO: 1979648 - RNA, 15 nt, Shigella flexneri 2a str. 301
gccucguucuucccu

SEQ ID NO: 1979649 - RNA, 19 nt, Shigella flexneri 2a str. 301
gccucgcuggucagcgcca

SEQ ID NO: 1979650 - RNA, 13 nt, Shigella flexneri 2a str. 301
gccucugccagcu

SEQ ID NO: 1979651 - RNA, 19 nt, Shigella flexneri 2a str. 301
gccucucaaaccccgccac

SEQ ID NO: 1979652 - RNA, 16 nt, Shigella flexneri 2a str. 301
gccucuuacgccgcca

SEQ ID NO: 1979653 - RNA, 17 nt, Shigella flexneri 2a str. 301
gccucuuacgccgccac

SEQ ID NO: 1979654 - RNA, 14 nt, Shigella flexneri 2a str. 301
gccugccgccagca

SEQ ID NO: 1979655 - RNA, 22 nt, Shigella flexneri 2a str. 301
gccugcugauaagacgcaucca

SEQ ID NO: 1979656 - RNA, 15 nt, Shigella flexneri 2a str. 301
gccugcuggccccau

SEQ ID NO: 1979657 - RNA, 18 nt, Shigella flexneri 2a str. 301
gccuggcccauagacagg

SEQ ID NO: 1979658 - RNA, 19 nt, Shigella flexneri 2a str. 301
gccuucacaggccgccagg

SEQ ID NO: 1979659 - RNA, 18 nt, Shigella flexneri 2a str. 301
gccuucacaggccgccag

SEQ ID NO: 1979660 - RNA, 23 nt, Shigella flexneri 2a str. 301
gccuuauugccugugacuuucug

SEQ ID NO: 1979661 - RNA, 13 nt, Shigella flexneri 2a str. 301
gccuuaaaaacca

SEQ ID NO: 1979662 - RNA, 16 nt, Shigella flexneri 2a str. 301
gccuguccggaauacu

SEQ ID NO: 1979663 - RNA, 17 nt, Shigella flexneri 2a str. 301
gccuguauuccuggccg

SEQ ID NO: 1979664 - RNA, 16 nt, Shigella flexneri 2a str. 301
gccuguccacacccag

SEQ ID NO: 1979665 - RNA, 17 nt, Shigella flexneri 2a str. 301
gccuggcugcauggcaa

SEQ ID NO: 1979666 - RNA, 13 nt, Shigella flexneri 2a str. 301
gccugggcgaggu

SEQ ID NO: 1979667 - RNA, 19 nt, Shigella flexneri 2a str. 301
gccugggcgauuuccuuca

SEQ ID NO: 1979668 - RNA, 15 nt, Shigella flexneri 2a str. 301
gccuggggagauguu

SEQ ID NO: 1979669 - RNA, 17 nt, Shigella flexneri 2a str. 301
gccuggguuuucacaga

SEQ ID NO: 1979670 - RNA, 16 nt, Shigella flexneri 2a str. 301
gccugguaccagcacc

SEQ ID NO: 1979671 - RNA, 14 nt, Shigella flexneri 2a str. 301
gcgaaauugguaga

SEQ ID NO: 1979672 - RNA, 17 nt, Shigella flexneri 2a str. 301
gcgaaacgguguaaaaa

SEQ ID NO: 1979673 - RNA, 11 nt, Shigella flexneri 2a str. 301
gcgaaagaaaa

SEQ ID NO: 1979674 - RNA, 18 nt, Shigella flexneri 2a str. 301
gccuuuuccuuucagagu

SEQ ID NO: 1979675 - RNA, 17 nt, Shigella flexneri 2a str. 301
gcgaagaaagcggguga

SEQ ID NO: 1979676 - RNA, 17 nt, Shigella flexneri 2a str. 301
gcgaacuguugagagua

SEQ ID NO: 1979677 - RNA, 14 nt, Shigella flexneri 2a str. 301
gcgaacuaaacaac

SEQ ID NO: 1979678 - RNA, 13 nt, Shigella flexneri 2a str. 301
gcgaacuaaacaa

SEQ ID NO: 1979679 - RNA, 22 nt, Shigella flexneri 2a str. 301
gcgaagauacccgcgaggcgca

SEQ ID NO: 1979680 - RNA, 22 nt, Shigella flexneri 2a str. 301
gcgaacaucgagugcggcgagc

SEQ ID NO: 1979681 - RNA, 17 nt, Shigella flexneri 2a str. 301
gcgaaccgcugucaccc

SEQ ID NO: 1979682 - RNA, 15 nt, Shigella flexneri 2a str. 301
gcgaacgggauaaac

SEQ ID NO: 1979683 - RNA, 23 nt, Shigella flexneri 2a str. 301
gcgaacggcgcgguuuccaccuu

SEQ ID NO: 1979684 - RNA, 21 nt, Shigella flexneri 2a str. 301
gccuuuauuaaugacauucag

SEQ ID NO: 1979685 - RNA, 21 nt, Shigella flexneri 2a str. 301
gccuuuucaguuggcugacaa

SEQ ID NO: 1979686 - RNA, 21 nt, Shigella flexneri 2a str. 301
gccuuuuaaugcgcuuccugc

SEQ ID NO: 1979687 - RNA, 22 nt, Shigella flexneri 2a str. 301
gccuuucuuaauauuuuccgug

SEQ ID NO: 1979688 - RNA, 22 nt, Shigella flexneri 2a str. 301
gccuuugaaaauaacaucgcca

SEQ ID NO: 1979689 - RNA, 13 nt, Shigella flexneri 2a str. 301
gccuuucucagaa

SEQ ID NO: 1979690 - RNA, 23 nt, Shigella flexneri 2a str. 301
gccuuuccuccugucuucccugc

SEQ ID NO: 1979691 - RNA, 19 nt, Shigella flexneri 2a str. 301
gccuucggcgucuccaccu

SEQ ID NO: 1979692 - RNA, 12 nt, Shigella flexneri 2a str. 301
gccuucaggaau

SEQ ID NO: 1979693 - RNA, 15 nt, Shigella flexneri 2a str. 301
gccuucacuuccggc

SEQ ID NO: 1979694 - RNA, 18 nt, Shigella flexneri 2a str. 301
gccuucacggcuuuguca

SEQ ID NO: 1979695 - RNA, 19 nt, Shigella flexneri 2a str. 301
gccuucgugcggcugcauc

SEQ ID NO: 1979696 - RNA, 17 nt, Shigella flexneri 2a str. 301
ggcgcgaaccaucaccu

SEQ ID NO: 1979697 - RNA, 14 nt, Shigella flexneri 2a str. 301
ggcgcgaaacauca

SEQ ID NO: 1979698 - RNA, 20 nt, Shigella flexneri 2a str. 301
aaauacgcuggcugaacauu

SEQ ID NO: 1979699 - RNA, 14 nt, Shigella flexneri 2a str. 301
aaauaccguucauu

SEQ ID NO: 1979700 - RNA, 19 nt, Shigella flexneri 2a str. 301
ggcgcggaaagcaccugcg

SEQ ID NO: 1979701 - RNA, 15 nt, Shigella flexneri 2a str. 301
ggcgcgucagauuga

SEQ ID NO: 1979702 - RNA, 20 nt, Shigella flexneri 2a str. 301
ggcggcaguauagcggcaug

SEQ ID NO: 1979703 - RNA, 14 nt, Shigella flexneri 2a str. 301
ggcggcacagccag

SEQ ID NO: 1979704 - RNA, 15 nt, Shigella flexneri 2a str. 301
ggcggcacagccagc

SEQ ID NO: 1979705 - RNA, 14 nt, Shigella flexneri 2a str. 301
ggcggcaaugaaag

SEQ ID NO: 1979706 - RNA, 19 nt, Shigella flexneri 2a str. 301
ggcggauaauaauauccuu

SEQ ID NO: 1979707 - RNA, 18 nt, Shigella flexneri 2a str. 301
ggcgggcaagcggcggca

SEQ ID NO: 1979708 - RNA, 21 nt, Shigella flexneri 2a str. 301
ggcgggaucaccugcacaugc

SEQ ID NO: 1979709 - RNA, 22 nt, Shigella flexneri 2a str. 301
ggcgggaucaccugcacaugca

SEQ ID NO: 1979710 - RNA, 19 nt, Shigella flexneri 2a str. 301
ggcgguuaccuuggcacug

SEQ ID NO: 1979711 - RNA, 17 nt, Shigella flexneri 2a str. 301
ggcgguuaauaaugauu

SEQ ID NO: 1979712 - RNA, 22 nt, Shigella flexneri 2a str. 301
ggcggguuaaccagcaccagcu

SEQ ID NO: 1979713 - RNA, 23 nt, Shigella flexneri 2a str. 301
ggcgggcuuuuuuugccccagaa

SEQ ID NO: 1979714 - RNA, 18 nt, Shigella flexneri 2a str. 301
aaauacauuaguaauuuc

SEQ ID NO: 1979715 - RNA, 17 nt, Shigella flexneri 2a str. 301
aaauacccaaaaaauag

SEQ ID NO: 1979716 - RNA, 22 nt, Shigella flexneri 2a str. 301
aaauacccaaaaaauagcaaag

SEQ ID NO: 1979717 - RNA, 22 nt, Shigella flexneri 2a str. 301
aaauaccccgccagcagaauga

SEQ ID NO: 1979718 - RNA, 11 nt, Shigella flexneri 2a str. 301
aaauacaugac

SEQ ID NO: 1979719 - RNA, 23 nt, Shigella flexneri 2a str. 301
ggcgcacguucugucgcucugcu

SEQ ID NO: 1979720 - RNA, 17 nt, Shigella flexneri 2a str. 301
ggcgcaccaguucgccg

SEQ ID NO: 1979721 - RNA, 17 nt, Shigella flexneri 2a str. 301
ggcgauuuuugauaauu

SEQ ID NO: 1979722 - RNA, 19 nt, Shigella flexneri 2a str. 301
ggcgaugcacaugcuucag

SEQ ID NO: 1979723 - RNA, 15 nt, Shigella flexneri 2a str. 301
ggcgauguucugguc

SEQ ID NO: 1979724 - RNA, 13 nt, Shigella flexneri 2a str. 301
ggcgauaccagua

SEQ ID NO: 1979725 - RNA, 12 nt, Shigella flexneri 2a str. 301
aaauaauuuuaa

SEQ ID NO: 1979726 - RNA, 13 nt, Shigella flexneri 2a str. 301
aaauaauuuuaaa

SEQ ID NO: 1979727 - RNA, 18 nt, Shigella flexneri 2a str. 301
ggcgauaaucagcgccag

SEQ ID NO: 1979728 - RNA, 23 nt, Shigella flexneri 2a str. 301
aaauaaugcgacaacagaaauaa

SEQ ID NO: 1979729 - RNA, 22 nt, Shigella flexneri 2a str. 301
aaauaaucgcauucaggaccuc

SEQ ID NO: 1979730 - RNA, 21 nt, Shigella flexneri 2a str. 301
aaauaaucccgcgcaacaaau

SEQ ID NO: 1979731 - RNA, 12 nt, Shigella flexneri 2a str. 301
aaauaauauccc

SEQ ID NO: 1979732 - RNA, 12 nt, Shigella flexneri 2a str. 301
aaauaaucaaau

SEQ ID NO: 1979733 - RNA, 22 nt, Shigella flexneri 2a str. 301
aaauaagcgacguuguuuucau

SEQ ID NO: 1979734 - RNA, 13 nt, Shigella flexneri 2a str. 301
ggcgacagcgaaa

SEQ ID NO: 1979735 - RNA, 17 nt, Shigella flexneri 2a str. 301
ggccuuuuccuuucaga

SEQ ID NO: 1979736 - RNA, 23 nt, Shigella flexneri 2a str. 301
ggcgaaagcagaaaaagaagccg

SEQ ID NO: 1979737 - RNA, 16 nt, Shigella flexneri 2a str. 301
ggccgacagcaggcuc

SEQ ID NO: 1979738 - RNA, 14 nt, Shigella flexneri 2a str. 301
ggccgacagcaggc

SEQ ID NO: 1979739 - RNA, 16 nt, Shigella flexneri 2a str. 301
ggcgagcgccagcaug

SEQ ID NO: 1979740 - RNA, 11 nt, Shigella flexneri 2a str. 301
ggcgagcgcca

SEQ ID NO: 1979741 - RNA, 19 nt, Shigella flexneri 2a str. 301
ggcgagcaacgcagcggcg

SEQ ID NO: 1979742 - RNA, 21 nt, Shigella flexneri 2a str. 301
ggcgagauccggaucccacca

SEQ ID NO: 1979743 - RNA, 22 nt, Shigella flexneri 2a str. 301
ggcgagaacgacauggcccagc

SEQ ID NO: 1979744 - RNA, 17 nt, Shigella flexneri 2a str. 301
ggcgagacugcgcgccg

SEQ ID NO: 1979745 - RNA, 21 nt, Shigella flexneri 2a str. 301
ggcgagacugcgcgccgccgc

SEQ ID NO: 1979746 - RNA, 22 nt, Shigella flexneri 2a str. 301
ggcgagacgccgauugacugga

SEQ ID NO: 1979747 - RNA, 20 nt, Shigella flexneri 2a str. 301
aaauaacgccccggcaaaac

SEQ ID NO: 1979748 - RNA, 16 nt, Shigella flexneri 2a str. 301
aaauaacguaaaaacc

SEQ ID NO: 1979749 - RNA, 19 nt, Shigella flexneri 2a str. 301
aaauaacaucccuuaacac

SEQ ID NO: 1979750 - RNA, 10 nt, Shigella flexneri 2a str. 301
ggcugccgcc

SEQ ID NO: 1979751 - RNA, 13 nt, Shigella flexneri 2a str. 301
ggcugccaugguu

SEQ ID NO: 1979752 - RNA, 14 nt, Shigella flexneri 2a str. 301
ggcugccagcucuc

SEQ ID NO: 1979753 - RNA, 13 nt, Shigella flexneri 2a str. 301
ggcugccagcucu

SEQ ID NO: 1979754 - RNA, 24 nt, Shigella flexneri 2a str. 301
ggcugccagaucaucguuuccgau

SEQ ID NO: 1979755 - RNA, 10 nt, Shigella flexneri 2a str. 301
ggcugcagca

SEQ ID NO: 1979756 - RNA, 10 nt, Shigella flexneri 2a str. 301
ggcugacugu

SEQ ID NO: 1979757 - RNA, 14 nt, Shigella flexneri 2a str. 301
ggcugacaaaucag

SEQ ID NO: 1979758 - RNA, 21 nt, Shigella flexneri 2a str. 301
ggcugaccccaaccgcccugc

SEQ ID NO: 1979759 - RNA, 14 nt, Shigella flexneri 2a str. 301
ggcucuuuaaacag

SEQ ID NO: 1979760 - RNA, 22 nt, Shigella flexneri 2a str. 301
ggcugaacgacaaauucaggaa

SEQ ID NO: 1979761 - RNA, 14 nt, Shigella flexneri 2a str. 301
ggcugaacgugcuc

SEQ ID NO: 1979762 - RNA, 13 nt, Shigella flexneri 2a str. 301
ggcugaagaagua

SEQ ID NO: 1979763 - RNA, 23 nt, Shigella flexneri 2a str. 301
ggcugagauuuaugacaaacgca

SEQ ID NO: 1979764 - RNA, 20 nt, Shigella flexneri 2a str. 301
ggcugagcaaacaguucugc

SEQ ID NO: 1979765 - RNA, 18 nt, Shigella flexneri 2a str. 301
ggcguagugcccgcagua

SEQ ID NO: 1979766 - RNA, 23 nt, Shigella flexneri 2a str. 301
ggcgucaacaacacucucugaag

SEQ ID NO: 1979767 - RNA, 20 nt, Shigella flexneri 2a str. 301
ggcucauccccugaugcugu

SEQ ID NO: 1979768 - RNA, 17 nt, Shigella flexneri 2a str. 301
ggcuccaacggcccgcu

SEQ ID NO: 1979769 - RNA, 22 nt, Shigella flexneri 2a str. 301
ggcucuuaagcaccgacguuga

SEQ ID NO: 1979770 - RNA, 19 nt, Shigella flexneri 2a str. 301
ggcucugguguucuuuuac

SEQ ID NO: 1979771 - RNA, 14 nt, Shigella flexneri 2a str. 301
ggcucugcggcgga

SEQ ID NO: 1979772 - RNA, 18 nt, Shigella flexneri 2a str. 301
ggcucgccauccagugaa

SEQ ID NO: 1979773 - RNA, 21 nt, Shigella flexneri 2a str. 301
ggcucggagagaaaagcaaaa

SEQ ID NO: 1979774 - RNA, 12 nt, Shigella flexneri 2a str. 301
ggcuugccgggc

SEQ ID NO: 1979775 - RNA, 15 nt, Shigella flexneri 2a str. 301
ggcuugccagcaggg

SEQ ID NO: 1979776 - RNA, 21 nt, Shigella flexneri 2a str. 301
ggcuucugccuuauccagcag

SEQ ID NO: 1979777 - RNA, 16 nt, Shigella flexneri 2a str. 301
ggcuucugccuuaucc

SEQ ID NO: 1979778 - RNA, 12 nt, Shigella flexneri 2a str. 301
ggcuucucgccu

SEQ ID NO: 1979779 - RNA, 16 nt, Shigella flexneri 2a str. 301
ggcuucggcguccagu

SEQ ID NO: 1979780 - RNA, 12 nt, Shigella flexneri 2a str. 301
ggcuucaaagca

SEQ ID NO: 1979781 - RNA, 22 nt, Shigella flexneri 2a str. 301
ggcuucgccaaaucgcugcugc

SEQ ID NO: 1979782 - RNA, 13 nt, Shigella flexneri 2a str. 301
ggcuucgacgcuc

SEQ ID NO: 1979783 - RNA, 17 nt, Shigella flexneri 2a str. 301
ggcuguuuucagcacca

SEQ ID NO: 1979784 - RNA, 15 nt, Shigella flexneri 2a str. 301
ggcuguuucuggaug

SEQ ID NO: 1979785 - RNA, 18 nt, Shigella flexneri 2a str. 301
ggcuuaaacgcagagaca

SEQ ID NO: 1979786 - RNA, 20 nt, Shigella flexneri 2a str. 301
ggcuguuucaggaacaccgc

SEQ ID NO: 1979787 - RNA, 19 nt, Shigella flexneri 2a str. 301
ggcuguucacugugcuggu

SEQ ID NO: 1979788 - RNA, 19 nt, Shigella flexneri 2a str. 301
ggcugugguacugccggcg

SEQ ID NO: 1979789 - RNA, 13 nt, Shigella flexneri 2a str. 301
ggcuuaauugccc

SEQ ID NO: 1979790 - RNA, 18 nt, Shigella flexneri 2a str. 301
ggcugguuacucaccagc

SEQ ID NO: 1979791 - RNA, 21 nt, Shigella flexneri 2a str. 301
ggcuguagaagcugacgacga

SEQ ID NO: 1979792 - RNA, 19 nt, Shigella flexneri 2a str. 301
ggcugugcccguaaaaaau

SEQ ID NO: 1979793 - RNA, 20 nt, Shigella flexneri 2a str. 301
ggcugugggucaccguacug

SEQ ID NO: 1979794 - RNA, 15 nt, Shigella flexneri 2a str. 301
ggcuggcgcauacca

SEQ ID NO: 1979795 - RNA, 20 nt, Shigella flexneri 2a str. 301
ggcuggcgaagcccagaaug

SEQ ID NO: 1979796 - RNA, 16 nt, Shigella flexneri 2a str. 301
ggcuggccacaaaccu

SEQ ID NO: 1979797 - RNA, 19 nt, Shigella flexneri 2a str. 301
ggcuggccccgucagcaaa

SEQ ID NO: 1979798 - RNA, 14 nt, Shigella flexneri 2a str. 301
ggcuggaucagacg

SEQ ID NO: 1979799 - RNA, 16 nt, Shigella flexneri 2a str. 301
ggcuggaucagacgca

SEQ ID NO: 1979800 - RNA, 15 nt, Shigella flexneri 2a str. 301
ggcugcuauccaguu

SEQ ID NO: 1979801 - RNA, 18 nt, Shigella flexneri 2a str. 301
ggcuggaagcuggauuaa

SEQ ID NO: 1979802 - RNA, 20 nt, Shigella flexneri 2a str. 301
ggcugcugauguucgccaga

SEQ ID NO: 1979803 - RNA, 18 nt, Shigella flexneri 2a str. 301
gggcagcaucgccaggau

SEQ ID NO: 1979804 - RNA, 18 nt, Shigella flexneri 2a str. 301
gggcaggggcuucuuccg

SEQ ID NO: 1979805 - RNA, 19 nt, Shigella flexneri 2a str. 301
gggcaagaauaucugcucc

SEQ ID NO: 1979806 - RNA, 21 nt, Shigella flexneri 2a str. 301
gggcaaugcgggugcaaucaa

SEQ ID NO: 1979807 - RNA, 22 nt, Shigella flexneri 2a str. 301
gggcaccacgccggaugaaauc

SEQ ID NO: 1979808 - RNA, 22 nt, Shigella flexneri 2a str. 301
gggcacguucggcggaugcagg

SEQ ID NO: 1979809 - RNA, 16 nt, Shigella flexneri 2a str. 301
gggcaacuggagcagg

SEQ ID NO: 1979810 - RNA, 17 nt, Shigella flexneri 2a str. 301
gggcaaccugcuuuaaa

SEQ ID NO: 1979811 - RNA, 20 nt, Shigella flexneri 2a str. 301
gggauuaaaaaguaagaauu

SEQ ID NO: 1979812 - RNA, 20 nt, Shigella flexneri 2a str. 301
gggauguguaaguaaugaca

SEQ ID NO: 1979813 - RNA, 11 nt, Shigella flexneri 2a str. 301
gggaugcugau

SEQ ID NO: 1979814 - RNA, 14 nt, Shigella flexneri 2a str. 301
gggaugcuggggcc

SEQ ID NO: 1979815 - RNA, 20 nt, Shigella flexneri 2a str. 301
gggaucauccacccgcagca

SEQ ID NO: 1979816 - RNA, 15 nt, Shigella flexneri 2a str. 301
gggaucagcuuuuua

SEQ ID NO: 1979817 - RNA, 15 nt, Shigella flexneri 2a str. 301
gggaucaucagcaaa

SEQ ID NO: 1979818 - RNA, 13 nt, Shigella flexneri 2a str. 301
gggauagcucaau

SEQ ID NO: 1979819 - RNA, 15 nt, Shigella flexneri 2a str. 301
gggaggauuucuccc

SEQ ID NO: 1979820 - RNA, 14 nt, Shigella flexneri 2a str. 301
gggaaaguggcguu

SEQ ID NO: 1979821 - RNA, 12 nt, Shigella flexneri 2a str. 301
gggaacagaggc

SEQ ID NO: 1979822 - RNA, 22 nt, Shigella flexneri 2a str. 301
gggaacaguacauuguuuucca

SEQ ID NO: 1979823 - RNA, 13 nt, Shigella flexneri 2a str. 301
gggaaggucaggu

SEQ ID NO: 1979824 - RNA, 18 nt, Shigella flexneri 2a str. 301
gggaagcgcaccaauuca

SEQ ID NO: 1979825 - RNA, 19 nt, Shigella flexneri 2a str. 301
ggcuuugcuacagccuggu

SEQ ID NO: 1979826 - RNA, 14 nt, Shigella flexneri 2a str. 301
ggcuuuggcaaacu

SEQ ID NO: 1979827 - RNA, 17 nt, Shigella flexneri 2a str. 301
ggcuuugcuguuuccag

SEQ ID NO: 1979828 - RNA, 22 nt, Shigella flexneri 2a str. 301
ggcuuugccuccccaacauaua

SEQ ID NO: 1979829 - RNA, 23 nt, Shigella flexneri 2a str. 301
ggcuuuaccaccgucaaaaaaac

SEQ ID NO: 1979830 - RNA, 14 nt, Shigella flexneri 2a str. 301
ggcuuuuuuuugcc

SEQ ID NO: 1979831 - RNA, 16 nt, Shigella flexneri 2a str. 301
gggaaaacgcuggcag

SEQ ID NO: 1979832 - RNA, 19 nt, Shigella flexneri 2a str. 301
gggaaaacgcuggcagcau

SEQ ID NO: 1979833 - RNA, 23 nt, Shigella flexneri 2a str. 301
gggaaaacagcgcaccagaaaca

SEQ ID NO: 1979834 - RNA, 18 nt, Shigella flexneri 2a str. 301
gggaaaacagcgcaccag

SEQ ID NO: 1979835 - RNA, 12 nt, Shigella flexneri 2a str. 301
ggcuuuuuaauu

SEQ ID NO: 1979836 - RNA, 17 nt, Shigella flexneri 2a str. 301
gggaaggucagguuuga

SEQ ID NO: 1979837 - RNA, 17 nt, Shigella flexneri 2a str. 301
gggaauaaaagccagga

SEQ ID NO: 1979838 - RNA, 12 nt, Shigella flexneri 2a str. 301
gggacauuuagc

SEQ ID NO: 1979839 - RNA, 13 nt, Shigella flexneri 2a str. 301
gggacaugauuca

SEQ ID NO: 1979840 - RNA, 15 nt, Shigella flexneri 2a str. 301
gggagagggccgggg

SEQ ID NO: 1979841 - RNA, 23 nt, Shigella flexneri 2a str. 301
gggagcagauacggcgcaucugu

SEQ ID NO: 1979842 - RNA, 23 nt, Shigella flexneri 2a str. 301
gggagcgcuuuuuuccugccgcu

SEQ ID NO: 1979843 - RNA, 22 nt, Shigella flexneri 2a str. 301
gggacgguccgugcgcuuuuua

SEQ ID NO: 1979844 - RNA, 15 nt, Shigella flexneri 2a str. 301
ggggcggcaaucgcu

SEQ ID NO: 1979845 - RNA, 11 nt, Shigella flexneri 2a str. 301
gggggaaggau

SEQ ID NO: 1979846 - RNA, 21 nt, Shigella flexneri 2a str. 301
ggggauguguuauucagcugg

SEQ ID NO: 1979847 - RNA, 14 nt, Shigella flexneri 2a str. 301
ggggauaagaauau

SEQ ID NO: 1979848 - RNA, 14 nt, Shigella flexneri 2a str. 301
ggggaugcugaaaa

SEQ ID NO: 1979849 - RNA, 17 nt, Shigella flexneri 2a str. 301
ggggacauuuagcggcc

SEQ ID NO: 1979850 - RNA, 21 nt, Shigella flexneri 2a str. 301
gggcuuuuuuuauuauuccgu

SEQ ID NO: 1979851 - RNA, 17 nt, Shigella flexneri 2a str. 301
gggcuuuuuuauuucau

SEQ ID NO: 1979852 - RNA, 20 nt, Shigella flexneri 2a str. 301
gggcuggcguacccaucaac

SEQ ID NO: 1979853 - RNA, 12 nt, Shigella flexneri 2a str. 301
gggcuggccaau

SEQ ID NO: 1979854 - RNA, 19 nt, Shigella flexneri 2a str. 301
gggcuggccaauuggcugg

SEQ ID NO: 1979855 - RNA, 12 nt, Shigella flexneri 2a str. 301
ggguaaaaggau

SEQ ID NO: 1979856 - RNA, 22 nt, Shigella flexneri 2a str. 301
gggguuuucucuuuccagcaac

SEQ ID NO: 1979857 - RNA, 13 nt, Shigella flexneri 2a str. 301
ggguaagggagga

SEQ ID NO: 1979858 - RNA, 13 nt, Shigella flexneri 2a str. 301
ggguaagcgccac

SEQ ID NO: 1979859 - RNA, 13 nt, Shigella flexneri 2a str. 301
ggguaaagagcgu

SEQ ID NO: 1979860 - RNA, 15 nt, Shigella flexneri 2a str. 301
ggguacgacuuccug

SEQ ID NO: 1979861 - RNA, 15 nt, Shigella flexneri 2a str. 301
ggguaauuucauuaa

SEQ ID NO: 1979862 - RNA, 14 nt, Shigella flexneri 2a str. 301
ggguaggaucagaa

SEQ ID NO: 1979863 - RNA, 14 nt, Shigella flexneri 2a str. 301
gggguaaagcgcgg

SEQ ID NO: 1979864 - RNA, 18 nt, Shigella flexneri 2a str. 301
gggguauuuccagggccu

SEQ ID NO: 1979865 - RNA, 13 nt, Shigella flexneri 2a str. 301
gggguuacgaccu

SEQ ID NO: 1979866 - RNA, 12 nt, Shigella flexneri 2a str. 301
ggggugucggug

SEQ ID NO: 1979867 - RNA, 21 nt, Shigella flexneri 2a str. 301
ggguauggaucccucuuucug

SEQ ID NO: 1979868 - RNA, 16 nt, Shigella flexneri 2a str. 301
ggguauucauccggua

SEQ ID NO: 1979869 - RNA, 17 nt, Shigella flexneri 2a str. 301
gggucuuuuaaauccug

SEQ ID NO: 1979870 - RNA, 14 nt, Shigella flexneri 2a str. 301
gggcaugaguaaaa

SEQ ID NO: 1979871 - RNA, 15 nt, Shigella flexneri 2a str. 301
gggcaucucaggcag

SEQ ID NO: 1979872 - RNA, 19 nt, Shigella flexneri 2a str. 301
gggccgauuaaagacagcg

SEQ ID NO: 1979873 - RNA, 22 nt, Shigella flexneri 2a str. 301
gggccgauuaaagacagcgagg

SEQ ID NO: 1979874 - RNA, 12 nt, Shigella flexneri 2a str. 301
gggccugaacaa

SEQ ID NO: 1979875 - RNA, 15 nt, Shigella flexneri 2a str. 301
gggccugaacaagca

SEQ ID NO: 1979876 - RNA, 15 nt, Shigella flexneri 2a str. 301
gggccuccugcagcg

SEQ ID NO: 1979877 - RNA, 19 nt, Shigella flexneri 2a str. 301
gggccgucaggugacacuu

SEQ ID NO: 1979878 - RNA, 15 nt, Shigella flexneri 2a str. 301
gggccguaauauuuc

SEQ ID NO: 1979879 - RNA, 21 nt, Shigella flexneri 2a str. 301
gggcgaauuaucggcagcggc

SEQ ID NO: 1979880 - RNA, 18 nt, Shigella flexneri 2a str. 301
gggcgagguggauauaaa

SEQ ID NO: 1979881 - RNA, 20 nt, Shigella flexneri 2a str. 301
gggcggaacuucgcgaguga

SEQ ID NO: 1979882 - RNA, 11 nt, Shigella flexneri 2a str. 301
gggcgcgggcg

SEQ ID NO: 1979883 - RNA, 19 nt, Shigella flexneri 2a str. 301
gggcgcguccggcgucgcu

SEQ ID NO: 1979884 - RNA, 17 nt, Shigella flexneri 2a str. 301
gggcguuacagcuggag

SEQ ID NO: 1979885 - RNA, 14 nt, Shigella flexneri 2a str. 301
gggcuaaugccagu

SEQ ID NO: 1979886 - RNA, 15 nt, Shigella flexneri 2a str. 301
gguaaccgccaguaa

SEQ ID NO: 1979887 - RNA, 15 nt, Shigella flexneri 2a str. 301
gguaacccauccagc

SEQ ID NO: 1979888 - RNA, 12 nt, Shigella flexneri 2a str. 301
gguaacauccag

SEQ ID NO: 1979889 - RNA, 17 nt, Shigella flexneri 2a str. 301
gguaacauacuccaccc

SEQ ID NO: 1979890 - RNA, 12 nt, Shigella flexneri 2a str. 301
gguaaagaagag

SEQ ID NO: 1979891 - RNA, 18 nt, Shigella flexneri 2a str. 301
gguaaaaccgacuuaaaa

SEQ ID NO: 1979892 - RNA, 13 nt, Shigella flexneri 2a str. 301
gguaaggauaaaa

SEQ ID NO: 1979893 - RNA, 21 nt, Shigella flexneri 2a str. 301
gguaaguucacgcagguuaga

SEQ ID NO: 1979894 - RNA, 22 nt, Shigella flexneri 2a str. 301
gguaacucugaugacugaugcu

SEQ ID NO: 1979895 - RNA, 22 nt, Shigella flexneri 2a str. 301
gguaauacuaaucucacccaua

SEQ ID NO: 1979896 - RNA, 17 nt, Shigella flexneri 2a str. 301
gguaauuugaucaaaua

SEQ ID NO: 1979897 - RNA, 11 nt, Shigella flexneri 2a str. 301
gguaauucccu

SEQ ID NO: 1979898 - RNA, 17 nt, Shigella flexneri 2a str. 301
gguaauuaagauucagc

SEQ ID NO: 1979899 - RNA, 14 nt, Shigella flexneri 2a str. 301
gguaaugccaguca

SEQ ID NO: 1979900 - RNA, 12 nt, Shigella flexneri 2a str. 301
gguaauggucag

SEQ ID NO: 1979901 - RNA, 15 nt, Shigella flexneri 2a str. 301
ggguuagucugcauu

SEQ ID NO: 1979902 - RNA, 17 nt, Shigella flexneri 2a str. 301
ggguucgacgcgguuga

SEQ ID NO: 1979903 - RNA, 20 nt, Shigella flexneri 2a str. 301
gggugauuguucgcaccggu

SEQ ID NO: 1979904 - RNA, 19 nt, Shigella flexneri 2a str. 301
gggugagggcguagagaga

SEQ ID NO: 1979905 - RNA, 14 nt, Shigella flexneri 2a str. 301
gggugagggaggau

SEQ ID NO: 1979906 - RNA, 21 nt, Shigella flexneri 2a str. 301
gggugcgaauaagcugcguga

SEQ ID NO: 1979907 - RNA, 22 nt, Shigella flexneri 2a str. 301
gguagcugcccccgcucuucca

SEQ ID NO: 1979908 - RNA, 20 nt, Shigella flexneri 2a str. 301
gguagcaaaacaauuuggug

SEQ ID NO: 1979909 - RNA, 22 nt, Shigella flexneri 2a str. 301
gguagacgcgcuagcuucaggu

SEQ ID NO: 1979910 - RNA, 16 nt, Shigella flexneri 2a str. 301
gguacuuucacaggga

SEQ ID NO: 1979911 - RNA, 14 nt, Shigella flexneri 2a str. 301
gguacuggcaggga

SEQ ID NO: 1979912 - RNA, 18 nt, Shigella flexneri 2a str. 301
gguacgaaaagggcugga

SEQ ID NO: 1979913 - RNA, 19 nt, Shigella flexneri 2a str. 301
gguaccuuugaacugcuga

SEQ ID NO: 1979914 - RNA, 23 nt, Shigella flexneri 2a str. 301
gguacgaauacggauauguuuac

SEQ ID NO: 1979915 - RNA, 22 nt, Shigella flexneri 2a str. 301
gguacgcaauuccagcaagcca

SEQ ID NO: 1979916 - RNA, 19 nt, Shigella flexneri 2a str. 301
gguacgccuuaguuauaaa

SEQ ID NO: 1979917 - RNA, 18 nt, Shigella flexneri 2a str. 301
gguacuaucagcguaaag

SEQ ID NO: 1979918 - RNA, 21 nt, Shigella flexneri 2a str. 301
gguacaaccaucccuccugug

SEQ ID NO: 1979919 - RNA, 12 nt, Shigella flexneri 2a str. 301
gguacagagcaa

SEQ ID NO: 1979920 - RNA, 16 nt, Shigella flexneri 2a str. 301
gguaccagaaucaccu

SEQ ID NO: 1979921 - RNA, 18 nt, Shigella flexneri 2a str. 301
gguaucgcgccagccagu

SEQ ID NO: 1979922 - RNA, 17 nt, Shigella flexneri 2a str. 301
gguauacgucccgguga

SEQ ID NO: 1979923 - RNA, 15 nt, Shigella flexneri 2a str. 301
gguaucaaacacagg

SEQ ID NO: 1979924 - RNA, 11 nt, Shigella flexneri 2a str. 301
gguaucaaacc

SEQ ID NO: 1979925 - RNA, 17 nt, Shigella flexneri 2a str. 301
gguauaaaauagcaaua

SEQ ID NO: 1979926 - RNA, 15 nt, Shigella flexneri 2a str. 301
gguauacgucccggu

SEQ ID NO: 1979927 - RNA, 15 nt, Shigella flexneri 2a str. 301
gguaguccaugacca

SEQ ID NO: 1979928 - RNA, 16 nt, Shigella flexneri 2a str. 301
ggucaacgucaacuuu

SEQ ID NO: 1979929 - RNA, 14 nt, Shigella flexneri 2a str. 301
ggucaaaagcugca

SEQ ID NO: 1979930 - RNA, 16 nt, Shigella flexneri 2a str. 301
gguauuuucugaaacg

SEQ ID NO: 1979931 - RNA, 21 nt, Shigella flexneri 2a str. 301
gguaucuuuaaucgagauacg

SEQ ID NO: 1979932 - RNA, 22 nt, Shigella flexneri 2a str. 301
gguaucguaaccuugauccugc

SEQ ID NO: 1979933 - RNA, 21 nt, Shigella flexneri 2a str. 301
gguaucgucgggcuggugcug

SEQ ID NO: 1979934 - RNA, 18 nt, Shigella flexneri 2a str. 301
gguaucgggcaguuuacc

SEQ ID NO: 1979935 - RNA, 15 nt, Shigella flexneri 2a str. 301
gguauuaguggcaac

SEQ ID NO: 1979936 - RNA, 19 nt, Shigella flexneri 2a str. 301
gguauucaaccguuuccag

SEQ ID NO: 1979937 - RNA, 18 nt, Shigella flexneri 2a str. 301
gguauggucacggugagg

SEQ ID NO: 1979938 - RNA, 21 nt, Shigella flexneri 2a str. 301
ggucagaacgaccaguucaca

SEQ ID NO: 1979939 - RNA, 10 nt, Shigella flexneri 2a str. 301
ggucagagaa

SEQ ID NO: 1979940 - RNA, 22 nt, Shigella flexneri 2a str. 301
ggucagagagccagccccacag

SEQ ID NO: 1979941 - RNA, 17 nt, Shigella flexneri 2a str. 301
ggucacugacaccagca

SEQ ID NO: 1979942 - RNA, 22 nt, Shigella flexneri 2a str. 301
ggucacggcuguagccagcucg

SEQ ID NO: 1979943 - RNA, 15 nt, Shigella flexneri 2a str. 301
ggucacaucgcugac

SEQ ID NO: 1979944 - RNA, 13 nt, Shigella flexneri 2a str. 301
ggucaccaguuca

SEQ ID NO: 1979945 - RNA, 22 nt, Shigella flexneri 2a str. 301
ggucaauuccuucugggcgcgg

SEQ ID NO: 1979946 - RNA, 14 nt, Shigella flexneri 2a str. 301
ggucagaucagcca

SEQ ID NO: 1979947 - RNA, 22 nt, Shigella flexneri 2a str. 301
ggucagcaggagcagccccugc

SEQ ID NO: 1979948 - RNA, 18 nt, Shigella flexneri 2a str. 301
ggucagcgccuggcugca

SEQ ID NO: 1979949 - RNA, 14 nt, Shigella flexneri 2a str. 301
ggucagccagcggc

SEQ ID NO: 1979950 - RNA, 20 nt, Shigella flexneri 2a str. 301
ggucagccacaguugaucag

SEQ ID NO: 1979951 - RNA, 19 nt, Shigella flexneri 2a str. 301
ggucagguauuuugucagc

SEQ ID NO: 1979952 - RNA, 16 nt, Shigella flexneri 2a str. 301
ggucaggcuaaagaaa

SEQ ID NO: 1979953 - RNA, 17 nt, Shigella flexneri 2a str. 301
gguccagccgccagggc

SEQ ID NO: 1979954 - RNA, 16 nt, Shigella flexneri 2a str. 301
gguccgggcaucagca

SEQ ID NO: 1979955 - RNA, 20 nt, Shigella flexneri 2a str. 301
ggucauuuucuucagcaguu

SEQ ID NO: 1979956 - RNA, 18 nt, Shigella flexneri 2a str. 301
ggucauuaugaccguuca

SEQ ID NO: 1979957 - RNA, 19 nt, Shigella flexneri 2a str. 301
ggucauggcauuaauaugc

SEQ ID NO: 1979958 - RNA, 15 nt, Shigella flexneri 2a str. 301
ggucaguuggcuggg

SEQ ID NO: 1979959 - RNA, 17 nt, Shigella flexneri 2a str. 301
ggucggcuucccugcgg

SEQ ID NO: 1979960 - RNA, 21 nt, Shigella flexneri 2a str. 301
ggucgugcgguuucagcucac

SEQ ID NO: 1979961 - RNA, 16 nt, Shigella flexneri 2a str. 301
ggucgucuuuuacagc

SEQ ID NO: 1979962 - RNA, 13 nt, Shigella flexneri 2a str. 301
ggucugcaaaaug

SEQ ID NO: 1979963 - RNA, 22 nt, Shigella flexneri 2a str. 301
ggucugcagauauucaugcagg

SEQ ID NO: 1979964 - RNA, 12 nt, Shigella flexneri 2a str. 301
ggugaaaaaaac

SEQ ID NO: 1979965 - RNA, 14 nt, Shigella flexneri 2a str. 301
ggugaaaaaauuaa

SEQ ID NO: 1979966 - RNA, 13 nt, Shigella flexneri 2a str. 301
ggugaaaaaccaa

SEQ ID NO: 1979967 - RNA, 18 nt, Shigella flexneri 2a str. 301
ggucugcggaucauggua

SEQ ID NO: 1979968 - RNA, 17 nt, Shigella flexneri 2a str. 301
ggucggcaaacugcuga

SEQ ID NO: 1979969 - RNA, 23 nt, Shigella flexneri 2a str. 301
ggucgcucgcgccgcauccgaca

SEQ ID NO: 1979970 - RNA, 22 nt, Shigella flexneri 2a str. 301
ggucgccccggaacgggagaaa

SEQ ID NO: 1979971 - RNA, 12 nt, Shigella flexneri 2a str. 301
gguccuucaucu

SEQ ID NO: 1979972 - RNA, 12 nt, Shigella flexneri 2a str. 301
gguccuuuugcc

SEQ ID NO: 1979973 - RNA, 18 nt, Shigella flexneri 2a str. 301
ggucgcacugcucuuuuu

SEQ ID NO: 1979974 - RNA, 21 nt, Shigella flexneri 2a str. 301
gcuuucgagcacgacuuucuc

SEQ ID NO: 1979975 - RNA, 20 nt, Shigella flexneri 2a str. 301
gcuuucgccaggucgcugac

SEQ ID NO: 1979976 - RNA, 16 nt, Shigella flexneri 2a str. 301
ggaacaacguaucuug

SEQ ID NO: 1979977 - RNA, 16 nt, Shigella flexneri 2a str. 301
ggaacaggcagggcca

SEQ ID NO: 1979978 - RNA, 19 nt, Shigella flexneri 2a str. 301
ggaacauucgccgcuguga

SEQ ID NO: 1979979 - RNA, 15 nt, Shigella flexneri 2a str. 301
ggaacauccuuuccu

SEQ ID NO: 1979980 - RNA, 18 nt, Shigella flexneri 2a str. 301
ggaacaucaccaaguccc

SEQ ID NO: 1979981 - RNA, 16 nt, Shigella flexneri 2a str. 301
ggaacaucaccccgcc

SEQ ID NO: 1979982 - RNA, 18 nt, Shigella flexneri 2a str. 301
ggaagccggaauuuuccu

SEQ ID NO: 1979983 - RNA, 14 nt, Shigella flexneri 2a str. 301
ggaaguauuucaau

SEQ ID NO: 1979984 - RNA, 21 nt, Shigella flexneri 2a str. 301
ggaaguauuucaauauggaag

SEQ ID NO: 1979985 - RNA, 14 nt, Shigella flexneri 2a str. 301
ggaagcuccaccag

SEQ ID NO: 1979986 - RNA, 20 nt, Shigella flexneri 2a str. 301
ggaagcgcccgucacugaau

SEQ ID NO: 1979987 - RNA, 19 nt, Shigella flexneri 2a str. 301
ggaagccuuccgcaaacag

SEQ ID NO: 1979988 - RNA, 19 nt, Shigella flexneri 2a str. 301
ggaauuuuacagcccuggc

SEQ ID NO: 1979989 - RNA, 16 nt, Shigella flexneri 2a str. 301
ggacacauuucuuuug

SEQ ID NO: 1979990 - RNA, 13 nt, Shigella flexneri 2a str. 301
ggacaccucacca

SEQ ID NO: 1979991 - RNA, 20 nt, Shigella flexneri 2a str. 301
ggacacugcuuacaggcugg

SEQ ID NO: 1979992 - RNA, 21 nt, Shigella flexneri 2a str. 301
ggacacugcuuacaggcuggu

SEQ ID NO: 1979993 - RNA, 14 nt, Shigella flexneri 2a str. 301
ggaauaccacuuuc

SEQ ID NO: 1979994 - RNA, 19 nt, Shigella flexneri 2a str. 301
ggaauacauauauuacaac

SEQ ID NO: 1979995 - RNA, 15 nt, Shigella flexneri 2a str. 301
ggaauaaaagccagg

SEQ ID NO: 1979996 - RNA, 22 nt, Shigella flexneri 2a str. 301
ggaaguuaauuucgacgggcug

SEQ ID NO: 1979997 - RNA, 18 nt, Shigella flexneri 2a str. 301
ggaaguaccaauggcaau

SEQ ID NO: 1979998 - RNA, 13 nt, Shigella flexneri 2a str. 301
ggaaguuacucaa

SEQ ID NO: 1979999 - RNA, 16 nt, Shigella flexneri 2a str. 301
ggaaugucaucaucaa

SEQ ID NO: 1980000 - RNA, 17 nt, Shigella flexneri 2a str. 301
ggaaugccggaaucaga

SEQ ID NO: 1980001 - RNA, 16 nt, Shigella flexneri 2a str. 301
ggacagcguugccagc

SEQ ID NO: 1980002 - RNA, 16 nt, Shigella flexneri 2a str. 301
ggacagacuggcuauu

SEQ ID NO: 1980003 - RNA, 18 nt, Shigella flexneri 2a str. 301
ggacagacuggcuauuaa

SEQ ID NO: 1980004 - RNA, 22 nt, Shigella flexneri 2a str. 301
aaaggcugacaaaucagaggcu

SEQ ID NO: 1980005 - RNA, 13 nt, Shigella flexneri 2a str. 301
aaaggcugaggga

SEQ ID NO: 1980006 - RNA, 19 nt, Shigella flexneri 2a str. 301
ggacccuuaaagggucagg

SEQ ID NO: 1980007 - RNA, 18 nt, Shigella flexneri 2a str. 301
ggaccuuucugaugcaua

SEQ ID NO: 1980008 - RNA, 18 nt, Shigella flexneri 2a str. 301
ggacgaacaguucaacgc

SEQ ID NO: 1980009 - RNA, 17 nt, Shigella flexneri 2a str. 301
aaaggcuuugacuaaca

SEQ ID NO: 1980010 - RNA, 19 nt, Shigella flexneri 2a str. 301
ggacgauaaaccaggccaa

SEQ ID NO: 1980011 - RNA, 15 nt, Shigella flexneri 2a str. 301
aaaggggugaaaaaa

SEQ ID NO: 1980012 - RNA, 18 nt, Shigella flexneri 2a str. 301
ggacuuguuuuugaucuc

SEQ ID NO: 1980013 - RNA, 21 nt, Shigella flexneri 2a str. 301
ggacuuuaugaaccugaacca

SEQ ID NO: 1980014 - RNA, 15 nt, Shigella flexneri 2a str. 301
ggagacuaaggcagc

SEQ ID NO: 1980015 - RNA, 18 nt, Shigella flexneri 2a str. 301
ggagacguauuaaauucc

SEQ ID NO: 1980016 - RNA, 21 nt, Shigella flexneri 2a str. 301
ggagagaaaagcaaaagaugg

SEQ ID NO: 1980017 - RNA, 19 nt, Shigella flexneri 2a str. 301
ggagauuaacugggcguca

SEQ ID NO: 1980018 - RNA, 15 nt, Shigella flexneri 2a str. 301
ggagagggaaauccc

SEQ ID NO: 1980019 - RNA, 14 nt, Shigella flexneri 2a str. 301
ggagcaggccgggu

SEQ ID NO: 1980020 - RNA, 14 nt, Shigella flexneri 2a str. 301
ggagcagccagcca

SEQ ID NO: 1980021 - RNA, 12 nt, Shigella flexneri 2a str. 301
ggagcagccccu

SEQ ID NO: 1980022 - RNA, 21 nt, Shigella flexneri 2a str. 301
ggagcagccccugcgccagcg

SEQ ID NO: 1980023 - RNA, 23 nt, Shigella flexneri 2a str. 301
ggagcaaaagugguguugaagaa

SEQ ID NO: 1980024 - RNA, 14 nt, Shigella flexneri 2a str. 301
ggagcaacugcgcu

SEQ ID NO: 1980025 - RNA, 20 nt, Shigella flexneri 2a str. 301
ggacugaaauuacaggcagu

SEQ ID NO: 1980026 - RNA, 15 nt, Shigella flexneri 2a str. 301
ggacugcucacgcca

SEQ ID NO: 1980027 - RNA, 19 nt, Shigella flexneri 2a str. 301
aaaguaacugacaguagcc

SEQ ID NO: 1980028 - RNA, 19 nt, Shigella flexneri 2a str. 301
ggacuuaaggucacagaag

SEQ ID NO: 1980029 - RNA, 15 nt, Shigella flexneri 2a str. 301
aaagguaauggucag

SEQ ID NO: 1980030 - RNA, 18 nt, Shigella flexneri 2a str. 301
ggauaaacacucgcugug

SEQ ID NO: 1980031 - RNA, 14 nt, Shigella flexneri 2a str. 301
ggaguuuaauaaau

SEQ ID NO: 1980032 - RNA, 14 nt, Shigella flexneri 2a str. 301
ggagccaguuggcg

SEQ ID NO: 1980033 - RNA, 16 nt, Shigella flexneri 2a str. 301
ggauaccaccagugcc

SEQ ID NO: 1980034 - RNA, 20 nt, Shigella flexneri 2a str. 301
ggauaauacacuaacagaac

SEQ ID NO: 1980035 - RNA, 18 nt, Shigella flexneri 2a str. 301
ggauagagcucauuucau

SEQ ID NO: 1980036 - RNA, 19 nt, Shigella flexneri 2a str. 301
ggaucaaaaaugucaucgu

SEQ ID NO: 1980037 - RNA, 18 nt, Shigella flexneri 2a str. 301
ggauauucaucuccagca

SEQ ID NO: 1980038 - RNA, 15 nt, Shigella flexneri 2a str. 301
ggaucaagcaacaua

SEQ ID NO: 1980039 - RNA, 12 nt, Shigella flexneri 2a str. 301
ggaucggaggca

SEQ ID NO: 1980040 - RNA, 17 nt, Shigella flexneri 2a str. 301
ggauccaguccccccca

SEQ ID NO: 1980041 - RNA, 22 nt, Shigella flexneri 2a str. 301
ggaucauccacccgcagcaagc

SEQ ID NO: 1980042 - RNA, 18 nt, Shigella flexneri 2a str. 301
ggaucaacggccugacca

SEQ ID NO: 1980043 - RNA, 19 nt, Shigella flexneri 2a str. 301
ggaucgucaggaucagcca

SEQ ID NO: 1980044 - RNA, 15 nt, Shigella flexneri 2a str. 301
ggaucuuuugucaug

SEQ ID NO: 1980045 - RNA, 21 nt, Shigella flexneri 2a str. 301
ggaugaacauaaucugcaaau

SEQ ID NO: 1980046 - RNA, 14 nt, Shigella flexneri 2a str. 301
ggaugacacgcagg

SEQ ID NO: 1980047 - RNA, 12 nt, Shigella flexneri 2a str. 301
ggaugacccagc

SEQ ID NO: 1980048 - RNA, 17 nt, Shigella flexneri 2a str. 301
ggaucuuuucuuucgcc

SEQ ID NO: 1980049 - RNA, 16 nt, Shigella flexneri 2a str. 301
ggaucuuugacugaaa

SEQ ID NO: 1980050 - RNA, 21 nt, Shigella flexneri 2a str. 301
ggaucguucacaugagagaaa

SEQ ID NO: 1980051 - RNA, 18 nt, Shigella flexneri 2a str. 301
ggaucugaugggauuaga

SEQ ID NO: 1980052 - RNA, 20 nt, Shigella flexneri 2a str. 301
ggaucugcggguuagucugc

SEQ ID NO: 1980053 - RNA, 17 nt, Shigella flexneri 2a str. 301
ggaugggcguagcuggg

SEQ ID NO: 1980054 - RNA, 22 nt, Shigella flexneri 2a str. 301
ggauggucgcuuuguggcggca

SEQ ID NO: 1980055 - RNA, 12 nt, Shigella flexneri 2a str. 301
ggauggcggcuu

SEQ ID NO: 1980056 - RNA, 18 nt, Shigella flexneri 2a str. 301
ggauggcguagcagcagc

SEQ ID NO: 1980057 - RNA, 17 nt, Shigella flexneri 2a str. 301
aaaguaaucaagcccug

SEQ ID NO: 1980058 - RNA, 18 nt, Shigella flexneri 2a str. 301
aaaguaccaucguccagc

SEQ ID NO: 1980059 - RNA, 22 nt, Shigella flexneri 2a str. 301
aaaguacagaugccaaucaguu

SEQ ID NO: 1980060 - RNA, 20 nt, Shigella flexneri 2a str. 301
ggauguguuauucagcuggc

SEQ ID NO: 1980061 - RNA, 22 nt, Shigella flexneri 2a str. 301
ggaugugaaaaugaguauucag

SEQ ID NO: 1980062 - RNA, 15 nt, Shigella flexneri 2a str. 301
ggaugccgaaaaaag

SEQ ID NO: 1980063 - RNA, 16 nt, Shigella flexneri 2a str. 301
ggaugccgaaaaaagu

SEQ ID NO: 1980064 - RNA, 16 nt, Shigella flexneri 2a str. 301
ggaugccucuccuguu

SEQ ID NO: 1980065 - RNA, 11 nt, Shigella flexneri 2a str. 301
ggauggcggcu

SEQ ID NO: 1980066 - RNA, 13 nt, Shigella flexneri 2a str. 301
ggauggccgggca

SEQ ID NO: 1980067 - RNA, 20 nt, Shigella flexneri 2a str. 301
ggaugcgggucaggccagga

SEQ ID NO: 1980068 - RNA, 17 nt, Shigella flexneri 2a str. 301
ggauggcaaacugauua

SEQ ID NO: 1980069 - RNA, 21 nt, Shigella flexneri 2a str. 301
ggauuucugauuauggcggcg

SEQ ID NO: 1980070 - RNA, 16 nt, Shigella flexneri 2a str. 301
ggauuucuccccccuc

SEQ ID NO: 1980071 - RNA, 17 nt, Shigella flexneri 2a str. 301
ggauucgaaccuucgaa

SEQ ID NO: 1980072 - RNA, 23 nt, Shigella flexneri 2a str. 301
ggauucaugcggguauucauccg

SEQ ID NO: 1980073 - RNA, 21 nt, Shigella flexneri 2a str. 301
ggauuccagcgccgccagaag

SEQ ID NO: 1980074 - RNA, 23 nt, Shigella flexneri 2a str. 301
ggauuacgacucaaccccagcca

SEQ ID NO: 1980075 - RNA, 14 nt, Shigella flexneri 2a str. 301
ggcaaccagcccau

SEQ ID NO: 1980076 - RNA, 14 nt, Shigella flexneri 2a str. 301
ggauuuuuuuauuu

SEQ ID NO: 1980077 - RNA, 13 nt, Shigella flexneri 2a str. 301
ggauuuugcccug

SEQ ID NO: 1980078 - RNA, 15 nt, Shigella flexneri 2a str. 301
ggcaaaaaucggcaa

SEQ ID NO: 1980079 - RNA, 12 nt, Shigella flexneri 2a str. 301
ggcaacugcugc

SEQ ID NO: 1980080 - RNA, 15 nt, Shigella flexneri 2a str. 301
ggcaagaauuacuuc

SEQ ID NO: 1980081 - RNA, 15 nt, Shigella flexneri 2a str. 301
ggcaagcaggacgcc

SEQ ID NO: 1980082 - RNA, 16 nt, Shigella flexneri 2a str. 301
ggcaagcauaugacga

SEQ ID NO: 1980083 - RNA, 20 nt, Shigella flexneri 2a str. 301
ggcaagagcgaucggcagcu

SEQ ID NO: 1980084 - RNA, 14 nt, Shigella flexneri 2a str. 301
ggcaagauacugca

SEQ ID NO: 1980085 - RNA, 18 nt, Shigella flexneri 2a str. 301
ggccauacccgccagugc

SEQ ID NO: 1980086 - RNA, 15 nt, Shigella flexneri 2a str. 301
ggccaguuucauagu

SEQ ID NO: 1980087 - RNA, 16 nt, Shigella flexneri 2a str. 301
ggccaugcggcgagga

SEQ ID NO: 1980088 - RNA, 18 nt, Shigella flexneri 2a str. 301
ggccaugaccgccgcagc

SEQ ID NO: 1980089 - RNA, 19 nt, Shigella flexneri 2a str. 301
ggccccuuccucgggaggg

SEQ ID NO: 1980090 - RNA, 12 nt, Shigella flexneri 2a str. 301
ggcccaucaucu

SEQ ID NO: 1980091 - RNA, 16 nt, Shigella flexneri 2a str. 301
ggcccaccuggcugag

SEQ ID NO: 1980092 - RNA, 18 nt, Shigella flexneri 2a str. 301
ggcccagaccccagcucu

SEQ ID NO: 1980093 - RNA, 13 nt, Shigella flexneri 2a str. 301
aaagucuccuuug

SEQ ID NO: 1980094 - RNA, 13 nt, Shigella flexneri 2a str. 301
aaagugaaaaaca

SEQ ID NO: 1980095 - RNA, 19 nt, Shigella flexneri 2a str. 301
aaagucguaggccugauaa

SEQ ID NO: 1980096 - RNA, 21 nt, Shigella flexneri 2a str. 301
ggcccuuucccuucucgucgg

SEQ ID NO: 1980097 - RNA, 21 nt, Shigella flexneri 2a str. 301
ggcccuucuggucaugaaccu

SEQ ID NO: 1980098 - RNA, 13 nt, Shigella flexneri 2a str. 301
ggcagaugcgucu

SEQ ID NO: 1980099 - RNA, 21 nt, Shigella flexneri 2a str. 301
ggcagauacaaccaaucgcgg

SEQ ID NO: 1980100 - RNA, 16 nt, Shigella flexneri 2a str. 301
ggcagccagauggcug

SEQ ID NO: 1980101 - RNA, 13 nt, Shigella flexneri 2a str. 301
ggcagccagcauc

SEQ ID NO: 1980102 - RNA, 23 nt, Shigella flexneri 2a str. 301
ggcagccagccaugcggcaucuu

SEQ ID NO: 1980103 - RNA, 13 nt, Shigella flexneri 2a str. 301
ggcagcgaagggu

SEQ ID NO: 1980104 - RNA, 20 nt, Shigella flexneri 2a str. 301
ggcaagccgcuaacagcagc

SEQ ID NO: 1980105 - RNA, 15 nt, Shigella flexneri 2a str. 301
ggcaaguagcgccau

SEQ ID NO: 1980106 - RNA, 19 nt, Shigella flexneri 2a str. 301
ggcaagugugaugguauuc

SEQ ID NO: 1980107 - RNA, 17 nt, Shigella flexneri 2a str. 301
ggcagaaugcccugcgg

SEQ ID NO: 1980108 - RNA, 18 nt, Shigella flexneri 2a str. 301
ggcagagaaagcaaaaau

SEQ ID NO: 1980109 - RNA, 14 nt, Shigella flexneri 2a str. 301
ggcagagaucgccg

SEQ ID NO: 1980110 - RNA, 22 nt, Shigella flexneri 2a str. 301
ggcagacgcucgccauuuuuca

SEQ ID NO: 1980111 - RNA, 14 nt, Shigella flexneri 2a str. 301
ggcagacgugacca

SEQ ID NO: 1980112 - RNA, 17 nt, Shigella flexneri 2a str. 301
aaaguagggcugauaaa

SEQ ID NO: 1980113 - RNA, 21 nt, Shigella flexneri 2a str. 301
aaaguagggcugauaaacaag

SEQ ID NO: 1980114 - RNA, 19 nt, Shigella flexneri 2a str. 301
aaaguagaagcaagaauaa

SEQ ID NO: 1980115 - RNA, 17 nt, Shigella flexneri 2a str. 301
ggcagcucgaccgcugc

SEQ ID NO: 1980116 - RNA, 17 nt, Shigella flexneri 2a str. 301
ggcaggaaaaaagcgcu

SEQ ID NO: 1980117 - RNA, 20 nt, Shigella flexneri 2a str. 301
ggcaggcuucaacacaggcc

SEQ ID NO: 1980118 - RNA, 16 nt, Shigella flexneri 2a str. 301
ggcaggccuggguaaa

SEQ ID NO: 1980119 - RNA, 22 nt, Shigella flexneri 2a str. 301
ggcaggaugcccaugccaauua

SEQ ID NO: 1980120 - RNA, 14 nt, Shigella flexneri 2a str. 301
ggcaggccaaaaaa

SEQ ID NO: 1980121 - RNA, 21 nt, Shigella flexneri 2a str. 301
ggcauauaguggguaacaauu

SEQ ID NO: 1980122 - RNA, 20 nt, Shigella flexneri 2a str. 301
ggcauauuccgccaccugcg

SEQ ID NO: 1980123 - RNA, 10 nt, Shigella flexneri 2a str. 301
ggcaucaaac

SEQ ID NO: 1980124 - RNA, 15 nt, Shigella flexneri 2a str. 301
ggcaguaauaccaga

SEQ ID NO: 1980125 - RNA, 14 nt, Shigella flexneri 2a str. 301
ggcaucagcagaau

SEQ ID NO: 1980126 - RNA, 22 nt, Shigella flexneri 2a str. 301
ggcaggucuuucaccugauuac

SEQ ID NO: 1980127 - RNA, 20 nt, Shigella flexneri 2a str. 301
ggcaggucaugugucgccgc

SEQ ID NO: 1980128 - RNA, 18 nt, Shigella flexneri 2a str. 301
ggcaugcuguccagcagg

SEQ ID NO: 1980129 - RNA, 20 nt, Shigella flexneri 2a str. 301
aaagucccuucccagccggg

SEQ ID NO: 1980130 - RNA, 19 nt, Shigella flexneri 2a str. 301
aaaguccaggcugcaaagu

SEQ ID NO: 1980131 - RNA, 22 nt, Shigella flexneri 2a str. 301
aaagucauccuuaaagaaaaag

SEQ ID NO: 1980132 - RNA, 16 nt, Shigella flexneri 2a str. 301
ggcaucguccauuucu

SEQ ID NO: 1980133 - RNA, 19 nt, Shigella flexneri 2a str. 301
ggcaucguguugaugcucc

SEQ ID NO: 1980134 - RNA, 13 nt, Shigella flexneri 2a str. 301
ggcaucgggcagc

SEQ ID NO: 1980135 - RNA, 20 nt, Shigella flexneri 2a str. 301
ggcauuggcauagugcugag

SEQ ID NO: 1980136 - RNA, 18 nt, Shigella flexneri 2a str. 301
ggcauucucacuccagcc

SEQ ID NO: 1980137 - RNA, 22 nt, Shigella flexneri 2a str. 301
ggcauuacaagaaucaugccaa

SEQ ID NO: 1980138 - RNA, 16 nt, Shigella flexneri 2a str. 301
ggccaauuggcuggcc

SEQ ID NO: 1980139 - RNA, 15 nt, Shigella flexneri 2a str. 301
ggccagacauuauaa

SEQ ID NO: 1980140 - RNA, 16 nt, Shigella flexneri 2a str. 301
ggccagacauuauaaa

SEQ ID NO: 1980141 - RNA, 15 nt, Shigella flexneri 2a str. 301
ggccagaacaaacua

SEQ ID NO: 1980142 - RNA, 12 nt, Shigella flexneri 2a str. 301
ggccagaaaaaa

SEQ ID NO: 1980143 - RNA, 19 nt, Shigella flexneri 2a str. 301
ggccaauugcugugccgga

SEQ ID NO: 1980144 - RNA, 22 nt, Shigella flexneri 2a str. 301
gcuggcaauacuggcagcaguc

SEQ ID NO: 1980145 - RNA, 12 nt, Shigella flexneri 2a str. 301
gcuggcaaugac

SEQ ID NO: 1980146 - RNA, 22 nt, Shigella flexneri 2a str. 301
gcuggcaagauggcgaacauaa

SEQ ID NO: 1980147 - RNA, 14 nt, Shigella flexneri 2a str. 301
gcuggcaagauggc

SEQ ID NO: 1980148 - RNA, 16 nt, Shigella flexneri 2a str. 301
gcuggcacgcucuuca

SEQ ID NO: 1980149 - RNA, 23 nt, Shigella flexneri 2a str. 301
gcuggcaacgcgccgccaacccu

SEQ ID NO: 1980150 - RNA, 16 nt, Shigella flexneri 2a str. 301
gcuggucagcgccagu

SEQ ID NO: 1980151 - RNA, 18 nt, Shigella flexneri 2a str. 301
aaaggaaggucauccaaa

SEQ ID NO: 1980152 - RNA, 20 nt, Shigella flexneri 2a str. 301
gcuguaguccuaacagagca

SEQ ID NO: 1980153 - RNA, 21 nt, Shigella flexneri 2a str. 301
gcuguauuuugcguuucugcu

SEQ ID NO: 1980154 - RNA, 18 nt, Shigella flexneri 2a str. 301
gcuguauucuucagcgac

SEQ ID NO: 1980155 - RNA, 16 nt, Shigella flexneri 2a str. 301
gcuguauguuccccuc

SEQ ID NO: 1980156 - RNA, 20 nt, Shigella flexneri 2a str. 301
gcuguauucaagccaugaau

SEQ ID NO: 1980157 - RNA, 23 nt, Shigella flexneri 2a str. 301
gcugucaguucaccauuagacag

SEQ ID NO: 1980158 - RNA, 16 nt, Shigella flexneri 2a str. 301
gcuguuguucaacacu

SEQ ID NO: 1980159 - RNA, 22 nt, Shigella flexneri 2a str. 301
gcuguuguuuuuucaaccuaaa

SEQ ID NO: 1980160 - RNA, 17 nt, Shigella flexneri 2a str. 301
gcuguugucugaaugau

SEQ ID NO: 1980161 - RNA, 14 nt, Shigella flexneri 2a str. 301
gcuguuuucagcac

SEQ ID NO: 1980162 - RNA, 19 nt, Shigella flexneri 2a str. 301
gcuguuuuccagcaccacu

SEQ ID NO: 1980163 - RNA, 23 nt, Shigella flexneri 2a str. 301
gcuguuuuccagcaccacuuccg

SEQ ID NO: 1980164 - RNA, 17 nt, Shigella flexneri 2a str. 301
gcuguuuguucaagcgc

SEQ ID NO: 1980165 - RNA, 15 nt, Shigella flexneri 2a str. 301
gcuuaaucgcggcgg

SEQ ID NO: 1980166 - RNA, 20 nt, Shigella flexneri 2a str. 301
gcuuaauguuaaccaucuca

SEQ ID NO: 1980167 - RNA, 16 nt, Shigella flexneri 2a str. 301
gcuuaaggcagaaaca

SEQ ID NO: 1980168 - RNA, 18 nt, Shigella flexneri 2a str. 301
gcuuaacgcgucuuauca

SEQ ID NO: 1980169 - RNA, 20 nt, Shigella flexneri 2a str. 301
gcuuaaaccauuccagcaua

SEQ ID NO: 1980170 - RNA, 18 nt, Shigella flexneri 2a str. 301
gcuuaacaacgggcaccg

SEQ ID NO: 1980171 - RNA, 18 nt, Shigella flexneri 2a str. 301
gcuuaaccccgggcugga

SEQ ID NO: 1980172 - RNA, 16 nt, Shigella flexneri 2a str. 301
gcugucauccagcagc

SEQ ID NO: 1980173 - RNA, 17 nt, Shigella flexneri 2a str. 301
gcuguucgagcaucaca

SEQ ID NO: 1980174 - RNA, 12 nt, Shigella flexneri 2a str. 301
gcuguucuuccc

SEQ ID NO: 1980175 - RNA, 20 nt, Shigella flexneri 2a str. 301
gcuguucgguuuugcccaca

SEQ ID NO: 1980176 - RNA, 18 nt, Shigella flexneri 2a str. 301
gcuguucacugugcuggu

SEQ ID NO: 1980177 - RNA, 15 nt, Shigella flexneri 2a str. 301
gcuguucacugugcu

SEQ ID NO: 1980178 - RNA, 20 nt, Shigella flexneri 2a str. 301
gcuucaauuuuuucuggcga

SEQ ID NO: 1980179 - RNA, 12 nt, Shigella flexneri 2a str. 301
gcuucaaucuga

SEQ ID NO: 1980180 - RNA, 13 nt, Shigella flexneri 2a str. 301
gcuucaccagcag

SEQ ID NO: 1980181 - RNA, 14 nt, Shigella flexneri 2a str. 301
gcuucaccagcagc

SEQ ID NO: 1980182 - RNA, 17 nt, Shigella flexneri 2a str. 301
gcuucacgcgccagcuu

SEQ ID NO: 1980183 - RNA, 15 nt, Shigella flexneri 2a str. 301
gcuucaaauuagccg

SEQ ID NO: 1980184 - RNA, 17 nt, Shigella flexneri 2a str. 301
gcuucaaauuagccgca

SEQ ID NO: 1980185 - RNA, 14 nt, Shigella flexneri 2a str. 301
gcuucaagaugcca

SEQ ID NO: 1980186 - RNA, 22 nt, Shigella flexneri 2a str. 301
gcuuaugcgccguuuuuuuucu

SEQ ID NO: 1980187 - RNA, 14 nt, Shigella flexneri 2a str. 301
gcuuaucuuccugu

SEQ ID NO: 1980188 - RNA, 16 nt, Shigella flexneri 2a str. 301
gcuuauuagggaucau

SEQ ID NO: 1980189 - RNA, 14 nt, Shigella flexneri 2a str. 301
gcuuauucauuacu

SEQ ID NO: 1980190 - RNA, 19 nt, Shigella flexneri 2a str. 301
gcuuauccggcaugcaauc

SEQ ID NO: 1980191 - RNA, 15 nt, Shigella flexneri 2a str. 301
gcuuaccaugccaac

SEQ ID NO: 1980192 - RNA, 21 nt, Shigella flexneri 2a str. 301
gcuuaccguccucuucccaga

SEQ ID NO: 1980193 - RNA, 22 nt, Shigella flexneri 2a str. 301
gcuuaccguccucuucccagac

SEQ ID NO: 1980194 - RNA, 13 nt, Shigella flexneri 2a str. 301
gcuuacaggcugg

SEQ ID NO: 1980195 - RNA, 17 nt, Shigella flexneri 2a str. 301
gcuuacgccugccagcu

SEQ ID NO: 1980196 - RNA, 22 nt, Shigella flexneri 2a str. 301
gcuuacgcugauuaaagacggc

SEQ ID NO: 1980197 - RNA, 13 nt, Shigella flexneri 2a str. 301
gcuuagaaauuca

SEQ ID NO: 1980198 - RNA, 14 nt, Shigella flexneri 2a str. 301
gcuuacucauccac

SEQ ID NO: 1980199 - RNA, 13 nt, Shigella flexneri 2a str. 301
gcuuacugaaaau

SEQ ID NO: 1980200 - RNA, 19 nt, Shigella flexneri 2a str. 301
gcuuccgguuguucaacca

SEQ ID NO: 1980201 - RNA, 15 nt, Shigella flexneri 2a str. 301
gcuuccggucugcga

SEQ ID NO: 1980202 - RNA, 18 nt, Shigella flexneri 2a str. 301
gcuuccugaguaauaacu

SEQ ID NO: 1980203 - RNA, 16 nt, Shigella flexneri 2a str. 301
gcuuccagcagaccuu

SEQ ID NO: 1980204 - RNA, 13 nt, Shigella flexneri 2a str. 301
gcuucccaaagau

SEQ ID NO: 1980205 - RNA, 15 nt, Shigella flexneri 2a str. 301
gcuucccaaagaucu

SEQ ID NO: 1980206 - RNA, 15 nt, Shigella flexneri 2a str. 301
gcuucauccagcagu

SEQ ID NO: 1980207 - RNA, 15 nt, Shigella flexneri 2a str. 301
gcuucaucgcccaca

SEQ ID NO: 1980208 - RNA, 14 nt, Shigella flexneri 2a str. 301
gcuucaugcuuaau

SEQ ID NO: 1980209 - RNA, 16 nt, Shigella flexneri 2a str. 301
gcuucaugcuuaauca

SEQ ID NO: 1980210 - RNA, 13 nt, Shigella flexneri 2a str. 301
gcuucauuuacau

SEQ ID NO: 1980211 - RNA, 20 nt, Shigella flexneri 2a str. 301
gcuucauugcucucuucucc

SEQ ID NO: 1980212 - RNA, 18 nt, Shigella flexneri 2a str. 301
gcuucauugcucucuucu

SEQ ID NO: 1980213 - RNA, 22 nt, Shigella flexneri 2a str. 301
gcuucagugacuucugccagcu

SEQ ID NO: 1980214 - RNA, 21 nt, Shigella flexneri 2a str. 301
gcuucagugacuucugccagc

SEQ ID NO: 1980215 - RNA, 17 nt, Shigella flexneri 2a str. 301
gcuucagcguaucccag

SEQ ID NO: 1980216 - RNA, 15 nt, Shigella flexneri 2a str. 301
gcuucauaaagauaa

SEQ ID NO: 1980217 - RNA, 18 nt, Shigella flexneri 2a str. 301
gcuucauaaagauaaugu

SEQ ID NO: 1980218 - RNA, 15 nt, Shigella flexneri 2a str. 301
gcuucauauagaucu

SEQ ID NO: 1980219 - RNA, 23 nt, Shigella flexneri 2a str. 301
gcuucgguuuuguugccgcccgu

SEQ ID NO: 1980220 - RNA, 14 nt, Shigella flexneri 2a str. 301
gcuucguccaugcu

SEQ ID NO: 1980221 - RNA, 14 nt, Shigella flexneri 2a str. 301
gcuucgcuucccaa

SEQ ID NO: 1980222 - RNA, 17 nt, Shigella flexneri 2a str. 301
gcuucgcuuaucaggcc

SEQ ID NO: 1980223 - RNA, 21 nt, Shigella flexneri 2a str. 301
gcuucgcggacaucguccagc

SEQ ID NO: 1980224 - RNA, 22 nt, Shigella flexneri 2a str. 301
gcuucgcggacaucguccagcu

SEQ ID NO: 1980225 - RNA, 23 nt, Shigella flexneri 2a str. 301
gcuucgcggacaucguccagcuu

SEQ ID NO: 1980226 - RNA, 19 nt, Shigella flexneri 2a str. 301
gcuucgcggacaucgucca

SEQ ID NO: 1980227 - RNA, 18 nt, Shigella flexneri 2a str. 301
gcuucgagcuggaagcca

SEQ ID NO: 1980228 - RNA, 14 nt, Shigella flexneri 2a str. 301
gcuucugcagcuuu

SEQ ID NO: 1980229 - RNA, 22 nt, Shigella flexneri 2a str. 301
gcuucugacuauauaaauuacc

SEQ ID NO: 1980230 - RNA, 23 nt, Shigella flexneri 2a str. 301
gcuucugcguucugauuuaaucu

SEQ ID NO: 1980231 - RNA, 18 nt, Shigella flexneri 2a str. 301
gcuucugccuuauccagc

SEQ ID NO: 1980232 - RNA, 13 nt, Shigella flexneri 2a str. 301
gcuucuggcuggc

SEQ ID NO: 1980233 - RNA, 15 nt, Shigella flexneri 2a str. 301
gcuucuggcggcggc

SEQ ID NO: 1980234 - RNA, 13 nt, Shigella flexneri 2a str. 301
gcuucguuuucag

SEQ ID NO: 1980235 - RNA, 19 nt, Shigella flexneri 2a str. 301
gcuucucccagccgcccug

SEQ ID NO: 1980236 - RNA, 18 nt, Shigella flexneri 2a str. 301
gcuucucgugaaacucac

SEQ ID NO: 1980237 - RNA, 21 nt, Shigella flexneri 2a str. 301
gcuucucgugaaacucacgca

SEQ ID NO: 1980238 - RNA, 16 nt, Shigella flexneri 2a str. 301
gcuugcgucauccagc

SEQ ID NO: 1980239 - RNA, 14 nt, Shigella flexneri 2a str. 301
gcuugcucuggucu

SEQ ID NO: 1980240 - RNA, 17 nt, Shigella flexneri 2a str. 301
gcuugccggaaccggau

SEQ ID NO: 1980241 - RNA, 20 nt, Shigella flexneri 2a str. 301
gcuugccgggccguaauauu

SEQ ID NO: 1980242 - RNA, 18 nt, Shigella flexneri 2a str. 301
gcuugccguugagggcgc

SEQ ID NO: 1980243 - RNA, 19 nt, Shigella flexneri 2a str. 301
gcuugcaggaucagcuccg

SEQ ID NO: 1980244 - RNA, 22 nt, Shigella flexneri 2a str. 301
gcuugacgcgucuuaucaggcc

SEQ ID NO: 1980245 - RNA, 22 nt, Shigella flexneri 2a str. 301
gcuugacgugucuuaucaggcc

SEQ ID NO: 1980246 - RNA, 19 nt, Shigella flexneri 2a str. 301
gcuugagcaggagcagcag

SEQ ID NO: 1980247 - RNA, 18 nt, Shigella flexneri 2a str. 301
gcuugauccuacacauac

SEQ ID NO: 1980248 - RNA, 23 nt, Shigella flexneri 2a str. 301
gcuugaucaauaacgccaugagc

SEQ ID NO: 1980249 - RNA, 19 nt, Shigella flexneri 2a str. 301
gcuugaggaucaacugaaa

SEQ ID NO: 1980250 - RNA, 16 nt, Shigella flexneri 2a str. 301
gcuugaaaaauaaagu

SEQ ID NO: 1980251 - RNA, 20 nt, Shigella flexneri 2a str. 301
gcuucuuuuuuauggcuggc

SEQ ID NO: 1980252 - RNA, 22 nt, Shigella flexneri 2a str. 301
gcuucuucugccgcuuccagca

SEQ ID NO: 1980253 - RNA, 15 nt, Shigella flexneri 2a str. 301
gcuucuguuauucca

SEQ ID NO: 1980254 - RNA, 18 nt, Shigella flexneri 2a str. 301
aaaggccagcaaucccca

SEQ ID NO: 1980255 - RNA, 17 nt, Shigella flexneri 2a str. 301
aaaggccagcaaucccc

SEQ ID NO: 1980256 - RNA, 16 nt, Shigella flexneri 2a str. 301
aaaggccagccaggca

SEQ ID NO: 1980257 - RNA, 15 nt, Shigella flexneri 2a str. 301
aaaggcaccuggaaa

SEQ ID NO: 1980258 - RNA, 16 nt, Shigella flexneri 2a str. 301
gcuuggcaagcccagc

SEQ ID NO: 1980259 - RNA, 19 nt, Shigella flexneri 2a str. 301
gcuuggcaagcccagcacc

SEQ ID NO: 1980260 - RNA, 23 nt, Shigella flexneri 2a str. 301
gcuugcugauaacgugcagcuuu

SEQ ID NO: 1980261 - RNA, 18 nt, Shigella flexneri 2a str. 301
gcuugguuuugccaugca

SEQ ID NO: 1980262 - RNA, 16 nt, Shigella flexneri 2a str. 301
gcuuguggugaaacua

SEQ ID NO: 1980263 - RNA, 19 nt, Shigella flexneri 2a str. 301
aaaggcgugaacuucgcca

SEQ ID NO: 1980264 - RNA, 20 nt, Shigella flexneri 2a str. 301
aaaggcggcagaacagaaca

SEQ ID NO: 1980265 - RNA, 21 nt, Shigella flexneri 2a str. 301
aaaggcgagguauaaaaugag

SEQ ID NO: 1980266 - RNA, 20 nt, Shigella flexneri 2a str. 301
gcuugguucuccaaauacau

SEQ ID NO: 1980267 - RNA, 21 nt, Shigella flexneri 2a str. 301
gcuuucacgccgccguuagcu

SEQ ID NO: 1980268 - RNA, 21 nt, Shigella flexneri 2a str. 301
gcuuucacgcucgguccuucg

SEQ ID NO: 1980269 - RNA, 16 nt, Shigella flexneri 2a str. 301
gcuuucacuauuucuu

SEQ ID NO: 1980270 - RNA, 18 nt, Shigella flexneri 2a str. 301
gcuuucacuauuucuuug

SEQ ID NO: 1980271 - RNA, 21 nt, Shigella flexneri 2a str. 301
gcuuucaccugcgcgugaccg

SEQ ID NO: 1980272 - RNA, 21 nt, Shigella flexneri 2a str. 301
gcuuucacucugaaaacgcug

SEQ ID NO: 1980273 - RNA, 21 nt, Shigella flexneri 2a str. 301
gcuuucacucaguguuggaug

SEQ ID NO: 1980274 - RNA, 15 nt, Shigella flexneri 2a str. 301
gcuuucacgccgccg

SEQ ID NO: 1980275 - RNA, 23 nt, Shigella flexneri 2a str. 301
gcuuuauccugcccacuccagcu

SEQ ID NO: 1980276 - RNA, 23 nt, Shigella flexneri 2a str. 301
gcuuuccaccaucacgccaauaa

SEQ ID NO: 1980277 - RNA, 17 nt, Shigella flexneri 2a str. 301
gcuuucauauuccagcc

SEQ ID NO: 1980278 - RNA, 20 nt, Shigella flexneri 2a str. 301
gcuuucaguucuagaacuaa

SEQ ID NO: 1980279 - RNA, 17 nt, Shigella flexneri 2a str. 301
gcuuucagcagcggcuc

SEQ ID NO: 1980280 - RNA, 17 nt, Shigella flexneri 2a str. 301
gcuuucagcacuuaucu

SEQ ID NO: 1980281 - RNA, 18 nt, Shigella flexneri 2a str. 301
gcuuucaggucagcgaau

SEQ ID NO: 1980282 - RNA, 22 nt, Shigella flexneri 2a str. 301
gcuuuccaggcaucagcaacac

SEQ ID NO: 1980283 - RNA, 18 nt, Shigella flexneri 2a str. 301
gcuuuccagcacaaagcg

SEQ ID NO: 1980284 - RNA, 18 nt, Shigella flexneri 2a str. 301
gcuuuccagcuucaaauu

SEQ ID NO: 1980285 - RNA, 17 nt, Shigella flexneri 2a str. 301
gcuuguuucauuacucg

SEQ ID NO: 1980286 - RNA, 16 nt, Shigella flexneri 2a str. 301
gcuuuacccagccaug

SEQ ID NO: 1980287 - RNA, 20 nt, Shigella flexneri 2a str. 301
gcuuuacaauauccagcgcg

SEQ ID NO: 1980288 - RNA, 21 nt, Shigella flexneri 2a str. 301
gcuuuaccaccgucaaaaaaa

SEQ ID NO: 1980289 - RNA, 14 nt, Shigella flexneri 2a str. 301
gcuuuagggcuggc

SEQ ID NO: 1980290 - RNA, 15 nt, Shigella flexneri 2a str. 301
gcuuuauacaaauga

SEQ ID NO: 1980291 - RNA, 22 nt, Shigella flexneri 2a str. 301
gcuccaugagaagcugaaauca

SEQ ID NO: 1980292 - RNA, 20 nt, Shigella flexneri 2a str. 301
gcuccagcguaccugccgcg

SEQ ID NO: 1980293 - RNA, 16 nt, Shigella flexneri 2a str. 301
gcuccagcguaccugc

SEQ ID NO: 1980294 - RNA, 14 nt, Shigella flexneri 2a str. 301
gcuccauccaccag

SEQ ID NO: 1980295 - RNA, 16 nt, Shigella flexneri 2a str. 301
gcuccauaauugccag

SEQ ID NO: 1980296 - RNA, 22 nt, Shigella flexneri 2a str. 301
gcuccgcaagcgaaugaggcag

SEQ ID NO: 1980297 - RNA, 22 nt, Shigella flexneri 2a str. 301
gcucccugccaguccugcucaa

SEQ ID NO: 1980298 - RNA, 16 nt, Shigella flexneri 2a str. 301
gcucccuuaucgggaa

SEQ ID NO: 1980299 - RNA, 17 nt, Shigella flexneri 2a str. 301
gcucccuucggggcggc

SEQ ID NO: 1980300 - RNA, 17 nt, Shigella flexneri 2a str. 301
gcuccuccuucucaccu

SEQ ID NO: 1980301 - RNA, 19 nt, Shigella flexneri 2a str. 301
gcuccucgaguccuuccag

SEQ ID NO: 1980302 - RNA, 14 nt, Shigella flexneri 2a str. 301
gcuccguuucccuc

SEQ ID NO: 1980303 - RNA, 24 nt, Shigella flexneri 2a str. 301
gcuccggcaccucccccugagcag

SEQ ID NO: 1980304 - RNA, 21 nt, Shigella flexneri 2a str. 301
gcuccgggaaaacgcuggcag

SEQ ID NO: 1980305 - RNA, 21 nt, Shigella flexneri 2a str. 301
gcuccggcggcacagccagcg

SEQ ID NO: 1980306 - RNA, 22 nt, Shigella flexneri 2a str. 301
gcuccgggugugacaacaacau

SEQ ID NO: 1980307 - RNA, 18 nt, Shigella flexneri 2a str. 301
gcuccagccgcucccuuc

SEQ ID NO: 1980308 - RNA, 13 nt, Shigella flexneri 2a str. 301
gcuccagcgggcg

SEQ ID NO: 1980309 - RNA, 21 nt, Shigella flexneri 2a str. 301
gcuccagcgggcgaaucaacu

SEQ ID NO: 1980310 - RNA, 23 nt, Shigella flexneri 2a str. 301
gcuccacaagaaugccugccagc

SEQ ID NO: 1980311 - RNA, 16 nt, Shigella flexneri 2a str. 301
gcuccacaagcuccgg

SEQ ID NO: 1980312 - RNA, 20 nt, Shigella flexneri 2a str. 301
gcuccagauuaccagcgaca

SEQ ID NO: 1980313 - RNA, 20 nt, Shigella flexneri 2a str. 301
gcuccagcaaaaagcggcuc

SEQ ID NO: 1980314 - RNA, 16 nt, Shigella flexneri 2a str. 301
gcucaucggcauacag

SEQ ID NO: 1980315 - RNA, 15 nt, Shigella flexneri 2a str. 301
gcucauagcggcugc

SEQ ID NO: 1980316 - RNA, 17 nt, Shigella flexneri 2a str. 301
gcucauacucugucuga

SEQ ID NO: 1980317 - RNA, 15 nt, Shigella flexneri 2a str. 301
gcucauauuccugca

SEQ ID NO: 1980318 - RNA, 16 nt, Shigella flexneri 2a str. 301
gcucaucagcccggca

SEQ ID NO: 1980319 - RNA, 12 nt, Shigella flexneri 2a str. 301
gcucaucagcgg

SEQ ID NO: 1980320 - RNA, 21 nt, Shigella flexneri 2a str. 301
gcucaucagcggcgaagccua

SEQ ID NO: 1980321 - RNA, 16 nt, Shigella flexneri 2a str. 301
gcucaucagcuccggu

SEQ ID NO: 1980322 - RNA, 19 nt, Shigella flexneri 2a str. 301
gcucaucaggccuacaaaa

SEQ ID NO: 1980323 - RNA, 16 nt, Shigella flexneri 2a str. 301
gcggucaaaagcugca

SEQ ID NO: 1980324 - RNA, 13 nt, Shigella flexneri 2a str. 301
gcggucaaccauc

SEQ ID NO: 1980325 - RNA, 13 nt, Shigella flexneri 2a str. 301
gcgguaauggucg

SEQ ID NO: 1980326 - RNA, 13 nt, Shigella flexneri 2a str. 301
gcgguaucaccac

SEQ ID NO: 1980327 - RNA, 13 nt, Shigella flexneri 2a str. 301
gcuccuguugaug

SEQ ID NO: 1980328 - RNA, 16 nt, Shigella flexneri 2a str. 301
gcuccuuaauaaaaua

SEQ ID NO: 1980329 - RNA, 16 nt, Shigella flexneri 2a str. 301
gcuccugcauugacuc

SEQ ID NO: 1980330 - RNA, 13 nt, Shigella flexneri 2a str. 301
gcuccucuuucau

SEQ ID NO: 1980331 - RNA, 15 nt, Shigella flexneri 2a str. 301
gcucgacaagauauu

SEQ ID NO: 1980332 - RNA, 18 nt, Shigella flexneri 2a str. 301
gcucgaacagcugguuga

SEQ ID NO: 1980333 - RNA, 15 nt, Shigella flexneri 2a str. 301
gcucgaacgccucug

SEQ ID NO: 1980334 - RNA, 12 nt, Shigella flexneri 2a str. 301
gcucgcacuuuc

SEQ ID NO: 1980335 - RNA, 18 nt, Shigella flexneri 2a str. 301
gcucgcgguuagcggcuu

SEQ ID NO: 1980336 - RNA, 21 nt, Shigella flexneri 2a str. 301
gcucgcguucgauggcgcgcc

SEQ ID NO: 1980337 - RNA, 15 nt, Shigella flexneri 2a str. 301
gcucgccgcagagau

SEQ ID NO: 1980338 - RNA, 12 nt, Shigella flexneri 2a str. 301
gcucgccgccgc

SEQ ID NO: 1980339 - RNA, 16 nt, Shigella flexneri 2a str. 301
gcucgcuggcaggccg

SEQ ID NO: 1980340 - RNA, 19 nt, Shigella flexneri 2a str. 301
gcugccgggguaaagcgcg

SEQ ID NO: 1980341 - RNA, 14 nt, Shigella flexneri 2a str. 301
gcugccgucaauuu

SEQ ID NO: 1980342 - RNA, 17 nt, Shigella flexneri 2a str. 301
gcugccucucuucgcug

SEQ ID NO: 1980343 - RNA, 20 nt, Shigella flexneri 2a str. 301
gcugccucucuucgcugcug

SEQ ID NO: 1980344 - RNA, 14 nt, Shigella flexneri 2a str. 301
gcugccuacacaau

SEQ ID NO: 1980345 - RNA, 23 nt, Shigella flexneri 2a str. 301
gcugccuggcccauagacagggu

SEQ ID NO: 1980346 - RNA, 20 nt, Shigella flexneri 2a str. 301
gcugccuguacggcagugaa

SEQ ID NO: 1980347 - RNA, 20 nt, Shigella flexneri 2a str. 301
gcugcgcaggaugcuaagcg

SEQ ID NO: 1980348 - RNA, 23 nt, Shigella flexneri 2a str. 301
gcugccggaaggcagccuuucuc

SEQ ID NO: 1980349 - RNA, 21 nt, Shigella flexneri 2a str. 301
gcugccggcacaggcaucacu

SEQ ID NO: 1980350 - RNA, 21 nt, Shigella flexneri 2a str. 301
gcugccgccaguucuuccagu

SEQ ID NO: 1980351 - RNA, 15 nt, Shigella flexneri 2a str. 301
gcugccgccaguucu

SEQ ID NO: 1980352 - RNA, 14 nt, Shigella flexneri 2a str. 301
gcugccgcgccaga

SEQ ID NO: 1980353 - RNA, 16 nt, Shigella flexneri 2a str. 301
gcugccgacaaaugca

SEQ ID NO: 1980354 - RNA, 20 nt, Shigella flexneri 2a str. 301
gcugccgaaccacugaugga

SEQ ID NO: 1980355 - RNA, 15 nt, Shigella flexneri 2a str. 301
gcugccagccaggau

SEQ ID NO: 1980356 - RNA, 22 nt, Shigella flexneri 2a str. 301
gcugccagaaaucggccuucca

SEQ ID NO: 1980357 - RNA, 22 nt, Shigella flexneri 2a str. 301
gcugccagcgauuuaucggcaa

SEQ ID NO: 1980358 - RNA, 14 nt, Shigella flexneri 2a str. 301
gcugccagccgccg

SEQ ID NO: 1980359 - RNA, 16 nt, Shigella flexneri 2a str. 301
gcugcguuccggcaug

SEQ ID NO: 1980360 - RNA, 20 nt, Shigella flexneri 2a str. 301
gcugcguuugcccuaaagcg

SEQ ID NO: 1980361 - RNA, 22 nt, Shigella flexneri 2a str. 301
gcugcucaggcgaggcggacug

SEQ ID NO: 1980362 - RNA, 13 nt, Shigella flexneri 2a str. 301
gcugcuauccagu

SEQ ID NO: 1980363 - RNA, 11 nt, Shigella flexneri 2a str. 301
gcugcgcccgc

SEQ ID NO: 1980364 - RNA, 23 nt, Shigella flexneri 2a str. 301
gcugcgccaguugcuuauccagc

SEQ ID NO: 1980365 - RNA, 19 nt, Shigella flexneri 2a str. 301
gcuggauuaacgcugggga

SEQ ID NO: 1980366 - RNA, 16 nt, Shigella flexneri 2a str. 301
gcuggaagauguuucu

SEQ ID NO: 1980367 - RNA, 22 nt, Shigella flexneri 2a str. 301
gcuggaaagcucuucaugcagc

SEQ ID NO: 1980368 - RNA, 17 nt, Shigella flexneri 2a str. 301
gcugcugcucaaaggca

SEQ ID NO: 1980369 - RNA, 17 nt, Shigella flexneri 2a str. 301
gcugaaaucacagcggc

SEQ ID NO: 1980370 - RNA, 20 nt, Shigella flexneri 2a str. 301
gcucucgcagcucaucaaca

SEQ ID NO: 1980371 - RNA, 14 nt, Shigella flexneri 2a str. 301
gcucucgccagcac

SEQ ID NO: 1980372 - RNA, 18 nt, Shigella flexneri 2a str. 301
gcugaacuggcgaagccu

SEQ ID NO: 1980373 - RNA, 13 nt, Shigella flexneri 2a str. 301
gcugaacuuaugc

SEQ ID NO: 1980374 - RNA, 15 nt, Shigella flexneri 2a str. 301
gcugaacgcaccuuc

SEQ ID NO: 1980375 - RNA, 16 nt, Shigella flexneri 2a str. 301
gcugaaggcacagaaa

SEQ ID NO: 1980376 - RNA, 22 nt, Shigella flexneri 2a str. 301
gcugaaggcacagaaaaauaac

SEQ ID NO: 1980377 - RNA, 18 nt, Shigella flexneri 2a str. 301
gcugaagaaaauggccag

SEQ ID NO: 1980378 - RNA, 20 nt, Shigella flexneri 2a str. 301
gcugaauaauccccauauca

SEQ ID NO: 1980379 - RNA, 23 nt, Shigella flexneri 2a str. 301
gcugaauuuuuuucucgcggcgg

SEQ ID NO: 1980380 - RNA, 16 nt, Shigella flexneri 2a str. 301
gcugaauuugaccuug

SEQ ID NO: 1980381 - RNA, 21 nt, Shigella flexneri 2a str. 301
gcugaauuugaccuugcggcu

SEQ ID NO: 1980382 - RNA, 18 nt, Shigella flexneri 2a str. 301
gcugacaaaucagaggcu

SEQ ID NO: 1980383 - RNA, 19 nt, Shigella flexneri 2a str. 301
gcugaaucgccaaaaacau

SEQ ID NO: 1980384 - RNA, 19 nt, Shigella flexneri 2a str. 301
gcugacagcgcgucuugua

SEQ ID NO: 1980385 - RNA, 20 nt, Shigella flexneri 2a str. 301
gcugacauaaacaccagcaa

SEQ ID NO: 1980386 - RNA, 18 nt, Shigella flexneri 2a str. 301
gcugacaggcgcugauga

SEQ ID NO: 1980387 - RNA, 23 nt, Shigella flexneri 2a str. 301
gcugacauaaacaccagcaauaa

SEQ ID NO: 1980388 - RNA, 17 nt, Shigella flexneri 2a str. 301
gcugacgcaucuucucc

SEQ ID NO: 1980389 - RNA, 22 nt, Shigella flexneri 2a str. 301
gcugcaauaaaauaucuuccac

SEQ ID NO: 1980390 - RNA, 22 nt, Shigella flexneri 2a str. 301
gcugcaagaugaauaauguuua

SEQ ID NO: 1980391 - RNA, 12 nt, Shigella flexneri 2a str. 301
gcugauuuuucu

SEQ ID NO: 1980392 - RNA, 19 nt, Shigella flexneri 2a str. 301
gcugauuuuuuuucaaccu

SEQ ID NO: 1980393 - RNA, 16 nt, Shigella flexneri 2a str. 301
gcugcaaaaaauugcg

SEQ ID NO: 1980394 - RNA, 21 nt, Shigella flexneri 2a str. 301
gcugauuuugcugaucggcaa

SEQ ID NO: 1980395 - RNA, 21 nt, Shigella flexneri 2a str. 301
gcugcaaagcauuuuuucaca

SEQ ID NO: 1980396 - RNA, 21 nt, Shigella flexneri 2a str. 301
gcugcacugguuuccgccagc

SEQ ID NO: 1980397 - RNA, 23 nt, Shigella flexneri 2a str. 301
gcugauuaugucaucaucgccac

SEQ ID NO: 1980398 - RNA, 20 nt, Shigella flexneri 2a str. 301
gcugauucucccucaucauu

SEQ ID NO: 1980399 - RNA, 14 nt, Shigella flexneri 2a str. 301
gcugauuucaccau

SEQ ID NO: 1980400 - RNA, 16 nt, Shigella flexneri 2a str. 301
gcugauuucaccaucu

SEQ ID NO: 1980401 - RNA, 21 nt, Shigella flexneri 2a str. 301
gcugauuucaccccacaccac

SEQ ID NO: 1980402 - RNA, 15 nt, Shigella flexneri 2a str. 301
gcugaugucagcacu

SEQ ID NO: 1980403 - RNA, 21 nt, Shigella flexneri 2a str. 301
gcugauguuguuucucuuucu

SEQ ID NO: 1980404 - RNA, 14 nt, Shigella flexneri 2a str. 301
gcugagcacuaucc

SEQ ID NO: 1980405 - RNA, 11 nt, Shigella flexneri 2a str. 301
gcugagauacu

SEQ ID NO: 1980406 - RNA, 20 nt, Shigella flexneri 2a str. 301
gcugauauucgacaccaucu

SEQ ID NO: 1980407 - RNA, 14 nt, Shigella flexneri 2a str. 301
uaaacugagccaaa

SEQ ID NO: 1980408 - RNA, 23 nt, Shigella flexneri 2a str. 301
uaaacuggauggcucugauugau

SEQ ID NO: 1980409 - RNA, 20 nt, Shigella flexneri 2a str. 301
uaaacuuacugacaucaaac

SEQ ID NO: 1980410 - RNA, 13 nt, Shigella flexneri 2a str. 301
uaaacuucaccag

SEQ ID NO: 1980411 - RNA, 14 nt, Shigella flexneri 2a str. 301
uaaagauaauguaa

SEQ ID NO: 1980412 - RNA, 15 nt, Shigella flexneri 2a str. 301
uaaagaccauaaaua

SEQ ID NO: 1980413 - RNA, 20 nt, Shigella flexneri 2a str. 301
uaaacgcuuuuuugagcagc

SEQ ID NO: 1980414 - RNA, 14 nt, Shigella flexneri 2a str. 301
uaaacgccuuaucc

SEQ ID NO: 1980415 - RNA, 15 nt, Shigella flexneri 2a str. 301
uaaacgcuauuugcc

SEQ ID NO: 1980416 - RNA, 17 nt, Shigella flexneri 2a str. 301
uaaacgccguucuucag

SEQ ID NO: 1980417 - RNA, 19 nt, Shigella flexneri 2a str. 301
uaaacgccggaugacacau

SEQ ID NO: 1980418 - RNA, 21 nt, Shigella flexneri 2a str. 301
uaaacgccugcuuaucgcccu

SEQ ID NO: 1980419 - RNA, 21 nt, Shigella flexneri 2a str. 301
uaaaccgucagcaccagggaa

SEQ ID NO: 1980420 - RNA, 17 nt, Shigella flexneri 2a str. 301
uaaaccuccagcaucag

SEQ ID NO: 1980421 - RNA, 19 nt, Shigella flexneri 2a str. 301
uaaaccggacaauaaaaaa

SEQ ID NO: 1980422 - RNA, 23 nt, Shigella flexneri 2a str. 301
uaaaccaccugggucugcagaua

SEQ ID NO: 1980423 - RNA, 15 nt, Shigella flexneri 2a str. 301
uaaaccacccaccag

SEQ ID NO: 1980424 - RNA, 17 nt, Shigella flexneri 2a str. 301
uaaaccaacaaaacuca

SEQ ID NO: 1980425 - RNA, 15 nt, Shigella flexneri 2a str. 301
guuuuuauuuugccc

SEQ ID NO: 1980426 - RNA, 15 nt, Shigella flexneri 2a str. 301
guuuuuaucuucaca

SEQ ID NO: 1980427 - RNA, 22 nt, Shigella flexneri 2a str. 301
guuuuucauugcacucuccucc

SEQ ID NO: 1980428 - RNA, 20 nt, Shigella flexneri 2a str. 301
uaaacaagcguacaaaauua

SEQ ID NO: 1980429 - RNA, 18 nt, Shigella flexneri 2a str. 301
uaaagcugccgucaauuu

SEQ ID NO: 1980430 - RNA, 21 nt, Shigella flexneri 2a str. 301
uaaagcccucaccgaagcgag

SEQ ID NO: 1980431 - RNA, 19 nt, Shigella flexneri 2a str. 301
uaaagcccauaccacagca

SEQ ID NO: 1980432 - RNA, 21 nt, Shigella flexneri 2a str. 301
uaaagcaucaauugcuaccga

SEQ ID NO: 1980433 - RNA, 19 nt, Shigella flexneri 2a str. 301
uaaagcauuuucauccauu

SEQ ID NO: 1980434 - RNA, 13 nt, Shigella flexneri 2a str. 301
uaaagaugccauu

SEQ ID NO: 1980435 - RNA, 22 nt, Shigella flexneri 2a str. 301
uaaagaugccauuggcauaaau

SEQ ID NO: 1980436 - RNA, 21 nt, Shigella flexneri 2a str. 301
uaaaguaggccagauaagacg

SEQ ID NO: 1980437 - RNA, 22 nt, Shigella flexneri 2a str. 301
uaaagucagcguuauagcgcau

SEQ ID NO: 1980438 - RNA, 19 nt, Shigella flexneri 2a str. 301
uaaaguuaccuguggcgua

SEQ ID NO: 1980439 - RNA, 14 nt, Shigella flexneri 2a str. 301
uaaaguuagucgcg

SEQ ID NO: 1980440 - RNA, 18 nt, Shigella flexneri 2a str. 301
uaaaguugcucucaaaga

SEQ ID NO: 1980441 - RNA, 18 nt, Shigella flexneri 2a str. 301
uaaauauauaaaaaaaca

SEQ ID NO: 1980442 - RNA, 13 nt, Shigella flexneri 2a str. 301
uaaauauaaaaca

SEQ ID NO: 1980443 - RNA, 10 nt, Shigella flexneri 2a str. 301
uaaauaauaa

SEQ ID NO: 1980444 - RNA, 18 nt, Shigella flexneri 2a str. 301
uaaaguuuggcugugccc

SEQ ID NO: 1980445 - RNA, 13 nt, Shigella flexneri 2a str. 301
uaaauaacuuuua

SEQ ID NO: 1980446 - RNA, 21 nt, Shigella flexneri 2a str. 301
uaaauauuaauacaacaacac

SEQ ID NO: 1980447 - RNA, 21 nt, Shigella flexneri 2a str. 301
uaaauauuaaggguaaaagga

SEQ ID NO: 1980448 - RNA, 15 nt, Shigella flexneri 2a str. 301
uaaaucacgcuuauc

SEQ ID NO: 1980449 - RNA, 20 nt, Shigella flexneri 2a str. 301
uaaaucacgcuuaucgcccu

SEQ ID NO: 1980450 - RNA, 11 nt, Shigella flexneri 2a str. 301
uaaaucagauc

SEQ ID NO: 1980451 - RNA, 16 nt, Shigella flexneri 2a str. 301
uaaauaucaucaaaau

SEQ ID NO: 1980452 - RNA, 18 nt, Shigella flexneri 2a str. 301
uaaaucaucggguuacug

SEQ ID NO: 1980453 - RNA, 12 nt, Shigella flexneri 2a str. 301
uaaaucauaaua

SEQ ID NO: 1980454 - RNA, 15 nt, Shigella flexneri 2a str. 301
uaaaucauaauaaag

SEQ ID NO: 1980455 - RNA, 16 nt, Shigella flexneri 2a str. 301
uaaaucauauaucgca

SEQ ID NO: 1980456 - RNA, 21 nt, Shigella flexneri 2a str. 301
uaacacuuguuaugagauaau

SEQ ID NO: 1980457 - RNA, 19 nt, Shigella flexneri 2a str. 301
uaacacgcucuggcaggcu

SEQ ID NO: 1980458 - RNA, 22 nt, Shigella flexneri 2a str. 301
uaacacgcucuggcaggcuuca

SEQ ID NO: 1980459 - RNA, 13 nt, Shigella flexneri 2a str. 301
uaacacugauaac

SEQ ID NO: 1980460 - RNA, 23 nt, Shigella flexneri 2a str. 301
uaacagaaugcgggcgaaaacau

SEQ ID NO: 1980461 - RNA, 19 nt, Shigella flexneri 2a str. 301
uaacagaacgcauaacagc

SEQ ID NO: 1980462 - RNA, 21 nt, Shigella flexneri 2a str. 301
uaacagaacgcauaacagccc

SEQ ID NO: 1980463 - RNA, 15 nt, Shigella flexneri 2a str. 301
uaacagaaauggccc

SEQ ID NO: 1980464 - RNA, 20 nt, Shigella flexneri 2a str. 301
uaacaucgccagaaaucagc

SEQ ID NO: 1980465 - RNA, 19 nt, Shigella flexneri 2a str. 301
uaacaucgccagaaaucag

SEQ ID NO: 1980466 - RNA, 10 nt, Shigella flexneri 2a str. 301
uaacauccag

SEQ ID NO: 1980467 - RNA, 16 nt, Shigella flexneri 2a str. 301
uaaccaccaguaaauu

SEQ ID NO: 1980468 - RNA, 21 nt, Shigella flexneri 2a str. 301
uaaccagcguuuccagcacca

SEQ ID NO: 1980469 - RNA, 23 nt, Shigella flexneri 2a str. 301
uaaccagccuggcggaaagccag

SEQ ID NO: 1980470 - RNA, 18 nt, Shigella flexneri 2a str. 301
uaaccagccaaauaaaau

SEQ ID NO: 1980471 - RNA, 14 nt, Shigella flexneri 2a str. 301
uaaccagccaaaua

SEQ ID NO: 1980472 - RNA, 15 nt, Shigella flexneri 2a str. 301
uaaccagcaccagcu

SEQ ID NO: 1980473 - RNA, 22 nt, Shigella flexneri 2a str. 301
uaaccagcacguugaacugacu

SEQ ID NO: 1980474 - RNA, 16 nt, Shigella flexneri 2a str. 301
uaaccaucuucuucac

SEQ ID NO: 1980475 - RNA, 16 nt, Shigella flexneri 2a str. 301
uaaccaguccauuacc

SEQ ID NO: 1980476 - RNA, 16 nt, Shigella flexneri 2a str. 301
uaaccaucaaaacgcu

SEQ ID NO: 1980477 - RNA, 18 nt, Shigella flexneri 2a str. 301
uaacgguguaaugccagu

SEQ ID NO: 1980478 - RNA, 19 nt, Shigella flexneri 2a str. 301
uaacguaaaaacccgcuuc

SEQ ID NO: 1980479 - RNA, 21 nt, Shigella flexneri 2a str. 301
uaacgguaaagcccucaccga

SEQ ID NO: 1980480 - RNA, 22 nt, Shigella flexneri 2a str. 301
uaacggcuggccacaaaccuua

SEQ ID NO: 1980481 - RNA, 21 nt, Shigella flexneri 2a str. 301
uaacggaggacuuauggcugg

SEQ ID NO: 1980482 - RNA, 20 nt, Shigella flexneri 2a str. 301
uaacggcagcaaggcuauuc

SEQ ID NO: 1980483 - RNA, 14 nt, Shigella flexneri 2a str. 301
uaacggccugacca

SEQ ID NO: 1980484 - RNA, 22 nt, Shigella flexneri 2a str. 301
uaacggcucacgcccaucagca

SEQ ID NO: 1980485 - RNA, 17 nt, Shigella flexneri 2a str. 301
uaacgccuuuuccagcg

SEQ ID NO: 1980486 - RNA, 15 nt, Shigella flexneri 2a str. 301
uaacgccuuuuccag

SEQ ID NO: 1980487 - RNA, 16 nt, Shigella flexneri 2a str. 301
uaacgccuuuuccagc

SEQ ID NO: 1980488 - RNA, 21 nt, Shigella flexneri 2a str. 301
uaacgccggagagaaaaaccu

SEQ ID NO: 1980489 - RNA, 19 nt, Shigella flexneri 2a str. 301
uaacgccuucccuuucagc

SEQ ID NO: 1980490 - RNA, 13 nt, Shigella flexneri 2a str. 301
uaacgcuggggau

SEQ ID NO: 1980491 - RNA, 19 nt, Shigella flexneri 2a str. 301
uaacgcgggcuucuucuuu

SEQ ID NO: 1980492 - RNA, 17 nt, Shigella flexneri 2a str. 301
uaacgccccggcaaaac

SEQ ID NO: 1980493 - RNA, 15 nt, Shigella flexneri 2a str. 301
uaacgccccaaucca

SEQ ID NO: 1980494 - RNA, 22 nt, Shigella flexneri 2a str. 301
uaacgcaucggcuaaaccauca

SEQ ID NO: 1980495 - RNA, 21 nt, Shigella flexneri 2a str. 301
uaacgccaauucauuccuuga

SEQ ID NO: 1980496 - RNA, 23 nt, Shigella flexneri 2a str. 301
uaacgccaauucauuccuugaaa

SEQ ID NO: 1980497 - RNA, 23 nt, Shigella flexneri 2a str. 301
uaacgcagaaucuucuucucagc

SEQ ID NO: 1980498 - RNA, 22 nt, Shigella flexneri 2a str. 301
uaacgcagggcuguuuaucgug

SEQ ID NO: 1980499 - RNA, 17 nt, Shigella flexneri 2a str. 301
uaacgcacacauccaca

SEQ ID NO: 1980500 - RNA, 21 nt, Shigella flexneri 2a str. 301
uaaccgguacgccgcguuuau

SEQ ID NO: 1980501 - RNA, 22 nt, Shigella flexneri 2a str. 301
uaaccgggagauuuucuccugc

SEQ ID NO: 1980502 - RNA, 14 nt, Shigella flexneri 2a str. 301
uaaccgucacguuc

SEQ ID NO: 1980503 - RNA, 19 nt, Shigella flexneri 2a str. 301
uaaccgggguuucacccac

SEQ ID NO: 1980504 - RNA, 20 nt, Shigella flexneri 2a str. 301
uaaccgaccuucacgcugcg

SEQ ID NO: 1980505 - RNA, 13 nt, Shigella flexneri 2a str. 301
uaaccguuuugug

SEQ ID NO: 1980506 - RNA, 14 nt, Shigella flexneri 2a str. 301
uaaccuaaaugcuc

SEQ ID NO: 1980507 - RNA, 15 nt, Shigella flexneri 2a str. 301
uaaccguuuccuuga

SEQ ID NO: 1980508 - RNA, 16 nt, Shigella flexneri 2a str. 301
uaaccguccaguugug

SEQ ID NO: 1980509 - RNA, 16 nt, Shigella flexneri 2a str. 301
uaacaacgugguuuuc

SEQ ID NO: 1980510 - RNA, 22 nt, Shigella flexneri 2a str. 301
uaacaacgugugcuuuguucau

SEQ ID NO: 1980511 - RNA, 22 nt, Shigella flexneri 2a str. 301
uaacaacuggcggucaugacga

SEQ ID NO: 1980512 - RNA, 14 nt, Shigella flexneri 2a str. 301
uaacaaaaaacaaa

SEQ ID NO: 1980513 - RNA, 23 nt, Shigella flexneri 2a str. 301
uaaauuuuuucacuguucugaua

SEQ ID NO: 1980514 - RNA, 15 nt, Shigella flexneri 2a str. 301
uaacaccgauuuugu

SEQ ID NO: 1980515 - RNA, 21 nt, Shigella flexneri 2a str. 301
uaacaccgauuuuguaaaaga

SEQ ID NO: 1980516 - RNA, 15 nt, Shigella flexneri 2a str. 301
uaacaccaguaaaua

SEQ ID NO: 1980517 - RNA, 13 nt, Shigella flexneri 2a str. 301
uaacaccauccau

SEQ ID NO: 1980518 - RNA, 13 nt, Shigella flexneri 2a str. 301
uaacaccagaaug

SEQ ID NO: 1980519 - RNA, 14 nt, Shigella flexneri 2a str. 301
uaacaauuuaucag

SEQ ID NO: 1980520 - RNA, 18 nt, Shigella flexneri 2a str. 301
uaacaauuuaucagacaa

SEQ ID NO: 1980521 - RNA, 18 nt, Shigella flexneri 2a str. 301
uaaaugcugcagccaggg

SEQ ID NO: 1980522 - RNA, 22 nt, Shigella flexneri 2a str. 301
uaaauggcgaacgggauaaacg

SEQ ID NO: 1980523 - RNA, 17 nt, Shigella flexneri 2a str. 301
uaaaugcugcagccagg

SEQ ID NO: 1980524 - RNA, 14 nt, Shigella flexneri 2a str. 301
uaaaucccagugcc

SEQ ID NO: 1980525 - RNA, 20 nt, Shigella flexneri 2a str. 301
uaaaucccagugccugcaua

SEQ ID NO: 1980526 - RNA, 16 nt, Shigella flexneri 2a str. 301
uaaaucccaggcuuca

SEQ ID NO: 1980527 - RNA, 14 nt, Shigella flexneri 2a str. 301
uaaauccauaagau

SEQ ID NO: 1980528 - RNA, 15 nt, Shigella flexneri 2a str. 301
uaaauccaacaacac

SEQ ID NO: 1980529 - RNA, 15 nt, Shigella flexneri 2a str. 301
uaaauucuucugaau

SEQ ID NO: 1980530 - RNA, 17 nt, Shigella flexneri 2a str. 301
uaaauucucaauaucau

SEQ ID NO: 1980531 - RNA, 21 nt, Shigella flexneri 2a str. 301
uaaauucaaugaauuaaaaaa

SEQ ID NO: 1980532 - RNA, 20 nt, Shigella flexneri 2a str. 301
uaauaaaauuuacaguauaa

SEQ ID NO: 1980533 - RNA, 11 nt, Shigella flexneri 2a str. 301
uaauaaagcgg

SEQ ID NO: 1980534 - RNA, 15 nt, Shigella flexneri 2a str. 301
uaauaaagaugccau

SEQ ID NO: 1980535 - RNA, 13 nt, Shigella flexneri 2a str. 301
uaauaaauauuaa

SEQ ID NO: 1980536 - RNA, 20 nt, Shigella flexneri 2a str. 301
uaauaaauguggagauaaac

SEQ ID NO: 1980537 - RNA, 19 nt, Shigella flexneri 2a str. 301
uaauaaaugccggaagcug

SEQ ID NO: 1980538 - RNA, 21 nt, Shigella flexneri 2a str. 301
uaauaaaugccggaagcugca

SEQ ID NO: 1980539 - RNA, 13 nt, Shigella flexneri 2a str. 301
uaauaacacauau

SEQ ID NO: 1980540 - RNA, 15 nt, Shigella flexneri 2a str. 301
uaaguuacacaucau

SEQ ID NO: 1980541 - RNA, 19 nt, Shigella flexneri 2a str. 301
uaaguucaaguuugcuuca

SEQ ID NO: 1980542 - RNA, 17 nt, Shigella flexneri 2a str. 301
uaaguugccacgcuuca

SEQ ID NO: 1980543 - RNA, 14 nt, Shigella flexneri 2a str. 301
uaaguugaaucggc

SEQ ID NO: 1980544 - RNA, 23 nt, Shigella flexneri 2a str. 301
uaaguuuaucccaauuaucugga

SEQ ID NO: 1980545 - RNA, 22 nt, Shigella flexneri 2a str. 301
uaaguguuucacuuucaucacc

SEQ ID NO: 1980546 - RNA, 22 nt, Shigella flexneri 2a str. 301
uaaguguccgccaauuucauca

SEQ ID NO: 1980547 - RNA, 13 nt, Shigella flexneri 2a str. 301
uaaguacauuaag

SEQ ID NO: 1980548 - RNA, 15 nt, Shigella flexneri 2a str. 301
uaaguaugcaauaac

SEQ ID NO: 1980549 - RNA, 21 nt, Shigella flexneri 2a str. 301
uaagucuggcacgaccgccuu

SEQ ID NO: 1980550 - RNA, 18 nt, Shigella flexneri 2a str. 301
uaagucggucaaguaauu

SEQ ID NO: 1980551 - RNA, 20 nt, Shigella flexneri 2a str. 301
uaaggugguagcugcccccg

SEQ ID NO: 1980552 - RNA, 21 nt, Shigella flexneri 2a str. 301
uaagguuaagccucacgguuc

SEQ ID NO: 1980553 - RNA, 18 nt, Shigella flexneri 2a str. 301
uaagguucacuuaaucuc

SEQ ID NO: 1980554 - RNA, 16 nt, Shigella flexneri 2a str. 301
uaaguaaugaacuccg

SEQ ID NO: 1980555 - RNA, 13 nt, Shigella flexneri 2a str. 301
uaaguaagcaaca

SEQ ID NO: 1980556 - RNA, 18 nt, Shigella flexneri 2a str. 301
uaagggaggauuucuccc

SEQ ID NO: 1980557 - RNA, 23 nt, Shigella flexneri 2a str. 301
uaagggaggauuucuccccccuc

SEQ ID NO: 1980558 - RNA, 16 nt, Shigella flexneri 2a str. 301
uaagggcugacaguug

SEQ ID NO: 1980559 - RNA, 14 nt, Shigella flexneri 2a str. 301
uaaggcuucaauca

SEQ ID NO: 1980560 - RNA, 21 nt, Shigella flexneri 2a str. 301
uaaggucagacgaagucaaca

SEQ ID NO: 1980561 - RNA, 16 nt, Shigella flexneri 2a str. 301
uaagguccuccagcuc

SEQ ID NO: 1980562 - RNA, 19 nt, Shigella flexneri 2a str. 301
uaagguaucgcgaaaaaaa

SEQ ID NO: 1980563 - RNA, 22 nt, Shigella flexneri 2a str. 301
uaagguaucgcgaaaaaaaaga

SEQ ID NO: 1980564 - RNA, 17 nt, Shigella flexneri 2a str. 301
uaagccauuuaacucac

SEQ ID NO: 1980565 - RNA, 18 nt, Shigella flexneri 2a str. 301
uaagccauguuuaacucc

SEQ ID NO: 1980566 - RNA, 23 nt, Shigella flexneri 2a str. 301
uaagccagaccacccguaauccc

SEQ ID NO: 1980567 - RNA, 23 nt, Shigella flexneri 2a str. 301
uaagccaagcgccgccucagcca

SEQ ID NO: 1980568 - RNA, 13 nt, Shigella flexneri 2a str. 301
uaagccgucccua

SEQ ID NO: 1980569 - RNA, 24 nt, Shigella flexneri 2a str. 301
uaagcgacgggcgacaaacgcugu

SEQ ID NO: 1980570 - RNA, 14 nt, Shigella flexneri 2a str. 301
uaagcgcagcgcau

SEQ ID NO: 1980571 - RNA, 12 nt, Shigella flexneri 2a str. 301
uaagccuuccgc

SEQ ID NO: 1980572 - RNA, 14 nt, Shigella flexneri 2a str. 301
uaagccuuucagga

SEQ ID NO: 1980573 - RNA, 14 nt, Shigella flexneri 2a str. 301
uaagcaaaggugcc

SEQ ID NO: 1980574 - RNA, 16 nt, Shigella flexneri 2a str. 301
uaagcaacgcgcaccg

SEQ ID NO: 1980575 - RNA, 16 nt, Shigella flexneri 2a str. 301
uaagcagccaucugau

SEQ ID NO: 1980576 - RNA, 18 nt, Shigella flexneri 2a str. 301
uaagcaggcuggcuacga

SEQ ID NO: 1980577 - RNA, 20 nt, Shigella flexneri 2a str. 301
uaagcacuacucuauacagg

SEQ ID NO: 1980578 - RNA, 19 nt, Shigella flexneri 2a str. 301
uaagcacuacucuauacag

SEQ ID NO: 1980579 - RNA, 17 nt, Shigella flexneri 2a str. 301
uaagcaucuauuauugu

SEQ ID NO: 1980580 - RNA, 16 nt, Shigella flexneri 2a str. 301
uaagcaugaauaucaa

SEQ ID NO: 1980581 - RNA, 17 nt, Shigella flexneri 2a str. 301
uaagcaguccagcgccu

SEQ ID NO: 1980582 - RNA, 16 nt, Shigella flexneri 2a str. 301
uaagcagucaucugau

SEQ ID NO: 1980583 - RNA, 17 nt, Shigella flexneri 2a str. 301
uaaggaaacuccagccc

SEQ ID NO: 1980584 - RNA, 22 nt, Shigella flexneri 2a str. 301
uaaggaacggggguuuuacuuu

SEQ ID NO: 1980585 - RNA, 12 nt, Shigella flexneri 2a str. 301
uaaggauaaaaa

SEQ ID NO: 1980586 - RNA, 13 nt, Shigella flexneri 2a str. 301
uaaggauaaaaaa

SEQ ID NO: 1980587 - RNA, 22 nt, Shigella flexneri 2a str. 301
uaaggccccuuccucgggaggg

SEQ ID NO: 1980588 - RNA, 20 nt, Shigella flexneri 2a str. 301
uaaggcgcaauaaucagugc

SEQ ID NO: 1980589 - RNA, 18 nt, Shigella flexneri 2a str. 301
uaagcugucgaaaagaua

SEQ ID NO: 1980590 - RNA, 14 nt, Shigella flexneri 2a str. 301
uaagcgccaccguc

SEQ ID NO: 1980591 - RNA, 22 nt, Shigella flexneri 2a str. 301
uaagcguaagcgcauccggcac

SEQ ID NO: 1980592 - RNA, 14 nt, Shigella flexneri 2a str. 301
uaagcguagcgcau

SEQ ID NO: 1980593 - RNA, 16 nt, Shigella flexneri 2a str. 301
uaagcguucauccaac

SEQ ID NO: 1980594 - RNA, 12 nt, Shigella flexneri 2a str. 301
uaagaacaagca

SEQ ID NO: 1980595 - RNA, 23 nt, Shigella flexneri 2a str. 301
uaagaacugacuuccacuuccug

SEQ ID NO: 1980596 - RNA, 18 nt, Shigella flexneri 2a str. 301
uaagaauccggaaacgcu

SEQ ID NO: 1980597 - RNA, 22 nt, Shigella flexneri 2a str. 301
uaagaauguccauuauuucaau

SEQ ID NO: 1980598 - RNA, 16 nt, Shigella flexneri 2a str. 301
uaagaauugauaaaaa

SEQ ID NO: 1980599 - RNA, 17 nt, Shigella flexneri 2a str. 301
uaagaagccuuuaucug

SEQ ID NO: 1980600 - RNA, 23 nt, Shigella flexneri 2a str. 301
uaacuucuuuacuggcuuucauu

SEQ ID NO: 1980601 - RNA, 17 nt, Shigella flexneri 2a str. 301
uaacuuugaagcccagu

SEQ ID NO: 1980602 - RNA, 13 nt, Shigella flexneri 2a str. 301
uaacuuuuaucug

SEQ ID NO: 1980603 - RNA, 15 nt, Shigella flexneri 2a str. 301
uaacuuuuaucuguu

SEQ ID NO: 1980604 - RNA, 23 nt, Shigella flexneri 2a str. 301
uaagacuuuuuucaugggugcca

SEQ ID NO: 1980605 - RNA, 14 nt, Shigella flexneri 2a str. 301
uaagagcuggcauc

SEQ ID NO: 1980606 - RNA, 22 nt, Shigella flexneri 2a str. 301
uaagaggaauugauucaucaag

SEQ ID NO: 1980607 - RNA, 15 nt, Shigella flexneri 2a str. 301
uaagaguuucaacau

SEQ ID NO: 1980608 - RNA, 22 nt, Shigella flexneri 2a str. 301
uaagacuggcaaagcaggccag

SEQ ID NO: 1980609 - RNA, 14 nt, Shigella flexneri 2a str. 301
uaagauaaaagcaa

SEQ ID NO: 1980610 - RNA, 19 nt, Shigella flexneri 2a str. 301
uaagauaccccagcgcaag

SEQ ID NO: 1980611 - RNA, 15 nt, Shigella flexneri 2a str. 301
uaagaugcgccagca

SEQ ID NO: 1980612 - RNA, 15 nt, Shigella flexneri 2a str. 301
uaagaugcuacaaca

SEQ ID NO: 1980613 - RNA, 20 nt, Shigella flexneri 2a str. 301
uaagaugcuacaacaucgua

SEQ ID NO: 1980614 - RNA, 16 nt, Shigella flexneri 2a str. 301
uaagaugguuauccag

SEQ ID NO: 1980615 - RNA, 18 nt, Shigella flexneri 2a str. 301
uaagaucaucggccagau

SEQ ID NO: 1980616 - RNA, 22 nt, Shigella flexneri 2a str. 301
uaagaucaucggccagauaaua

SEQ ID NO: 1980617 - RNA, 20 nt, Shigella flexneri 2a str. 301
uaagaucagaagcguaaccg

SEQ ID NO: 1980618 - RNA, 19 nt, Shigella flexneri 2a str. 301
uaagaucgacggcuuuuag

SEQ ID NO: 1980619 - RNA, 18 nt, Shigella flexneri 2a str. 301
uaagaucgguugcgauau

SEQ ID NO: 1980620 - RNA, 22 nt, Shigella flexneri 2a str. 301
uaacugacuuucguuugaaaac

SEQ ID NO: 1980621 - RNA, 17 nt, Shigella flexneri 2a str. 301
uaacugacuuccgcuag

SEQ ID NO: 1980622 - RNA, 18 nt, Shigella flexneri 2a str. 301
aaaucccagugccugcau

SEQ ID NO: 1980623 - RNA, 14 nt, Shigella flexneri 2a str. 301
aaaucccgcugaau

SEQ ID NO: 1980624 - RNA, 15 nt, Shigella flexneri 2a str. 301
uaacugcugcucaau

SEQ ID NO: 1980625 - RNA, 19 nt, Shigella flexneri 2a str. 301
uaacugcguuucuggcuua

SEQ ID NO: 1980626 - RNA, 19 nt, Shigella flexneri 2a str. 301
uaacugccgucaaugcgca

SEQ ID NO: 1980627 - RNA, 19 nt, Shigella flexneri 2a str. 301
aaaucccgcuucaacgacc

SEQ ID NO: 1980628 - RNA, 23 nt, Shigella flexneri 2a str. 301
aaaucccgccgcuggcgggauuu

SEQ ID NO: 1980629 - RNA, 16 nt, Shigella flexneri 2a str. 301
aaauccgcacucaucu

SEQ ID NO: 1980630 - RNA, 18 nt, Shigella flexneri 2a str. 301
aaauccgcacucaucuua

SEQ ID NO: 1980631 - RNA, 12 nt, Shigella flexneri 2a str. 301
aaaucccugauc

SEQ ID NO: 1980632 - RNA, 13 nt, Shigella flexneri 2a str. 301
uaacuuaauguca

SEQ ID NO: 1980633 - RNA, 16 nt, Shigella flexneri 2a str. 301
uaacuuaauaaacauc

SEQ ID NO: 1980634 - RNA, 15 nt, Shigella flexneri 2a str. 301
uaacuuaauaaacau

SEQ ID NO: 1980635 - RNA, 15 nt, Shigella flexneri 2a str. 301
uaacuucaucagcaa

SEQ ID NO: 1980636 - RNA, 19 nt, Shigella flexneri 2a str. 301
uaacuuccugcuggcugua

SEQ ID NO: 1980637 - RNA, 13 nt, Shigella flexneri 2a str. 301
uaacugugccaaa

SEQ ID NO: 1980638 - RNA, 17 nt, Shigella flexneri 2a str. 301
uaacuggcgggcuuuuu

SEQ ID NO: 1980639 - RNA, 19 nt, Shigella flexneri 2a str. 301
uaacgucgguuucaucaca

SEQ ID NO: 1980640 - RNA, 15 nt, Shigella flexneri 2a str. 301
uaacgucaccauccc

SEQ ID NO: 1980641 - RNA, 18 nt, Shigella flexneri 2a str. 301
uaacgugucauaacuggu

SEQ ID NO: 1980642 - RNA, 19 nt, Shigella flexneri 2a str. 301
uaacgugcagcuuucccuu

SEQ ID NO: 1980643 - RNA, 15 nt, Shigella flexneri 2a str. 301
uaacguuauauccca

SEQ ID NO: 1980644 - RNA, 22 nt, Shigella flexneri 2a str. 301
uaacuacccaaccgauaaccac

SEQ ID NO: 1980645 - RNA, 15 nt, Shigella flexneri 2a str. 301
uaacuacaaucacga

SEQ ID NO: 1980646 - RNA, 20 nt, Shigella flexneri 2a str. 301
uaacguuucuuucaucaggu

SEQ ID NO: 1980647 - RNA, 22 nt, Shigella flexneri 2a str. 301
uaacguuuuuucgucaguucau

SEQ ID NO: 1980648 - RNA, 20 nt, Shigella flexneri 2a str. 301
uaacucucuuuugcuugaca

SEQ ID NO: 1980649 - RNA, 15 nt, Shigella flexneri 2a str. 301
uaacucauauaacgc

SEQ ID NO: 1980650 - RNA, 19 nt, Shigella flexneri 2a str. 301
uaacuccccgagaaauacu

SEQ ID NO: 1980651 - RNA, 17 nt, Shigella flexneri 2a str. 301
uaacucccccuuucuga

SEQ ID NO: 1980652 - RNA, 22 nt, Shigella flexneri 2a str. 301
uaacuccuucuaaagcaacucc

SEQ ID NO: 1980653 - RNA, 23 nt, Shigella flexneri 2a str. 301
uaacuauuguuuugaugaaucag

SEQ ID NO: 1980654 - RNA, 20 nt, Shigella flexneri 2a str. 301
uaacucaaaaauaaucaucu

SEQ ID NO: 1980655 - RNA, 17 nt, Shigella flexneri 2a str. 301
uaacuaggcgaacauuc

SEQ ID NO: 1980656 - RNA, 14 nt, Shigella flexneri 2a str. 301
uaacucaccaucaa

SEQ ID NO: 1980657 - RNA, 19 nt, Shigella flexneri 2a str. 301
uaacucacccaugaagaau

SEQ ID NO: 1980658 - RNA, 12 nt, Shigella flexneri 2a str. 301
uaacucaccauc

SEQ ID NO: 1980659 - RNA, 15 nt, Shigella flexneri 2a str. 301
uaauagaacuauaau

SEQ ID NO: 1980660 - RNA, 17 nt, Shigella flexneri 2a str. 301
uaauacugcuccccgaa

SEQ ID NO: 1980661 - RNA, 18 nt, Shigella flexneri 2a str. 301
uaauagauccuuuuuccc

SEQ ID NO: 1980662 - RNA, 22 nt, Shigella flexneri 2a str. 301
uaauagagauagccugaucaug

SEQ ID NO: 1980663 - RNA, 20 nt, Shigella flexneri 2a str. 301
uaauacgccggucacgcccg

SEQ ID NO: 1980664 - RNA, 23 nt, Shigella flexneri 2a str. 301
uaauacguagcaccgacgucgau

SEQ ID NO: 1980665 - RNA, 13 nt, Shigella flexneri 2a str. 301
uaauaguuucuga

SEQ ID NO: 1980666 - RNA, 19 nt, Shigella flexneri 2a str. 301
uaauaggcaggcaucauca

SEQ ID NO: 1980667 - RNA, 18 nt, Shigella flexneri 2a str. 301
uaauaguauuaagccagu

SEQ ID NO: 1980668 - RNA, 14 nt, Shigella flexneri 2a str. 301
uaauagccaucaca

SEQ ID NO: 1980669 - RNA, 14 nt, Shigella flexneri 2a str. 301
uaauaauuucugca

SEQ ID NO: 1980670 - RNA, 17 nt, Shigella flexneri 2a str. 301
uaauaauucaaaaaccu

SEQ ID NO: 1980671 - RNA, 15 nt, Shigella flexneri 2a str. 301
uaauaaugagcagaa

SEQ ID NO: 1980672 - RNA, 22 nt, Shigella flexneri 2a str. 301
uaauaccgacuccguagaaccu

SEQ ID NO: 1980673 - RNA, 23 nt, Shigella flexneri 2a str. 301
uaauaccgacuucggccagugcu

SEQ ID NO: 1980674 - RNA, 21 nt, Shigella flexneri 2a str. 301
uaauaccgacuccguagaacc

SEQ ID NO: 1980675 - RNA, 14 nt, Shigella flexneri 2a str. 301
uaauaccagccuuc

SEQ ID NO: 1980676 - RNA, 20 nt, Shigella flexneri 2a str. 301
uaauaccagccuucuucauc

SEQ ID NO: 1980677 - RNA, 12 nt, Shigella flexneri 2a str. 301
uaauacaggcua

SEQ ID NO: 1980678 - RNA, 21 nt, Shigella flexneri 2a str. 301
uaauacaggcuacucccagua

SEQ ID NO: 1980679 - RNA, 21 nt, Shigella flexneri 2a str. 301
uaauaagguucauugagcgca

SEQ ID NO: 1980680 - RNA, 21 nt, Shigella flexneri 2a str. 301
uaaucaucacgccaauaccgc

SEQ ID NO: 1980681 - RNA, 16 nt, Shigella flexneri 2a str. 301
uaaucauauuaaauuu

SEQ ID NO: 1980682 - RNA, 15 nt, Shigella flexneri 2a str. 301
uaaucagcuuuucca

SEQ ID NO: 1980683 - RNA, 16 nt, Shigella flexneri 2a str. 301
uaaucagcuuuuccau

SEQ ID NO: 1980684 - RNA, 14 nt, Shigella flexneri 2a str. 301
uaaucaggcuaucu

SEQ ID NO: 1980685 - RNA, 17 nt, Shigella flexneri 2a str. 301
uaaucagaauuuuucgc

SEQ ID NO: 1980686 - RNA, 18 nt, Shigella flexneri 2a str. 301
uaaucagaucguugaccu

SEQ ID NO: 1980687 - RNA, 14 nt, Shigella flexneri 2a str. 301
uaaucaauuuaucg

SEQ ID NO: 1980688 - RNA, 14 nt, Shigella flexneri 2a str. 301
uaauccgagaaucg

SEQ ID NO: 1980689 - RNA, 15 nt, Shigella flexneri 2a str. 301
uaauccccaaugacc

SEQ ID NO: 1980690 - RNA, 19 nt, Shigella flexneri 2a str. 301
uaaucccgcgcaacaaaua

SEQ ID NO: 1980691 - RNA, 14 nt, Shigella flexneri 2a str. 301
uaauccacuuucuu

SEQ ID NO: 1980692 - RNA, 16 nt, Shigella flexneri 2a str. 301
uaaucauuacaaccgc

SEQ ID NO: 1980693 - RNA, 22 nt, Shigella flexneri 2a str. 301
uaaucaucgcgugacagccuug

SEQ ID NO: 1980694 - RNA, 15 nt, Shigella flexneri 2a str. 301
uaaucaucucuccuu

SEQ ID NO: 1980695 - RNA, 11 nt, Shigella flexneri 2a str. 301
uaaucaucauu

SEQ ID NO: 1980696 - RNA, 19 nt, Shigella flexneri 2a str. 301
uaaucaucauuaauaucuu

SEQ ID NO: 1980697 - RNA, 21 nt, Shigella flexneri 2a str. 301
uaaucauccaccuuaaaacaa

SEQ ID NO: 1980698 - RNA, 23 nt, Shigella flexneri 2a str. 301
uaaucauccaccuuaaaacaaua

SEQ ID NO: 1980699 - RNA, 21 nt, Shigella flexneri 2a str. 301
uaaucaacgcaccgacaaauu

SEQ ID NO: 1980700 - RNA, 22 nt, Shigella flexneri 2a str. 301
uaauauuccgcugacuuuauac

SEQ ID NO: 1980701 - RNA, 13 nt, Shigella flexneri 2a str. 301
uaauauuuaucuu

SEQ ID NO: 1980702 - RNA, 18 nt, Shigella flexneri 2a str. 301
uaauauccaacgauauag

SEQ ID NO: 1980703 - RNA, 15 nt, Shigella flexneri 2a str. 301
uaauaucaggcauuc

SEQ ID NO: 1980704 - RNA, 16 nt, Shigella flexneri 2a str. 301
uaauauauaaagauuc

SEQ ID NO: 1980705 - RNA, 19 nt, Shigella flexneri 2a str. 301
uaauauccggugcauucau

SEQ ID NO: 1980706 - RNA, 17 nt, Shigella flexneri 2a str. 301
uaauaucuccagcuaua

SEQ ID NO: 1980707 - RNA, 22 nt, Shigella flexneri 2a str. 301
uaauaucuuucugccaccagua

SEQ ID NO: 1980708 - RNA, 16 nt, Shigella flexneri 2a str. 301
uaauaugcaauucaca

SEQ ID NO: 1980709 - RNA, 14 nt, Shigella flexneri 2a str. 301
uaauaugcaauuca

SEQ ID NO: 1980710 - RNA, 13 nt, Shigella flexneri 2a str. 301
uaauaugcugguu

SEQ ID NO: 1980711 - RNA, 22 nt, Shigella flexneri 2a str. 301
uaauaugcugguuccugacucc

SEQ ID NO: 1980712 - RNA, 18 nt, Shigella flexneri 2a str. 301
uaaucgccagcaaaauca

SEQ ID NO: 1980713 - RNA, 21 nt, Shigella flexneri 2a str. 301
uaaucgccagcaaaaucacca

SEQ ID NO: 1980714 - RNA, 13 nt, Shigella flexneri 2a str. 301
uaaucgcaauuac

SEQ ID NO: 1980715 - RNA, 18 nt, Shigella flexneri 2a str. 301
uaaugauuuaaaaccacu

SEQ ID NO: 1980716 - RNA, 15 nt, Shigella flexneri 2a str. 301
uaaugcgcuuccugc

SEQ ID NO: 1980717 - RNA, 19 nt, Shigella flexneri 2a str. 301
uaaugcgacaacagaaaua

SEQ ID NO: 1980718 - RNA, 22 nt, Shigella flexneri 2a str. 301
uaaugccugcacuuugugucag

SEQ ID NO: 1980719 - RNA, 16 nt, Shigella flexneri 2a str. 301
uaaugccguuuggcaa

SEQ ID NO: 1980720 - RNA, 14 nt, Shigella flexneri 2a str. 301
uaauguggcugggg

SEQ ID NO: 1980721 - RNA, 20 nt, Shigella flexneri 2a str. 301
uaaugugucugaaagcagac

SEQ ID NO: 1980722 - RNA, 13 nt, Shigella flexneri 2a str. 301
uaauguggcuggg

SEQ ID NO: 1980723 - RNA, 14 nt, Shigella flexneri 2a str. 301
uaauuacacccuua

SEQ ID NO: 1980724 - RNA, 15 nt, Shigella flexneri 2a str. 301
uaauuacacccuuaa

SEQ ID NO: 1980725 - RNA, 24 nt, Shigella flexneri 2a str. 301
uaauuaccuuaucaaucucagcaa

SEQ ID NO: 1980726 - RNA, 15 nt, Shigella flexneri 2a str. 301
uaauuauuauaauaa

SEQ ID NO: 1980727 - RNA, 19 nt, Shigella flexneri 2a str. 301
uaauuaugccgaucaucau

SEQ ID NO: 1980728 - RNA, 19 nt, Shigella flexneri 2a str. 301
uaauugaccagaucuucau

SEQ ID NO: 1980729 - RNA, 19 nt, Shigella flexneri 2a str. 301
uaauugagaaccacaauga

SEQ ID NO: 1980730 - RNA, 20 nt, Shigella flexneri 2a str. 301
uaauuccgggcguugauuaa

SEQ ID NO: 1980731 - RNA, 23 nt, Shigella flexneri 2a str. 301
uaauuccucccguuaugaucagc

SEQ ID NO: 1980732 - RNA, 15 nt, Shigella flexneri 2a str. 301
uaauuccugcgcugc

SEQ ID NO: 1980733 - RNA, 15 nt, Shigella flexneri 2a str. 301
uaauucaaaaaccug

SEQ ID NO: 1980734 - RNA, 21 nt, Shigella flexneri 2a str. 301
uaauucccugcgccagcggca

SEQ ID NO: 1980735 - RNA, 20 nt, Shigella flexneri 2a str. 301
uacaacugcuuuuugcucuc

SEQ ID NO: 1980736 - RNA, 21 nt, Shigella flexneri 2a str. 301
uacaacugccgcgccugaauc

SEQ ID NO: 1980737 - RNA, 15 nt, Shigella flexneri 2a str. 301
uacaacuuacgcagu

SEQ ID NO: 1980738 - RNA, 17 nt, Shigella flexneri 2a str. 301
uacaagaaucaugccaa

SEQ ID NO: 1980739 - RNA, 19 nt, Shigella flexneri 2a str. 301
uacaaaugggcacaauuca

SEQ ID NO: 1980740 - RNA, 19 nt, Shigella flexneri 2a str. 301
uacaaagccaacagcagcc

SEQ ID NO: 1980741 - RNA, 13 nt, Shigella flexneri 2a str. 301
uacaaacccagcc

SEQ ID NO: 1980742 - RNA, 23 nt, Shigella flexneri 2a str. 301
uacaaacggcugacgggaaaacg

SEQ ID NO: 1980743 - RNA, 16 nt, Shigella flexneri 2a str. 301
uacaaaaucuauugca

SEQ ID NO: 1980744 - RNA, 18 nt, Shigella flexneri 2a str. 301
uacaaaauuuaacaccau

SEQ ID NO: 1980745 - RNA, 21 nt, Shigella flexneri 2a str. 301
uaauuuugugcagcaugcacc

SEQ ID NO: 1980746 - RNA, 14 nt, Shigella flexneri 2a str. 301
uaauuuuuucuucc

SEQ ID NO: 1980747 - RNA, 18 nt, Shigella flexneri 2a str. 301
uaauuuuucaauauccaa

SEQ ID NO: 1980748 - RNA, 20 nt, Shigella flexneri 2a str. 301
uaauugccggaugcgacgca

SEQ ID NO: 1980749 - RNA, 16 nt, Shigella flexneri 2a str. 301
uaauugcgaugccagu

SEQ ID NO: 1980750 - RNA, 23 nt, Shigella flexneri 2a str. 301
uaauugccagcuugcuuuccagc

SEQ ID NO: 1980751 - RNA, 15 nt, Shigella flexneri 2a str. 301
uaauuucuuuucaua

SEQ ID NO: 1980752 - RNA, 19 nt, Shigella flexneri 2a str. 301
uaauuucuuuucauaauca

SEQ ID NO: 1980753 - RNA, 21 nt, Shigella flexneri 2a str. 301
uaauuucacaaguugucccau

SEQ ID NO: 1980754 - RNA, 19 nt, Shigella flexneri 2a str. 301
uaauuugaucgauggcagu

SEQ ID NO: 1980755 - RNA, 20 nt, Shigella flexneri 2a str. 301
uaauuugcggaauuuuuccg

SEQ ID NO: 1980756 - RNA, 16 nt, Shigella flexneri 2a str. 301
uacaggguaaaaagag

SEQ ID NO: 1980757 - RNA, 19 nt, Shigella flexneri 2a str. 301
uacaguaugagcaaacaau

SEQ ID NO: 1980758 - RNA, 17 nt, Shigella flexneri 2a str. 301
uacagucugcucccuuu

SEQ ID NO: 1980759 - RNA, 17 nt, Shigella flexneri 2a str. 301
uacaauuuacguuuuaa

SEQ ID NO: 1980760 - RNA, 22 nt, Shigella flexneri 2a str. 301
uacaauucuaccguuggccuga

SEQ ID NO: 1980761 - RNA, 18 nt, Shigella flexneri 2a str. 301
uacaucaccguucagcuu

SEQ ID NO: 1980762 - RNA, 20 nt, Shigella flexneri 2a str. 301
uacaucaucacugccaggag

SEQ ID NO: 1980763 - RNA, 11 nt, Shigella flexneri 2a str. 301
uacauacugag

SEQ ID NO: 1980764 - RNA, 18 nt, Shigella flexneri 2a str. 301
uaccaaauuccagaaaag

SEQ ID NO: 1980765 - RNA, 18 nt, Shigella flexneri 2a str. 301
uaccaaauuggcaaaauu

SEQ ID NO: 1980766 - RNA, 20 nt, Shigella flexneri 2a str. 301
uacauugauauacagcccgg

SEQ ID NO: 1980767 - RNA, 17 nt, Shigella flexneri 2a str. 301
uacauugccgacauggc

SEQ ID NO: 1980768 - RNA, 19 nt, Shigella flexneri 2a str. 301
uacauugagaauaucggca

SEQ ID NO: 1980769 - RNA, 14 nt, Shigella flexneri 2a str. 301
uacaucuuaaucuu

SEQ ID NO: 1980770 - RNA, 17 nt, Shigella flexneri 2a str. 301
uacaucuacaaaaaacu

SEQ ID NO: 1980771 - RNA, 23 nt, Shigella flexneri 2a str. 301
uacaucuacaaaaaacuggccuc

SEQ ID NO: 1980772 - RNA, 21 nt, Shigella flexneri 2a str. 301
uacauuaucgcgucuaaauuu

SEQ ID NO: 1980773 - RNA, 16 nt, Shigella flexneri 2a str. 301
uacauuaguaauuucc

SEQ ID NO: 1980774 - RNA, 15 nt, Shigella flexneri 2a str. 301
uacaucuucaucauc

SEQ ID NO: 1980775 - RNA, 16 nt, Shigella flexneri 2a str. 301
uaccagauaaacaucg

SEQ ID NO: 1980776 - RNA, 17 nt, Shigella flexneri 2a str. 301
uaccagaccauacagug

SEQ ID NO: 1980777 - RNA, 23 nt, Shigella flexneri 2a str. 301
uaccaccaaugucgaaagcccca

SEQ ID NO: 1980778 - RNA, 14 nt, Shigella flexneri 2a str. 301
uaccacccgcagug

SEQ ID NO: 1980779 - RNA, 13 nt, Shigella flexneri 2a str. 301
uaccaccagugcc

SEQ ID NO: 1980780 - RNA, 11 nt, Shigella flexneri 2a str. 301
uaccagccaga

SEQ ID NO: 1980781 - RNA, 15 nt, Shigella flexneri 2a str. 301
uaccagaucucacca

SEQ ID NO: 1980782 - RNA, 22 nt, Shigella flexneri 2a str. 301
uaccagaugcucuuuucugaag

SEQ ID NO: 1980783 - RNA, 19 nt, Shigella flexneri 2a str. 301
uaccagcaccugcuugaac

SEQ ID NO: 1980784 - RNA, 23 nt, Shigella flexneri 2a str. 301
uaccaggauaggcuucuauacca

SEQ ID NO: 1980785 - RNA, 20 nt, Shigella flexneri 2a str. 301
uaccagcgacaucaccgccg

SEQ ID NO: 1980786 - RNA, 22 nt, Shigella flexneri 2a str. 301
uaccagccccgaugccaucaug

SEQ ID NO: 1980787 - RNA, 14 nt, Shigella flexneri 2a str. 301
uacccaaaaaauag

SEQ ID NO: 1980788 - RNA, 23 nt, Shigella flexneri 2a str. 301
uacccaaccgauaaccacgcuca

SEQ ID NO: 1980789 - RNA, 12 nt, Shigella flexneri 2a str. 301
uacccagcagca

SEQ ID NO: 1980790 - RNA, 17 nt, Shigella flexneri 2a str. 301
uacccagcagcagcggu

SEQ ID NO: 1980791 - RNA, 19 nt, Shigella flexneri 2a str. 301
uacccagcguguugaggaa

SEQ ID NO: 1980792 - RNA, 15 nt, Shigella flexneri 2a str. 301
uacccaaucccccac

SEQ ID NO: 1980793 - RNA, 17 nt, Shigella flexneri 2a str. 301
uaccccgccagcagaau

SEQ ID NO: 1980794 - RNA, 22 nt, Shigella flexneri 2a str. 301
uacccagcguguugaggaagcg

SEQ ID NO: 1980795 - RNA, 16 nt, Shigella flexneri 2a str. 301
uacccaguauguaacu

SEQ ID NO: 1980796 - RNA, 15 nt, Shigella flexneri 2a str. 301
uaccaugcaccaacc

SEQ ID NO: 1980797 - RNA, 12 nt, Shigella flexneri 2a str. 301
uaccaucaccaa

SEQ ID NO: 1980798 - RNA, 17 nt, Shigella flexneri 2a str. 301
uaccaucggcagcgcca

SEQ ID NO: 1980799 - RNA, 16 nt, Shigella flexneri 2a str. 301
uaccaguccuacacac

SEQ ID NO: 1980800 - RNA, 16 nt, Shigella flexneri 2a str. 301
uaccaguacgcccacg

SEQ ID NO: 1980801 - RNA, 20 nt, Shigella flexneri 2a str. 301
uaccaggcgaccguuuucac

SEQ ID NO: 1980802 - RNA, 19 nt, Shigella flexneri 2a str. 301
uaccaguucgcuuuccguu

SEQ ID NO: 1980803 - RNA, 17 nt, Shigella flexneri 2a str. 301
uacccguccagauauag

SEQ ID NO: 1980804 - RNA, 21 nt, Shigella flexneri 2a str. 301
uacccgcucgaaguuuuccuc

SEQ ID NO: 1980805 - RNA, 20 nt, Shigella flexneri 2a str. 301
uaccccucuauccagcucau

SEQ ID NO: 1980806 - RNA, 17 nt, Shigella flexneri 2a str. 301
uacccugacccagaccg

SEQ ID NO: 1980807 - RNA, 17 nt, Shigella flexneri 2a str. 301
uacccugaucaaucacu

SEQ ID NO: 1980808 - RNA, 14 nt, Shigella flexneri 2a str. 301
uacccugaaucaau

SEQ ID NO: 1980809 - RNA, 19 nt, Shigella flexneri 2a str. 301
uacccuuaacucuuccuga

SEQ ID NO: 1980810 - RNA, 17 nt, Shigella flexneri 2a str. 301
uaccgaagaguaaccaa

SEQ ID NO: 1980811 - RNA, 24 nt, Shigella flexneri 2a str. 301
uaccgaauccaguaagcugugcga

SEQ ID NO: 1980812 - RNA, 15 nt, Shigella flexneri 2a str. 301
uaccgaaccaaaaua

SEQ ID NO: 1980813 - RNA, 13 nt, Shigella flexneri 2a str. 301
uaccgauucccag

SEQ ID NO: 1980814 - RNA, 23 nt, Shigella flexneri 2a str. 301
uaccgcaacucauuuacagaaac

SEQ ID NO: 1980815 - RNA, 17 nt, Shigella flexneri 2a str. 301
uaccgauagauucagca

SEQ ID NO: 1980816 - RNA, 14 nt, Shigella flexneri 2a str. 301
uaccgauccccgga

SEQ ID NO: 1980817 - RNA, 18 nt, Shigella flexneri 2a str. 301
uaccgcagugaaauuucu

SEQ ID NO: 1980818 - RNA, 18 nt, Shigella flexneri 2a str. 301
uaccggacacacuucauu

SEQ ID NO: 1980819 - RNA, 17 nt, Shigella flexneri 2a str. 301
uaccggacuccagacac

SEQ ID NO: 1980820 - RNA, 16 nt, Shigella flexneri 2a str. 301
uaccggauaaauuuaa

SEQ ID NO: 1980821 - RNA, 21 nt, Shigella flexneri 2a str. 301
uaccggaacacucuuccaguc

SEQ ID NO: 1980822 - RNA, 20 nt, Shigella flexneri 2a str. 301
uacuguuuaucuucccagcg

SEQ ID NO: 1980823 - RNA, 22 nt, Shigella flexneri 2a str. 301
uacugugaaccucgaucagagu

SEQ ID NO: 1980824 - RNA, 23 nt, Shigella flexneri 2a str. 301
uacugucuccacuauaaaaaaac

SEQ ID NO: 1980825 - RNA, 23 nt, Shigella flexneri 2a str. 301
uacuggauagauauucuccagcu

SEQ ID NO: 1980826 - RNA, 22 nt, Shigella flexneri 2a str. 301
uacuggcaaucgccagcggcag

SEQ ID NO: 1980827 - RNA, 21 nt, Shigella flexneri 2a str. 301
uacugcucagacggugaccag

SEQ ID NO: 1980828 - RNA, 15 nt, Shigella flexneri 2a str. 301
uacugccuugaugaa

SEQ ID NO: 1980829 - RNA, 17 nt, Shigella flexneri 2a str. 301
uacuggaguuauucauu

SEQ ID NO: 1980830 - RNA, 19 nt, Shigella flexneri 2a str. 301
uacuucucgauaaaccauc

SEQ ID NO: 1980831 - RNA, 23 nt, Shigella flexneri 2a str. 301
uacuucuucaugccaaaagggag

SEQ ID NO: 1980832 - RNA, 16 nt, Shigella flexneri 2a str. 301
uacuugcaagaucgcg

SEQ ID NO: 1980833 - RNA, 21 nt, Shigella flexneri 2a str. 301
uacuucagcaagcgauaauuu

SEQ ID NO: 1980834 - RNA, 21 nt, Shigella flexneri 2a str. 301
uacuucaccuucuuuacugcc

SEQ ID NO: 1980835 - RNA, 12 nt, Shigella flexneri 2a str. 301
uacuucagcaag

SEQ ID NO: 1980836 - RNA, 20 nt, Shigella flexneri 2a str. 301
uacucguuuauuaugccaca

SEQ ID NO: 1980837 - RNA, 16 nt, Shigella flexneri 2a str. 301
uacucuccuccagguu

SEQ ID NO: 1980838 - RNA, 18 nt, Shigella flexneri 2a str. 301
uacucuugugccaguuca

SEQ ID NO: 1980839 - RNA, 22 nt, Shigella flexneri 2a str. 301
uacugauaguguuuuauguuca

SEQ ID NO: 1980840 - RNA, 22 nt, Shigella flexneri 2a str. 301
uacugauugacgcguucgcuaa

SEQ ID NO: 1980841 - RNA, 20 nt, Shigella flexneri 2a str. 301
uacugauaauuuuuucacua

SEQ ID NO: 1980842 - RNA, 23 nt, Shigella flexneri 2a str. 301
uacugacuagaugugcaguuccu

SEQ ID NO: 1980843 - RNA, 21 nt, Shigella flexneri 2a str. 301
uacugaccgucgccuucaacg

SEQ ID NO: 1980844 - RNA, 21 nt, Shigella flexneri 2a str. 301
uacugacggaucccgccaaca

SEQ ID NO: 1980845 - RNA, 14 nt, Shigella flexneri 2a str. 301
uacugacuggcaag

SEQ ID NO: 1980846 - RNA, 14 nt, Shigella flexneri 2a str. 301
uacugagagaaaaa

SEQ ID NO: 1980847 - RNA, 16 nt, Shigella flexneri 2a str. 301
uacugacaaacugcgc

SEQ ID NO: 1980848 - RNA, 15 nt, Shigella flexneri 2a str. 301
uacugacaauuugcc

SEQ ID NO: 1980849 - RNA, 21 nt, Shigella flexneri 2a str. 301
uacugacaauuugcccaugua

SEQ ID NO: 1980850 - RNA, 13 nt, Shigella flexneri 2a str. 301
uacugaaucccug

SEQ ID NO: 1980851 - RNA, 11 nt, Shigella flexneri 2a str. 301
uacugacauca

SEQ ID NO: 1980852 - RNA, 13 nt, Shigella flexneri 2a str. 301
uacugaaaccuga

SEQ ID NO: 1980853 - RNA, 21 nt, Shigella flexneri 2a str. 301
uacucuuugacaacaucaucu

SEQ ID NO: 1980854 - RNA, 17 nt, Shigella flexneri 2a str. 301
uacuaaaugugcaauca

SEQ ID NO: 1980855 - RNA, 17 nt, Shigella flexneri 2a str. 301
uacgggaggucaucagc

SEQ ID NO: 1980856 - RNA, 19 nt, Shigella flexneri 2a str. 301
uacggcuccgcaagcgaau

SEQ ID NO: 1980857 - RNA, 20 nt, Shigella flexneri 2a str. 301
uacggcguuucacuucugag

SEQ ID NO: 1980858 - RNA, 11 nt, Shigella flexneri 2a str. 301
uacguaaccca

SEQ ID NO: 1980859 - RNA, 15 nt, Shigella flexneri 2a str. 301
uacguaacccaccac

SEQ ID NO: 1980860 - RNA, 19 nt, Shigella flexneri 2a str. 301
uacgggcaccaguaacgau

SEQ ID NO: 1980861 - RNA, 13 nt, Shigella flexneri 2a str. 301
uacgucacuucau

SEQ ID NO: 1980862 - RNA, 15 nt, Shigella flexneri 2a str. 301
uacguaauuuauaau

SEQ ID NO: 1980863 - RNA, 22 nt, Shigella flexneri 2a str. 301
uacgcguaaaacagccagcgcu

SEQ ID NO: 1980864 - RNA, 22 nt, Shigella flexneri 2a str. 301
uacgcguaaaugcguugcuggc

SEQ ID NO: 1980865 - RNA, 18 nt, Shigella flexneri 2a str. 301
uacgcguacacuuuccug

SEQ ID NO: 1980866 - RNA, 14 nt, Shigella flexneri 2a str. 301
uacggcccagaccc

SEQ ID NO: 1980867 - RNA, 18 nt, Shigella flexneri 2a str. 301
uacgcgcaauauccugcg

SEQ ID NO: 1980868 - RNA, 21 nt, Shigella flexneri 2a str. 301
uacgcgccaaucggcaauuca

SEQ ID NO: 1980869 - RNA, 15 nt, Shigella flexneri 2a str. 301
uacgcgccccuucca

SEQ ID NO: 1980870 - RNA, 15 nt, Shigella flexneri 2a str. 301
uaccguaucuaccac

SEQ ID NO: 1980871 - RNA, 20 nt, Shigella flexneri 2a str. 301
uaccgugguacguuaaaguu

SEQ ID NO: 1980872 - RNA, 16 nt, Shigella flexneri 2a str. 301
uacgacacgccuccug

SEQ ID NO: 1980873 - RNA, 23 nt, Shigella flexneri 2a str. 301
uaccgucgccagacgcagcaagg

SEQ ID NO: 1980874 - RNA, 13 nt, Shigella flexneri 2a str. 301
uaccgucuguaac

SEQ ID NO: 1980875 - RNA, 18 nt, Shigella flexneri 2a str. 301
uaccgugcuguacagcag

SEQ ID NO: 1980876 - RNA, 21 nt, Shigella flexneri 2a str. 301
uacgcaacugccaguaaagca

SEQ ID NO: 1980877 - RNA, 22 nt, Shigella flexneri 2a str. 301
uacgagucgccuguacuuccug

SEQ ID NO: 1980878 - RNA, 16 nt, Shigella flexneri 2a str. 301
uacgcauugcucacuu

SEQ ID NO: 1980879 - RNA, 12 nt, Shigella flexneri 2a str. 301
uacgcagcauca

SEQ ID NO: 1980880 - RNA, 15 nt, Shigella flexneri 2a str. 301
uacgcauaaaaccag

SEQ ID NO: 1980881 - RNA, 22 nt, Shigella flexneri 2a str. 301
uacgcauaaaaccagcaaacag

SEQ ID NO: 1980882 - RNA, 21 nt, Shigella flexneri 2a str. 301
uacgcaaucaaaaucuccugc

SEQ ID NO: 1980883 - RNA, 20 nt, Shigella flexneri 2a str. 301
uacgccugccagcucuuucg

SEQ ID NO: 1980884 - RNA, 18 nt, Shigella flexneri 2a str. 301
uacgccaucgccagcagc

SEQ ID NO: 1980885 - RNA, 21 nt, Shigella flexneri 2a str. 301
uacgccaucgccagcagccau

SEQ ID NO: 1980886 - RNA, 16 nt, Shigella flexneri 2a str. 301
uacgccauccggcgug

SEQ ID NO: 1980887 - RNA, 20 nt, Shigella flexneri 2a str. 301
uacgccagucacggugcagc

SEQ ID NO: 1980888 - RNA, 16 nt, Shigella flexneri 2a str. 301
uacgcccaucauucag

SEQ ID NO: 1980889 - RNA, 17 nt, Shigella flexneri 2a str. 301
guccauccauacgggca

SEQ ID NO: 1980890 - RNA, 17 nt, Shigella flexneri 2a str. 301
guccaucacuucgccga

SEQ ID NO: 1980891 - RNA, 16 nt, Shigella flexneri 2a str. 301
gucccagccuugccag

SEQ ID NO: 1980892 - RNA, 23 nt, Shigella flexneri 2a str. 301
guccagcuuuucgauaacccggc

SEQ ID NO: 1980893 - RNA, 21 nt, Shigella flexneri 2a str. 301
guccauagcgauguauuucau

SEQ ID NO: 1980894 - RNA, 14 nt, Shigella flexneri 2a str. 301
guccauacugucuc

SEQ ID NO: 1980895 - RNA, 18 nt, Shigella flexneri 2a str. 301
guccaccaauagcccaug

SEQ ID NO: 1980896 - RNA, 14 nt, Shigella flexneri 2a str. 301
guccaaucagcaca

SEQ ID NO: 1980897 - RNA, 18 nt, Shigella flexneri 2a str. 301
guccaccgcgaugcugcc

SEQ ID NO: 1980898 - RNA, 14 nt, Shigella flexneri 2a str. 301
guccagccgccagg

SEQ ID NO: 1980899 - RNA, 14 nt, Shigella flexneri 2a str. 301
gucaugaaauauag

SEQ ID NO: 1980900 - RNA, 14 nt, Shigella flexneri 2a str. 301
gucaugaaccugcc

SEQ ID NO: 1980901 - RNA, 14 nt, Shigella flexneri 2a str. 301
gucaucugcacggu

SEQ ID NO: 1980902 - RNA, 18 nt, Shigella flexneri 2a str. 301
gucaucggcguugcccau

SEQ ID NO: 1980903 - RNA, 14 nt, Shigella flexneri 2a str. 301
gucaugucaugagu

SEQ ID NO: 1980904 - RNA, 14 nt, Shigella flexneri 2a str. 301
guccaaaagguccu

SEQ ID NO: 1980905 - RNA, 15 nt, Shigella flexneri 2a str. 301
gucauuuuuucgaca

SEQ ID NO: 1980906 - RNA, 21 nt, Shigella flexneri 2a str. 301
gucaucagcauaaucaccagu

SEQ ID NO: 1980907 - RNA, 19 nt, Shigella flexneri 2a str. 301
gucaucagucugagccugc

SEQ ID NO: 1980908 - RNA, 18 nt, Shigella flexneri 2a str. 301
gucauccaggaacuccag

SEQ ID NO: 1980909 - RNA, 16 nt, Shigella flexneri 2a str. 301
gucaucccagucuuca

SEQ ID NO: 1980910 - RNA, 22 nt, Shigella flexneri 2a str. 301
gucaucccccaguggcagcaau

SEQ ID NO: 1980911 - RNA, 16 nt, Shigella flexneri 2a str. 301
gucaucgacagcaaau

SEQ ID NO: 1980912 - RNA, 20 nt, Shigella flexneri 2a str. 301
gucagcccgugauuuuccug

SEQ ID NO: 1980913 - RNA, 16 nt, Shigella flexneri 2a str. 301
gucagcgccuggcugc

SEQ ID NO: 1980914 - RNA, 20 nt, Shigella flexneri 2a str. 301
gucaggcaaccgcugagcga

SEQ ID NO: 1980915 - RNA, 20 nt, Shigella flexneri 2a str. 301
gucaggcaagccgcuaacag

SEQ ID NO: 1980916 - RNA, 17 nt, Shigella flexneri 2a str. 301
gucaggccgauaauaaa

SEQ ID NO: 1980917 - RNA, 12 nt, Shigella flexneri 2a str. 301
gucagguaacaa

SEQ ID NO: 1980918 - RNA, 18 nt, Shigella flexneri 2a str. 301
gucaggucacccaacaug

SEQ ID NO: 1980919 - RNA, 16 nt, Shigella flexneri 2a str. 301
gucaggggcauuuuca

SEQ ID NO: 1980920 - RNA, 17 nt, Shigella flexneri 2a str. 301
gucaggggcauuuucaa

SEQ ID NO: 1980921 - RNA, 22 nt, Shigella flexneri 2a str. 301
gucacucucgacccgacagaug

SEQ ID NO: 1980922 - RNA, 13 nt, Shigella flexneri 2a str. 301
gucacugauagug

SEQ ID NO: 1980923 - RNA, 14 nt, Shigella flexneri 2a str. 301
gucacugacuauuu

SEQ ID NO: 1980924 - RNA, 21 nt, Shigella flexneri 2a str. 301
gucacguagcggcggcagauu

SEQ ID NO: 1980925 - RNA, 19 nt, Shigella flexneri 2a str. 301
gucacguucuccccgaggc

SEQ ID NO: 1980926 - RNA, 13 nt, Shigella flexneri 2a str. 301
gucagccagcggc

SEQ ID NO: 1980927 - RNA, 15 nt, Shigella flexneri 2a str. 301
gucagccagaaagaa

SEQ ID NO: 1980928 - RNA, 17 nt, Shigella flexneri 2a str. 301
gucagccacuucuucca

SEQ ID NO: 1980929 - RNA, 16 nt, Shigella flexneri 2a str. 301
gucacugcaucuuccg

SEQ ID NO: 1980930 - RNA, 15 nt, Shigella flexneri 2a str. 301
gucaaucauccauau

SEQ ID NO: 1980931 - RNA, 21 nt, Shigella flexneri 2a str. 301
gucaauauucuggguagucca

SEQ ID NO: 1980932 - RNA, 21 nt, Shigella flexneri 2a str. 301
gucaacugcgccacucgauac

SEQ ID NO: 1980933 - RNA, 16 nt, Shigella flexneri 2a str. 301
gucaacguuaacuuuc

SEQ ID NO: 1980934 - RNA, 19 nt, Shigella flexneri 2a str. 301
ggugaaaguaaaaaagaag

SEQ ID NO: 1980935 - RNA, 18 nt, Shigella flexneri 2a str. 301
ggugaaaguaaaaaagaa

SEQ ID NO: 1980936 - RNA, 12 nt, Shigella flexneri 2a str. 301
gucaaucugcuc

SEQ ID NO: 1980937 - RNA, 11 nt, Shigella flexneri 2a str. 301
gucaaucugac

SEQ ID NO: 1980938 - RNA, 12 nt, Shigella flexneri 2a str. 301
gucacccagaca

SEQ ID NO: 1980939 - RNA, 16 nt, Shigella flexneri 2a str. 301
gucacgccaauaaucg

SEQ ID NO: 1980940 - RNA, 18 nt, Shigella flexneri 2a str. 301
gucacgcauucagcaaau

SEQ ID NO: 1980941 - RNA, 15 nt, Shigella flexneri 2a str. 301
gucaccgccagguga

SEQ ID NO: 1980942 - RNA, 16 nt, Shigella flexneri 2a str. 301
gucaccggaauaauga

SEQ ID NO: 1980943 - RNA, 18 nt, Shigella flexneri 2a str. 301
gucaccggaauaaugaug

SEQ ID NO: 1980944 - RNA, 15 nt, Shigella flexneri 2a str. 301
guccgcguccagcuu

SEQ ID NO: 1980945 - RNA, 16 nt, Shigella flexneri 2a str. 301
guccgcguccgcugga

SEQ ID NO: 1980946 - RNA, 22 nt, Shigella flexneri 2a str. 301
guccgcgucuuaucaggccuac

SEQ ID NO: 1980947 - RNA, 23 nt, Shigella flexneri 2a str. 301
guccgcuauuucuugugcauggc

SEQ ID NO: 1980948 - RNA, 14 nt, Shigella flexneri 2a str. 301
guccgcuucaccac

SEQ ID NO: 1980949 - RNA, 17 nt, Shigella flexneri 2a str. 301
guccggcagcagaaagc

SEQ ID NO: 1980950 - RNA, 19 nt, Shigella flexneri 2a str. 301
guccccuggggagugaccu

SEQ ID NO: 1980951 - RNA, 17 nt, Shigella flexneri 2a str. 301
gucccaugaugcgcggc

SEQ ID NO: 1980952 - RNA, 22 nt, Shigella flexneri 2a str. 301
guccucccuuauugcuaaugau

SEQ ID NO: 1980953 - RNA, 12 nt, Shigella flexneri 2a str. 301
guccuccagcuc

SEQ ID NO: 1980954 - RNA, 14 nt, Shigella flexneri 2a str. 301
guccugcaaggugg

SEQ ID NO: 1980955 - RNA, 16 nt, Shigella flexneri 2a str. 301
guccugcaaggugguc

SEQ ID NO: 1980956 - RNA, 14 nt, Shigella flexneri 2a str. 301
guccggcgcugcaa

SEQ ID NO: 1980957 - RNA, 17 nt, Shigella flexneri 2a str. 301
gucgauaucgauaauca

SEQ ID NO: 1980958 - RNA, 16 nt, Shigella flexneri 2a str. 301
gucgagcagagaaacg

SEQ ID NO: 1980959 - RNA, 15 nt, Shigella flexneri 2a str. 301
guccugcguuucuuc

SEQ ID NO: 1980960 - RNA, 14 nt, Shigella flexneri 2a str. 301
guccuucuaccagc

SEQ ID NO: 1980961 - RNA, 23 nt, Shigella flexneri 2a str. 301
gucgcccgaccaucgccagcuca

SEQ ID NO: 1980962 - RNA, 21 nt, Shigella flexneri 2a str. 301
gucgcccccgcgccagcgggc

SEQ ID NO: 1980963 - RNA, 15 nt, Shigella flexneri 2a str. 301
gucgccgccuguucc

SEQ ID NO: 1980964 - RNA, 14 nt, Shigella flexneri 2a str. 301
gucgccguaccggg

SEQ ID NO: 1980965 - RNA, 15 nt, Shigella flexneri 2a str. 301
gucgccgggaugcug

SEQ ID NO: 1980966 - RNA, 19 nt, Shigella flexneri 2a str. 301
gucgcugaagucucgccag

SEQ ID NO: 1980967 - RNA, 15 nt, Shigella flexneri 2a str. 301
gucgguuuauggaaa

SEQ ID NO: 1980968 - RNA, 19 nt, Shigella flexneri 2a str. 301
gucgguuuguacucuuccg

SEQ ID NO: 1980969 - RNA, 14 nt, Shigella flexneri 2a str. 301
gucguaaacaacug

SEQ ID NO: 1980970 - RNA, 18 nt, Shigella flexneri 2a str. 301
gucggugcucaucagccc

SEQ ID NO: 1980971 - RNA, 14 nt, Shigella flexneri 2a str. 301
gucguaagccaccg

SEQ ID NO: 1980972 - RNA, 21 nt, Shigella flexneri 2a str. 301
gucgugaaugccguaggccca

SEQ ID NO: 1980973 - RNA, 18 nt, Shigella flexneri 2a str. 301
gucgggccgucuggcugc

SEQ ID NO: 1980974 - RNA, 18 nt, Shigella flexneri 2a str. 301
gucggaaccacaacucaa

SEQ ID NO: 1980975 - RNA, 20 nt, Shigella flexneri 2a str. 301
gucggaaaauuauuuuaaau

SEQ ID NO: 1980976 - RNA, 16 nt, Shigella flexneri 2a str. 301
gucgcugucuuccugg

SEQ ID NO: 1980977 - RNA, 13 nt, Shigella flexneri 2a str. 301
gucgcuguauuuu

SEQ ID NO: 1980978 - RNA, 22 nt, Shigella flexneri 2a str. 301
gucuggauuuggcugccgagca

SEQ ID NO: 1980979 - RNA, 14 nt, Shigella flexneri 2a str. 301
gucugcuucugccu

SEQ ID NO: 1980980 - RNA, 14 nt, Shigella flexneri 2a str. 301
gucugggcaaaauc

SEQ ID NO: 1980981 - RNA, 14 nt, Shigella flexneri 2a str. 301
gucuggcagauccu

SEQ ID NO: 1980982 - RNA, 12 nt, Shigella flexneri 2a str. 301
gucuguacggca

SEQ ID NO: 1980983 - RNA, 14 nt, Shigella flexneri 2a str. 301
gucuggugaccugg

SEQ ID NO: 1980984 - RNA, 19 nt, Shigella flexneri 2a str. 301
gucugguguaucugcuguu

SEQ ID NO: 1980985 - RNA, 15 nt, Shigella flexneri 2a str. 301
gucugagccgaaaaa

SEQ ID NO: 1980986 - RNA, 22 nt, Shigella flexneri 2a str. 301
gucugaccauaacccgcuucca

SEQ ID NO: 1980987 - RNA, 21 nt, Shigella flexneri 2a str. 301
gucugaauaucaucccccugc

SEQ ID NO: 1980988 - RNA, 14 nt, Shigella flexneri 2a str. 301
gucugaauccaucu

SEQ ID NO: 1980989 - RNA, 20 nt, Shigella flexneri 2a str. 301
gucugaauccaucuguaucc

SEQ ID NO: 1980990 - RNA, 22 nt, Shigella flexneri 2a str. 301
gucugauuccgauauucaauug

SEQ ID NO: 1980991 - RNA, 21 nt, Shigella flexneri 2a str. 301
gucugaucggcaaucacgccc

SEQ ID NO: 1980992 - RNA, 22 nt, Shigella flexneri 2a str. 301
gucugcauuuucucgcggacug

SEQ ID NO: 1980993 - RNA, 18 nt, Shigella flexneri 2a str. 301
gucugccaucauggcauc

SEQ ID NO: 1980994 - RNA, 17 nt, Shigella flexneri 2a str. 301
gucugccgguacuucac

SEQ ID NO: 1980995 - RNA, 20 nt, Shigella flexneri 2a str. 301
gucugccgguacuucaccag

SEQ ID NO: 1980996 - RNA, 23 nt, Shigella flexneri 2a str. 301
gucucucagcacaccauaaaaca

SEQ ID NO: 1980997 - RNA, 15 nt, Shigella flexneri 2a str. 301
gucucuucaugccuc

SEQ ID NO: 1980998 - RNA, 18 nt, Shigella flexneri 2a str. 301
gucucuggcuucccggca

SEQ ID NO: 1980999 - RNA, 20 nt, Shigella flexneri 2a str. 301
gucucggaagguuucuucaa

SEQ ID NO: 1981000 - RNA, 22 nt, Shigella flexneri 2a str. 301
gucucgauguagauauacugca

SEQ ID NO: 1981001 - RNA, 19 nt, Shigella flexneri 2a str. 301
gucucgauacgcccuggau

SEQ ID NO: 1981002 - RNA, 20 nt, Shigella flexneri 2a str. 301
gucguugcuaacaauggagc

SEQ ID NO: 1981003 - RNA, 17 nt, Shigella flexneri 2a str. 301
gucucaggugucuggca

SEQ ID NO: 1981004 - RNA, 16 nt, Shigella flexneri 2a str. 301
gucucaggugucuggc

SEQ ID NO: 1981005 - RNA, 18 nt, Shigella flexneri 2a str. 301
gucucccgaugccagcac

SEQ ID NO: 1981006 - RNA, 14 nt, Shigella flexneri 2a str. 301
gucguucaggcgcu

SEQ ID NO: 1981007 - RNA, 22 nt, Shigella flexneri 2a str. 301
gucguugcaaucagcggugccg

SEQ ID NO: 1981008 - RNA, 12 nt, Shigella flexneri 2a str. 301
gucguggcaaaa

SEQ ID NO: 1981009 - RNA, 21 nt, Shigella flexneri 2a str. 301
gucguggcaaucguagcccag

SEQ ID NO: 1981010 - RNA, 11 nt, Shigella flexneri 2a str. 301
gucuucccugc

SEQ ID NO: 1981011 - RNA, 10 nt, Shigella flexneri 2a str. 301
gucuuccugc

SEQ ID NO: 1981012 - RNA, 14 nt, Shigella flexneri 2a str. 301
gucuucccgcagcc

SEQ ID NO: 1981013 - RNA, 14 nt, Shigella flexneri 2a str. 301
gucuucccagcccc

SEQ ID NO: 1981014 - RNA, 21 nt, Shigella flexneri 2a str. 301
gucuucugguugcgaaaaaau

SEQ ID NO: 1981015 - RNA, 16 nt, Shigella flexneri 2a str. 301
gucuucugguuuuucu

SEQ ID NO: 1981016 - RNA, 20 nt, Shigella flexneri 2a str. 301
gucuucugcagucaccugcg

SEQ ID NO: 1981017 - RNA, 21 nt, Shigella flexneri 2a str. 301
gucuucugugauuccgccagu

SEQ ID NO: 1981018 - RNA, 19 nt, Shigella flexneri 2a str. 301
gucuucugugauuccgcca

SEQ ID NO: 1981019 - RNA, 21 nt, Shigella flexneri 2a str. 301
gucuugaauaaauuggcuggg

SEQ ID NO: 1981020 - RNA, 23 nt, Shigella flexneri 2a str. 301
gucuugaauaaauuggcuggggu

SEQ ID NO: 1981021 - RNA, 20 nt, Shigella flexneri 2a str. 301
gucuucaucauccucuucag

SEQ ID NO: 1981022 - RNA, 16 nt, Shigella flexneri 2a str. 301
gucuuaucaugccuac

SEQ ID NO: 1981023 - RNA, 20 nt, Shigella flexneri 2a str. 301
gucuuauccggccuuccugu

SEQ ID NO: 1981024 - RNA, 21 nt, Shigella flexneri 2a str. 301
gucuuaaaggggugaaaaaaa

SEQ ID NO: 1981025 - RNA, 20 nt, Shigella flexneri 2a str. 301
gucuuaaaccggacaauaaa

SEQ ID NO: 1981026 - RNA, 15 nt, Shigella flexneri 2a str. 301
gucuguuuuaucucc

SEQ ID NO: 1981027 - RNA, 18 nt, Shigella flexneri 2a str. 301
gucuguuuuaucucccug

SEQ ID NO: 1981028 - RNA, 13 nt, Shigella flexneri 2a str. 301
gucuguuccccuc

SEQ ID NO: 1981029 - RNA, 22 nt, Shigella flexneri 2a str. 301
gucuuucuuaccccugauuuug

SEQ ID NO: 1981030 - RNA, 22 nt, Shigella flexneri 2a str. 301
gucuuuauugaguaccagcgca

SEQ ID NO: 1981031 - RNA, 16 nt, Shigella flexneri 2a str. 301
gucuuugcguuccauc

SEQ ID NO: 1981032 - RNA, 14 nt, Shigella flexneri 2a str. 301
gucuuguacuuccg

SEQ ID NO: 1981033 - RNA, 13 nt, Shigella flexneri 2a str. 301
gugaaaaauaaaa

SEQ ID NO: 1981034 - RNA, 21 nt, Shigella flexneri 2a str. 301
gugaaaaaccaaucucccagc

SEQ ID NO: 1981035 - RNA, 14 nt, Shigella flexneri 2a str. 301
gugaaaaaaacugc

SEQ ID NO: 1981036 - RNA, 11 nt, Shigella flexneri 2a str. 301
gugaaaaaaag

SEQ ID NO: 1981037 - RNA, 17 nt, Shigella flexneri 2a str. 301
gucuuuuuuccagcaca

SEQ ID NO: 1981038 - RNA, 22 nt, Shigella flexneri 2a str. 301
gucuuuuuucacuggcaaugac

SEQ ID NO: 1981039 - RNA, 12 nt, Shigella flexneri 2a str. 301
gucuuuuuucac

SEQ ID NO: 1981040 - RNA, 22 nt, Shigella flexneri 2a str. 301
gucuuuuucucccuuaaaaaau

SEQ ID NO: 1981041 - RNA, 13 nt, Shigella flexneri 2a str. 301
gucuuuugaucaa

SEQ ID NO: 1981042 - RNA, 22 nt, Shigella flexneri 2a str. 301
gugaaaacgacgcgguauuggu

SEQ ID NO: 1981043 - RNA, 14 nt, Shigella flexneri 2a str. 301
gugaaaaucgaguu

SEQ ID NO: 1981044 - RNA, 19 nt, Shigella flexneri 2a str. 301
gugaaacaaaucacuauua

SEQ ID NO: 1981045 - RNA, 23 nt, Shigella flexneri 2a str. 301
gugaaaccuuuaugcagcucggu

SEQ ID NO: 1981046 - RNA, 17 nt, Shigella flexneri 2a str. 301
gugaaagagccgucauu

SEQ ID NO: 1981047 - RNA, 21 nt, Shigella flexneri 2a str. 301
gugaaagagccgucauucugc

SEQ ID NO: 1981048 - RNA, 17 nt, Shigella flexneri 2a str. 301
aaauagccaaucauucc

SEQ ID NO: 1981049 - RNA, 21 nt, Shigella flexneri 2a str. 301
aaauagccaaucauucccauu

SEQ ID NO: 1981050 - RNA, 20 nt, Shigella flexneri 2a str. 301
aaauagcaaaguaauaauga

SEQ ID NO: 1981051 - RNA, 21 nt, Shigella flexneri 2a str. 301
gugcaggcaccagccccugga

SEQ ID NO: 1981052 - RNA, 16 nt, Shigella flexneri 2a str. 301
gugcacgcgcuucagu

SEQ ID NO: 1981053 - RNA, 20 nt, Shigella flexneri 2a str. 301
gugcacaacaaucugcaaau

SEQ ID NO: 1981054 - RNA, 21 nt, Shigella flexneri 2a str. 301
gugcagacaugacgcccggca

SEQ ID NO: 1981055 - RNA, 20 nt, Shigella flexneri 2a str. 301
gugaucguggccaugaccgc

SEQ ID NO: 1981056 - RNA, 14 nt, Shigella flexneri 2a str. 301
gugauuaucggcau

SEQ ID NO: 1981057 - RNA, 16 nt, Shigella flexneri 2a str. 301
gugcaaucaaacucaa

SEQ ID NO: 1981058 - RNA, 16 nt, Shigella flexneri 2a str. 301
gugcaauaccauggcu

SEQ ID NO: 1981059 - RNA, 22 nt, Shigella flexneri 2a str. 301
gugcaauaccauggcucaccag

SEQ ID NO: 1981060 - RNA, 22 nt, Shigella flexneri 2a str. 301
gugauuuccgccgccagcagac

SEQ ID NO: 1981061 - RNA, 14 nt, Shigella flexneri 2a str. 301
gugauuucuucauu

SEQ ID NO: 1981062 - RNA, 23 nt, Shigella flexneri 2a str. 301
gugcaagcauuagcauacugaaa

SEQ ID NO: 1981063 - RNA, 17 nt, Shigella flexneri 2a str. 301
gugcaagaaaugacaga

SEQ ID NO: 1981064 - RNA, 21 nt, Shigella flexneri 2a str. 301
gugauuucaggcuuuuuucca

SEQ ID NO: 1981065 - RNA, 21 nt, Shigella flexneri 2a str. 301
gugauuccgccaguugcggcu

SEQ ID NO: 1981066 - RNA, 22 nt, Shigella flexneri 2a str. 301
gugauugccgcaacgguugcgg

SEQ ID NO: 1981067 - RNA, 15 nt, Shigella flexneri 2a str. 301
gugauugccgcagaa

SEQ ID NO: 1981068 - RNA, 11 nt, Shigella flexneri 2a str. 301
gugacugcugg

SEQ ID NO: 1981069 - RNA, 16 nt, Shigella flexneri 2a str. 301
gugacuggaaaucaaa

SEQ ID NO: 1981070 - RNA, 21 nt, Shigella flexneri 2a str. 301
gugacucaauggcauccgcca

SEQ ID NO: 1981071 - RNA, 21 nt, Shigella flexneri 2a str. 301
gugagaucauuauuaaacaga

SEQ ID NO: 1981072 - RNA, 16 nt, Shigella flexneri 2a str. 301
gugagagauaauaaaa

SEQ ID NO: 1981073 - RNA, 22 nt, Shigella flexneri 2a str. 301
gugagcgguguugccgaagcag

SEQ ID NO: 1981074 - RNA, 14 nt, Shigella flexneri 2a str. 301
gugagcacaucugg

SEQ ID NO: 1981075 - RNA, 15 nt, Shigella flexneri 2a str. 301
gugagcagggcacuu

SEQ ID NO: 1981076 - RNA, 14 nt, Shigella flexneri 2a str. 301
gugagauugcugcg

SEQ ID NO: 1981077 - RNA, 20 nt, Shigella flexneri 2a str. 301
gugagauuaaucgcggcugg

SEQ ID NO: 1981078 - RNA, 22 nt, Shigella flexneri 2a str. 301
gugaggggaacccguuggcaca

SEQ ID NO: 1981079 - RNA, 16 nt, Shigella flexneri 2a str. 301
gugagcugguaaccgc

SEQ ID NO: 1981080 - RNA, 12 nt, Shigella flexneri 2a str. 301
gugagcgugcgg

SEQ ID NO: 1981081 - RNA, 12 nt, Shigella flexneri 2a str. 301
gugagguaacaa

SEQ ID NO: 1981082 - RNA, 22 nt, Shigella flexneri 2a str. 301
gugaguuccgcugcuggggcca

SEQ ID NO: 1981083 - RNA, 17 nt, Shigella flexneri 2a str. 301
gugaguugguuauucaa

SEQ ID NO: 1981084 - RNA, 22 nt, Shigella flexneri 2a str. 301
gugauaaaacgcagucuuccca

SEQ ID NO: 1981085 - RNA, 23 nt, Shigella flexneri 2a str. 301
gugauaaaacgcagucuucccag

SEQ ID NO: 1981086 - RNA, 18 nt, Shigella flexneri 2a str. 301
gugacacgcgcgcauggu

SEQ ID NO: 1981087 - RNA, 18 nt, Shigella flexneri 2a str. 301
gugacacaaucaaauccu

SEQ ID NO: 1981088 - RNA, 16 nt, Shigella flexneri 2a str. 301
gugacaccaaccgcgg

SEQ ID NO: 1981089 - RNA, 23 nt, Shigella flexneri 2a str. 301
aaauaggaauccgggucuguaaa

SEQ ID NO: 1981090 - RNA, 18 nt, Shigella flexneri 2a str. 301
gugacagcccggcauguu

SEQ ID NO: 1981091 - RNA, 13 nt, Shigella flexneri 2a str. 301
gugaccagcagca

SEQ ID NO: 1981092 - RNA, 16 nt, Shigella flexneri 2a str. 301
gugacgcaaccgcaaa

SEQ ID NO: 1981093 - RNA, 17 nt, Shigella flexneri 2a str. 301
gugacgacaccaucucu

SEQ ID NO: 1981094 - RNA, 18 nt, Shigella flexneri 2a str. 301
gugacgaaacugcucaaa

SEQ ID NO: 1981095 - RNA, 17 nt, Shigella flexneri 2a str. 301
gugacgcugucuuauca

SEQ ID NO: 1981096 - RNA, 23 nt, Shigella flexneri 2a str. 301
gugaccgaaggugcacuagacga

SEQ ID NO: 1981097 - RNA, 16 nt, Shigella flexneri 2a str. 301
gugacccgcagccagc

SEQ ID NO: 1981098 - RNA, 18 nt, Shigella flexneri 2a str. 301
gugacccgcagccagcac

SEQ ID NO: 1981099 - RNA, 22 nt, Shigella flexneri 2a str. 301
gugaccaucagcaugacaaaaa

SEQ ID NO: 1981100 - RNA, 15 nt, Shigella flexneri 2a str. 301
gugaauuguuuuaua

SEQ ID NO: 1981101 - RNA, 17 nt, Shigella flexneri 2a str. 301
gugacaaucaccagguc

SEQ ID NO: 1981102 - RNA, 23 nt, Shigella flexneri 2a str. 301
gugaauauuuaaccugagcuuga

SEQ ID NO: 1981103 - RNA, 14 nt, Shigella flexneri 2a str. 301
gugaaucacuccau

SEQ ID NO: 1981104 - RNA, 17 nt, Shigella flexneri 2a str. 301
gugaaugguggcgauga

SEQ ID NO: 1981105 - RNA, 20 nt, Shigella flexneri 2a str. 301
gugaaucgggcgugauucca

SEQ ID NO: 1981106 - RNA, 23 nt, Shigella flexneri 2a str. 301
gugaagugagaauuuuucacucc

SEQ ID NO: 1981107 - RNA, 21 nt, Shigella flexneri 2a str. 301
gugaaguugccggauguguug

SEQ ID NO: 1981108 - RNA, 21 nt, Shigella flexneri 2a str. 301
aaauagcccgauggauuuauc

SEQ ID NO: 1981109 - RNA, 17 nt, Shigella flexneri 2a str. 301
aaauagccccugacugg

SEQ ID NO: 1981110 - RNA, 14 nt, Shigella flexneri 2a str. 301
aaauagccugccag

SEQ ID NO: 1981111 - RNA, 18 nt, Shigella flexneri 2a str. 301
gugaagcacguaaaucuu

SEQ ID NO: 1981112 - RNA, 15 nt, Shigella flexneri 2a str. 301
gugaagcagagcaga

SEQ ID NO: 1981113 - RNA, 16 nt, Shigella flexneri 2a str. 301
gugaagcagagcagac

SEQ ID NO: 1981114 - RNA, 18 nt, Shigella flexneri 2a str. 301
gugaagagauccaccagc

SEQ ID NO: 1981115 - RNA, 19 nt, Shigella flexneri 2a str. 301
gugaacguguaggccugau

SEQ ID NO: 1981116 - RNA, 21 nt, Shigella flexneri 2a str. 301
gugaacugccacacaggccau

SEQ ID NO: 1981117 - RNA, 14 nt, Shigella flexneri 2a str. 301
gugaacgccuuauc

SEQ ID NO: 1981118 - RNA, 15 nt, Shigella flexneri 2a str. 301
gugaacgccagcaga

SEQ ID NO: 1981119 - RNA, 13 nt, Shigella flexneri 2a str. 301
guuuccagauuuu

SEQ ID NO: 1981120 - RNA, 12 nt, Shigella flexneri 2a str. 301
guuuccagcacc

SEQ ID NO: 1981121 - RNA, 22 nt, Shigella flexneri 2a str. 301
guuuccagcucggcaaucuguu

SEQ ID NO: 1981122 - RNA, 21 nt, Shigella flexneri 2a str. 301
guuuccagcaucgaccaggau

SEQ ID NO: 1981123 - RNA, 13 nt, Shigella flexneri 2a str. 301
guuucccuguuca

SEQ ID NO: 1981124 - RNA, 14 nt, Shigella flexneri 2a str. 301
guuuccucaugcau

SEQ ID NO: 1981125 - RNA, 22 nt, Shigella flexneri 2a str. 301
guuucgaacaggccgacuggca

SEQ ID NO: 1981126 - RNA, 12 nt, Shigella flexneri 2a str. 301
aaaucaaaccaa

SEQ ID NO: 1981127 - RNA, 15 nt, Shigella flexneri 2a str. 301
aaaucaacaugaaaa

SEQ ID NO: 1981128 - RNA, 19 nt, Shigella flexneri 2a str. 301
aaaucaacaugaaaauaac

SEQ ID NO: 1981129 - RNA, 13 nt, Shigella flexneri 2a str. 301
aaaucaacauguu

SEQ ID NO: 1981130 - RNA, 14 nt, Shigella flexneri 2a str. 301
aaaucaccaccagc

SEQ ID NO: 1981131 - RNA, 21 nt, Shigella flexneri 2a str. 301
aaaucaccauauucagcagca

SEQ ID NO: 1981132 - RNA, 17 nt, Shigella flexneri 2a str. 301
aaaucaccaccagcacc

SEQ ID NO: 1981133 - RNA, 13 nt, Shigella flexneri 2a str. 301
aaaucacgcgccu

SEQ ID NO: 1981134 - RNA, 13 nt, Shigella flexneri 2a str. 301
aaaucacgcauca

SEQ ID NO: 1981135 - RNA, 20 nt, Shigella flexneri 2a str. 301
aaaucacgcugcugauuaaa

SEQ ID NO: 1981136 - RNA, 18 nt, Shigella flexneri 2a str. 301
aaaucacgucgauuuuua

SEQ ID NO: 1981137 - RNA, 23 nt, Shigella flexneri 2a str. 301
aaaucaccauauucagcagcaga

SEQ ID NO: 1981138 - RNA, 16 nt, Shigella flexneri 2a str. 301
aaaucacgauugcugc

SEQ ID NO: 1981139 - RNA, 14 nt, Shigella flexneri 2a str. 301
guuucucuguucag

SEQ ID NO: 1981140 - RNA, 18 nt, Shigella flexneri 2a str. 301
guuucucugacgcucucu

SEQ ID NO: 1981141 - RNA, 23 nt, Shigella flexneri 2a str. 301
guuucucaaaugaccgcgcuggc

SEQ ID NO: 1981142 - RNA, 18 nt, Shigella flexneri 2a str. 301
aaaucacuauuaaagaaa

SEQ ID NO: 1981143 - RNA, 23 nt, Shigella flexneri 2a str. 301
aaaucaauccaguguaaaacagc

SEQ ID NO: 1981144 - RNA, 17 nt, Shigella flexneri 2a str. 301
guuucgaauuacacagc

SEQ ID NO: 1981145 - RNA, 16 nt, Shigella flexneri 2a str. 301
guuucgacaauaauca

SEQ ID NO: 1981146 - RNA, 22 nt, Shigella flexneri 2a str. 301
aaaucaacuugacgauuaacgc

SEQ ID NO: 1981147 - RNA, 15 nt, Shigella flexneri 2a str. 301
guuucgcgguuggug

SEQ ID NO: 1981148 - RNA, 18 nt, Shigella flexneri 2a str. 301
guuucggcaucagcagaa

SEQ ID NO: 1981149 - RNA, 12 nt, Shigella flexneri 2a str. 301
guuucgccagcc

SEQ ID NO: 1981150 - RNA, 17 nt, Shigella flexneri 2a str. 301
guuucgccagccgaugc

SEQ ID NO: 1981151 - RNA, 18 nt, Shigella flexneri 2a str. 301
guuucgauuucugacugu

SEQ ID NO: 1981152 - RNA, 16 nt, Shigella flexneri 2a str. 301
guuucgcuucuucagc

SEQ ID NO: 1981153 - RNA, 18 nt, Shigella flexneri 2a str. 301
guuucgugcaucauggaa

SEQ ID NO: 1981154 - RNA, 18 nt, Shigella flexneri 2a str. 301
guuucguggauaacaccg

SEQ ID NO: 1981155 - RNA, 19 nt, Shigella flexneri 2a str. 301
guuugccguugaucucucc

SEQ ID NO: 1981156 - RNA, 15 nt, Shigella flexneri 2a str. 301
guuugcgcccaguua

SEQ ID NO: 1981157 - RNA, 21 nt, Shigella flexneri 2a str. 301
guuugcgcagccaguuaaccu

SEQ ID NO: 1981158 - RNA, 15 nt, Shigella flexneri 2a str. 301
guuugcgucauggua

SEQ ID NO: 1981159 - RNA, 19 nt, Shigella flexneri 2a str. 301
guuugcgucagcuucagau

SEQ ID NO: 1981160 - RNA, 13 nt, Shigella flexneri 2a str. 301
guuugucauaaau

SEQ ID NO: 1981161 - RNA, 21 nt, Shigella flexneri 2a str. 301
guuugucauaaaucucagccc

SEQ ID NO: 1981162 - RNA, 13 nt, Shigella flexneri 2a str. 301
guuugcugccuuc

SEQ ID NO: 1981163 - RNA, 12 nt, Shigella flexneri 2a str. 301
guuuguucagcu

SEQ ID NO: 1981164 - RNA, 16 nt, Shigella flexneri 2a str. 301
guuuguucaagcgcaa

SEQ ID NO: 1981165 - RNA, 17 nt, Shigella flexneri 2a str. 301
guuugugggaauaacca

SEQ ID NO: 1981166 - RNA, 20 nt, Shigella flexneri 2a str. 301
guuugugccgaaccguaggc

SEQ ID NO: 1981167 - RNA, 18 nt, Shigella flexneri 2a str. 301
guuuuacuuuuuaacuuu

SEQ ID NO: 1981168 - RNA, 17 nt, Shigella flexneri 2a str. 301
guuuuacuuugccuuuc

SEQ ID NO: 1981169 - RNA, 21 nt, Shigella flexneri 2a str. 301
guuuuacuggaguuauucauu

SEQ ID NO: 1981170 - RNA, 20 nt, Shigella flexneri 2a str. 301
guuucuucgauggcuggggu

SEQ ID NO: 1981171 - RNA, 18 nt, Shigella flexneri 2a str. 301
guuugaucacuuccagca

SEQ ID NO: 1981172 - RNA, 16 nt, Shigella flexneri 2a str. 301
guuugaucacuuccag

SEQ ID NO: 1981173 - RNA, 18 nt, Shigella flexneri 2a str. 301
guuucuggcuuaaacgca

SEQ ID NO: 1981174 - RNA, 16 nt, Shigella flexneri 2a str. 301
guuucugcgcuucugc

SEQ ID NO: 1981175 - RNA, 16 nt, Shigella flexneri 2a str. 301
guuucuuccagcgcca

SEQ ID NO: 1981176 - RNA, 16 nt, Shigella flexneri 2a str. 301
guuucugcagcuccag

SEQ ID NO: 1981177 - RNA, 13 nt, Shigella flexneri 2a str. 301
guuucugcagcuc

SEQ ID NO: 1981178 - RNA, 19 nt, Shigella flexneri 2a str. 301
guuucugauacagcucaug

SEQ ID NO: 1981179 - RNA, 17 nt, Shigella flexneri 2a str. 301
guuucugcuucugccag

SEQ ID NO: 1981180 - RNA, 22 nt, Shigella flexneri 2a str. 301
guuucuggaugauccuggccug

SEQ ID NO: 1981181 - RNA, 21 nt, Shigella flexneri 2a str. 301
guuucugaauuucagcgccug

SEQ ID NO: 1981182 - RNA, 20 nt, Shigella flexneri 2a str. 301
guuuugcccacucaacgguu

SEQ ID NO: 1981183 - RNA, 14 nt, Shigella flexneri 2a str. 301
guuuucaccggcac

SEQ ID NO: 1981184 - RNA, 17 nt, Shigella flexneri 2a str. 301
guuuucacccuuucguu

SEQ ID NO: 1981185 - RNA, 12 nt, Shigella flexneri 2a str. 301
guuuucaccagu

SEQ ID NO: 1981186 - RNA, 13 nt, Shigella flexneri 2a str. 301
guuuucuuugcca

SEQ ID NO: 1981187 - RNA, 18 nt, Shigella flexneri 2a str. 301
guuuucaguugcucugca

SEQ ID NO: 1981188 - RNA, 20 nt, Shigella flexneri 2a str. 301
guuuucagcuucgguuucac

SEQ ID NO: 1981189 - RNA, 21 nt, Shigella flexneri 2a str. 301
guuuucagcucgcgcaauuua

SEQ ID NO: 1981190 - RNA, 20 nt, Shigella flexneri 2a str. 301
aaauccaaccucuucuuuua

SEQ ID NO: 1981191 - RNA, 13 nt, Shigella flexneri 2a str. 301
aaauccaacaaca

SEQ ID NO: 1981192 - RNA, 14 nt, Shigella flexneri 2a str. 301
aaaucaucaucuuu

SEQ ID NO: 1981193 - RNA, 15 nt, Shigella flexneri 2a str. 301
aaaucaucaucuuua

SEQ ID NO: 1981194 - RNA, 17 nt, Shigella flexneri 2a str. 301
aaaucauauaauuguuc

SEQ ID NO: 1981195 - RNA, 22 nt, Shigella flexneri 2a str. 301
guuuuauaaucgcaucaaucuu

SEQ ID NO: 1981196 - RNA, 17 nt, Shigella flexneri 2a str. 301
guuuuaguguuuguauu

SEQ ID NO: 1981197 - RNA, 17 nt, Shigella flexneri 2a str. 301
guuuuauaacggcuggc

SEQ ID NO: 1981198 - RNA, 14 nt, Shigella flexneri 2a str. 301
guuuuauaaucgca

SEQ ID NO: 1981199 - RNA, 21 nt, Shigella flexneri 2a str. 301
aaauauggugaaaguaaaaaa

SEQ ID NO: 1981200 - RNA, 17 nt, Shigella flexneri 2a str. 301
aaauauggugaaaguaa

SEQ ID NO: 1981201 - RNA, 22 nt, Shigella flexneri 2a str. 301
aaauauggugaaaguaaaaaag

SEQ ID NO: 1981202 - RNA, 13 nt, Shigella flexneri 2a str. 301
aaauauuaauaau

SEQ ID NO: 1981203 - RNA, 13 nt, Shigella flexneri 2a str. 301
guuucaucuucag

SEQ ID NO: 1981204 - RNA, 16 nt, Shigella flexneri 2a str. 301
guuucauaucugccag

SEQ ID NO: 1981205 - RNA, 14 nt, Shigella flexneri 2a str. 301
guuucaguaauccu

SEQ ID NO: 1981206 - RNA, 18 nt, Shigella flexneri 2a str. 301
guuucagaccaauaaucc

SEQ ID NO: 1981207 - RNA, 16 nt, Shigella flexneri 2a str. 301
guuucacuuucugcaa

SEQ ID NO: 1981208 - RNA, 20 nt, Shigella flexneri 2a str. 301
guuucagccccaucaacgcc

SEQ ID NO: 1981209 - RNA, 18 nt, Shigella flexneri 2a str. 301
aaauaucgcccauaugaa

SEQ ID NO: 1981210 - RNA, 17 nt, Shigella flexneri 2a str. 301
aaauaucuucaauagca

SEQ ID NO: 1981211 - RNA, 22 nt, Shigella flexneri 2a str. 301
aaauaucuauauacaaucacac

SEQ ID NO: 1981212 - RNA, 16 nt, Shigella flexneri 2a str. 301
guuucaaugcucugca

SEQ ID NO: 1981213 - RNA, 18 nt, Shigella flexneri 2a str. 301
guuucaauauccgguuca

SEQ ID NO: 1981214 - RNA, 19 nt, Shigella flexneri 2a str. 301
guuuacugucugcuucugc

SEQ ID NO: 1981215 - RNA, 14 nt, Shigella flexneri 2a str. 301
guuuaucaggccac

SEQ ID NO: 1981216 - RNA, 13 nt, Shigella flexneri 2a str. 301
guuuauccauccc

SEQ ID NO: 1981217 - RNA, 14 nt, Shigella flexneri 2a str. 301
guuuaucuucccag

SEQ ID NO: 1981218 - RNA, 18 nt, Shigella flexneri 2a str. 301
guugucaguucuuuuauu

SEQ ID NO: 1981219 - RNA, 23 nt, Shigella flexneri 2a str. 301
guugucaggaagccccagcuuuu

SEQ ID NO: 1981220 - RNA, 23 nt, Shigella flexneri 2a str. 301
guuguccuuaccacagacaaaau

SEQ ID NO: 1981221 - RNA, 17 nt, Shigella flexneri 2a str. 301
guugucauuacaacaag

SEQ ID NO: 1981222 - RNA, 15 nt, Shigella flexneri 2a str. 301
guugucauuacaaca

SEQ ID NO: 1981223 - RNA, 14 nt, Shigella flexneri 2a str. 301
guuuaagacgccgc

SEQ ID NO: 1981224 - RNA, 17 nt, Shigella flexneri 2a str. 301
guuuaauaaauuuagcu

SEQ ID NO: 1981225 - RNA, 14 nt, Shigella flexneri 2a str. 301
guuuaaccaucagg

SEQ ID NO: 1981226 - RNA, 20 nt, Shigella flexneri 2a str. 301
guuuaaccgggagauuuucu

SEQ ID NO: 1981227 - RNA, 16 nt, Shigella flexneri 2a str. 301
guugucgccgcuggug

SEQ ID NO: 1981228 - RNA, 14 nt, Shigella flexneri 2a str. 301
guuuacgccaggca

SEQ ID NO: 1981229 - RNA, 23 nt, Shigella flexneri 2a str. 301
guuuacuucgcuuuacccugguu

SEQ ID NO: 1981230 - RNA, 19 nt, Shigella flexneri 2a str. 301
guugcguuuuuaucuucac

SEQ ID NO: 1981231 - RNA, 21 nt, Shigella flexneri 2a str. 301
guugcgucucgacaaacuccg

SEQ ID NO: 1981232 - RNA, 16 nt, Shigella flexneri 2a str. 301
guugcguugaaacguu

SEQ ID NO: 1981233 - RNA, 13 nt, Shigella flexneri 2a str. 301
guugcugaccuuc

SEQ ID NO: 1981234 - RNA, 23 nt, Shigella flexneri 2a str. 301
guugcugccgacaaaugcaguuu

SEQ ID NO: 1981235 - RNA, 19 nt, Shigella flexneri 2a str. 301
guugcugccuugcgggcug

SEQ ID NO: 1981236 - RNA, 16 nt, Shigella flexneri 2a str. 301
guugcgcaugaccuuu

SEQ ID NO: 1981237 - RNA, 14 nt, Shigella flexneri 2a str. 301
guugcgcccaucau

SEQ ID NO: 1981238 - RNA, 22 nt, Shigella flexneri 2a str. 301
guugcgccugauaaucugcuga

SEQ ID NO: 1981239 - RNA, 16 nt, Shigella flexneri 2a str. 301
guugcgccuugucuuu

SEQ ID NO: 1981240 - RNA, 20 nt, Shigella flexneri 2a str. 301
guugcgcuucccgaaucaug

SEQ ID NO: 1981241 - RNA, 15 nt, Shigella flexneri 2a str. 301
guugcgguuucaacu

SEQ ID NO: 1981242 - RNA, 18 nt, Shigella flexneri 2a str. 301
guugcguaacugaucgua

SEQ ID NO: 1981243 - RNA, 22 nt, Shigella flexneri 2a str. 301
guugguucagugggcgcugcug

SEQ ID NO: 1981244 - RNA, 15 nt, Shigella flexneri 2a str. 301
guugguacuguggca

SEQ ID NO: 1981245 - RNA, 22 nt, Shigella flexneri 2a str. 301
guuggcgcauaacucaccauca

SEQ ID NO: 1981246 - RNA, 17 nt, Shigella flexneri 2a str. 301
guuggcgcuggcggcug

SEQ ID NO: 1981247 - RNA, 18 nt, Shigella flexneri 2a str. 301
guugccgcucuuuuguuc

SEQ ID NO: 1981248 - RNA, 12 nt, Shigella flexneri 2a str. 301
guugccugcugu

SEQ ID NO: 1981249 - RNA, 23 nt, Shigella flexneri 2a str. 301
guugcgaaaaaaucauccauccg

SEQ ID NO: 1981250 - RNA, 16 nt, Shigella flexneri 2a str. 301
guugcgaucgaccugc

SEQ ID NO: 1981251 - RNA, 13 nt, Shigella flexneri 2a str. 301
guugcaccagcaa

SEQ ID NO: 1981252 - RNA, 19 nt, Shigella flexneri 2a str. 301
guugcaccgaguucuucac

SEQ ID NO: 1981253 - RNA, 23 nt, Shigella flexneri 2a str. 301
guucucaucgccaucaauaacca

SEQ ID NO: 1981254 - RNA, 14 nt, Shigella flexneri 2a str. 301
guucucaauuacug

SEQ ID NO: 1981255 - RNA, 14 nt, Shigella flexneri 2a str. 301
guucuacauaaaac

SEQ ID NO: 1981256 - RNA, 15 nt, Shigella flexneri 2a str. 301
guucuaccgcagggg

SEQ ID NO: 1981257 - RNA, 22 nt, Shigella flexneri 2a str. 301
guucuacgugcgcuauguguua

SEQ ID NO: 1981258 - RNA, 20 nt, Shigella flexneri 2a str. 301
guucucccauaggaugaggu

SEQ ID NO: 1981259 - RNA, 17 nt, Shigella flexneri 2a str. 301
guugagggcgcaauuuc

SEQ ID NO: 1981260 - RNA, 11 nt, Shigella flexneri 2a str. 301
guugaggaagc

SEQ ID NO: 1981261 - RNA, 18 nt, Shigella flexneri 2a str. 301
guugaggaacucaaacca

SEQ ID NO: 1981262 - RNA, 15 nt, Shigella flexneri 2a str. 301
guuaagaaaacggaa

SEQ ID NO: 1981263 - RNA, 20 nt, Shigella flexneri 2a str. 301
guuaaucuuuucugagucaa

SEQ ID NO: 1981264 - RNA, 11 nt, Shigella flexneri 2a str. 301
guuaaugguug

SEQ ID NO: 1981265 - RNA, 16 nt, Shigella flexneri 2a str. 301
guuaacgcgucuuuga

SEQ ID NO: 1981266 - RNA, 19 nt, Shigella flexneri 2a str. 301
guuaacugaauauuccagu

SEQ ID NO: 1981267 - RNA, 21 nt, Shigella flexneri 2a str. 301
guuaacugaauauuccaguua

SEQ ID NO: 1981268 - RNA, 12 nt, Shigella flexneri 2a str. 301
guuaaccagcac

SEQ ID NO: 1981269 - RNA, 21 nt, Shigella flexneri 2a str. 301
guuaaaauucaagacaucaau

SEQ ID NO: 1981270 - RNA, 23 nt, Shigella flexneri 2a str. 301
guuaacaccaccgccgacuguca

SEQ ID NO: 1981271 - RNA, 18 nt, Shigella flexneri 2a str. 301
guuaacaccaguaaauaa

SEQ ID NO: 1981272 - RNA, 20 nt, Shigella flexneri 2a str. 301
guuaaaacuaaaaacagcau

SEQ ID NO: 1981273 - RNA, 17 nt, Shigella flexneri 2a str. 301
guuaaaacuuuuagcau

SEQ ID NO: 1981274 - RNA, 23 nt, Shigella flexneri 2a str. 301
guuaaaauaccagaucucaccac

SEQ ID NO: 1981275 - RNA, 17 nt, Shigella flexneri 2a str. 301
guguugcguuuaaacca

SEQ ID NO: 1981276 - RNA, 17 nt, Shigella flexneri 2a str. 301
guguugcuccccagaau

SEQ ID NO: 1981277 - RNA, 22 nt, Shigella flexneri 2a str. 301
guguugccgccaccuuucuguu

SEQ ID NO: 1981278 - RNA, 23 nt, Shigella flexneri 2a str. 301
guguugcugaacuuaugcaaaau

SEQ ID NO: 1981279 - RNA, 23 nt, Shigella flexneri 2a str. 301
guuaucagaaccgcccagaccug

SEQ ID NO: 1981280 - RNA, 14 nt, Shigella flexneri 2a str. 301
guuaucucauucaa

SEQ ID NO: 1981281 - RNA, 13 nt, Shigella flexneri 2a str. 301
guuaugaaacucc

SEQ ID NO: 1981282 - RNA, 22 nt, Shigella flexneri 2a str. 301
guuaugcaccgacaauccggua

SEQ ID NO: 1981283 - RNA, 13 nt, Shigella flexneri 2a str. 301
guuagucaucauc

SEQ ID NO: 1981284 - RNA, 15 nt, Shigella flexneri 2a str. 301
guuagucaugaaaua

SEQ ID NO: 1981285 - RNA, 18 nt, Shigella flexneri 2a str. 301
guuaccuucggccccauc

SEQ ID NO: 1981286 - RNA, 18 nt, Shigella flexneri 2a str. 301
guuaccgacugcggccug

SEQ ID NO: 1981287 - RNA, 16 nt, Shigella flexneri 2a str. 301
guuaccgaucgccagc

SEQ ID NO: 1981288 - RNA, 17 nt, Shigella flexneri 2a str. 301
guuagaaacaaaaaaac

SEQ ID NO: 1981289 - RNA, 18 nt, Shigella flexneri 2a str. 301
guuacuuuuuaugucauu

SEQ ID NO: 1981290 - RNA, 16 nt, Shigella flexneri 2a str. 301
guuacugccaucuucc

SEQ ID NO: 1981291 - RNA, 17 nt, Shigella flexneri 2a str. 301
guuacugucgcgcagca

SEQ ID NO: 1981292 - RNA, 13 nt, Shigella flexneri 2a str. 301
guuccgauaaguu

SEQ ID NO: 1981293 - RNA, 21 nt, Shigella flexneri 2a str. 301
guuccaucuuuaugaaauauc

SEQ ID NO: 1981294 - RNA, 15 nt, Shigella flexneri 2a str. 301
guuccaucaccagau

SEQ ID NO: 1981295 - RNA, 14 nt, Shigella flexneri 2a str. 301
guuccauaaucgcc

SEQ ID NO: 1981296 - RNA, 17 nt, Shigella flexneri 2a str. 301
guuccauaaucgccuga

SEQ ID NO: 1981297 - RNA, 16 nt, Shigella flexneri 2a str. 301
guuccauaugaauucc

SEQ ID NO: 1981298 - RNA, 22 nt, Shigella flexneri 2a str. 301
guuccgccauuuuaaucaucug

SEQ ID NO: 1981299 - RNA, 23 nt, Shigella flexneri 2a str. 301
guuccggagaagcguagguguua

SEQ ID NO: 1981300 - RNA, 20 nt, Shigella flexneri 2a str. 301
guuccuuaacuucaucagca

SEQ ID NO: 1981301 - RNA, 15 nt, Shigella flexneri 2a str. 301
guucggcgguuuuuu

SEQ ID NO: 1981302 - RNA, 20 nt, Shigella flexneri 2a str. 301
guucggggcuguuuuccagc

SEQ ID NO: 1981303 - RNA, 23 nt, Shigella flexneri 2a str. 301
guucgcauacggguuuuccccuu

SEQ ID NO: 1981304 - RNA, 22 nt, Shigella flexneri 2a str. 301
guucgcccacgcgcauucccag

SEQ ID NO: 1981305 - RNA, 19 nt, Shigella flexneri 2a str. 301
guucgccccaaaaaagcga

SEQ ID NO: 1981306 - RNA, 22 nt, Shigella flexneri 2a str. 301
guucgcaccaucaaaguuuuua

SEQ ID NO: 1981307 - RNA, 22 nt, Shigella flexneri 2a str. 301
guuauugguauggucgugauca

SEQ ID NO: 1981308 - RNA, 16 nt, Shigella flexneri 2a str. 301
guuauuuccaggagau

SEQ ID NO: 1981309 - RNA, 21 nt, Shigella flexneri 2a str. 301
guucaccauuagacaguuugc

SEQ ID NO: 1981310 - RNA, 23 nt, Shigella flexneri 2a str. 301
guucagccagugaccuuaaucag

SEQ ID NO: 1981311 - RNA, 17 nt, Shigella flexneri 2a str. 301
guucagcgcaacuugca

SEQ ID NO: 1981312 - RNA, 18 nt, Shigella flexneri 2a str. 301
guucagcgggcagggcau

SEQ ID NO: 1981313 - RNA, 15 nt, Shigella flexneri 2a str. 301
guucacgcagcucac

SEQ ID NO: 1981314 - RNA, 18 nt, Shigella flexneri 2a str. 301
guucacgccaucaucggc

SEQ ID NO: 1981315 - RNA, 19 nt, Shigella flexneri 2a str. 301
guucacgccgcaucuggca

SEQ ID NO: 1981316 - RNA, 22 nt, Shigella flexneri 2a str. 301
guucacggcgauaccaguaaua

SEQ ID NO: 1981317 - RNA, 14 nt, Shigella flexneri 2a str. 301
guuccaguggcuga

SEQ ID NO: 1981318 - RNA, 19 nt, Shigella flexneri 2a str. 301
guuccacuucugcggguga

SEQ ID NO: 1981319 - RNA, 19 nt, Shigella flexneri 2a str. 301
guuccaccacguuuuucaa

SEQ ID NO: 1981320 - RNA, 18 nt, Shigella flexneri 2a str. 301
guuccaccgcguuuucca

SEQ ID NO: 1981321 - RNA, 22 nt, Shigella flexneri 2a str. 301
guuccaccgcguuuuccaguuc

SEQ ID NO: 1981322 - RNA, 21 nt, Shigella flexneri 2a str. 301
guuccacggaauauuucaccg

SEQ ID NO: 1981323 - RNA, 18 nt, Shigella flexneri 2a str. 301
guucauccccucuuccau

SEQ ID NO: 1981324 - RNA, 14 nt, Shigella flexneri 2a str. 301
guucauccugcugg

SEQ ID NO: 1981325 - RNA, 14 nt, Shigella flexneri 2a str. 301
guucaucucaaaca

SEQ ID NO: 1981326 - RNA, 13 nt, Shigella flexneri 2a str. 301
guucaucugacca

SEQ ID NO: 1981327 - RNA, 22 nt, Shigella flexneri 2a str. 301
guucagcgucggcgucaucgac

SEQ ID NO: 1981328 - RNA, 13 nt, Shigella flexneri 2a str. 301
guguccacuuccg

SEQ ID NO: 1981329 - RNA, 19 nt, Shigella flexneri 2a str. 301
guguagcucgccuucaggu

SEQ ID NO: 1981330 - RNA, 20 nt, Shigella flexneri 2a str. 301
guguagcacuugcagcuccu

SEQ ID NO: 1981331 - RNA, 15 nt, Shigella flexneri 2a str. 301
gugucuuaucaggcc

SEQ ID NO: 1981332 - RNA, 14 nt, Shigella flexneri 2a str. 301
gugugacaccaacc

SEQ ID NO: 1981333 - RNA, 13 nt, Shigella flexneri 2a str. 301
gugugaaaccuuu

SEQ ID NO: 1981334 - RNA, 13 nt, Shigella flexneri 2a str. 301
gugucccacuggu

SEQ ID NO: 1981335 - RNA, 16 nt, Shigella flexneri 2a str. 301
guggggaaugauauuu

SEQ ID NO: 1981336 - RNA, 16 nt, Shigella flexneri 2a str. 301
guggguaaugcuguga

SEQ ID NO: 1981337 - RNA, 20 nt, Shigella flexneri 2a str. 301
gugggucugucccauuuuaa

SEQ ID NO: 1981338 - RNA, 19 nt, Shigella flexneri 2a str. 301
guggguauauuucaggcca

SEQ ID NO: 1981339 - RNA, 18 nt, Shigella flexneri 2a str. 301
guguaccggauaaauuua

SEQ ID NO: 1981340 - RNA, 15 nt, Shigella flexneri 2a str. 301
gugguugccggucug

SEQ ID NO: 1981341 - RNA, 20 nt, Shigella flexneri 2a str. 301
gugguuaacgaccagcggaa

SEQ ID NO: 1981342 - RNA, 12 nt, Shigella flexneri 2a str. 301
gugugcuccagu

SEQ ID NO: 1981343 - RNA, 17 nt, Shigella flexneri 2a str. 301
gugugcuacggucugcc

SEQ ID NO: 1981344 - RNA, 17 nt, Shigella flexneri 2a str. 301
gugugcaaucacuuccu

SEQ ID NO: 1981345 - RNA, 12 nt, Shigella flexneri 2a str. 301
aaauauauccua

SEQ ID NO: 1981346 - RNA, 23 nt, Shigella flexneri 2a str. 301
aaauaucacucggggcuuuucuc

SEQ ID NO: 1981347 - RNA, 20 nt, Shigella flexneri 2a str. 301
aaauaucaucaaaauuaaca

SEQ ID NO: 1981348 - RNA, 18 nt, Shigella flexneri 2a str. 301
guguguuuucuguuaaug

SEQ ID NO: 1981349 - RNA, 11 nt, Shigella flexneri 2a str. 301
gugugugcuga

SEQ ID NO: 1981350 - RNA, 13 nt, Shigella flexneri 2a str. 301
gugugugcugauu

SEQ ID NO: 1981351 - RNA, 19 nt, Shigella flexneri 2a str. 301
guguggucuuuucaacagu

SEQ ID NO: 1981352 - RNA, 17 nt, Shigella flexneri 2a str. 301
guguggcaucguccguc

SEQ ID NO: 1981353 - RNA, 14 nt, Shigella flexneri 2a str. 301
guguuccagagaac

SEQ ID NO: 1981354 - RNA, 13 nt, Shigella flexneri 2a str. 301
guguuccucugcc

SEQ ID NO: 1981355 - RNA, 16 nt, Shigella flexneri 2a str. 301
guguucgucacuggcg

SEQ ID NO: 1981356 - RNA, 16 nt, Shigella flexneri 2a str. 301
guggaaaagaaaacag

SEQ ID NO: 1981357 - RNA, 15 nt, Shigella flexneri 2a str. 301
guggaaacagugauu

SEQ ID NO: 1981358 - RNA, 14 nt, Shigella flexneri 2a str. 301
gugcugugacagau

SEQ ID NO: 1981359 - RNA, 19 nt, Shigella flexneri 2a str. 301
guggaacaaauagacacaa

SEQ ID NO: 1981360 - RNA, 14 nt, Shigella flexneri 2a str. 301
gugcuguacagcag

SEQ ID NO: 1981361 - RNA, 15 nt, Shigella flexneri 2a str. 301
guggaacggugaaaa

SEQ ID NO: 1981362 - RNA, 22 nt, Shigella flexneri 2a str. 301
guggaagcccaaaucauaaaaa

SEQ ID NO: 1981363 - RNA, 20 nt, Shigella flexneri 2a str. 301
guggcaaucauauucaccac

SEQ ID NO: 1981364 - RNA, 14 nt, Shigella flexneri 2a str. 301
guggauguuuuacu

SEQ ID NO: 1981365 - RNA, 16 nt, Shigella flexneri 2a str. 301
guggaucgauuucaau

SEQ ID NO: 1981366 - RNA, 19 nt, Shigella flexneri 2a str. 301
guggaucacaucgccggug

SEQ ID NO: 1981367 - RNA, 22 nt, Shigella flexneri 2a str. 301
guggaucccagaagaauaucaa

SEQ ID NO: 1981368 - RNA, 16 nt, Shigella flexneri 2a str. 301
guggaucaagcaacau

SEQ ID NO: 1981369 - RNA, 21 nt, Shigella flexneri 2a str. 301
guggaucaagcaacauaaccu

SEQ ID NO: 1981370 - RNA, 17 nt, Shigella flexneri 2a str. 301
guggcagggaaucagau

SEQ ID NO: 1981371 - RNA, 15 nt, Shigella flexneri 2a str. 301
guggcagucuggccu

SEQ ID NO: 1981372 - RNA, 20 nt, Shigella flexneri 2a str. 301
guggcauugguugcuggaaa

SEQ ID NO: 1981373 - RNA, 22 nt, Shigella flexneri 2a str. 301
guggccauaaccacgcagcgcc

SEQ ID NO: 1981374 - RNA, 19 nt, Shigella flexneri 2a str. 301
guggccaguaaucggcuga

SEQ ID NO: 1981375 - RNA, 21 nt, Shigella flexneri 2a str. 301
guggccaguuccacuucugca

SEQ ID NO: 1981376 - RNA, 16 nt, Shigella flexneri 2a str. 301
guggcccagccuuucc

SEQ ID NO: 1981377 - RNA, 20 nt, Shigella flexneri 2a str. 301
guggcccagccuuuccugca

SEQ ID NO: 1981378 - RNA, 15 nt, Shigella flexneri 2a str. 301
guggcucagacucuc

SEQ ID NO: 1981379 - RNA, 22 nt, Shigella flexneri 2a str. 301
gugggacaguaucgauauggac

SEQ ID NO: 1981380 - RNA, 23 nt, Shigella flexneri 2a str. 301
gugggauucaccaaucggcagaa

SEQ ID NO: 1981381 - RNA, 23 nt, Shigella flexneri 2a str. 301
gugggaucacaucuucaauccac

SEQ ID NO: 1981382 - RNA, 16 nt, Shigella flexneri 2a str. 301
gugggauuccagcgcc

SEQ ID NO: 1981383 - RNA, 18 nt, Shigella flexneri 2a str. 301
gugggauuccagcgccgc

SEQ ID NO: 1981384 - RNA, 13 nt, Shigella flexneri 2a str. 301
guggcgcagccgu

SEQ ID NO: 1981385 - RNA, 17 nt, Shigella flexneri 2a str. 301
guggcgcagccgucauu

SEQ ID NO: 1981386 - RNA, 20 nt, Shigella flexneri 2a str. 301
guggcgauucauaugcgcca

SEQ ID NO: 1981387 - RNA, 18 nt, Shigella flexneri 2a str. 301
guggcgggaucaccugca

SEQ ID NO: 1981388 - RNA, 18 nt, Shigella flexneri 2a str. 301
guggcgguaacauccaga

SEQ ID NO: 1981389 - RNA, 14 nt, Shigella flexneri 2a str. 301
guggcguggcgcuc

SEQ ID NO: 1981390 - RNA, 19 nt, Shigella flexneri 2a str. 301
ucagccccuugcugacucc

SEQ ID NO: 1981391 - RNA, 16 nt, Shigella flexneri 2a str. 301
ucagcccuucuuuaug

SEQ ID NO: 1981392 - RNA, 13 nt, Shigella flexneri 2a str. 301
ucagcccuuuaau

SEQ ID NO: 1981393 - RNA, 20 nt, Shigella flexneri 2a str. 301
ucagcauuucgcgauauugc

SEQ ID NO: 1981394 - RNA, 13 nt, Shigella flexneri 2a str. 301
ucagcccagcccu

SEQ ID NO: 1981395 - RNA, 13 nt, Shigella flexneri 2a str. 301
ucagcgcaugauu

SEQ ID NO: 1981396 - RNA, 13 nt, Shigella flexneri 2a str. 301
ucagcgcagcacc

SEQ ID NO: 1981397 - RNA, 23 nt, Shigella flexneri 2a str. 301
ucagcgaucguuuuuaaccccag

SEQ ID NO: 1981398 - RNA, 15 nt, Shigella flexneri 2a str. 301
ucagcgccagcgcga

SEQ ID NO: 1981399 - RNA, 16 nt, Shigella flexneri 2a str. 301
ucagcuccucuuucau

SEQ ID NO: 1981400 - RNA, 23 nt, Shigella flexneri 2a str. 301
ucagcuccccuggauugcagggg

SEQ ID NO: 1981401 - RNA, 19 nt, Shigella flexneri 2a str. 301
ucagcuccggcagcugcuc

SEQ ID NO: 1981402 - RNA, 15 nt, Shigella flexneri 2a str. 301
ucagcucauccagcg

SEQ ID NO: 1981403 - RNA, 19 nt, Shigella flexneri 2a str. 301
ucagcuccacaagaaugcc

SEQ ID NO: 1981404 - RNA, 15 nt, Shigella flexneri 2a str. 301
ucagcgggcagggca

SEQ ID NO: 1981405 - RNA, 20 nt, Shigella flexneri 2a str. 301
ucagcggcguaucuuccagg

SEQ ID NO: 1981406 - RNA, 16 nt, Shigella flexneri 2a str. 301
ucagcggcaauucuuu

SEQ ID NO: 1981407 - RNA, 24 nt, Shigella flexneri 2a str. 301
ucagcaauaaucagauggcggcug

SEQ ID NO: 1981408 - RNA, 13 nt, Shigella flexneri 2a str. 301
ucagcaaucugau

SEQ ID NO: 1981409 - RNA, 16 nt, Shigella flexneri 2a str. 301
ucagcaaucucuucaa

SEQ ID NO: 1981410 - RNA, 20 nt, Shigella flexneri 2a str. 301
ucagcaagacaauguuugca

SEQ ID NO: 1981411 - RNA, 17 nt, Shigella flexneri 2a str. 301
ucagcaagcgauaauuu

SEQ ID NO: 1981412 - RNA, 19 nt, Shigella flexneri 2a str. 301
ucagcaauucucucuucag

SEQ ID NO: 1981413 - RNA, 21 nt, Shigella flexneri 2a str. 301
ucagcagacggccaaaaucuc

SEQ ID NO: 1981414 - RNA, 22 nt, Shigella flexneri 2a str. 301
ucagcacuuaucucuuccgcau

SEQ ID NO: 1981415 - RNA, 19 nt, Shigella flexneri 2a str. 301
ucagcacgucuuccauugc

SEQ ID NO: 1981416 - RNA, 17 nt, Shigella flexneri 2a str. 301
ucagcaugacaaaaaag

SEQ ID NO: 1981417 - RNA, 22 nt, Shigella flexneri 2a str. 301
ucagcauuguugaaaacgcgca

SEQ ID NO: 1981418 - RNA, 16 nt, Shigella flexneri 2a str. 301
ucagcauucucaucac

SEQ ID NO: 1981419 - RNA, 15 nt, Shigella flexneri 2a str. 301
ucagcauuauuuuua

SEQ ID NO: 1981420 - RNA, 18 nt, Shigella flexneri 2a str. 301
ucagcauauaggaggccu

SEQ ID NO: 1981421 - RNA, 18 nt, Shigella flexneri 2a str. 301
ucagcauaaucaccagua

SEQ ID NO: 1981422 - RNA, 22 nt, Shigella flexneri 2a str. 301
ucagcaucccaccugaaauggu

SEQ ID NO: 1981423 - RNA, 12 nt, Shigella flexneri 2a str. 301
ucagcaugacaa

SEQ ID NO: 1981424 - RNA, 17 nt, Shigella flexneri 2a str. 301
ucagcaucaaugaccug

SEQ ID NO: 1981425 - RNA, 20 nt, Shigella flexneri 2a str. 301
ucagcaguucagucagcagu

SEQ ID NO: 1981426 - RNA, 15 nt, Shigella flexneri 2a str. 301
ucagcauaaaaauau

SEQ ID NO: 1981427 - RNA, 16 nt, Shigella flexneri 2a str. 301
ucagcaguucacgcag

SEQ ID NO: 1981428 - RNA, 17 nt, Shigella flexneri 2a str. 301
ucagcauaaucaccagu

SEQ ID NO: 1981429 - RNA, 23 nt, Shigella flexneri 2a str. 301
ucagcagcggcucggucagaccc

SEQ ID NO: 1981430 - RNA, 20 nt, Shigella flexneri 2a str. 301
ucaggcccgcauagagaaaa

SEQ ID NO: 1981431 - RNA, 21 nt, Shigella flexneri 2a str. 301
ucaggcccgccagcgccuggg

SEQ ID NO: 1981432 - RNA, 15 nt, Shigella flexneri 2a str. 301
ucaggccgauuucau

SEQ ID NO: 1981433 - RNA, 22 nt, Shigella flexneri 2a str. 301
ucaggccuacaagucugugcug

SEQ ID NO: 1981434 - RNA, 16 nt, Shigella flexneri 2a str. 301
ucaggccuacaggauu

SEQ ID NO: 1981435 - RNA, 15 nt, Shigella flexneri 2a str. 301
ucaggccuacaaaau

SEQ ID NO: 1981436 - RNA, 23 nt, Shigella flexneri 2a str. 301
ucaggcgagucgagaucccuucc

SEQ ID NO: 1981437 - RNA, 23 nt, Shigella flexneri 2a str. 301
ucaggcgaaucuuagugcgccug

SEQ ID NO: 1981438 - RNA, 22 nt, Shigella flexneri 2a str. 301
aaaucucacccgguacaucaau

SEQ ID NO: 1981439 - RNA, 12 nt, Shigella flexneri 2a str. 301
aaaucuccagau

SEQ ID NO: 1981440 - RNA, 21 nt, Shigella flexneri 2a str. 301
aaaucuccugccaauacaaaa

SEQ ID NO: 1981441 - RNA, 11 nt, Shigella flexneri 2a str. 301
ucaggccagga

SEQ ID NO: 1981442 - RNA, 16 nt, Shigella flexneri 2a str. 301
ucaggcaucugagcau

SEQ ID NO: 1981443 - RNA, 17 nt, Shigella flexneri 2a str. 301
ucaggcauuacugugca

SEQ ID NO: 1981444 - RNA, 18 nt, Shigella flexneri 2a str. 301
ucaggauaaacuccugca

SEQ ID NO: 1981445 - RNA, 23 nt, Shigella flexneri 2a str. 301
ucaggcaaugggcaaacgcucuc

SEQ ID NO: 1981446 - RNA, 17 nt, Shigella flexneri 2a str. 301
ucaggcaguuuugcguu

SEQ ID NO: 1981447 - RNA, 18 nt, Shigella flexneri 2a str. 301
ucaggcacuucuucugca

SEQ ID NO: 1981448 - RNA, 15 nt, Shigella flexneri 2a str. 301
ucaggacguuuucag

SEQ ID NO: 1981449 - RNA, 20 nt, Shigella flexneri 2a str. 301
ucaggacguuuucagccagc

SEQ ID NO: 1981450 - RNA, 23 nt, Shigella flexneri 2a str. 301
ucaggaccugcucugccagacgg

SEQ ID NO: 1981451 - RNA, 16 nt, Shigella flexneri 2a str. 301
ucaggaguuuaaucuc

SEQ ID NO: 1981452 - RNA, 16 nt, Shigella flexneri 2a str. 301
ucaggcguugaaaaau

SEQ ID NO: 1981453 - RNA, 22 nt, Shigella flexneri 2a str. 301
ucaggcguuuguaacccaccau

SEQ ID NO: 1981454 - RNA, 16 nt, Shigella flexneri 2a str. 301
ucaggcggcucaccug

SEQ ID NO: 1981455 - RNA, 15 nt, Shigella flexneri 2a str. 301
ucaggcggcucaccu

SEQ ID NO: 1981456 - RNA, 22 nt, Shigella flexneri 2a str. 301
ucaggcgcugaaagaagcggug

SEQ ID NO: 1981457 - RNA, 12 nt, Shigella flexneri 2a str. 301
ucaggcgcugca

SEQ ID NO: 1981458 - RNA, 13 nt, Shigella flexneri 2a str. 301
ucaggucacccaa

SEQ ID NO: 1981459 - RNA, 14 nt, Shigella flexneri 2a str. 301
ucaggucagcgaau

SEQ ID NO: 1981460 - RNA, 16 nt, Shigella flexneri 2a str. 301
ucagguauuuugucag

SEQ ID NO: 1981461 - RNA, 15 nt, Shigella flexneri 2a str. 301
ucaggcuucuguacc

SEQ ID NO: 1981462 - RNA, 15 nt, Shigella flexneri 2a str. 301
ucaggucugcaaaau

SEQ ID NO: 1981463 - RNA, 18 nt, Shigella flexneri 2a str. 301
ucagugaacaauuaacgu

SEQ ID NO: 1981464 - RNA, 21 nt, Shigella flexneri 2a str. 301
ucagucucaagggaggaguca

SEQ ID NO: 1981465 - RNA, 15 nt, Shigella flexneri 2a str. 301
ucagucgugauuguc

SEQ ID NO: 1981466 - RNA, 16 nt, Shigella flexneri 2a str. 301
ucagucuagcccgaug

SEQ ID NO: 1981467 - RNA, 13 nt, Shigella flexneri 2a str. 301
ucaguauuuccac

SEQ ID NO: 1981468 - RNA, 17 nt, Shigella flexneri 2a str. 301
ucaguauaacuacugau

SEQ ID NO: 1981469 - RNA, 19 nt, Shigella flexneri 2a str. 301
ucaguauggaucaaaucuc

SEQ ID NO: 1981470 - RNA, 19 nt, Shigella flexneri 2a str. 301
ucaguagcgcaaucaccac

SEQ ID NO: 1981471 - RNA, 21 nt, Shigella flexneri 2a str. 301
ucaguagcgcaaucaccacca

SEQ ID NO: 1981472 - RNA, 10 nt, Shigella flexneri 2a str. 301
ucagugucuu

SEQ ID NO: 1981473 - RNA, 17 nt, Shigella flexneri 2a str. 301
ucagugguguagggcag

SEQ ID NO: 1981474 - RNA, 18 nt, Shigella flexneri 2a str. 301
ucaguggguuaugaaacu

SEQ ID NO: 1981475 - RNA, 21 nt, Shigella flexneri 2a str. 301
ucaguggguuaugaaacucca

SEQ ID NO: 1981476 - RNA, 13 nt, Shigella flexneri 2a str. 301
ucagugcuucacc

SEQ ID NO: 1981477 - RNA, 22 nt, Shigella flexneri 2a str. 301
ucaguggaagacguugauucac

SEQ ID NO: 1981478 - RNA, 15 nt, Shigella flexneri 2a str. 301
ucagugcaaaugcca

SEQ ID NO: 1981479 - RNA, 21 nt, Shigella flexneri 2a str. 301
ucagugcaccgcguagcaucu

SEQ ID NO: 1981480 - RNA, 14 nt, Shigella flexneri 2a str. 301
aaaucguaagcagg

SEQ ID NO: 1981481 - RNA, 15 nt, Shigella flexneri 2a str. 301
aaaucgugaaacaau

SEQ ID NO: 1981482 - RNA, 19 nt, Shigella flexneri 2a str. 301
aaaucguauccggcauuau

SEQ ID NO: 1981483 - RNA, 18 nt, Shigella flexneri 2a str. 301
aaaucggugggcugacau

SEQ ID NO: 1981484 - RNA, 15 nt, Shigella flexneri 2a str. 301
aaaucgugcaaauuc

SEQ ID NO: 1981485 - RNA, 15 nt, Shigella flexneri 2a str. 301
ucagaucauccugcg

SEQ ID NO: 1981486 - RNA, 20 nt, Shigella flexneri 2a str. 301
ucagaucccaauucauuccu

SEQ ID NO: 1981487 - RNA, 17 nt, Shigella flexneri 2a str. 301
ucagauccgcacccgca

SEQ ID NO: 1981488 - RNA, 17 nt, Shigella flexneri 2a str. 301
ucagaucguucgcacca

SEQ ID NO: 1981489 - RNA, 21 nt, Shigella flexneri 2a str. 301
ucagauaaugcccgaugaccu

SEQ ID NO: 1981490 - RNA, 14 nt, Shigella flexneri 2a str. 301
ucagaugccugaug

SEQ ID NO: 1981491 - RNA, 12 nt, Shigella flexneri 2a str. 301
ucagaucuuuaa

SEQ ID NO: 1981492 - RNA, 22 nt, Shigella flexneri 2a str. 301
ucagaugaacgagucaacgcuu

SEQ ID NO: 1981493 - RNA, 22 nt, Shigella flexneri 2a str. 301
ucagauuauagugauccugcau

SEQ ID NO: 1981494 - RNA, 15 nt, Shigella flexneri 2a str. 301
ucagauucaaauuau

SEQ ID NO: 1981495 - RNA, 15 nt, Shigella flexneri 2a str. 301
ucagaugugcggugg

SEQ ID NO: 1981496 - RNA, 13 nt, Shigella flexneri 2a str. 301
ucagauugagcau

SEQ ID NO: 1981497 - RNA, 17 nt, Shigella flexneri 2a str. 301
ucagacuuugcgccauc

SEQ ID NO: 1981498 - RNA, 19 nt, Shigella flexneri 2a str. 301
ucagacuauucagcucuuc

SEQ ID NO: 1981499 - RNA, 20 nt, Shigella flexneri 2a str. 301
ucagacguugcauuucgucu

SEQ ID NO: 1981500 - RNA, 13 nt, Shigella flexneri 2a str. 301
ucagacguucuuc

SEQ ID NO: 1981501 - RNA, 19 nt, Shigella flexneri 2a str. 301
ucagacguucuuccugugg

SEQ ID NO: 1981502 - RNA, 16 nt, Shigella flexneri 2a str. 301
ucagaccuuuuaauuu

SEQ ID NO: 1981503 - RNA, 16 nt, Shigella flexneri 2a str. 301
ucagagugccgaagaa

SEQ ID NO: 1981504 - RNA, 17 nt, Shigella flexneri 2a str. 301
ucagagauucuuuuccu

SEQ ID NO: 1981505 - RNA, 14 nt, Shigella flexneri 2a str. 301
ucagagaagcaccg

SEQ ID NO: 1981506 - RNA, 22 nt, Shigella flexneri 2a str. 301
ucagagagccagccccacagca

SEQ ID NO: 1981507 - RNA, 16 nt, Shigella flexneri 2a str. 301
ucagaaucgcgcccca

SEQ ID NO: 1981508 - RNA, 18 nt, Shigella flexneri 2a str. 301
ucagaauccggugccuua

SEQ ID NO: 1981509 - RNA, 16 nt, Shigella flexneri 2a str. 301
ucagacaacuucccug

SEQ ID NO: 1981510 - RNA, 22 nt, Shigella flexneri 2a str. 301
ucagaccguuaugcacggcaug

SEQ ID NO: 1981511 - RNA, 17 nt, Shigella flexneri 2a str. 301
ucagaccgcuucugcgu

SEQ ID NO: 1981512 - RNA, 19 nt, Shigella flexneri 2a str. 301
ucagaccagacugcuccug

SEQ ID NO: 1981513 - RNA, 17 nt, Shigella flexneri 2a str. 301
ucagaccaaucaccacu

SEQ ID NO: 1981514 - RNA, 22 nt, Shigella flexneri 2a str. 301
ucagaccaauccagccggcaaa

SEQ ID NO: 1981515 - RNA, 11 nt, Shigella flexneri 2a str. 301
ucagaaucagg

SEQ ID NO: 1981516 - RNA, 16 nt, Shigella flexneri 2a str. 301
ucagaagacgcuccag

SEQ ID NO: 1981517 - RNA, 19 nt, Shigella flexneri 2a str. 301
ucagaagacgcuccagugu

SEQ ID NO: 1981518 - RNA, 14 nt, Shigella flexneri 2a str. 301
ucagaacguaaacg

SEQ ID NO: 1981519 - RNA, 19 nt, Shigella flexneri 2a str. 301
ucagaaacuguaauugaga

SEQ ID NO: 1981520 - RNA, 21 nt, Shigella flexneri 2a str. 301
ucagaaaguauauaaaaaaca

SEQ ID NO: 1981521 - RNA, 19 nt, Shigella flexneri 2a str. 301
ucagaaaggcguuguccuu

SEQ ID NO: 1981522 - RNA, 23 nt, Shigella flexneri 2a str. 301
ucagaaauuuggcuccucugacu

SEQ ID NO: 1981523 - RNA, 20 nt, Shigella flexneri 2a str. 301
ucagaaauuuggcuccucug

SEQ ID NO: 1981524 - RNA, 18 nt, Shigella flexneri 2a str. 301
ucagaacacuucuucugu

SEQ ID NO: 1981525 - RNA, 18 nt, Shigella flexneri 2a str. 301
ucacuuucgagcaauuuu

SEQ ID NO: 1981526 - RNA, 18 nt, Shigella flexneri 2a str. 301
ucacuuuuggugcuuuug

SEQ ID NO: 1981527 - RNA, 20 nt, Shigella flexneri 2a str. 301
ucacuuuuggugcuuuugcu

SEQ ID NO: 1981528 - RNA, 19 nt, Shigella flexneri 2a str. 301
ucagaaaaauacaauucuc

SEQ ID NO: 1981529 - RNA, 14 nt, Shigella flexneri 2a str. 301
ucagaaacacacuu

SEQ ID NO: 1981530 - RNA, 17 nt, Shigella flexneri 2a str. 301
ucagaaacacacuuucc

SEQ ID NO: 1981531 - RNA, 18 nt, Shigella flexneri 2a str. 301
ucacuucgccgaugaagu

SEQ ID NO: 1981532 - RNA, 12 nt, Shigella flexneri 2a str. 301
ucacuuccucaa

SEQ ID NO: 1981533 - RNA, 18 nt, Shigella flexneri 2a str. 301
ucacuucgucagaaaugg

SEQ ID NO: 1981534 - RNA, 23 nt, Shigella flexneri 2a str. 301
ucacuucugaguucggcaugggg

SEQ ID NO: 1981535 - RNA, 15 nt, Shigella flexneri 2a str. 301
ucacuucaucgccgu

SEQ ID NO: 1981536 - RNA, 12 nt, Shigella flexneri 2a str. 301
ucacuugcuacc

SEQ ID NO: 1981537 - RNA, 13 nt, Shigella flexneri 2a str. 301
ucacuucugccuc

SEQ ID NO: 1981538 - RNA, 18 nt, Shigella flexneri 2a str. 301
ucacuucugccucugucg

SEQ ID NO: 1981539 - RNA, 21 nt, Shigella flexneri 2a str. 301
ucacuaugagguagccugagu

SEQ ID NO: 1981540 - RNA, 21 nt, Shigella flexneri 2a str. 301
ucacugcaaauacccaaaaaa

SEQ ID NO: 1981541 - RNA, 23 nt, Shigella flexneri 2a str. 301
ucacugcgaaagcgucagcuuuc

SEQ ID NO: 1981542 - RNA, 16 nt, Shigella flexneri 2a str. 301
ucacugcuuaauauua

SEQ ID NO: 1981543 - RNA, 22 nt, Shigella flexneri 2a str. 301
ucacugggcgauuaauaaaauu

SEQ ID NO: 1981544 - RNA, 17 nt, Shigella flexneri 2a str. 301
ucacuggcgcagacagg

SEQ ID NO: 1981545 - RNA, 12 nt, Shigella flexneri 2a str. 301
ucacgccaauac

SEQ ID NO: 1981546 - RNA, 13 nt, Shigella flexneri 2a str. 301
ucacgccaaccag

SEQ ID NO: 1981547 - RNA, 21 nt, Shigella flexneri 2a str. 301
ucacgccgcauccggcauaaa

SEQ ID NO: 1981548 - RNA, 18 nt, Shigella flexneri 2a str. 301
ucacgcccggaauuucaa

SEQ ID NO: 1981549 - RNA, 14 nt, Shigella flexneri 2a str. 301
ucacggcaccagcc

SEQ ID NO: 1981550 - RNA, 22 nt, Shigella flexneri 2a str. 301
ucacccgccgguggcguuucca

SEQ ID NO: 1981551 - RNA, 20 nt, Shigella flexneri 2a str. 301
ucacccggaggaaagcaccu

SEQ ID NO: 1981552 - RNA, 18 nt, Shigella flexneri 2a str. 301
ucacggcuguagccagcu

SEQ ID NO: 1981553 - RNA, 13 nt, Shigella flexneri 2a str. 301
ucacguuccaggc

SEQ ID NO: 1981554 - RNA, 15 nt, Shigella flexneri 2a str. 301
ucacgucucaucagg

SEQ ID NO: 1981555 - RNA, 19 nt, Shigella flexneri 2a str. 301
ucacggcccauuccucaug

SEQ ID NO: 1981556 - RNA, 15 nt, Shigella flexneri 2a str. 301
ucacggcaccagcca

SEQ ID NO: 1981557 - RNA, 13 nt, Shigella flexneri 2a str. 301
ucacggccacucu

SEQ ID NO: 1981558 - RNA, 18 nt, Shigella flexneri 2a str. 301
ucacggcugcuaauauuu

SEQ ID NO: 1981559 - RNA, 23 nt, Shigella flexneri 2a str. 301
ucacuauccgccccauuuuuaac

SEQ ID NO: 1981560 - RNA, 15 nt, Shigella flexneri 2a str. 301
ucaaagccaggcaga

SEQ ID NO: 1981561 - RNA, 23 nt, Shigella flexneri 2a str. 301
ucaaacuggguuuugaucuccag

SEQ ID NO: 1981562 - RNA, 15 nt, Shigella flexneri 2a str. 301
ucaaacuuuuaaauu

SEQ ID NO: 1981563 - RNA, 23 nt, Shigella flexneri 2a str. 301
ucaaagaugcaggaguagaacgg

SEQ ID NO: 1981564 - RNA, 18 nt, Shigella flexneri 2a str. 301
ucaaacuuuaauuuuuca

SEQ ID NO: 1981565 - RNA, 16 nt, Shigella flexneri 2a str. 301
ucaaaucacuaaaccc

SEQ ID NO: 1981566 - RNA, 20 nt, Shigella flexneri 2a str. 301
ucaaauaucuauauacaauc

SEQ ID NO: 1981567 - RNA, 16 nt, Shigella flexneri 2a str. 301
ucaaaucaacaaccug

SEQ ID NO: 1981568 - RNA, 14 nt, Shigella flexneri 2a str. 301
ucaaauaucugccg

SEQ ID NO: 1981569 - RNA, 15 nt, Shigella flexneri 2a str. 301
ucaaauacuucaaua

SEQ ID NO: 1981570 - RNA, 15 nt, Shigella flexneri 2a str. 301
ucaaagcugcuuuuc

SEQ ID NO: 1981571 - RNA, 23 nt, Shigella flexneri 2a str. 301
ucaaauggcauccuugcuaacca

SEQ ID NO: 1981572 - RNA, 21 nt, Shigella flexneri 2a str. 301
ucaaaugcugcggaucaaucg

SEQ ID NO: 1981573 - RNA, 18 nt, Shigella flexneri 2a str. 301
ucaacaaaccaaaaccgc

SEQ ID NO: 1981574 - RNA, 11 nt, Shigella flexneri 2a str. 301
ucaacaaacca

SEQ ID NO: 1981575 - RNA, 22 nt, Shigella flexneri 2a str. 301
ucaaauuugucgccaacuucau

SEQ ID NO: 1981576 - RNA, 16 nt, Shigella flexneri 2a str. 301
ucaaacucuucacacc

SEQ ID NO: 1981577 - RNA, 19 nt, Shigella flexneri 2a str. 301
ucaaaccauucccugcuuu

SEQ ID NO: 1981578 - RNA, 13 nt, Shigella flexneri 2a str. 301
ucaaaccaauggc

SEQ ID NO: 1981579 - RNA, 20 nt, Shigella flexneri 2a str. 301
ucaaaccaauggcauuggca

SEQ ID NO: 1981580 - RNA, 19 nt, Shigella flexneri 2a str. 301
ucaaaccacuuaauuauua

SEQ ID NO: 1981581 - RNA, 18 nt, Shigella flexneri 2a str. 301
ucaaaccacuuaauuauu

SEQ ID NO: 1981582 - RNA, 22 nt, Shigella flexneri 2a str. 301
ucaaacauuagcgcaugaccag

SEQ ID NO: 1981583 - RNA, 16 nt, Shigella flexneri 2a str. 301
ucaaacaguucuggaa

SEQ ID NO: 1981584 - RNA, 18 nt, Shigella flexneri 2a str. 301
ucaaacaguucuggaaga

SEQ ID NO: 1981585 - RNA, 12 nt, Shigella flexneri 2a str. 301
ucaaacaguggu

SEQ ID NO: 1981586 - RNA, 13 nt, Shigella flexneri 2a str. 301
ucaaacaggcugc

SEQ ID NO: 1981587 - RNA, 19 nt, Shigella flexneri 2a str. 301
ucaaaacggugaucaaaac

SEQ ID NO: 1981588 - RNA, 17 nt, Shigella flexneri 2a str. 301
ucaacccgcacagucac

SEQ ID NO: 1981589 - RNA, 13 nt, Shigella flexneri 2a str. 301
ucaacccgcccag

SEQ ID NO: 1981590 - RNA, 16 nt, Shigella flexneri 2a str. 301
ucaacccuuuccagcg

SEQ ID NO: 1981591 - RNA, 19 nt, Shigella flexneri 2a str. 301
ucaaccgcgccugaccauu

SEQ ID NO: 1981592 - RNA, 20 nt, Shigella flexneri 2a str. 301
ucaaccgucgcgcccuccug

SEQ ID NO: 1981593 - RNA, 20 nt, Shigella flexneri 2a str. 301
ucaaccugaucgugccagga

SEQ ID NO: 1981594 - RNA, 21 nt, Shigella flexneri 2a str. 301
ucaaccgugacguaugaaaau

SEQ ID NO: 1981595 - RNA, 17 nt, Shigella flexneri 2a str. 301
ucaaccgcagugauuuc

SEQ ID NO: 1981596 - RNA, 14 nt, Shigella flexneri 2a str. 301
ucaaccuaaaguaa

SEQ ID NO: 1981597 - RNA, 16 nt, Shigella flexneri 2a str. 301
ucaaccuaaaguaaag

SEQ ID NO: 1981598 - RNA, 18 nt, Shigella flexneri 2a str. 301
ucaaccuuuccuuguaac

SEQ ID NO: 1981599 - RNA, 14 nt, Shigella flexneri 2a str. 301
ucaacgaagaaaac

SEQ ID NO: 1981600 - RNA, 17 nt, Shigella flexneri 2a str. 301
ucaacgauucaagaaac

SEQ ID NO: 1981601 - RNA, 20 nt, Shigella flexneri 2a str. 301
ucaacgauuucucagcagac

SEQ ID NO: 1981602 - RNA, 20 nt, Shigella flexneri 2a str. 301
ucaacgccauacggcuauga

SEQ ID NO: 1981603 - RNA, 18 nt, Shigella flexneri 2a str. 301
ucaacuccgccagcaacu

SEQ ID NO: 1981604 - RNA, 16 nt, Shigella flexneri 2a str. 301
ucaacuucagcagcag

SEQ ID NO: 1981605 - RNA, 19 nt, Shigella flexneri 2a str. 301
ucaacuuuguucugaauca

SEQ ID NO: 1981606 - RNA, 12 nt, Shigella flexneri 2a str. 301
ucaacggccuga

SEQ ID NO: 1981607 - RNA, 23 nt, Shigella flexneri 2a str. 301
ucaacgcucaggccgauuucaug

SEQ ID NO: 1981608 - RNA, 19 nt, Shigella flexneri 2a str. 301
ucaacgcucuccugcggaa

SEQ ID NO: 1981609 - RNA, 14 nt, Shigella flexneri 2a str. 301
ucaacgcgccgcca

SEQ ID NO: 1981610 - RNA, 16 nt, Shigella flexneri 2a str. 301
ucaacgccgcuaucag

SEQ ID NO: 1981611 - RNA, 13 nt, Shigella flexneri 2a str. 301
ucaacaguucaug

SEQ ID NO: 1981612 - RNA, 16 nt, Shigella flexneri 2a str. 301
ucaacagcguuucuuc

SEQ ID NO: 1981613 - RNA, 13 nt, Shigella flexneri 2a str. 301
ucaacaguaaacu

SEQ ID NO: 1981614 - RNA, 18 nt, Shigella flexneri 2a str. 301
ucaacagggcagacauuc

SEQ ID NO: 1981615 - RNA, 21 nt, Shigella flexneri 2a str. 301
ucaacauacaaauagccaauu

SEQ ID NO: 1981616 - RNA, 16 nt, Shigella flexneri 2a str. 301
ucaacauacaaauagc

SEQ ID NO: 1981617 - RNA, 15 nt, Shigella flexneri 2a str. 301
ucaacaugaaaauaa

SEQ ID NO: 1981618 - RNA, 20 nt, Shigella flexneri 2a str. 301
ucaacauguuccugccaguc

SEQ ID NO: 1981619 - RNA, 18 nt, Shigella flexneri 2a str. 301
ucaacauuucccccuucc

SEQ ID NO: 1981620 - RNA, 15 nt, Shigella flexneri 2a str. 301
ucaaccaacgcaccg

SEQ ID NO: 1981621 - RNA, 20 nt, Shigella flexneri 2a str. 301
ucaaccagaucggacuucau

SEQ ID NO: 1981622 - RNA, 20 nt, Shigella flexneri 2a str. 301
ucaaccacuuuaucgagaau

SEQ ID NO: 1981623 - RNA, 16 nt, Shigella flexneri 2a str. 301
ucaaccagccagcgcu

SEQ ID NO: 1981624 - RNA, 12 nt, Shigella flexneri 2a str. 301
ucaaccacucac

SEQ ID NO: 1981625 - RNA, 22 nt, Shigella flexneri 2a str. 301
ucaaccacuacgugaucgucuu

SEQ ID NO: 1981626 - RNA, 12 nt, Shigella flexneri 2a str. 301
ucaacaccacug

SEQ ID NO: 1981627 - RNA, 16 nt, Shigella flexneri 2a str. 301
ucaacacauccagugg

SEQ ID NO: 1981628 - RNA, 21 nt, Shigella flexneri 2a str. 301
ucaacacagugaugaaaacga

SEQ ID NO: 1981629 - RNA, 17 nt, Shigella flexneri 2a str. 301
ucaacaccaugacaaau

SEQ ID NO: 1981630 - RNA, 15 nt, Shigella flexneri 2a str. 301
ucaacagcaucaucg

SEQ ID NO: 1981631 - RNA, 18 nt, Shigella flexneri 2a str. 301
ucaacagauuacauuaaa

SEQ ID NO: 1981632 - RNA, 21 nt, Shigella flexneri 2a str. 301
ucaacaaauucuggcaccacc

SEQ ID NO: 1981633 - RNA, 16 nt, Shigella flexneri 2a str. 301
ucaacaacaauuucac

SEQ ID NO: 1981634 - RNA, 16 nt, Shigella flexneri 2a str. 301
ucaacaauugaagaau

SEQ ID NO: 1981635 - RNA, 19 nt, Shigella flexneri 2a str. 301
ucaacaagcaaauguuaau

SEQ ID NO: 1981636 - RNA, 18 nt, Shigella flexneri 2a str. 301
ucaacaauacaaaugccu

SEQ ID NO: 1981637 - RNA, 16 nt, Shigella flexneri 2a str. 301
ucaacaauacgcaccg

SEQ ID NO: 1981638 - RNA, 22 nt, Shigella flexneri 2a str. 301
ucacagcuaaucaucaucagug

SEQ ID NO: 1981639 - RNA, 21 nt, Shigella flexneri 2a str. 301
ucacagggcucuuaagcaccg

SEQ ID NO: 1981640 - RNA, 16 nt, Shigella flexneri 2a str. 301
ucacagcggcuuccac

SEQ ID NO: 1981641 - RNA, 17 nt, Shigella flexneri 2a str. 301
ucacaggcacaccgccg

SEQ ID NO: 1981642 - RNA, 14 nt, Shigella flexneri 2a str. 301
ucacaaaacgaaua

SEQ ID NO: 1981643 - RNA, 17 nt, Shigella flexneri 2a str. 301
ucacaaaacgaauaauu

SEQ ID NO: 1981644 - RNA, 10 nt, Shigella flexneri 2a str. 301
ucacaaaaag

SEQ ID NO: 1981645 - RNA, 14 nt, Shigella flexneri 2a str. 301
ucaauuucacagua

SEQ ID NO: 1981646 - RNA, 12 nt, Shigella flexneri 2a str. 301
ucacaaacauca

SEQ ID NO: 1981647 - RNA, 19 nt, Shigella flexneri 2a str. 301
ucacagaggucuuuucucg

SEQ ID NO: 1981648 - RNA, 20 nt, Shigella flexneri 2a str. 301
aaaucgauaaaacuucccgu

SEQ ID NO: 1981649 - RNA, 14 nt, Shigella flexneri 2a str. 301
aaaucgacagccag

SEQ ID NO: 1981650 - RNA, 14 nt, Shigella flexneri 2a str. 301
ucacauaacugccu

SEQ ID NO: 1981651 - RNA, 17 nt, Shigella flexneri 2a str. 301
ucacauaacggcccggc

SEQ ID NO: 1981652 - RNA, 20 nt, Shigella flexneri 2a str. 301
ucacaggguggcccaaaugg

SEQ ID NO: 1981653 - RNA, 23 nt, Shigella flexneri 2a str. 301
aaaucgccaacaaucucuuccag

SEQ ID NO: 1981654 - RNA, 14 nt, Shigella flexneri 2a str. 301
aaaucgccaagauu

SEQ ID NO: 1981655 - RNA, 14 nt, Shigella flexneri 2a str. 301
aaaucgcccagcaa

SEQ ID NO: 1981656 - RNA, 11 nt, Shigella flexneri 2a str. 301
aaaucgcccgg

SEQ ID NO: 1981657 - RNA, 21 nt, Shigella flexneri 2a str. 301
aaaucgcugaauaucuuucuc

SEQ ID NO: 1981658 - RNA, 19 nt, Shigella flexneri 2a str. 301
ucacauaaucgaaaacauc

SEQ ID NO: 1981659 - RNA, 21 nt, Shigella flexneri 2a str. 301
aaaucggcgcggaaucgcccu

SEQ ID NO: 1981660 - RNA, 18 nt, Shigella flexneri 2a str. 301
aaaucgggcagcacauag

SEQ ID NO: 1981661 - RNA, 18 nt, Shigella flexneri 2a str. 301
ucaccauauucagcagca

SEQ ID NO: 1981662 - RNA, 21 nt, Shigella flexneri 2a str. 301
ucaccauaaaacgcgcuacug

SEQ ID NO: 1981663 - RNA, 15 nt, Shigella flexneri 2a str. 301
ucaccaucagcagca

SEQ ID NO: 1981664 - RNA, 14 nt, Shigella flexneri 2a str. 301
ucaccauccacgga

SEQ ID NO: 1981665 - RNA, 17 nt, Shigella flexneri 2a str. 301
ucaccaugagcggcgcu

SEQ ID NO: 1981666 - RNA, 13 nt, Shigella flexneri 2a str. 301
ucaccaucuucac

SEQ ID NO: 1981667 - RNA, 23 nt, Shigella flexneri 2a str. 301
ucaccacgaaaacagcggccacu

SEQ ID NO: 1981668 - RNA, 13 nt, Shigella flexneri 2a str. 301
ucaccacgcagca

SEQ ID NO: 1981669 - RNA, 12 nt, Shigella flexneri 2a str. 301
ucaccagcgcga

SEQ ID NO: 1981670 - RNA, 19 nt, Shigella flexneri 2a str. 301
ucaccagcgcgaggaucac

SEQ ID NO: 1981671 - RNA, 22 nt, Shigella flexneri 2a str. 301
ucaccagcgcgaggaucacgca

SEQ ID NO: 1981672 - RNA, 16 nt, Shigella flexneri 2a str. 301
ucaccaggucaccaga

SEQ ID NO: 1981673 - RNA, 22 nt, Shigella flexneri 2a str. 301
ucaccaccagcggaauaucaga

SEQ ID NO: 1981674 - RNA, 20 nt, Shigella flexneri 2a str. 301
ucaccacccagcgguaaaau

SEQ ID NO: 1981675 - RNA, 22 nt, Shigella flexneri 2a str. 301
ucaccacccguaaucaccacau

SEQ ID NO: 1981676 - RNA, 15 nt, Shigella flexneri 2a str. 301
ucaccaccagcaccg

SEQ ID NO: 1981677 - RNA, 13 nt, Shigella flexneri 2a str. 301
ucacaucccagca

SEQ ID NO: 1981678 - RNA, 21 nt, Shigella flexneri 2a str. 301
ucacauccggcaauauucauu

SEQ ID NO: 1981679 - RNA, 14 nt, Shigella flexneri 2a str. 301
ucacaucaccaaca

SEQ ID NO: 1981680 - RNA, 23 nt, Shigella flexneri 2a str. 301
ucacaucagcgcauuuaccaggc

SEQ ID NO: 1981681 - RNA, 22 nt, Shigella flexneri 2a str. 301
ucaauggcugcaaagcauuuuu

SEQ ID NO: 1981682 - RNA, 21 nt, Shigella flexneri 2a str. 301
ucaaugauaguucaacagauu

SEQ ID NO: 1981683 - RNA, 18 nt, Shigella flexneri 2a str. 301
ucaaugauuucugccagc

SEQ ID NO: 1981684 - RNA, 12 nt, Shigella flexneri 2a str. 301
ucaaucaccgca

SEQ ID NO: 1981685 - RNA, 15 nt, Shigella flexneri 2a str. 301
ucaaucaccgcuuca

SEQ ID NO: 1981686 - RNA, 16 nt, Shigella flexneri 2a str. 301
ucaauauggaaguuuu

SEQ ID NO: 1981687 - RNA, 20 nt, Shigella flexneri 2a str. 301
ucaaucauccauauuuucag

SEQ ID NO: 1981688 - RNA, 12 nt, Shigella flexneri 2a str. 301
ucaaucauuuuu

SEQ ID NO: 1981689 - RNA, 15 nt, Shigella flexneri 2a str. 301
ucaaucauccauauu

SEQ ID NO: 1981690 - RNA, 19 nt, Shigella flexneri 2a str. 301
ucaaucauccauauuuuca

SEQ ID NO: 1981691 - RNA, 17 nt, Shigella flexneri 2a str. 301
ucaauucggaaauaauc

SEQ ID NO: 1981692 - RNA, 13 nt, Shigella flexneri 2a str. 301
ucaauuccuucug

SEQ ID NO: 1981693 - RNA, 18 nt, Shigella flexneri 2a str. 301
ucaauuccuucugggcgc

SEQ ID NO: 1981694 - RNA, 14 nt, Shigella flexneri 2a str. 301
ucaauuccuauuuu

SEQ ID NO: 1981695 - RNA, 21 nt, Shigella flexneri 2a str. 301
ucaauuuauugaauuuacaca

SEQ ID NO: 1981696 - RNA, 17 nt, Shigella flexneri 2a str. 301
ucaauugcgcaccagcu

SEQ ID NO: 1981697 - RNA, 13 nt, Shigella flexneri 2a str. 301
ucaauucucuaau

SEQ ID NO: 1981698 - RNA, 10 nt, Shigella flexneri 2a str. 301
ucaauaauca

SEQ ID NO: 1981699 - RNA, 20 nt, Shigella flexneri 2a str. 301
ucaauaaucugauuugucgg

SEQ ID NO: 1981700 - RNA, 14 nt, Shigella flexneri 2a str. 301
ucaauaaacaauga

SEQ ID NO: 1981701 - RNA, 15 nt, Shigella flexneri 2a str. 301
ucaauaaaagaaauc

SEQ ID NO: 1981702 - RNA, 13 nt, Shigella flexneri 2a str. 301
ucaauaaacggga

SEQ ID NO: 1981703 - RNA, 18 nt, Shigella flexneri 2a str. 301
ucaauaaagugauauuuc

SEQ ID NO: 1981704 - RNA, 16 nt, Shigella flexneri 2a str. 301
ucaauaugauaaaccu

SEQ ID NO: 1981705 - RNA, 17 nt, Shigella flexneri 2a str. 301
ucaauaugauaaaccuc

SEQ ID NO: 1981706 - RNA, 23 nt, Shigella flexneri 2a str. 301
ucaauaucauuacgccagucacg

SEQ ID NO: 1981707 - RNA, 14 nt, Shigella flexneri 2a str. 301
ucaauaucaucauu

SEQ ID NO: 1981708 - RNA, 18 nt, Shigella flexneri 2a str. 301
ucaauaucaucauuugca

SEQ ID NO: 1981709 - RNA, 20 nt, Shigella flexneri 2a str. 301
ucaauacuuucacaaaaaua

SEQ ID NO: 1981710 - RNA, 14 nt, Shigella flexneri 2a str. 301
ucaauacuuuccag

SEQ ID NO: 1981711 - RNA, 16 nt, Shigella flexneri 2a str. 301
ucaauacuuuccagca

SEQ ID NO: 1981712 - RNA, 19 nt, Shigella flexneri 2a str. 301
ucaauaccgcguaauacau

SEQ ID NO: 1981713 - RNA, 14 nt, Shigella flexneri 2a str. 301
uauuaacggcucug

SEQ ID NO: 1981714 - RNA, 19 nt, Shigella flexneri 2a str. 301
uauuaacucagcauuauuu

SEQ ID NO: 1981715 - RNA, 17 nt, Shigella flexneri 2a str. 301
uauuaacuuaauaaaca

SEQ ID NO: 1981716 - RNA, 15 nt, Shigella flexneri 2a str. 301
uauuaacuuaauaaa

SEQ ID NO: 1981717 - RNA, 15 nt, Shigella flexneri 2a str. 301
uauuaaauuugcuuu

SEQ ID NO: 1981718 - RNA, 18 nt, Shigella flexneri 2a str. 301
uauuaaggguaaaaggau

SEQ ID NO: 1981719 - RNA, 21 nt, Shigella flexneri 2a str. 301
uauuaagcagacggcucaucu

SEQ ID NO: 1981720 - RNA, 22 nt, Shigella flexneri 2a str. 301
uauuaauccagggaucaacauu

SEQ ID NO: 1981721 - RNA, 15 nt, Shigella flexneri 2a str. 301
uauuaauucuaaaac

SEQ ID NO: 1981722 - RNA, 16 nt, Shigella flexneri 2a str. 301
uauuaucuaucgcguu

SEQ ID NO: 1981723 - RNA, 14 nt, Shigella flexneri 2a str. 301
uauuaguacucauu

SEQ ID NO: 1981724 - RNA, 15 nt, Shigella flexneri 2a str. 301
uauguucagauaaug

SEQ ID NO: 1981725 - RNA, 23 nt, Shigella flexneri 2a str. 301
uauguucagccgucauccaggaa

SEQ ID NO: 1981726 - RNA, 22 nt, Shigella flexneri 2a str. 301
uauguucagaaagcgccagcaa

SEQ ID NO: 1981727 - RNA, 23 nt, Shigella flexneri 2a str. 301
uauguuauagaguacuugcuaca

SEQ ID NO: 1981728 - RNA, 18 nt, Shigella flexneri 2a str. 301
uauguggaaacagugauu

SEQ ID NO: 1981729 - RNA, 13 nt, Shigella flexneri 2a str. 301
uauguuuaucagg

SEQ ID NO: 1981730 - RNA, 14 nt, Shigella flexneri 2a str. 301
uaugugaaauuuau

SEQ ID NO: 1981731 - RNA, 16 nt, Shigella flexneri 2a str. 301
uaugucguuauauaaa

SEQ ID NO: 1981732 - RNA, 14 nt, Shigella flexneri 2a str. 301
uaugucauuaaccg

SEQ ID NO: 1981733 - RNA, 15 nt, Shigella flexneri 2a str. 301
uaugguucacuugcu

SEQ ID NO: 1981734 - RNA, 16 nt, Shigella flexneri 2a str. 301
uauguaagcagaaaag

SEQ ID NO: 1981735 - RNA, 18 nt, Shigella flexneri 2a str. 301
uauugguaaacucaaagu

SEQ ID NO: 1981736 - RNA, 14 nt, Shigella flexneri 2a str. 301
uauugggugacugg

SEQ ID NO: 1981737 - RNA, 15 nt, Shigella flexneri 2a str. 301
uauugcuucaccagc

SEQ ID NO: 1981738 - RNA, 21 nt, Shigella flexneri 2a str. 301
uauuguugauaaggaaauuca

SEQ ID NO: 1981739 - RNA, 16 nt, Shigella flexneri 2a str. 301
uauuguugaauuccga

SEQ ID NO: 1981740 - RNA, 15 nt, Shigella flexneri 2a str. 301
uauuguuuugaugaa

SEQ ID NO: 1981741 - RNA, 16 nt, Shigella flexneri 2a str. 301
uauugaagauuuugcu

SEQ ID NO: 1981742 - RNA, 17 nt, Shigella flexneri 2a str. 301
uauugaagauguugcca

SEQ ID NO: 1981743 - RNA, 21 nt, Shigella flexneri 2a str. 301
uauugaagauguugccacacg

SEQ ID NO: 1981744 - RNA, 14 nt, Shigella flexneri 2a str. 301
aaauccggccagcg

SEQ ID NO: 1981745 - RNA, 21 nt, Shigella flexneri 2a str. 301
uauugauucaucucuucuucc

SEQ ID NO: 1981746 - RNA, 17 nt, Shigella flexneri 2a str. 301
uauugauuuucuuguca

SEQ ID NO: 1981747 - RNA, 22 nt, Shigella flexneri 2a str. 301
aaauccugccgcaguuucugau

SEQ ID NO: 1981748 - RNA, 16 nt, Shigella flexneri 2a str. 301
uauucuuauaaagaaa

SEQ ID NO: 1981749 - RNA, 21 nt, Shigella flexneri 2a str. 301
uauucuuauaaagaaaaucug

SEQ ID NO: 1981750 - RNA, 17 nt, Shigella flexneri 2a str. 301
uauucuuauuaaauugu

SEQ ID NO: 1981751 - RNA, 15 nt, Shigella flexneri 2a str. 301
uauucgggauugcca

SEQ ID NO: 1981752 - RNA, 17 nt, Shigella flexneri 2a str. 301
uauuccauccugcucaa

SEQ ID NO: 1981753 - RNA, 21 nt, Shigella flexneri 2a str. 301
uauucccaacgcgccaccgac

SEQ ID NO: 1981754 - RNA, 12 nt, Shigella flexneri 2a str. 301
uauuccccagac

SEQ ID NO: 1981755 - RNA, 11 nt, Shigella flexneri 2a str. 301
uauuccccaga

SEQ ID NO: 1981756 - RNA, 20 nt, Shigella flexneri 2a str. 301
uauucccguauuacugagau

SEQ ID NO: 1981757 - RNA, 18 nt, Shigella flexneri 2a str. 301
uauuauuaaagagcgccu

SEQ ID NO: 1981758 - RNA, 21 nt, Shigella flexneri 2a str. 301
uauuaugcgaccauaugaaua

SEQ ID NO: 1981759 - RNA, 15 nt, Shigella flexneri 2a str. 301
uauucaaaggcucca

SEQ ID NO: 1981760 - RNA, 13 nt, Shigella flexneri 2a str. 301
uaucuuuucaggu

SEQ ID NO: 1981761 - RNA, 14 nt, Shigella flexneri 2a str. 301
uaugaaaauaggaa

SEQ ID NO: 1981762 - RNA, 18 nt, Shigella flexneri 2a str. 301
uaugaacacgaucucacg

SEQ ID NO: 1981763 - RNA, 20 nt, Shigella flexneri 2a str. 301
uaugaauagcggaaaucucc

SEQ ID NO: 1981764 - RNA, 22 nt, Shigella flexneri 2a str. 301
uaugaauagcggaaaucuccag

SEQ ID NO: 1981765 - RNA, 18 nt, Shigella flexneri 2a str. 301
uaugaauagcggaaaucu

SEQ ID NO: 1981766 - RNA, 19 nt, Shigella flexneri 2a str. 301
uaugaauagcggaaaucuc

SEQ ID NO: 1981767 - RNA, 17 nt, Shigella flexneri 2a str. 301
uaugaaagaaaaucaau

SEQ ID NO: 1981768 - RNA, 19 nt, Shigella flexneri 2a str. 301
uaucuucgauaaacucaau

SEQ ID NO: 1981769 - RNA, 13 nt, Shigella flexneri 2a str. 301
uaucuucccagcc

SEQ ID NO: 1981770 - RNA, 13 nt, Shigella flexneri 2a str. 301
uaucuuccacuuc

SEQ ID NO: 1981771 - RNA, 18 nt, Shigella flexneri 2a str. 301
uaucuuuacugauaauuu

SEQ ID NO: 1981772 - RNA, 13 nt, Shigella flexneri 2a str. 301
uaucuguguaaug

SEQ ID NO: 1981773 - RNA, 20 nt, Shigella flexneri 2a str. 301
uaucuguggcgcuaugcugg

SEQ ID NO: 1981774 - RNA, 18 nt, Shigella flexneri 2a str. 301
uaucuucaccguucguga

SEQ ID NO: 1981775 - RNA, 12 nt, Shigella flexneri 2a str. 301
uaucuccauccg

SEQ ID NO: 1981776 - RNA, 12 nt, Shigella flexneri 2a str. 301
uaucucaacaca

SEQ ID NO: 1981777 - RNA, 13 nt, Shigella flexneri 2a str. 301
uaucucaaaaauu

SEQ ID NO: 1981778 - RNA, 18 nt, Shigella flexneri 2a str. 301
uaucucagauaaaugcaa

SEQ ID NO: 1981779 - RNA, 18 nt, Shigella flexneri 2a str. 301
uaucugcagauguuuuaa

SEQ ID NO: 1981780 - RNA, 14 nt, Shigella flexneri 2a str. 301
uaucugaaucaaaa

SEQ ID NO: 1981781 - RNA, 15 nt, Shigella flexneri 2a str. 301
uaucugaaucaaaau

SEQ ID NO: 1981782 - RNA, 17 nt, Shigella flexneri 2a str. 301
uaucugaaucaaaauca

SEQ ID NO: 1981783 - RNA, 17 nt, Shigella flexneri 2a str. 301
uaucugccguucagcua

SEQ ID NO: 1981784 - RNA, 17 nt, Shigella flexneri 2a str. 301
uaucuggcaagcaggac

SEQ ID NO: 1981785 - RNA, 12 nt, Shigella flexneri 2a str. 301
uaucguucugcc

SEQ ID NO: 1981786 - RNA, 20 nt, Shigella flexneri 2a str. 301
uaucuauucacgaaucuauu

SEQ ID NO: 1981787 - RNA, 12 nt, Shigella flexneri 2a str. 301
uaucuauucauc

SEQ ID NO: 1981788 - RNA, 22 nt, Shigella flexneri 2a str. 301
uaugagaaaauuucauuaauau

SEQ ID NO: 1981789 - RNA, 19 nt, Shigella flexneri 2a str. 301
uaugaaucuuuucaucgca

SEQ ID NO: 1981790 - RNA, 22 nt, Shigella flexneri 2a str. 301
uaugaauauauccgaaaaagga

SEQ ID NO: 1981791 - RNA, 15 nt, Shigella flexneri 2a str. 301
uaugaaugauaaaau

SEQ ID NO: 1981792 - RNA, 23 nt, Shigella flexneri 2a str. 301
uaugcaacaacugaaaaaaaauu

SEQ ID NO: 1981793 - RNA, 14 nt, Shigella flexneri 2a str. 301
uaugccacgugagc

SEQ ID NO: 1981794 - RNA, 23 nt, Shigella flexneri 2a str. 301
uaugaugaaggcuaaugcugucg

SEQ ID NO: 1981795 - RNA, 14 nt, Shigella flexneri 2a str. 301
uaugaugaaacuga

SEQ ID NO: 1981796 - RNA, 18 nt, Shigella flexneri 2a str. 301
uaugaugcgacuugucau

SEQ ID NO: 1981797 - RNA, 20 nt, Shigella flexneri 2a str. 301
uaugaucaaaaucauauaau

SEQ ID NO: 1981798 - RNA, 15 nt, Shigella flexneri 2a str. 301
uaugauauuuuuuua

SEQ ID NO: 1981799 - RNA, 22 nt, Shigella flexneri 2a str. 301
uauggaucagaguugaaaaaca

SEQ ID NO: 1981800 - RNA, 15 nt, Shigella flexneri 2a str. 301
uauggagcaggaaua

SEQ ID NO: 1981801 - RNA, 14 nt, Shigella flexneri 2a str. 301
uauggcaccuguug

SEQ ID NO: 1981802 - RNA, 18 nt, Shigella flexneri 2a str. 301
uauggacuuuaugaaccu

SEQ ID NO: 1981803 - RNA, 19 nt, Shigella flexneri 2a str. 301
uauggccguuuuccccaac

SEQ ID NO: 1981804 - RNA, 21 nt, Shigella flexneri 2a str. 301
uaugggcgaauaaaaagccua

SEQ ID NO: 1981805 - RNA, 18 nt, Shigella flexneri 2a str. 301
uauggcuguuggugaaca

SEQ ID NO: 1981806 - RNA, 18 nt, Shigella flexneri 2a str. 301
uauggugaaaguaaaaaa

SEQ ID NO: 1981807 - RNA, 16 nt, Shigella flexneri 2a str. 301
uaugccgaucaucauc

SEQ ID NO: 1981808 - RNA, 21 nt, Shigella flexneri 2a str. 301
uaugccacgugagcuuuucug

SEQ ID NO: 1981809 - RNA, 12 nt, Shigella flexneri 2a str. 301
uaugccagcccc

SEQ ID NO: 1981810 - RNA, 22 nt, Shigella flexneri 2a str. 301
uaugccaugcgauggcggcagc

SEQ ID NO: 1981811 - RNA, 17 nt, Shigella flexneri 2a str. 301
uaugccuguccucuuca

SEQ ID NO: 1981812 - RNA, 19 nt, Shigella flexneri 2a str. 301
uaugcgaccauaugaauau

SEQ ID NO: 1981813 - RNA, 15 nt, Shigella flexneri 2a str. 301
uaugccguaaaagua

SEQ ID NO: 1981814 - RNA, 13 nt, Shigella flexneri 2a str. 301
uaugccucuuuca

SEQ ID NO: 1981815 - RNA, 21 nt, Shigella flexneri 2a str. 301
uaugcggugccauuaaaccaa

SEQ ID NO: 1981816 - RNA, 16 nt, Shigella flexneri 2a str. 301
uaugcgccuuucgcuu

SEQ ID NO: 1981817 - RNA, 13 nt, Shigella flexneri 2a str. 301
uaugcgccagacu

SEQ ID NO: 1981818 - RNA, 17 nt, Shigella flexneri 2a str. 301
uaugcgcgucagagauu

SEQ ID NO: 1981819 - RNA, 22 nt, Shigella flexneri 2a str. 301
uaugcugaaugaucggauaucu

SEQ ID NO: 1981820 - RNA, 17 nt, Shigella flexneri 2a str. 301
uaugcuguaaacaacau

SEQ ID NO: 1981821 - RNA, 17 nt, Shigella flexneri 2a str. 301
uaugcuguccuaaaaaa

SEQ ID NO: 1981822 - RNA, 19 nt, Shigella flexneri 2a str. 301
uaucagcgccaccacaaaa

SEQ ID NO: 1981823 - RNA, 20 nt, Shigella flexneri 2a str. 301
uaucagcguuaucagggagg

SEQ ID NO: 1981824 - RNA, 18 nt, Shigella flexneri 2a str. 301
uaucaggcacauuacacc

SEQ ID NO: 1981825 - RNA, 12 nt, Shigella flexneri 2a str. 301
uauccagcgcau

SEQ ID NO: 1981826 - RNA, 16 nt, Shigella flexneri 2a str. 301
uauccagcggcagcca

SEQ ID NO: 1981827 - RNA, 21 nt, Shigella flexneri 2a str. 301
uauccagcgauaccggugcac

SEQ ID NO: 1981828 - RNA, 22 nt, Shigella flexneri 2a str. 301
uauccggcacuuacuuuccuua

SEQ ID NO: 1981829 - RNA, 16 nt, Shigella flexneri 2a str. 301
uaucccugcuguccug

SEQ ID NO: 1981830 - RNA, 17 nt, Shigella flexneri 2a str. 301
uauccggccuacaaaac

SEQ ID NO: 1981831 - RNA, 15 nt, Shigella flexneri 2a str. 301
uauccggcuaacaaa

SEQ ID NO: 1981832 - RNA, 13 nt, Shigella flexneri 2a str. 301
uauccgguucacu

SEQ ID NO: 1981833 - RNA, 17 nt, Shigella flexneri 2a str. 301
uauccuauauagccccu

SEQ ID NO: 1981834 - RNA, 16 nt, Shigella flexneri 2a str. 301
uauccucaguugucug

SEQ ID NO: 1981835 - RNA, 18 nt, Shigella flexneri 2a str. 301
uauccucaguugucugaa

SEQ ID NO: 1981836 - RNA, 21 nt, Shigella flexneri 2a str. 301
uauccaguccgcgcuugccgc

SEQ ID NO: 1981837 - RNA, 17 nt, Shigella flexneri 2a str. 301
uauccccccaugaaaua

SEQ ID NO: 1981838 - RNA, 18 nt, Shigella flexneri 2a str. 301
uauccccccaugaaauaa

SEQ ID NO: 1981839 - RNA, 19 nt, Shigella flexneri 2a str. 301
uaucccgcgcguuuuucuu

SEQ ID NO: 1981840 - RNA, 15 nt, Shigella flexneri 2a str. 301
uauccccugcgaugg

SEQ ID NO: 1981841 - RNA, 21 nt, Shigella flexneri 2a str. 301
uauccggcacuuacuuuccuu

SEQ ID NO: 1981842 - RNA, 20 nt, Shigella flexneri 2a str. 301
uauccuguggacgcagcuca

SEQ ID NO: 1981843 - RNA, 18 nt, Shigella flexneri 2a str. 301
uauccuucugcguuuuug

SEQ ID NO: 1981844 - RNA, 20 nt, Shigella flexneri 2a str. 301
uauccugcccacuccagcua

SEQ ID NO: 1981845 - RNA, 15 nt, Shigella flexneri 2a str. 301
uauccugauaaaaac

SEQ ID NO: 1981846 - RNA, 23 nt, Shigella flexneri 2a str. 301
uauccugacgagcuuucuuauuu

SEQ ID NO: 1981847 - RNA, 17 nt, Shigella flexneri 2a str. 301
uaucgauaaauggcgca

SEQ ID NO: 1981848 - RNA, 21 nt, Shigella flexneri 2a str. 301
uaucgagagaauggggucagc

SEQ ID NO: 1981849 - RNA, 16 nt, Shigella flexneri 2a str. 301
uaucgacgaaccauuu

SEQ ID NO: 1981850 - RNA, 16 nt, Shigella flexneri 2a str. 301
uaucgacgcgccagca

SEQ ID NO: 1981851 - RNA, 16 nt, Shigella flexneri 2a str. 301
uaucgauuuucaaaau

SEQ ID NO: 1981852 - RNA, 23 nt, Shigella flexneri 2a str. 301
uaucgauuucuacacccagcccc

SEQ ID NO: 1981853 - RNA, 18 nt, Shigella flexneri 2a str. 301
uaucgcugauauacccuu

SEQ ID NO: 1981854 - RNA, 21 nt, Shigella flexneri 2a str. 301
uaucgcugauauacccuucau

SEQ ID NO: 1981855 - RNA, 19 nt, Shigella flexneri 2a str. 301
uaucgcucaauauccugac

SEQ ID NO: 1981856 - RNA, 16 nt, Shigella flexneri 2a str. 301
uaucgcguugaugauu

SEQ ID NO: 1981857 - RNA, 18 nt, Shigella flexneri 2a str. 301
uaucgcgccaucaaaucu

SEQ ID NO: 1981858 - RNA, 14 nt, Shigella flexneri 2a str. 301
uaucgcgcagaaau

SEQ ID NO: 1981859 - RNA, 15 nt, Shigella flexneri 2a str. 301
uaucgcgcagaaauu

SEQ ID NO: 1981860 - RNA, 16 nt, Shigella flexneri 2a str. 301
uaucgcgaugauuuuc

SEQ ID NO: 1981861 - RNA, 19 nt, Shigella flexneri 2a str. 301
uaucgcgaugauuuucgcu

SEQ ID NO: 1981862 - RNA, 19 nt, Shigella flexneri 2a str. 301
uaucgcgaaaaaaaagaug

SEQ ID NO: 1981863 - RNA, 14 nt, Shigella flexneri 2a str. 301
uaucgccguacaua

SEQ ID NO: 1981864 - RNA, 13 nt, Shigella flexneri 2a str. 301
uaucggguuuguu

SEQ ID NO: 1981865 - RNA, 13 nt, Shigella flexneri 2a str. 301
uaucggagaacag

SEQ ID NO: 1981866 - RNA, 17 nt, Shigella flexneri 2a str. 301
uaucggccaucuguucu

SEQ ID NO: 1981867 - RNA, 20 nt, Shigella flexneri 2a str. 301
uaucaagaucaucaaacuuu

SEQ ID NO: 1981868 - RNA, 19 nt, Shigella flexneri 2a str. 301
uaucaacuagcuguuguaa

SEQ ID NO: 1981869 - RNA, 17 nt, Shigella flexneri 2a str. 301
uaucagauuggcuucau

SEQ ID NO: 1981870 - RNA, 14 nt, Shigella flexneri 2a str. 301
uaucagaccgcuuc

SEQ ID NO: 1981871 - RNA, 17 nt, Shigella flexneri 2a str. 301
uaucagagauucuuuuc

SEQ ID NO: 1981872 - RNA, 23 nt, Shigella flexneri 2a str. 301
uaucaccaaugauaaguuucacu

SEQ ID NO: 1981873 - RNA, 17 nt, Shigella flexneri 2a str. 301
uaucacccuuuucugcc

SEQ ID NO: 1981874 - RNA, 19 nt, Shigella flexneri 2a str. 301
uaucacccuuuucugccgc

SEQ ID NO: 1981875 - RNA, 12 nt, Shigella flexneri 2a str. 301
uaucacagcaga

SEQ ID NO: 1981876 - RNA, 22 nt, Shigella flexneri 2a str. 301
uauauuacgagucacaaacauc

SEQ ID NO: 1981877 - RNA, 17 nt, Shigella flexneri 2a str. 301
uauaugacgcucgcgca

SEQ ID NO: 1981878 - RNA, 19 nt, Shigella flexneri 2a str. 301
uauauaaaaaaacaaugcg

SEQ ID NO: 1981879 - RNA, 22 nt, Shigella flexneri 2a str. 301
uauaucucagauaaaugcaaac

SEQ ID NO: 1981880 - RNA, 22 nt, Shigella flexneri 2a str. 301
uauaucugacgccgccgguguc

SEQ ID NO: 1981881 - RNA, 19 nt, Shigella flexneri 2a str. 301
uauaucucagauaaaugca

SEQ ID NO: 1981882 - RNA, 16 nt, Shigella flexneri 2a str. 301
uauaucgcaagucauu

SEQ ID NO: 1981883 - RNA, 21 nt, Shigella flexneri 2a str. 301
uauauauuaaucaucauuaau

SEQ ID NO: 1981884 - RNA, 16 nt, Shigella flexneri 2a str. 301
uauauccgaaaaagga

SEQ ID NO: 1981885 - RNA, 17 nt, Shigella flexneri 2a str. 301
uauauccgaaaaaggau

SEQ ID NO: 1981886 - RNA, 18 nt, Shigella flexneri 2a str. 301
uauaaguggcgcucucaa

SEQ ID NO: 1981887 - RNA, 12 nt, Shigella flexneri 2a str. 301
uauaagcucaau

SEQ ID NO: 1981888 - RNA, 12 nt, Shigella flexneri 2a str. 301
uauaauacgcuu

SEQ ID NO: 1981889 - RNA, 20 nt, Shigella flexneri 2a str. 301
uauaauaucuuuucuuaaca

SEQ ID NO: 1981890 - RNA, 17 nt, Shigella flexneri 2a str. 301
uauaauaucuuuucuua

SEQ ID NO: 1981891 - RNA, 12 nt, Shigella flexneri 2a str. 301
uauaauuauugc

SEQ ID NO: 1981892 - RNA, 18 nt, Shigella flexneri 2a str. 301
uauaauugcuuuuuucca

SEQ ID NO: 1981893 - RNA, 16 nt, Shigella flexneri 2a str. 301
uauaauugguauucug

SEQ ID NO: 1981894 - RNA, 22 nt, Shigella flexneri 2a str. 301
uauaaucgcgaauagcuucaaa

SEQ ID NO: 1981895 - RNA, 17 nt, Shigella flexneri 2a str. 301
uauaaucacucaaaaua

SEQ ID NO: 1981896 - RNA, 16 nt, Shigella flexneri 2a str. 301
uauaagccaguaagac

SEQ ID NO: 1981897 - RNA, 16 nt, Shigella flexneri 2a str. 301
uauaaccugaauauua

SEQ ID NO: 1981898 - RNA, 20 nt, Shigella flexneri 2a str. 301
uauaaccggcaacagaacgc

SEQ ID NO: 1981899 - RNA, 16 nt, Shigella flexneri 2a str. 301
uauaaccgccauagaa

SEQ ID NO: 1981900 - RNA, 22 nt, Shigella flexneri 2a str. 301
uauaacccccuccuuuuaucau

SEQ ID NO: 1981901 - RNA, 13 nt, Shigella flexneri 2a str. 301
uauaaauaaaaau

SEQ ID NO: 1981902 - RNA, 21 nt, Shigella flexneri 2a str. 301
uauaaauaaaaauugaaucac

SEQ ID NO: 1981903 - RNA, 22 nt, Shigella flexneri 2a str. 301
uaguacgggcaauuucacguuc

SEQ ID NO: 1981904 - RNA, 14 nt, Shigella flexneri 2a str. 301
uagucaauuaaaaa

SEQ ID NO: 1981905 - RNA, 13 nt, Shigella flexneri 2a str. 301
uaguacaaauuuu

SEQ ID NO: 1981906 - RNA, 13 nt, Shigella flexneri 2a str. 301
uagucacaaaucu

SEQ ID NO: 1981907 - RNA, 15 nt, Shigella flexneri 2a str. 301
uagucaugaugacgc

SEQ ID NO: 1981908 - RNA, 12 nt, Shigella flexneri 2a str. 301
uagucaucauca

SEQ ID NO: 1981909 - RNA, 13 nt, Shigella flexneri 2a str. 301
uagucaucaucag

SEQ ID NO: 1981910 - RNA, 20 nt, Shigella flexneri 2a str. 301
uagguucucucagucuuucc

SEQ ID NO: 1981911 - RNA, 22 nt, Shigella flexneri 2a str. 301
uaggugucaaccagccagcgcu

SEQ ID NO: 1981912 - RNA, 17 nt, Shigella flexneri 2a str. 301
uacuuucacaaaaauaa

SEQ ID NO: 1981913 - RNA, 17 nt, Shigella flexneri 2a str. 301
uaguuagccggagaaau

SEQ ID NO: 1981914 - RNA, 16 nt, Shigella flexneri 2a str. 301
uaguuaugaaaauagg

SEQ ID NO: 1981915 - RNA, 17 nt, Shigella flexneri 2a str. 301
uaguggguuucugccgc

SEQ ID NO: 1981916 - RNA, 17 nt, Shigella flexneri 2a str. 301
uaguggcucagacucuc

SEQ ID NO: 1981917 - RNA, 16 nt, Shigella flexneri 2a str. 301
uaguggcaaauucuug

SEQ ID NO: 1981918 - RNA, 18 nt, Shigella flexneri 2a str. 301
uagucugguugagcagua

SEQ ID NO: 1981919 - RNA, 12 nt, Shigella flexneri 2a str. 301
uccuuccagcuc

SEQ ID NO: 1981920 - RNA, 15 nt, Shigella flexneri 2a str. 301
uccuucgauaaaagc

SEQ ID NO: 1981921 - RNA, 17 nt, Shigella flexneri 2a str. 301
uccuucuguucuuauaa

SEQ ID NO: 1981922 - RNA, 19 nt, Shigella flexneri 2a str. 301
uccuucgcagacugggcaa

SEQ ID NO: 1981923 - RNA, 23 nt, Shigella flexneri 2a str. 301
uccuucuuguucgaagaguucca

SEQ ID NO: 1981924 - RNA, 14 nt, Shigella flexneri 2a str. 301
uccuugaaaaagag

SEQ ID NO: 1981925 - RNA, 17 nt, Shigella flexneri 2a str. 301
uccuugaaauggcguua

SEQ ID NO: 1981926 - RNA, 17 nt, Shigella flexneri 2a str. 301
uccuugaguuucgucuu

SEQ ID NO: 1981927 - RNA, 16 nt, Shigella flexneri 2a str. 301
uccuuuaccucgaaaa

SEQ ID NO: 1981928 - RNA, 19 nt, Shigella flexneri 2a str. 301
uccuuggauauuuuaauca

SEQ ID NO: 1981929 - RNA, 18 nt, Shigella flexneri 2a str. 301
uccuugcguacaccaaca

SEQ ID NO: 1981930 - RNA, 13 nt, Shigella flexneri 2a str. 301
ucgaaaaaaaaga

SEQ ID NO: 1981931 - RNA, 16 nt, Shigella flexneri 2a str. 301
uccuuuuauuuaaccg

SEQ ID NO: 1981932 - RNA, 17 nt, Shigella flexneri 2a str. 301
uccuuuccuuaagccag

SEQ ID NO: 1981933 - RNA, 14 nt, Shigella flexneri 2a str. 301
ucgaacagcagcag

SEQ ID NO: 1981934 - RNA, 19 nt, Shigella flexneri 2a str. 301
ucgaaccaaacagcgccag

SEQ ID NO: 1981935 - RNA, 21 nt, Shigella flexneri 2a str. 301
ucgaacauccccacagaaaca

SEQ ID NO: 1981936 - RNA, 16 nt, Shigella flexneri 2a str. 301
ucgaacauacacaagc

SEQ ID NO: 1981937 - RNA, 15 nt, Shigella flexneri 2a str. 301
ucgaaagccccagcc

SEQ ID NO: 1981938 - RNA, 19 nt, Shigella flexneri 2a str. 301
ucgaaaugauggucuggug

SEQ ID NO: 1981939 - RNA, 17 nt, Shigella flexneri 2a str. 301
ucgaaaucaacauguuc

SEQ ID NO: 1981940 - RNA, 18 nt, Shigella flexneri 2a str. 301
ucgaacucauacaccagc

SEQ ID NO: 1981941 - RNA, 19 nt, Shigella flexneri 2a str. 301
ucgaacucauacaccagcg

SEQ ID NO: 1981942 - RNA, 17 nt, Shigella flexneri 2a str. 301
ucgaacucauacaccag

SEQ ID NO: 1981943 - RNA, 22 nt, Shigella flexneri 2a str. 301
ucgaacggguuaaauccugucu

SEQ ID NO: 1981944 - RNA, 21 nt, Shigella flexneri 2a str. 301
ucgaaggauaaugaaggauga

SEQ ID NO: 1981945 - RNA, 23 nt, Shigella flexneri 2a str. 301
ucgaaguuuucacgguugaugua

SEQ ID NO: 1981946 - RNA, 13 nt, Shigella flexneri 2a str. 301
ucgaaguuuuccu

SEQ ID NO: 1981947 - RNA, 17 nt, Shigella flexneri 2a str. 301
ucgaaguuuuccucagu

SEQ ID NO: 1981948 - RNA, 14 nt, Shigella flexneri 2a str. 301
ucgaagcuucucau

SEQ ID NO: 1981949 - RNA, 13 nt, Shigella flexneri 2a str. 301
ucgacaacugcug

SEQ ID NO: 1981950 - RNA, 14 nt, Shigella flexneri 2a str. 301
ucgacaauaaucaa

SEQ ID NO: 1981951 - RNA, 12 nt, Shigella flexneri 2a str. 301
ucgacaccaucu

SEQ ID NO: 1981952 - RNA, 15 nt, Shigella flexneri 2a str. 301
ucgacaccaaacaga

SEQ ID NO: 1981953 - RNA, 15 nt, Shigella flexneri 2a str. 301
ucgacaaaaacccug

SEQ ID NO: 1981954 - RNA, 17 nt, Shigella flexneri 2a str. 301
ucgacaaaaucggaaac

SEQ ID NO: 1981955 - RNA, 18 nt, Shigella flexneri 2a str. 301
ucgacaaaaucggaaaca

SEQ ID NO: 1981956 - RNA, 13 nt, Shigella flexneri 2a str. 301
ucgacaaaaugag

SEQ ID NO: 1981957 - RNA, 15 nt, Shigella flexneri 2a str. 301
ucgaaugccgcagca

SEQ ID NO: 1981958 - RNA, 14 nt, Shigella flexneri 2a str. 301
ucgaauuacacagc

SEQ ID NO: 1981959 - RNA, 15 nt, Shigella flexneri 2a str. 301
ucgaauuacacagcc

SEQ ID NO: 1981960 - RNA, 16 nt, Shigella flexneri 2a str. 301
ucgaccaggauuugau

SEQ ID NO: 1981961 - RNA, 21 nt, Shigella flexneri 2a str. 301
ucgacagccaguuugacaucg

SEQ ID NO: 1981962 - RNA, 12 nt, Shigella flexneri 2a str. 301
ucgacagcagcc

SEQ ID NO: 1981963 - RNA, 15 nt, Shigella flexneri 2a str. 301
ucgacaucaagaaau

SEQ ID NO: 1981964 - RNA, 16 nt, Shigella flexneri 2a str. 301
ucgacgauugcuuuua

SEQ ID NO: 1981965 - RNA, 20 nt, Shigella flexneri 2a str. 301
ucgacgcccuggaagaaaaa

SEQ ID NO: 1981966 - RNA, 22 nt, Shigella flexneri 2a str. 301
ucgaccugcgccugcaccauug

SEQ ID NO: 1981967 - RNA, 13 nt, Shigella flexneri 2a str. 301
ucgacgggcuggu

SEQ ID NO: 1981968 - RNA, 18 nt, Shigella flexneri 2a str. 301
ucgacggugacacuuugc

SEQ ID NO: 1981969 - RNA, 17 nt, Shigella flexneri 2a str. 301
ucgacguccaaucagca

SEQ ID NO: 1981970 - RNA, 20 nt, Shigella flexneri 2a str. 301
ucgacuucuucauucauccg

SEQ ID NO: 1981971 - RNA, 21 nt, Shigella flexneri 2a str. 301
ucgacuuuagucgcuugcagg

SEQ ID NO: 1981972 - RNA, 23 nt, Shigella flexneri 2a str. 301
ucgacuuuuuucggguuauuggu

SEQ ID NO: 1981973 - RNA, 16 nt, Shigella flexneri 2a str. 301
ucgagaaggcgcugac

SEQ ID NO: 1981974 - RNA, 14 nt, Shigella flexneri 2a str. 301
ucgagaauauucac

SEQ ID NO: 1981975 - RNA, 20 nt, Shigella flexneri 2a str. 301
ucgagauucuuaaagucuuu

SEQ ID NO: 1981976 - RNA, 17 nt, Shigella flexneri 2a str. 301
ucgaggcaauccguaau

SEQ ID NO: 1981977 - RNA, 16 nt, Shigella flexneri 2a str. 301
ucgagcgcgagcaggc

SEQ ID NO: 1981978 - RNA, 19 nt, Shigella flexneri 2a str. 301
ucgagcgguaaaccguuau

SEQ ID NO: 1981979 - RNA, 20 nt, Shigella flexneri 2a str. 301
ucgagcaucacaucaaaucc

SEQ ID NO: 1981980 - RNA, 13 nt, Shigella flexneri 2a str. 301
ucgagcagagaaa

SEQ ID NO: 1981981 - RNA, 16 nt, Shigella flexneri 2a str. 301
ucgagcgacagauuca

SEQ ID NO: 1981982 - RNA, 22 nt, Shigella flexneri 2a str. 301
ucgaggccgcggcucaggcgca

SEQ ID NO: 1981983 - RNA, 18 nt, Shigella flexneri 2a str. 301
ucgagguacgcuccagca

SEQ ID NO: 1981984 - RNA, 16 nt, Shigella flexneri 2a str. 301
ucgagugaauaauuga

SEQ ID NO: 1981985 - RNA, 17 nt, Shigella flexneri 2a str. 301
ucgaguccuuccagguc

SEQ ID NO: 1981986 - RNA, 22 nt, Shigella flexneri 2a str. 301
ucgauaaacaguuucgccaggg

SEQ ID NO: 1981987 - RNA, 23 nt, Shigella flexneri 2a str. 301
ucgauaaacgccggaugacacau

SEQ ID NO: 1981988 - RNA, 18 nt, Shigella flexneri 2a str. 301
ucgaguuugccgcugucc

SEQ ID NO: 1981989 - RNA, 20 nt, Shigella flexneri 2a str. 301
ucgaguucaucacaccaguc

SEQ ID NO: 1981990 - RNA, 21 nt, Shigella flexneri 2a str. 301
ucgauaaccaucuucuucacu

SEQ ID NO: 1981991 - RNA, 20 nt, Shigella flexneri 2a str. 301
ucgauaaccaucuucuucac

SEQ ID NO: 1981992 - RNA, 23 nt, Shigella flexneri 2a str. 301
ucgaucaaacaauuuucauugaa

SEQ ID NO: 1981993 - RNA, 15 nt, Shigella flexneri 2a str. 301
ucgauaugaccauug

SEQ ID NO: 1981994 - RNA, 19 nt, Shigella flexneri 2a str. 301
ucgauccagugauuccagu

SEQ ID NO: 1981995 - RNA, 23 nt, Shigella flexneri 2a str. 301
ucgaucaugacgggcaagaauau

SEQ ID NO: 1981996 - RNA, 20 nt, Shigella flexneri 2a str. 301
ucgaugccugaugacaugca

SEQ ID NO: 1981997 - RNA, 19 nt, Shigella flexneri 2a str. 301
ucgaugccuugugggccug

SEQ ID NO: 1981998 - RNA, 12 nt, Shigella flexneri 2a str. 301
ucgauggcagua

SEQ ID NO: 1981999 - RNA, 18 nt, Shigella flexneri 2a str. 301
ucgaucucuucgccugcc

SEQ ID NO: 1982000 - RNA, 13 nt, Shigella flexneri 2a str. 301
ucgaucuguuuua

SEQ ID NO: 1982001 - RNA, 22 nt, Shigella flexneri 2a str. 301
ucgaucgagagugguaaaggag

SEQ ID NO: 1982002 - RNA, 21 nt, Shigella flexneri 2a str. 301
ucgauuuggcucaacaacugc

SEQ ID NO: 1982003 - RNA, 15 nt, Shigella flexneri 2a str. 301
ucgauuuuuaaugaa

SEQ ID NO: 1982004 - RNA, 19 nt, Shigella flexneri 2a str. 301
ucgauugcacaaagguuuc

SEQ ID NO: 1982005 - RNA, 20 nt, Shigella flexneri 2a str. 301
ucgauugcacauucccugca

SEQ ID NO: 1982006 - RNA, 16 nt, Shigella flexneri 2a str. 301
ucgauucacauuuaaa

SEQ ID NO: 1982007 - RNA, 14 nt, Shigella flexneri 2a str. 301
ucgcacaaaaucau

SEQ ID NO: 1982008 - RNA, 16 nt, Shigella flexneri 2a str. 301
ucgcacaaaaucauga

SEQ ID NO: 1982009 - RNA, 10 nt, Shigella flexneri 2a str. 301
ucgcaauuac

SEQ ID NO: 1982010 - RNA, 17 nt, Shigella flexneri 2a str. 301
ucgcacaaaaucaugag

SEQ ID NO: 1982011 - RNA, 17 nt, Shigella flexneri 2a str. 301
ucgcaccgcuggcagaa

SEQ ID NO: 1982012 - RNA, 16 nt, Shigella flexneri 2a str. 301
ucgcacgccuggcagu

SEQ ID NO: 1982013 - RNA, 14 nt, Shigella flexneri 2a str. 301
ucgcaccaaaaauc

SEQ ID NO: 1982014 - RNA, 18 nt, Shigella flexneri 2a str. 301
ucgcaaauauuucacccg

SEQ ID NO: 1982015 - RNA, 21 nt, Shigella flexneri 2a str. 301
ucgcaaauugacuacaccauu

SEQ ID NO: 1982016 - RNA, 15 nt, Shigella flexneri 2a str. 301
ucgauuuuuuccagc

SEQ ID NO: 1982017 - RNA, 16 nt, Shigella flexneri 2a str. 301
ucgcaaugauuuugau

SEQ ID NO: 1982018 - RNA, 20 nt, Shigella flexneri 2a str. 301
ucgcaauacccugacccaga

SEQ ID NO: 1982019 - RNA, 21 nt, Shigella flexneri 2a str. 301
ucgcaauaaucaucucuccuu

SEQ ID NO: 1982020 - RNA, 18 nt, Shigella flexneri 2a str. 301
ucgcaagccacgccgaac

SEQ ID NO: 1982021 - RNA, 22 nt, Shigella flexneri 2a str. 301
ucgcagaugaauuuaucuuuaa

SEQ ID NO: 1982022 - RNA, 15 nt, Shigella flexneri 2a str. 301
ucgcagccagcgcgc

SEQ ID NO: 1982023 - RNA, 18 nt, Shigella flexneri 2a str. 301
ucgcacuaaguucugccc

SEQ ID NO: 1982024 - RNA, 17 nt, Shigella flexneri 2a str. 301
ucgcacuaaguucugcc

SEQ ID NO: 1982025 - RNA, 23 nt, Shigella flexneri 2a str. 301
ucgcagaaauaccccgccagcag

SEQ ID NO: 1982026 - RNA, 13 nt, Shigella flexneri 2a str. 301
ucgcagaagccac

SEQ ID NO: 1982027 - RNA, 17 nt, Shigella flexneri 2a str. 301
ucgcagaagccacgcgu

SEQ ID NO: 1982028 - RNA, 16 nt, Shigella flexneri 2a str. 301
ucgcacuuaccuucac

SEQ ID NO: 1982029 - RNA, 15 nt, Shigella flexneri 2a str. 301
ucgcauaccauccag

SEQ ID NO: 1982030 - RNA, 18 nt, Shigella flexneri 2a str. 301
ucgcauaaaccacagacc

SEQ ID NO: 1982031 - RNA, 16 nt, Shigella flexneri 2a str. 301
ucgcaguagccaugca

SEQ ID NO: 1982032 - RNA, 14 nt, Shigella flexneri 2a str. 301
ucgcagcugccugc

SEQ ID NO: 1982033 - RNA, 22 nt, Shigella flexneri 2a str. 301
uccggcucgccuuucggcugca

SEQ ID NO: 1982034 - RNA, 20 nt, Shigella flexneri 2a str. 301
uccggcugccagccaggaua

SEQ ID NO: 1982035 - RNA, 18 nt, Shigella flexneri 2a str. 301
uccggcgggucgcugccg

SEQ ID NO: 1982036 - RNA, 20 nt, Shigella flexneri 2a str. 301
uccggcguuuucaaccagcc

SEQ ID NO: 1982037 - RNA, 14 nt, Shigella flexneri 2a str. 301
uccggcgcguugau

SEQ ID NO: 1982038 - RNA, 19 nt, Shigella flexneri 2a str. 301
uccggcggcacagccagcg

SEQ ID NO: 1982039 - RNA, 21 nt, Shigella flexneri 2a str. 301
uccggcgcaauucccggaccg

SEQ ID NO: 1982040 - RNA, 17 nt, Shigella flexneri 2a str. 301
uccgggucauccaggaa

SEQ ID NO: 1982041 - RNA, 16 nt, Shigella flexneri 2a str. 301
uccgggguucgaaucc

SEQ ID NO: 1982042 - RNA, 14 nt, Shigella flexneri 2a str. 301
uccggguuuucaac

SEQ ID NO: 1982043 - RNA, 15 nt, Shigella flexneri 2a str. 301
uccggcuuuuuacuu

SEQ ID NO: 1982044 - RNA, 16 nt, Shigella flexneri 2a str. 301
uccggcuguuccagca

SEQ ID NO: 1982045 - RNA, 18 nt, Shigella flexneri 2a str. 301
uccggcuuguucaucacc

SEQ ID NO: 1982046 - RNA, 16 nt, Shigella flexneri 2a str. 301
uccgggccagcggcuc

SEQ ID NO: 1982047 - RNA, 20 nt, Shigella flexneri 2a str. 301
uccgggcuauauacccuucu

SEQ ID NO: 1982048 - RNA, 17 nt, Shigella flexneri 2a str. 301
uccgcuggcgucugggc

SEQ ID NO: 1982049 - RNA, 12 nt, Shigella flexneri 2a str. 301
uccgcuggagca

SEQ ID NO: 1982050 - RNA, 17 nt, Shigella flexneri 2a str. 301
uccgcuggcccaucaga

SEQ ID NO: 1982051 - RNA, 18 nt, Shigella flexneri 2a str. 301
uccgcucgccgcagagau

SEQ ID NO: 1982052 - RNA, 13 nt, Shigella flexneri 2a str. 301
uccgcuucaaucu

SEQ ID NO: 1982053 - RNA, 21 nt, Shigella flexneri 2a str. 301
uccgcuuacucauccacugcc

SEQ ID NO: 1982054 - RNA, 14 nt, Shigella flexneri 2a str. 301
uccggcaaaaacaa

SEQ ID NO: 1982055 - RNA, 16 nt, Shigella flexneri 2a str. 301
uccggauggcaaacug

SEQ ID NO: 1982056 - RNA, 15 nt, Shigella flexneri 2a str. 301
uccggacguucagcc

SEQ ID NO: 1982057 - RNA, 21 nt, Shigella flexneri 2a str. 301
uccggacugcucacgccacgg

SEQ ID NO: 1982058 - RNA, 15 nt, Shigella flexneri 2a str. 301
uccggcaugaacaaa

SEQ ID NO: 1982059 - RNA, 19 nt, Shigella flexneri 2a str. 301
uccggcauuaucacaucag

SEQ ID NO: 1982060 - RNA, 13 nt, Shigella flexneri 2a str. 301
uccggcagucagu

SEQ ID NO: 1982061 - RNA, 20 nt, Shigella flexneri 2a str. 301
uccggcaguaauaccagacc

SEQ ID NO: 1982062 - RNA, 22 nt, Shigella flexneri 2a str. 301
uccggcaauugugauggucaga

SEQ ID NO: 1982063 - RNA, 22 nt, Shigella flexneri 2a str. 301
uccggcaccaauguaggccuga

SEQ ID NO: 1982064 - RNA, 14 nt, Shigella flexneri 2a str. 301
uccggcagaagcaa

SEQ ID NO: 1982065 - RNA, 17 nt, Shigella flexneri 2a str. 301
uccggcagccaggcaau

SEQ ID NO: 1982066 - RNA, 19 nt, Shigella flexneri 2a str. 301
uccguuaugucucccgccc

SEQ ID NO: 1982067 - RNA, 20 nt, Shigella flexneri 2a str. 301
uccguuaucacagcagaacu

SEQ ID NO: 1982068 - RNA, 13 nt, Shigella flexneri 2a str. 301
uccguucagaucg

SEQ ID NO: 1982069 - RNA, 21 nt, Shigella flexneri 2a str. 301
uccguucaaaacagcccuuuc

SEQ ID NO: 1982070 - RNA, 16 nt, Shigella flexneri 2a str. 301
uccguugaaaaugcug

SEQ ID NO: 1982071 - RNA, 15 nt, Shigella flexneri 2a str. 301
uccuaaaaacaguac

SEQ ID NO: 1982072 - RNA, 23 nt, Shigella flexneri 2a str. 301
uccuaaaaaauuaacaaaacaau

SEQ ID NO: 1982073 - RNA, 17 nt, Shigella flexneri 2a str. 301
uccguuuucagugucca

SEQ ID NO: 1982074 - RNA, 15 nt, Shigella flexneri 2a str. 301
uccguagugaaaaag

SEQ ID NO: 1982075 - RNA, 19 nt, Shigella flexneri 2a str. 301
uccgucaccggaauaauga

SEQ ID NO: 1982076 - RNA, 16 nt, Shigella flexneri 2a str. 301
uccgucauccauacca

SEQ ID NO: 1982077 - RNA, 15 nt, Shigella flexneri 2a str. 301
uccgucagaccaauc

SEQ ID NO: 1982078 - RNA, 22 nt, Shigella flexneri 2a str. 301
uccgucagccacuccacugaag

SEQ ID NO: 1982079 - RNA, 20 nt, Shigella flexneri 2a str. 301
uccgucgaaagcccaucauc

SEQ ID NO: 1982080 - RNA, 15 nt, Shigella flexneri 2a str. 301
uccgucccagccuug

SEQ ID NO: 1982081 - RNA, 15 nt, Shigella flexneri 2a str. 301
uccgguucacuucac

SEQ ID NO: 1982082 - RNA, 15 nt, Shigella flexneri 2a str. 301
uccucaauuaacauu

SEQ ID NO: 1982083 - RNA, 22 nt, Shigella flexneri 2a str. 301
uccucaagaauaugcuuugccu

SEQ ID NO: 1982084 - RNA, 21 nt, Shigella flexneri 2a str. 301
uccucaagaauaugcuuugcc

SEQ ID NO: 1982085 - RNA, 13 nt, Shigella flexneri 2a str. 301
uccucaagaauau

SEQ ID NO: 1982086 - RNA, 15 nt, Shigella flexneri 2a str. 301
uccuaucgugguucc

SEQ ID NO: 1982087 - RNA, 22 nt, Shigella flexneri 2a str. 301
uccuauuguugauaaggaaauu

SEQ ID NO: 1982088 - RNA, 13 nt, Shigella flexneri 2a str. 301
uccuauugcugcu

SEQ ID NO: 1982089 - RNA, 19 nt, Shigella flexneri 2a str. 301
uccuaaaggcaaaaugcca

SEQ ID NO: 1982090 - RNA, 18 nt, Shigella flexneri 2a str. 301
uccuacaccgaacaacug

SEQ ID NO: 1982091 - RNA, 19 nt, Shigella flexneri 2a str. 301
uccuacaccgaacaacugu

SEQ ID NO: 1982092 - RNA, 15 nt, Shigella flexneri 2a str. 301
uccuacaacugggac

SEQ ID NO: 1982093 - RNA, 21 nt, Shigella flexneri 2a str. 301
uccugcaacuucucuuucggc

SEQ ID NO: 1982094 - RNA, 23 nt, Shigella flexneri 2a str. 301
uccugaucaagcacaugcugaca

SEQ ID NO: 1982095 - RNA, 19 nt, Shigella flexneri 2a str. 301
uccugauggacauuuuucc

SEQ ID NO: 1982096 - RNA, 22 nt, Shigella flexneri 2a str. 301
uccugacguaacgaccaccacc

SEQ ID NO: 1982097 - RNA, 23 nt, Shigella flexneri 2a str. 301
uccugagccggaacuuugcugca

SEQ ID NO: 1982098 - RNA, 16 nt, Shigella flexneri 2a str. 301
uccugagcacuggggc

SEQ ID NO: 1982099 - RNA, 17 nt, Shigella flexneri 2a str. 301
uccugagcacuggggcu

SEQ ID NO: 1982100 - RNA, 22 nt, Shigella flexneri 2a str. 301
uccugacggugauacagcaaaa

SEQ ID NO: 1982101 - RNA, 14 nt, Shigella flexneri 2a str. 301
uccugaccaccaua

SEQ ID NO: 1982102 - RNA, 17 nt, Shigella flexneri 2a str. 301
uccucuuucaucucccg

SEQ ID NO: 1982103 - RNA, 18 nt, Shigella flexneri 2a str. 301
uccucuguaaacuccuuu

SEQ ID NO: 1982104 - RNA, 23 nt, Shigella flexneri 2a str. 301
uccucugucaggguuauagccuu

SEQ ID NO: 1982105 - RNA, 16 nt, Shigella flexneri 2a str. 301
uccucugacuggacuc

SEQ ID NO: 1982106 - RNA, 15 nt, Shigella flexneri 2a str. 301
uccucucaugagcag

SEQ ID NO: 1982107 - RNA, 17 nt, Shigella flexneri 2a str. 301
uccugaaauuccugaga

SEQ ID NO: 1982108 - RNA, 22 nt, Shigella flexneri 2a str. 301
uccugaacucgccagccaccau

SEQ ID NO: 1982109 - RNA, 20 nt, Shigella flexneri 2a str. 301
uccugaagaagcguuccauu

SEQ ID NO: 1982110 - RNA, 23 nt, Shigella flexneri 2a str. 301
uccugaacggucgaggcaaccag

SEQ ID NO: 1982111 - RNA, 16 nt, Shigella flexneri 2a str. 301
uccugaagaugcugca

SEQ ID NO: 1982112 - RNA, 19 nt, Shigella flexneri 2a str. 301
uccugaagacgccucgcau

SEQ ID NO: 1982113 - RNA, 21 nt, Shigella flexneri 2a str. 301
uccucguuucgcccugccuuu

SEQ ID NO: 1982114 - RNA, 16 nt, Shigella flexneri 2a str. 301
uccucgccguuaauga

SEQ ID NO: 1982115 - RNA, 19 nt, Shigella flexneri 2a str. 301
uccuccggcuccacuucgu

SEQ ID NO: 1982116 - RNA, 13 nt, Shigella flexneri 2a str. 301
uccuccagcuccu

SEQ ID NO: 1982117 - RNA, 23 nt, Shigella flexneri 2a str. 301
uccucaucgauauuaucuucauc

SEQ ID NO: 1982118 - RNA, 15 nt, Shigella flexneri 2a str. 301
uccuccagcagcaca

SEQ ID NO: 1982119 - RNA, 15 nt, Shigella flexneri 2a str. 301
uccugcacuuucagc

SEQ ID NO: 1982120 - RNA, 14 nt, Shigella flexneri 2a str. 301
uccugcaagccaac

SEQ ID NO: 1982121 - RNA, 23 nt, Shigella flexneri 2a str. 301
uccugcgggagcgcuuuuuuccu

SEQ ID NO: 1982122 - RNA, 17 nt, Shigella flexneri 2a str. 301
uccugcgcugcguagcc

SEQ ID NO: 1982123 - RNA, 16 nt, Shigella flexneri 2a str. 301
uccugccgcaguuucu

SEQ ID NO: 1982124 - RNA, 19 nt, Shigella flexneri 2a str. 301
uccugccgcguuggcaaug

SEQ ID NO: 1982125 - RNA, 21 nt, Shigella flexneri 2a str. 301
uccugccggacguguuuucac

SEQ ID NO: 1982126 - RNA, 16 nt, Shigella flexneri 2a str. 301
uccugcgcacaagccc

SEQ ID NO: 1982127 - RNA, 20 nt, Shigella flexneri 2a str. 301
uccugcgcaggaagcgguug

SEQ ID NO: 1982128 - RNA, 16 nt, Shigella flexneri 2a str. 301
uccugccaguuuuucc

SEQ ID NO: 1982129 - RNA, 17 nt, Shigella flexneri 2a str. 301
uccugccaguuuuuccg

SEQ ID NO: 1982130 - RNA, 18 nt, Shigella flexneri 2a str. 301
uccugcauugacucgccu

SEQ ID NO: 1982131 - RNA, 22 nt, Shigella flexneri 2a str. 301
uccugcucaaugucugucauau

SEQ ID NO: 1982132 - RNA, 13 nt, Shigella flexneri 2a str. 301
uccugcuccuguc

SEQ ID NO: 1982133 - RNA, 23 nt, Shigella flexneri 2a str. 301
uccugcuguacgucagcgucaua

SEQ ID NO: 1982134 - RNA, 19 nt, Shigella flexneri 2a str. 301
uccuggcggggauuauugc

SEQ ID NO: 1982135 - RNA, 21 nt, Shigella flexneri 2a str. 301
uccuggcgggaauaaaagcca

SEQ ID NO: 1982136 - RNA, 13 nt, Shigella flexneri 2a str. 301
uccuggcgcuggc

SEQ ID NO: 1982137 - RNA, 18 nt, Shigella flexneri 2a str. 301
uccuggcuugccagccau

SEQ ID NO: 1982138 - RNA, 21 nt, Shigella flexneri 2a str. 301
uccuggcuguuacucaacuga

SEQ ID NO: 1982139 - RNA, 16 nt, Shigella flexneri 2a str. 301
uccuggcgaaaacgcc

SEQ ID NO: 1982140 - RNA, 19 nt, Shigella flexneri 2a str. 301
uccuggauuuccucggcug

SEQ ID NO: 1982141 - RNA, 22 nt, Shigella flexneri 2a str. 301
uccuggcaacggacgaccgauu

SEQ ID NO: 1982142 - RNA, 23 nt, Shigella flexneri 2a str. 301
uccuucacuuuugccagacgaau

SEQ ID NO: 1982143 - RNA, 18 nt, Shigella flexneri 2a str. 301
uccuucaggaucaaccgc

SEQ ID NO: 1982144 - RNA, 13 nt, Shigella flexneri 2a str. 301
uccuuagaagcac

SEQ ID NO: 1982145 - RNA, 14 nt, Shigella flexneri 2a str. 301
uccuuaaacaccug

SEQ ID NO: 1982146 - RNA, 18 nt, Shigella flexneri 2a str. 301
uccuuaacuccucgccuu

SEQ ID NO: 1982147 - RNA, 14 nt, Shigella flexneri 2a str. 301
uccuuaauaaaaua

SEQ ID NO: 1982148 - RNA, 20 nt, Shigella flexneri 2a str. 301
uccuggucugaugaaugguu

SEQ ID NO: 1982149 - RNA, 17 nt, Shigella flexneri 2a str. 301
uccugguuucuggucau

SEQ ID NO: 1982150 - RNA, 22 nt, Shigella flexneri 2a str. 301
uccuggggguucaucaccacug

SEQ ID NO: 1982151 - RNA, 23 nt, Shigella flexneri 2a str. 301
uccuggcuuggcuggcgugagcc

SEQ ID NO: 1982152 - RNA, 13 nt, Shigella flexneri 2a str. 301
uccuguagcguua

SEQ ID NO: 1982153 - RNA, 18 nt, Shigella flexneri 2a str. 301
uccuguagcuggaaaauc

SEQ ID NO: 1982154 - RNA, 22 nt, Shigella flexneri 2a str. 301
uccuguucaaacauuagcgcau

SEQ ID NO: 1982155 - RNA, 18 nt, Shigella flexneri 2a str. 301
uccuguugaaaaaccaga

SEQ ID NO: 1982156 - RNA, 15 nt, Shigella flexneri 2a str. 301
uccuguugaaaaacc

SEQ ID NO: 1982157 - RNA, 17 nt, Shigella flexneri 2a str. 301
uccuguugcguuaagcc

SEQ ID NO: 1982158 - RNA, 16 nt, Shigella flexneri 2a str. 301
ucccaccgggcaacug

SEQ ID NO: 1982159 - RNA, 19 nt, Shigella flexneri 2a str. 301
ucccacgcggcaacggcuu

SEQ ID NO: 1982160 - RNA, 18 nt, Shigella flexneri 2a str. 301
ucccacggugcagcugcg

SEQ ID NO: 1982161 - RNA, 22 nt, Shigella flexneri 2a str. 301
ucccacugcgccacgguguugu

SEQ ID NO: 1982162 - RNA, 11 nt, Shigella flexneri 2a str. 301
ucccacugcca

SEQ ID NO: 1982163 - RNA, 14 nt, Shigella flexneri 2a str. 301
ucccagccuugcca

SEQ ID NO: 1982164 - RNA, 20 nt, Shigella flexneri 2a str. 301
ucccagccggguaagaaaag

SEQ ID NO: 1982165 - RNA, 20 nt, Shigella flexneri 2a str. 301
ucccagcccccuguguugau

SEQ ID NO: 1982166 - RNA, 16 nt, Shigella flexneri 2a str. 301
ucccagcccagcgcuu

SEQ ID NO: 1982167 - RNA, 20 nt, Shigella flexneri 2a str. 301
ucccagcagagaucuuucac

SEQ ID NO: 1982168 - RNA, 17 nt, Shigella flexneri 2a str. 301
ucccagauagcaacagc

SEQ ID NO: 1982169 - RNA, 21 nt, Shigella flexneri 2a str. 301
ucccagacguuucgccagccg

SEQ ID NO: 1982170 - RNA, 19 nt, Shigella flexneri 2a str. 301
ucccagaauguuaacgcca

SEQ ID NO: 1982171 - RNA, 15 nt, Shigella flexneri 2a str. 301
ucccagaauguuaac

SEQ ID NO: 1982172 - RNA, 22 nt, Shigella flexneri 2a str. 301
ucccaggccgccugcaacgcuu

SEQ ID NO: 1982173 - RNA, 15 nt, Shigella flexneri 2a str. 301
ucccaggccaaaucc

SEQ ID NO: 1982174 - RNA, 14 nt, Shigella flexneri 2a str. 301
ucccaggcagaagc

SEQ ID NO: 1982175 - RNA, 16 nt, Shigella flexneri 2a str. 301
ucccaggcaaauccca

SEQ ID NO: 1982176 - RNA, 15 nt, Shigella flexneri 2a str. 301
ucccagcgcaggcag

SEQ ID NO: 1982177 - RNA, 19 nt, Shigella flexneri 2a str. 301
ucccagcgcggugauaacc

SEQ ID NO: 1982178 - RNA, 15 nt, Shigella flexneri 2a str. 301
ucccagugccugcau

SEQ ID NO: 1982179 - RNA, 13 nt, Shigella flexneri 2a str. 301
ucccagucauccg

SEQ ID NO: 1982180 - RNA, 16 nt, Shigella flexneri 2a str. 301
ucccaguuauuaaaac

SEQ ID NO: 1982181 - RNA, 14 nt, Shigella flexneri 2a str. 301
ucccagucuuucca

SEQ ID NO: 1982182 - RNA, 20 nt, Shigella flexneri 2a str. 301
ucccaguaagccuaaaugua

SEQ ID NO: 1982183 - RNA, 14 nt, Shigella flexneri 2a str. 301
ucccaguagugcuu

SEQ ID NO: 1982184 - RNA, 15 nt, Shigella flexneri 2a str. 301
ucccaucuuuuuaag

SEQ ID NO: 1982185 - RNA, 16 nt, Shigella flexneri 2a str. 301
ucccauaaccaacaau

SEQ ID NO: 1982186 - RNA, 22 nt, Shigella flexneri 2a str. 301
uccccauggacgcgucagucgc

SEQ ID NO: 1982187 - RNA, 18 nt, Shigella flexneri 2a str. 301
uccccagcggaaaauauc

SEQ ID NO: 1982188 - RNA, 16 nt, Shigella flexneri 2a str. 301
uccccaggguuucucc

SEQ ID NO: 1982189 - RNA, 22 nt, Shigella flexneri 2a str. 301
uccccaguaaucgggcaacugc

SEQ ID NO: 1982190 - RNA, 16 nt, Shigella flexneri 2a str. 301
ucccccugccagacca

SEQ ID NO: 1982191 - RNA, 16 nt, Shigella flexneri 2a str. 301
uccccccucugaucag

SEQ ID NO: 1982192 - RNA, 21 nt, Shigella flexneri 2a str. 301
ucccccccacuaagcaccaaa

SEQ ID NO: 1982193 - RNA, 14 nt, Shigella flexneri 2a str. 301
ucccccacagcucu

SEQ ID NO: 1982194 - RNA, 20 nt, Shigella flexneri 2a str. 301
ucccccacagcucugcuguc

SEQ ID NO: 1982195 - RNA, 12 nt, Shigella flexneri 2a str. 301
ucccccacagcu

SEQ ID NO: 1982196 - RNA, 16 nt, Shigella flexneri 2a str. 301
ucccauuuauuuuucc

SEQ ID NO: 1982197 - RNA, 23 nt, Shigella flexneri 2a str. 301
ucccauuuauuuuuccuccauug

SEQ ID NO: 1982198 - RNA, 22 nt, Shigella flexneri 2a str. 301
ucccauuuuugaauggaucucc

SEQ ID NO: 1982199 - RNA, 23 nt, Shigella flexneri 2a str. 301
uccccaaaaaaucaacgacaaaa

SEQ ID NO: 1982200 - RNA, 16 nt, Shigella flexneri 2a str. 301
ucccauuagacuauuu

SEQ ID NO: 1982201 - RNA, 14 nt, Shigella flexneri 2a str. 301
uccccagaaaauuu

SEQ ID NO: 1982202 - RNA, 17 nt, Shigella flexneri 2a str. 301
uccccagaagcuuucca

SEQ ID NO: 1982203 - RNA, 18 nt, Shigella flexneri 2a str. 301
uccccaccuguccagacg

SEQ ID NO: 1982204 - RNA, 16 nt, Shigella flexneri 2a str. 301
uccccacaaccggcgg

SEQ ID NO: 1982205 - RNA, 16 nt, Shigella flexneri 2a str. 301
uccccggucagcagca

SEQ ID NO: 1982206 - RNA, 22 nt, Shigella flexneri 2a str. 301
uccccggcuuuuugggccaggg

SEQ ID NO: 1982207 - RNA, 17 nt, Shigella flexneri 2a str. 301
uccccggauucaugcua

SEQ ID NO: 1982208 - RNA, 17 nt, Shigella flexneri 2a str. 301
uccccggcaaccacacc

SEQ ID NO: 1982209 - RNA, 21 nt, Shigella flexneri 2a str. 301
uccccggcaaccacacccaca

SEQ ID NO: 1982210 - RNA, 20 nt, Shigella flexneri 2a str. 301
uccccggcagugcuuucauu

SEQ ID NO: 1982211 - RNA, 15 nt, Shigella flexneri 2a str. 301
uccccuaacucuuuc

SEQ ID NO: 1982212 - RNA, 15 nt, Shigella flexneri 2a str. 301
uccccguaucuucau

SEQ ID NO: 1982213 - RNA, 16 nt, Shigella flexneri 2a str. 301
uccccuccagcgagcu

SEQ ID NO: 1982214 - RNA, 16 nt, Shigella flexneri 2a str. 301
uccccucacccuaacc

SEQ ID NO: 1982215 - RNA, 16 nt, Shigella flexneri 2a str. 301
uccccgcuugggcaga

SEQ ID NO: 1982216 - RNA, 15 nt, Shigella flexneri 2a str. 301
uccccgccucaccgc

SEQ ID NO: 1982217 - RNA, 18 nt, Shigella flexneri 2a str. 301
ucccccuuucugagagga

SEQ ID NO: 1982218 - RNA, 19 nt, Shigella flexneri 2a str. 301
uccccgauuguugaugagc

SEQ ID NO: 1982219 - RNA, 19 nt, Shigella flexneri 2a str. 301
ucccgauaaccuucuucau

SEQ ID NO: 1982220 - RNA, 18 nt, Shigella flexneri 2a str. 301
ucccgauggucagcuuca

SEQ ID NO: 1982221 - RNA, 20 nt, Shigella flexneri 2a str. 301
ucccgauggucagcuucacc

SEQ ID NO: 1982222 - RNA, 22 nt, Shigella flexneri 2a str. 301
ucccgaggaucacaaugccacc

SEQ ID NO: 1982223 - RNA, 13 nt, Shigella flexneri 2a str. 301
uccccucgcuccu

SEQ ID NO: 1982224 - RNA, 14 nt, Shigella flexneri 2a str. 301
uccccucgccccuu

SEQ ID NO: 1982225 - RNA, 21 nt, Shigella flexneri 2a str. 301
uccccuucucaaucccuuucu

SEQ ID NO: 1982226 - RNA, 14 nt, Shigella flexneri 2a str. 301
ucccgugccagagc

SEQ ID NO: 1982227 - RNA, 15 nt, Shigella flexneri 2a str. 301
ucccguuucccuguc

SEQ ID NO: 1982228 - RNA, 16 nt, Shigella flexneri 2a str. 301
ucccggcaagauucca

SEQ ID NO: 1982229 - RNA, 19 nt, Shigella flexneri 2a str. 301
ucccggauaaaucuccauu

SEQ ID NO: 1982230 - RNA, 14 nt, Shigella flexneri 2a str. 301
ucccggauauccca

SEQ ID NO: 1982231 - RNA, 14 nt, Shigella flexneri 2a str. 301
ucccggcagagaaa

SEQ ID NO: 1982232 - RNA, 16 nt, Shigella flexneri 2a str. 301
ucccggcauuucugau

SEQ ID NO: 1982233 - RNA, 13 nt, Shigella flexneri 2a str. 301
ucccggcucaucc

SEQ ID NO: 1982234 - RNA, 18 nt, Shigella flexneri 2a str. 301
ucccggcugcaaccagau

SEQ ID NO: 1982235 - RNA, 21 nt, Shigella flexneri 2a str. 301
ucccgggucgcgacugccagc

SEQ ID NO: 1982236 - RNA, 15 nt, Shigella flexneri 2a str. 301
ucccgcuuacaucaa

SEQ ID NO: 1982237 - RNA, 22 nt, Shigella flexneri 2a str. 301
ucccggaccgucaucuuccacc

SEQ ID NO: 1982238 - RNA, 14 nt, Shigella flexneri 2a str. 301
ucccggaagccacc

SEQ ID NO: 1982239 - RNA, 17 nt, Shigella flexneri 2a str. 301
ucccgcuucguuuucag

SEQ ID NO: 1982240 - RNA, 18 nt, Shigella flexneri 2a str. 301
ucccgcuucguuuucagc

SEQ ID NO: 1982241 - RNA, 23 nt, Shigella flexneri 2a str. 301
ucccgcgccgcagccggaaaacc

SEQ ID NO: 1982242 - RNA, 20 nt, Shigella flexneri 2a str. 301
ucccgcgauggcccggcggu

SEQ ID NO: 1982243 - RNA, 19 nt, Shigella flexneri 2a str. 301
ucccgcgauuuccugaccc

SEQ ID NO: 1982244 - RNA, 15 nt, Shigella flexneri 2a str. 301
ucccgccagcaccag

SEQ ID NO: 1982245 - RNA, 14 nt, Shigella flexneri 2a str. 301
ucccgccagcacca

SEQ ID NO: 1982246 - RNA, 13 nt, Shigella flexneri 2a str. 301
ucccgcaccagcg

SEQ ID NO: 1982247 - RNA, 21 nt, Shigella flexneri 2a str. 301
ucccgcgaacgagaauuucuc

SEQ ID NO: 1982248 - RNA, 18 nt, Shigella flexneri 2a str. 301
ucccgccgcuaucccaug

SEQ ID NO: 1982249 - RNA, 15 nt, Shigella flexneri 2a str. 301
ucccuauuuuuucgu

SEQ ID NO: 1982250 - RNA, 22 nt, Shigella flexneri 2a str. 301
ucccucacccccauucccgcau

SEQ ID NO: 1982251 - RNA, 13 nt, Shigella flexneri 2a str. 301
ucccuaaaauauu

SEQ ID NO: 1982252 - RNA, 17 nt, Shigella flexneri 2a str. 301
ucccguuucagccccuu

SEQ ID NO: 1982253 - RNA, 14 nt, Shigella flexneri 2a str. 301
ucccucuacauuca

SEQ ID NO: 1982254 - RNA, 21 nt, Shigella flexneri 2a str. 301
ucccucgucgguggugguccc

SEQ ID NO: 1982255 - RNA, 18 nt, Shigella flexneri 2a str. 301
ucccucauacugguuucu

SEQ ID NO: 1982256 - RNA, 17 nt, Shigella flexneri 2a str. 301
ucccucccguuucccug

SEQ ID NO: 1982257 - RNA, 19 nt, Shigella flexneri 2a str. 301
ucccucccguuucccuguc

SEQ ID NO: 1982258 - RNA, 14 nt, Shigella flexneri 2a str. 301
ucccucuuucuggc

SEQ ID NO: 1982259 - RNA, 15 nt, Shigella flexneri 2a str. 301
ucccugaaggcugcc

SEQ ID NO: 1982260 - RNA, 22 nt, Shigella flexneri 2a str. 301
ucccugaauaacaccagccaga

SEQ ID NO: 1982261 - RNA, 15 nt, Shigella flexneri 2a str. 301
ucccugacaaaucau

SEQ ID NO: 1982262 - RNA, 21 nt, Shigella flexneri 2a str. 301
ucccugacaaaucaugcggau

SEQ ID NO: 1982263 - RNA, 13 nt, Shigella flexneri 2a str. 301
ucccugccagucc

SEQ ID NO: 1982264 - RNA, 18 nt, Shigella flexneri 2a str. 301
ucccugcgccagcggcag

SEQ ID NO: 1982265 - RNA, 16 nt, Shigella flexneri 2a str. 301
ucccugcggaaaaaag

SEQ ID NO: 1982266 - RNA, 20 nt, Shigella flexneri 2a str. 301
ucccugcggauauuugcgau

SEQ ID NO: 1982267 - RNA, 23 nt, Shigella flexneri 2a str. 301
ucccugcacuaugaaugaacaaa

SEQ ID NO: 1982268 - RNA, 22 nt, Shigella flexneri 2a str. 301
ucccugcaauagauugaauuag

SEQ ID NO: 1982269 - RNA, 21 nt, Shigella flexneri 2a str. 301
ucccuggcccaucgccagugc

SEQ ID NO: 1982270 - RNA, 19 nt, Shigella flexneri 2a str. 301
ucccugcugaauccccuuc

SEQ ID NO: 1982271 - RNA, 19 nt, Shigella flexneri 2a str. 301
ucccuuccggugcaaucag

SEQ ID NO: 1982272 - RNA, 13 nt, Shigella flexneri 2a str. 301
ucccuucccagcc

SEQ ID NO: 1982273 - RNA, 15 nt, Shigella flexneri 2a str. 301
ucccuucccagccgg

SEQ ID NO: 1982274 - RNA, 21 nt, Shigella flexneri 2a str. 301
ucccuuccgcaauacagccag

SEQ ID NO: 1982275 - RNA, 18 nt, Shigella flexneri 2a str. 301
ucccuucagccaccaggu

SEQ ID NO: 1982276 - RNA, 17 nt, Shigella flexneri 2a str. 301
ucccuuagcuaauuuuu

SEQ ID NO: 1982277 - RNA, 22 nt, Shigella flexneri 2a str. 301
uccgaccaggcguucugccugg

SEQ ID NO: 1982278 - RNA, 14 nt, Shigella flexneri 2a str. 301
ucccuuuuucaagc

SEQ ID NO: 1982279 - RNA, 15 nt, Shigella flexneri 2a str. 301
ucccuuucucuucaa

SEQ ID NO: 1982280 - RNA, 11 nt, Shigella flexneri 2a str. 301
ucccuuuggcc

SEQ ID NO: 1982281 - RNA, 17 nt, Shigella flexneri 2a str. 301
ucccuuguuauugugua

SEQ ID NO: 1982282 - RNA, 19 nt, Shigella flexneri 2a str. 301
uccgagaauggacaccagc

SEQ ID NO: 1982283 - RNA, 18 nt, Shigella flexneri 2a str. 301
aaaucugccgauuucaac

SEQ ID NO: 1982284 - RNA, 16 nt, Shigella flexneri 2a str. 301
aaaucugaaaucauca

SEQ ID NO: 1982285 - RNA, 18 nt, Shigella flexneri 2a str. 301
uccgccucuaacagauca

SEQ ID NO: 1982286 - RNA, 20 nt, Shigella flexneri 2a str. 301
uccgcgaauuaugcagccuu

SEQ ID NO: 1982287 - RNA, 21 nt, Shigella flexneri 2a str. 301
uccgccgccauugacguuccu

SEQ ID NO: 1982288 - RNA, 22 nt, Shigella flexneri 2a str. 301
uccgcccuacgcguuaaagagc

SEQ ID NO: 1982289 - RNA, 16 nt, Shigella flexneri 2a str. 301
uccgccccauuuuuaa

SEQ ID NO: 1982290 - RNA, 15 nt, Shigella flexneri 2a str. 301
uccgccauuuuaauc

SEQ ID NO: 1982291 - RNA, 21 nt, Shigella flexneri 2a str. 301
uccgccauuuuaaucaucuga

SEQ ID NO: 1982292 - RNA, 16 nt, Shigella flexneri 2a str. 301
uccgcgucauucagcu

SEQ ID NO: 1982293 - RNA, 17 nt, Shigella flexneri 2a str. 301
uccgcguccgcuggacc

SEQ ID NO: 1982294 - RNA, 23 nt, Shigella flexneri 2a str. 301
uccgcgugacgcuggcagaaagu

SEQ ID NO: 1982295 - RNA, 18 nt, Shigella flexneri 2a str. 301
uccgcggcuuugucauaa

SEQ ID NO: 1982296 - RNA, 16 nt, Shigella flexneri 2a str. 301
uccgcuaucaguucag

SEQ ID NO: 1982297 - RNA, 13 nt, Shigella flexneri 2a str. 301
uccgcuauuucuu

SEQ ID NO: 1982298 - RNA, 15 nt, Shigella flexneri 2a str. 301
uccgauauucaauug

SEQ ID NO: 1982299 - RNA, 18 nt, Shigella flexneri 2a str. 301
uccgcaccaacuccacuu

SEQ ID NO: 1982300 - RNA, 22 nt, Shigella flexneri 2a str. 301
uccgcaccaacuccacuucacc

SEQ ID NO: 1982301 - RNA, 21 nt, Shigella flexneri 2a str. 301
uccgcaaugcggagguuucuu

SEQ ID NO: 1982302 - RNA, 20 nt, Shigella flexneri 2a str. 301
uccgcaauacaucaaagcgu

SEQ ID NO: 1982303 - RNA, 19 nt, Shigella flexneri 2a str. 301
uccgcaugauucugagaaa

SEQ ID NO: 1982304 - RNA, 17 nt, Shigella flexneri 2a str. 301
uccgcauccggcauaaa

SEQ ID NO: 1982305 - RNA, 18 nt, Shigella flexneri 2a str. 301
uccgccagauuuauuuac

SEQ ID NO: 1982306 - RNA, 13 nt, Shigella flexneri 2a str. 301
uccgccaccugcg

SEQ ID NO: 1982307 - RNA, 14 nt, Shigella flexneri 2a str. 301
uccgccaucagucg

SEQ ID NO: 1982308 - RNA, 17 nt, Shigella flexneri 2a str. 301
uccgccagugccaaagc

SEQ ID NO: 1982309 - RNA, 11 nt, Shigella flexneri 2a str. 301
uccgccagcgg

SEQ ID NO: 1982310 - RNA, 13 nt, Shigella flexneri 2a str. 301
uccgccagcgcca

SEQ ID NO: 1982311 - RNA, 17 nt, Shigella flexneri 2a str. 301
uccaucguccgugaaga

SEQ ID NO: 1982312 - RNA, 17 nt, Shigella flexneri 2a str. 301
uccaucggcauuaaucu

SEQ ID NO: 1982313 - RNA, 18 nt, Shigella flexneri 2a str. 301
uccaucuuuaugaaauau

SEQ ID NO: 1982314 - RNA, 14 nt, Shigella flexneri 2a str. 301
uccaugaaaauaga

SEQ ID NO: 1982315 - RNA, 22 nt, Shigella flexneri 2a str. 301
uccauccggcuggucagcaacu

SEQ ID NO: 1982316 - RNA, 18 nt, Shigella flexneri 2a str. 301
uccaucccgcucuguaag

SEQ ID NO: 1982317 - RNA, 18 nt, Shigella flexneri 2a str. 301
uccauccauacgggcaug

SEQ ID NO: 1982318 - RNA, 13 nt, Shigella flexneri 2a str. 301
uccauccagcaac

SEQ ID NO: 1982319 - RNA, 13 nt, Shigella flexneri 2a str. 301
uccaucacuucau

SEQ ID NO: 1982320 - RNA, 14 nt, Shigella flexneri 2a str. 301
uccaucacuucauc

SEQ ID NO: 1982321 - RNA, 19 nt, Shigella flexneri 2a str. 301
uccaucagauucagcagcg

SEQ ID NO: 1982322 - RNA, 14 nt, Shigella flexneri 2a str. 301
uccaugugggcugc

SEQ ID NO: 1982323 - RNA, 17 nt, Shigella flexneri 2a str. 301
uccauguugcuggaaga

SEQ ID NO: 1982324 - RNA, 22 nt, Shigella flexneri 2a str. 301
uccauggacgaugagacccgcc

SEQ ID NO: 1982325 - RNA, 14 nt, Shigella flexneri 2a str. 301
uccaugccaucugc

SEQ ID NO: 1982326 - RNA, 15 nt, Shigella flexneri 2a str. 301
uccaugcacucccau

SEQ ID NO: 1982327 - RNA, 20 nt, Shigella flexneri 2a str. 301
uccaugcgcauuaagccaug

SEQ ID NO: 1982328 - RNA, 15 nt, Shigella flexneri 2a str. 301
uccauuucauugagu

SEQ ID NO: 1982329 - RNA, 22 nt, Shigella flexneri 2a str. 301
ucccaaaagcucggucauugcc

SEQ ID NO: 1982330 - RNA, 21 nt, Shigella flexneri 2a str. 301
uccauuuugagggaaacggag

SEQ ID NO: 1982331 - RNA, 12 nt, Shigella flexneri 2a str. 301
uccauuuuucac

SEQ ID NO: 1982332 - RNA, 18 nt, Shigella flexneri 2a str. 301
uccauucaucgccuuuca

SEQ ID NO: 1982333 - RNA, 14 nt, Shigella flexneri 2a str. 301
uccauucgaugaga

SEQ ID NO: 1982334 - RNA, 16 nt, Shigella flexneri 2a str. 301
uccauucgcugcugcg

SEQ ID NO: 1982335 - RNA, 20 nt, Shigella flexneri 2a str. 301
uccauugccgcuuuccaggc

SEQ ID NO: 1982336 - RNA, 18 nt, Shigella flexneri 2a str. 301
ucccaacaacagcgcgcu

SEQ ID NO: 1982337 - RNA, 13 nt, Shigella flexneri 2a str. 301
ucccaacaacagc

SEQ ID NO: 1982338 - RNA, 24 nt, Shigella flexneri 2a str. 301
ucccaaccuuguuucugagcauga

SEQ ID NO: 1982339 - RNA, 22 nt, Shigella flexneri 2a str. 301
ucccaccagacgugauaaacau

SEQ ID NO: 1982340 - RNA, 16 nt, Shigella flexneri 2a str. 301
ucccaccaccagcaau

SEQ ID NO: 1982341 - RNA, 17 nt, Shigella flexneri 2a str. 301
ucccaauugcacauauu

SEQ ID NO: 1982342 - RNA, 21 nt, Shigella flexneri 2a str. 301
uccacuucugcacgguuuuuc

SEQ ID NO: 1982343 - RNA, 17 nt, Shigella flexneri 2a str. 301
uccacuuucgcggcuuu

SEQ ID NO: 1982344 - RNA, 16 nt, Shigella flexneri 2a str. 301
uccagcaucuguucuu

SEQ ID NO: 1982345 - RNA, 16 nt, Shigella flexneri 2a str. 301
uccagcauaaugugcg

SEQ ID NO: 1982346 - RNA, 19 nt, Shigella flexneri 2a str. 301
uccagcauauguuuacgcu

SEQ ID NO: 1982347 - RNA, 22 nt, Shigella flexneri 2a str. 301
uccagcauacgcugccagccau

SEQ ID NO: 1982348 - RNA, 18 nt, Shigella flexneri 2a str. 301
uccagcgcguaaauaccu

SEQ ID NO: 1982349 - RNA, 14 nt, Shigella flexneri 2a str. 301
uccagcgcugcggc

SEQ ID NO: 1982350 - RNA, 20 nt, Shigella flexneri 2a str. 301
uccagcgcggcgaaggugcc

SEQ ID NO: 1982351 - RNA, 13 nt, Shigella flexneri 2a str. 301
uccagcgccgcca

SEQ ID NO: 1982352 - RNA, 22 nt, Shigella flexneri 2a str. 301
uccagcgccgccagaagggaag

SEQ ID NO: 1982353 - RNA, 23 nt, Shigella flexneri 2a str. 301
uccagcgccauuggcuuuugcuu

SEQ ID NO: 1982354 - RNA, 19 nt, Shigella flexneri 2a str. 301
uccaggagcguauucagca

SEQ ID NO: 1982355 - RNA, 13 nt, Shigella flexneri 2a str. 301
uccaggagcucca

SEQ ID NO: 1982356 - RNA, 20 nt, Shigella flexneri 2a str. 301
uccaggagcuccagguccuc

SEQ ID NO: 1982357 - RNA, 17 nt, Shigella flexneri 2a str. 301
uccaggaguuccggguc

SEQ ID NO: 1982358 - RNA, 23 nt, Shigella flexneri 2a str. 301
uccaggaguuccgggucauccag

SEQ ID NO: 1982359 - RNA, 22 nt, Shigella flexneri 2a str. 301
uccagucggcguaauccugaaa

SEQ ID NO: 1982360 - RNA, 17 nt, Shigella flexneri 2a str. 301
uccagucgagaaccuga

SEQ ID NO: 1982361 - RNA, 20 nt, Shigella flexneri 2a str. 301
uccagucgcaaaccuggcau

SEQ ID NO: 1982362 - RNA, 21 nt, Shigella flexneri 2a str. 301
uccagugcgcuuuauucagau

SEQ ID NO: 1982363 - RNA, 21 nt, Shigella flexneri 2a str. 301
uccagugccggaugauucaca

SEQ ID NO: 1982364 - RNA, 22 nt, Shigella flexneri 2a str. 301
uccagugccugugacaacacuu

SEQ ID NO: 1982365 - RNA, 12 nt, Shigella flexneri 2a str. 301
uccaguggcuga

SEQ ID NO: 1982366 - RNA, 13 nt, Shigella flexneri 2a str. 301
uccaguggcugug

SEQ ID NO: 1982367 - RNA, 13 nt, Shigella flexneri 2a str. 301
uccagguccuccu

SEQ ID NO: 1982368 - RNA, 14 nt, Shigella flexneri 2a str. 301
uccagguauuuaac

SEQ ID NO: 1982369 - RNA, 15 nt, Shigella flexneri 2a str. 301
uccagguauuuaacc

SEQ ID NO: 1982370 - RNA, 20 nt, Shigella flexneri 2a str. 301
uccaggucaaccuagccuuc

SEQ ID NO: 1982371 - RNA, 16 nt, Shigella flexneri 2a str. 301
uccauagcgauguauu

SEQ ID NO: 1982372 - RNA, 20 nt, Shigella flexneri 2a str. 301
uccauagucacuaccuguuu

SEQ ID NO: 1982373 - RNA, 18 nt, Shigella flexneri 2a str. 301
uccauauggcugcauuca

SEQ ID NO: 1982374 - RNA, 16 nt, Shigella flexneri 2a str. 301
uccaucaagauuagcg

SEQ ID NO: 1982375 - RNA, 19 nt, Shigella flexneri 2a str. 301
uccaucaaagguuuuucag

SEQ ID NO: 1982376 - RNA, 21 nt, Shigella flexneri 2a str. 301
uccaucaaagguuuuucagua

SEQ ID NO: 1982377 - RNA, 16 nt, Shigella flexneri 2a str. 301
uccaguugcccgguaa

SEQ ID NO: 1982378 - RNA, 14 nt, Shigella flexneri 2a str. 301
uccaguugguugau

SEQ ID NO: 1982379 - RNA, 20 nt, Shigella flexneri 2a str. 301
uccaguucaagugcuaccca

SEQ ID NO: 1982380 - RNA, 17 nt, Shigella flexneri 2a str. 301
uccaguguggccagagu

SEQ ID NO: 1982381 - RNA, 19 nt, Shigella flexneri 2a str. 301
uccaguucgaucucuucgc

SEQ ID NO: 1982382 - RNA, 14 nt, Shigella flexneri 2a str. 301
uccaguugauacag

SEQ ID NO: 1982383 - RNA, 18 nt, Shigella flexneri 2a str. 301
uccaauaugcgguacugc

SEQ ID NO: 1982384 - RNA, 14 nt, Shigella flexneri 2a str. 301
uccaccagcggcug

SEQ ID NO: 1982385 - RNA, 13 nt, Shigella flexneri 2a str. 301
uccaccagcgcgu

SEQ ID NO: 1982386 - RNA, 14 nt, Shigella flexneri 2a str. 301
uccacccgcagcca

SEQ ID NO: 1982387 - RNA, 15 nt, Shigella flexneri 2a str. 301
uccaccccagcagaa

SEQ ID NO: 1982388 - RNA, 18 nt, Shigella flexneri 2a str. 301
uccacaagcuccggcuuu

SEQ ID NO: 1982389 - RNA, 11 nt, Shigella flexneri 2a str. 301
uccacacccag

SEQ ID NO: 1982390 - RNA, 16 nt, Shigella flexneri 2a str. 301
uccacuuccaccagcg

SEQ ID NO: 1982391 - RNA, 21 nt, Shigella flexneri 2a str. 301
uccacuuccgcgucaaucugc

SEQ ID NO: 1982392 - RNA, 21 nt, Shigella flexneri 2a str. 301
uccacuucacggcugcuaaua

SEQ ID NO: 1982393 - RNA, 15 nt, Shigella flexneri 2a str. 301
uccacgguucuccac

SEQ ID NO: 1982394 - RNA, 21 nt, Shigella flexneri 2a str. 301
uccacgguccgugugaacgau

SEQ ID NO: 1982395 - RNA, 14 nt, Shigella flexneri 2a str. 301
uccacuaacuguuu

SEQ ID NO: 1982396 - RNA, 14 nt, Shigella flexneri 2a str. 301
uccacguuccccag

SEQ ID NO: 1982397 - RNA, 21 nt, Shigella flexneri 2a str. 301
uccacgccgcugucuaccagc

SEQ ID NO: 1982398 - RNA, 17 nt, Shigella flexneri 2a str. 301
uccacgccuuuuuucac

SEQ ID NO: 1982399 - RNA, 20 nt, Shigella flexneri 2a str. 301
uccacgcuauacagcagcca

SEQ ID NO: 1982400 - RNA, 20 nt, Shigella flexneri 2a str. 301
uccacgcgauacuuuuucaa

SEQ ID NO: 1982401 - RNA, 17 nt, Shigella flexneri 2a str. 301
uccacggaaucaccgcc

SEQ ID NO: 1982402 - RNA, 17 nt, Shigella flexneri 2a str. 301
ucauuguccgucugaaa

SEQ ID NO: 1982403 - RNA, 19 nt, Shigella flexneri 2a str. 301
ucauugccaguccuaaaaa

SEQ ID NO: 1982404 - RNA, 17 nt, Shigella flexneri 2a str. 301
ucauuugaauaguuaau

SEQ ID NO: 1982405 - RNA, 20 nt, Shigella flexneri 2a str. 301
ucauuuucggcagugaaaac

SEQ ID NO: 1982406 - RNA, 16 nt, Shigella flexneri 2a str. 301
ucauuuucucuuucag

SEQ ID NO: 1982407 - RNA, 21 nt, Shigella flexneri 2a str. 301
ucauuuucuucagcaguucag

SEQ ID NO: 1982408 - RNA, 18 nt, Shigella flexneri 2a str. 301
uccaaaccgacugccugc

SEQ ID NO: 1982409 - RNA, 18 nt, Shigella flexneri 2a str. 301
ucauuagucacaaaucuc

SEQ ID NO: 1982410 - RNA, 23 nt, Shigella flexneri 2a str. 301
ucauuagcccgguagcaugaacc

SEQ ID NO: 1982411 - RNA, 16 nt, Shigella flexneri 2a str. 301
ucauucagcucgcuaa

SEQ ID NO: 1982412 - RNA, 13 nt, Shigella flexneri 2a str. 301
ucauuccuggagc

SEQ ID NO: 1982413 - RNA, 15 nt, Shigella flexneri 2a str. 301
ucauucgaaaccacc

SEQ ID NO: 1982414 - RNA, 17 nt, Shigella flexneri 2a str. 301
ucauugaaggcggcgca

SEQ ID NO: 1982415 - RNA, 14 nt, Shigella flexneri 2a str. 301
ucauugaaggcggc

SEQ ID NO: 1982416 - RNA, 22 nt, Shigella flexneri 2a str. 301
ucauugaacgggugauuucccc

SEQ ID NO: 1982417 - RNA, 18 nt, Shigella flexneri 2a str. 301
ucauugagcugcaaccau

SEQ ID NO: 1982418 - RNA, 20 nt, Shigella flexneri 2a str. 301
ucauugagcugcaaccauuu

SEQ ID NO: 1982419 - RNA, 21 nt, Shigella flexneri 2a str. 301
ucaguuguucagaaugcccac

SEQ ID NO: 1982420 - RNA, 21 nt, Shigella flexneri 2a str. 301
ucaguugcaccugauccagcu

SEQ ID NO: 1982421 - RNA, 14 nt, Shigella flexneri 2a str. 301
ucaguugucugaau

SEQ ID NO: 1982422 - RNA, 15 nt, Shigella flexneri 2a str. 301
ucagugucuuaucug

SEQ ID NO: 1982423 - RNA, 17 nt, Shigella flexneri 2a str. 301
ucagugucgcaguagcc

SEQ ID NO: 1982424 - RNA, 16 nt, Shigella flexneri 2a str. 301
ucaguucuagaacuaa

SEQ ID NO: 1982425 - RNA, 15 nt, Shigella flexneri 2a str. 301
ucaguucuaccauca

SEQ ID NO: 1982426 - RNA, 18 nt, Shigella flexneri 2a str. 301
ucaguuugcaaacccuga

SEQ ID NO: 1982427 - RNA, 17 nt, Shigella flexneri 2a str. 301
ucaugucggcagugauu

SEQ ID NO: 1982428 - RNA, 14 nt, Shigella flexneri 2a str. 301
ucaugugcaggauu

SEQ ID NO: 1982429 - RNA, 22 nt, Shigella flexneri 2a str. 301
ugauucgaucaaacaauuuuca

SEQ ID NO: 1982430 - RNA, 16 nt, Shigella flexneri 2a str. 301
ugauucgauucacauu

SEQ ID NO: 1982431 - RNA, 11 nt, Shigella flexneri 2a str. 301
ugauuccugca

SEQ ID NO: 1982432 - RNA, 20 nt, Shigella flexneri 2a str. 301
ugauuccagcauaaugacuc

SEQ ID NO: 1982433 - RNA, 17 nt, Shigella flexneri 2a str. 301
ugaugaggcauaagcga

SEQ ID NO: 1982434 - RNA, 15 nt, Shigella flexneri 2a str. 301
ugaugaguugaaaac

SEQ ID NO: 1982435 - RNA, 18 nt, Shigella flexneri 2a str. 301
ugauugagcugcccggcu

SEQ ID NO: 1982436 - RNA, 15 nt, Shigella flexneri 2a str. 301
ugauugaagaaauca

SEQ ID NO: 1982437 - RNA, 22 nt, Shigella flexneri 2a str. 301
ugauugagauaaacugccgaca

SEQ ID NO: 1982438 - RNA, 13 nt, Shigella flexneri 2a str. 301
ugcaaaaccuggu

SEQ ID NO: 1982439 - RNA, 12 nt, Shigella flexneri 2a str. 301
ugcaaaaucaaa

SEQ ID NO: 1982440 - RNA, 13 nt, Shigella flexneri 2a str. 301
ugcaaacauuuca

SEQ ID NO: 1982441 - RNA, 18 nt, Shigella flexneri 2a str. 301
ugcaaauacccaaaaaau

SEQ ID NO: 1982442 - RNA, 17 nt, Shigella flexneri 2a str. 301
ugcaaauaaauaccguu

SEQ ID NO: 1982443 - RNA, 12 nt, Shigella flexneri 2a str. 301
ugcaaauauaca

SEQ ID NO: 1982444 - RNA, 14 nt, Shigella flexneri 2a str. 301
ugcaaaucaccaca

SEQ ID NO: 1982445 - RNA, 17 nt, Shigella flexneri 2a str. 301
ugcaaaauaccaauaau

SEQ ID NO: 1982446 - RNA, 20 nt, Shigella flexneri 2a str. 301
ugauuuuuuuucaaccuaaa

SEQ ID NO: 1982447 - RNA, 19 nt, Shigella flexneri 2a str. 301
ugauuuuucguuuuaaugc

SEQ ID NO: 1982448 - RNA, 23 nt, Shigella flexneri 2a str. 301
ugauuuuucguuuuaaugcgauc

SEQ ID NO: 1982449 - RNA, 22 nt, Shigella flexneri 2a str. 301
ugauuuucucgcccguuuugag

SEQ ID NO: 1982450 - RNA, 15 nt, Shigella flexneri 2a str. 301
ugauuuuauugcguc

SEQ ID NO: 1982451 - RNA, 18 nt, Shigella flexneri 2a str. 301
ugauuuucaccagcaucg

SEQ ID NO: 1982452 - RNA, 16 nt, Shigella flexneri 2a str. 301
ugcaaucagauaaaau

SEQ ID NO: 1982453 - RNA, 13 nt, Shigella flexneri 2a str. 301
ugcaaucagauaa

SEQ ID NO: 1982454 - RNA, 19 nt, Shigella flexneri 2a str. 301
ugcaaucaccacugccagc

SEQ ID NO: 1982455 - RNA, 12 nt, Shigella flexneri 2a str. 301
ugcaaucagcgg

SEQ ID NO: 1982456 - RNA, 21 nt, Shigella flexneri 2a str. 301
ugcaaucaacaccacugccag

SEQ ID NO: 1982457 - RNA, 20 nt, Shigella flexneri 2a str. 301
ugcaauagcgccugcugcug

SEQ ID NO: 1982458 - RNA, 17 nt, Shigella flexneri 2a str. 301
ugcaauaauuuacagcc

SEQ ID NO: 1982459 - RNA, 19 nt, Shigella flexneri 2a str. 301
ugcaauaauuuacagccug

SEQ ID NO: 1982460 - RNA, 18 nt, Shigella flexneri 2a str. 301
ugcaagugagucggcuuu

SEQ ID NO: 1982461 - RNA, 17 nt, Shigella flexneri 2a str. 301
ugcaauaacaauacuua

SEQ ID NO: 1982462 - RNA, 19 nt, Shigella flexneri 2a str. 301
ugcaauaacaauacuuaua

SEQ ID NO: 1982463 - RNA, 15 nt, Shigella flexneri 2a str. 301
ugcaaucuacaaaag

SEQ ID NO: 1982464 - RNA, 15 nt, Shigella flexneri 2a str. 301
ugcaaugauucaggc

SEQ ID NO: 1982465 - RNA, 17 nt, Shigella flexneri 2a str. 301
ugcacaaagguuucgua

SEQ ID NO: 1982466 - RNA, 12 nt, Shigella flexneri 2a str. 301
ugcaauugcucc

SEQ ID NO: 1982467 - RNA, 14 nt, Shigella flexneri 2a str. 301
ugcaauuuauugau

SEQ ID NO: 1982468 - RNA, 19 nt, Shigella flexneri 2a str. 301
ugcaauuccaucauaucac

SEQ ID NO: 1982469 - RNA, 20 nt, Shigella flexneri 2a str. 301
ugcaagaucgcucaucagcu

SEQ ID NO: 1982470 - RNA, 13 nt, Shigella flexneri 2a str. 301
ugcaagauguuaa

SEQ ID NO: 1982471 - RNA, 12 nt, Shigella flexneri 2a str. 301
ugcaagaaauga

SEQ ID NO: 1982472 - RNA, 16 nt, Shigella flexneri 2a str. 301
ugcaagccuguaguac

SEQ ID NO: 1982473 - RNA, 17 nt, Shigella flexneri 2a str. 301
ugcaaccuuuuccauug

SEQ ID NO: 1982474 - RNA, 14 nt, Shigella flexneri 2a str. 301
ugcaacgaacgcau

SEQ ID NO: 1982475 - RNA, 13 nt, Shigella flexneri 2a str. 301
ugcaacgagugca

SEQ ID NO: 1982476 - RNA, 22 nt, Shigella flexneri 2a str. 301
ugcaacaagaggcaauaguucu

SEQ ID NO: 1982477 - RNA, 20 nt, Shigella flexneri 2a str. 301
ugcaacaacugaaaaaaaau

SEQ ID NO: 1982478 - RNA, 22 nt, Shigella flexneri 2a str. 301
ugcaaauucucuauuucacccg

SEQ ID NO: 1982479 - RNA, 20 nt, Shigella flexneri 2a str. 301
ugcaaaugccagauaagaca

SEQ ID NO: 1982480 - RNA, 13 nt, Shigella flexneri 2a str. 301
ugcaaaugccaga

SEQ ID NO: 1982481 - RNA, 15 nt, Shigella flexneri 2a str. 301
ugcaaauucaauaua

SEQ ID NO: 1982482 - RNA, 13 nt, Shigella flexneri 2a str. 301
ugcaacagcacca

SEQ ID NO: 1982483 - RNA, 18 nt, Shigella flexneri 2a str. 301
ugcaacauguugaaucuu

SEQ ID NO: 1982484 - RNA, 14 nt, Shigella flexneri 2a str. 301
ugcaaccuuuucca

SEQ ID NO: 1982485 - RNA, 12 nt, Shigella flexneri 2a str. 301
ugcaaccacaca

SEQ ID NO: 1982486 - RNA, 20 nt, Shigella flexneri 2a str. 301
ugcagcacggagagacguug

SEQ ID NO: 1982487 - RNA, 14 nt, Shigella flexneri 2a str. 301
ugcagccaggccau

SEQ ID NO: 1982488 - RNA, 14 nt, Shigella flexneri 2a str. 301
ugcagccaggguca

SEQ ID NO: 1982489 - RNA, 16 nt, Shigella flexneri 2a str. 301
ugcagcccagcaucag

SEQ ID NO: 1982490 - RNA, 22 nt, Shigella flexneri 2a str. 301
ugcagcacacauuauaggccug

SEQ ID NO: 1982491 - RNA, 17 nt, Shigella flexneri 2a str. 301
ugcagcacggagagacg

SEQ ID NO: 1982492 - RNA, 16 nt, Shigella flexneri 2a str. 301
ugcagcaacucuuuuu

SEQ ID NO: 1982493 - RNA, 14 nt, Shigella flexneri 2a str. 301
ugcagcaagccauc

SEQ ID NO: 1982494 - RNA, 15 nt, Shigella flexneri 2a str. 301
ugcagccggagcuuc

SEQ ID NO: 1982495 - RNA, 14 nt, Shigella flexneri 2a str. 301
ugcagccuucauuc

SEQ ID NO: 1982496 - RNA, 22 nt, Shigella flexneri 2a str. 301
ugcagccuucauucaggcauug

SEQ ID NO: 1982497 - RNA, 15 nt, Shigella flexneri 2a str. 301
ugcagcgucaucaac

SEQ ID NO: 1982498 - RNA, 16 nt, Shigella flexneri 2a str. 301
ugcagcguuuccagcc

SEQ ID NO: 1982499 - RNA, 14 nt, Shigella flexneri 2a str. 301
ugcagcguuuccag

SEQ ID NO: 1982500 - RNA, 13 nt, Shigella flexneri 2a str. 301
ugcagcguuucca

SEQ ID NO: 1982501 - RNA, 16 nt, Shigella flexneri 2a str. 301
ugcacuagguuuucgu

SEQ ID NO: 1982502 - RNA, 20 nt, Shigella flexneri 2a str. 301
ugcacuagacgaugaaaaag

SEQ ID NO: 1982503 - RNA, 17 nt, Shigella flexneri 2a str. 301
ugcacucgcauccucuu

SEQ ID NO: 1982504 - RNA, 20 nt, Shigella flexneri 2a str. 301
ugcacucagguaacagggaa

SEQ ID NO: 1982505 - RNA, 19 nt, Shigella flexneri 2a str. 301
ugcacuugcuuaaaauccc

SEQ ID NO: 1982506 - RNA, 12 nt, Shigella flexneri 2a str. 301
ugcacuggcuuc

SEQ ID NO: 1982507 - RNA, 22 nt, Shigella flexneri 2a str. 301
ugcagaucguuuuccugcauua

SEQ ID NO: 1982508 - RNA, 16 nt, Shigella flexneri 2a str. 301
ugcaccagcaacaagc

SEQ ID NO: 1982509 - RNA, 17 nt, Shigella flexneri 2a str. 301
ugcaccagcuggcuguc

SEQ ID NO: 1982510 - RNA, 20 nt, Shigella flexneri 2a str. 301
ugcaccggcgacaucccagg

SEQ ID NO: 1982511 - RNA, 18 nt, Shigella flexneri 2a str. 301
ugcaccugauccagcucu

SEQ ID NO: 1982512 - RNA, 17 nt, Shigella flexneri 2a str. 301
ugcacguuguuauccag

SEQ ID NO: 1982513 - RNA, 13 nt, Shigella flexneri 2a str. 301
ugcacguuuucaa

SEQ ID NO: 1982514 - RNA, 22 nt, Shigella flexneri 2a str. 301
ugcacguccgguggcauccgca

SEQ ID NO: 1982515 - RNA, 17 nt, Shigella flexneri 2a str. 301
ugcacagacuuaauauu

SEQ ID NO: 1982516 - RNA, 20 nt, Shigella flexneri 2a str. 301
ugcacagacuuaauauugcc

SEQ ID NO: 1982517 - RNA, 22 nt, Shigella flexneri 2a str. 301
ugcacaccccgcgcagcugaga

SEQ ID NO: 1982518 - RNA, 15 nt, Shigella flexneri 2a str. 301
ugcacacuuuccaua

SEQ ID NO: 1982519 - RNA, 12 nt, Shigella flexneri 2a str. 301
ugcacaaauuug

SEQ ID NO: 1982520 - RNA, 16 nt, Shigella flexneri 2a str. 301
ugcacaacaaucugca

SEQ ID NO: 1982521 - RNA, 19 nt, Shigella flexneri 2a str. 301
ugcacacagggcgcuagcc

SEQ ID NO: 1982522 - RNA, 16 nt, Shigella flexneri 2a str. 301
ugcacaauugccagcc

SEQ ID NO: 1982523 - RNA, 17 nt, Shigella flexneri 2a str. 301
ugcaccaacaaauagag

SEQ ID NO: 1982524 - RNA, 20 nt, Shigella flexneri 2a str. 301
ugcacauucccugcagucac

SEQ ID NO: 1982525 - RNA, 19 nt, Shigella flexneri 2a str. 301
ugcacaucuaaccauuauu

SEQ ID NO: 1982526 - RNA, 22 nt, Shigella flexneri 2a str. 301
ugcacaugaugauggcuaucaa

SEQ ID NO: 1982527 - RNA, 12 nt, Shigella flexneri 2a str. 301
ugcacaggcaag

SEQ ID NO: 1982528 - RNA, 14 nt, Shigella flexneri 2a str. 301
ugcauaauccugcc

SEQ ID NO: 1982529 - RNA, 23 nt, Shigella flexneri 2a str. 301
ugcauaaucgcaacgccuuccgu

SEQ ID NO: 1982530 - RNA, 18 nt, Shigella flexneri 2a str. 301
ugcauaaagcgguuuuca

SEQ ID NO: 1982531 - RNA, 21 nt, Shigella flexneri 2a str. 301
ugcauaaacgccgucaucaca

SEQ ID NO: 1982532 - RNA, 22 nt, Shigella flexneri 2a str. 301
ugcaucaggcaaacuucacgca

SEQ ID NO: 1982533 - RNA, 23 nt, Shigella flexneri 2a str. 301
ugcaucacauccggcaauauuca

SEQ ID NO: 1982534 - RNA, 18 nt, Shigella flexneri 2a str. 301
ugcaucaaguugauuuuu

SEQ ID NO: 1982535 - RNA, 11 nt, Shigella flexneri 2a str. 301
ugcaucaacca

SEQ ID NO: 1982536 - RNA, 18 nt, Shigella flexneri 2a str. 301
ugcaucacgcgcaucugu

SEQ ID NO: 1982537 - RNA, 20 nt, Shigella flexneri 2a str. 301
ugcauacccagaacuaucau

SEQ ID NO: 1982538 - RNA, 16 nt, Shigella flexneri 2a str. 301
ugcauacaguacgugu

SEQ ID NO: 1982539 - RNA, 17 nt, Shigella flexneri 2a str. 301
ugcagugccgcugcucg

SEQ ID NO: 1982540 - RNA, 19 nt, Shigella flexneri 2a str. 301
ugcagugcauccagcagcc

SEQ ID NO: 1982541 - RNA, 20 nt, Shigella flexneri 2a str. 301
ugcagucgcuguauuuugcg

SEQ ID NO: 1982542 - RNA, 17 nt, Shigella flexneri 2a str. 301
ugcagucauaaccaguc

SEQ ID NO: 1982543 - RNA, 17 nt, Shigella flexneri 2a str. 301
ugcagucaccugcccuc

SEQ ID NO: 1982544 - RNA, 23 nt, Shigella flexneri 2a str. 301
ugcaguacaucguagugaugcca

SEQ ID NO: 1982545 - RNA, 14 nt, Shigella flexneri 2a str. 301
ugcagguucgacug

SEQ ID NO: 1982546 - RNA, 22 nt, Shigella flexneri 2a str. 301
ugccaccaccagcguaccgaua

SEQ ID NO: 1982547 - RNA, 15 nt, Shigella flexneri 2a str. 301
ugccaccagcagcgu

SEQ ID NO: 1982548 - RNA, 11 nt, Shigella flexneri 2a str. 301
ugccacaaacg

SEQ ID NO: 1982549 - RNA, 21 nt, Shigella flexneri 2a str. 301
ugccaaucaguucaccacuuu

SEQ ID NO: 1982550 - RNA, 23 nt, Shigella flexneri 2a str. 301
ugccaaucaguucaccacuuugu

SEQ ID NO: 1982551 - RNA, 14 nt, Shigella flexneri 2a str. 301
ugccaaucagcaga

SEQ ID NO: 1982552 - RNA, 19 nt, Shigella flexneri 2a str. 301
ugcauuuucaaagguacgu

SEQ ID NO: 1982553 - RNA, 17 nt, Shigella flexneri 2a str. 301
ugcauuuccauaaauug

SEQ ID NO: 1982554 - RNA, 18 nt, Shigella flexneri 2a str. 301
ugcauuuccauaaauugc

SEQ ID NO: 1982555 - RNA, 13 nt, Shigella flexneri 2a str. 301
ugcaucagucacg

SEQ ID NO: 1982556 - RNA, 15 nt, Shigella flexneri 2a str. 301
ugcaucaugaaaacc

SEQ ID NO: 1982557 - RNA, 14 nt, Shigella flexneri 2a str. 301
ugcaucggcauaau

SEQ ID NO: 1982558 - RNA, 18 nt, Shigella flexneri 2a str. 301
ugcaucguauugguacau

SEQ ID NO: 1982559 - RNA, 23 nt, Shigella flexneri 2a str. 301
ugcaucuccggcgcauccaugau

SEQ ID NO: 1982560 - RNA, 15 nt, Shigella flexneri 2a str. 301
ugcaucuccugacac

SEQ ID NO: 1982561 - RNA, 22 nt, Shigella flexneri 2a str. 301
ugcaucgucuguuuuaucuccc

SEQ ID NO: 1982562 - RNA, 13 nt, Shigella flexneri 2a str. 301
ugcaucuguuuuc

SEQ ID NO: 1982563 - RNA, 13 nt, Shigella flexneri 2a str. 301
ugcaucugaaacu

SEQ ID NO: 1982564 - RNA, 20 nt, Shigella flexneri 2a str. 301
ugcauuccaguccacaucaa

SEQ ID NO: 1982565 - RNA, 22 nt, Shigella flexneri 2a str. 301
ugcauuccaguccacaucaacc

SEQ ID NO: 1982566 - RNA, 16 nt, Shigella flexneri 2a str. 301
ugagcguaaagaaccu

SEQ ID NO: 1982567 - RNA, 21 nt, Shigella flexneri 2a str. 301
ugagcguaaagaaccucuuca

SEQ ID NO: 1982568 - RNA, 16 nt, Shigella flexneri 2a str. 301
ugagcgguacaccaaa

SEQ ID NO: 1982569 - RNA, 16 nt, Shigella flexneri 2a str. 301
ugagcggccuuuuccu

SEQ ID NO: 1982570 - RNA, 19 nt, Shigella flexneri 2a str. 301
ugagcggcgggcuuuaauc

SEQ ID NO: 1982571 - RNA, 19 nt, Shigella flexneri 2a str. 301
ugagcgggcgaaccaggcc

SEQ ID NO: 1982572 - RNA, 21 nt, Shigella flexneri 2a str. 301
ugagcggacugaacgcggccc

SEQ ID NO: 1982573 - RNA, 18 nt, Shigella flexneri 2a str. 301
ugagcaaggcauaggcuu

SEQ ID NO: 1982574 - RNA, 20 nt, Shigella flexneri 2a str. 301
ugagauagcaucuuccagcg

SEQ ID NO: 1982575 - RNA, 23 nt, Shigella flexneri 2a str. 301
ugagauaauucuguaauccucuu

SEQ ID NO: 1982576 - RNA, 20 nt, Shigella flexneri 2a str. 301
ugagcaaacaguucugcagc

SEQ ID NO: 1982577 - RNA, 21 nt, Shigella flexneri 2a str. 301
ugagauuuauuuaccgcuacu

SEQ ID NO: 1982578 - RNA, 15 nt, Shigella flexneri 2a str. 301
ugagauuucaccaau

SEQ ID NO: 1982579 - RNA, 15 nt, Shigella flexneri 2a str. 301
ugagcugcaucuguu

SEQ ID NO: 1982580 - RNA, 20 nt, Shigella flexneri 2a str. 301
ugagcguuacccgcagccau

SEQ ID NO: 1982581 - RNA, 18 nt, Shigella flexneri 2a str. 301
ugagcuaaugcaaaucac

SEQ ID NO: 1982582 - RNA, 17 nt, Shigella flexneri 2a str. 301
ugaggaucacaaaacga

SEQ ID NO: 1982583 - RNA, 14 nt, Shigella flexneri 2a str. 301
ugaggaucaccagu

SEQ ID NO: 1982584 - RNA, 16 nt, Shigella flexneri 2a str. 301
ugaggaguuuaauaaa

SEQ ID NO: 1982585 - RNA, 21 nt, Shigella flexneri 2a str. 301
ugaggaguuuaauaaauuuag

SEQ ID NO: 1982586 - RNA, 16 nt, Shigella flexneri 2a str. 301
ugagggcgcaauuucc

SEQ ID NO: 1982587 - RNA, 23 nt, Shigella flexneri 2a str. 301
ugaggcggucuggauuuggcugc

SEQ ID NO: 1982588 - RNA, 17 nt, Shigella flexneri 2a str. 301
ugagggaggauuucucc

SEQ ID NO: 1982589 - RNA, 20 nt, Shigella flexneri 2a str. 301
ugagguggccgagaggcuga

SEQ ID NO: 1982590 - RNA, 16 nt, Shigella flexneri 2a str. 301
ugagucuucccuuguu

SEQ ID NO: 1982591 - RNA, 13 nt, Shigella flexneri 2a str. 301
ugagugaaauuuu

SEQ ID NO: 1982592 - RNA, 16 nt, Shigella flexneri 2a str. 301
ugagugccaaaaaaau

SEQ ID NO: 1982593 - RNA, 19 nt, Shigella flexneri 2a str. 301
ugagugccggggcgcggcg

SEQ ID NO: 1982594 - RNA, 13 nt, Shigella flexneri 2a str. 301
ugauaaacaagcg

SEQ ID NO: 1982595 - RNA, 17 nt, Shigella flexneri 2a str. 301
ugauaaacaaacagcgc

SEQ ID NO: 1982596 - RNA, 16 nt, Shigella flexneri 2a str. 301
ugauaaaccuccagca

SEQ ID NO: 1982597 - RNA, 14 nt, Shigella flexneri 2a str. 301
ugauaacuucuacc

SEQ ID NO: 1982598 - RNA, 14 nt, Shigella flexneri 2a str. 301
ugaguuaagaagau

SEQ ID NO: 1982599 - RNA, 15 nt, Shigella flexneri 2a str. 301
ugaguucacugccgu

SEQ ID NO: 1982600 - RNA, 14 nt, Shigella flexneri 2a str. 301
ugaguucacugccg

SEQ ID NO: 1982601 - RNA, 14 nt, Shigella flexneri 2a str. 301
ugaguuccacuggu

SEQ ID NO: 1982602 - RNA, 19 nt, Shigella flexneri 2a str. 301
ugauacgcgcaccggaaca

SEQ ID NO: 1982603 - RNA, 20 nt, Shigella flexneri 2a str. 301
ugauacgcgccaaucggcaa

SEQ ID NO: 1982604 - RNA, 22 nt, Shigella flexneri 2a str. 301
ugauagauuuauuuauuauuaa

SEQ ID NO: 1982605 - RNA, 22 nt, Shigella flexneri 2a str. 301
ugauagcaauaccaucaccaac

SEQ ID NO: 1982606 - RNA, 19 nt, Shigella flexneri 2a str. 301
ugauaccgggcuguucacu

SEQ ID NO: 1982607 - RNA, 23 nt, Shigella flexneri 2a str. 301
ugauaauaggaaucauuguuaua

SEQ ID NO: 1982608 - RNA, 12 nt, Shigella flexneri 2a str. 301
ugauaaggaaau

SEQ ID NO: 1982609 - RNA, 17 nt, Shigella flexneri 2a str. 301
ugauaaggaaauucagc

SEQ ID NO: 1982610 - RNA, 14 nt, Shigella flexneri 2a str. 301
ugauaggcuuccac

SEQ ID NO: 1982611 - RNA, 14 nt, Shigella flexneri 2a str. 301
ugauaguuaaaauu

SEQ ID NO: 1982612 - RNA, 19 nt, Shigella flexneri 2a str. 301
ugauaucaaaacgcucuga

SEQ ID NO: 1982613 - RNA, 16 nt, Shigella flexneri 2a str. 301
ugauaucauuaaaguu

SEQ ID NO: 1982614 - RNA, 13 nt, Shigella flexneri 2a str. 301
ugauaucccugcu

SEQ ID NO: 1982615 - RNA, 17 nt, Shigella flexneri 2a str. 301
ugauaucggccaucugu

SEQ ID NO: 1982616 - RNA, 22 nt, Shigella flexneri 2a str. 301
ugaucuucauagauagccagca

SEQ ID NO: 1982617 - RNA, 13 nt, Shigella flexneri 2a str. 301
ugaucgccauauu

SEQ ID NO: 1982618 - RNA, 19 nt, Shigella flexneri 2a str. 301
ugaucgccgcacuuucucc

SEQ ID NO: 1982619 - RNA, 22 nt, Shigella flexneri 2a str. 301
ugaucgagaucggccagcaccu

SEQ ID NO: 1982620 - RNA, 15 nt, Shigella flexneri 2a str. 301
ugaucggcgcgaaag

SEQ ID NO: 1982621 - RNA, 17 nt, Shigella flexneri 2a str. 301
ugauccugcaacagcac

SEQ ID NO: 1982622 - RNA, 14 nt, Shigella flexneri 2a str. 301
ugaucgaaaaugcg

SEQ ID NO: 1982623 - RNA, 17 nt, Shigella flexneri 2a str. 301
ugaucauaaaaauuaaa

SEQ ID NO: 1982624 - RNA, 14 nt, Shigella flexneri 2a str. 301
ugauaucucaccag

SEQ ID NO: 1982625 - RNA, 14 nt, Shigella flexneri 2a str. 301
ugacguuaagaaaa

SEQ ID NO: 1982626 - RNA, 18 nt, Shigella flexneri 2a str. 301
ugacguuuacuucgcuuu

SEQ ID NO: 1982627 - RNA, 14 nt, Shigella flexneri 2a str. 301
ugacguuccuuucu

SEQ ID NO: 1982628 - RNA, 13 nt, Shigella flexneri 2a str. 301
ugacuaaaacccu

SEQ ID NO: 1982629 - RNA, 23 nt, Shigella flexneri 2a str. 301
ugacuauuuccgauauucaggcg

SEQ ID NO: 1982630 - RNA, 20 nt, Shigella flexneri 2a str. 301
ugacucaauggcauccgcca

SEQ ID NO: 1982631 - RNA, 20 nt, Shigella flexneri 2a str. 301
ugacucaaugaaauccauug

SEQ ID NO: 1982632 - RNA, 13 nt, Shigella flexneri 2a str. 301
ugacuacaccauu

SEQ ID NO: 1982633 - RNA, 22 nt, Shigella flexneri 2a str. 301
ugacguagcagcuccgccagcu

SEQ ID NO: 1982634 - RNA, 18 nt, Shigella flexneri 2a str. 301
ugacguaucaccgagaca

SEQ ID NO: 1982635 - RNA, 18 nt, Shigella flexneri 2a str. 301
ugacgucgaaacugacau

SEQ ID NO: 1982636 - RNA, 17 nt, Shigella flexneri 2a str. 301
ugacguccuguacuguu

SEQ ID NO: 1982637 - RNA, 18 nt, Shigella flexneri 2a str. 301
ugacugaugcuuuccgcc

SEQ ID NO: 1982638 - RNA, 21 nt, Shigella flexneri 2a str. 301
ugacugaaucaggaaccacaa

SEQ ID NO: 1982639 - RNA, 22 nt, Shigella flexneri 2a str. 301
ugacuuccacuuccugcggagc

SEQ ID NO: 1982640 - RNA, 15 nt, Shigella flexneri 2a str. 301
ugacuuauaagucuc

SEQ ID NO: 1982641 - RNA, 20 nt, Shigella flexneri 2a str. 301
ugacucagcggcugccagca

SEQ ID NO: 1982642 - RNA, 12 nt, Shigella flexneri 2a str. 301
ugacuccccgau

SEQ ID NO: 1982643 - RNA, 22 nt, Shigella flexneri 2a str. 301
ugacuccccgauuguugaugag

SEQ ID NO: 1982644 - RNA, 12 nt, Shigella flexneri 2a str. 301
ugacucuuguaa

SEQ ID NO: 1982645 - RNA, 15 nt, Shigella flexneri 2a str. 301
ugacucuuuauuuca

SEQ ID NO: 1982646 - RNA, 23 nt, Shigella flexneri 2a str. 301
ugacugaagaaaucccccagcau

SEQ ID NO: 1982647 - RNA, 14 nt, Shigella flexneri 2a str. 301
ugacugaagaaauc

SEQ ID NO: 1982648 - RNA, 19 nt, Shigella flexneri 2a str. 301
ugagaaccuuuaucacugu

SEQ ID NO: 1982649 - RNA, 17 nt, Shigella flexneri 2a str. 301
ugagaacgacagugacu

SEQ ID NO: 1982650 - RNA, 14 nt, Shigella flexneri 2a str. 301
ugagaacaccaccu

SEQ ID NO: 1982651 - RNA, 13 nt, Shigella flexneri 2a str. 301
ugagaacaccacc

SEQ ID NO: 1982652 - RNA, 21 nt, Shigella flexneri 2a str. 301
ugagaaauuaacgucaccauc

SEQ ID NO: 1982653 - RNA, 19 nt, Shigella flexneri 2a str. 301
ugagagcaugaaaugaaaa

SEQ ID NO: 1982654 - RNA, 15 nt, Shigella flexneri 2a str. 301
ugagagcaugaaaug

SEQ ID NO: 1982655 - RNA, 17 nt, Shigella flexneri 2a str. 301
ugagagggcgauaaauc

SEQ ID NO: 1982656 - RNA, 13 nt, Shigella flexneri 2a str. 301
ugacgaugacugg

SEQ ID NO: 1982657 - RNA, 17 nt, Shigella flexneri 2a str. 301
ugacgauagcgccgcca

SEQ ID NO: 1982658 - RNA, 14 nt, Shigella flexneri 2a str. 301
ugacgaucaccaca

SEQ ID NO: 1982659 - RNA, 20 nt, Shigella flexneri 2a str. 301
ugacgaucauauuguucccc

SEQ ID NO: 1982660 - RNA, 21 nt, Shigella flexneri 2a str. 301
ugacgccaaaauaacuuaaug

SEQ ID NO: 1982661 - RNA, 23 nt, Shigella flexneri 2a str. 301
ugacgcauccgaucgcgcaucag

SEQ ID NO: 1982662 - RNA, 20 nt, Shigella flexneri 2a str. 301
ugacgcagauccugauuuaa

SEQ ID NO: 1982663 - RNA, 15 nt, Shigella flexneri 2a str. 301
ugacgcccccaaacu

SEQ ID NO: 1982664 - RNA, 16 nt, Shigella flexneri 2a str. 301
ugacgcgggcagcaga

SEQ ID NO: 1982665 - RNA, 21 nt, Shigella flexneri 2a str. 301
ugacgcucucuacgcccugua

SEQ ID NO: 1982666 - RNA, 19 nt, Shigella flexneri 2a str. 301
ugaccgguugcuggaucaa

SEQ ID NO: 1982667 - RNA, 15 nt, Shigella flexneri 2a str. 301
ugaccguuacugaua

SEQ ID NO: 1982668 - RNA, 22 nt, Shigella flexneri 2a str. 301
ugaccgauaugaauaauuucgg

SEQ ID NO: 1982669 - RNA, 20 nt, Shigella flexneri 2a str. 301
ugaccgggcgcggcuguugc

SEQ ID NO: 1982670 - RNA, 19 nt, Shigella flexneri 2a str. 301
ugaccgaaugcagucgcgu

SEQ ID NO: 1982671 - RNA, 15 nt, Shigella flexneri 2a str. 301
ugacgaccacccagc

SEQ ID NO: 1982672 - RNA, 14 nt, Shigella flexneri 2a str. 301
ugaccagacuggag

SEQ ID NO: 1982673 - RNA, 12 nt, Shigella flexneri 2a str. 301
ugacccagaccg

SEQ ID NO: 1982674 - RNA, 12 nt, Shigella flexneri 2a str. 301
ugacccagcaag

SEQ ID NO: 1982675 - RNA, 12 nt, Shigella flexneri 2a str. 301
ugaccaccagca

SEQ ID NO: 1982676 - RNA, 14 nt, Shigella flexneri 2a str. 301
ugaccaccagcacg

SEQ ID NO: 1982677 - RNA, 23 nt, Shigella flexneri 2a str. 301
ugaccaccgucccaguaauuacc

SEQ ID NO: 1982678 - RNA, 22 nt, Shigella flexneri 2a str. 301
ugacccgcaccguccucacugu

SEQ ID NO: 1982679 - RNA, 18 nt, Shigella flexneri 2a str. 301
ugacccgcagccagcacu

SEQ ID NO: 1982680 - RNA, 19 nt, Shigella flexneri 2a str. 301
ugacccgcagccagcacug

SEQ ID NO: 1982681 - RNA, 21 nt, Shigella flexneri 2a str. 301
ugacccggugguugcuuaucc

SEQ ID NO: 1982682 - RNA, 19 nt, Shigella flexneri 2a str. 301
ugacaucgugcugguagaa

SEQ ID NO: 1982683 - RNA, 19 nt, Shigella flexneri 2a str. 301
ugaauaaauuggcuggggu

SEQ ID NO: 1982684 - RNA, 19 nt, Shigella flexneri 2a str. 301
ugaauaaauacauugcagu

SEQ ID NO: 1982685 - RNA, 16 nt, Shigella flexneri 2a str. 301
ugaauaacaccagcca

SEQ ID NO: 1982686 - RNA, 13 nt, Shigella flexneri 2a str. 301
ugaccaaaaacau

SEQ ID NO: 1982687 - RNA, 18 nt, Shigella flexneri 2a str. 301
ugacauuaucagacaccg

SEQ ID NO: 1982688 - RNA, 13 nt, Shigella flexneri 2a str. 301
ugacauuaucugg

SEQ ID NO: 1982689 - RNA, 21 nt, Shigella flexneri 2a str. 301
ugacauuaaccaaccaccaaa

SEQ ID NO: 1982690 - RNA, 20 nt, Shigella flexneri 2a str. 301
ugacauucugacuggucagu

SEQ ID NO: 1982691 - RNA, 13 nt, Shigella flexneri 2a str. 301
ucugacugucaga

SEQ ID NO: 1982692 - RNA, 19 nt, Shigella flexneri 2a str. 301
ucugagagcaugaaaugaa

SEQ ID NO: 1982693 - RNA, 20 nt, Shigella flexneri 2a str. 301
ucugagcaucacauaaucga

SEQ ID NO: 1982694 - RNA, 20 nt, Shigella flexneri 2a str. 301
ucugagcaugaugccugaug

SEQ ID NO: 1982695 - RNA, 14 nt, Shigella flexneri 2a str. 301
ucugauaguuaaaa

SEQ ID NO: 1982696 - RNA, 12 nt, Shigella flexneri 2a str. 301
ucugauccugca

SEQ ID NO: 1982697 - RNA, 17 nt, Shigella flexneri 2a str. 301
ucugaugauauuuuucc

SEQ ID NO: 1982698 - RNA, 23 nt, Shigella flexneri 2a str. 301
ucugaauaucaucccccugcgau

SEQ ID NO: 1982699 - RNA, 18 nt, Shigella flexneri 2a str. 301
ucugaauggcugcauucc

SEQ ID NO: 1982700 - RNA, 22 nt, Shigella flexneri 2a str. 301
ucugacaacguagcguuaaaac

SEQ ID NO: 1982701 - RNA, 16 nt, Shigella flexneri 2a str. 301
ucugacuauauaaauu

SEQ ID NO: 1982702 - RNA, 21 nt, Shigella flexneri 2a str. 301
ucugacuauauaaauuacccu

SEQ ID NO: 1982703 - RNA, 22 nt, Shigella flexneri 2a str. 301
ucugacuauauaaauuacccuu

SEQ ID NO: 1982704 - RNA, 15 nt, Shigella flexneri 2a str. 301
aaaugcugguuuugu

SEQ ID NO: 1982705 - RNA, 19 nt, Shigella flexneri 2a str. 301
aaaugcugcaauugcggca

SEQ ID NO: 1982706 - RNA, 17 nt, Shigella flexneri 2a str. 301
ucugaauaacacccaua

SEQ ID NO: 1982707 - RNA, 11 nt, Shigella flexneri 2a str. 301
ucugaauaaac

SEQ ID NO: 1982708 - RNA, 19 nt, Shigella flexneri 2a str. 301
ucugaaguagccaguacca

SEQ ID NO: 1982709 - RNA, 12 nt, Shigella flexneri 2a str. 301
ucugaacugaac

SEQ ID NO: 1982710 - RNA, 17 nt, Shigella flexneri 2a str. 301
ucugaaaucaucaauac

SEQ ID NO: 1982711 - RNA, 20 nt, Shigella flexneri 2a str. 301
ucugaaaacuaaccuuacaa

SEQ ID NO: 1982712 - RNA, 14 nt, Shigella flexneri 2a str. 301
ucucuucagccaac

SEQ ID NO: 1982713 - RNA, 21 nt, Shigella flexneri 2a str. 301
ucucuucacgcuuugcaggcu

SEQ ID NO: 1982714 - RNA, 14 nt, Shigella flexneri 2a str. 301
ucucuuccagugcc

SEQ ID NO: 1982715 - RNA, 19 nt, Shigella flexneri 2a str. 301
ucucuucggcuucugccuu

SEQ ID NO: 1982716 - RNA, 18 nt, Shigella flexneri 2a str. 301
ucucuguuuugcaugggg

SEQ ID NO: 1982717 - RNA, 21 nt, Shigella flexneri 2a str. 301
ucucuguuuccagauuuugcu

SEQ ID NO: 1982718 - RNA, 23 nt, Shigella flexneri 2a str. 301
ucgcaucaggcaucaugcucaga

SEQ ID NO: 1982719 - RNA, 16 nt, Shigella flexneri 2a str. 301
ucgcaucaggcaugau

SEQ ID NO: 1982720 - RNA, 19 nt, Shigella flexneri 2a str. 301
ucgcaucaggcauugugca

SEQ ID NO: 1982721 - RNA, 19 nt, Shigella flexneri 2a str. 301
ucgcaucaggcauugugcu

SEQ ID NO: 1982722 - RNA, 15 nt, Shigella flexneri 2a str. 301
ucgcaucaggcauuu

SEQ ID NO: 1982723 - RNA, 23 nt, Shigella flexneri 2a str. 301
ucgcaucccgguaucaaagcgcc

SEQ ID NO: 1982724 - RNA, 22 nt, Shigella flexneri 2a str. 301
ucgcaucgaugguugcccugcu

SEQ ID NO: 1982725 - RNA, 17 nt, Shigella flexneri 2a str. 301
ucgcaucggauugcucc

SEQ ID NO: 1982726 - RNA, 17 nt, Shigella flexneri 2a str. 301
ucgcauggcggaucacg

SEQ ID NO: 1982727 - RNA, 15 nt, Shigella flexneri 2a str. 301
ucgcaucuggcacua

SEQ ID NO: 1982728 - RNA, 17 nt, Shigella flexneri 2a str. 301
ucgcauuaacagccaga

SEQ ID NO: 1982729 - RNA, 15 nt, Shigella flexneri 2a str. 301
ucucggcuuugguau

SEQ ID NO: 1982730 - RNA, 13 nt, Shigella flexneri 2a str. 301
ucucgggaaggcc

SEQ ID NO: 1982731 - RNA, 22 nt, Shigella flexneri 2a str. 301
ucucgggcaguaaaucaauauc

SEQ ID NO: 1982732 - RNA, 16 nt, Shigella flexneri 2a str. 301
ucucgguuugcggcag

SEQ ID NO: 1982733 - RNA, 21 nt, Shigella flexneri 2a str. 301
ucucggucggcauuuuucggc

SEQ ID NO: 1982734 - RNA, 22 nt, Shigella flexneri 2a str. 301
ucucgucgaacucauacaccag

SEQ ID NO: 1982735 - RNA, 18 nt, Shigella flexneri 2a str. 301
ucucguccaguuugccuu

SEQ ID NO: 1982736 - RNA, 21 nt, Shigella flexneri 2a str. 301
ucugcgugaguuuuugucccc

SEQ ID NO: 1982737 - RNA, 19 nt, Shigella flexneri 2a str. 301
ucugcguaucgcccugcca

SEQ ID NO: 1982738 - RNA, 15 nt, Shigella flexneri 2a str. 301
ucugcguaauguuua

SEQ ID NO: 1982739 - RNA, 15 nt, Shigella flexneri 2a str. 301
ucugcguacccggau

SEQ ID NO: 1982740 - RNA, 23 nt, Shigella flexneri 2a str. 301
ucugcgcuauccagcgcauagcu

SEQ ID NO: 1982741 - RNA, 12 nt, Shigella flexneri 2a str. 301
ucugcgcuuugu

SEQ ID NO: 1982742 - RNA, 14 nt, Shigella flexneri 2a str. 301
ucugcggcaucaua

SEQ ID NO: 1982743 - RNA, 16 nt, Shigella flexneri 2a str. 301
ucugcggaucuuuuuc

SEQ ID NO: 1982744 - RNA, 15 nt, Shigella flexneri 2a str. 301
ucugcugauuaaccc

SEQ ID NO: 1982745 - RNA, 12 nt, Shigella flexneri 2a str. 301
ucugcuggcaaa

SEQ ID NO: 1982746 - RNA, 16 nt, Shigella flexneri 2a str. 301
ucuggcgcaggugaua

SEQ ID NO: 1982747 - RNA, 18 nt, Shigella flexneri 2a str. 301
ucuggcgaaccgcuuugc

SEQ ID NO: 1982748 - RNA, 10 nt, Shigella flexneri 2a str. 301
ucuggaauuc

SEQ ID NO: 1982749 - RNA, 20 nt, Shigella flexneri 2a str. 301
ucuggaacuggcugccagcg

SEQ ID NO: 1982750 - RNA, 21 nt, Shigella flexneri 2a str. 301
ucuggauagagcucauuucau

SEQ ID NO: 1982751 - RNA, 20 nt, Shigella flexneri 2a str. 301
ucuggcauaaacaaagcgca

SEQ ID NO: 1982752 - RNA, 15 nt, Shigella flexneri 2a str. 301
ucuggcauaacgcca

SEQ ID NO: 1982753 - RNA, 16 nt, Shigella flexneri 2a str. 301
ucuggcaucacuucuu

SEQ ID NO: 1982754 - RNA, 21 nt, Shigella flexneri 2a str. 301
ucugccuguccaccacgcugc

SEQ ID NO: 1982755 - RNA, 17 nt, Shigella flexneri 2a str. 301
ucugccgggaagcucuc

SEQ ID NO: 1982756 - RNA, 13 nt, Shigella flexneri 2a str. 301
ucugccgcaauuc

SEQ ID NO: 1982757 - RNA, 22 nt, Shigella flexneri 2a str. 301
ucugccggagggauguggccca

SEQ ID NO: 1982758 - RNA, 21 nt, Shigella flexneri 2a str. 301
ucugcgagcuuucgaccagcc

SEQ ID NO: 1982759 - RNA, 21 nt, Shigella flexneri 2a str. 301
ucugcgaauugagaugacgcc

SEQ ID NO: 1982760 - RNA, 20 nt, Shigella flexneri 2a str. 301
ucugcgcauuucccagcaag

SEQ ID NO: 1982761 - RNA, 21 nt, Shigella flexneri 2a str. 301
ucugcgcauaacugccggaug

SEQ ID NO: 1982762 - RNA, 17 nt, Shigella flexneri 2a str. 301
ucugauguuguuuuuaa

SEQ ID NO: 1982763 - RNA, 15 nt, Shigella flexneri 2a str. 301
ucugaugcauaaaaa

SEQ ID NO: 1982764 - RNA, 17 nt, Shigella flexneri 2a str. 301
ucugauugauucagggu

SEQ ID NO: 1982765 - RNA, 23 nt, Shigella flexneri 2a str. 301
ucugauuuaaccaacaauaaaau

SEQ ID NO: 1982766 - RNA, 14 nt, Shigella flexneri 2a str. 301
ucugcaaaaaugcc

SEQ ID NO: 1982767 - RNA, 22 nt, Shigella flexneri 2a str. 301
ucugcaaaauaccaauaaucaa

SEQ ID NO: 1982768 - RNA, 22 nt, Shigella flexneri 2a str. 301
ucugauuuuccuccagcagcac

SEQ ID NO: 1982769 - RNA, 23 nt, Shigella flexneri 2a str. 301
ucugccauccguaauuuuuacuc

SEQ ID NO: 1982770 - RNA, 22 nt, Shigella flexneri 2a str. 301
ucugccgcauggaaccaguuca

SEQ ID NO: 1982771 - RNA, 24 nt, Shigella flexneri 2a str. 301
ucugccgcauggaaccaguucacu

SEQ ID NO: 1982772 - RNA, 19 nt, Shigella flexneri 2a str. 301
ucuuaaaggggugaaaaaa

SEQ ID NO: 1982773 - RNA, 15 nt, Shigella flexneri 2a str. 301
ucuuaacgucgcaag

SEQ ID NO: 1982774 - RNA, 20 nt, Shigella flexneri 2a str. 301
ucuuaagguucacuuaaucu

SEQ ID NO: 1982775 - RNA, 22 nt, Shigella flexneri 2a str. 301
ucuguuugccucguucuucccu

SEQ ID NO: 1982776 - RNA, 13 nt, Shigella flexneri 2a str. 301
ucuuacuucaaca

SEQ ID NO: 1982777 - RNA, 20 nt, Shigella flexneri 2a str. 301
ucuuauuaaauugucuuaaa

SEQ ID NO: 1982778 - RNA, 20 nt, Shigella flexneri 2a str. 301
ucuuccccugcgauaacggu

SEQ ID NO: 1982779 - RNA, 20 nt, Shigella flexneri 2a str. 301
ucuucccgagacauuccuuu

SEQ ID NO: 1982780 - RNA, 22 nt, Shigella flexneri 2a str. 301
ucuucccgagacauuccuuuac

SEQ ID NO: 1982781 - RNA, 23 nt, Shigella flexneri 2a str. 301
ucuucccgagacauuccuuuacu

SEQ ID NO: 1982782 - RNA, 24 nt, Shigella flexneri 2a str. 301
ucuucccgagacauuccuuuacuu

SEQ ID NO: 1982783 - RNA, 18 nt, Shigella flexneri 2a str. 301
ucuucauugugguucuca

SEQ ID NO: 1982784 - RNA, 22 nt, Shigella flexneri 2a str. 301
ucuucauuaugaauagcggaaa

SEQ ID NO: 1982785 - RNA, 13 nt, Shigella flexneri 2a str. 301
ucuucccgcagcc

SEQ ID NO: 1982786 - RNA, 17 nt, Shigella flexneri 2a str. 301
ucuuccgcgccaaacau

SEQ ID NO: 1982787 - RNA, 13 nt, Shigella flexneri 2a str. 301
ucuucauuaccuu

SEQ ID NO: 1982788 - RNA, 21 nt, Shigella flexneri 2a str. 301
ucuucauuaaauuuccgcgaa

SEQ ID NO: 1982789 - RNA, 18 nt, Shigella flexneri 2a str. 301
ucuucaucgauacugcuc

SEQ ID NO: 1982790 - RNA, 13 nt, Shigella flexneri 2a str. 301
ucuucaucaccga

SEQ ID NO: 1982791 - RNA, 16 nt, Shigella flexneri 2a str. 301
ucuucaaacugaagau

SEQ ID NO: 1982792 - RNA, 12 nt, Shigella flexneri 2a str. 301
ucuucaaagcca

SEQ ID NO: 1982793 - RNA, 13 nt, Shigella flexneri 2a str. 301
ucuucaacacacu

SEQ ID NO: 1982794 - RNA, 14 nt, Shigella flexneri 2a str. 301
ucuucagcaucaau

SEQ ID NO: 1982795 - RNA, 14 nt, Shigella flexneri 2a str. 301
ucuucagcaguuca

SEQ ID NO: 1982796 - RNA, 16 nt, Shigella flexneri 2a str. 301
ucuucagccccuccac

SEQ ID NO: 1982797 - RNA, 22 nt, Shigella flexneri 2a str. 301
ucuucauaacuuugaucgcguu

SEQ ID NO: 1982798 - RNA, 21 nt, Shigella flexneri 2a str. 301
ucuucauacgcggcagaaugg

SEQ ID NO: 1982799 - RNA, 19 nt, Shigella flexneri 2a str. 301
ucuucugucgggcaucacu

SEQ ID NO: 1982800 - RNA, 15 nt, Shigella flexneri 2a str. 301
ucuucugguuucagu

SEQ ID NO: 1982801 - RNA, 20 nt, Shigella flexneri 2a str. 301
ucuucuucacuucuucaaua

SEQ ID NO: 1982802 - RNA, 14 nt, Shigella flexneri 2a str. 301
ucuucuuccgcuuc

SEQ ID NO: 1982803 - RNA, 15 nt, Shigella flexneri 2a str. 301
ucuucuugaccguuu

SEQ ID NO: 1982804 - RNA, 19 nt, Shigella flexneri 2a str. 301
ucuucgaagaucucgguaa

SEQ ID NO: 1982805 - RNA, 23 nt, Shigella flexneri 2a str. 301
ucuucgauuuaaccgcuuucacc

SEQ ID NO: 1982806 - RNA, 14 nt, Shigella flexneri 2a str. 301
ucuugagcuccaca

SEQ ID NO: 1982807 - RNA, 16 nt, Shigella flexneri 2a str. 301
ucuugaguuggcaugc

SEQ ID NO: 1982808 - RNA, 16 nt, Shigella flexneri 2a str. 301
ucuugaacgcaaaugu

SEQ ID NO: 1982809 - RNA, 14 nt, Shigella flexneri 2a str. 301
ucuucuuucaucau

SEQ ID NO: 1982810 - RNA, 21 nt, Shigella flexneri 2a str. 301
ucuugauuugcuuguuucauu

SEQ ID NO: 1982811 - RNA, 16 nt, Shigella flexneri 2a str. 301
ucuugcagcuuaauca

SEQ ID NO: 1982812 - RNA, 13 nt, Shigella flexneri 2a str. 301
ucuugcaaaauca

SEQ ID NO: 1982813 - RNA, 18 nt, Shigella flexneri 2a str. 301
ucuugcaaaaucaauaaa

SEQ ID NO: 1982814 - RNA, 22 nt, Shigella flexneri 2a str. 301
ucuugcgcggauggccucugcc

SEQ ID NO: 1982815 - RNA, 22 nt, Shigella flexneri 2a str. 301
ucuugcgaacaggucgagaaca

SEQ ID NO: 1982816 - RNA, 22 nt, Shigella flexneri 2a str. 301
ucuugcaggaagggauugugca

SEQ ID NO: 1982817 - RNA, 13 nt, Shigella flexneri 2a str. 301
ucuuuacuaaacg

SEQ ID NO: 1982818 - RNA, 15 nt, Shigella flexneri 2a str. 301
ucuuuacgcaaaauc

SEQ ID NO: 1982819 - RNA, 16 nt, Shigella flexneri 2a str. 301
ucuuuacgcaaaauca

SEQ ID NO: 1982820 - RNA, 13 nt, Shigella flexneri 2a str. 301
ucuuuacacacaa

SEQ ID NO: 1982821 - RNA, 21 nt, Shigella flexneri 2a str. 301
ucuuuacuaaacggucccuca

SEQ ID NO: 1982822 - RNA, 16 nt, Shigella flexneri 2a str. 301
ucuuuacugauaauuu

SEQ ID NO: 1982823 - RNA, 14 nt, Shigella flexneri 2a str. 301
ucuuucaauuugua

SEQ ID NO: 1982824 - RNA, 17 nt, Shigella flexneri 2a str. 301
ucuuucaccucuucauu

SEQ ID NO: 1982825 - RNA, 14 nt, Shigella flexneri 2a str. 301
ucuuucaaugcuuu

SEQ ID NO: 1982826 - RNA, 19 nt, Shigella flexneri 2a str. 301
ucuuuauggguuucuaauu

SEQ ID NO: 1982827 - RNA, 22 nt, Shigella flexneri 2a str. 301
ucuuuaucggucuuagcaaagg

SEQ ID NO: 1982828 - RNA, 14 nt, Shigella flexneri 2a str. 301
ucuuguugaacagg

SEQ ID NO: 1982829 - RNA, 15 nt, Shigella flexneri 2a str. 301
ucuuuaaaaaguaaa

SEQ ID NO: 1982830 - RNA, 15 nt, Shigella flexneri 2a str. 301
ucuuguaggccugau

SEQ ID NO: 1982831 - RNA, 12 nt, Shigella flexneri 2a str. 301
ucuuguaggcca

SEQ ID NO: 1982832 - RNA, 15 nt, Shigella flexneri 2a str. 301
ucuuggguauaaaac

SEQ ID NO: 1982833 - RNA, 22 nt, Shigella flexneri 2a str. 301
ucuugcuucugacuauauaaau

SEQ ID NO: 1982834 - RNA, 13 nt, Shigella flexneri 2a str. 301
ucuugcuggaugc

SEQ ID NO: 1982835 - RNA, 19 nt, Shigella flexneri 2a str. 301
ucuuucuuugcaugacgau

SEQ ID NO: 1982836 - RNA, 22 nt, Shigella flexneri 2a str. 301
ucuuugcgcccccgauccagcg

SEQ ID NO: 1982837 - RNA, 22 nt, Shigella flexneri 2a str. 301
ucuuugcggcuauucuugaagu

SEQ ID NO: 1982838 - RNA, 22 nt, Shigella flexneri 2a str. 301
ucuuugcccgcagauccagugc

SEQ ID NO: 1982839 - RNA, 15 nt, Shigella flexneri 2a str. 301
ucuuuggcaucaauc

SEQ ID NO: 1982840 - RNA, 14 nt, Shigella flexneri 2a str. 301
ucuuucucaaucug

SEQ ID NO: 1982841 - RNA, 18 nt, Shigella flexneri 2a str. 301
ucuuucgcggcaaccuga

SEQ ID NO: 1982842 - RNA, 21 nt, Shigella flexneri 2a str. 301
ucuuucgaauguggcagcaac

SEQ ID NO: 1982843 - RNA, 20 nt, Shigella flexneri 2a str. 301
ucuuucgacggcaucagaaa

SEQ ID NO: 1982844 - RNA, 17 nt, Shigella flexneri 2a str. 301
ucuuucagcaccgcgaa

SEQ ID NO: 1982845 - RNA, 17 nt, Shigella flexneri 2a str. 301
ucuuucagcaccagccc

SEQ ID NO: 1982846 - RNA, 17 nt, Shigella flexneri 2a str. 301
ucuuucacgcccagucc

SEQ ID NO: 1982847 - RNA, 13 nt, Shigella flexneri 2a str. 301
ucuuucaucuccc

SEQ ID NO: 1982848 - RNA, 15 nt, Shigella flexneri 2a str. 301
ucuuucauauucaau

SEQ ID NO: 1982849 - RNA, 22 nt, Shigella flexneri 2a str. 301
ucuuuccagacucaacaggccc

SEQ ID NO: 1982850 - RNA, 23 nt, Shigella flexneri 2a str. 301
ucuuuccagcaaccaaugccacc

SEQ ID NO: 1982851 - RNA, 17 nt, Shigella flexneri 2a str. 301
ucuuuccguucaaaaca

SEQ ID NO: 1982852 - RNA, 20 nt, Shigella flexneri 2a str. 301
ucuuuuacagcgccagaagg

SEQ ID NO: 1982853 - RNA, 23 nt, Shigella flexneri 2a str. 301
ucuuuguaucgcugaaagauggc

SEQ ID NO: 1982854 - RNA, 12 nt, Shigella flexneri 2a str. 301
ucuuugucggug

SEQ ID NO: 1982855 - RNA, 21 nt, Shigella flexneri 2a str. 301
ucuuugugccacgcuggcccg

SEQ ID NO: 1982856 - RNA, 20 nt, Shigella flexneri 2a str. 301
ucuuuugcuugacaaaaaga

SEQ ID NO: 1982857 - RNA, 23 nt, Shigella flexneri 2a str. 301
ucuuuuucgaacauuucgagaau

SEQ ID NO: 1982858 - RNA, 19 nt, Shigella flexneri 2a str. 301
ucuuuuucauuaugaucaa

SEQ ID NO: 1982859 - RNA, 21 nt, Shigella flexneri 2a str. 301
ucuuuuucauuaugaucaaaa

SEQ ID NO: 1982860 - RNA, 15 nt, Shigella flexneri 2a str. 301
ugaaccgcacagguu

SEQ ID NO: 1982861 - RNA, 16 nt, Shigella flexneri 2a str. 301
ugaaccgcacagguug

SEQ ID NO: 1982862 - RNA, 16 nt, Shigella flexneri 2a str. 301
ugaaccgaaauggcug

SEQ ID NO: 1982863 - RNA, 21 nt, Shigella flexneri 2a str. 301
ugaaccgugucgccaucaaag

SEQ ID NO: 1982864 - RNA, 18 nt, Shigella flexneri 2a str. 301
ugaaaugaaaaucaccau

SEQ ID NO: 1982865 - RNA, 19 nt, Shigella flexneri 2a str. 301
ugaaaucgggcagcacaua

SEQ ID NO: 1982866 - RNA, 13 nt, Shigella flexneri 2a str. 301
ugaacagccugug

SEQ ID NO: 1982867 - RNA, 17 nt, Shigella flexneri 2a str. 301
ugaacagcuuuuuccug

SEQ ID NO: 1982868 - RNA, 16 nt, Shigella flexneri 2a str. 301
ugaacggcuucgccuc

SEQ ID NO: 1982869 - RNA, 20 nt, Shigella flexneri 2a str. 301
ugaacgugcaaaaucaaaca

SEQ ID NO: 1982870 - RNA, 19 nt, Shigella flexneri 2a str. 301
ugaacgugcaaaaucaaac

SEQ ID NO: 1982871 - RNA, 18 nt, Shigella flexneri 2a str. 301
ugaacgugcaaaaucaaa

SEQ ID NO: 1982872 - RNA, 14 nt, Shigella flexneri 2a str. 301
ugaacgugcaaaau

SEQ ID NO: 1982873 - RNA, 18 nt, Shigella flexneri 2a str. 301
ugaacguggcaacccgcg

SEQ ID NO: 1982874 - RNA, 14 nt, Shigella flexneri 2a str. 301
ugaacguggccaug

SEQ ID NO: 1982875 - RNA, 20 nt, Shigella flexneri 2a str. 301
ugaacgccuuauccggccua

SEQ ID NO: 1982876 - RNA, 20 nt, Shigella flexneri 2a str. 301
ugaacucuuaagguucacuu

SEQ ID NO: 1982877 - RNA, 17 nt, Shigella flexneri 2a str. 301
ugaacugaacaaaaaag

SEQ ID NO: 1982878 - RNA, 19 nt, Shigella flexneri 2a str. 301
ugaacuggcuuuuuucaau

SEQ ID NO: 1982879 - RNA, 20 nt, Shigella flexneri 2a str. 301
ugaacuggcuuuuuucaauu

SEQ ID NO: 1982880 - RNA, 22 nt, Shigella flexneri 2a str. 301
ugaacuggcuuuuuucaauuaa

SEQ ID NO: 1982881 - RNA, 12 nt, Shigella flexneri 2a str. 301
ugaacugauugc

SEQ ID NO: 1982882 - RNA, 21 nt, Shigella flexneri 2a str. 301
ugaacugauugccacccugcg

SEQ ID NO: 1982883 - RNA, 14 nt, Shigella flexneri 2a str. 301
ugaacugaauacga

SEQ ID NO: 1982884 - RNA, 19 nt, Shigella flexneri 2a str. 301
ugaacucgccgcacaggcg

SEQ ID NO: 1982885 - RNA, 20 nt, Shigella flexneri 2a str. 301
ugaacucgccgcacaggcgu

SEQ ID NO: 1982886 - RNA, 22 nt, Shigella flexneri 2a str. 301
ugaacucgacgcccuggaagaa

SEQ ID NO: 1982887 - RNA, 20 nt, Shigella flexneri 2a str. 301
ugaacucaacgccuucuucg

SEQ ID NO: 1982888 - RNA, 17 nt, Shigella flexneri 2a str. 301
ugaagucucaauuagua

SEQ ID NO: 1982889 - RNA, 21 nt, Shigella flexneri 2a str. 301
ugaagucagggucuuccagca

SEQ ID NO: 1982890 - RNA, 13 nt, Shigella flexneri 2a str. 301
ugaaguagccagu

SEQ ID NO: 1982891 - RNA, 19 nt, Shigella flexneri 2a str. 301
ugaagucuuuuuucaacuu

SEQ ID NO: 1982892 - RNA, 20 nt, Shigella flexneri 2a str. 301
ugaauaaaguuuuaguugcc

SEQ ID NO: 1982893 - RNA, 17 nt, Shigella flexneri 2a str. 301
ugaauaaaauucuccag

SEQ ID NO: 1982894 - RNA, 14 nt, Shigella flexneri 2a str. 301
ugaaggauaagacg

SEQ ID NO: 1982895 - RNA, 20 nt, Shigella flexneri 2a str. 301
ugaaggaugaaacugccgga

SEQ ID NO: 1982896 - RNA, 16 nt, Shigella flexneri 2a str. 301
ugaaggcaaacuucuc

SEQ ID NO: 1982897 - RNA, 22 nt, Shigella flexneri 2a str. 301
ugaagcaauccauaccagcaca

SEQ ID NO: 1982898 - RNA, 22 nt, Shigella flexneri 2a str. 301
ugaagccaaaucauccagaccg

SEQ ID NO: 1982899 - RNA, 19 nt, Shigella flexneri 2a str. 301
ugaagcccaguaccgccag

SEQ ID NO: 1982900 - RNA, 20 nt, Shigella flexneri 2a str. 301
ugaagccaaccgggccgcag

SEQ ID NO: 1982901 - RNA, 19 nt, Shigella flexneri 2a str. 301
ugaacugggcgcggcccac

SEQ ID NO: 1982902 - RNA, 16 nt, Shigella flexneri 2a str. 301
ugaacuggcuuuuuuc

SEQ ID NO: 1982903 - RNA, 16 nt, Shigella flexneri 2a str. 301
ugaacugggcgcggcc

SEQ ID NO: 1982904 - RNA, 22 nt, Shigella flexneri 2a str. 301
ugaacuucgcagccgugacugg

SEQ ID NO: 1982905 - RNA, 22 nt, Shigella flexneri 2a str. 301
ugaaaaagugccaaaaaucgca

SEQ ID NO: 1982906 - RNA, 20 nt, Shigella flexneri 2a str. 301
ugaaaaagcucccuaaaaua

SEQ ID NO: 1982907 - RNA, 14 nt, Shigella flexneri 2a str. 301
ugaaaaaaugauga

SEQ ID NO: 1982908 - RNA, 14 nt, Shigella flexneri 2a str. 301
ugaaaaaccaaucu

SEQ ID NO: 1982909 - RNA, 14 nt, Shigella flexneri 2a str. 301
ucuuuuuuccgcuu

SEQ ID NO: 1982910 - RNA, 23 nt, Shigella flexneri 2a str. 301
ugaaaaaaaggcgaaaggcuggc

SEQ ID NO: 1982911 - RNA, 15 nt, Shigella flexneri 2a str. 301
ugaaaaaaccugcac

SEQ ID NO: 1982912 - RNA, 23 nt, Shigella flexneri 2a str. 301
ugaaaaaacaaauauugauggga

SEQ ID NO: 1982913 - RNA, 18 nt, Shigella flexneri 2a str. 301
ugaaaaguccaggcugca

SEQ ID NO: 1982914 - RNA, 15 nt, Shigella flexneri 2a str. 301
ugaaaauaaccauau

SEQ ID NO: 1982915 - RNA, 21 nt, Shigella flexneri 2a str. 301
ugaaaacgccggagugaaaau

SEQ ID NO: 1982916 - RNA, 15 nt, Shigella flexneri 2a str. 301
ugaaaacccugcgca

SEQ ID NO: 1982917 - RNA, 12 nt, Shigella flexneri 2a str. 301
ugaaaaauaaaa

SEQ ID NO: 1982918 - RNA, 22 nt, Shigella flexneri 2a str. 301
ugaaaaaucaaaaaacuggaaa

SEQ ID NO: 1982919 - RNA, 14 nt, Shigella flexneri 2a str. 301
ugaaaaaucaaaaa

SEQ ID NO: 1982920 - RNA, 23 nt, Shigella flexneri 2a str. 301
ugaaaggcgcucauuuucucuuu

SEQ ID NO: 1982921 - RNA, 22 nt, Shigella flexneri 2a str. 301
ugaaaggcgcucauuuucucuu

SEQ ID NO: 1982922 - RNA, 18 nt, Shigella flexneri 2a str. 301
ugaaaggaaaaaauacag

SEQ ID NO: 1982923 - RNA, 19 nt, Shigella flexneri 2a str. 301
ugaaagccccaccagcaaa

SEQ ID NO: 1982924 - RNA, 17 nt, Shigella flexneri 2a str. 301
ugaaagccccaccagca

SEQ ID NO: 1982925 - RNA, 24 nt, Shigella flexneri 2a str. 301
ugaaagcguuuaugcgcauugcca

SEQ ID NO: 1982926 - RNA, 18 nt, Shigella flexneri 2a str. 301
ugaaacucgauacgacac

SEQ ID NO: 1982927 - RNA, 23 nt, Shigella flexneri 2a str. 301
ugaaauccggcaccugucagacu

SEQ ID NO: 1982928 - RNA, 15 nt, Shigella flexneri 2a str. 301
ugaaaucagcacaua

SEQ ID NO: 1982929 - RNA, 20 nt, Shigella flexneri 2a str. 301
ugaaauacccgcucauucgu

SEQ ID NO: 1982930 - RNA, 13 nt, Shigella flexneri 2a str. 301
ugaaacucagcca

SEQ ID NO: 1982931 - RNA, 19 nt, Shigella flexneri 2a str. 301
ugaaacucagcauggaaau

SEQ ID NO: 1982932 - RNA, 22 nt, Shigella flexneri 2a str. 301
ugaaacgucaaauaauuccugc

SEQ ID NO: 1982933 - RNA, 22 nt, Shigella flexneri 2a str. 301
ugaaacgcuuuacguuccuggc

SEQ ID NO: 1982934 - RNA, 14 nt, Shigella flexneri 2a str. 301
ugaaacaaaucacu

SEQ ID NO: 1982935 - RNA, 13 nt, Shigella flexneri 2a str. 301
ugaaaauguggua

SEQ ID NO: 1982936 - RNA, 14 nt, Shigella flexneri 2a str. 301
ugaaaaugcugguu

SEQ ID NO: 1982937 - RNA, 16 nt, Shigella flexneri 2a str. 301
ugcucguaaguuaacu

SEQ ID NO: 1982938 - RNA, 22 nt, Shigella flexneri 2a str. 301
ugcucgcagaaauaccccgcca

SEQ ID NO: 1982939 - RNA, 22 nt, Shigella flexneri 2a str. 301
ugcucugaagguuguuaaccac

SEQ ID NO: 1982940 - RNA, 17 nt, Shigella flexneri 2a str. 301
ugcucucgggcaguaaa

SEQ ID NO: 1982941 - RNA, 14 nt, Shigella flexneri 2a str. 301
ugcucguucagcgg

SEQ ID NO: 1982942 - RNA, 22 nt, Shigella flexneri 2a str. 301
ugcucguuauucagccugacag

SEQ ID NO: 1982943 - RNA, 20 nt, Shigella flexneri 2a str. 301
ugcucuggugcggcaaaaac

SEQ ID NO: 1982944 - RNA, 13 nt, Shigella flexneri 2a str. 301
ugcucuggugcgg

SEQ ID NO: 1982945 - RNA, 20 nt, Shigella flexneri 2a str. 301
ugcucugaggcugaugacaa

SEQ ID NO: 1982946 - RNA, 22 nt, Shigella flexneri 2a str. 301
ugcucugaggcugaugacaaac

SEQ ID NO: 1982947 - RNA, 11 nt, Shigella flexneri 2a str. 301
ugcucuuucag

SEQ ID NO: 1982948 - RNA, 12 nt, Shigella flexneri 2a str. 301
ugcucuuucagc

SEQ ID NO: 1982949 - RNA, 12 nt, Shigella flexneri 2a str. 301
ugcucuucuuuc

SEQ ID NO: 1982950 - RNA, 14 nt, Shigella flexneri 2a str. 301
ugcucuucuuucau

SEQ ID NO: 1982951 - RNA, 13 nt, Shigella flexneri 2a str. 301
ugcugaaaucaca

SEQ ID NO: 1982952 - RNA, 14 nt, Shigella flexneri 2a str. 301
ugcugaacuuaugc

SEQ ID NO: 1982953 - RNA, 16 nt, Shigella flexneri 2a str. 301
ugcucuuuuugcauaa

SEQ ID NO: 1982954 - RNA, 15 nt, Shigella flexneri 2a str. 301
ugcugaccaccagca

SEQ ID NO: 1982955 - RNA, 23 nt, Shigella flexneri 2a str. 301
ugcugaauuugaccuugcggcuu

SEQ ID NO: 1982956 - RNA, 20 nt, Shigella flexneri 2a str. 301
ugcugacgcagauccugauu

SEQ ID NO: 1982957 - RNA, 22 nt, Shigella flexneri 2a str. 301
ugcugacgcuacuggacauucc

SEQ ID NO: 1982958 - RNA, 19 nt, Shigella flexneri 2a str. 301
ugcugauaacgugcagcuu

SEQ ID NO: 1982959 - RNA, 21 nt, Shigella flexneri 2a str. 301
ugcugaguguaacgcuugcug

SEQ ID NO: 1982960 - RNA, 23 nt, Shigella flexneri 2a str. 301
ugcugauacuccaugaguaacag

SEQ ID NO: 1982961 - RNA, 16 nt, Shigella flexneri 2a str. 301
ugcugaugcacgcaga

SEQ ID NO: 1982962 - RNA, 21 nt, Shigella flexneri 2a str. 301
ugcugacuuugauccagccau

SEQ ID NO: 1982963 - RNA, 19 nt, Shigella flexneri 2a str. 301
ugcugacuuugauccagcc

SEQ ID NO: 1982964 - RNA, 21 nt, Shigella flexneri 2a str. 301
ugcugagcggcguaccuucag

SEQ ID NO: 1982965 - RNA, 15 nt, Shigella flexneri 2a str. 301
ugcugaggcugaccc

SEQ ID NO: 1982966 - RNA, 19 nt, Shigella flexneri 2a str. 301
ugcugccaaagugacacaa

SEQ ID NO: 1982967 - RNA, 21 nt, Shigella flexneri 2a str. 301
ugcugcaguaaccggaaauaa

SEQ ID NO: 1982968 - RNA, 16 nt, Shigella flexneri 2a str. 301
ugcugccgauggcaca

SEQ ID NO: 1982969 - RNA, 16 nt, Shigella flexneri 2a str. 301
ugcugccgccaguucu

SEQ ID NO: 1982970 - RNA, 16 nt, Shigella flexneri 2a str. 301
ugcugcaauugcggca

SEQ ID NO: 1982971 - RNA, 18 nt, Shigella flexneri 2a str. 301
ugcugcaauuccacaccc

SEQ ID NO: 1982972 - RNA, 17 nt, Shigella flexneri 2a str. 301
ugcugcacauacugcau

SEQ ID NO: 1982973 - RNA, 14 nt, Shigella flexneri 2a str. 301
aaaugguuuugcgu

SEQ ID NO: 1982974 - RNA, 15 nt, Shigella flexneri 2a str. 301
aaauguaaaaccaac

SEQ ID NO: 1982975 - RNA, 16 nt, Shigella flexneri 2a str. 301
ugcuggcagauaaauu

SEQ ID NO: 1982976 - RNA, 11 nt, Shigella flexneri 2a str. 301
ugcuggccaac

SEQ ID NO: 1982977 - RNA, 22 nt, Shigella flexneri 2a str. 301
ugcuggcugcgggaguugcucc

SEQ ID NO: 1982978 - RNA, 18 nt, Shigella flexneri 2a str. 301
ugcugcucaaaggcauua

SEQ ID NO: 1982979 - RNA, 15 nt, Shigella flexneri 2a str. 301
ugcugcugauccagc

SEQ ID NO: 1982980 - RNA, 12 nt, Shigella flexneri 2a str. 301
ugcugcucugaa

SEQ ID NO: 1982981 - RNA, 22 nt, Shigella flexneri 2a str. 301
ugcugcguuugcccuaaagcgc

SEQ ID NO: 1982982 - RNA, 20 nt, Shigella flexneri 2a str. 301
ugcugcuggaagguaaggau

SEQ ID NO: 1982983 - RNA, 18 nt, Shigella flexneri 2a str. 301
ugcugcuuuaucagauca

SEQ ID NO: 1982984 - RNA, 21 nt, Shigella flexneri 2a str. 301
ugcuggaucugcggguuaguc

SEQ ID NO: 1982985 - RNA, 16 nt, Shigella flexneri 2a str. 301
ugcuggacgcauugca

SEQ ID NO: 1982986 - RNA, 20 nt, Shigella flexneri 2a str. 301
ugcuggacgcauugcauuuc

SEQ ID NO: 1982987 - RNA, 20 nt, Shigella flexneri 2a str. 301
ugcuggacucccagaacaac

SEQ ID NO: 1982988 - RNA, 14 nt, Shigella flexneri 2a str. 301
ugcuggacuugaac

SEQ ID NO: 1982989 - RNA, 11 nt, Shigella flexneri 2a str. 301
ugcugguuuug

SEQ ID NO: 1982990 - RNA, 16 nt, Shigella flexneri 2a str. 301
ugcuguaucacuauga

SEQ ID NO: 1982991 - RNA, 21 nt, Shigella flexneri 2a str. 301
ugcuguaucgccggugguugc

SEQ ID NO: 1982992 - RNA, 21 nt, Shigella flexneri 2a str. 301
ugcuguaauuucacaccauca

SEQ ID NO: 1982993 - RNA, 14 nt, Shigella flexneri 2a str. 301
ugcugguacuggug

SEQ ID NO: 1982994 - RNA, 15 nt, Shigella flexneri 2a str. 301
ugcugguacuuucac

SEQ ID NO: 1982995 - RNA, 16 nt, Shigella flexneri 2a str. 301
ugcugguagaagcugg

SEQ ID NO: 1982996 - RNA, 16 nt, Shigella flexneri 2a str. 301
ugcuggggccgucauu

SEQ ID NO: 1982997 - RNA, 16 nt, Shigella flexneri 2a str. 301
ugcuguucuucugcug

SEQ ID NO: 1982998 - RNA, 18 nt, Shigella flexneri 2a str. 301
ugcuguuccuaucuucau

SEQ ID NO: 1982999 - RNA, 19 nt, Shigella flexneri 2a str. 301
ugcuguucgagcaucacau

SEQ ID NO: 1983000 - RNA, 21 nt, Shigella flexneri 2a str. 301
ugcugugcgccacagacauaa

SEQ ID NO: 1983001 - RNA, 17 nt, Shigella flexneri 2a str. 301
ugcuguggauucagcac

SEQ ID NO: 1983002 - RNA, 17 nt, Shigella flexneri 2a str. 301
ugcugugccggaagggg

SEQ ID NO: 1983003 - RNA, 12 nt, Shigella flexneri 2a str. 301
ugcuguuuuaca

SEQ ID NO: 1983004 - RNA, 23 nt, Shigella flexneri 2a str. 301
ugcuuaaauuucuuaccacugcc

SEQ ID NO: 1983005 - RNA, 17 nt, Shigella flexneri 2a str. 301
ugcuuacgcaacugcca

SEQ ID NO: 1983006 - RNA, 12 nt, Shigella flexneri 2a str. 301
ugcuuacguugu

SEQ ID NO: 1983007 - RNA, 21 nt, Shigella flexneri 2a str. 301
ugcuuaguaaaaauagugcgu

SEQ ID NO: 1983008 - RNA, 14 nt, Shigella flexneri 2a str. 301
ugcuuauccagcac

SEQ ID NO: 1983009 - RNA, 14 nt, Shigella flexneri 2a str. 301
ugcuuauccucugu

SEQ ID NO: 1983010 - RNA, 23 nt, Shigella flexneri 2a str. 301
ugcuuaucgcccugcuccagcaa

SEQ ID NO: 1983011 - RNA, 15 nt, Shigella flexneri 2a str. 301
ugcuucaagaugcca

SEQ ID NO: 1983012 - RNA, 21 nt, Shigella flexneri 2a str. 301
ugcuucacgcggguugccacc

SEQ ID NO: 1983013 - RNA, 19 nt, Shigella flexneri 2a str. 301
ugcuucacgcccagaucca

SEQ ID NO: 1983014 - RNA, 13 nt, Shigella flexneri 2a str. 301
ugcuucaccagca

SEQ ID NO: 1983015 - RNA, 19 nt, Shigella flexneri 2a str. 301
ugcuucaggacuucuuugc

SEQ ID NO: 1983016 - RNA, 16 nt, Shigella flexneri 2a str. 301
ugcuucaguuccugau

SEQ ID NO: 1983017 - RNA, 13 nt, Shigella flexneri 2a str. 301
ugcuucugcuuca

SEQ ID NO: 1983018 - RNA, 18 nt, Shigella flexneri 2a str. 301
ugcuugacgugucuuauc

SEQ ID NO: 1983019 - RNA, 13 nt, Shigella flexneri 2a str. 301
ugcuucugccugg

SEQ ID NO: 1983020 - RNA, 20 nt, Shigella flexneri 2a str. 301
ugcuucugccaguuguugcu

SEQ ID NO: 1983021 - RNA, 20 nt, Shigella flexneri 2a str. 301
ugcuucuccguguucgucac

SEQ ID NO: 1983022 - RNA, 16 nt, Shigella flexneri 2a str. 301
ugcuucggucagcacg

SEQ ID NO: 1983023 - RNA, 22 nt, Shigella flexneri 2a str. 301
ugcuucggucagaauuucgacu

SEQ ID NO: 1983024 - RNA, 17 nt, Shigella flexneri 2a str. 301
ugcuuccgccagcggcg

SEQ ID NO: 1983025 - RNA, 22 nt, Shigella flexneri 2a str. 301
ugcuuccugaguaauaacuucc

SEQ ID NO: 1983026 - RNA, 19 nt, Shigella flexneri 2a str. 301
ugcuucauuaccuuuuuuc

SEQ ID NO: 1983027 - RNA, 22 nt, Shigella flexneri 2a str. 301
ugcuucauuaccuuuuuucccu

SEQ ID NO: 1983028 - RNA, 18 nt, Shigella flexneri 2a str. 301
ugcuugcgauauucuuca

SEQ ID NO: 1983029 - RNA, 15 nt, Shigella flexneri 2a str. 301
ugcuugccccuuccc

SEQ ID NO: 1983030 - RNA, 19 nt, Shigella flexneri 2a str. 301
ugcuugucccaaccuuguu

SEQ ID NO: 1983031 - RNA, 19 nt, Shigella flexneri 2a str. 301
ugcuuuacgcuuaucccag

SEQ ID NO: 1983032 - RNA, 14 nt, Shigella flexneri 2a str. 301
ugcuuuaaaugcug

SEQ ID NO: 1983033 - RNA, 20 nt, Shigella flexneri 2a str. 301
ugcuuuuaccauacuggauu

SEQ ID NO: 1983034 - RNA, 17 nt, Shigella flexneri 2a str. 301
ugcuuuucauacaaucg

SEQ ID NO: 1983035 - RNA, 18 nt, Shigella flexneri 2a str. 301
ugcuuuucccuccacucc

SEQ ID NO: 1983036 - RNA, 15 nt, Shigella flexneri 2a str. 301
ugcuuuucccuccac

SEQ ID NO: 1983037 - RNA, 13 nt, Shigella flexneri 2a str. 301
ugcuuuugcuucu

SEQ ID NO: 1983038 - RNA, 17 nt, Shigella flexneri 2a str. 301
ugcuuuuguuaauugcu

SEQ ID NO: 1983039 - RNA, 14 nt, Shigella flexneri 2a str. 301
ugcuuuuuccugcg

SEQ ID NO: 1983040 - RNA, 18 nt, Shigella flexneri 2a str. 301
ugcuuuuuacuagccugc

SEQ ID NO: 1983041 - RNA, 20 nt, Shigella flexneri 2a str. 301
ugcuuuuuacuagccugcuc

SEQ ID NO: 1983042 - RNA, 22 nt, Shigella flexneri 2a str. 301
ugcuuuuuacuagccugcuccc

SEQ ID NO: 1983043 - RNA, 12 nt, Shigella flexneri 2a str. 301
uggaaaacaaca

SEQ ID NO: 1983044 - RNA, 13 nt, Shigella flexneri 2a str. 301
uggaaaagaaaac

SEQ ID NO: 1983045 - RNA, 12 nt, Shigella flexneri 2a str. 301
uggaaaucaaaa

SEQ ID NO: 1983046 - RNA, 21 nt, Shigella flexneri 2a str. 301
uggaaauguccgcgaacagca

SEQ ID NO: 1983047 - RNA, 22 nt, Shigella flexneri 2a str. 301
uggaacacuuugccgucagcca

SEQ ID NO: 1983048 - RNA, 23 nt, Shigella flexneri 2a str. 301
uggaacagccggaugucuggaac

SEQ ID NO: 1983049 - RNA, 17 nt, Shigella flexneri 2a str. 301
uggaacggcagauccaa

SEQ ID NO: 1983050 - RNA, 18 nt, Shigella flexneri 2a str. 301
uggaacggcagauccaaa

SEQ ID NO: 1983051 - RNA, 20 nt, Shigella flexneri 2a str. 301
uggaagaccugacuguucca

SEQ ID NO: 1983052 - RNA, 23 nt, Shigella flexneri 2a str. 301
uggaagaccugacuguuccagca

SEQ ID NO: 1983053 - RNA, 21 nt, Shigella flexneri 2a str. 301
uggaacuggcuguagaagcug

SEQ ID NO: 1983054 - RNA, 15 nt, Shigella flexneri 2a str. 301
uggaagaaacgcuua

SEQ ID NO: 1983055 - RNA, 20 nt, Shigella flexneri 2a str. 301
uggaagcauaauaagcuuuu

SEQ ID NO: 1983056 - RNA, 14 nt, Shigella flexneri 2a str. 301
uggacgcagcucau

SEQ ID NO: 1983057 - RNA, 16 nt, Shigella flexneri 2a str. 301
uggacagacuggcuau

SEQ ID NO: 1983058 - RNA, 13 nt, Shigella flexneri 2a str. 301
uggaauaagccaa

SEQ ID NO: 1983059 - RNA, 14 nt, Shigella flexneri 2a str. 301
uggaaucaauaauu

SEQ ID NO: 1983060 - RNA, 22 nt, Shigella flexneri 2a str. 301
uggaagguaaggauaaaaaagg

SEQ ID NO: 1983061 - RNA, 14 nt, Shigella flexneri 2a str. 301
uggaaggguugaaa

SEQ ID NO: 1983062 - RNA, 19 nt, Shigella flexneri 2a str. 301
uggaaggguugaaauauau

SEQ ID NO: 1983063 - RNA, 15 nt, Shigella flexneri 2a str. 301
uggaauggaaacagc

SEQ ID NO: 1983064 - RNA, 19 nt, Shigella flexneri 2a str. 301
ugcgucucuuguugcaaca

SEQ ID NO: 1983065 - RNA, 17 nt, Shigella flexneri 2a str. 301
ugcgucgcauccggcaa

SEQ ID NO: 1983066 - RNA, 17 nt, Shigella flexneri 2a str. 301
ugcgucucgacaaacuc

SEQ ID NO: 1983067 - RNA, 16 nt, Shigella flexneri 2a str. 301
ugcgugagguaacaau

SEQ ID NO: 1983068 - RNA, 16 nt, Shigella flexneri 2a str. 301
ugcgugaguuuuuguc

SEQ ID NO: 1983069 - RNA, 14 nt, Shigella flexneri 2a str. 301
ugcgucauccagca

SEQ ID NO: 1983070 - RNA, 15 nt, Shigella flexneri 2a str. 301
ugcgucauuccggag

SEQ ID NO: 1983071 - RNA, 18 nt, Shigella flexneri 2a str. 301
ugcguccgguaauuuuua

SEQ ID NO: 1983072 - RNA, 14 nt, Shigella flexneri 2a str. 301
ugcgucgcacucuc

SEQ ID NO: 1983073 - RNA, 22 nt, Shigella flexneri 2a str. 301
ugcguuuuaccaguuucagaau

SEQ ID NO: 1983074 - RNA, 15 nt, Shigella flexneri 2a str. 301
ugcguuucugcuucu

SEQ ID NO: 1983075 - RNA, 15 nt, Shigella flexneri 2a str. 301
ugcgggaguggcgaa

SEQ ID NO: 1983076 - RNA, 23 nt, Shigella flexneri 2a str. 301
ugcggucguaaucgcccgcuucc

SEQ ID NO: 1983077 - RNA, 19 nt, Shigella flexneri 2a str. 301
ugcggugccauuaaaccaa

SEQ ID NO: 1983078 - RNA, 14 nt, Shigella flexneri 2a str. 301
ugcgguuaaugguu

SEQ ID NO: 1983079 - RNA, 16 nt, Shigella flexneri 2a str. 301
ugcgguuucagcucac

SEQ ID NO: 1983080 - RNA, 18 nt, Shigella flexneri 2a str. 301
ugcgcuuccugcagcuuc

SEQ ID NO: 1983081 - RNA, 19 nt, Shigella flexneri 2a str. 301
ugcgcuuccugcagcuuca

SEQ ID NO: 1983082 - RNA, 12 nt, Shigella flexneri 2a str. 301
ugcgcuuccagc

SEQ ID NO: 1983083 - RNA, 13 nt, Shigella flexneri 2a str. 301
ugcgcuuccagcu

SEQ ID NO: 1983084 - RNA, 13 nt, Shigella flexneri 2a str. 301
ugcgcuuccugca

SEQ ID NO: 1983085 - RNA, 16 nt, Shigella flexneri 2a str. 301
ugcgcuucuuccagca

SEQ ID NO: 1983086 - RNA, 15 nt, Shigella flexneri 2a str. 301
ugcgcugggcaacaa

SEQ ID NO: 1983087 - RNA, 15 nt, Shigella flexneri 2a str. 301
ugcgcugugugugcu

SEQ ID NO: 1983088 - RNA, 17 nt, Shigella flexneri 2a str. 301
ugcgcuucuuccagcau

SEQ ID NO: 1983089 - RNA, 17 nt, Shigella flexneri 2a str. 301
ugcgcuuuaucgccgcu

SEQ ID NO: 1983090 - RNA, 15 nt, Shigella flexneri 2a str. 301
ugcgcuuucuuaaau

SEQ ID NO: 1983091 - RNA, 16 nt, Shigella flexneri 2a str. 301
ugcgcuuuauucagau

SEQ ID NO: 1983092 - RNA, 14 nt, Shigella flexneri 2a str. 301
ugcggaaaaaagaa

SEQ ID NO: 1983093 - RNA, 21 nt, Shigella flexneri 2a str. 301
ugcggaaaaaagaaagaagcc

SEQ ID NO: 1983094 - RNA, 14 nt, Shigella flexneri 2a str. 301
ugcggaaauuccag

SEQ ID NO: 1983095 - RNA, 17 nt, Shigella flexneri 2a str. 301
ugcggaaauuccagcgg

SEQ ID NO: 1983096 - RNA, 19 nt, Shigella flexneri 2a str. 301
ugcggaagucgcagcugcc

SEQ ID NO: 1983097 - RNA, 16 nt, Shigella flexneri 2a str. 301
ugcggacaaaacguga

SEQ ID NO: 1983098 - RNA, 18 nt, Shigella flexneri 2a str. 301
ugcggcugcugaggcuga

SEQ ID NO: 1983099 - RNA, 18 nt, Shigella flexneri 2a str. 301
ugcggcuuccagagcagc

SEQ ID NO: 1983100 - RNA, 22 nt, Shigella flexneri 2a str. 301
ugcggcgcaagcggcgacugag

SEQ ID NO: 1983101 - RNA, 13 nt, Shigella flexneri 2a str. 301
ugcggcagggcaa

SEQ ID NO: 1983102 - RNA, 14 nt, Shigella flexneri 2a str. 301
ugcggcgaggaauc

SEQ ID NO: 1983103 - RNA, 13 nt, Shigella flexneri 2a str. 301
ugcggcaggcaca

SEQ ID NO: 1983104 - RNA, 13 nt, Shigella flexneri 2a str. 301
ugcggcagcucca

SEQ ID NO: 1983105 - RNA, 13 nt, Shigella flexneri 2a str. 301
ugcggcaccagcg

SEQ ID NO: 1983106 - RNA, 18 nt, Shigella flexneri 2a str. 301
ugcuaaaaacaucaugau

SEQ ID NO: 1983107 - RNA, 20 nt, Shigella flexneri 2a str. 301
ugcuaaaccagcccugguuu

SEQ ID NO: 1983108 - RNA, 16 nt, Shigella flexneri 2a str. 301
ugcguuuuuaucuuca

SEQ ID NO: 1983109 - RNA, 18 nt, Shigella flexneri 2a str. 301
ugcguuuuccggcacgca

SEQ ID NO: 1983110 - RNA, 22 nt, Shigella flexneri 2a str. 301
ugcuaacucaucaccaucaggc

SEQ ID NO: 1983111 - RNA, 24 nt, Shigella flexneri 2a str. 301
ugcuaagcgcgguaaaaucuucac

SEQ ID NO: 1983112 - RNA, 14 nt, Shigella flexneri 2a str. 301
ugcuacccacuucc

SEQ ID NO: 1983113 - RNA, 23 nt, Shigella flexneri 2a str. 301
ugcuaucuccuguugugaugcaa

SEQ ID NO: 1983114 - RNA, 21 nt, Shigella flexneri 2a str. 301
ugcuaucuccuguugugaugc

SEQ ID NO: 1983115 - RNA, 19 nt, Shigella flexneri 2a str. 301
ugcuaguuaucuccuugcu

SEQ ID NO: 1983116 - RNA, 16 nt, Shigella flexneri 2a str. 301
ugcuaugcugaaugau

SEQ ID NO: 1983117 - RNA, 18 nt, Shigella flexneri 2a str. 301
ugcuauuuaccacuacug

SEQ ID NO: 1983118 - RNA, 19 nt, Shigella flexneri 2a str. 301
ugcuauugcggaugaaagu

SEQ ID NO: 1983119 - RNA, 15 nt, Shigella flexneri 2a str. 301
ugcuauucaccagca

SEQ ID NO: 1983120 - RNA, 15 nt, Shigella flexneri 2a str. 301
ugcucaacccuuucc

SEQ ID NO: 1983121 - RNA, 19 nt, Shigella flexneri 2a str. 301
ugcucaacccuuuccagcg

SEQ ID NO: 1983122 - RNA, 23 nt, Shigella flexneri 2a str. 301
ugcucaucuggcguaccaaucag

SEQ ID NO: 1983123 - RNA, 18 nt, Shigella flexneri 2a str. 301
ugcucaucagcccggcaa

SEQ ID NO: 1983124 - RNA, 22 nt, Shigella flexneri 2a str. 301
ugcucaucagcgguaaaacgcc

SEQ ID NO: 1983125 - RNA, 14 nt, Shigella flexneri 2a str. 301
ugcucaucgauauc

SEQ ID NO: 1983126 - RNA, 16 nt, Shigella flexneri 2a str. 301
ugcucauaaaaugauu

SEQ ID NO: 1983127 - RNA, 14 nt, Shigella flexneri 2a str. 301
ugcucauaaacgcg

SEQ ID NO: 1983128 - RNA, 14 nt, Shigella flexneri 2a str. 301
ugcucaucagcccg

SEQ ID NO: 1983129 - RNA, 23 nt, Shigella flexneri 2a str. 301
ugcucauagaccauugcaucauc

SEQ ID NO: 1983130 - RNA, 20 nt, Shigella flexneri 2a str. 301
ugcucaggaguaaacuuucc

SEQ ID NO: 1983131 - RNA, 17 nt, Shigella flexneri 2a str. 301
ugcucaauugacaguuu

SEQ ID NO: 1983132 - RNA, 22 nt, Shigella flexneri 2a str. 301
ugcucacagaguauuuccagcu

SEQ ID NO: 1983133 - RNA, 18 nt, Shigella flexneri 2a str. 301
ugcucagaaucacgccaa

SEQ ID NO: 1983134 - RNA, 14 nt, Shigella flexneri 2a str. 301
ugcuccuuaauaaa

SEQ ID NO: 1983135 - RNA, 22 nt, Shigella flexneri 2a str. 301
ugcuccggguagagguuauaaa

SEQ ID NO: 1983136 - RNA, 23 nt, Shigella flexneri 2a str. 301
ugcuccgccgcagccgcauuuuu

SEQ ID NO: 1983137 - RNA, 14 nt, Shigella flexneri 2a str. 301
ugcucccagcgcau

SEQ ID NO: 1983138 - RNA, 21 nt, Shigella flexneri 2a str. 301
ugcuccauccauugcauaaac

SEQ ID NO: 1983139 - RNA, 12 nt, Shigella flexneri 2a str. 301
ugcuccauccau

SEQ ID NO: 1983140 - RNA, 22 nt, Shigella flexneri 2a str. 301
ugcuccauuagcccgagaucuu

SEQ ID NO: 1983141 - RNA, 18 nt, Shigella flexneri 2a str. 301
ugcuccagcguaccugcc

SEQ ID NO: 1983142 - RNA, 18 nt, Shigella flexneri 2a str. 301
ugcucauucuuccuccag

SEQ ID NO: 1983143 - RNA, 14 nt, Shigella flexneri 2a str. 301
ugcuccacuccugc

SEQ ID NO: 1983144 - RNA, 13 nt, Shigella flexneri 2a str. 301
ugcuccacugcuc

SEQ ID NO: 1983145 - RNA, 13 nt, Shigella flexneri 2a str. 301
ugcuccagcagau

SEQ ID NO: 1983146 - RNA, 17 nt, Shigella flexneri 2a str. 301
ugcgccacaggucagca

SEQ ID NO: 1983147 - RNA, 23 nt, Shigella flexneri 2a str. 301
ugcgccaaaugucagcugccagu

SEQ ID NO: 1983148 - RNA, 20 nt, Shigella flexneri 2a str. 301
ugcgcauuucccagcaagaa

SEQ ID NO: 1983149 - RNA, 21 nt, Shigella flexneri 2a str. 301
ugcgccaaacagaugaugcgu

SEQ ID NO: 1983150 - RNA, 17 nt, Shigella flexneri 2a str. 301
ugcgccacuucccagcc

SEQ ID NO: 1983151 - RNA, 19 nt, Shigella flexneri 2a str. 301
ugcgccacaggucagcagg

SEQ ID NO: 1983152 - RNA, 12 nt, Shigella flexneri 2a str. 301
ugcgccacaucc

SEQ ID NO: 1983153 - RNA, 20 nt, Shigella flexneri 2a str. 301
ugcgcaauacguugcaaaau

SEQ ID NO: 1983154 - RNA, 18 nt, Shigella flexneri 2a str. 301
ugcgccaucggcagcauc

SEQ ID NO: 1983155 - RNA, 21 nt, Shigella flexneri 2a str. 301
ugcgccaggauaagcgccgcu

SEQ ID NO: 1983156 - RNA, 17 nt, Shigella flexneri 2a str. 301
ugcgccaguagggcguc

SEQ ID NO: 1983157 - RNA, 15 nt, Shigella flexneri 2a str. 301
ugcgcccugggcuuc

SEQ ID NO: 1983158 - RNA, 19 nt, Shigella flexneri 2a str. 301
ugcgccgccucugcgcuuu

SEQ ID NO: 1983159 - RNA, 15 nt, Shigella flexneri 2a str. 301
ugccuuucagcgcau

SEQ ID NO: 1983160 - RNA, 14 nt, Shigella flexneri 2a str. 301
ugccuuugaaaucg

SEQ ID NO: 1983161 - RNA, 16 nt, Shigella flexneri 2a str. 301
ugcgaacugugcaccc

SEQ ID NO: 1983162 - RNA, 22 nt, Shigella flexneri 2a str. 301
ugcgaacugugcacccgcuuca

SEQ ID NO: 1983163 - RNA, 18 nt, Shigella flexneri 2a str. 301
ugcgaaaaaaucauccau

SEQ ID NO: 1983164 - RNA, 14 nt, Shigella flexneri 2a str. 301
ugcgaaaaaaaagc

SEQ ID NO: 1983165 - RNA, 11 nt, Shigella flexneri 2a str. 301
ugcgaaacgau

SEQ ID NO: 1983166 - RNA, 15 nt, Shigella flexneri 2a str. 301
ugcgaaguuuuuccg

SEQ ID NO: 1983167 - RNA, 17 nt, Shigella flexneri 2a str. 301
ugcgaaguuuuuccgcc

SEQ ID NO: 1983168 - RNA, 16 nt, Shigella flexneri 2a str. 301
ugcgaauaaugguauc

SEQ ID NO: 1983169 - RNA, 15 nt, Shigella flexneri 2a str. 301
ugcgaauacacccug

SEQ ID NO: 1983170 - RNA, 18 nt, Shigella flexneri 2a str. 301
ugcgaauggcaugcuccc

SEQ ID NO: 1983171 - RNA, 16 nt, Shigella flexneri 2a str. 301
ugcgaauugccaccau

SEQ ID NO: 1983172 - RNA, 16 nt, Shigella flexneri 2a str. 301
ugcgaucgcaaaucca

SEQ ID NO: 1983173 - RNA, 22 nt, Shigella flexneri 2a str. 301
ugcgauaucgacggcgugcuga

SEQ ID NO: 1983174 - RNA, 17 nt, Shigella flexneri 2a str. 301
ugcgaguuuucgcaucc

SEQ ID NO: 1983175 - RNA, 18 nt, Shigella flexneri 2a str. 301
ugcgauagccuucagugc

SEQ ID NO: 1983176 - RNA, 22 nt, Shigella flexneri 2a str. 301
ugcgagguuauccgccagcgcc

SEQ ID NO: 1983177 - RNA, 15 nt, Shigella flexneri 2a str. 301
ugcgagcgccuuauc

SEQ ID NO: 1983178 - RNA, 14 nt, Shigella flexneri 2a str. 301
ugccgguaaugcug

SEQ ID NO: 1983179 - RNA, 19 nt, Shigella flexneri 2a str. 301
ugccgggguagaccgcgcu

SEQ ID NO: 1983180 - RNA, 14 nt, Shigella flexneri 2a str. 301
ugccggugaugccg

SEQ ID NO: 1983181 - RNA, 18 nt, Shigella flexneri 2a str. 301
ugccgguggaagggcuuu

SEQ ID NO: 1983182 - RNA, 17 nt, Shigella flexneri 2a str. 301
ugccgguggccuugccg

SEQ ID NO: 1983183 - RNA, 16 nt, Shigella flexneri 2a str. 301
ugccguacaggcagcu

SEQ ID NO: 1983184 - RNA, 14 nt, Shigella flexneri 2a str. 301
ugccguacaggcag

SEQ ID NO: 1983185 - RNA, 21 nt, Shigella flexneri 2a str. 301
ugccguaaaucccagugccug

SEQ ID NO: 1983186 - RNA, 14 nt, Shigella flexneri 2a str. 301
ugccgguuccugca

SEQ ID NO: 1983187 - RNA, 23 nt, Shigella flexneri 2a str. 301
ugccgguucgacggcuggacaaa

SEQ ID NO: 1983188 - RNA, 15 nt, Shigella flexneri 2a str. 301
ugccgucgaccagca

SEQ ID NO: 1983189 - RNA, 15 nt, Shigella flexneri 2a str. 301
ugccagagcccauca

SEQ ID NO: 1983190 - RNA, 14 nt, Shigella flexneri 2a str. 301
ugccagagcagcaa

SEQ ID NO: 1983191 - RNA, 14 nt, Shigella flexneri 2a str. 301
ugccagaccuccgu

SEQ ID NO: 1983192 - RNA, 19 nt, Shigella flexneri 2a str. 301
ugccagacgaauaaaacag

SEQ ID NO: 1983193 - RNA, 16 nt, Shigella flexneri 2a str. 301
ugccagaccaaacagc

SEQ ID NO: 1983194 - RNA, 14 nt, Shigella flexneri 2a str. 301
ugccagaaggggga

SEQ ID NO: 1983195 - RNA, 22 nt, Shigella flexneri 2a str. 301
ugccagaaagcguauccaucac

SEQ ID NO: 1983196 - RNA, 22 nt, Shigella flexneri 2a str. 301
ugccagaaauccaggcccgcau

SEQ ID NO: 1983197 - RNA, 17 nt, Shigella flexneri 2a str. 301
ugccagaacaaccagag

SEQ ID NO: 1983198 - RNA, 19 nt, Shigella flexneri 2a str. 301
ugccaccuccaagccugau

SEQ ID NO: 1983199 - RNA, 23 nt, Shigella flexneri 2a str. 301
ugccaccugccggagcgccacca

SEQ ID NO: 1983200 - RNA, 12 nt, Shigella flexneri 2a str. 301
ugccacccugcg

SEQ ID NO: 1983201 - RNA, 16 nt, Shigella flexneri 2a str. 301
ugccggccagcgccac

SEQ ID NO: 1983202 - RNA, 21 nt, Shigella flexneri 2a str. 301
ugccggcaucaaacgguugau

SEQ ID NO: 1983203 - RNA, 16 nt, Shigella flexneri 2a str. 301
ugccagauaagacacu

SEQ ID NO: 1983204 - RNA, 16 nt, Shigella flexneri 2a str. 301
ugccagauaauggcug

SEQ ID NO: 1983205 - RNA, 22 nt, Shigella flexneri 2a str. 301
ugccagaggagccaucaccauc

SEQ ID NO: 1983206 - RNA, 19 nt, Shigella flexneri 2a str. 301
ugccagaggagccaucacc

SEQ ID NO: 1983207 - RNA, 21 nt, Shigella flexneri 2a str. 301
ugccagaggagccaucaccau

SEQ ID NO: 1983208 - RNA, 18 nt, Shigella flexneri 2a str. 301
ugccagaggagccaucac

SEQ ID NO: 1983209 - RNA, 17 nt, Shigella flexneri 2a str. 301
ugccuguacggcaguga

SEQ ID NO: 1983210 - RNA, 14 nt, Shigella flexneri 2a str. 301
ugccugucgggaca

SEQ ID NO: 1983211 - RNA, 21 nt, Shigella flexneri 2a str. 301
ugccugugacaacacuucaua

SEQ ID NO: 1983212 - RNA, 22 nt, Shigella flexneri 2a str. 301
ugccugugcaaccuuuuccauu

SEQ ID NO: 1983213 - RNA, 12 nt, Shigella flexneri 2a str. 301
ugccuuaaucaa

SEQ ID NO: 1983214 - RNA, 16 nt, Shigella flexneri 2a str. 301
ugccuguucgccgccg

SEQ ID NO: 1983215 - RNA, 18 nt, Shigella flexneri 2a str. 301
ugccuguucgcuacuguu

SEQ ID NO: 1983216 - RNA, 22 nt, Shigella flexneri 2a str. 301
ugccuuagccacaaagcagggc

SEQ ID NO: 1983217 - RNA, 23 nt, Shigella flexneri 2a str. 301
ugccuuagccacaaagcagggcu

SEQ ID NO: 1983218 - RNA, 18 nt, Shigella flexneri 2a str. 301
ugccuucacaggccgcca

SEQ ID NO: 1983219 - RNA, 14 nt, Shigella flexneri 2a str. 301
ugccuuccaucccu

SEQ ID NO: 1983220 - RNA, 16 nt, Shigella flexneri 2a str. 301
ugccuuccccgagcgg

SEQ ID NO: 1983221 - RNA, 20 nt, Shigella flexneri 2a str. 301
ugccuuccagcgaugcccag

SEQ ID NO: 1983222 - RNA, 14 nt, Shigella flexneri 2a str. 301
ugccuucauacugc

SEQ ID NO: 1983223 - RNA, 11 nt, Shigella flexneri 2a str. 301
ugccuuccagc

SEQ ID NO: 1983224 - RNA, 20 nt, Shigella flexneri 2a str. 301
ugccuucggcgucuccaccu

SEQ ID NO: 1983225 - RNA, 19 nt, Shigella flexneri 2a str. 301
ugccugagacagacagccu

SEQ ID NO: 1983226 - RNA, 18 nt, Shigella flexneri 2a str. 301
ugccugauguacaaccau

SEQ ID NO: 1983227 - RNA, 12 nt, Shigella flexneri 2a str. 301
ugccugauuacg

SEQ ID NO: 1983228 - RNA, 16 nt, Shigella flexneri 2a str. 301
ugccugauccugggcu

SEQ ID NO: 1983229 - RNA, 22 nt, Shigella flexneri 2a str. 301
ugccugaugcggcguaaacgcc

SEQ ID NO: 1983230 - RNA, 13 nt, Shigella flexneri 2a str. 301
ugccugcagcugc

SEQ ID NO: 1983231 - RNA, 18 nt, Shigella flexneri 2a str. 301
ugccugcacuuuguguca

SEQ ID NO: 1983232 - RNA, 17 nt, Shigella flexneri 2a str. 301
ugccugccagcuugcga

SEQ ID NO: 1983233 - RNA, 18 nt, Shigella flexneri 2a str. 301
ugccugccagucaaucau

SEQ ID NO: 1983234 - RNA, 22 nt, Shigella flexneri 2a str. 301
ugccucggggaacgcaaaauuc

SEQ ID NO: 1983235 - RNA, 19 nt, Shigella flexneri 2a str. 301
ugccucgggauccaugcac

SEQ ID NO: 1983236 - RNA, 17 nt, Shigella flexneri 2a str. 301
ugccucguuggucagcu

SEQ ID NO: 1983237 - RNA, 16 nt, Shigella flexneri 2a str. 301
ugccucuccccagcgg

SEQ ID NO: 1983238 - RNA, 21 nt, Shigella flexneri 2a str. 301
ugccucuccccagcggaaaau

SEQ ID NO: 1983239 - RNA, 17 nt, Shigella flexneri 2a str. 301
ugccgucugggcaaaau

SEQ ID NO: 1983240 - RNA, 21 nt, Shigella flexneri 2a str. 301
ugccgucugggcaaaaucauc

SEQ ID NO: 1983241 - RNA, 18 nt, Shigella flexneri 2a str. 301
ugccucgcugaagcuuac

SEQ ID NO: 1983242 - RNA, 17 nt, Shigella flexneri 2a str. 301
ugguuuucaauuaucac

SEQ ID NO: 1983243 - RNA, 18 nt, Shigella flexneri 2a str. 301
uguaaacgaagcgccauu

SEQ ID NO: 1983244 - RNA, 17 nt, Shigella flexneri 2a str. 301
ugguuugauagcaauac

SEQ ID NO: 1983245 - RNA, 14 nt, Shigella flexneri 2a str. 301
ugguuuguuccgca

SEQ ID NO: 1983246 - RNA, 14 nt, Shigella flexneri 2a str. 301
uguaaaugaacuca

SEQ ID NO: 1983247 - RNA, 18 nt, Shigella flexneri 2a str. 301
ugguucgacggccaguca

SEQ ID NO: 1983248 - RNA, 22 nt, Shigella flexneri 2a str. 301
ugguucggcaaaaucuuccaga

SEQ ID NO: 1983249 - RNA, 15 nt, Shigella flexneri 2a str. 301
ugguuguaauccacc

SEQ ID NO: 1983250 - RNA, 14 nt, Shigella flexneri 2a str. 301
ugguugucaccgcc

SEQ ID NO: 1983251 - RNA, 14 nt, Shigella flexneri 2a str. 301
ugguugccagccac

SEQ ID NO: 1983252 - RNA, 13 nt, Shigella flexneri 2a str. 301
ugguugcgccugg

SEQ ID NO: 1983253 - RNA, 20 nt, Shigella flexneri 2a str. 301
uguacaggauauauuucauc

SEQ ID NO: 1983254 - RNA, 16 nt, Shigella flexneri 2a str. 301
uguacagcgaaacaua

SEQ ID NO: 1983255 - RNA, 22 nt, Shigella flexneri 2a str. 301
uguacagauccgccauuucucc

SEQ ID NO: 1983256 - RNA, 16 nt, Shigella flexneri 2a str. 301
uguacaggcuccugua

SEQ ID NO: 1983257 - RNA, 17 nt, Shigella flexneri 2a str. 301
uguacauggugcacauu

SEQ ID NO: 1983258 - RNA, 14 nt, Shigella flexneri 2a str. 301
uguacaugcugcuu

SEQ ID NO: 1983259 - RNA, 13 nt, Shigella flexneri 2a str. 301
uguacggcaguga

SEQ ID NO: 1983260 - RNA, 22 nt, Shigella flexneri 2a str. 301
uguacauuaccacgauuuugac

SEQ ID NO: 1983261 - RNA, 19 nt, Shigella flexneri 2a str. 301
uguacuccagcagaccagc

SEQ ID NO: 1983262 - RNA, 20 nt, Shigella flexneri 2a str. 301
uguacuccagcagaccagca

SEQ ID NO: 1983263 - RNA, 21 nt, Shigella flexneri 2a str. 301
uguaagacauuuaacccuuca

SEQ ID NO: 1983264 - RNA, 18 nt, Shigella flexneri 2a str. 301
uguaagggcuaaucugaa

SEQ ID NO: 1983265 - RNA, 23 nt, Shigella flexneri 2a str. 301
uguaaguaaugacaaaauugcug

SEQ ID NO: 1983266 - RNA, 13 nt, Shigella flexneri 2a str. 301
uguaaaugcugcu

SEQ ID NO: 1983267 - RNA, 22 nt, Shigella flexneri 2a str. 301
uguaauuaaauuaucaacuauc

SEQ ID NO: 1983268 - RNA, 19 nt, Shigella flexneri 2a str. 301
uguaauacggcucucaccu

SEQ ID NO: 1983269 - RNA, 17 nt, Shigella flexneri 2a str. 301
uguaauaguguauuaau

SEQ ID NO: 1983270 - RNA, 17 nt, Shigella flexneri 2a str. 301
uguaaguggaugcccgg

SEQ ID NO: 1983271 - RNA, 17 nt, Shigella flexneri 2a str. 301
ugguuauuucacuucaa

SEQ ID NO: 1983272 - RNA, 22 nt, Shigella flexneri 2a str. 301
ugguuauuucacuucaaccaca

SEQ ID NO: 1983273 - RNA, 19 nt, Shigella flexneri 2a str. 301
ugguuaucuuccaccacca

SEQ ID NO: 1983274 - RNA, 14 nt, Shigella flexneri 2a str. 301
ugguuaugccauuu

SEQ ID NO: 1983275 - RNA, 20 nt, Shigella flexneri 2a str. 301
ugguuauccagcaaccaggu

SEQ ID NO: 1983276 - RNA, 23 nt, Shigella flexneri 2a str. 301
ugguuagcggcgguaaaaucauc

SEQ ID NO: 1983277 - RNA, 19 nt, Shigella flexneri 2a str. 301
ugguuagcggcgguaaaau

SEQ ID NO: 1983278 - RNA, 21 nt, Shigella flexneri 2a str. 301
ugguuagagcacaucacucau

SEQ ID NO: 1983279 - RNA, 18 nt, Shigella flexneri 2a str. 301
ugguguucggcauucugc

SEQ ID NO: 1983280 - RNA, 18 nt, Shigella flexneri 2a str. 301
ugguuaaauaaggcuuua

SEQ ID NO: 1983281 - RNA, 14 nt, Shigella flexneri 2a str. 301
ugguguugaagaaa

SEQ ID NO: 1983282 - RNA, 11 nt, Shigella flexneri 2a str. 301
ugguuaacaau

SEQ ID NO: 1983283 - RNA, 22 nt, Shigella flexneri 2a str. 301
ugguuaacaaucacaauagaaa

SEQ ID NO: 1983284 - RNA, 17 nt, Shigella flexneri 2a str. 301
ugguuaacgaaucaauc

SEQ ID NO: 1983285 - RNA, 15 nt, Shigella flexneri 2a str. 301
ugguuaccaucaacc

SEQ ID NO: 1983286 - RNA, 12 nt, Shigella flexneri 2a str. 301
ugguuacacggg

SEQ ID NO: 1983287 - RNA, 15 nt, Shigella flexneri 2a str. 301
ugguggucaccauga

SEQ ID NO: 1983288 - RNA, 15 nt, Shigella flexneri 2a str. 301
uggugguguggcugc

SEQ ID NO: 1983289 - RNA, 19 nt, Shigella flexneri 2a str. 301
ugguguagcgauccugacc

SEQ ID NO: 1983290 - RNA, 18 nt, Shigella flexneri 2a str. 301
ugguguuaaaucuguuca

SEQ ID NO: 1983291 - RNA, 16 nt, Shigella flexneri 2a str. 301
ugguguggcugcacac

SEQ ID NO: 1983292 - RNA, 17 nt, Shigella flexneri 2a str. 301
ugguguggcugcacacc

SEQ ID NO: 1983293 - RNA, 16 nt, Shigella flexneri 2a str. 301
ugguggacaaccauaa

SEQ ID NO: 1983294 - RNA, 21 nt, Shigella flexneri 2a str. 301
ugguggccgccacgcgugagc

SEQ ID NO: 1983295 - RNA, 17 nt, Shigella flexneri 2a str. 301
uggugcaaggaaauaau

SEQ ID NO: 1983296 - RNA, 19 nt, Shigella flexneri 2a str. 301
uggugcaauuucagcgucc

SEQ ID NO: 1983297 - RNA, 20 nt, Shigella flexneri 2a str. 301
uggugauugccggaauggug

SEQ ID NO: 1983298 - RNA, 19 nt, Shigella flexneri 2a str. 301
uggugaugguauuguccug

SEQ ID NO: 1983299 - RNA, 20 nt, Shigella flexneri 2a str. 301
uggugacuuuugcccggcau

SEQ ID NO: 1983300 - RNA, 20 nt, Shigella flexneri 2a str. 301
uggugccgaugauuuacauc

SEQ ID NO: 1983301 - RNA, 15 nt, Shigella flexneri 2a str. 301
uggguaggaucagaa

SEQ ID NO: 1983302 - RNA, 23 nt, Shigella flexneri 2a str. 301
ugggucacucaggccaaaugaca

SEQ ID NO: 1983303 - RNA, 16 nt, Shigella flexneri 2a str. 301
uggucugcaugacggc

SEQ ID NO: 1983304 - RNA, 18 nt, Shigella flexneri 2a str. 301
uggucuggaacuggcugc

SEQ ID NO: 1983305 - RNA, 13 nt, Shigella flexneri 2a str. 301
uggucugccauca

SEQ ID NO: 1983306 - RNA, 23 nt, Shigella flexneri 2a str. 301
uggucugacgcugaauacgcacc

SEQ ID NO: 1983307 - RNA, 13 nt, Shigella flexneri 2a str. 301
uggucugaaucaa

SEQ ID NO: 1983308 - RNA, 18 nt, Shigella flexneri 2a str. 301
ugggucggcgauaaccau

SEQ ID NO: 1983309 - RNA, 22 nt, Shigella flexneri 2a str. 301
ugggucugcagauauucaugca

SEQ ID NO: 1983310 - RNA, 16 nt, Shigella flexneri 2a str. 301
ugucaccacccugccc

SEQ ID NO: 1983311 - RNA, 14 nt, Shigella flexneri 2a str. 301
ugucaccagccgau

SEQ ID NO: 1983312 - RNA, 14 nt, Shigella flexneri 2a str. 301
ugucacaaauagag

SEQ ID NO: 1983313 - RNA, 21 nt, Shigella flexneri 2a str. 301
ugucaauacuuucacaaaaau

SEQ ID NO: 1983314 - RNA, 14 nt, Shigella flexneri 2a str. 301
ugucaauaaucuga

SEQ ID NO: 1983315 - RNA, 22 nt, Shigella flexneri 2a str. 301
uguauuucuucauacuaccugg

SEQ ID NO: 1983316 - RNA, 18 nt, Shigella flexneri 2a str. 301
uguauuuauuuucaggau

SEQ ID NO: 1983317 - RNA, 17 nt, Shigella flexneri 2a str. 301
uguauucaugcccugcc

SEQ ID NO: 1983318 - RNA, 18 nt, Shigella flexneri 2a str. 301
uguaucccagaucgcuuu

SEQ ID NO: 1983319 - RNA, 16 nt, Shigella flexneri 2a str. 301
uguaucgucacugguu

SEQ ID NO: 1983320 - RNA, 19 nt, Shigella flexneri 2a str. 301
uguaucugcagauuaugcc

SEQ ID NO: 1983321 - RNA, 12 nt, Shigella flexneri 2a str. 301
uguaucugcugu

SEQ ID NO: 1983322 - RNA, 17 nt, Shigella flexneri 2a str. 301
uguagcacuugcagcuc

SEQ ID NO: 1983323 - RNA, 15 nt, Shigella flexneri 2a str. 301
uguacuguuucacug

SEQ ID NO: 1983324 - RNA, 23 nt, Shigella flexneri 2a str. 301
ugucccacuggucgcccugggua

SEQ ID NO: 1983325 - RNA, 20 nt, Shigella flexneri 2a str. 301
uguccauggugucugaugag

SEQ ID NO: 1983326 - RNA, 19 nt, Shigella flexneri 2a str. 301
ugucagcaaucugauugac

SEQ ID NO: 1983327 - RNA, 22 nt, Shigella flexneri 2a str. 301
ugucaccauuggcauugguauc

SEQ ID NO: 1983328 - RNA, 15 nt, Shigella flexneri 2a str. 301
ugucagcccuuuuuc

SEQ ID NO: 1983329 - RNA, 15 nt, Shigella flexneri 2a str. 301
ugucagcucauccag

SEQ ID NO: 1983330 - RNA, 16 nt, Shigella flexneri 2a str. 301
ugucagcucauccagc

SEQ ID NO: 1983331 - RNA, 23 nt, Shigella flexneri 2a str. 301
uguccucgccguuuucuggggcg

SEQ ID NO: 1983332 - RNA, 19 nt, Shigella flexneri 2a str. 301
uguccuaaaaaauuaacaa

SEQ ID NO: 1983333 - RNA, 19 nt, Shigella flexneri 2a str. 301
uguccgccaauuucaucac

SEQ ID NO: 1983334 - RNA, 21 nt, Shigella flexneri 2a str. 301
uguccgauuuguucucuucug

SEQ ID NO: 1983335 - RNA, 19 nt, Shigella flexneri 2a str. 301
ugucgagauuaaacaaggu

SEQ ID NO: 1983336 - RNA, 12 nt, Shigella flexneri 2a str. 301
ugucgagugaau

SEQ ID NO: 1983337 - RNA, 21 nt, Shigella flexneri 2a str. 301
ugucgaggccaauuuggcugc

SEQ ID NO: 1983338 - RNA, 21 nt, Shigella flexneri 2a str. 301
ugucgaucaucaggcccgcau

SEQ ID NO: 1983339 - RNA, 15 nt, Shigella flexneri 2a str. 301
ugucgaucuccgccu

SEQ ID NO: 1983340 - RNA, 15 nt, Shigella flexneri 2a str. 301
ugucgcauccggcaa

SEQ ID NO: 1983341 - RNA, 16 nt, Shigella flexneri 2a str. 301
ugucgcuguuucugga

SEQ ID NO: 1983342 - RNA, 19 nt, Shigella flexneri 2a str. 301
ugucgacggaauaaaccca

SEQ ID NO: 1983343 - RNA, 17 nt, Shigella flexneri 2a str. 301
ugucggcccgcauuauu

SEQ ID NO: 1983344 - RNA, 16 nt, Shigella flexneri 2a str. 301
ugucggcggauaauaa

SEQ ID NO: 1983345 - RNA, 15 nt, Shigella flexneri 2a str. 301
ugucggcaagauacu

SEQ ID NO: 1983346 - RNA, 13 nt, Shigella flexneri 2a str. 301
ugucggcacugac

SEQ ID NO: 1983347 - RNA, 14 nt, Shigella flexneri 2a str. 301
ugucuccacuauaa

SEQ ID NO: 1983348 - RNA, 13 nt, Shigella flexneri 2a str. 301
ugucucagcuuca

SEQ ID NO: 1983349 - RNA, 20 nt, Shigella flexneri 2a str. 301
ugucuaacccgcgacuggcg

SEQ ID NO: 1983350 - RNA, 18 nt, Shigella flexneri 2a str. 301
ugucguuuccauggacga

SEQ ID NO: 1983351 - RNA, 12 nt, Shigella flexneri 2a str. 301
ugucuuuacccg

SEQ ID NO: 1983352 - RNA, 15 nt, Shigella flexneri 2a str. 301
ugucuuuacccggac

SEQ ID NO: 1983353 - RNA, 17 nt, Shigella flexneri 2a str. 301
ugugaacgagaaaauga

SEQ ID NO: 1983354 - RNA, 14 nt, Shigella flexneri 2a str. 301
ugugaaccucacag

SEQ ID NO: 1983355 - RNA, 23 nt, Shigella flexneri 2a str. 301
ugucuuuugaucugcuaaacgua

SEQ ID NO: 1983356 - RNA, 17 nt, Shigella flexneri 2a str. 301
ugucuuuuuacucccgc

SEQ ID NO: 1983357 - RNA, 17 nt, Shigella flexneri 2a str. 301
ugugcaaauucaauaaa

SEQ ID NO: 1983358 - RNA, 15 nt, Shigella flexneri 2a str. 301
ugugcaaccuuuucc

SEQ ID NO: 1983359 - RNA, 19 nt, Shigella flexneri 2a str. 301
ugugcacgugccagauguu

SEQ ID NO: 1983360 - RNA, 16 nt, Shigella flexneri 2a str. 301
ugugcacgaggcuggc

SEQ ID NO: 1983361 - RNA, 19 nt, Shigella flexneri 2a str. 301
ugugccagcucgugcagaa

SEQ ID NO: 1983362 - RNA, 12 nt, Shigella flexneri 2a str. 301
ugugccagaacc

SEQ ID NO: 1983363 - RNA, 18 nt, Shigella flexneri 2a str. 301
ugugccgcgaugauuggg

SEQ ID NO: 1983364 - RNA, 16 nt, Shigella flexneri 2a str. 301
ugugcccguaaaaaau

SEQ ID NO: 1983365 - RNA, 20 nt, Shigella flexneri 2a str. 301
ugugcccguaaaaaauggcu

SEQ ID NO: 1983366 - RNA, 12 nt, Shigella flexneri 2a str. 301
ugugauggaccg

SEQ ID NO: 1983367 - RNA, 15 nt, Shigella flexneri 2a str. 301
ugugaucuuuuucgc

SEQ ID NO: 1983368 - RNA, 14 nt, Shigella flexneri 2a str. 301
ugggcuucauccag

SEQ ID NO: 1983369 - RNA, 16 nt, Shigella flexneri 2a str. 301
ugggcuucauccagca

SEQ ID NO: 1983370 - RNA, 17 nt, Shigella flexneri 2a str. 301
ugggcuucauccagcag

SEQ ID NO: 1983371 - RNA, 24 nt, Shigella flexneri 2a str. 301
ugggcuguucaccacugaauaaca

SEQ ID NO: 1983372 - RNA, 15 nt, Shigella flexneri 2a str. 301
ugggcgauuuccuuc

SEQ ID NO: 1983373 - RNA, 13 nt, Shigella flexneri 2a str. 301
ugggcgaagagaa

SEQ ID NO: 1983374 - RNA, 20 nt, Shigella flexneri 2a str. 301
ugggcgaagagaaagaacga

SEQ ID NO: 1983375 - RNA, 15 nt, Shigella flexneri 2a str. 301
uggguaaugcuguga

SEQ ID NO: 1983376 - RNA, 22 nt, Shigella flexneri 2a str. 301
ugggguugcagaaacaaccuga

SEQ ID NO: 1983377 - RNA, 15 nt, Shigella flexneri 2a str. 301
ugggcuucuuuauga

SEQ ID NO: 1983378 - RNA, 16 nt, Shigella flexneri 2a str. 301
uggggaaaaacacaaa

SEQ ID NO: 1983379 - RNA, 18 nt, Shigella flexneri 2a str. 301
ugggcaguugcgcgcgca

SEQ ID NO: 1983380 - RNA, 20 nt, Shigella flexneri 2a str. 301
ugggcaggccuggguaaaaa

SEQ ID NO: 1983381 - RNA, 17 nt, Shigella flexneri 2a str. 301
ugggcaucggcaaucac

SEQ ID NO: 1983382 - RNA, 18 nt, Shigella flexneri 2a str. 301
ugggcaugauacugaugu

SEQ ID NO: 1983383 - RNA, 16 nt, Shigella flexneri 2a str. 301
ugggccagaaaaaacg

SEQ ID NO: 1983384 - RNA, 20 nt, Shigella flexneri 2a str. 301
uggcugcgcgaaaacccucg

SEQ ID NO: 1983385 - RNA, 19 nt, Shigella flexneri 2a str. 301
uggcugcgcgaaaacccuc

SEQ ID NO: 1983386 - RNA, 19 nt, Shigella flexneri 2a str. 301
uggcuggccccgucagcaa

SEQ ID NO: 1983387 - RNA, 16 nt, Shigella flexneri 2a str. 301
uggcuggaacaacgug

SEQ ID NO: 1983388 - RNA, 15 nt, Shigella flexneri 2a str. 301
uggcugauauuaagc

SEQ ID NO: 1983389 - RNA, 21 nt, Shigella flexneri 2a str. 301
uggcugacauaaacaccagca

SEQ ID NO: 1983390 - RNA, 23 nt, Shigella flexneri 2a str. 301
uggcugagcaaacaguucugcag

SEQ ID NO: 1983391 - RNA, 15 nt, Shigella flexneri 2a str. 301
uggcugagcacuauc

SEQ ID NO: 1983392 - RNA, 16 nt, Shigella flexneri 2a str. 301
uggcugcaaagcauuu

SEQ ID NO: 1983393 - RNA, 21 nt, Shigella flexneri 2a str. 301
uggcugauuaacguuuccauu

SEQ ID NO: 1983394 - RNA, 15 nt, Shigella flexneri 2a str. 301
uggcucgccauccag

SEQ ID NO: 1983395 - RNA, 20 nt, Shigella flexneri 2a str. 301
uggcugacauaaacaccagc

SEQ ID NO: 1983396 - RNA, 21 nt, Shigella flexneri 2a str. 301
uggcugacugucgcagccagc

SEQ ID NO: 1983397 - RNA, 21 nt, Shigella flexneri 2a str. 301
ugggaacaguacauuguuuuc

SEQ ID NO: 1983398 - RNA, 18 nt, Shigella flexneri 2a str. 301
uggcuguuuucagcacca

SEQ ID NO: 1983399 - RNA, 16 nt, Shigella flexneri 2a str. 301
uggcugugcguuaccc

SEQ ID NO: 1983400 - RNA, 14 nt, Shigella flexneri 2a str. 301
ugggaaggugcgga

SEQ ID NO: 1983401 - RNA, 13 nt, Shigella flexneri 2a str. 301
ugggaagccucca

SEQ ID NO: 1983402 - RNA, 22 nt, Shigella flexneri 2a str. 301
uggcgcgaagcccucaaacaac

SEQ ID NO: 1983403 - RNA, 17 nt, Shigella flexneri 2a str. 301
uggcguaaagccuuuua

SEQ ID NO: 1983404 - RNA, 19 nt, Shigella flexneri 2a str. 301
uggcucaaucgccaccacc

SEQ ID NO: 1983405 - RNA, 21 nt, Shigella flexneri 2a str. 301
uggcucaagcaccauccuguu

SEQ ID NO: 1983406 - RNA, 16 nt, Shigella flexneri 2a str. 301
uggcucaucaagcaca

SEQ ID NO: 1983407 - RNA, 16 nt, Shigella flexneri 2a str. 301
uggcucaucaaacaac

SEQ ID NO: 1983408 - RNA, 13 nt, Shigella flexneri 2a str. 301
uggcucaccagca

SEQ ID NO: 1983409 - RNA, 21 nt, Shigella flexneri 2a str. 301
uggcuauaaaugaacugggca

SEQ ID NO: 1983410 - RNA, 18 nt, Shigella flexneri 2a str. 301
uggcuauaaucacucaaa

SEQ ID NO: 1983411 - RNA, 22 nt, Shigella flexneri 2a str. 301
uggcuaaucggcugcagugcaa

SEQ ID NO: 1983412 - RNA, 20 nt, Shigella flexneri 2a str. 301
uggcguccgugccuuuacca

SEQ ID NO: 1983413 - RNA, 21 nt, Shigella flexneri 2a str. 301
uggcgcaaguuacuccuggua

SEQ ID NO: 1983414 - RNA, 20 nt, Shigella flexneri 2a str. 301
uggcgcaccuuuuuuuaugc

SEQ ID NO: 1983415 - RNA, 19 nt, Shigella flexneri 2a str. 301
uggcgcaucggucagaccc

SEQ ID NO: 1983416 - RNA, 13 nt, Shigella flexneri 2a str. 301
uggcgcauccagc

SEQ ID NO: 1983417 - RNA, 16 nt, Shigella flexneri 2a str. 301
uggcgauguaauucag

SEQ ID NO: 1983418 - RNA, 19 nt, Shigella flexneri 2a str. 301
uggcgauuuugaagucuuu

SEQ ID NO: 1983419 - RNA, 20 nt, Shigella flexneri 2a str. 301
uggcgacggcgaaucaaccg

SEQ ID NO: 1983420 - RNA, 15 nt, Shigella flexneri 2a str. 301
uggcgacuucugcuu

SEQ ID NO: 1983421 - RNA, 14 nt, Shigella flexneri 2a str. 301
uggccuggcuggug

SEQ ID NO: 1983422 - RNA, 17 nt, Shigella flexneri 2a str. 301
uggcccuaggcauagaa

SEQ ID NO: 1983423 - RNA, 16 nt, Shigella flexneri 2a str. 301
uggacgcgccaacaaa

SEQ ID NO: 1983424 - RNA, 21 nt, Shigella flexneri 2a str. 301
uggacgccguauucacuuuca

SEQ ID NO: 1983425 - RNA, 22 nt, Shigella flexneri 2a str. 301
uggacgccguauucacuuucaa

SEQ ID NO: 1983426 - RNA, 19 nt, Shigella flexneri 2a str. 301
uggacgccguuuaaaggga

SEQ ID NO: 1983427 - RNA, 17 nt, Shigella flexneri 2a str. 301
uggagagagcccuggau

SEQ ID NO: 1983428 - RNA, 18 nt, Shigella flexneri 2a str. 301
uggagaguugcaccagca

SEQ ID NO: 1983429 - RNA, 20 nt, Shigella flexneri 2a str. 301
uggagaguugcaccagcaac

SEQ ID NO: 1983430 - RNA, 20 nt, Shigella flexneri 2a str. 301
uggagcacauugccugaugc

SEQ ID NO: 1983431 - RNA, 13 nt, Shigella flexneri 2a str. 301
uggagcaggaaua

SEQ ID NO: 1983432 - RNA, 17 nt, Shigella flexneri 2a str. 301
uggagcuaaacagcgcu

SEQ ID NO: 1983433 - RNA, 22 nt, Shigella flexneri 2a str. 301
uggagggaaauuaaaugguuaa

SEQ ID NO: 1983434 - RNA, 15 nt, Shigella flexneri 2a str. 301
uggaucccucuuucu

SEQ ID NO: 1983435 - RNA, 18 nt, Shigella flexneri 2a str. 301
uggaucccagaagaauau

SEQ ID NO: 1983436 - RNA, 18 nt, Shigella flexneri 2a str. 301
uggaucguaucgucaaca

SEQ ID NO: 1983437 - RNA, 22 nt, Shigella flexneri 2a str. 301
uggaucaaggauugcagcacug

SEQ ID NO: 1983438 - RNA, 20 nt, Shigella flexneri 2a str. 301
uggaugcaaucacaaauaga

SEQ ID NO: 1983439 - RNA, 22 nt, Shigella flexneri 2a str. 301
uggaugcaaucacaaauagacg

SEQ ID NO: 1983440 - RNA, 21 nt, Shigella flexneri 2a str. 301
uggaugcgccauaccaugcac

SEQ ID NO: 1983441 - RNA, 15 nt, Shigella flexneri 2a str. 301
uggaugcggaaccau

SEQ ID NO: 1983442 - RNA, 21 nt, Shigella flexneri 2a str. 301
uggauaagaugcuacaacauc

SEQ ID NO: 1983443 - RNA, 13 nt, Shigella flexneri 2a str. 301
uggaucaagcccc

SEQ ID NO: 1983444 - RNA, 14 nt, Shigella flexneri 2a str. 301
uggauauuuuaauc

SEQ ID NO: 1983445 - RNA, 14 nt, Shigella flexneri 2a str. 301
uggaucaaaucucg

SEQ ID NO: 1983446 - RNA, 16 nt, Shigella flexneri 2a str. 301
uggaucaacaggcacu

SEQ ID NO: 1983447 - RNA, 13 nt, Shigella flexneri 2a str. 301
uggauaggcaccg

SEQ ID NO: 1983448 - RNA, 21 nt, Shigella flexneri 2a str. 301
uggauaacguuuaucccaguc

SEQ ID NO: 1983449 - RNA, 22 nt, Shigella flexneri 2a str. 301
uggauaaacacucgcuguggca

SEQ ID NO: 1983450 - RNA, 10 nt, Shigella flexneri 2a str. 301
uggcaagcag

SEQ ID NO: 1983451 - RNA, 16 nt, Shigella flexneri 2a str. 301
uggcaagcccagcacc

SEQ ID NO: 1983452 - RNA, 18 nt, Shigella flexneri 2a str. 301
uggcaacgacgguaaacc

SEQ ID NO: 1983453 - RNA, 16 nt, Shigella flexneri 2a str. 301
uggcaacuuuaauaau

SEQ ID NO: 1983454 - RNA, 15 nt, Shigella flexneri 2a str. 301
uggcagaaacagcca

SEQ ID NO: 1983455 - RNA, 18 nt, Shigella flexneri 2a str. 301
uggcagaaacagccauaa

SEQ ID NO: 1983456 - RNA, 19 nt, Shigella flexneri 2a str. 301
uggcagaaacagccauaac

SEQ ID NO: 1983457 - RNA, 15 nt, Shigella flexneri 2a str. 301
uggcacucaacaacc

SEQ ID NO: 1983458 - RNA, 16 nt, Shigella flexneri 2a str. 301
uggcaauaaagacauc

SEQ ID NO: 1983459 - RNA, 18 nt, Shigella flexneri 2a str. 301
uggcacguaccaugcgca

SEQ ID NO: 1983460 - RNA, 23 nt, Shigella flexneri 2a str. 301
uggcagguaaucggcauuggcau

SEQ ID NO: 1983461 - RNA, 14 nt, Shigella flexneri 2a str. 301
uggcagucuggccu

SEQ ID NO: 1983462 - RNA, 20 nt, Shigella flexneri 2a str. 301
uggcaguagcgccucuucca

SEQ ID NO: 1983463 - RNA, 13 nt, Shigella flexneri 2a str. 301
uggcagucuuaau

SEQ ID NO: 1983464 - RNA, 23 nt, Shigella flexneri 2a str. 301
uggcagugggccagaaaaaacgu

SEQ ID NO: 1983465 - RNA, 21 nt, Shigella flexneri 2a str. 301
uggcagaugcuuuaaucaucc

SEQ ID NO: 1983466 - RNA, 17 nt, Shigella flexneri 2a str. 301
uggcagauacauugcca

SEQ ID NO: 1983467 - RNA, 19 nt, Shigella flexneri 2a str. 301
uggcagaguaucgccaucc

SEQ ID NO: 1983468 - RNA, 22 nt, Shigella flexneri 2a str. 301
uggauuagcgaccgaacagauc

SEQ ID NO: 1983469 - RNA, 13 nt, Shigella flexneri 2a str. 301
uggauuaaauugc

SEQ ID NO: 1983470 - RNA, 20 nt, Shigella flexneri 2a str. 301
uggcaaccuucuucuuucag

SEQ ID NO: 1983471 - RNA, 15 nt, Shigella flexneri 2a str. 301
uggcaacgcgccgcc

SEQ ID NO: 1983472 - RNA, 16 nt, Shigella flexneri 2a str. 301
uggcaacgcgccgcca

SEQ ID NO: 1983473 - RNA, 13 nt, Shigella flexneri 2a str. 301
uggcauccuugcu

SEQ ID NO: 1983474 - RNA, 22 nt, Shigella flexneri 2a str. 301
uggcaucaaacacugaaccgaa

SEQ ID NO: 1983475 - RNA, 18 nt, Shigella flexneri 2a str. 301
uggcauaaacaaagcgca

SEQ ID NO: 1983476 - RNA, 22 nt, Shigella flexneri 2a str. 301
uggcauaaacaaagcgcacuau

SEQ ID NO: 1983477 - RNA, 18 nt, Shigella flexneri 2a str. 301
uggcaucugauaagccca

SEQ ID NO: 1983478 - RNA, 20 nt, Shigella flexneri 2a str. 301
uggcaucugauaagcccagc

SEQ ID NO: 1983479 - RNA, 18 nt, Shigella flexneri 2a str. 301
uggcauguccuucuucug

SEQ ID NO: 1983480 - RNA, 17 nt, Shigella flexneri 2a str. 301
uggcauuaauaugcuca

SEQ ID NO: 1983481 - RNA, 14 nt, Shigella flexneri 2a str. 301
uggcauucucacuc

SEQ ID NO: 1983482 - RNA, 21 nt, Shigella flexneri 2a str. 301
uggcccaguugauucgcgcgu

SEQ ID NO: 1983483 - RNA, 16 nt, Shigella flexneri 2a str. 301
uggcccagccuuuccu

SEQ ID NO: 1983484 - RNA, 14 nt, Shigella flexneri 2a str. 301
uggcccaaaaggca

SEQ ID NO: 1983485 - RNA, 14 nt, Shigella flexneri 2a str. 301
uggccagagugcgu

SEQ ID NO: 1983486 - RNA, 19 nt, Shigella flexneri 2a str. 301
uggccacuucuguuacucc

SEQ ID NO: 1983487 - RNA, 18 nt, Shigella flexneri 2a str. 301
uuaacuccuucuaaagca

SEQ ID NO: 1983488 - RNA, 14 nt, Shigella flexneri 2a str. 301
uuaagacacacuau

SEQ ID NO: 1983489 - RNA, 17 nt, Shigella flexneri 2a str. 301
uuaacguuacuaauaaa

SEQ ID NO: 1983490 - RNA, 14 nt, Shigella flexneri 2a str. 301
uuaagccgcugugu

SEQ ID NO: 1983491 - RNA, 13 nt, Shigella flexneri 2a str. 301
uuaagcucagaaa

SEQ ID NO: 1983492 - RNA, 14 nt, Shigella flexneri 2a str. 301
ugugccguaaccaa

SEQ ID NO: 1983493 - RNA, 18 nt, Shigella flexneri 2a str. 301
ugugcuuuacaccaugcc

SEQ ID NO: 1983494 - RNA, 23 nt, Shigella flexneri 2a str. 301
ugugcuuucaguucuagaacuaa

SEQ ID NO: 1983495 - RNA, 17 nt, Shigella flexneri 2a str. 301
uuaaccacuucagaacc

SEQ ID NO: 1983496 - RNA, 12 nt, Shigella flexneri 2a str. 301
uuaacccauuuu

SEQ ID NO: 1983497 - RNA, 19 nt, Shigella flexneri 2a str. 301
uuaaccgugggaaacagua

SEQ ID NO: 1983498 - RNA, 14 nt, Shigella flexneri 2a str. 301
uuaacgguaagcgc

SEQ ID NO: 1983499 - RNA, 20 nt, Shigella flexneri 2a str. 301
uuaacguaaguuagaggcac

SEQ ID NO: 1983500 - RNA, 14 nt, Shigella flexneri 2a str. 301
uuaaucaacucacg

SEQ ID NO: 1983501 - RNA, 23 nt, Shigella flexneri 2a str. 301
uuaaucaagaaaccgaaguugua

SEQ ID NO: 1983502 - RNA, 13 nt, Shigella flexneri 2a str. 301
uuaaucaccagcg

SEQ ID NO: 1983503 - RNA, 19 nt, Shigella flexneri 2a str. 301
uuaaucguugucuuacuuu

SEQ ID NO: 1983504 - RNA, 22 nt, Shigella flexneri 2a str. 301
uuaaucgccguauaauaucuuu

SEQ ID NO: 1983505 - RNA, 15 nt, Shigella flexneri 2a str. 301
uuaaucgcggcuggc

SEQ ID NO: 1983506 - RNA, 18 nt, Shigella flexneri 2a str. 301
uuaauauuaacuuaauaa

SEQ ID NO: 1983507 - RNA, 19 nt, Shigella flexneri 2a str. 301
uuaagcuuuccggcaucac

SEQ ID NO: 1983508 - RNA, 15 nt, Shigella flexneri 2a str. 301
uuaaggaaaaacgaa

SEQ ID NO: 1983509 - RNA, 13 nt, Shigella flexneri 2a str. 301
uuaaguuuauccc

SEQ ID NO: 1983510 - RNA, 17 nt, Shigella flexneri 2a str. 301
uuaauaacacauauauu

SEQ ID NO: 1983511 - RNA, 18 nt, Shigella flexneri 2a str. 301
uuaauaacacauauauua

SEQ ID NO: 1983512 - RNA, 18 nt, Shigella flexneri 2a str. 301
uuaauaacgacauauaca

SEQ ID NO: 1983513 - RNA, 19 nt, Shigella flexneri 2a str. 301
uuaauugaaccuaagcuuu

SEQ ID NO: 1983514 - RNA, 23 nt, Shigella flexneri 2a str. 301
uuaauucugagagcaugaaauga

SEQ ID NO: 1983515 - RNA, 21 nt, Shigella flexneri 2a str. 301
uuaauugcccgaagccaauuu

SEQ ID NO: 1983516 - RNA, 20 nt, Shigella flexneri 2a str. 301
uuaauugcccgaagccaauu

SEQ ID NO: 1983517 - RNA, 17 nt, Shigella flexneri 2a str. 301
uuaauugccguuaaaac

SEQ ID NO: 1983518 - RNA, 19 nt, Shigella flexneri 2a str. 301
uuaauugccguuaaaacua

SEQ ID NO: 1983519 - RNA, 16 nt, Shigella flexneri 2a str. 301
uuaauucauacaucgc

SEQ ID NO: 1983520 - RNA, 14 nt, Shigella flexneri 2a str. 301
uuaauuccggugaa

SEQ ID NO: 1983521 - RNA, 19 nt, Shigella flexneri 2a str. 301
uuaauuauccccucaaccu

SEQ ID NO: 1983522 - RNA, 23 nt, Shigella flexneri 2a str. 301
uuaaugcauggcagauaaacaac

SEQ ID NO: 1983523 - RNA, 23 nt, Shigella flexneri 2a str. 301
uuaaugcggcaguaagcgcggcu

SEQ ID NO: 1983524 - RNA, 17 nt, Shigella flexneri 2a str. 301
uuaaugcgcuuccugca

SEQ ID NO: 1983525 - RNA, 20 nt, Shigella flexneri 2a str. 301
uuaauggcgauaaucgaacc

SEQ ID NO: 1983526 - RNA, 22 nt, Shigella flexneri 2a str. 301
uuaauguuguaagcuugacaua

SEQ ID NO: 1983527 - RNA, 19 nt, Shigella flexneri 2a str. 301
uuacaggcaguaaccaaaa

SEQ ID NO: 1983528 - RNA, 13 nt, Shigella flexneri 2a str. 301
uuacagccugcca

SEQ ID NO: 1983529 - RNA, 22 nt, Shigella flexneri 2a str. 301
uuacagccugccagcaugcaua

SEQ ID NO: 1983530 - RNA, 21 nt, Shigella flexneri 2a str. 301
uuacagcaacgggcugaagaa

SEQ ID NO: 1983531 - RNA, 22 nt, Shigella flexneri 2a str. 301
uuacaauuuacguuuuaaaccu

SEQ ID NO: 1983532 - RNA, 15 nt, Shigella flexneri 2a str. 301
uuaauuucgacgggc

SEQ ID NO: 1983533 - RNA, 18 nt, Shigella flexneri 2a str. 301
uuaauuucgacgggcugg

SEQ ID NO: 1983534 - RNA, 12 nt, Shigella flexneri 2a str. 301
uuacaguuucug

SEQ ID NO: 1983535 - RNA, 19 nt, Shigella flexneri 2a str. 301
uuaccacaccggcaauaau

SEQ ID NO: 1983536 - RNA, 22 nt, Shigella flexneri 2a str. 301
uuacauuaucgcgucuaaauuu

SEQ ID NO: 1983537 - RNA, 20 nt, Shigella flexneri 2a str. 301
uuacaugcgcgacaaaaauu

SEQ ID NO: 1983538 - RNA, 18 nt, Shigella flexneri 2a str. 301
uuacaugcgcgacaaaaa

SEQ ID NO: 1983539 - RNA, 21 nt, Shigella flexneri 2a str. 301
uuacaugcgcgacaaaaauua

SEQ ID NO: 1983540 - RNA, 19 nt, Shigella flexneri 2a str. 301
uuacaugcugguguaacuu

SEQ ID NO: 1983541 - RNA, 16 nt, Shigella flexneri 2a str. 301
uuacaucuacaaaaaa

SEQ ID NO: 1983542 - RNA, 23 nt, Shigella flexneri 2a str. 301
uuacaggguaaaaccaugccauc

SEQ ID NO: 1983543 - RNA, 21 nt, Shigella flexneri 2a str. 301
uuacaguaugagcaaacaaua

SEQ ID NO: 1983544 - RNA, 12 nt, Shigella flexneri 2a str. 301
uuaguaucuauu

SEQ ID NO: 1983545 - RNA, 18 nt, Shigella flexneri 2a str. 301
uuagucaauuaaaaaauu

SEQ ID NO: 1983546 - RNA, 13 nt, Shigella flexneri 2a str. 301
uuaguaugaagaa

SEQ ID NO: 1983547 - RNA, 19 nt, Shigella flexneri 2a str. 301
uuaguaaacgcguagaucu

SEQ ID NO: 1983548 - RNA, 15 nt, Shigella flexneri 2a str. 301
uuaguaacaacggau

SEQ ID NO: 1983549 - RNA, 16 nt, Shigella flexneri 2a str. 301
uuaguuuuauacucag

SEQ ID NO: 1983550 - RNA, 21 nt, Shigella flexneri 2a str. 301
uuagugcugcuggaagguaag

SEQ ID NO: 1983551 - RNA, 12 nt, Shigella flexneri 2a str. 301
uuagucugcauu

SEQ ID NO: 1983552 - RNA, 16 nt, Shigella flexneri 2a str. 301
uuagucugcauuuucu

SEQ ID NO: 1983553 - RNA, 18 nt, Shigella flexneri 2a str. 301
uuaguggcaaccacaacc

SEQ ID NO: 1983554 - RNA, 14 nt, Shigella flexneri 2a str. 301
uuauaaauaaaaau

SEQ ID NO: 1983555 - RNA, 13 nt, Shigella flexneri 2a str. 301
uuauaaacguucc

SEQ ID NO: 1983556 - RNA, 16 nt, Shigella flexneri 2a str. 301
uuauaaucuuuaaaaa

SEQ ID NO: 1983557 - RNA, 19 nt, Shigella flexneri 2a str. 301
uuauaaucuuuaaaaaaag

SEQ ID NO: 1983558 - RNA, 15 nt, Shigella flexneri 2a str. 301
uuauacucagucagg

SEQ ID NO: 1983559 - RNA, 15 nt, Shigella flexneri 2a str. 301
uuauacaucgcuuuc

SEQ ID NO: 1983560 - RNA, 17 nt, Shigella flexneri 2a str. 301
uuacgugcacaggcaac

SEQ ID NO: 1983561 - RNA, 21 nt, Shigella flexneri 2a str. 301
uuacguggguaggaucacaag

SEQ ID NO: 1983562 - RNA, 15 nt, Shigella flexneri 2a str. 301
uuacguuacccagca

SEQ ID NO: 1983563 - RNA, 14 nt, Shigella flexneri 2a str. 301
uuaccgccaccagg

SEQ ID NO: 1983564 - RNA, 16 nt, Shigella flexneri 2a str. 301
uuaccgcaaagcccac

SEQ ID NO: 1983565 - RNA, 22 nt, Shigella flexneri 2a str. 301
uuaccgauccccggauucaugc

SEQ ID NO: 1983566 - RNA, 17 nt, Shigella flexneri 2a str. 301
uuaccgcaccaccagca

SEQ ID NO: 1983567 - RNA, 17 nt, Shigella flexneri 2a str. 301
uuacccggacacucggc

SEQ ID NO: 1983568 - RNA, 21 nt, Shigella flexneri 2a str. 301
uuacucauccacugccuguca

SEQ ID NO: 1983569 - RNA, 13 nt, Shigella flexneri 2a str. 301
uuacucauaaaua

SEQ ID NO: 1983570 - RNA, 16 nt, Shigella flexneri 2a str. 301
uuacguuuuaaaccua

SEQ ID NO: 1983571 - RNA, 17 nt, Shigella flexneri 2a str. 301
uuacguuuccgcuauca

SEQ ID NO: 1983572 - RNA, 23 nt, Shigella flexneri 2a str. 301
uuacguuucucugcuaauuuauc

SEQ ID NO: 1983573 - RNA, 22 nt, Shigella flexneri 2a str. 301
uuacuaauaaaucgugaaacaa

SEQ ID NO: 1983574 - RNA, 23 nt, Shigella flexneri 2a str. 301
uuacuugcugcucugaagguugu

SEQ ID NO: 1983575 - RNA, 17 nt, Shigella flexneri 2a str. 301
uuacuggcuuucauuuu

SEQ ID NO: 1983576 - RNA, 16 nt, Shigella flexneri 2a str. 301
uuacuucucgauaaac

SEQ ID NO: 1983577 - RNA, 12 nt, Shigella flexneri 2a str. 301
uuacuuuauuua

SEQ ID NO: 1983578 - RNA, 12 nt, Shigella flexneri 2a str. 301
uuacuuuccuua

SEQ ID NO: 1983579 - RNA, 13 nt, Shigella flexneri 2a str. 301
uuacugacugucc

SEQ ID NO: 1983580 - RNA, 22 nt, Shigella flexneri 2a str. 301
uuacugagauggcuucauccca

SEQ ID NO: 1983581 - RNA, 11 nt, Shigella flexneri 2a str. 301
uuacuccagau

SEQ ID NO: 1983582 - RNA, 16 nt, Shigella flexneri 2a str. 301
uuacuccacuuccugc

SEQ ID NO: 1983583 - RNA, 20 nt, Shigella flexneri 2a str. 301
uuacucccgugccagagcau

SEQ ID NO: 1983584 - RNA, 20 nt, Shigella flexneri 2a str. 301
uuacugcauugaauuucuau

SEQ ID NO: 1983585 - RNA, 15 nt, Shigella flexneri 2a str. 301
uuacugcagccagcg

SEQ ID NO: 1983586 - RNA, 12 nt, Shigella flexneri 2a str. 301
uuacugcauuca

SEQ ID NO: 1983587 - RNA, 15 nt, Shigella flexneri 2a str. 301
uuacugccaccaucc

SEQ ID NO: 1983588 - RNA, 18 nt, Shigella flexneri 2a str. 301
uuacuggaguuauucauu

SEQ ID NO: 1983589 - RNA, 22 nt, Shigella flexneri 2a str. 301
uuacuggcggguuuuuuauuua

SEQ ID NO: 1983590 - RNA, 13 nt, Shigella flexneri 2a str. 301
uuagggugagggg

SEQ ID NO: 1983591 - RNA, 21 nt, Shigella flexneri 2a str. 301
uuagcaucagcgccaccagcg

SEQ ID NO: 1983592 - RNA, 14 nt, Shigella flexneri 2a str. 301
uuagcccaauaauc

SEQ ID NO: 1983593 - RNA, 13 nt, Shigella flexneri 2a str. 301
uuagccauaaaac

SEQ ID NO: 1983594 - RNA, 15 nt, Shigella flexneri 2a str. 301
uuagccggauaaaca

SEQ ID NO: 1983595 - RNA, 23 nt, Shigella flexneri 2a str. 301
uuagacuuuagucaucagucuga

SEQ ID NO: 1983596 - RNA, 13 nt, Shigella flexneri 2a str. 301
uuagacuuuaguc

SEQ ID NO: 1983597 - RNA, 19 nt, Shigella flexneri 2a str. 301
uuagacggcgcaacauccg

SEQ ID NO: 1983598 - RNA, 16 nt, Shigella flexneri 2a str. 301
uuagcaucagcgccac

SEQ ID NO: 1983599 - RNA, 20 nt, Shigella flexneri 2a str. 301
uuagcagcaugauaucaaaa

SEQ ID NO: 1983600 - RNA, 16 nt, Shigella flexneri 2a str. 301
uucaacgcggcgcugc

SEQ ID NO: 1983601 - RNA, 23 nt, Shigella flexneri 2a str. 301
uucaagacgaauaccuucuuccu

SEQ ID NO: 1983602 - RNA, 22 nt, Shigella flexneri 2a str. 301
uucaacgccccauuuuuaauaa

SEQ ID NO: 1983603 - RNA, 22 nt, Shigella flexneri 2a str. 301
uucaagacgaauaccuucuucc

SEQ ID NO: 1983604 - RNA, 18 nt, Shigella flexneri 2a str. 301
uucaagaauuaaaauauc

SEQ ID NO: 1983605 - RNA, 19 nt, Shigella flexneri 2a str. 301
uucaagccaggcuuuaaau

SEQ ID NO: 1983606 - RNA, 23 nt, Shigella flexneri 2a str. 301
uucaauaccgccugcaaauaaau

SEQ ID NO: 1983607 - RNA, 21 nt, Shigella flexneri 2a str. 301
uucaauaccgccugcaaauaa

SEQ ID NO: 1983608 - RNA, 18 nt, Shigella flexneri 2a str. 301
uucaauaccgccugcaaa

SEQ ID NO: 1983609 - RNA, 16 nt, Shigella flexneri 2a str. 301
uucaauaaccugcaaa

SEQ ID NO: 1983610 - RNA, 22 nt, Shigella flexneri 2a str. 301
uucaauaaccugcaaaauaguc

SEQ ID NO: 1983611 - RNA, 18 nt, Shigella flexneri 2a str. 301
uucaauaaauugcaggaa

SEQ ID NO: 1983612 - RNA, 15 nt, Shigella flexneri 2a str. 301
uucaacgaagaaaac

SEQ ID NO: 1983613 - RNA, 23 nt, Shigella flexneri 2a str. 301
uucaaacacccgaccaucaacua

SEQ ID NO: 1983614 - RNA, 18 nt, Shigella flexneri 2a str. 301
uucaacaucaucucccac

SEQ ID NO: 1983615 - RNA, 16 nt, Shigella flexneri 2a str. 301
uucaaaagaugagaaa

SEQ ID NO: 1983616 - RNA, 16 nt, Shigella flexneri 2a str. 301
uucaaaaacuaauuca

SEQ ID NO: 1983617 - RNA, 17 nt, Shigella flexneri 2a str. 301
uuauuuggugaauauga

SEQ ID NO: 1983618 - RNA, 14 nt, Shigella flexneri 2a str. 301
uuauuucucacuuu

SEQ ID NO: 1983619 - RNA, 16 nt, Shigella flexneri 2a str. 301
uuauuguuugucauga

SEQ ID NO: 1983620 - RNA, 19 nt, Shigella flexneri 2a str. 301
uucacaggccgccaggcag

SEQ ID NO: 1983621 - RNA, 23 nt, Shigella flexneri 2a str. 301
uucacaggccgccaggcagagcu

SEQ ID NO: 1983622 - RNA, 12 nt, Shigella flexneri 2a str. 301
uucacaucauca

SEQ ID NO: 1983623 - RNA, 20 nt, Shigella flexneri 2a str. 301
uucacacugaugacaggcua

SEQ ID NO: 1983624 - RNA, 17 nt, Shigella flexneri 2a str. 301
uucacagaaggccagga

SEQ ID NO: 1983625 - RNA, 23 nt, Shigella flexneri 2a str. 301
uucacacccgguaucaaacccuu

SEQ ID NO: 1983626 - RNA, 17 nt, Shigella flexneri 2a str. 301
uucacacacuuuuauua

SEQ ID NO: 1983627 - RNA, 18 nt, Shigella flexneri 2a str. 301
uucaaucccgccaaugca

SEQ ID NO: 1983628 - RNA, 21 nt, Shigella flexneri 2a str. 301
uucaauauauugaauuugcau

SEQ ID NO: 1983629 - RNA, 22 nt, Shigella flexneri 2a str. 301
uucaauacgcuccaguaccugc

SEQ ID NO: 1983630 - RNA, 20 nt, Shigella flexneri 2a str. 301
uucaccucuucauuaaacca

SEQ ID NO: 1983631 - RNA, 12 nt, Shigella flexneri 2a str. 301
uucaccggugag

SEQ ID NO: 1983632 - RNA, 15 nt, Shigella flexneri 2a str. 301
uucacgaauauuucc

SEQ ID NO: 1983633 - RNA, 22 nt, Shigella flexneri 2a str. 301
uucacgagagauacgcuugccg

SEQ ID NO: 1983634 - RNA, 16 nt, Shigella flexneri 2a str. 301
uucaccuuuuuccaga

SEQ ID NO: 1983635 - RNA, 18 nt, Shigella flexneri 2a str. 301
uucacgaaaacagcgcag

SEQ ID NO: 1983636 - RNA, 23 nt, Shigella flexneri 2a str. 301
uucacgaaucuauucauuuaugu

SEQ ID NO: 1983637 - RNA, 15 nt, Shigella flexneri 2a str. 301
uucacgcaaggcaca

SEQ ID NO: 1983638 - RNA, 14 nt, Shigella flexneri 2a str. 301
uucacgcacuuccg

SEQ ID NO: 1983639 - RNA, 14 nt, Shigella flexneri 2a str. 301
uucaccgcuaaagc

SEQ ID NO: 1983640 - RNA, 19 nt, Shigella flexneri 2a str. 301
uucaccgauaaaagcccug

SEQ ID NO: 1983641 - RNA, 20 nt, Shigella flexneri 2a str. 301
uucaccguaauaguuucuga

SEQ ID NO: 1983642 - RNA, 22 nt, Shigella flexneri 2a str. 301
uucacaucauccggcaccuuuu

SEQ ID NO: 1983643 - RNA, 15 nt, Shigella flexneri 2a str. 301
uucacccaccggaau

SEQ ID NO: 1983644 - RNA, 21 nt, Shigella flexneri 2a str. 301
uucagcaacaaaauggcaaag

SEQ ID NO: 1983645 - RNA, 22 nt, Shigella flexneri 2a str. 301
uucagcaagcgauaauuuaugc

SEQ ID NO: 1983646 - RNA, 13 nt, Shigella flexneri 2a str. 301
uucagcagcccau

SEQ ID NO: 1983647 - RNA, 22 nt, Shigella flexneri 2a str. 301
uucagcaccgcgcuauuuuccu

SEQ ID NO: 1983648 - RNA, 11 nt, Shigella flexneri 2a str. 301
uucagcaauac

SEQ ID NO: 1983649 - RNA, 11 nt, Shigella flexneri 2a str. 301
uucagcaccag

SEQ ID NO: 1983650 - RNA, 12 nt, Shigella flexneri 2a str. 301
uucagcaccaga

SEQ ID NO: 1983651 - RNA, 13 nt, Shigella flexneri 2a str. 301
uucagaccaauaa

SEQ ID NO: 1983652 - RNA, 17 nt, Shigella flexneri 2a str. 301
uucagaccagacugcuc

SEQ ID NO: 1983653 - RNA, 17 nt, Shigella flexneri 2a str. 301
uucagaagcugaagcag

SEQ ID NO: 1983654 - RNA, 18 nt, Shigella flexneri 2a str. 301
uucagaauagacaaaaau

SEQ ID NO: 1983655 - RNA, 21 nt, Shigella flexneri 2a str. 301
uucacguugacgcauacagcc

SEQ ID NO: 1983656 - RNA, 17 nt, Shigella flexneri 2a str. 301
uucaggaugguauugga

SEQ ID NO: 1983657 - RNA, 13 nt, Shigella flexneri 2a str. 301
uucaggaugguau

SEQ ID NO: 1983658 - RNA, 20 nt, Shigella flexneri 2a str. 301
uucaggagaagcaucagccc

SEQ ID NO: 1983659 - RNA, 17 nt, Shigella flexneri 2a str. 301
uucagcuuauucaucaa

SEQ ID NO: 1983660 - RNA, 16 nt, Shigella flexneri 2a str. 301
uucaggaacaccgcac

SEQ ID NO: 1983661 - RNA, 16 nt, Shigella flexneri 2a str. 301
uucagccggaauaauc

SEQ ID NO: 1983662 - RNA, 15 nt, Shigella flexneri 2a str. 301
uucagccgucaucca

SEQ ID NO: 1983663 - RNA, 16 nt, Shigella flexneri 2a str. 301
uucagcucaagaaucu

SEQ ID NO: 1983664 - RNA, 16 nt, Shigella flexneri 2a str. 301
uucagcucgcuaaagc

SEQ ID NO: 1983665 - RNA, 20 nt, Shigella flexneri 2a str. 301
uucagcagcucaucaagcug

SEQ ID NO: 1983666 - RNA, 18 nt, Shigella flexneri 2a str. 301
uucagcagcggcacacaa

SEQ ID NO: 1983667 - RNA, 14 nt, Shigella flexneri 2a str. 301
uucagcagcggcac

SEQ ID NO: 1983668 - RNA, 21 nt, Shigella flexneri 2a str. 301
uuauggcuggcuggcaucuug

SEQ ID NO: 1983669 - RNA, 18 nt, Shigella flexneri 2a str. 301
uuaugguagugccgucag

SEQ ID NO: 1983670 - RNA, 13 nt, Shigella flexneri 2a str. 301
uuauggugcuagu

SEQ ID NO: 1983671 - RNA, 16 nt, Shigella flexneri 2a str. 301
uuauggcgauaucaaa

SEQ ID NO: 1983672 - RNA, 19 nt, Shigella flexneri 2a str. 301
uuauggcgauaucaaaaaa

SEQ ID NO: 1983673 - RNA, 23 nt, Shigella flexneri 2a str. 301
uuaugcaauagcgccugcugcug

SEQ ID NO: 1983674 - RNA, 14 nt, Shigella flexneri 2a str. 301
uuaugcaauauauu

SEQ ID NO: 1983675 - RNA, 21 nt, Shigella flexneri 2a str. 301
uuauggauaaaggccugccgc

SEQ ID NO: 1983676 - RNA, 18 nt, Shigella flexneri 2a str. 301
uuaugcucucguuaagua

SEQ ID NO: 1983677 - RNA, 22 nt, Shigella flexneri 2a str. 301
uuaugugguuaugccauuuucc

SEQ ID NO: 1983678 - RNA, 20 nt, Shigella flexneri 2a str. 301
uuauguucagccgucaucca

SEQ ID NO: 1983679 - RNA, 23 nt, Shigella flexneri 2a str. 301
uuaugugcuucuaccaugaugau

SEQ ID NO: 1983680 - RNA, 17 nt, Shigella flexneri 2a str. 301
uuauuaaauuuaauaau

SEQ ID NO: 1983681 - RNA, 18 nt, Shigella flexneri 2a str. 301
uuauuaaauuuaauaaua

SEQ ID NO: 1983682 - RNA, 14 nt, Shigella flexneri 2a str. 301
uuauuaauucuaaa

SEQ ID NO: 1983683 - RNA, 20 nt, Shigella flexneri 2a str. 301
uuaucuacagcauuuccuua

SEQ ID NO: 1983684 - RNA, 19 nt, Shigella flexneri 2a str. 301
uuaucucccuguaucccag

SEQ ID NO: 1983685 - RNA, 13 nt, Shigella flexneri 2a str. 301
uuaucuccuugcu

SEQ ID NO: 1983686 - RNA, 16 nt, Shigella flexneri 2a str. 301
uuaucgcgccaucaaa

SEQ ID NO: 1983687 - RNA, 15 nt, Shigella flexneri 2a str. 301
uuaucgcgccaucaa

SEQ ID NO: 1983688 - RNA, 17 nt, Shigella flexneri 2a str. 301
uuaucgcgcugaauaau

SEQ ID NO: 1983689 - RNA, 13 nt, Shigella flexneri 2a str. 301
uuaucgccuacca

SEQ ID NO: 1983690 - RNA, 20 nt, Shigella flexneri 2a str. 301
uuaucgcauuaucaaagaug

SEQ ID NO: 1983691 - RNA, 20 nt, Shigella flexneri 2a str. 301
uuaucgugaauucacucuau

SEQ ID NO: 1983692 - RNA, 24 nt, Shigella flexneri 2a str. 301
uuaucgugccuacacauuaucuca

SEQ ID NO: 1983693 - RNA, 23 nt, Shigella flexneri 2a str. 301
uuaucugaucaauauagauauca

SEQ ID NO: 1983694 - RNA, 15 nt, Shigella flexneri 2a str. 301
uuaucugcaauuacu

SEQ ID NO: 1983695 - RNA, 15 nt, Shigella flexneri 2a str. 301
uuaucuucccagccc

SEQ ID NO: 1983696 - RNA, 23 nt, Shigella flexneri 2a str. 301
uuaucuucgagauucuuaaaguc

SEQ ID NO: 1983697 - RNA, 11 nt, Shigella flexneri 2a str. 301
uuaucuucaca

SEQ ID NO: 1983698 - RNA, 13 nt, Shigella flexneri 2a str. 301
uuaugaucaucaa

SEQ ID NO: 1983699 - RNA, 14 nt, Shigella flexneri 2a str. 301
uuaugaguauuuaa

SEQ ID NO: 1983700 - RNA, 13 nt, Shigella flexneri 2a str. 301
uuaugaggaugca

SEQ ID NO: 1983701 - RNA, 23 nt, Shigella flexneri 2a str. 301
uuauagcauagcguugauuagac

SEQ ID NO: 1983702 - RNA, 14 nt, Shigella flexneri 2a str. 301
uuauagcaguaauu

SEQ ID NO: 1983703 - RNA, 19 nt, Shigella flexneri 2a str. 301
uuauagcaguaauugcagc

SEQ ID NO: 1983704 - RNA, 17 nt, Shigella flexneri 2a str. 301
uuauagcucaacgcugc

SEQ ID NO: 1983705 - RNA, 16 nt, Shigella flexneri 2a str. 301
uuauaucagugauaua

SEQ ID NO: 1983706 - RNA, 20 nt, Shigella flexneri 2a str. 301
uuauauauugggaucaaaaa

SEQ ID NO: 1983707 - RNA, 18 nt, Shigella flexneri 2a str. 301
uuauauccggugcaacug

SEQ ID NO: 1983708 - RNA, 20 nt, Shigella flexneri 2a str. 301
uuauaugaugaaacugauaa

SEQ ID NO: 1983709 - RNA, 14 nt, Shigella flexneri 2a str. 301
uuauaucucagaua

SEQ ID NO: 1983710 - RNA, 13 nt, Shigella flexneri 2a str. 301
uuaucaagauauu

SEQ ID NO: 1983711 - RNA, 13 nt, Shigella flexneri 2a str. 301
uuaucaaaucacc

SEQ ID NO: 1983712 - RNA, 17 nt, Shigella flexneri 2a str. 301
uuauccggcuaacaaaa

SEQ ID NO: 1983713 - RNA, 13 nt, Shigella flexneri 2a str. 301
uuauccggcuaua

SEQ ID NO: 1983714 - RNA, 17 nt, Shigella flexneri 2a str. 301
uuauccggccuacaaaa

SEQ ID NO: 1983715 - RNA, 18 nt, Shigella flexneri 2a str. 301
uuauccggccuacaaaau

SEQ ID NO: 1983716 - RNA, 12 nt, Shigella flexneri 2a str. 301
uuauccggugag

SEQ ID NO: 1983717 - RNA, 19 nt, Shigella flexneri 2a str. 301
uuaucgacugccagaguca

SEQ ID NO: 1983718 - RNA, 20 nt, Shigella flexneri 2a str. 301
uuaucgacugccagagucaa

SEQ ID NO: 1983719 - RNA, 11 nt, Shigella flexneri 2a str. 301
uuauccagcaa

SEQ ID NO: 1983720 - RNA, 15 nt, Shigella flexneri 2a str. 301
uuauccaguuaucaa

SEQ ID NO: 1983721 - RNA, 17 nt, Shigella flexneri 2a str. 301
uuauccagccuacaaaa

SEQ ID NO: 1983722 - RNA, 21 nt, Shigella flexneri 2a str. 301
uuaucccgauuaaucagugca

SEQ ID NO: 1983723 - RNA, 22 nt, Shigella flexneri 2a str. 301
uuaucccaucccacucaucgca

SEQ ID NO: 1983724 - RNA, 20 nt, Shigella flexneri 2a str. 301
uuaucccaauuaucuggaau

SEQ ID NO: 1983725 - RNA, 22 nt, Shigella flexneri 2a str. 301
uuauccgcaucacuccacacca

SEQ ID NO: 1983726 - RNA, 17 nt, Shigella flexneri 2a str. 301
uuauccgaccuacaaaa

SEQ ID NO: 1983727 - RNA, 18 nt, Shigella flexneri 2a str. 301
uuauccgaccuacaaaac

SEQ ID NO: 1983728 - RNA, 17 nt, Shigella flexneri 2a str. 301
uuauccggcaugaaaac

SEQ ID NO: 1983729 - RNA, 11 nt, Shigella flexneri 2a str. 301
uuaucaugccu

SEQ ID NO: 1983730 - RNA, 17 nt, Shigella flexneri 2a str. 301
uuaucaggccuacaaaa

SEQ ID NO: 1983731 - RNA, 22 nt, Shigella flexneri 2a str. 301
uuaucaggccuacaauguuucu

SEQ ID NO: 1983732 - RNA, 21 nt, Shigella flexneri 2a str. 301
uuaucaggccuacauuggugc

SEQ ID NO: 1983733 - RNA, 11 nt, Shigella flexneri 2a str. 301
uuaucaggccu

SEQ ID NO: 1983734 - RNA, 22 nt, Shigella flexneri 2a str. 301
uuaucacgcaaccacaacgcac

SEQ ID NO: 1983735 - RNA, 19 nt, Shigella flexneri 2a str. 301
uuaucaccgcauuuugacu

SEQ ID NO: 1983736 - RNA, 20 nt, Shigella flexneri 2a str. 301
uuaucacgaugcuaaaaaca

SEQ ID NO: 1983737 - RNA, 15 nt, Shigella flexneri 2a str. 301
uuaucacuuaaccca

SEQ ID NO: 1983738 - RNA, 17 nt, Shigella flexneri 2a str. 301
uuaucagaaccgcccag

SEQ ID NO: 1983739 - RNA, 21 nt, Shigella flexneri 2a str. 301
uuaucagacaccgauugcccc

SEQ ID NO: 1983740 - RNA, 21 nt, Shigella flexneri 2a str. 301
uuaucaauuaacugugccagc

SEQ ID NO: 1983741 - RNA, 12 nt, Shigella flexneri 2a str. 301
uuaucacagcag

SEQ ID NO: 1983742 - RNA, 12 nt, Shigella flexneri 2a str. 301
uuaucaauuccu

SEQ ID NO: 1983743 - RNA, 19 nt, Shigella flexneri 2a str. 301
uuaucaauuccuauuuugu

SEQ ID NO: 1983744 - RNA, 17 nt, Shigella flexneri 2a str. 301
uucuacggguaaguguu

SEQ ID NO: 1983745 - RNA, 20 nt, Shigella flexneri 2a str. 301
uucuacggguaaguguuuca

SEQ ID NO: 1983746 - RNA, 15 nt, Shigella flexneri 2a str. 301
uucuacgaugcgaua

SEQ ID NO: 1983747 - RNA, 20 nt, Shigella flexneri 2a str. 301
uucuaauuuuuccagcauuu

SEQ ID NO: 1983748 - RNA, 15 nt, Shigella flexneri 2a str. 301
uucuacacccagccc

SEQ ID NO: 1983749 - RNA, 14 nt, Shigella flexneri 2a str. 301
uucuacaagcagag

SEQ ID NO: 1983750 - RNA, 16 nt, Shigella flexneri 2a str. 301
uucuacagaaaugaaa

SEQ ID NO: 1983751 - RNA, 17 nt, Shigella flexneri 2a str. 301
uucucagcgguaauggu

SEQ ID NO: 1983752 - RNA, 20 nt, Shigella flexneri 2a str. 301
uucucacuccagccagagcc

SEQ ID NO: 1983753 - RNA, 14 nt, Shigella flexneri 2a str. 301
uucucaccagcuga

SEQ ID NO: 1983754 - RNA, 12 nt, Shigella flexneri 2a str. 301
uucucgcaaaac

SEQ ID NO: 1983755 - RNA, 16 nt, Shigella flexneri 2a str. 301
uucucgauaaaaccuu

SEQ ID NO: 1983756 - RNA, 15 nt, Shigella flexneri 2a str. 301
uucucuacgcccucg

SEQ ID NO: 1983757 - RNA, 20 nt, Shigella flexneri 2a str. 301
uucucucaauccgccaaaac

SEQ ID NO: 1983758 - RNA, 16 nt, Shigella flexneri 2a str. 301
uucucgggagguaaug

SEQ ID NO: 1983759 - RNA, 15 nt, Shigella flexneri 2a str. 301
uucucggcaaacagc

SEQ ID NO: 1983760 - RNA, 18 nt, Shigella flexneri 2a str. 301
uucucucugauuacccuu

SEQ ID NO: 1983761 - RNA, 17 nt, Shigella flexneri 2a str. 301
uucucuguucagccuga

SEQ ID NO: 1983762 - RNA, 13 nt, Shigella flexneri 2a str. 301
uucugcagcucca

SEQ ID NO: 1983763 - RNA, 16 nt, Shigella flexneri 2a str. 301
uucugcaaugcugcga

SEQ ID NO: 1983764 - RNA, 23 nt, Shigella flexneri 2a str. 301
uucggugauauacgucacuucau

SEQ ID NO: 1983765 - RNA, 23 nt, Shigella flexneri 2a str. 301
uucgguccgacgugcucgaacau

SEQ ID NO: 1983766 - RNA, 17 nt, Shigella flexneri 2a str. 301
uucggacguuugccaug

SEQ ID NO: 1983767 - RNA, 18 nt, Shigella flexneri 2a str. 301
uucgcuuuggaagguaaa

SEQ ID NO: 1983768 - RNA, 17 nt, Shigella flexneri 2a str. 301
uucggugcgacaaacau

SEQ ID NO: 1983769 - RNA, 14 nt, Shigella flexneri 2a str. 301
uucguaauaauuca

SEQ ID NO: 1983770 - RNA, 20 nt, Shigella flexneri 2a str. 301
uucguaauaauucacggccc

SEQ ID NO: 1983771 - RNA, 14 nt, Shigella flexneri 2a str. 301
uucguaauaacuca

SEQ ID NO: 1983772 - RNA, 14 nt, Shigella flexneri 2a str. 301
uucguagcguuuuu

SEQ ID NO: 1983773 - RNA, 19 nt, Shigella flexneri 2a str. 301
uucguguggaguaauaauu

SEQ ID NO: 1983774 - RNA, 22 nt, Shigella flexneri 2a str. 301
uucguuaacaacaacuucuaau

SEQ ID NO: 1983775 - RNA, 20 nt, Shigella flexneri 2a str. 301
uucguguggaaaagcaguaa

SEQ ID NO: 1983776 - RNA, 15 nt, Shigella flexneri 2a str. 301
uucgugccacaguuu

SEQ ID NO: 1983777 - RNA, 23 nt, Shigella flexneri 2a str. 301
uucguucgggcagguuucaccuu

SEQ ID NO: 1983778 - RNA, 15 nt, Shigella flexneri 2a str. 301
uucgccugccugcag

SEQ ID NO: 1983779 - RNA, 14 nt, Shigella flexneri 2a str. 301
uucgccguuuucuu

SEQ ID NO: 1983780 - RNA, 19 nt, Shigella flexneri 2a str. 301
uucgccgguuccagcuuca

SEQ ID NO: 1983781 - RNA, 23 nt, Shigella flexneri 2a str. 301
uucgccgcugcgaucgcaaaucc

SEQ ID NO: 1983782 - RNA, 20 nt, Shigella flexneri 2a str. 301
uucgccaaaucgcugcugcu

SEQ ID NO: 1983783 - RNA, 20 nt, Shigella flexneri 2a str. 301
uucgccaaaugucaccagcc

SEQ ID NO: 1983784 - RNA, 23 nt, Shigella flexneri 2a str. 301
uucgccgcagcaucgucaucauu

SEQ ID NO: 1983785 - RNA, 21 nt, Shigella flexneri 2a str. 301
uucgccgaugaaguacagccc

SEQ ID NO: 1983786 - RNA, 17 nt, Shigella flexneri 2a str. 301
uucgcugaaaggcgauu

SEQ ID NO: 1983787 - RNA, 17 nt, Shigella flexneri 2a str. 301
uucgcugaauaccgauu

SEQ ID NO: 1983788 - RNA, 16 nt, Shigella flexneri 2a str. 301
uucgcuggaauaaucg

SEQ ID NO: 1983789 - RNA, 14 nt, Shigella flexneri 2a str. 301
uucgcugccacacc

SEQ ID NO: 1983790 - RNA, 15 nt, Shigella flexneri 2a str. 301
uucgcugacaguacc

SEQ ID NO: 1983791 - RNA, 16 nt, Shigella flexneri 2a str. 301
uuccuuggauauuuua

SEQ ID NO: 1983792 - RNA, 22 nt, Shigella flexneri 2a str. 301
uuccuugauugggguugcagaa

SEQ ID NO: 1983793 - RNA, 17 nt, Shigella flexneri 2a str. 301
uuccuuucccuauuuuu

SEQ ID NO: 1983794 - RNA, 15 nt, Shigella flexneri 2a str. 301
uucgaaaaaaaagaa

SEQ ID NO: 1983795 - RNA, 18 nt, Shigella flexneri 2a str. 301
uucgaacauuucgagaau

SEQ ID NO: 1983796 - RNA, 20 nt, Shigella flexneri 2a str. 301
uucgaaaccacccaccgcac

SEQ ID NO: 1983797 - RNA, 14 nt, Shigella flexneri 2a str. 301
uucgaaaaucucau

SEQ ID NO: 1983798 - RNA, 16 nt, Shigella flexneri 2a str. 301
uucgaaaaucucauau

SEQ ID NO: 1983799 - RNA, 15 nt, Shigella flexneri 2a str. 301
uucgcaccaaaucca

SEQ ID NO: 1983800 - RNA, 20 nt, Shigella flexneri 2a str. 301
uucgcacgaaccguaaaagc

SEQ ID NO: 1983801 - RNA, 22 nt, Shigella flexneri 2a str. 301
uuccaguuccggcaucgacagu

SEQ ID NO: 1983802 - RNA, 18 nt, Shigella flexneri 2a str. 301
uuccaguuccggcauuaa

SEQ ID NO: 1983803 - RNA, 14 nt, Shigella flexneri 2a str. 301
uuccagugcgguaa

SEQ ID NO: 1983804 - RNA, 22 nt, Shigella flexneri 2a str. 301
uuccagucggcguaauccugaa

SEQ ID NO: 1983805 - RNA, 17 nt, Shigella flexneri 2a str. 301
uuccaguagauucaaca

SEQ ID NO: 1983806 - RNA, 23 nt, Shigella flexneri 2a str. 301
uuccauaaucgacucccgcgccg

SEQ ID NO: 1983807 - RNA, 18 nt, Shigella flexneri 2a str. 301
uuccagcucaaccagauu

SEQ ID NO: 1983808 - RNA, 15 nt, Shigella flexneri 2a str. 301
uuccagcggcaggcc

SEQ ID NO: 1983809 - RNA, 12 nt, Shigella flexneri 2a str. 301
uuccagcggcag

SEQ ID NO: 1983810 - RNA, 14 nt, Shigella flexneri 2a str. 301
uuccagggcagcag

SEQ ID NO: 1983811 - RNA, 22 nt, Shigella flexneri 2a str. 301
uuccaggcuggcaggccucaug

SEQ ID NO: 1983812 - RNA, 12 nt, Shigella flexneri 2a str. 301
uuccagcucuua

SEQ ID NO: 1983813 - RNA, 22 nt, Shigella flexneri 2a str. 301
uuccauugagaaagcccuggcg

SEQ ID NO: 1983814 - RNA, 16 nt, Shigella flexneri 2a str. 301
uuccauuucaucgcca

SEQ ID NO: 1983815 - RNA, 17 nt, Shigella flexneri 2a str. 301
uuccaucuuuccucacu

SEQ ID NO: 1983816 - RNA, 14 nt, Shigella flexneri 2a str. 301
uuccaucuccagcu

SEQ ID NO: 1983817 - RNA, 22 nt, Shigella flexneri 2a str. 301
uuccaucgaccaaccuugcgcc

SEQ ID NO: 1983818 - RNA, 17 nt, Shigella flexneri 2a str. 301
uuccauauugucuucaa

SEQ ID NO: 1983819 - RNA, 15 nt, Shigella flexneri 2a str. 301
uuccauaugaauucc

SEQ ID NO: 1983820 - RNA, 13 nt, Shigella flexneri 2a str. 301
uucaggcgcugaa

SEQ ID NO: 1983821 - RNA, 20 nt, Shigella flexneri 2a str. 301
uuccaccagcggcugaauau

SEQ ID NO: 1983822 - RNA, 21 nt, Shigella flexneri 2a str. 301
uuccacccacggcguuaacug

SEQ ID NO: 1983823 - RNA, 19 nt, Shigella flexneri 2a str. 301
uuccaccaccacagacaau

SEQ ID NO: 1983824 - RNA, 14 nt, Shigella flexneri 2a str. 301
uuccaccucccccu

SEQ ID NO: 1983825 - RNA, 19 nt, Shigella flexneri 2a str. 301
uuccacucauuaauuuccu

SEQ ID NO: 1983826 - RNA, 19 nt, Shigella flexneri 2a str. 301
uuccacggaauauuucacc

SEQ ID NO: 1983827 - RNA, 18 nt, Shigella flexneri 2a str. 301
uuccacgcaggcauuauc

SEQ ID NO: 1983828 - RNA, 13 nt, Shigella flexneri 2a str. 301
uuccacuucauca

SEQ ID NO: 1983829 - RNA, 17 nt, Shigella flexneri 2a str. 301
uuccacuuucacgccca

SEQ ID NO: 1983830 - RNA, 15 nt, Shigella flexneri 2a str. 301
uuccacuucacggcu

SEQ ID NO: 1983831 - RNA, 12 nt, Shigella flexneri 2a str. 301
uuccacuucauc

SEQ ID NO: 1983832 - RNA, 13 nt, Shigella flexneri 2a str. 301
uuccagaauaucu

SEQ ID NO: 1983833 - RNA, 17 nt, Shigella flexneri 2a str. 301
uuccagaaaagagacgc

SEQ ID NO: 1983834 - RNA, 15 nt, Shigella flexneri 2a str. 301
uuccagaauaucuuc

SEQ ID NO: 1983835 - RNA, 14 nt, Shigella flexneri 2a str. 301
uuccagacucaaca

SEQ ID NO: 1983836 - RNA, 18 nt, Shigella flexneri 2a str. 301
uuccagacucaacaggcc

SEQ ID NO: 1983837 - RNA, 22 nt, Shigella flexneri 2a str. 301
uuccagauugcuuaaguuuugc

SEQ ID NO: 1983838 - RNA, 14 nt, Shigella flexneri 2a str. 301
uuccagcgaauaug

SEQ ID NO: 1983839 - RNA, 19 nt, Shigella flexneri 2a str. 301
uuccagccgaccauugcca

SEQ ID NO: 1983840 - RNA, 23 nt, Shigella flexneri 2a str. 301
uuccagccgaccauugccaguaa

SEQ ID NO: 1983841 - RNA, 20 nt, Shigella flexneri 2a str. 301
uuccagcagaccagcaauaa

SEQ ID NO: 1983842 - RNA, 16 nt, Shigella flexneri 2a str. 301
uuccagcagaccagca

SEQ ID NO: 1983843 - RNA, 15 nt, Shigella flexneri 2a str. 301
uuccagcaagccacu

SEQ ID NO: 1983844 - RNA, 13 nt, Shigella flexneri 2a str. 301
uuccagcacaccc

SEQ ID NO: 1983845 - RNA, 14 nt, Shigella flexneri 2a str. 301
uuccagcaguucca

SEQ ID NO: 1983846 - RNA, 14 nt, Shigella flexneri 2a str. 301
uuccagcaguucgc

SEQ ID NO: 1983847 - RNA, 19 nt, Shigella flexneri 2a str. 301
uuccagcauaaugacucuc

SEQ ID NO: 1983848 - RNA, 22 nt, Shigella flexneri 2a str. 301
uuccuaugcaacaacugaaaaa

SEQ ID NO: 1983849 - RNA, 15 nt, Shigella flexneri 2a str. 301
uuccucauuucccug

SEQ ID NO: 1983850 - RNA, 11 nt, Shigella flexneri 2a str. 301
uuccuccauuu

SEQ ID NO: 1983851 - RNA, 13 nt, Shigella flexneri 2a str. 301
uuccuccauugaa

SEQ ID NO: 1983852 - RNA, 18 nt, Shigella flexneri 2a str. 301
uuccuccugucuucccug

SEQ ID NO: 1983853 - RNA, 20 nt, Shigella flexneri 2a str. 301
uuccuccugucuucccugcu

SEQ ID NO: 1983854 - RNA, 23 nt, Shigella flexneri 2a str. 301
uuccggcagaagcaaucauccca

SEQ ID NO: 1983855 - RNA, 16 nt, Shigella flexneri 2a str. 301
uuccggcaacaaugcc

SEQ ID NO: 1983856 - RNA, 22 nt, Shigella flexneri 2a str. 301
uuccggaucgccaaagcggcag

SEQ ID NO: 1983857 - RNA, 20 nt, Shigella flexneri 2a str. 301
uuccgcgucaaucugcccga

SEQ ID NO: 1983858 - RNA, 19 nt, Shigella flexneri 2a str. 301
uuccgcgucaaucugcccg

SEQ ID NO: 1983859 - RNA, 22 nt, Shigella flexneri 2a str. 301
uuccugcggagcaaccugcacg

SEQ ID NO: 1983860 - RNA, 15 nt, Shigella flexneri 2a str. 301
uuccugccaguuuuu

SEQ ID NO: 1983861 - RNA, 17 nt, Shigella flexneri 2a str. 301
uuccugcgcuuccagcu

SEQ ID NO: 1983862 - RNA, 14 nt, Shigella flexneri 2a str. 301
uuccugcaucgccu

SEQ ID NO: 1983863 - RNA, 19 nt, Shigella flexneri 2a str. 301
uuccugcaacuucucuuuc

SEQ ID NO: 1983864 - RNA, 15 nt, Shigella flexneri 2a str. 301
uuccuuaacauccau

SEQ ID NO: 1983865 - RNA, 15 nt, Shigella flexneri 2a str. 301
uuccuggcuuggcug

SEQ ID NO: 1983866 - RNA, 22 nt, Shigella flexneri 2a str. 301
uuccuggucggcaaacugcuga

SEQ ID NO: 1983867 - RNA, 21 nt, Shigella flexneri 2a str. 301
uuccugguucucacuguucac

SEQ ID NO: 1983868 - RNA, 21 nt, Shigella flexneri 2a str. 301
uuccuggaaccagugaauacu

SEQ ID NO: 1983869 - RNA, 17 nt, Shigella flexneri 2a str. 301
uuccuggccgugaagaa

SEQ ID NO: 1983870 - RNA, 19 nt, Shigella flexneri 2a str. 301
uuccuggagaguguuuuau

SEQ ID NO: 1983871 - RNA, 15 nt, Shigella flexneri 2a str. 301
uuccuggagcaggag

SEQ ID NO: 1983872 - RNA, 17 nt, Shigella flexneri 2a str. 301
uuccauuuuucacuuaa

SEQ ID NO: 1983873 - RNA, 14 nt, Shigella flexneri 2a str. 301
uucccaacaacagc

SEQ ID NO: 1983874 - RNA, 13 nt, Shigella flexneri 2a str. 301
uucccacucuuga

SEQ ID NO: 1983875 - RNA, 16 nt, Shigella flexneri 2a str. 301
uucccaucucaauauu

SEQ ID NO: 1983876 - RNA, 15 nt, Shigella flexneri 2a str. 301
uuccccuugauaacg

SEQ ID NO: 1983877 - RNA, 14 nt, Shigella flexneri 2a str. 301
uuccgcaauacagc

SEQ ID NO: 1983878 - RNA, 16 nt, Shigella flexneri 2a str. 301
uuccgcgccaaacauu

SEQ ID NO: 1983879 - RNA, 13 nt, Shigella flexneri 2a str. 301
uuccgaugagcga

SEQ ID NO: 1983880 - RNA, 23 nt, Shigella flexneri 2a str. 301
uuccgaccaggcguucugccugg

SEQ ID NO: 1983881 - RNA, 17 nt, Shigella flexneri 2a str. 301
uugccugugcaaccuuu

SEQ ID NO: 1983882 - RNA, 18 nt, Shigella flexneri 2a str. 301
uugccugugcaaccuuuu

SEQ ID NO: 1983883 - RNA, 15 nt, Shigella flexneri 2a str. 301
uugccugugcaaccu

SEQ ID NO: 1983884 - RNA, 19 nt, Shigella flexneri 2a str. 301
uugccugugcaaccuuuuc

SEQ ID NO: 1983885 - RNA, 18 nt, Shigella flexneri 2a str. 301
uugccugcgaagcucuuu

SEQ ID NO: 1983886 - RNA, 19 nt, Shigella flexneri 2a str. 301
uugccugcgaagcucuuuc

SEQ ID NO: 1983887 - RNA, 20 nt, Shigella flexneri 2a str. 301
uugccugauggccugcucaa

SEQ ID NO: 1983888 - RNA, 18 nt, Shigella flexneri 2a str. 301
uugcguucaucaguucca

SEQ ID NO: 1983889 - RNA, 14 nt, Shigella flexneri 2a str. 301
uugcguuaacugcu

SEQ ID NO: 1983890 - RNA, 17 nt, Shigella flexneri 2a str. 301
uugcguggcgauuugag

SEQ ID NO: 1983891 - RNA, 16 nt, Shigella flexneri 2a str. 301
uugcgugguuuuugcu

SEQ ID NO: 1983892 - RNA, 15 nt, Shigella flexneri 2a str. 301
uugcgccucaagaau

SEQ ID NO: 1983893 - RNA, 14 nt, Shigella flexneri 2a str. 301
uugcgccgucaugc

SEQ ID NO: 1983894 - RNA, 13 nt, Shigella flexneri 2a str. 301
uugcucauaaaau

SEQ ID NO: 1983895 - RNA, 14 nt, Shigella flexneri 2a str. 301
uugcucaucccgcc

SEQ ID NO: 1983896 - RNA, 16 nt, Shigella flexneri 2a str. 301
uugcucaaauccauca

SEQ ID NO: 1983897 - RNA, 14 nt, Shigella flexneri 2a str. 301
uugcucaacccuuu

SEQ ID NO: 1983898 - RNA, 19 nt, Shigella flexneri 2a str. 301
uugcucaacccuuuccagc

SEQ ID NO: 1983899 - RNA, 23 nt, Shigella flexneri 2a str. 301
uugcucuucuccggcuguuucag

SEQ ID NO: 1983900 - RNA, 23 nt, Shigella flexneri 2a str. 301
uugcucuaacggucgcggaacau

SEQ ID NO: 1983901 - RNA, 17 nt, Shigella flexneri 2a str. 301
uugcuccuuaauaaaau

SEQ ID NO: 1983902 - RNA, 13 nt, Shigella flexneri 2a str. 301
uugcucuguuuuc

SEQ ID NO: 1983903 - RNA, 20 nt, Shigella flexneri 2a str. 301
uugcucugguucaccauucu

SEQ ID NO: 1983904 - RNA, 19 nt, Shigella flexneri 2a str. 301
uugcccgggcgagcaaugu

SEQ ID NO: 1983905 - RNA, 15 nt, Shigella flexneri 2a str. 301
uugcccggucaggug

SEQ ID NO: 1983906 - RNA, 16 nt, Shigella flexneri 2a str. 301
uugcccgcaagcugcg

SEQ ID NO: 1983907 - RNA, 14 nt, Shigella flexneri 2a str. 301
uugccgcuacauca

SEQ ID NO: 1983908 - RNA, 19 nt, Shigella flexneri 2a str. 301
uugccgcuuaaauuuccac

SEQ ID NO: 1983909 - RNA, 17 nt, Shigella flexneri 2a str. 301
uugccggacgcugagca

SEQ ID NO: 1983910 - RNA, 22 nt, Shigella flexneri 2a str. 301
uugccggaugcggcguaaaugc

SEQ ID NO: 1983911 - RNA, 20 nt, Shigella flexneri 2a str. 301
uugccggauauuccugaaug

SEQ ID NO: 1983912 - RNA, 18 nt, Shigella flexneri 2a str. 301
uugccucguucuucccuc

SEQ ID NO: 1983913 - RNA, 18 nt, Shigella flexneri 2a str. 301
uugccgcgcucuuuaaag

SEQ ID NO: 1983914 - RNA, 19 nt, Shigella flexneri 2a str. 301
uugccaccccuuuugacuu

SEQ ID NO: 1983915 - RNA, 16 nt, Shigella flexneri 2a str. 301
uugccacccugcggcu

SEQ ID NO: 1983916 - RNA, 20 nt, Shigella flexneri 2a str. 301
uugcacgcagacacugcuga

SEQ ID NO: 1983917 - RNA, 17 nt, Shigella flexneri 2a str. 301
uugcaccgggcuuuuuu

SEQ ID NO: 1983918 - RNA, 15 nt, Shigella flexneri 2a str. 301
uugcaccuaaagcgc

SEQ ID NO: 1983919 - RNA, 23 nt, Shigella flexneri 2a str. 301
uugcacagguggcaaacgccacc

SEQ ID NO: 1983920 - RNA, 16 nt, Shigella flexneri 2a str. 301
uugcaccagcaacaag

SEQ ID NO: 1983921 - RNA, 15 nt, Shigella flexneri 2a str. 301
uugccaaauaucuua

SEQ ID NO: 1983922 - RNA, 14 nt, Shigella flexneri 2a str. 301
uugauucuguucag

SEQ ID NO: 1983923 - RNA, 13 nt, Shigella flexneri 2a str. 301
uugcaaaaucaau

SEQ ID NO: 1983924 - RNA, 19 nt, Shigella flexneri 2a str. 301
uugauuuuuuugauaaacc

SEQ ID NO: 1983925 - RNA, 23 nt, Shigella flexneri 2a str. 301
uugaugcgugagguaacaauaaa

SEQ ID NO: 1983926 - RNA, 22 nt, Shigella flexneri 2a str. 301
uugaugcguaccucacguucca

SEQ ID NO: 1983927 - RNA, 18 nt, Shigella flexneri 2a str. 301
uugcaacgcccaucaaca

SEQ ID NO: 1983928 - RNA, 17 nt, Shigella flexneri 2a str. 301
uugcaaccacacaggca

SEQ ID NO: 1983929 - RNA, 16 nt, Shigella flexneri 2a str. 301
uugcaacauguugaau

SEQ ID NO: 1983930 - RNA, 23 nt, Shigella flexneri 2a str. 301
uugcaagaucgcgcaucagcucc

SEQ ID NO: 1983931 - RNA, 16 nt, Shigella flexneri 2a str. 301
uugcaagaucgcucau

SEQ ID NO: 1983932 - RNA, 12 nt, Shigella flexneri 2a str. 301
uugcaaaguucc

SEQ ID NO: 1983933 - RNA, 20 nt, Shigella flexneri 2a str. 301
uugcaaagagaacugagcga

SEQ ID NO: 1983934 - RNA, 20 nt, Shigella flexneri 2a str. 301
uugcaaucagauaaaauaca

SEQ ID NO: 1983935 - RNA, 16 nt, Shigella flexneri 2a str. 301
uugcacagacuuaaua

SEQ ID NO: 1983936 - RNA, 22 nt, Shigella flexneri 2a str. 301
uugagaugguuacuuuuuaugu

SEQ ID NO: 1983937 - RNA, 21 nt, Shigella flexneri 2a str. 301
uugaguuuuucaucccucuca

SEQ ID NO: 1983938 - RNA, 17 nt, Shigella flexneri 2a str. 301
uugagagugcgaaacga

SEQ ID NO: 1983939 - RNA, 23 nt, Shigella flexneri 2a str. 301
uugacuuauaugcgcgaauacga

SEQ ID NO: 1983940 - RNA, 19 nt, Shigella flexneri 2a str. 301
uugaucaauucuaaauguu

SEQ ID NO: 1983941 - RNA, 23 nt, Shigella flexneri 2a str. 301
uugaucagccaggcgaugaaauu

SEQ ID NO: 1983942 - RNA, 13 nt, Shigella flexneri 2a str. 301
uugaucauaaaaa

SEQ ID NO: 1983943 - RNA, 17 nt, Shigella flexneri 2a str. 301
uugauccaggagcucca

SEQ ID NO: 1983944 - RNA, 13 nt, Shigella flexneri 2a str. 301
uugauccaggagc

SEQ ID NO: 1983945 - RNA, 21 nt, Shigella flexneri 2a str. 301
uugauccaggagcuccagguc

SEQ ID NO: 1983946 - RNA, 20 nt, Shigella flexneri 2a str. 301
uugauccguccccaccuguc

SEQ ID NO: 1983947 - RNA, 18 nt, Shigella flexneri 2a str. 301
uugauauuuauuuccuuc

SEQ ID NO: 1983948 - RNA, 13 nt, Shigella flexneri 2a str. 301
uugauauccaccu

SEQ ID NO: 1983949 - RNA, 22 nt, Shigella flexneri 2a str. 301
uugaaaugugguuucacuuucu

SEQ ID NO: 1983950 - RNA, 18 nt, Shigella flexneri 2a str. 301
uugaaaucgaacagguug

SEQ ID NO: 1983951 - RNA, 13 nt, Shigella flexneri 2a str. 301
uugaaaucgaaca

SEQ ID NO: 1983952 - RNA, 19 nt, Shigella flexneri 2a str. 301
uugaacccggcaucaacca

SEQ ID NO: 1983953 - RNA, 19 nt, Shigella flexneri 2a str. 301
uugaacauaucagcgcaaa

SEQ ID NO: 1983954 - RNA, 19 nt, Shigella flexneri 2a str. 301
uugaaagagccgauaaaca

SEQ ID NO: 1983955 - RNA, 14 nt, Shigella flexneri 2a str. 301
uugaaauaccaggu

SEQ ID NO: 1983956 - RNA, 13 nt, Shigella flexneri 2a str. 301
uugaaauagccaa

SEQ ID NO: 1983957 - RNA, 12 nt, Shigella flexneri 2a str. 301
uugaaaaacaug

SEQ ID NO: 1983958 - RNA, 16 nt, Shigella flexneri 2a str. 301
uugaaaaaucaaaaaa

SEQ ID NO: 1983959 - RNA, 15 nt, Shigella flexneri 2a str. 301
uucuuuugagcgucc

SEQ ID NO: 1983960 - RNA, 15 nt, Shigella flexneri 2a str. 301
uucuuuuaccuucag

SEQ ID NO: 1983961 - RNA, 23 nt, Shigella flexneri 2a str. 301
uucuuugcugccguuaacccguc

SEQ ID NO: 1983962 - RNA, 19 nt, Shigella flexneri 2a str. 301
uucuuuguagaugauuuuu

SEQ ID NO: 1983963 - RNA, 13 nt, Shigella flexneri 2a str. 301
uucuuugcugccg

SEQ ID NO: 1983964 - RNA, 21 nt, Shigella flexneri 2a str. 301
uucuuugcaugacgaucaacc

SEQ ID NO: 1983965 - RNA, 21 nt, Shigella flexneri 2a str. 301
uucuuuauaucugguuugcca

SEQ ID NO: 1983966 - RNA, 17 nt, Shigella flexneri 2a str. 301
uucugccaggcuggcag

SEQ ID NO: 1983967 - RNA, 15 nt, Shigella flexneri 2a str. 301
uucugccgcuguuuu

SEQ ID NO: 1983968 - RNA, 23 nt, Shigella flexneri 2a str. 301
uucugccaaacgcucccugccag

SEQ ID NO: 1983969 - RNA, 17 nt, Shigella flexneri 2a str. 301
uucugccgcuuccagca

SEQ ID NO: 1983970 - RNA, 18 nt, Shigella flexneri 2a str. 301
uucugcgcacacacgccc

SEQ ID NO: 1983971 - RNA, 16 nt, Shigella flexneri 2a str. 301
uucugcgauagcagca

SEQ ID NO: 1983972 - RNA, 17 nt, Shigella flexneri 2a str. 301
uucugcgauagcagcag

SEQ ID NO: 1983973 - RNA, 16 nt, Shigella flexneri 2a str. 301
uucuugcuguuugcga

SEQ ID NO: 1983974 - RNA, 21 nt, Shigella flexneri 2a str. 301
uucuugcuccacguucagaga

SEQ ID NO: 1983975 - RNA, 14 nt, Shigella flexneri 2a str. 301
uucuuuaaauaugg

SEQ ID NO: 1983976 - RNA, 13 nt, Shigella flexneri 2a str. 301
uugaagaaaucag

SEQ ID NO: 1983977 - RNA, 16 nt, Shigella flexneri 2a str. 301
uugaacuuuaagcuga

SEQ ID NO: 1983978 - RNA, 12 nt, Shigella flexneri 2a str. 301
uugaacuaucau

SEQ ID NO: 1983979 - RNA, 15 nt, Shigella flexneri 2a str. 301
uugaacucugaaucg

SEQ ID NO: 1983980 - RNA, 21 nt, Shigella flexneri 2a str. 301
uugaacggauauuuugccagg

SEQ ID NO: 1983981 - RNA, 16 nt, Shigella flexneri 2a str. 301
uugaacgcaaauguaa

SEQ ID NO: 1983982 - RNA, 21 nt, Shigella flexneri 2a str. 301
uugaaccuaagcuuucgagca

SEQ ID NO: 1983983 - RNA, 11 nt, Shigella flexneri 2a str. 301
uugaagucagg

SEQ ID NO: 1983984 - RNA, 13 nt, Shigella flexneri 2a str. 301
uugaagcaaucca

SEQ ID NO: 1983985 - RNA, 19 nt, Shigella flexneri 2a str. 301
uugaagauuuugcugugcu

SEQ ID NO: 1983986 - RNA, 12 nt, Shigella flexneri 2a str. 301
uugaagauuagc

SEQ ID NO: 1983987 - RNA, 16 nt, Shigella flexneri 2a str. 301
uugaauaucuccucug

SEQ ID NO: 1983988 - RNA, 15 nt, Shigella flexneri 2a str. 301
uugaaugucugucug

SEQ ID NO: 1983989 - RNA, 18 nt, Shigella flexneri 2a str. 301
uugacgcgucuuaucagg

SEQ ID NO: 1983990 - RNA, 21 nt, Shigella flexneri 2a str. 301
uugacgcuguuguuuuuucaa

SEQ ID NO: 1983991 - RNA, 21 nt, Shigella flexneri 2a str. 301
uugaccuugcggcuuaacugu

SEQ ID NO: 1983992 - RNA, 14 nt, Shigella flexneri 2a str. 301
uugaccgccagcgc

SEQ ID NO: 1983993 - RNA, 12 nt, Shigella flexneri 2a str. 301
uugaccugaaua

SEQ ID NO: 1983994 - RNA, 13 nt, Shigella flexneri 2a str. 301
uugacucggaguc

SEQ ID NO: 1983995 - RNA, 12 nt, Shigella flexneri 2a str. 301
uugacucucauc

SEQ ID NO: 1983996 - RNA, 20 nt, Shigella flexneri 2a str. 301
uugacugaaaaguuaauguu

SEQ ID NO: 1983997 - RNA, 18 nt, Shigella flexneri 2a str. 301
uugacgugucuuaucagg

SEQ ID NO: 1983998 - RNA, 13 nt, Shigella flexneri 2a str. 301
uugacaaagugcg

SEQ ID NO: 1983999 - RNA, 11 nt, Shigella flexneri 2a str. 301
uugacaacauc

SEQ ID NO: 1984000 - RNA, 15 nt, Shigella flexneri 2a str. 301
uugaauugcucagua

SEQ ID NO: 1984001 - RNA, 14 nt, Shigella flexneri 2a str. 301
uugacauguugcug

SEQ ID NO: 1984002 - RNA, 22 nt, Shigella flexneri 2a str. 301
uugacauauaaccggcaacaga

SEQ ID NO: 1984003 - RNA, 20 nt, Shigella flexneri 2a str. 301
uuuaccaccgucaaaaaaac

SEQ ID NO: 1984004 - RNA, 19 nt, Shigella flexneri 2a str. 301
uuuaccaccgucaaaaaaa

SEQ ID NO: 1984005 - RNA, 13 nt, Shigella flexneri 2a str. 301
uuuaccagcagcc

SEQ ID NO: 1984006 - RNA, 14 nt, Shigella flexneri 2a str. 301
uuuacccagcagca

SEQ ID NO: 1984007 - RNA, 11 nt, Shigella flexneri 2a str. 301
uuuacccagcg

SEQ ID NO: 1984008 - RNA, 19 nt, Shigella flexneri 2a str. 301
uuuacccaaacuuaacacu

SEQ ID NO: 1984009 - RNA, 21 nt, Shigella flexneri 2a str. 301
uuuaccccacgucaucuguca

SEQ ID NO: 1984010 - RNA, 14 nt, Shigella flexneri 2a str. 301
uuuaccuucauuug

SEQ ID NO: 1984011 - RNA, 17 nt, Shigella flexneri 2a str. 301
uuuaccuugcucaucca

SEQ ID NO: 1984012 - RNA, 20 nt, Shigella flexneri 2a str. 301
uuuaccaauauaauuccauu

SEQ ID NO: 1984013 - RNA, 13 nt, Shigella flexneri 2a str. 301
uuuaccaauauaa

SEQ ID NO: 1984014 - RNA, 15 nt, Shigella flexneri 2a str. 301
uuuacaauaaccauu

SEQ ID NO: 1984015 - RNA, 11 nt, Shigella flexneri 2a str. 301
uuuaaccaaca

SEQ ID NO: 1984016 - RNA, 16 nt, Shigella flexneri 2a str. 301
uuuaacggaugaugcu

SEQ ID NO: 1984017 - RNA, 16 nt, Shigella flexneri 2a str. 301
uuuaacgcaugcacau

SEQ ID NO: 1984018 - RNA, 22 nt, Shigella flexneri 2a str. 301
uuuaacguuacuaauaaaucgu

SEQ ID NO: 1984019 - RNA, 21 nt, Shigella flexneri 2a str. 301
uuuagcugucccaagugauuu

SEQ ID NO: 1984020 - RNA, 11 nt, Shigella flexneri 2a str. 301
uuuagcgccag

SEQ ID NO: 1984021 - RNA, 18 nt, Shigella flexneri 2a str. 301
uuuagccgcuucugcagc

SEQ ID NO: 1984022 - RNA, 16 nt, Shigella flexneri 2a str. 301
uuuacgcaaccacaaa

SEQ ID NO: 1984023 - RNA, 13 nt, Shigella flexneri 2a str. 301
uuuacgcaaccac

SEQ ID NO: 1984024 - RNA, 19 nt, Shigella flexneri 2a str. 301
uuuacgccgcaucaggcau

SEQ ID NO: 1984025 - RNA, 19 nt, Shigella flexneri 2a str. 301
uuuacgccgcauccggcaa

SEQ ID NO: 1984026 - RNA, 15 nt, Shigella flexneri 2a str. 301
uuuacuauuauuuuu

SEQ ID NO: 1984027 - RNA, 19 nt, Shigella flexneri 2a str. 301
uuuacugauaauuuuuuca

SEQ ID NO: 1984028 - RNA, 22 nt, Shigella flexneri 2a str. 301
uuuacucccguucauucaacuu

SEQ ID NO: 1984029 - RNA, 23 nt, Shigella flexneri 2a str. 301
uuuauaaagaacucgaggauaaa

SEQ ID NO: 1984030 - RNA, 22 nt, Shigella flexneri 2a str. 301
uuuaguaacaacggauuauccc

SEQ ID NO: 1984031 - RNA, 23 nt, Shigella flexneri 2a str. 301
uuguugcgcugaaacuuuaccaa

SEQ ID NO: 1984032 - RNA, 19 nt, Shigella flexneri 2a str. 301
uuguugccgcccguuuucu

SEQ ID NO: 1984033 - RNA, 13 nt, Shigella flexneri 2a str. 301
uuguugucacacc

SEQ ID NO: 1984034 - RNA, 20 nt, Shigella flexneri 2a str. 301
uuguuauccaccgaaauaau

SEQ ID NO: 1984035 - RNA, 21 nt, Shigella flexneri 2a str. 301
uugcugacggccguugugacu

SEQ ID NO: 1984036 - RNA, 15 nt, Shigella flexneri 2a str. 301
uugcugauucucccu

SEQ ID NO: 1984037 - RNA, 20 nt, Shigella flexneri 2a str. 301
uugcugcggcguuccccagu

SEQ ID NO: 1984038 - RNA, 19 nt, Shigella flexneri 2a str. 301
uugcugcguggaauuuguc

SEQ ID NO: 1984039 - RNA, 15 nt, Shigella flexneri 2a str. 301
uugcugcguggaauu

SEQ ID NO: 1984040 - RNA, 19 nt, Shigella flexneri 2a str. 301
uuguuuaauggcaaaaacu

SEQ ID NO: 1984041 - RNA, 12 nt, Shigella flexneri 2a str. 301
uuguuuaaauau

SEQ ID NO: 1984042 - RNA, 16 nt, Shigella flexneri 2a str. 301
uuguuuaugccggaug

SEQ ID NO: 1984043 - RNA, 18 nt, Shigella flexneri 2a str. 301
uuuaaaaagaaaaaacua

SEQ ID NO: 1984044 - RNA, 15 nt, Shigella flexneri 2a str. 301
uuuaaaaaguaaaac

SEQ ID NO: 1984045 - RNA, 19 nt, Shigella flexneri 2a str. 301
uuguuuuggguguuuaugc

SEQ ID NO: 1984046 - RNA, 16 nt, Shigella flexneri 2a str. 301
uuguuuuugccggaug

SEQ ID NO: 1984047 - RNA, 12 nt, Shigella flexneri 2a str. 301
uuguuuuuucaa

SEQ ID NO: 1984048 - RNA, 19 nt, Shigella flexneri 2a str. 301
uuuaaauaucaucaaaauu

SEQ ID NO: 1984049 - RNA, 16 nt, Shigella flexneri 2a str. 301
uuuaaccagucgcuga

SEQ ID NO: 1984050 - RNA, 18 nt, Shigella flexneri 2a str. 301
uuuaaccgccuaauuaca

SEQ ID NO: 1984051 - RNA, 20 nt, Shigella flexneri 2a str. 301
uuuaacaguuguccaaacgu

SEQ ID NO: 1984052 - RNA, 13 nt, Shigella flexneri 2a str. 301
uuuaaauuuccca

SEQ ID NO: 1984053 - RNA, 23 nt, Shigella flexneri 2a str. 301
uuuaaagagacagaaucaggcca

SEQ ID NO: 1984054 - RNA, 14 nt, Shigella flexneri 2a str. 301
uuuaaaccugauuu

SEQ ID NO: 1984055 - RNA, 18 nt, Shigella flexneri 2a str. 301
uuuaaacaauuucagaau

SEQ ID NO: 1984056 - RNA, 13 nt, Shigella flexneri 2a str. 301
uuuaaacagagau

SEQ ID NO: 1984057 - RNA, 12 nt, Shigella flexneri 2a str. 301
uuuaaacauuaa

SEQ ID NO: 1984058 - RNA, 14 nt, Shigella flexneri 2a str. 301
uuucacaguacgcu

SEQ ID NO: 1984059 - RNA, 17 nt, Shigella flexneri 2a str. 301
uuucacauguucauuua

SEQ ID NO: 1984060 - RNA, 20 nt, Shigella flexneri 2a str. 301
uuucaccaacgaugaagaga

SEQ ID NO: 1984061 - RNA, 11 nt, Shigella flexneri 2a str. 301
uuucaccagcg

SEQ ID NO: 1984062 - RNA, 19 nt, Shigella flexneri 2a str. 301
uuucacccgcgaccaccag

SEQ ID NO: 1984063 - RNA, 18 nt, Shigella flexneri 2a str. 301
uuucacaggaaaaacuuu

SEQ ID NO: 1984064 - RNA, 17 nt, Shigella flexneri 2a str. 301
uuucaccgaugcacaga

SEQ ID NO: 1984065 - RNA, 19 nt, Shigella flexneri 2a str. 301
uuucaccugauuaccguga

SEQ ID NO: 1984066 - RNA, 22 nt, Shigella flexneri 2a str. 301
uuucacgaccaccgaugaagaa

SEQ ID NO: 1984067 - RNA, 15 nt, Shigella flexneri 2a str. 301
uuucacgaacacagu

SEQ ID NO: 1984068 - RNA, 23 nt, Shigella flexneri 2a str. 301
uuucacgccugcggcuuccagag

SEQ ID NO: 1984069 - RNA, 21 nt, Shigella flexneri 2a str. 301
uuucacgccgccguuagcuuc

SEQ ID NO: 1984070 - RNA, 16 nt, Shigella flexneri 2a str. 301
uuucacgcaauaccug

SEQ ID NO: 1984071 - RNA, 16 nt, Shigella flexneri 2a str. 301
uuucacggcaccagcc

SEQ ID NO: 1984072 - RNA, 19 nt, Shigella flexneri 2a str. 301
uuucacggccacucugccu

SEQ ID NO: 1984073 - RNA, 13 nt, Shigella flexneri 2a str. 301
uuucaagauuagc

SEQ ID NO: 1984074 - RNA, 21 nt, Shigella flexneri 2a str. 301
uuucaagugacauacucuuuc

SEQ ID NO: 1984075 - RNA, 13 nt, Shigella flexneri 2a str. 301
uuucaaugcuuuu

SEQ ID NO: 1984076 - RNA, 16 nt, Shigella flexneri 2a str. 301
uuucaauuccauuucc

SEQ ID NO: 1984077 - RNA, 16 nt, Shigella flexneri 2a str. 301
uuucaaucgacuuuuc

SEQ ID NO: 1984078 - RNA, 15 nt, Shigella flexneri 2a str. 301
uuucaaugcacaauc

SEQ ID NO: 1984079 - RNA, 20 nt, Shigella flexneri 2a str. 301
uuucaacaauacaaaugccu

SEQ ID NO: 1984080 - RNA, 23 nt, Shigella flexneri 2a str. 301
uuucaacaaccuugcguuuuuca

SEQ ID NO: 1984081 - RNA, 19 nt, Shigella flexneri 2a str. 301
uuucaacgccccauuuuua

SEQ ID NO: 1984082 - RNA, 17 nt, Shigella flexneri 2a str. 301
uuucaacggaccaauaa

SEQ ID NO: 1984083 - RNA, 15 nt, Shigella flexneri 2a str. 301
uuucaaccuaaagua

SEQ ID NO: 1984084 - RNA, 16 nt, Shigella flexneri 2a str. 301
uuucaaccuaaaguaa

SEQ ID NO: 1984085 - RNA, 21 nt, Shigella flexneri 2a str. 301
uuuauuugacccgcaguaaau

SEQ ID NO: 1984086 - RNA, 12 nt, Shigella flexneri 2a str. 301
uuucaaacgcca

SEQ ID NO: 1984087 - RNA, 18 nt, Shigella flexneri 2a str. 301
uuucaaagguaaugguca

SEQ ID NO: 1984088 - RNA, 14 nt, Shigella flexneri 2a str. 301
uuuauucaccagua

SEQ ID NO: 1984089 - RNA, 20 nt, Shigella flexneri 2a str. 301
uuuauuaugccacagagaau

SEQ ID NO: 1984090 - RNA, 12 nt, Shigella flexneri 2a str. 301
uuuauuucagua

SEQ ID NO: 1984091 - RNA, 19 nt, Shigella flexneri 2a str. 301
uuuauucugacgccaccau

SEQ ID NO: 1984092 - RNA, 14 nt, Shigella flexneri 2a str. 301
uuuauacucaguca

SEQ ID NO: 1984093 - RNA, 19 nt, Shigella flexneri 2a str. 301
uuuauaccaacaaaaaacg

SEQ ID NO: 1984094 - RNA, 15 nt, Shigella flexneri 2a str. 301
uuucauccuucauua

SEQ ID NO: 1984095 - RNA, 16 nt, Shigella flexneri 2a str. 301
uuucauuccaguaagg

SEQ ID NO: 1984096 - RNA, 22 nt, Shigella flexneri 2a str. 301
uuucauucagaacacuucuucu

SEQ ID NO: 1984097 - RNA, 16 nt, Shigella flexneri 2a str. 301
uuucaugcuauuccuu

SEQ ID NO: 1984098 - RNA, 18 nt, Shigella flexneri 2a str. 301
uuucaugcuauuccuuga

SEQ ID NO: 1984099 - RNA, 21 nt, Shigella flexneri 2a str. 301
uuucauguuaaauuccggcuc

SEQ ID NO: 1984100 - RNA, 13 nt, Shigella flexneri 2a str. 301
uuuccaccgcaaa

SEQ ID NO: 1984101 - RNA, 17 nt, Shigella flexneri 2a str. 301
uuuccacgcugauugca

SEQ ID NO: 1984102 - RNA, 13 nt, Shigella flexneri 2a str. 301
uuuccacuuccac

SEQ ID NO: 1984103 - RNA, 21 nt, Shigella flexneri 2a str. 301
uuuccagcucaaccagauucg

SEQ ID NO: 1984104 - RNA, 13 nt, Shigella flexneri 2a str. 301
uuuccaaaacugg

SEQ ID NO: 1984105 - RNA, 17 nt, Shigella flexneri 2a str. 301
uuucauuuauuaccucc

SEQ ID NO: 1984106 - RNA, 21 nt, Shigella flexneri 2a str. 301
uuucaguaauccuuucucaau

SEQ ID NO: 1984107 - RNA, 17 nt, Shigella flexneri 2a str. 301
uuucagguuguuuucug

SEQ ID NO: 1984108 - RNA, 16 nt, Shigella flexneri 2a str. 301
uuucaggccagcggcu

SEQ ID NO: 1984109 - RNA, 12 nt, Shigella flexneri 2a str. 301
uuucagcugccc

SEQ ID NO: 1984110 - RNA, 23 nt, Shigella flexneri 2a str. 301
uuucagggaugaagugaagauga

SEQ ID NO: 1984111 - RNA, 15 nt, Shigella flexneri 2a str. 301
uuucaggucgguuuu

SEQ ID NO: 1984112 - RNA, 12 nt, Shigella flexneri 2a str. 301
uuucaggaaacu

SEQ ID NO: 1984113 - RNA, 20 nt, Shigella flexneri 2a str. 301
uuucaggcuuuuuuccagcu

SEQ ID NO: 1984114 - RNA, 19 nt, Shigella flexneri 2a str. 301
uuucauaucugccagauaa

SEQ ID NO: 1984115 - RNA, 19 nt, Shigella flexneri 2a str. 301
uuucaguggggcaggggcu

SEQ ID NO: 1984116 - RNA, 13 nt, Shigella flexneri 2a str. 301
uuucaguuggcug

SEQ ID NO: 1984117 - RNA, 15 nt, Shigella flexneri 2a str. 301
uuucaguuugccgcu

SEQ ID NO: 1984118 - RNA, 23 nt, Shigella flexneri 2a str. 301
uuucagacggcugucuuccugug

SEQ ID NO: 1984119 - RNA, 19 nt, Shigella flexneri 2a str. 301
uuucagaaaacgguugaua

SEQ ID NO: 1984120 - RNA, 18 nt, Shigella flexneri 2a str. 301
uuucagaaaguauauaaa

SEQ ID NO: 1984121 - RNA, 17 nt, Shigella flexneri 2a str. 301
uuucagaaauuuggcuc

SEQ ID NO: 1984122 - RNA, 20 nt, Shigella flexneri 2a str. 301
uuucacuucaaccacauuca

SEQ ID NO: 1984123 - RNA, 14 nt, Shigella flexneri 2a str. 301
uuucacuauuucuu

SEQ ID NO: 1984124 - RNA, 15 nt, Shigella flexneri 2a str. 301
uuucacuauuucuuu

SEQ ID NO: 1984125 - RNA, 16 nt, Shigella flexneri 2a str. 301
uuucacuuucugcaau

SEQ ID NO: 1984126 - RNA, 11 nt, Shigella flexneri 2a str. 301
uuucagcagcg

SEQ ID NO: 1984127 - RNA, 17 nt, Shigella flexneri 2a str. 301
uuucagcgaaugaaaga

SEQ ID NO: 1984128 - RNA, 19 nt, Shigella flexneri 2a str. 301
uuucagauuggugacaaag

SEQ ID NO: 1984129 - RNA, 20 nt, Shigella flexneri 2a str. 301
uuucagauuggugacaaagu

SEQ ID NO: 1984130 - RNA, 22 nt, Shigella flexneri 2a str. 301
uuucagauguuccgccauuuua

SEQ ID NO: 1984131 - RNA, 18 nt, Shigella flexneri 2a str. 301
uuugcaggugaccagcag

SEQ ID NO: 1984132 - RNA, 14 nt, Shigella flexneri 2a str. 301
uuugcagcuuugcu

SEQ ID NO: 1984133 - RNA, 22 nt, Shigella flexneri 2a str. 301
uuugcaucccagaaaaaaagua

SEQ ID NO: 1984134 - RNA, 15 nt, Shigella flexneri 2a str. 301
uuugccaaacgcguc

SEQ ID NO: 1984135 - RNA, 18 nt, Shigella flexneri 2a str. 301
uuugccaaauaucuuaua

SEQ ID NO: 1984136 - RNA, 20 nt, Shigella flexneri 2a str. 301
uuugcaucguccacuugaaa

SEQ ID NO: 1984137 - RNA, 17 nt, Shigella flexneri 2a str. 301
uuugccucguucuuccc

SEQ ID NO: 1984138 - RNA, 20 nt, Shigella flexneri 2a str. 301
uuugccuccccaacauauaa

SEQ ID NO: 1984139 - RNA, 22 nt, Shigella flexneri 2a str. 301
uuugccuccccaacauauaagu

SEQ ID NO: 1984140 - RNA, 18 nt, Shigella flexneri 2a str. 301
uuugccggaacauccggc

SEQ ID NO: 1984141 - RNA, 19 nt, Shigella flexneri 2a str. 301
uuugccgggcauuuaauuu

SEQ ID NO: 1984142 - RNA, 21 nt, Shigella flexneri 2a str. 301
uuugccaucagcgccugaugg

SEQ ID NO: 1984143 - RNA, 19 nt, Shigella flexneri 2a str. 301
uuugccgcagcaguugcca

SEQ ID NO: 1984144 - RNA, 17 nt, Shigella flexneri 2a str. 301
uuugccgaggaagacaa

SEQ ID NO: 1984145 - RNA, 17 nt, Shigella flexneri 2a str. 301
uuugccccuguugaaau

SEQ ID NO: 1984146 - RNA, 17 nt, Shigella flexneri 2a str. 301
uuugcguuugucauaaa

SEQ ID NO: 1984147 - RNA, 18 nt, Shigella flexneri 2a str. 301
uuugcgucagcucacaaa

SEQ ID NO: 1984148 - RNA, 15 nt, Shigella flexneri 2a str. 301
uuugcgguuaaaaau

SEQ ID NO: 1984149 - RNA, 20 nt, Shigella flexneri 2a str. 301
uuugcuauccaguacauuga

SEQ ID NO: 1984150 - RNA, 21 nt, Shigella flexneri 2a str. 301
uuugcucaacccuuuccagcg

SEQ ID NO: 1984151 - RNA, 18 nt, Shigella flexneri 2a str. 301
uuugcgcguaaacaaaca

SEQ ID NO: 1984152 - RNA, 19 nt, Shigella flexneri 2a str. 301
uuugcgcguaaacaaacaa

SEQ ID NO: 1984153 - RNA, 16 nt, Shigella flexneri 2a str. 301
uuugcgcggcagucac

SEQ ID NO: 1984154 - RNA, 13 nt, Shigella flexneri 2a str. 301
uuugcgccuggau

SEQ ID NO: 1984155 - RNA, 15 nt, Shigella flexneri 2a str. 301
uuugcgccucgccau

SEQ ID NO: 1984156 - RNA, 23 nt, Shigella flexneri 2a str. 301
uuugcgcauccagcguugagccc

SEQ ID NO: 1984157 - RNA, 18 nt, Shigella flexneri 2a str. 301
uuugcaaaguuccuauau

SEQ ID NO: 1984158 - RNA, 20 nt, Shigella flexneri 2a str. 301
uuugcaaaguuccuauauuu

SEQ ID NO: 1984159 - RNA, 20 nt, Shigella flexneri 2a str. 301
uuugcacgcuuucugcguga

SEQ ID NO: 1984160 - RNA, 18 nt, Shigella flexneri 2a str. 301
uuugcaggaaaaacugcc

SEQ ID NO: 1984161 - RNA, 16 nt, Shigella flexneri 2a str. 301
uuugcacauuccagau

SEQ ID NO: 1984162 - RNA, 12 nt, Shigella flexneri 2a str. 301
uuugcaccagaa

SEQ ID NO: 1984163 - RNA, 22 nt, Shigella flexneri 2a str. 301
uuugcaccccaauuaauugcca

SEQ ID NO: 1984164 - RNA, 15 nt, Shigella flexneri 2a str. 301
uuugcaaucagauaa

SEQ ID NO: 1984165 - RNA, 21 nt, Shigella flexneri 2a str. 301
uuugcaaucagauaaaauaca

SEQ ID NO: 1984166 - RNA, 20 nt, Shigella flexneri 2a str. 301
uuugaugaguugaaaaccuc

SEQ ID NO: 1984167 - RNA, 12 nt, Shigella flexneri 2a str. 301
uuugaugccagc

SEQ ID NO: 1984168 - RNA, 16 nt, Shigella flexneri 2a str. 301
uuugaucgauggcagu

SEQ ID NO: 1984169 - RNA, 15 nt, Shigella flexneri 2a str. 301
uuugaggaagcugcc

SEQ ID NO: 1984170 - RNA, 16 nt, Shigella flexneri 2a str. 301
uuucuugcgaacaggu

SEQ ID NO: 1984171 - RNA, 11 nt, Shigella flexneri 2a str. 301
uuucuucuucg

SEQ ID NO: 1984172 - RNA, 22 nt, Shigella flexneri 2a str. 301
uuucuuuuacaucuacaaaaaa

SEQ ID NO: 1984173 - RNA, 16 nt, Shigella flexneri 2a str. 301
uuucuuucaccucuuc

SEQ ID NO: 1984174 - RNA, 12 nt, Shigella flexneri 2a str. 301
uuucuucauucg

SEQ ID NO: 1984175 - RNA, 20 nt, Shigella flexneri 2a str. 301
uuucuucauuaaauuuccgc

SEQ ID NO: 1984176 - RNA, 14 nt, Shigella flexneri 2a str. 301
uuucuuauuucacu

SEQ ID NO: 1984177 - RNA, 14 nt, Shigella flexneri 2a str. 301
uuucuucauuaaau

SEQ ID NO: 1984178 - RNA, 19 nt, Shigella flexneri 2a str. 301
uuucuguuaauguuagcaa

SEQ ID NO: 1984179 - RNA, 21 nt, Shigella flexneri 2a str. 301
uuucugucuuaacgcaccaug

SEQ ID NO: 1984180 - RNA, 13 nt, Shigella flexneri 2a str. 301
uuucuuaaauuaa

SEQ ID NO: 1984181 - RNA, 17 nt, Shigella flexneri 2a str. 301
uuugacaacaucaucug

SEQ ID NO: 1984182 - RNA, 22 nt, Shigella flexneri 2a str. 301
uuugacagccccugugccagcu

SEQ ID NO: 1984183 - RNA, 15 nt, Shigella flexneri 2a str. 301
uuugacauguugcug

SEQ ID NO: 1984184 - RNA, 16 nt, Shigella flexneri 2a str. 301
uuugacauguugcuga

SEQ ID NO: 1984185 - RNA, 17 nt, Shigella flexneri 2a str. 301
uuugagccaaaaugccu

SEQ ID NO: 1984186 - RNA, 14 nt, Shigella flexneri 2a str. 301
uuugaaaaaaccug

SEQ ID NO: 1984187 - RNA, 12 nt, Shigella flexneri 2a str. 301
uuucuuuuuaaa

SEQ ID NO: 1984188 - RNA, 21 nt, Shigella flexneri 2a str. 301
uuugaaaugaugucgcugucu

SEQ ID NO: 1984189 - RNA, 17 nt, Shigella flexneri 2a str. 301
uuuccggcagaagcaau

SEQ ID NO: 1984190 - RNA, 14 nt, Shigella flexneri 2a str. 301
uuuccgcuucugcu

SEQ ID NO: 1984191 - RNA, 17 nt, Shigella flexneri 2a str. 301
uuuccgggagcaauuug

SEQ ID NO: 1984192 - RNA, 20 nt, Shigella flexneri 2a str. 301
uuuccggguuguacauuuug

SEQ ID NO: 1984193 - RNA, 17 nt, Shigella flexneri 2a str. 301
uuuccggucgcaggcag

SEQ ID NO: 1984194 - RNA, 18 nt, Shigella flexneri 2a str. 301
uuuccggaucgccaaagc

SEQ ID NO: 1984195 - RNA, 21 nt, Shigella flexneri 2a str. 301
uuuccgcgaauuaugcagccu

SEQ ID NO: 1984196 - RNA, 19 nt, Shigella flexneri 2a str. 301
uuucccuauuuuuucgugu

SEQ ID NO: 1984197 - RNA, 14 nt, Shigella flexneri 2a str. 301
uuucccuccacucc

SEQ ID NO: 1984198 - RNA, 19 nt, Shigella flexneri 2a str. 301
uuucccgcuucguuuucag

SEQ ID NO: 1984199 - RNA, 18 nt, Shigella flexneri 2a str. 301
uuucccggguaaacacca

SEQ ID NO: 1984200 - RNA, 16 nt, Shigella flexneri 2a str. 301
uuucccuguugcgcuc

SEQ ID NO: 1984201 - RNA, 13 nt, Shigella flexneri 2a str. 301
uuuccauugcauc

SEQ ID NO: 1984202 - RNA, 14 nt, Shigella flexneri 2a str. 301
uuucccauucuugg

SEQ ID NO: 1984203 - RNA, 16 nt, Shigella flexneri 2a str. 301
uuuccagggccucucc

SEQ ID NO: 1984204 - RNA, 17 nt, Shigella flexneri 2a str. 301
uuuccagguuauuuuau

SEQ ID NO: 1984205 - RNA, 16 nt, Shigella flexneri 2a str. 301
uuuccaugaccugcca

SEQ ID NO: 1984206 - RNA, 20 nt, Shigella flexneri 2a str. 301
uuuccaucuccagcugcucg

SEQ ID NO: 1984207 - RNA, 14 nt, Shigella flexneri 2a str. 301
uuuccauccggcaa

SEQ ID NO: 1984208 - RNA, 13 nt, Shigella flexneri 2a str. 301
uuuccuuaacucc

SEQ ID NO: 1984209 - RNA, 18 nt, Shigella flexneri 2a str. 301
uuuccuuaacuccucgcc

SEQ ID NO: 1984210 - RNA, 18 nt, Shigella flexneri 2a str. 301
uuuccuuaaacaccuggc

SEQ ID NO: 1984211 - RNA, 19 nt, Shigella flexneri 2a str. 301
uuuccugcggaugcgccau

SEQ ID NO: 1984212 - RNA, 18 nt, Shigella flexneri 2a str. 301
uuuccuggcgaacaucca

SEQ ID NO: 1984213 - RNA, 20 nt, Shigella flexneri 2a str. 301
uuuccuucaggaucaaccgc

SEQ ID NO: 1984214 - RNA, 18 nt, Shigella flexneri 2a str. 301
uuuccugcuucacgccca

SEQ ID NO: 1984215 - RNA, 20 nt, Shigella flexneri 2a str. 301
uuuccugccagaccuuauca

SEQ ID NO: 1984216 - RNA, 15 nt, Shigella flexneri 2a str. 301
uuuccugagcacugg

SEQ ID NO: 1984217 - RNA, 21 nt, Shigella flexneri 2a str. 301
uuuccucaguaccgugcagcg

SEQ ID NO: 1984218 - RNA, 14 nt, Shigella flexneri 2a str. 301
uuuccguuaaccua

SEQ ID NO: 1984219 - RNA, 16 nt, Shigella flexneri 2a str. 301
uuucgcugucgguacu

SEQ ID NO: 1984220 - RNA, 15 nt, Shigella flexneri 2a str. 301
uuucgcuggcagacu

SEQ ID NO: 1984221 - RNA, 16 nt, Shigella flexneri 2a str. 301
uuucgaucuggcagcu

SEQ ID NO: 1984222 - RNA, 22 nt, Shigella flexneri 2a str. 301
uuucgccagcgccaguuuuugu

SEQ ID NO: 1984223 - RNA, 20 nt, Shigella flexneri 2a str. 301
uuucgaccggguuucuuauu

SEQ ID NO: 1984224 - RNA, 19 nt, Shigella flexneri 2a str. 301
uuucgagcaggucagucag

SEQ ID NO: 1984225 - RNA, 14 nt, Shigella flexneri 2a str. 301
uuucgauaaucaaa

SEQ ID NO: 1984226 - RNA, 22 nt, Shigella flexneri 2a str. 301
uuucgaggauccaugacaucuc

SEQ ID NO: 1984227 - RNA, 15 nt, Shigella flexneri 2a str. 301
uuucgaauuuuccau

SEQ ID NO: 1984228 - RNA, 20 nt, Shigella flexneri 2a str. 301
uuucgaaccacaaaagacga

SEQ ID NO: 1984229 - RNA, 13 nt, Shigella flexneri 2a str. 301
uuucgcuucuuca

SEQ ID NO: 1984230 - RNA, 17 nt, Shigella flexneri 2a str. 301
uuucgcuuuacucccgu

SEQ ID NO: 1984231 - RNA, 17 nt, Shigella flexneri 2a str. 301
uuucgcuucuucagccu

SEQ ID NO: 1984232 - RNA, 22 nt, Shigella flexneri 2a str. 301
uuucgucugguucgccaaaugu

SEQ ID NO: 1984233 - RNA, 12 nt, Shigella flexneri 2a str. 301
uuucuacaagca

SEQ ID NO: 1984234 - RNA, 20 nt, Shigella flexneri 2a str. 301
uuucuaauagccaucacaaa

SEQ ID NO: 1984235 - RNA, 20 nt, Shigella flexneri 2a str. 301
uuucuccccauggacgcguc

SEQ ID NO: 1984236 - RNA, 10 nt, Shigella flexneri 2a str. 301
uuucuccccc

SEQ ID NO: 1984237 - RNA, 21 nt, Shigella flexneri 2a str. 301
uuucucggaucgcacaaucca

SEQ ID NO: 1984238 - RNA, 17 nt, Shigella flexneri 2a str. 301
uuucuccuucacucuau

SEQ ID NO: 1984239 - RNA, 15 nt, Shigella flexneri 2a str. 301
uuucuccuucacucu

SEQ ID NO: 1984240 - RNA, 19 nt, Shigella flexneri 2a str. 301
uuucucugcaaauauuaau

SEQ ID NO: 1984241 - RNA, 16 nt, Shigella flexneri 2a str. 301
uuucuggaugccaucg

SEQ ID NO: 1984242 - RNA, 15 nt, Shigella flexneri 2a str. 301
uuucugcugccacuu

SEQ ID NO: 1984243 - RNA, 19 nt, Shigella flexneri 2a str. 301
uuucuggcaucacuucuuu

SEQ ID NO: 1984244 - RNA, 21 nt, Shigella flexneri 2a str. 301
uuucuggcggcuuauauauua

SEQ ID NO: 1984245 - RNA, 14 nt, Shigella flexneri 2a str. 301
uuucuggcgucaaa

SEQ ID NO: 1984246 - RNA, 18 nt, Shigella flexneri 2a str. 301
uuucuggaugccaucgca

SEQ ID NO: 1984247 - RNA, 14 nt, Shigella flexneri 2a str. 301
uuucuggaguuaaa

SEQ ID NO: 1984248 - RNA, 18 nt, Shigella flexneri 2a str. 301
uuucuggaguuaaauuaa

SEQ ID NO: 1984249 - RNA, 15 nt, Shigella flexneri 2a str. 301
uuucuggucugcugg

SEQ ID NO: 1984250 - RNA, 13 nt, Shigella flexneri 2a str. 301
uuucugaauuuca

SEQ ID NO: 1984251 - RNA, 13 nt, Shigella flexneri 2a str. 301
uuucugaacugaa

SEQ ID NO: 1984252 - RNA, 17 nt, Shigella flexneri 2a str. 301
uuucucuuuaaacagau

SEQ ID NO: 1984253 - RNA, 17 nt, Shigella flexneri 2a str. 301
uuucugcaucaaccaac

SEQ ID NO: 1984254 - RNA, 21 nt, Shigella flexneri 2a str. 301
uuucugaugcauaaaaaaacg

SEQ ID NO: 1984255 - RNA, 16 nt, Shigella flexneri 2a str. 301
uuucugagauucaauu

SEQ ID NO: 1984256 - RNA, 17 nt, Shigella flexneri 2a str. 301
uuucugagucaauuucu

SEQ ID NO: 1984257 - RNA, 19 nt, Shigella flexneri 2a str. 301
uuuucaccaacgcaaaaag

SEQ ID NO: 1984258 - RNA, 19 nt, Shigella flexneri 2a str. 301
uuuucacccacacuucaau

SEQ ID NO: 1984259 - RNA, 16 nt, Shigella flexneri 2a str. 301
uuuucagcguucccca

SEQ ID NO: 1984260 - RNA, 20 nt, Shigella flexneri 2a str. 301
uuuucaguagacucaagcag

SEQ ID NO: 1984261 - RNA, 19 nt, Shigella flexneri 2a str. 301
uuuucaauaaccugcaaaa

SEQ ID NO: 1984262 - RNA, 19 nt, Shigella flexneri 2a str. 301
uuuucaacgugucuuuuac

SEQ ID NO: 1984263 - RNA, 20 nt, Shigella flexneri 2a str. 301
uuuuauuugugguuggcgug

SEQ ID NO: 1984264 - RNA, 22 nt, Shigella flexneri 2a str. 301
uuuuccuauugcugcugaucca

SEQ ID NO: 1984265 - RNA, 21 nt, Shigella flexneri 2a str. 301
uuuuccgcacguuagaaacaa

SEQ ID NO: 1984266 - RNA, 19 nt, Shigella flexneri 2a str. 301
uuuuccccaccucaucaga

SEQ ID NO: 1984267 - RNA, 18 nt, Shigella flexneri 2a str. 301
uuuucccuuccgccauca

SEQ ID NO: 1984268 - RNA, 19 nt, Shigella flexneri 2a str. 301
uuuuccaguagauucaaca

SEQ ID NO: 1984269 - RNA, 11 nt, Shigella flexneri 2a str. 301
uuuuccagcac

SEQ ID NO: 1984270 - RNA, 15 nt, Shigella flexneri 2a str. 301
uuuucauugccgcau

SEQ ID NO: 1984271 - RNA, 14 nt, Shigella flexneri 2a str. 301
uuuuccacaaugcc

SEQ ID NO: 1984272 - RNA, 13 nt, Shigella flexneri 2a str. 301
uuuucguuuuaau

SEQ ID NO: 1984273 - RNA, 22 nt, Shigella flexneri 2a str. 301
uuuucguuacguggcacauucu

SEQ ID NO: 1984274 - RNA, 16 nt, Shigella flexneri 2a str. 301
uuuucgccacuucagc

SEQ ID NO: 1984275 - RNA, 22 nt, Shigella flexneri 2a str. 301
uuuuccugcugcaucugaaacu

SEQ ID NO: 1984276 - RNA, 17 nt, Shigella flexneri 2a str. 301
uuuuccuugaaaaagag

SEQ ID NO: 1984277 - RNA, 17 nt, Shigella flexneri 2a str. 301
uuuucgagcaggucagu

SEQ ID NO: 1984278 - RNA, 20 nt, Shigella flexneri 2a str. 301
uuuucgaucacuuuuaaauu

SEQ ID NO: 1984279 - RNA, 14 nt, Shigella flexneri 2a str. 301
uuuuauaguacuuc

SEQ ID NO: 1984280 - RNA, 21 nt, Shigella flexneri 2a str. 301
uuuuauaaagaacucgaggau

SEQ ID NO: 1984281 - RNA, 20 nt, Shigella flexneri 2a str. 301
uuuuagcggaacgcagauau

SEQ ID NO: 1984282 - RNA, 17 nt, Shigella flexneri 2a str. 301
uuuuaguaucuauucau

SEQ ID NO: 1984283 - RNA, 18 nt, Shigella flexneri 2a str. 301
uuuuacgucugcaauuua

SEQ ID NO: 1984284 - RNA, 21 nt, Shigella flexneri 2a str. 301
uuuuacgcaaccacaaaacac

SEQ ID NO: 1984285 - RNA, 21 nt, Shigella flexneri 2a str. 301
uuuuacgccuguuaaucagcu

SEQ ID NO: 1984286 - RNA, 23 nt, Shigella flexneri 2a str. 301
uuuuaugauaggucauaucacaa

SEQ ID NO: 1984287 - RNA, 20 nt, Shigella flexneri 2a str. 301
uuuuaucucccuguauccca

SEQ ID NO: 1984288 - RNA, 18 nt, Shigella flexneri 2a str. 301
uuuuaucucuuacagaaa

SEQ ID NO: 1984289 - RNA, 19 nt, Shigella flexneri 2a str. 301
uuuuauugcguaaucuuuu

SEQ ID NO: 1984290 - RNA, 13 nt, Shigella flexneri 2a str. 301
uuuuauuuacacu

SEQ ID NO: 1984291 - RNA, 17 nt, Shigella flexneri 2a str. 301
uuuuauuaaauguguuu

SEQ ID NO: 1984292 - RNA, 16 nt, Shigella flexneri 2a str. 301
uuuuauguucagauaa

SEQ ID NO: 1984293 - RNA, 22 nt, Shigella flexneri 2a str. 301
uuugucaugacuacacuaaacg

SEQ ID NO: 1984294 - RNA, 17 nt, Shigella flexneri 2a str. 301
uuuguccauaaaaugca

SEQ ID NO: 1984295 - RNA, 14 nt, Shigella flexneri 2a str. 301
uuugucauuacuua

SEQ ID NO: 1984296 - RNA, 16 nt, Shigella flexneri 2a str. 301
uuugucaucaguuuca

SEQ ID NO: 1984297 - RNA, 16 nt, Shigella flexneri 2a str. 301
uuuguccgcuauuucu

SEQ ID NO: 1984298 - RNA, 23 nt, Shigella flexneri 2a str. 301
uuugucgugggcaggaaaaucag

SEQ ID NO: 1984299 - RNA, 15 nt, Shigella flexneri 2a str. 301
uuugugaucuuuuuc

SEQ ID NO: 1984300 - RNA, 16 nt, Shigella flexneri 2a str. 301
uuugugggaauaacca

SEQ ID NO: 1984301 - RNA, 21 nt, Shigella flexneri 2a str. 301
uuuguacaggauauauuucau

SEQ ID NO: 1984302 - RNA, 12 nt, Shigella flexneri 2a str. 301
uuuguauuuuau

SEQ ID NO: 1984303 - RNA, 18 nt, Shigella flexneri 2a str. 301
uuuguauuagaugcuagu

SEQ ID NO: 1984304 - RNA, 20 nt, Shigella flexneri 2a str. 301
uuuguaugccuggcauuucu

SEQ ID NO: 1984305 - RNA, 13 nt, Shigella flexneri 2a str. 301
uuuguaucgcuga

SEQ ID NO: 1984306 - RNA, 15 nt, Shigella flexneri 2a str. 301
uuuguaggccugaua

SEQ ID NO: 1984307 - RNA, 17 nt, Shigella flexneri 2a str. 301
uuuggaugagcaugcgg

SEQ ID NO: 1984308 - RNA, 20 nt, Shigella flexneri 2a str. 301
uuugcuuuugucaucagacu

SEQ ID NO: 1984309 - RNA, 12 nt, Shigella flexneri 2a str. 301
uuugcuuuuguu

SEQ ID NO: 1984310 - RNA, 14 nt, Shigella flexneri 2a str. 301
uuugcuuuguaaag

SEQ ID NO: 1984311 - RNA, 23 nt, Shigella flexneri 2a str. 301
uuuggugaagugagaauuuuuca

SEQ ID NO: 1984312 - RNA, 18 nt, Shigella flexneri 2a str. 301
uuuggucuggcaaaaaua

SEQ ID NO: 1984313 - RNA, 17 nt, Shigella flexneri 2a str. 301
uuuggcaucaaucaacg

SEQ ID NO: 1984314 - RNA, 12 nt, Shigella flexneri 2a str. 301
uuuuacaucauc

SEQ ID NO: 1984315 - RNA, 16 nt, Shigella flexneri 2a str. 301
uuuuacaucuacaaaa

SEQ ID NO: 1984316 - RNA, 20 nt, Shigella flexneri 2a str. 301
uuuuacaucuacaaaaaacu

SEQ ID NO: 1984317 - RNA, 22 nt, Shigella flexneri 2a str. 301
uuuuacaucuacaaaaaacugg

SEQ ID NO: 1984318 - RNA, 14 nt, Shigella flexneri 2a str. 301
uuuuaccagcgccu

SEQ ID NO: 1984319 - RNA, 23 nt, Shigella flexneri 2a str. 301
uuuuaccggucaggauuuccagc

SEQ ID NO: 1984320 - RNA, 22 nt, Shigella flexneri 2a str. 301
uuuuaccucuuucucauaaaac

SEQ ID NO: 1984321 - RNA, 20 nt, Shigella flexneri 2a str. 301
uuuuaaucgucaguuuuuca

SEQ ID NO: 1984322 - RNA, 19 nt, Shigella flexneri 2a str. 301
uuuuacaacguauugaaau

SEQ ID NO: 1984323 - RNA, 13 nt, Shigella flexneri 2a str. 301
uuuuaaauugaag

SEQ ID NO: 1984324 - RNA, 13 nt, Shigella flexneri 2a str. 301
uuuuaacuuuaau

SEQ ID NO: 1984325 - RNA, 22 nt, Shigella flexneri 2a str. 301
uuuuaacgccugacuggcuacu

SEQ ID NO: 1984326 - RNA, 16 nt, Shigella flexneri 2a str. 301
uuuuaagcaagugcaa

SEQ ID NO: 1984327 - RNA, 12 nt, Shigella flexneri 2a str. 301
uuuuaagugaug

SEQ ID NO: 1984328 - RNA, 20 nt, Shigella flexneri 2a str. 301
uuuguugcgcugaaacuuua

SEQ ID NO: 1984329 - RNA, 12 nt, Shigella flexneri 2a str. 301
uuuguugccgcc

SEQ ID NO: 1984330 - RNA, 19 nt, Shigella flexneri 2a str. 301
uuuguugauaaacaaacag

SEQ ID NO: 1984331 - RNA, 13 nt, Shigella flexneri 2a str. 301
uuuguucucuucu

SEQ ID NO: 1984332 - RNA, 22 nt, Shigella flexneri 2a str. 301
uuuguuacgauagaauauuucu

SEQ ID NO: 1984333 - RNA, 15 nt, Shigella flexneri 2a str. 301
uuuguuuguucuucu

SEQ ID NO: 1984334 - RNA, 20 nt, Shigella flexneri 2a str. 301
uuuuaaauaucaucaaaauu

SEQ ID NO: 1984335 - RNA, 21 nt, Shigella flexneri 2a str. 301
uuuugcuuucuauaagauacu

SEQ ID NO: 1984336 - RNA, 17 nt, Shigella flexneri 2a str. 301
uuuuggcgagagacgcu

SEQ ID NO: 1984337 - RNA, 17 nt, Shigella flexneri 2a str. 301
uuuuggcgaauuguucu

SEQ ID NO: 1984338 - RNA, 17 nt, Shigella flexneri 2a str. 301
uuuugggccagggauau

SEQ ID NO: 1984339 - RNA, 18 nt, Shigella flexneri 2a str. 301
uuuugcgcauccagcgcu

SEQ ID NO: 1984340 - RNA, 22 nt, Shigella flexneri 2a str. 301
uuuugccggacggcuguaaaug

SEQ ID NO: 1984341 - RNA, 21 nt, Shigella flexneri 2a str. 301
uuuugccgcccagucacggcu

SEQ ID NO: 1984342 - RNA, 14 nt, Shigella flexneri 2a str. 301
uuuugccgaauuca

SEQ ID NO: 1984343 - RNA, 22 nt, Shigella flexneri 2a str. 301
uuuugcaggaaaaacugcccgu

SEQ ID NO: 1984344 - RNA, 20 nt, Shigella flexneri 2a str. 301
uuuugaugcuguaaaaugag

SEQ ID NO: 1984345 - RNA, 17 nt, Shigella flexneri 2a str. 301
uuuugacgcccccaaac

SEQ ID NO: 1984346 - RNA, 13 nt, Shigella flexneri 2a str. 301
uuuucuuccaacc

SEQ ID NO: 1984347 - RNA, 17 nt, Shigella flexneri 2a str. 301
uuuucuuaacaaaaacu

SEQ ID NO: 1984348 - RNA, 21 nt, Shigella flexneri 2a str. 301
uuuucuuaacaaaaacuuuug

SEQ ID NO: 1984349 - RNA, 12 nt, Shigella flexneri 2a str. 301
uuuucuucaguu

SEQ ID NO: 1984350 - RNA, 11 nt, Shigella flexneri 2a str. 301
uuuucuuucac

SEQ ID NO: 1984351 - RNA, 11 nt, Shigella flexneri 2a str. 301
uuuugaacaga

SEQ ID NO: 1984352 - RNA, 22 nt, Shigella flexneri 2a str. 301
uuuugaacagcgguguacccug

SEQ ID NO: 1984353 - RNA, 15 nt, Shigella flexneri 2a str. 301
uuuucuacacagacg

SEQ ID NO: 1984354 - RNA, 14 nt, Shigella flexneri 2a str. 301
uuuucucaauauaa

SEQ ID NO: 1984355 - RNA, 16 nt, Shigella flexneri 2a str. 301
uuuucuggaugccauc

SEQ ID NO: 1984356 - RNA, 15 nt, Shigella flexneri 2a str. 301
uuuucuggcacaacu

SEQ ID NO: 1984357 - RNA, 11 nt, Shigella flexneri 2a str. 301
uuuucucuauc

SEQ ID NO: 1984358 - RNA, 17 nt, Shigella flexneri 2a str. 301
uuuuuccagauugcuua

SEQ ID NO: 1984359 - RNA, 12 nt, Shigella flexneri 2a str. 301
uuuuucaucccu

SEQ ID NO: 1984360 - RNA, 22 nt, Shigella flexneri 2a str. 301
uuuuuccagguacuuuugaaug

SEQ ID NO: 1984361 - RNA, 19 nt, Shigella flexneri 2a str. 301
uuuuucaaccuaaaguaaa

SEQ ID NO: 1984362 - RNA, 19 nt, Shigella flexneri 2a str. 301
uuuuucacugcggcaagaa

SEQ ID NO: 1984363 - RNA, 13 nt, Shigella flexneri 2a str. 301
uuuuuacccagca

SEQ ID NO: 1984364 - RNA, 19 nt, Shigella flexneri 2a str. 301
uuuuuacaucaucagaaau

SEQ ID NO: 1984365 - RNA, 23 nt, Shigella flexneri 2a str. 301
uuuuuagcacaaaaauagcccca

SEQ ID NO: 1984366 - RNA, 23 nt, Shigella flexneri 2a str. 301
uuuuuaguuguaaucauauuaaa

SEQ ID NO: 1984367 - RNA, 17 nt, Shigella flexneri 2a str. 301
uuuuuauagcuuauucu

SEQ ID NO: 1984368 - RNA, 15 nt, Shigella flexneri 2a str. 301
uuuuuaucuucaaga

SEQ ID NO: 1984369 - RNA, 18 nt, Shigella flexneri 2a str. 301
uuuuuaugcuuccuuccu

SEQ ID NO: 1984370 - RNA, 12 nt, Shigella flexneri 2a str. 301
uuuuuaugcuuc

SEQ ID NO: 1984371 - RNA, 23 nt, Shigella flexneri 2a str. 301
uuuuuaugaguuuggugccacgc

SEQ ID NO: 1984372 - RNA, 22 nt, Shigella flexneri 2a str. 301
uuuuuaacgccgcuauacgccu

SEQ ID NO: 1984373 - RNA, 19 nt, Shigella flexneri 2a str. 301
uuuuuaauagagauagccu

SEQ ID NO: 1984374 - RNA, 20 nt, Shigella flexneri 2a str. 301
uuuuuaauguggcuggggua

SEQ ID NO: 1984375 - RNA, 16 nt, Shigella flexneri 2a str. 301
uuuuuaaacaucaaac

SEQ ID NO: 1984376 - RNA, 14 nt, Shigella flexneri 2a str. 301
uuuuuaaacauuaa

SEQ ID NO: 1984377 - RNA, 11 nt, Shigella flexneri 2a str. 301
uuuuuaaacau

SEQ ID NO: 1984378 - RNA, 14 nt, Shigella flexneri 2a str. 301
uuuuuaaauuuccc

SEQ ID NO: 1984379 - RNA, 15 nt, Shigella flexneri 2a str. 301
uuuuuaaauuuccca

SEQ ID NO: 1984380 - RNA, 22 nt, Shigella flexneri 2a str. 301
uuuuguuucugaaucucuaagc

SEQ ID NO: 1984381 - RNA, 12 nt, Shigella flexneri 2a str. 301
uuuuggugcuuu

SEQ ID NO: 1984382 - RNA, 23 nt, Shigella flexneri 2a str. 301
uuuugguccuggucugaugaaug

SEQ ID NO: 1984383 - RNA, 17 nt, Shigella flexneri 2a str. 301
uuuuguaucgaacaaga

SEQ ID NO: 1984384 - RNA, 12 nt, Shigella flexneri 2a str. 301
uuuuguagaccu

SEQ ID NO: 1984385 - RNA, 13 nt, Shigella flexneri 2a str. 301
uuuuguccccuca

SEQ ID NO: 1984386 - RNA, 20 nt, Shigella flexneri 2a str. 301
uuuugucaugcgcucuccca

SEQ ID NO: 1984387 - RNA, 16 nt, Shigella flexneri 2a str. 301
uuuuguuuaaauaucu

SEQ ID NO: 1984388 - RNA, 19 nt, Shigella flexneri 2a str. 301
aaauguuuaguauuguuaa

SEQ ID NO: 1984389 - RNA, 23 nt, Shigella flexneri 2a str. 301
aaauguguuuuuauuugauuuca

SEQ ID NO: 1984390 - RNA, 19 nt, Shigella flexneri 2a str. 301
aaauguuaucgggcauagg

SEQ ID NO: 1984391 - RNA, 14 nt, Shigella flexneri 2a str. 301
aaauguuaagacug

SEQ ID NO: 1984392 - RNA, 12 nt, Shigella flexneri 2a str. 301
uuuuuucacaug

SEQ ID NO: 1984393 - RNA, 18 nt, Shigella flexneri 2a str. 301
aaaugugaagaggaacaa

SEQ ID NO: 1984394 - RNA, 18 nt, Shigella flexneri 2a str. 301
uuuuuucaaccuaaagua

SEQ ID NO: 1984395 - RNA, 21 nt, Shigella flexneri 2a str. 301
aaaugugccggaugcaucaca

SEQ ID NO: 1984396 - RNA, 19 nt, Shigella flexneri 2a str. 301
aaaugugccggaugcauca

SEQ ID NO: 1984397 - RNA, 20 nt, Shigella flexneri 2a str. 301
uuuuuuaucuucaagaauca

SEQ ID NO: 1984398 - RNA, 23 nt, Shigella flexneri 2a str. 301
aaauuaacgacgcauacucuuug

SEQ ID NO: 1984399 - RNA, 15 nt, Shigella flexneri 2a str. 301
aaauuaauccgguaa

SEQ ID NO: 1984400 - RNA, 21 nt, Shigella flexneri 2a str. 301
uuuuucgacaaacaccgaacc

SEQ ID NO: 1984401 - RNA, 22 nt, Shigella flexneri 2a str. 301
uuuuucgacaucaagaaaugca

SEQ ID NO: 1984402 - RNA, 22 nt, Shigella flexneri 2a str. 301
uuuuucgcgauagccgcuuucu

SEQ ID NO: 1984403 - RNA, 20 nt, Shigella flexneri 2a str. 301
uuuuugcucaacccuuucca

SEQ ID NO: 1984404 - RNA, 16 nt, Shigella flexneri 2a str. 301
uuuuugcgcgaagaaa

SEQ ID NO: 1984405 - RNA, 19 nt, Shigella flexneri 2a str. 301
uuuuugccugccagucaau

SEQ ID NO: 1984406 - RNA, 19 nt, Shigella flexneri 2a str. 301
uuuuugauaaucuucuucg

SEQ ID NO: 1984407 - RNA, 20 nt, Shigella flexneri 2a str. 301
aaauucaagacaucaauaaa

SEQ ID NO: 1984408 - RNA, 19 nt, Shigella flexneri 2a str. 301
aaauucaagacaucaauaa

SEQ ID NO: 1984409 - RNA, 15 nt, Shigella flexneri 2a str. 301
aaauuauuuuaaauu

SEQ ID NO: 1984410 - RNA, 13 nt, Shigella flexneri 2a str. 301
aaauucaaagugu

SEQ ID NO: 1984411 - RNA, 17 nt, Shigella flexneri 2a str. 301
aaauucauuaccaaccu

SEQ ID NO: 1984412 - RNA, 19 nt, Shigella flexneri 2a str. 301
aaauucauucaauuaauaa

SEQ ID NO: 1984413 - RNA, 22 nt, Shigella flexneri 2a str. 301
aaauucauucaauuaauaacac

SEQ ID NO: 1984414 - RNA, 13 nt, Shigella flexneri 2a str. 301
aaauuccagaaaa

SEQ ID NO: 1984415 - RNA, 18 nt, Shigella flexneri 2a str. 301
aaauucaggaauucagaa

SEQ ID NO: 1984416 - RNA, 21 nt, Shigella flexneri 2a str. 301
aaauucagcauuacccgucug

SEQ ID NO: 1984417 - RNA, 15 nt, Shigella flexneri 2a str. 301
aaauucgaaauagag

SEQ ID NO: 1984418 - RNA, 19 nt, Shigella flexneri 2a str. 301
aaauuccuaugcaacaacu

SEQ ID NO: 1984419 - RNA, 21 nt, Shigella flexneri 2a str. 301
aaauuccuaaccgaauucaaa

SEQ ID NO: 1984420 - RNA, 15 nt, Shigella flexneri 2a str. 301
aaauuccgaacaaaa

SEQ ID NO: 1984421 - RNA, 22 nt, Shigella flexneri 2a str. 301
aaauucuacagaaaugaaaaaa

SEQ ID NO: 1984422 - RNA, 23 nt, Shigella flexneri 2a str. 301
aaauucuacagaaaugaaaaaau

SEQ ID NO: 1984423 - RNA, 14 nt, Shigella flexneri 2a str. 301
aaauucuuaaugau

SEQ ID NO: 1984424 - RNA, 14 nt, Shigella flexneri 2a str. 301
aaauucuggcacca

SEQ ID NO: 1984425 - RNA, 17 nt, Shigella flexneri 2a str. 301
aaauucuggcaccaccu

SEQ ID NO: 1984426 - RNA, 23 nt, Shigella flexneri 2a str. 301
aaauuacucccgugccagagcau

SEQ ID NO: 1984427 - RNA, 21 nt, Shigella flexneri 2a str. 301
aaauuacugccuugaugaaaa

SEQ ID NO: 1984428 - RNA, 22 nt, Shigella flexneri 2a str. 301
aaauuacugccuugaugaaaaa

SEQ ID NO: 1984429 - RNA, 23 nt, Shigella flexneri 2a str. 301
aaauuacugccuugaugaaaaaa

SEQ ID NO: 1984430 - RNA, 11 nt, Shigella flexneri 2a str. 301
uuuuuuuucag

SEQ ID NO: 1984431 - RNA, 23 nt, Shigella flexneri 2a str. 301
aaauuaccgcaccaccagcagcu

SEQ ID NO: 1984432 - RNA, 12 nt, Shigella flexneri 2a str. 301
aaauuacgaucc

SEQ ID NO: 1984433 - RNA, 10 nt, Shigella flexneri 2a str. 301
uuuuuuccug

SEQ ID NO: 1984434 - RNA, 13 nt, Shigella flexneri 2a str. 301
uuuuuucuuccca

SEQ ID NO: 1984435 - RNA, 13 nt, Shigella flexneri 2a str. 301
uuuuuuucaaccu

SEQ ID NO: 1984436 - RNA, 16 nt, Shigella flexneri 2a str. 301
uuuuuugccaaauauc

SEQ ID NO: 1984437 - RNA, 14 nt, Shigella flexneri 2a str. 301
aaauuauaucuuau

SEQ ID NO: 1984438 - RNA, 15 nt, Shigella flexneri 2a str. 301
aaauuauaucuuauu

SEQ ID NO: 1984439 - RNA, 20 nt, Shigella flexneri 2a str. 301
aaauuaggucaaagaaucaa

SEQ ID NO: 1984440 - RNA, 19 nt, Shigella flexneri 2a str. 301
aaauuaucucuguuuugca

SEQ ID NO: 1984441 - RNA, 21 nt, Shigella flexneri 2a str. 301
aaauuauccacggcacaggcg

SEQ ID NO: 1984442 - RNA, 13 nt, Shigella flexneri 2a str. 301
aaauuauuuuaaa

SEQ ID NO: 1984443 - RNA, 13 nt, Shigella flexneri 2a str. 301
aauacaaaugccu

SEQ ID NO: 1984444 - RNA, 15 nt, Shigella flexneri 2a str. 301
aauacagcaauggaa

SEQ ID NO: 1984445 - RNA, 19 nt, Shigella flexneri 2a str. 301
aauacacuaacagaacaau

SEQ ID NO: 1984446 - RNA, 21 nt, Shigella flexneri 2a str. 301
aauacagcccagacaaaugaa

SEQ ID NO: 1984447 - RNA, 22 nt, Shigella flexneri 2a str. 301
aauacagccagccagcaccagg

SEQ ID NO: 1984448 - RNA, 21 nt, Shigella flexneri 2a str. 301
aauacagguuucaaugcacaa

SEQ ID NO: 1984449 - RNA, 19 nt, Shigella flexneri 2a str. 301
aauacauauauuacaacgu

SEQ ID NO: 1984450 - RNA, 17 nt, Shigella flexneri 2a str. 301
aauacauugauauacag

SEQ ID NO: 1984451 - RNA, 19 nt, Shigella flexneri 2a str. 301
aauacuccccuuucuuauu

SEQ ID NO: 1984452 - RNA, 17 nt, Shigella flexneri 2a str. 301
aauacuccauaacuauu

SEQ ID NO: 1984453 - RNA, 20 nt, Shigella flexneri 2a str. 301
aauagaaccuaagaaccaga

SEQ ID NO: 1984454 - RNA, 23 nt, Shigella flexneri 2a str. 301
aauaccauggcucaccagcagcg

SEQ ID NO: 1984455 - RNA, 19 nt, Shigella flexneri 2a str. 301
aauaccauggcucaccagc

SEQ ID NO: 1984456 - RNA, 13 nt, Shigella flexneri 2a str. 301
aauagcucaauga

SEQ ID NO: 1984457 - RNA, 14 nt, Shigella flexneri 2a str. 301
aauagcucaaugaa

SEQ ID NO: 1984458 - RNA, 20 nt, Shigella flexneri 2a str. 301
aauagcgucuacuaacgcuu

SEQ ID NO: 1984459 - RNA, 19 nt, Shigella flexneri 2a str. 301
aauagcguuaaucaucaac

SEQ ID NO: 1984460 - RNA, 19 nt, Shigella flexneri 2a str. 301
aauagcguuaauggcagau

SEQ ID NO: 1984461 - RNA, 14 nt, Shigella flexneri 2a str. 301
aauagacggagggg

SEQ ID NO: 1984462 - RNA, 15 nt, Shigella flexneri 2a str. 301
aauagagauagaaug

SEQ ID NO: 1984463 - RNA, 22 nt, Shigella flexneri 2a str. 301
aauagagaaaguaaaccaccag

SEQ ID NO: 1984464 - RNA, 22 nt, Shigella flexneri 2a str. 301
aauaguuccacuauuucaauau

SEQ ID NO: 1984465 - RNA, 20 nt, Shigella flexneri 2a str. 301
aauaguuuccgcuucugcuu

SEQ ID NO: 1984466 - RNA, 14 nt, Shigella flexneri 2a str. 301
aauaguuucaguau

SEQ ID NO: 1984467 - RNA, 18 nt, Shigella flexneri 2a str. 301
aauaguuucugacauuuu

SEQ ID NO: 1984468 - RNA, 19 nt, Shigella flexneri 2a str. 301
aauaguuucagccucugcc

SEQ ID NO: 1984469 - RNA, 13 nt, Shigella flexneri 2a str. 301
aauagcuuuaccc

SEQ ID NO: 1984470 - RNA, 13 nt, Shigella flexneri 2a str. 301
aauaggaaucauu

SEQ ID NO: 1984471 - RNA, 19 nt, Shigella flexneri 2a str. 301
aauagguugaguaugucgu

SEQ ID NO: 1984472 - RNA, 19 nt, Shigella flexneri 2a str. 301
aauaucggcaccagcgcag

SEQ ID NO: 1984473 - RNA, 23 nt, Shigella flexneri 2a str. 301
aauaucuuauagacuaaauuuca

SEQ ID NO: 1984474 - RNA, 16 nt, Shigella flexneri 2a str. 301
aauaucuuccuggcgc

SEQ ID NO: 1984475 - RNA, 20 nt, Shigella flexneri 2a str. 301
aauaucuuuucuuaacaaaa

SEQ ID NO: 1984476 - RNA, 12 nt, Shigella flexneri 2a str. 301
aauaucuuuucu

SEQ ID NO: 1984477 - RNA, 15 nt, Shigella flexneri 2a str. 301
aauaucuuuucuuaa

SEQ ID NO: 1984478 - RNA, 17 nt, Shigella flexneri 2a str. 301
aauaucuuucauauuca

SEQ ID NO: 1984479 - RNA, 14 nt, Shigella flexneri 2a str. 301
aauaucaauacauc

SEQ ID NO: 1984480 - RNA, 23 nt, Shigella flexneri 2a str. 301
aauaucgagacgggcgaggaaau

SEQ ID NO: 1984481 - RNA, 22 nt, Shigella flexneri 2a str. 301
aauauccuguggacgcagcuca

SEQ ID NO: 1984482 - RNA, 17 nt, Shigella flexneri 2a str. 301
aauauaaaacaacggaa

SEQ ID NO: 1984483 - RNA, 21 nt, Shigella flexneri 2a str. 301
aauauauugcaaucaucuugu

SEQ ID NO: 1984484 - RNA, 15 nt, Shigella flexneri 2a str. 301
aauauaugcauugau

SEQ ID NO: 1984485 - RNA, 18 nt, Shigella flexneri 2a str. 301
aauaucaagaucaucaaa

SEQ ID NO: 1984486 - RNA, 13 nt, Shigella flexneri 2a str. 301
aauaugaacauga

SEQ ID NO: 1984487 - RNA, 21 nt, Shigella flexneri 2a str. 301
aauaugaauuaacgucaggug

SEQ ID NO: 1984488 - RNA, 19 nt, Shigella flexneri 2a str. 301
aauauuaacuuaauaaaca

SEQ ID NO: 1984489 - RNA, 18 nt, Shigella flexneri 2a str. 301
aauauuauggcugucaug

SEQ ID NO: 1984490 - RNA, 20 nt, Shigella flexneri 2a str. 301
aauauuaaggguaaaaggau

SEQ ID NO: 1984491 - RNA, 13 nt, Shigella flexneri 2a str. 301
aauauuaaugcug

SEQ ID NO: 1984492 - RNA, 14 nt, Shigella flexneri 2a str. 301
aauauuacuucaga

SEQ ID NO: 1984493 - RNA, 15 nt, Shigella flexneri 2a str. 301
aauauugauuauugg

SEQ ID NO: 1984494 - RNA, 14 nt, Shigella flexneri 2a str. 301
aauauucagccaaa

SEQ ID NO: 1984495 - RNA, 21 nt, Shigella flexneri 2a str. 301
aauauucagccaaauccgauu

SEQ ID NO: 1984496 - RNA, 20 nt, Shigella flexneri 2a str. 301
aauauucugaagcaaacuug

SEQ ID NO: 1984497 - RNA, 20 nt, Shigella flexneri 2a str. 301
aauauucgccucguucccag

SEQ ID NO: 1984498 - RNA, 12 nt, Shigella flexneri 2a str. 301
aaucaaaugacu

SEQ ID NO: 1984499 - RNA, 14 nt, Shigella flexneri 2a str. 301
aaucaacaaaccaa

SEQ ID NO: 1984500 - RNA, 23 nt, Shigella flexneri 2a str. 301
aaucaacaauugcgggccaaaga

SEQ ID NO: 1984501 - RNA, 13 nt, Shigella flexneri 2a str. 301
aaucaaauacccu

SEQ ID NO: 1984502 - RNA, 19 nt, Shigella flexneri 2a str. 301
aaucaaauagccugccaga

SEQ ID NO: 1984503 - RNA, 16 nt, Shigella flexneri 2a str. 301
aaucaaauacaccuau

SEQ ID NO: 1984504 - RNA, 22 nt, Shigella flexneri 2a str. 301
aaucaacaugaaaauaaccaua

SEQ ID NO: 1984505 - RNA, 16 nt, Shigella flexneri 2a str. 301
aaucaacgaugucaau

SEQ ID NO: 1984506 - RNA, 19 nt, Shigella flexneri 2a str. 301
aaucaacaccaaacccgga

SEQ ID NO: 1984507 - RNA, 20 nt, Shigella flexneri 2a str. 301
aaucaacaccacugccagau

SEQ ID NO: 1984508 - RNA, 23 nt, Shigella flexneri 2a str. 301
aaucaaaaaaggcugacaaauca

SEQ ID NO: 1984509 - RNA, 20 nt, Shigella flexneri 2a str. 301
aaucaaaaaaggcugacaaa

SEQ ID NO: 1984510 - RNA, 22 nt, Shigella flexneri 2a str. 301
aauauuucccggccagucguag

SEQ ID NO: 1984511 - RNA, 22 nt, Shigella flexneri 2a str. 301
aaucaaaaaacuggaaaaauaa

SEQ ID NO: 1984512 - RNA, 20 nt, Shigella flexneri 2a str. 301
aaucaaaaaacuggaaaaau

SEQ ID NO: 1984513 - RNA, 21 nt, Shigella flexneri 2a str. 301
aaucaaaaaacuggaaaaaua

SEQ ID NO: 1984514 - RNA, 12 nt, Shigella flexneri 2a str. 301
aaucaaaaaacu

SEQ ID NO: 1984515 - RNA, 17 nt, Shigella flexneri 2a str. 301
aauauuuuucgucaguu

SEQ ID NO: 1984516 - RNA, 22 nt, Shigella flexneri 2a str. 301
aauauuuuguugcauaauuuca

SEQ ID NO: 1984517 - RNA, 19 nt, Shigella flexneri 2a str. 301
aaucacgacaaacacaaua

SEQ ID NO: 1984518 - RNA, 19 nt, Shigella flexneri 2a str. 301
aaucacgauugcugccgau

SEQ ID NO: 1984519 - RNA, 22 nt, Shigella flexneri 2a str. 301
aaucaccucaucaccacagaca

SEQ ID NO: 1984520 - RNA, 16 nt, Shigella flexneri 2a str. 301
aaucaccucuuuuucc

SEQ ID NO: 1984521 - RNA, 16 nt, Shigella flexneri 2a str. 301
aaucacgccgcccaua

SEQ ID NO: 1984522 - RNA, 13 nt, Shigella flexneri 2a str. 301
aaucacugccaga

SEQ ID NO: 1984523 - RNA, 15 nt, Shigella flexneri 2a str. 301
aaucacucaaaauau

SEQ ID NO: 1984524 - RNA, 14 nt, Shigella flexneri 2a str. 301
aaucacuucaucgc

SEQ ID NO: 1984525 - RNA, 13 nt, Shigella flexneri 2a str. 301
aaucacuucuucu

SEQ ID NO: 1984526 - RNA, 20 nt, Shigella flexneri 2a str. 301
aaucacuucuucuuguucau

SEQ ID NO: 1984527 - RNA, 15 nt, Shigella flexneri 2a str. 301
aaucacugccagaau

SEQ ID NO: 1984528 - RNA, 17 nt, Shigella flexneri 2a str. 301
aaucacugucauuagcc

SEQ ID NO: 1984529 - RNA, 19 nt, Shigella flexneri 2a str. 301
aaucacuugcgcauaauaa

SEQ ID NO: 1984530 - RNA, 22 nt, Shigella flexneri 2a str. 301
aaucagagccauccaguuuaau

SEQ ID NO: 1984531 - RNA, 14 nt, Shigella flexneri 2a str. 301
aaucagaauuuuuc

SEQ ID NO: 1984532 - RNA, 15 nt, Shigella flexneri 2a str. 301
aaucagaauuuuucg

SEQ ID NO: 1984533 - RNA, 21 nt, Shigella flexneri 2a str. 301
aaucagaagacgauaauuagg

SEQ ID NO: 1984534 - RNA, 22 nt, Shigella flexneri 2a str. 301
aaucagaucguugaccugaaua

SEQ ID NO: 1984535 - RNA, 14 nt, Shigella flexneri 2a str. 301
aaucagcaucaacc

SEQ ID NO: 1984536 - RNA, 24 nt, Shigella flexneri 2a str. 301
aaucagcaauuuuuccugguucuc

SEQ ID NO: 1984537 - RNA, 13 nt, Shigella flexneri 2a str. 301
aaucagcaauaaa

SEQ ID NO: 1984538 - RNA, 24 nt, Shigella flexneri 2a str. 301
aaucagccgcccggggagcaacag

SEQ ID NO: 1984539 - RNA, 17 nt, Shigella flexneri 2a str. 301
aaucagcuaauggcugc

SEQ ID NO: 1984540 - RNA, 18 nt, Shigella flexneri 2a str. 301
aaucaguucuaccaucaa

SEQ ID NO: 1984541 - RNA, 17 nt, Shigella flexneri 2a str. 301
aaucaguucaccacuuu

SEQ ID NO: 1984542 - RNA, 15 nt, Shigella flexneri 2a str. 301
aaucaucaaugccag

SEQ ID NO: 1984543 - RNA, 22 nt, Shigella flexneri 2a str. 301
aaucaucacgcgguuacgcacc

SEQ ID NO: 1984544 - RNA, 21 nt, Shigella flexneri 2a str. 301
aaucaacuuauugguaaacuc

SEQ ID NO: 1984545 - RNA, 17 nt, Shigella flexneri 2a str. 301
aaucaacuggcgcgcgu

SEQ ID NO: 1984546 - RNA, 18 nt, Shigella flexneri 2a str. 301
aaucaacgcgauauaaua

SEQ ID NO: 1984547 - RNA, 16 nt, Shigella flexneri 2a str. 301
aaucaacgcgaaaaug

SEQ ID NO: 1984548 - RNA, 22 nt, Shigella flexneri 2a str. 301
aaucaagcgccgaguaaaaaaa

SEQ ID NO: 1984549 - RNA, 14 nt, Shigella flexneri 2a str. 301
aaucaaggugauug

SEQ ID NO: 1984550 - RNA, 15 nt, Shigella flexneri 2a str. 301
aaucaagucuauuug

SEQ ID NO: 1984551 - RNA, 19 nt, Shigella flexneri 2a str. 301
aaucaauaauuaaucuggu

SEQ ID NO: 1984552 - RNA, 13 nt, Shigella flexneri 2a str. 301
aaucaaucagagc

SEQ ID NO: 1984553 - RNA, 13 nt, Shigella flexneri 2a str. 301
aaucaaucgcccc

SEQ ID NO: 1984554 - RNA, 18 nt, Shigella flexneri 2a str. 301
aaucaaucuuuacacaca

SEQ ID NO: 1984555 - RNA, 17 nt, Shigella flexneri 2a str. 301
aaucaaugcccaucacu

SEQ ID NO: 1984556 - RNA, 17 nt, Shigella flexneri 2a str. 301
aaucaccgccagcaagg

SEQ ID NO: 1984557 - RNA, 15 nt, Shigella flexneri 2a str. 301
aaucaccgccagcaa

SEQ ID NO: 1984558 - RNA, 19 nt, Shigella flexneri 2a str. 301
aaucaccucaucaccacag

SEQ ID NO: 1984559 - RNA, 20 nt, Shigella flexneri 2a str. 301
aaucacccccaccccggccc

SEQ ID NO: 1984560 - RNA, 21 nt, Shigella flexneri 2a str. 301
aaucaccgccacgcccuccug

SEQ ID NO: 1984561 - RNA, 17 nt, Shigella flexneri 2a str. 301
aaucaccaucagcagca

SEQ ID NO: 1984562 - RNA, 19 nt, Shigella flexneri 2a str. 301
aaucaccacccauuuuaau

SEQ ID NO: 1984563 - RNA, 14 nt, Shigella flexneri 2a str. 301
aaucaccacacaac

SEQ ID NO: 1984564 - RNA, 22 nt, Shigella flexneri 2a str. 301
aaucaccacaggccugauaaga

SEQ ID NO: 1984565 - RNA, 21 nt, Shigella flexneri 2a str. 301
aaucaccaucagcagcaacaa

SEQ ID NO: 1984566 - RNA, 23 nt, Shigella flexneri 2a str. 301
aaucaccaugccgugaugcgcaa

SEQ ID NO: 1984567 - RNA, 22 nt, Shigella flexneri 2a str. 301
aaucaccauauucagcagcaga

SEQ ID NO: 1984568 - RNA, 16 nt, Shigella flexneri 2a str. 301
aaucacaucaccauaa

SEQ ID NO: 1984569 - RNA, 17 nt, Shigella flexneri 2a str. 301
aaucacaauagaaauau

SEQ ID NO: 1984570 - RNA, 16 nt, Shigella flexneri 2a str. 301
aaucacacaaccaugc

SEQ ID NO: 1984571 - RNA, 17 nt, Shigella flexneri 2a str. 301
aaucacacaaccaugca

SEQ ID NO: 1984572 - RNA, 13 nt, Shigella flexneri 2a str. 301
aaucacaaauaga

SEQ ID NO: 1984573 - RNA, 20 nt, Shigella flexneri 2a str. 301
aaucugccagcguaaauccu

SEQ ID NO: 1984574 - RNA, 11 nt, Shigella flexneri 2a str. 301
aaucuucuucg

SEQ ID NO: 1984575 - RNA, 15 nt, Shigella flexneri 2a str. 301
aaucuugcaaauuca

SEQ ID NO: 1984576 - RNA, 12 nt, Shigella flexneri 2a str. 301
aaucuuccagaa

SEQ ID NO: 1984577 - RNA, 20 nt, Shigella flexneri 2a str. 301
aaucuuccagaucaccgcag

SEQ ID NO: 1984578 - RNA, 18 nt, Shigella flexneri 2a str. 301
aaugaagaaccgcaccag

SEQ ID NO: 1984579 - RNA, 22 nt, Shigella flexneri 2a str. 301
aaugaacgccaccccacaccag

SEQ ID NO: 1984580 - RNA, 15 nt, Shigella flexneri 2a str. 301
aaugacaaaauugcu

SEQ ID NO: 1984581 - RNA, 19 nt, Shigella flexneri 2a str. 301
aaugacagccagcaagucu

SEQ ID NO: 1984582 - RNA, 17 nt, Shigella flexneri 2a str. 301
aaugaugucggcauaaa

SEQ ID NO: 1984583 - RNA, 21 nt, Shigella flexneri 2a str. 301
aaugaugucggcauaaagcug

SEQ ID NO: 1984584 - RNA, 17 nt, Shigella flexneri 2a str. 301
aaugcaccaacaaauag

SEQ ID NO: 1984585 - RNA, 20 nt, Shigella flexneri 2a str. 301
aaugcaauaauguggccccu

SEQ ID NO: 1984586 - RNA, 15 nt, Shigella flexneri 2a str. 301
aaugaguuauacaga

SEQ ID NO: 1984587 - RNA, 11 nt, Shigella flexneri 2a str. 301
aaugauaagcc

SEQ ID NO: 1984588 - RNA, 15 nt, Shigella flexneri 2a str. 301
aaugagugaugauga

SEQ ID NO: 1984589 - RNA, 18 nt, Shigella flexneri 2a str. 301
aaugagugccaaaaaaau

SEQ ID NO: 1984590 - RNA, 19 nt, Shigella flexneri 2a str. 301
aaugagugccaaaaaaaua

SEQ ID NO: 1984591 - RNA, 13 nt, Shigella flexneri 2a str. 301
aaugaguauuacu

SEQ ID NO: 1984592 - RNA, 16 nt, Shigella flexneri 2a str. 301
aaugaguacugaugaa

SEQ ID NO: 1984593 - RNA, 13 nt, Shigella flexneri 2a str. 301
aaugacuccaacu

SEQ ID NO: 1984594 - RNA, 20 nt, Shigella flexneri 2a str. 301
aaugacaucaucgccccgcu

SEQ ID NO: 1984595 - RNA, 23 nt, Shigella flexneri 2a str. 301
aaucucccguuccugguuuucca

SEQ ID NO: 1984596 - RNA, 15 nt, Shigella flexneri 2a str. 301
aaucuccauuucauu

SEQ ID NO: 1984597 - RNA, 15 nt, Shigella flexneri 2a str. 301
aaucucaauguauuc

SEQ ID NO: 1984598 - RNA, 15 nt, Shigella flexneri 2a str. 301
aaucucaauuuucac

SEQ ID NO: 1984599 - RNA, 21 nt, Shigella flexneri 2a str. 301
aaucucacccgguacaucaau

SEQ ID NO: 1984600 - RNA, 16 nt, Shigella flexneri 2a str. 301
aaucuaaaacccggua

SEQ ID NO: 1984601 - RNA, 18 nt, Shigella flexneri 2a str. 301
aaucuaaccuacuuuuua

SEQ ID NO: 1984602 - RNA, 15 nt, Shigella flexneri 2a str. 301
aaucucgcguuucga

SEQ ID NO: 1984603 - RNA, 19 nt, Shigella flexneri 2a str. 301
aaucucgccguggauggga

SEQ ID NO: 1984604 - RNA, 19 nt, Shigella flexneri 2a str. 301
aaucuccugccaauacaaa

SEQ ID NO: 1984605 - RNA, 13 nt, Shigella flexneri 2a str. 301
aaucuccugcgca

SEQ ID NO: 1984606 - RNA, 17 nt, Shigella flexneri 2a str. 301
aaucugcaaaauaccaa

SEQ ID NO: 1984607 - RNA, 20 nt, Shigella flexneri 2a str. 301
aaucugauagugauccauca

SEQ ID NO: 1984608 - RNA, 12 nt, Shigella flexneri 2a str. 301
aaucugauauac

SEQ ID NO: 1984609 - RNA, 22 nt, Shigella flexneri 2a str. 301
aaucugaauuguuuuucguugc

SEQ ID NO: 1984610 - RNA, 16 nt, Shigella flexneri 2a str. 301
aaucugacaacaccaa

SEQ ID NO: 1984611 - RNA, 16 nt, Shigella flexneri 2a str. 301
aaucucuucacagaca

SEQ ID NO: 1984612 - RNA, 13 nt, Shigella flexneri 2a str. 301
aaucucuuccaga

SEQ ID NO: 1984613 - RNA, 22 nt, Shigella flexneri 2a str. 301
aaucucugguuuguuuucagau

SEQ ID NO: 1984614 - RNA, 16 nt, Shigella flexneri 2a str. 301
aaucugaauggcugca

SEQ ID NO: 1984615 - RNA, 13 nt, Shigella flexneri 2a str. 301
aaucugaaaucau

SEQ ID NO: 1984616 - RNA, 23 nt, Shigella flexneri 2a str. 301
aaucgaccaggccaucagcagcg

SEQ ID NO: 1984617 - RNA, 15 nt, Shigella flexneri 2a str. 301
aaucgacagccaguu

SEQ ID NO: 1984618 - RNA, 21 nt, Shigella flexneri 2a str. 301
aaucgaaccaaacagcgccag

SEQ ID NO: 1984619 - RNA, 14 nt, Shigella flexneri 2a str. 301
aaucgaacuucccg

SEQ ID NO: 1984620 - RNA, 19 nt, Shigella flexneri 2a str. 301
aaucgagauacguuugcca

SEQ ID NO: 1984621 - RNA, 18 nt, Shigella flexneri 2a str. 301
aaucgauaaaacuucccg

SEQ ID NO: 1984622 - RNA, 23 nt, Shigella flexneri 2a str. 301
aaucaucauugcuguuuuacagc

SEQ ID NO: 1984623 - RNA, 17 nt, Shigella flexneri 2a str. 301
aaucaucaucuuuauau

SEQ ID NO: 1984624 - RNA, 22 nt, Shigella flexneri 2a str. 301
aaucaucauuuuuucaccaaag

SEQ ID NO: 1984625 - RNA, 23 nt, Shigella flexneri 2a str. 301
aaucaucauuuuuucaccaaagc

SEQ ID NO: 1984626 - RNA, 15 nt, Shigella flexneri 2a str. 301
aaucauccauauuuu

SEQ ID NO: 1984627 - RNA, 22 nt, Shigella flexneri 2a str. 301
aaucauccauauuuucagcagu

SEQ ID NO: 1984628 - RNA, 20 nt, Shigella flexneri 2a str. 301
aaucgggagagauaagauaa

SEQ ID NO: 1984629 - RNA, 20 nt, Shigella flexneri 2a str. 301
aaucgggaaaaucugcggga

SEQ ID NO: 1984630 - RNA, 14 nt, Shigella flexneri 2a str. 301
aaucgggaaauaac

SEQ ID NO: 1984631 - RNA, 17 nt, Shigella flexneri 2a str. 301
aaucgggaaaaucugcg

SEQ ID NO: 1984632 - RNA, 21 nt, Shigella flexneri 2a str. 301
aaucggcgaagagagcgccag

SEQ ID NO: 1984633 - RNA, 13 nt, Shigella flexneri 2a str. 301
aaucgugaaaaau

SEQ ID NO: 1984634 - RNA, 14 nt, Shigella flexneri 2a str. 301
aaucggaacaacag

SEQ ID NO: 1984635 - RNA, 13 nt, Shigella flexneri 2a str. 301
aaucgcagcgcaa

SEQ ID NO: 1984636 - RNA, 20 nt, Shigella flexneri 2a str. 301
aaucgaucgcguaauaaaau

SEQ ID NO: 1984637 - RNA, 15 nt, Shigella flexneri 2a str. 301
aaucgcaagaucuca

SEQ ID NO: 1984638 - RNA, 19 nt, Shigella flexneri 2a str. 301
aaucgcaacgccuuccguc

SEQ ID NO: 1984639 - RNA, 17 nt, Shigella flexneri 2a str. 301
aauuaaacccgcaggcg

SEQ ID NO: 1984640 - RNA, 17 nt, Shigella flexneri 2a str. 301
aauuaacgguaauaauu

SEQ ID NO: 1984641 - RNA, 18 nt, Shigella flexneri 2a str. 301
aauuaagaauguuaaaua

SEQ ID NO: 1984642 - RNA, 17 nt, Shigella flexneri 2a str. 301
aauuaauaaucacauaa

SEQ ID NO: 1984643 - RNA, 20 nt, Shigella flexneri 2a str. 301
aauuaagcccggucaucagu

SEQ ID NO: 1984644 - RNA, 15 nt, Shigella flexneri 2a str. 301
aauuacuucucuuuc

SEQ ID NO: 1984645 - RNA, 23 nt, Shigella flexneri 2a str. 301
aauuacuuacaucugucugauaa

SEQ ID NO: 1984646 - RNA, 17 nt, Shigella flexneri 2a str. 301
aauuacagcgcauugcu

SEQ ID NO: 1984647 - RNA, 19 nt, Shigella flexneri 2a str. 301
aauuacaggcaguaaccaa

SEQ ID NO: 1984648 - RNA, 15 nt, Shigella flexneri 2a str. 301
aauuacaguuucuga

SEQ ID NO: 1984649 - RNA, 19 nt, Shigella flexneri 2a str. 301
aauguuucugcaauauauu

SEQ ID NO: 1984650 - RNA, 20 nt, Shigella flexneri 2a str. 301
aauguuguaagcuugacaua

SEQ ID NO: 1984651 - RNA, 15 nt, Shigella flexneri 2a str. 301
aaugugcugagaaca

SEQ ID NO: 1984652 - RNA, 13 nt, Shigella flexneri 2a str. 301
aauguggcagcaa

SEQ ID NO: 1984653 - RNA, 23 nt, Shigella flexneri 2a str. 301
aauguguuuacgcguuuuucaga

SEQ ID NO: 1984654 - RNA, 18 nt, Shigella flexneri 2a str. 301
aauguguuuauaagccau

SEQ ID NO: 1984655 - RNA, 23 nt, Shigella flexneri 2a str. 301
aauguucguccauuucagcgcag

SEQ ID NO: 1984656 - RNA, 13 nt, Shigella flexneri 2a str. 301
aauguucgucaua

SEQ ID NO: 1984657 - RNA, 19 nt, Shigella flexneri 2a str. 301
aauguuccaucaccagauu

SEQ ID NO: 1984658 - RNA, 15 nt, Shigella flexneri 2a str. 301
aauguucccugcgcc

SEQ ID NO: 1984659 - RNA, 21 nt, Shigella flexneri 2a str. 301
aauguuccggguuugccacau

SEQ ID NO: 1984660 - RNA, 14 nt, Shigella flexneri 2a str. 301
aauguuagcaaucc

SEQ ID NO: 1984661 - RNA, 21 nt, Shigella flexneri 2a str. 301
aaugcguugcuggcagauaaa

SEQ ID NO: 1984662 - RNA, 17 nt, Shigella flexneri 2a str. 301
aaugcccgaaugcagcu

SEQ ID NO: 1984663 - RNA, 22 nt, Shigella flexneri 2a str. 301
aaugcccgaugaccuugucaug

SEQ ID NO: 1984664 - RNA, 17 nt, Shigella flexneri 2a str. 301
aaugcacuuccagcggc

SEQ ID NO: 1984665 - RNA, 17 nt, Shigella flexneri 2a str. 301
aaugcccauggcaagaa

SEQ ID NO: 1984666 - RNA, 17 nt, Shigella flexneri 2a str. 301
aauggcacaaauggcaa

SEQ ID NO: 1984667 - RNA, 14 nt, Shigella flexneri 2a str. 301
aauggcaaagaugu

SEQ ID NO: 1984668 - RNA, 15 nt, Shigella flexneri 2a str. 301
aauggcgucaacaac

SEQ ID NO: 1984669 - RNA, 17 nt, Shigella flexneri 2a str. 301
aauggcggugaucccaa

SEQ ID NO: 1984670 - RNA, 17 nt, Shigella flexneri 2a str. 301
aauggcgucaacaacac

SEQ ID NO: 1984671 - RNA, 18 nt, Shigella flexneri 2a str. 301
aaugcugugaagauggcu

SEQ ID NO: 1984672 - RNA, 21 nt, Shigella flexneri 2a str. 301
aaugcuguuauccugaccacc

SEQ ID NO: 1984673 - RNA, 19 nt, Shigella flexneri 2a str. 301
aaugcuguuccagaccaua

SEQ ID NO: 1984674 - RNA, 22 nt, Shigella flexneri 2a str. 301
aaugcugucgguuuauggaaaa

SEQ ID NO: 1984675 - RNA, 20 nt, Shigella flexneri 2a str. 301
aauggucuggugaccuggga

SEQ ID NO: 1984676 - RNA, 23 nt, Shigella flexneri 2a str. 301
aaugguccgugacccggaauaaa

SEQ ID NO: 1984677 - RNA, 19 nt, Shigella flexneri 2a str. 301
aauggucuggugaccuggg

SEQ ID NO: 1984678 - RNA, 12 nt, Shigella flexneri 2a str. 301
aauguaugaggu

SEQ ID NO: 1984679 - RNA, 13 nt, Shigella flexneri 2a str. 301
aauggcuuuugcc

SEQ ID NO: 1984680 - RNA, 22 nt, Shigella flexneri 2a str. 301
aauggcugaccagaauuuaccc

SEQ ID NO: 1984681 - RNA, 21 nt, Shigella flexneri 2a str. 301
aaugggccaacaccagacauc

SEQ ID NO: 1984682 - RNA, 17 nt, Shigella flexneri 2a str. 301
aaugguaacuuucugcc

SEQ ID NO: 1984683 - RNA, 15 nt, Shigella flexneri 2a str. 301
aauggucccgacaac

SEQ ID NO: 1984684 - RNA, 18 nt, Shigella flexneri 2a str. 301
aaugguccgugacccgga

SEQ ID NO: 1984685 - RNA, 16 nt, Shigella flexneri 2a str. 301
aaugugaagaggaaca

SEQ ID NO: 1984686 - RNA, 17 nt, Shigella flexneri 2a str. 301
aaugucugucugacaac

SEQ ID NO: 1984687 - RNA, 21 nt, Shigella flexneri 2a str. 301
aaugugacagagccauugccc

SEQ ID NO: 1984688 - RNA, 13 nt, Shigella flexneri 2a str. 301
aaugucaucagca

SEQ ID NO: 1984689 - RNA, 20 nt, Shigella flexneri 2a str. 301
aaugucaucucuggcacgag

SEQ ID NO: 1984690 - RNA, 21 nt, Shigella flexneri 2a str. 301
aaugucaucucuggcacgaga

SEQ ID NO: 1984691 - RNA, 23 nt, Shigella flexneri 2a str. 301
aaugucaucucuggcacgagauc

SEQ ID NO: 1984692 - RNA, 20 nt, Shigella flexneri 2a str. 301
aaugucgauaaaguuagagc

SEQ ID NO: 1984693 - RNA, 22 nt, Shigella flexneri 2a str. 301
aagaccaauccgccagccaauu

SEQ ID NO: 1984694 - RNA, 17 nt, Shigella flexneri 2a str. 301
aagaccaggaaacccaa

SEQ ID NO: 1984695 - RNA, 17 nt, Shigella flexneri 2a str. 301
aagacagcgucacauca

SEQ ID NO: 1984696 - RNA, 19 nt, Shigella flexneri 2a str. 301
aagacaucaauaaacaaug

SEQ ID NO: 1984697 - RNA, 21 nt, Shigella flexneri 2a str. 301
aagacauagcacauaaaaugg

SEQ ID NO: 1984698 - RNA, 19 nt, Shigella flexneri 2a str. 301
aagaccguuucggugauga

SEQ ID NO: 1984699 - RNA, 20 nt, Shigella flexneri 2a str. 301
aagaccugacuguuccagca

SEQ ID NO: 1984700 - RNA, 20 nt, Shigella flexneri 2a str. 301
aagaccugccgggcugaugc

SEQ ID NO: 1984701 - RNA, 14 nt, Shigella flexneri 2a str. 301
aagacgaaaaauga

SEQ ID NO: 1984702 - RNA, 21 nt, Shigella flexneri 2a str. 301
aagaauuucuuuacugacagg

SEQ ID NO: 1984703 - RNA, 23 nt, Shigella flexneri 2a str. 301
aagaauugcagauaccacaucaa

SEQ ID NO: 1984704 - RNA, 22 nt, Shigella flexneri 2a str. 301
aagaauugcagauaccacauca

SEQ ID NO: 1984705 - RNA, 16 nt, Shigella flexneri 2a str. 301
aagaauugcagauacc

SEQ ID NO: 1984706 - RNA, 17 nt, Shigella flexneri 2a str. 301
aagaauugauaaaaaaa

SEQ ID NO: 1984707 - RNA, 23 nt, Shigella flexneri 2a str. 301
aagaauugauaaaaaaaacgcca

SEQ ID NO: 1984708 - RNA, 13 nt, Shigella flexneri 2a str. 301
aagacaauuuaau

SEQ ID NO: 1984709 - RNA, 18 nt, Shigella flexneri 2a str. 301
aagacagcgaggucacac

SEQ ID NO: 1984710 - RNA, 20 nt, Shigella flexneri 2a str. 301
aagacacugacgcgucuuau

SEQ ID NO: 1984711 - RNA, 12 nt, Shigella flexneri 2a str. 301
aagaauuuuugc

SEQ ID NO: 1984712 - RNA, 16 nt, Shigella flexneri 2a str. 301
aagaauaucuucuguu

SEQ ID NO: 1984713 - RNA, 14 nt, Shigella flexneri 2a str. 301
aagaaucaugccaa

SEQ ID NO: 1984714 - RNA, 17 nt, Shigella flexneri 2a str. 301
aagaaucaugccaaaaa

SEQ ID NO: 1984715 - RNA, 21 nt, Shigella flexneri 2a str. 301
aagaauaucagagcccucauu

SEQ ID NO: 1984716 - RNA, 19 nt, Shigella flexneri 2a str. 301
aagaaucgggcaacguuga

SEQ ID NO: 1984717 - RNA, 15 nt, Shigella flexneri 2a str. 301
aagaaugccugccag

SEQ ID NO: 1984718 - RNA, 21 nt, Shigella flexneri 2a str. 301
aagaauuaaaauaucaggcug

SEQ ID NO: 1984719 - RNA, 20 nt, Shigella flexneri 2a str. 301
aagaauguccauuauuucaa

SEQ ID NO: 1984720 - RNA, 21 nt, Shigella flexneri 2a str. 301
aagaauguccauuauuucaau

SEQ ID NO: 1984721 - RNA, 13 nt, Shigella flexneri 2a str. 301
aaauucuccagcg

SEQ ID NO: 1984722 - RNA, 14 nt, Shigella flexneri 2a str. 301
aagaauagccgcaa

SEQ ID NO: 1984723 - RNA, 14 nt, Shigella flexneri 2a str. 301
aagagaaaaccccc

SEQ ID NO: 1984724 - RNA, 16 nt, Shigella flexneri 2a str. 301
aagagaaccagcugcc

SEQ ID NO: 1984725 - RNA, 20 nt, Shigella flexneri 2a str. 301
aagagaaagaacgaguaaaa

SEQ ID NO: 1984726 - RNA, 20 nt, Shigella flexneri 2a str. 301
aagagacagaaucaggccau

SEQ ID NO: 1984727 - RNA, 14 nt, Shigella flexneri 2a str. 301
aagagacaaaaaag

SEQ ID NO: 1984728 - RNA, 13 nt, Shigella flexneri 2a str. 301
aagagagaagcca

SEQ ID NO: 1984729 - RNA, 15 nt, Shigella flexneri 2a str. 301
aagagagaagccaga

SEQ ID NO: 1984730 - RNA, 19 nt, Shigella flexneri 2a str. 301
aagagcaaauaaaacauca

SEQ ID NO: 1984731 - RNA, 19 nt, Shigella flexneri 2a str. 301
aagagauggaaugagcauc

SEQ ID NO: 1984732 - RNA, 19 nt, Shigella flexneri 2a str. 301
aagagauaaacgaccacuc

SEQ ID NO: 1984733 - RNA, 14 nt, Shigella flexneri 2a str. 301
aagagaucgaacag

SEQ ID NO: 1984734 - RNA, 17 nt, Shigella flexneri 2a str. 301
aagacguugauucacuu

SEQ ID NO: 1984735 - RNA, 17 nt, Shigella flexneri 2a str. 301
aagacgugcgccacaac

SEQ ID NO: 1984736 - RNA, 17 nt, Shigella flexneri 2a str. 301
aagacgcuccagugugg

SEQ ID NO: 1984737 - RNA, 16 nt, Shigella flexneri 2a str. 301
aagacgcguaaagcgu

SEQ ID NO: 1984738 - RNA, 13 nt, Shigella flexneri 2a str. 301
aagacgcagcaug

SEQ ID NO: 1984739 - RNA, 15 nt, Shigella flexneri 2a str. 301
aagacuguaaauacu

SEQ ID NO: 1984740 - RNA, 18 nt, Shigella flexneri 2a str. 301
aagacuggcaaagcaggc

SEQ ID NO: 1984741 - RNA, 14 nt, Shigella flexneri 2a str. 301
aagacugaugacaa

SEQ ID NO: 1984742 - RNA, 21 nt, Shigella flexneri 2a str. 301
aagaggcggagguuuuuuccu

SEQ ID NO: 1984743 - RNA, 15 nt, Shigella flexneri 2a str. 301
aagaggcgcagauga

SEQ ID NO: 1984744 - RNA, 14 nt, Shigella flexneri 2a str. 301
aagaggugggggau

SEQ ID NO: 1984745 - RNA, 17 nt, Shigella flexneri 2a str. 301
aagagcgacaaucccug

SEQ ID NO: 1984746 - RNA, 15 nt, Shigella flexneri 2a str. 301
aagagcgccucccuu

SEQ ID NO: 1984747 - RNA, 15 nt, Shigella flexneri 2a str. 301
aagagcgucuggaag

SEQ ID NO: 1984748 - RNA, 18 nt, Shigella flexneri 2a str. 301
aagagcgucuggaagaag

SEQ ID NO: 1984749 - RNA, 23 nt, Shigella flexneri 2a str. 301
aagaguugccccucuaacucuuc

SEQ ID NO: 1984750 - RNA, 22 nt, Shigella flexneri 2a str. 301
aagauaaaucgcacguugucag

SEQ ID NO: 1984751 - RNA, 12 nt, Shigella flexneri 2a str. 301
aagauaaacccc

SEQ ID NO: 1984752 - RNA, 14 nt, Shigella flexneri 2a str. 301
aagaguaaauugca

SEQ ID NO: 1984753 - RNA, 15 nt, Shigella flexneri 2a str. 301
aagaguaaccaaacg

SEQ ID NO: 1984754 - RNA, 15 nt, Shigella flexneri 2a str. 301
aagcaauuaacagug

SEQ ID NO: 1984755 - RNA, 13 nt, Shigella flexneri 2a str. 301
aagcaauccauac

SEQ ID NO: 1984756 - RNA, 16 nt, Shigella flexneri 2a str. 301
aagcaauaccgcgaau

SEQ ID NO: 1984757 - RNA, 14 nt, Shigella flexneri 2a str. 301
aagcaaaaauaaau

SEQ ID NO: 1984758 - RNA, 15 nt, Shigella flexneri 2a str. 301
aagcaacaaaguuug

SEQ ID NO: 1984759 - RNA, 12 nt, Shigella flexneri 2a str. 301
aagcaacaaagu

SEQ ID NO: 1984760 - RNA, 15 nt, Shigella flexneri 2a str. 301
aagcacaugcugaca

SEQ ID NO: 1984761 - RNA, 13 nt, Shigella flexneri 2a str. 301
aagcaccacuccu

SEQ ID NO: 1984762 - RNA, 15 nt, Shigella flexneri 2a str. 301
aagcacccagcaauc

SEQ ID NO: 1984763 - RNA, 20 nt, Shigella flexneri 2a str. 301
aagcacugcaucaaugccgg

SEQ ID NO: 1984764 - RNA, 18 nt, Shigella flexneri 2a str. 301
aagcacugucuaacaaca

SEQ ID NO: 1984765 - RNA, 18 nt, Shigella flexneri 2a str. 301
aagcagaaaaagaagccg

SEQ ID NO: 1984766 - RNA, 18 nt, Shigella flexneri 2a str. 301
aagcaccugcgcaggcau

SEQ ID NO: 1984767 - RNA, 18 nt, Shigella flexneri 2a str. 301
aagcacgguuaacaccag

SEQ ID NO: 1984768 - RNA, 19 nt, Shigella flexneri 2a str. 301
aagcauuauauaaugccag

SEQ ID NO: 1984769 - RNA, 20 nt, Shigella flexneri 2a str. 301
aagcaugucauacaugguuu

SEQ ID NO: 1984770 - RNA, 21 nt, Shigella flexneri 2a str. 301
aagcaugaucgaggcaaagag

SEQ ID NO: 1984771 - RNA, 12 nt, Shigella flexneri 2a str. 301
aagcaugaugcg

SEQ ID NO: 1984772 - RNA, 14 nt, Shigella flexneri 2a str. 301
aagcauuuuuucac

SEQ ID NO: 1984773 - RNA, 18 nt, Shigella flexneri 2a str. 301
aagcauuuuuucacaugu

SEQ ID NO: 1984774 - RNA, 11 nt, Shigella flexneri 2a str. 301
aagcauuuaau

SEQ ID NO: 1984775 - RNA, 21 nt, Shigella flexneri 2a str. 301
aagcauuuggugucgcugaaa

SEQ ID NO: 1984776 - RNA, 23 nt, Shigella flexneri 2a str. 301
aagcauuuggugucgcugaaagc

SEQ ID NO: 1984777 - RNA, 14 nt, Shigella flexneri 2a str. 301
aagcaucaauugcu

SEQ ID NO: 1984778 - RNA, 23 nt, Shigella flexneri 2a str. 301
aagcaucagggcgauuagcagca

SEQ ID NO: 1984779 - RNA, 17 nt, Shigella flexneri 2a str. 301
aagcaucguuguuacaa

SEQ ID NO: 1984780 - RNA, 15 nt, Shigella flexneri 2a str. 301
aagcaggugccuuac

SEQ ID NO: 1984781 - RNA, 15 nt, Shigella flexneri 2a str. 301
aagcaguuucaccag

SEQ ID NO: 1984782 - RNA, 19 nt, Shigella flexneri 2a str. 301
aagcaguuucaccagcagu

SEQ ID NO: 1984783 - RNA, 15 nt, Shigella flexneri 2a str. 301
aagcaggcuucacgc

SEQ ID NO: 1984784 - RNA, 18 nt, Shigella flexneri 2a str. 301
aagcaggccagauagcca

SEQ ID NO: 1984785 - RNA, 16 nt, Shigella flexneri 2a str. 301
aagcaggguugcagcc

SEQ ID NO: 1984786 - RNA, 16 nt, Shigella flexneri 2a str. 301
aagcagauaacccagc

SEQ ID NO: 1984787 - RNA, 13 nt, Shigella flexneri 2a str. 301
aagcagagcagac

SEQ ID NO: 1984788 - RNA, 19 nt, Shigella flexneri 2a str. 301
aagcagagcagacgcgaau

SEQ ID NO: 1984789 - RNA, 17 nt, Shigella flexneri 2a str. 301
aagcagcauacccaccg

SEQ ID NO: 1984790 - RNA, 13 nt, Shigella flexneri 2a str. 301
aagcagacaaccc

SEQ ID NO: 1984791 - RNA, 19 nt, Shigella flexneri 2a str. 301
aagcagacaacccacacau

SEQ ID NO: 1984792 - RNA, 21 nt, Shigella flexneri 2a str. 301
aagcagcgaugcuuugcgcuu

SEQ ID NO: 1984793 - RNA, 13 nt, Shigella flexneri 2a str. 301
aagcagccaucug

SEQ ID NO: 1984794 - RNA, 12 nt, Shigella flexneri 2a str. 301
aagcagcuugcu

SEQ ID NO: 1984795 - RNA, 18 nt, Shigella flexneri 2a str. 301
aagauauuuuuaugcaug

SEQ ID NO: 1984796 - RNA, 12 nt, Shigella flexneri 2a str. 301
aagauauguugu

SEQ ID NO: 1984797 - RNA, 16 nt, Shigella flexneri 2a str. 301
aagauauguuguggga

SEQ ID NO: 1984798 - RNA, 18 nt, Shigella flexneri 2a str. 301
aagauagcgucauuucua

SEQ ID NO: 1984799 - RNA, 22 nt, Shigella flexneri 2a str. 301
aagauccagguuacgcaccaga

SEQ ID NO: 1984800 - RNA, 21 nt, Shigella flexneri 2a str. 301
aagaucgcccuuuuuuacuuu

SEQ ID NO: 1984801 - RNA, 15 nt, Shigella flexneri 2a str. 301
aagaucgaaggcugu

SEQ ID NO: 1984802 - RNA, 16 nt, Shigella flexneri 2a str. 301
aagaucaucaaacuuu

SEQ ID NO: 1984803 - RNA, 16 nt, Shigella flexneri 2a str. 301
aagaucaucggccaga

SEQ ID NO: 1984804 - RNA, 19 nt, Shigella flexneri 2a str. 301
aagaucuuugcgcuuauac

SEQ ID NO: 1984805 - RNA, 12 nt, Shigella flexneri 2a str. 301
aagaucuuugcg

SEQ ID NO: 1984806 - RNA, 17 nt, Shigella flexneri 2a str. 301
aagaugaaacuuauuca

SEQ ID NO: 1984807 - RNA, 14 nt, Shigella flexneri 2a str. 301
aagaugaaacuuau

SEQ ID NO: 1984808 - RNA, 15 nt, Shigella flexneri 2a str. 301
aagaucgcucaucag

SEQ ID NO: 1984809 - RNA, 17 nt, Shigella flexneri 2a str. 301
aagaugaauaauguuua

SEQ ID NO: 1984810 - RNA, 14 nt, Shigella flexneri 2a str. 301
aagaugccugaugc

SEQ ID NO: 1984811 - RNA, 15 nt, Shigella flexneri 2a str. 301
aagaugcauuuauau

SEQ ID NO: 1984812 - RNA, 12 nt, Shigella flexneri 2a str. 301
aagaugcuacaa

SEQ ID NO: 1984813 - RNA, 14 nt, Shigella flexneri 2a str. 301
aagaugcuacaaca

SEQ ID NO: 1984814 - RNA, 16 nt, Shigella flexneri 2a str. 301
aagaugcuacaacauc

SEQ ID NO: 1984815 - RNA, 18 nt, Shigella flexneri 2a str. 301
aagauuaaaccaguucgu

SEQ ID NO: 1984816 - RNA, 18 nt, Shigella flexneri 2a str. 301
aagauguuucuggucugc

SEQ ID NO: 1984817 - RNA, 22 nt, Shigella flexneri 2a str. 301
aagauuacugacaauuugccca

SEQ ID NO: 1984818 - RNA, 14 nt, Shigella flexneri 2a str. 301
aagauuagccugaa

SEQ ID NO: 1984819 - RNA, 23 nt, Shigella flexneri 2a str. 301
aagauggauugcugaaauacaga

SEQ ID NO: 1984820 - RNA, 19 nt, Shigella flexneri 2a str. 301
aagauguucuaucuuucag

SEQ ID NO: 1984821 - RNA, 21 nt, Shigella flexneri 2a str. 301
aagauguucuaucuuucagac

SEQ ID NO: 1984822 - RNA, 22 nt, Shigella flexneri 2a str. 301
aagauuuugcugugcuuuacac

SEQ ID NO: 1984823 - RNA, 20 nt, Shigella flexneri 2a str. 301
aagauucaguucaacggugu

SEQ ID NO: 1984824 - RNA, 22 nt, Shigella flexneri 2a str. 301
aagauuagcgacgaacagcgau

SEQ ID NO: 1984825 - RNA, 14 nt, Shigella flexneri 2a str. 301
aauaaaaggaaaca

SEQ ID NO: 1984826 - RNA, 14 nt, Shigella flexneri 2a str. 301
aauaaaagccagga

SEQ ID NO: 1984827 - RNA, 16 nt, Shigella flexneri 2a str. 301
aauaaaacaggcagcu

SEQ ID NO: 1984828 - RNA, 14 nt, Shigella flexneri 2a str. 301
aauaaaacagaaac

SEQ ID NO: 1984829 - RNA, 22 nt, Shigella flexneri 2a str. 301
aauaaacaaugagauauuuaaa

SEQ ID NO: 1984830 - RNA, 15 nt, Shigella flexneri 2a str. 301
aauaaacaucagcua

SEQ ID NO: 1984831 - RNA, 21 nt, Shigella flexneri 2a str. 301
aauaaacaucagcuauucuua

SEQ ID NO: 1984832 - RNA, 21 nt, Shigella flexneri 2a str. 301
aauaaacguuccccaggguuu

SEQ ID NO: 1984833 - RNA, 15 nt, Shigella flexneri 2a str. 301
aauaaacuuuugggc

SEQ ID NO: 1984834 - RNA, 15 nt, Shigella flexneri 2a str. 301
aauaaaaucuauuau

SEQ ID NO: 1984835 - RNA, 14 nt, Shigella flexneri 2a str. 301
aauaaaaucuauua

SEQ ID NO: 1984836 - RNA, 20 nt, Shigella flexneri 2a str. 301
aaguuggugauguauaucgg

SEQ ID NO: 1984837 - RNA, 22 nt, Shigella flexneri 2a str. 301
aaguuuaauugccauuucuggc

SEQ ID NO: 1984838 - RNA, 21 nt, Shigella flexneri 2a str. 301
aaguucuucgaagcacucgua

SEQ ID NO: 1984839 - RNA, 15 nt, Shigella flexneri 2a str. 301
aaguuagaggcacau

SEQ ID NO: 1984840 - RNA, 14 nt, Shigella flexneri 2a str. 301
aaguuuuucaacac

SEQ ID NO: 1984841 - RNA, 17 nt, Shigella flexneri 2a str. 301
aaguuugcuucagaaua

SEQ ID NO: 1984842 - RNA, 20 nt, Shigella flexneri 2a str. 301
aaguuugcaacuuucgcuuu

SEQ ID NO: 1984843 - RNA, 22 nt, Shigella flexneri 2a str. 301
aaguuucacugggcgauuaaua

SEQ ID NO: 1984844 - RNA, 12 nt, Shigella flexneri 2a str. 301
aagucucagaaa

SEQ ID NO: 1984845 - RNA, 18 nt, Shigella flexneri 2a str. 301
aagucucaagagugaaca

SEQ ID NO: 1984846 - RNA, 22 nt, Shigella flexneri 2a str. 301
aagucguucagaucuuucacga

SEQ ID NO: 1984847 - RNA, 15 nt, Shigella flexneri 2a str. 301
aagucguucagaucu

SEQ ID NO: 1984848 - RNA, 20 nt, Shigella flexneri 2a str. 301
aagucguaggccugauaaga

SEQ ID NO: 1984849 - RNA, 10 nt, Shigella flexneri 2a str. 301
aagucccccc

SEQ ID NO: 1984850 - RNA, 23 nt, Shigella flexneri 2a str. 301
aaguccccccccucgcaccaaaa

SEQ ID NO: 1984851 - RNA, 19 nt, Shigella flexneri 2a str. 301
aaguaaggcgggaauaauu

SEQ ID NO: 1984852 - RNA, 16 nt, Shigella flexneri 2a str. 301
aaguaagcaacauaag

SEQ ID NO: 1984853 - RNA, 18 nt, Shigella flexneri 2a str. 301
aaguaucgcuuuccugga

SEQ ID NO: 1984854 - RNA, 23 nt, Shigella flexneri 2a str. 301
aaguaucgcuuuccuggagagag

SEQ ID NO: 1984855 - RNA, 14 nt, Shigella flexneri 2a str. 301
aaguggacgaacag

SEQ ID NO: 1984856 - RNA, 21 nt, Shigella flexneri 2a str. 301
aaguggacucuauggcuggca

SEQ ID NO: 1984857 - RNA, 16 nt, Shigella flexneri 2a str. 301
aaguguugcaggaaaa

SEQ ID NO: 1984858 - RNA, 16 nt, Shigella flexneri 2a str. 301
aaguuaauccacagca

SEQ ID NO: 1984859 - RNA, 20 nt, Shigella flexneri 2a str. 301
aaguuaauuucgacgggcug

SEQ ID NO: 1984860 - RNA, 17 nt, Shigella flexneri 2a str. 301
aaguuacaaaaaaaaau

SEQ ID NO: 1984861 - RNA, 22 nt, Shigella flexneri 2a str. 301
aagucuuuuuucaacuuuaucu

SEQ ID NO: 1984862 - RNA, 20 nt, Shigella flexneri 2a str. 301
aagucuuuuuucaacuuuau

SEQ ID NO: 1984863 - RNA, 19 nt, Shigella flexneri 2a str. 301
aagugaaaaacaccccauu

SEQ ID NO: 1984864 - RNA, 22 nt, Shigella flexneri 2a str. 301
aagugaauacagaacagugcca

SEQ ID NO: 1984865 - RNA, 20 nt, Shigella flexneri 2a str. 301
aagugaauagcgcccggaaa

SEQ ID NO: 1984866 - RNA, 20 nt, Shigella flexneri 2a str. 301
aagugaugguggugggggaa

SEQ ID NO: 1984867 - RNA, 16 nt, Shigella flexneri 2a str. 301
aagugcugggaaaccu

SEQ ID NO: 1984868 - RNA, 23 nt, Shigella flexneri 2a str. 301
aagugcgucacgcauucagcaaa

SEQ ID NO: 1984869 - RNA, 19 nt, Shigella flexneri 2a str. 301
aagugcgucaucggcggca

SEQ ID NO: 1984870 - RNA, 12 nt, Shigella flexneri 2a str. 301
aagcuccagcau

SEQ ID NO: 1984871 - RNA, 20 nt, Shigella flexneri 2a str. 301
aagcucgcucaucgaagaga

SEQ ID NO: 1984872 - RNA, 23 nt, Shigella flexneri 2a str. 301
aagcucugguguggagugcagca

SEQ ID NO: 1984873 - RNA, 19 nt, Shigella flexneri 2a str. 301
aagcucuucaugcagcaug

SEQ ID NO: 1984874 - RNA, 16 nt, Shigella flexneri 2a str. 301
aagcucucuuccaguu

SEQ ID NO: 1984875 - RNA, 14 nt, Shigella flexneri 2a str. 301
aagccaacagcagc

SEQ ID NO: 1984876 - RNA, 15 nt, Shigella flexneri 2a str. 301
aagccaacagcagcc

SEQ ID NO: 1984877 - RNA, 17 nt, Shigella flexneri 2a str. 301
aagccaaucacaaaaag

SEQ ID NO: 1984878 - RNA, 18 nt, Shigella flexneri 2a str. 301
aagccaccacgccaagaa

SEQ ID NO: 1984879 - RNA, 13 nt, Shigella flexneri 2a str. 301
aagccaccacgcc

SEQ ID NO: 1984880 - RNA, 20 nt, Shigella flexneri 2a str. 301
aagccaccgaacaaaacagc

SEQ ID NO: 1984881 - RNA, 13 nt, Shigella flexneri 2a str. 301
aagcggcacugcu

SEQ ID NO: 1984882 - RNA, 19 nt, Shigella flexneri 2a str. 301
aagcggccgucagaucgcc

SEQ ID NO: 1984883 - RNA, 18 nt, Shigella flexneri 2a str. 301
aagcgucgcaucaggcau

SEQ ID NO: 1984884 - RNA, 14 nt, Shigella flexneri 2a str. 301
aagcguauguggug

SEQ ID NO: 1984885 - RNA, 17 nt, Shigella flexneri 2a str. 301
aagcguauccaucacua

SEQ ID NO: 1984886 - RNA, 22 nt, Shigella flexneri 2a str. 301
aaggauaaaaaagggugcugca

SEQ ID NO: 1984887 - RNA, 20 nt, Shigella flexneri 2a str. 301
aaggaggcgugcuuuuauua

SEQ ID NO: 1984888 - RNA, 20 nt, Shigella flexneri 2a str. 301
aaggacaaaaauucaggaau

SEQ ID NO: 1984889 - RNA, 19 nt, Shigella flexneri 2a str. 301
aaggaauuuuacagcccug

SEQ ID NO: 1984890 - RNA, 18 nt, Shigella flexneri 2a str. 301
aagcuguaucccagccca

SEQ ID NO: 1984891 - RNA, 14 nt, Shigella flexneri 2a str. 301
aagcuguaucccag

SEQ ID NO: 1984892 - RNA, 17 nt, Shigella flexneri 2a str. 301
aagcugucaccaaucag

SEQ ID NO: 1984893 - RNA, 15 nt, Shigella flexneri 2a str. 301
aagcugcuguuaacu

SEQ ID NO: 1984894 - RNA, 20 nt, Shigella flexneri 2a str. 301
aagcugcguagcucaucuuc

SEQ ID NO: 1984895 - RNA, 20 nt, Shigella flexneri 2a str. 301
aagcugcggauccugagcaa

SEQ ID NO: 1984896 - RNA, 14 nt, Shigella flexneri 2a str. 301
aagcuguucuuccc

SEQ ID NO: 1984897 - RNA, 19 nt, Shigella flexneri 2a str. 301
aaggcugagggauccccag

SEQ ID NO: 1984898 - RNA, 17 nt, Shigella flexneri 2a str. 301
aaggcuuucgugaagcu

SEQ ID NO: 1984899 - RNA, 18 nt, Shigella flexneri 2a str. 301
aagguaaggauaaaaaag

SEQ ID NO: 1984900 - RNA, 13 nt, Shigella flexneri 2a str. 301
aagguagucccug

SEQ ID NO: 1984901 - RNA, 17 nt, Shigella flexneri 2a str. 301
aagguucuuugcugccg

SEQ ID NO: 1984902 - RNA, 18 nt, Shigella flexneri 2a str. 301
aagguuugaaaaaaccug

SEQ ID NO: 1984903 - RNA, 15 nt, Shigella flexneri 2a str. 301
aagguuucaguaaca

SEQ ID NO: 1984904 - RNA, 22 nt, Shigella flexneri 2a str. 301
aagguuuaauacgcuuaaucug

SEQ ID NO: 1984905 - RNA, 17 nt, Shigella flexneri 2a str. 301
aagguuaacuguggcgu

SEQ ID NO: 1984906 - RNA, 16 nt, Shigella flexneri 2a str. 301
aagguuaaaccgccag

SEQ ID NO: 1984907 - RNA, 18 nt, Shigella flexneri 2a str. 301
aagguuaauaaauauuaa

SEQ ID NO: 1984908 - RNA, 21 nt, Shigella flexneri 2a str. 301
aagguggcgucaaaaagcuca

SEQ ID NO: 1984909 - RNA, 21 nt, Shigella flexneri 2a str. 301
aagguggcgaagugccagucg

SEQ ID NO: 1984910 - RNA, 21 nt, Shigella flexneri 2a str. 301
aaggugugggcaaucacuuug

SEQ ID NO: 1984911 - RNA, 15 nt, Shigella flexneri 2a str. 301
aaggcagccuuucuc

SEQ ID NO: 1984912 - RNA, 23 nt, Shigella flexneri 2a str. 301
aaggccagaccguggucagaaaa

SEQ ID NO: 1984913 - RNA, 20 nt, Shigella flexneri 2a str. 301
aaggcaacgccccuucugcc

SEQ ID NO: 1984914 - RNA, 13 nt, Shigella flexneri 2a str. 301
aaggcaagaaaau

SEQ ID NO: 1984915 - RNA, 17 nt, Shigella flexneri 2a str. 301
aaggcacaacugcgacc

SEQ ID NO: 1984916 - RNA, 17 nt, Shigella flexneri 2a str. 301
aaggcacaagggugagg

SEQ ID NO: 1984917 - RNA, 23 nt, Shigella flexneri 2a str. 301
aaggcgcauugcuggcugcggga

SEQ ID NO: 1984918 - RNA, 22 nt, Shigella flexneri 2a str. 301
aaggcgcucauuuucucuuuca

SEQ ID NO: 1984919 - RNA, 16 nt, Shigella flexneri 2a str. 301
aaggcgcgguuucugc

SEQ ID NO: 1984920 - RNA, 13 nt, Shigella flexneri 2a str. 301
aaggcgagcgcgg

SEQ ID NO: 1984921 - RNA, 16 nt, Shigella flexneri 2a str. 301
aaggcgaaaggcuggc

SEQ ID NO: 1984922 - RNA, 22 nt, Shigella flexneri 2a str. 301
aaggccgcgaaccggaccagca

SEQ ID NO: 1984923 - RNA, 15 nt, Shigella flexneri 2a str. 301
aaggccggagcaugc

SEQ ID NO: 1984924 - RNA, 18 nt, Shigella flexneri 2a str. 301
aaggccagcaauccccag

SEQ ID NO: 1984925 - RNA, 21 nt, Shigella flexneri 2a str. 301
acaaauccuucacuuuugcca

SEQ ID NO: 1984926 - RNA, 17 nt, Shigella flexneri 2a str. 301
acaaaucagaacggaau

SEQ ID NO: 1984927 - RNA, 21 nt, Shigella flexneri 2a str. 301
acaaauagacacaagaaauau

SEQ ID NO: 1984928 - RNA, 19 nt, Shigella flexneri 2a str. 301
acaaauagagauagaaugc

SEQ ID NO: 1984929 - RNA, 21 nt, Shigella flexneri 2a str. 301
acaaauagagauagaaugcca

SEQ ID NO: 1984930 - RNA, 20 nt, Shigella flexneri 2a str. 301
acaaauagagcgccggaaau

SEQ ID NO: 1984931 - RNA, 19 nt, Shigella flexneri 2a str. 301
acaaauagccaauucccag

SEQ ID NO: 1984932 - RNA, 16 nt, Shigella flexneri 2a str. 301
acaaauagccagcaga

SEQ ID NO: 1984933 - RNA, 17 nt, Shigella flexneri 2a str. 301
acaaauagccagcagag

SEQ ID NO: 1984934 - RNA, 16 nt, Shigella flexneri 2a str. 301
acaaauagacacaaga

SEQ ID NO: 1984935 - RNA, 19 nt, Shigella flexneri 2a str. 301
acaaauaaauagauccagg

SEQ ID NO: 1984936 - RNA, 21 nt, Shigella flexneri 2a str. 301
acaaauaaauagauccaggaa

SEQ ID NO: 1984937 - RNA, 14 nt, Shigella flexneri 2a str. 301
acaaauaaaagcaa

SEQ ID NO: 1984938 - RNA, 13 nt, Shigella flexneri 2a str. 301
acaacaccgugca

SEQ ID NO: 1984939 - RNA, 18 nt, Shigella flexneri 2a str. 301
acaacacgccgauaauca

SEQ ID NO: 1984940 - RNA, 17 nt, Shigella flexneri 2a str. 301
acaacacauucaauaac

SEQ ID NO: 1984941 - RNA, 18 nt, Shigella flexneri 2a str. 301
acaacaacuucuaauuuu

SEQ ID NO: 1984942 - RNA, 22 nt, Shigella flexneri 2a str. 301
acaaauuugugcaaauucaaua

SEQ ID NO: 1984943 - RNA, 22 nt, Shigella flexneri 2a str. 301
acaaauuucaucgcuacaccaa

SEQ ID NO: 1984944 - RNA, 19 nt, Shigella flexneri 2a str. 301
acaaauggcaguaucggca

SEQ ID NO: 1984945 - RNA, 23 nt, Shigella flexneri 2a str. 301
acaaauggcaguaucggcaaggu

SEQ ID NO: 1984946 - RNA, 19 nt, Shigella flexneri 2a str. 301
acaaaugggcacaauucau

SEQ ID NO: 1984947 - RNA, 14 nt, Shigella flexneri 2a str. 301
acaaaugugccauu

SEQ ID NO: 1984948 - RNA, 21 nt, Shigella flexneri 2a str. 301
acaaagugcacuuugucaaua

SEQ ID NO: 1984949 - RNA, 12 nt, Shigella flexneri 2a str. 301
acaaagcaugau

SEQ ID NO: 1984950 - RNA, 18 nt, Shigella flexneri 2a str. 301
acaaagcgcacuuugcca

SEQ ID NO: 1984951 - RNA, 18 nt, Shigella flexneri 2a str. 301
acaaacguugcugacugu

SEQ ID NO: 1984952 - RNA, 15 nt, Shigella flexneri 2a str. 301
acaaacgcugacaua

SEQ ID NO: 1984953 - RNA, 18 nt, Shigella flexneri 2a str. 301
acaaacgcaaaauugccu

SEQ ID NO: 1984954 - RNA, 14 nt, Shigella flexneri 2a str. 301
acaaagacaucaaa

SEQ ID NO: 1984955 - RNA, 17 nt, Shigella flexneri 2a str. 301
acaaacugguguugaaa

SEQ ID NO: 1984956 - RNA, 21 nt, Shigella flexneri 2a str. 301
acaaacuugauagaacaaaag

SEQ ID NO: 1984957 - RNA, 20 nt, Shigella flexneri 2a str. 301
acaaacaucauccagugccg

SEQ ID NO: 1984958 - RNA, 13 nt, Shigella flexneri 2a str. 301
acaaacaucaucc

SEQ ID NO: 1984959 - RNA, 22 nt, Shigella flexneri 2a str. 301
acaaacagcucgacaccaaaca

SEQ ID NO: 1984960 - RNA, 23 nt, Shigella flexneri 2a str. 301
acaaacagcgccuguuuaccgcu

SEQ ID NO: 1984961 - RNA, 17 nt, Shigella flexneri 2a str. 301
acaagcguaugauugcc

SEQ ID NO: 1984962 - RNA, 14 nt, Shigella flexneri 2a str. 301
acaagccaccaucc

SEQ ID NO: 1984963 - RNA, 14 nt, Shigella flexneri 2a str. 301
acaagacuguaaau

SEQ ID NO: 1984964 - RNA, 13 nt, Shigella flexneri 2a str. 301
acaagacuguaaa

SEQ ID NO: 1984965 - RNA, 16 nt, Shigella flexneri 2a str. 301
acaagaaucaugccaa

SEQ ID NO: 1984966 - RNA, 13 nt, Shigella flexneri 2a str. 301
acaacuucccugu

SEQ ID NO: 1984967 - RNA, 14 nt, Shigella flexneri 2a str. 301
acaagaaauauaca

SEQ ID NO: 1984968 - RNA, 20 nt, Shigella flexneri 2a str. 301
acaagaaauauacaggcggg

SEQ ID NO: 1984969 - RNA, 20 nt, Shigella flexneri 2a str. 301
acaacuccguugaaauugcu

SEQ ID NO: 1984970 - RNA, 19 nt, Shigella flexneri 2a str. 301
acaacucaucacuguaggc

SEQ ID NO: 1984971 - RNA, 18 nt, Shigella flexneri 2a str. 301
acaacuaagccaguucau

SEQ ID NO: 1984972 - RNA, 14 nt, Shigella flexneri 2a str. 301
acaacugaaaaaaa

SEQ ID NO: 1984973 - RNA, 23 nt, Shigella flexneri 2a str. 301
acaacucgcuuaagccaucauca

SEQ ID NO: 1984974 - RNA, 19 nt, Shigella flexneri 2a str. 301
acaacgcuuuuugguucau

SEQ ID NO: 1984975 - RNA, 19 nt, Shigella flexneri 2a str. 301
acaacgcgcacuuugucuu

SEQ ID NO: 1984976 - RNA, 20 nt, Shigella flexneri 2a str. 301
acaacgcaauauccgccacu

SEQ ID NO: 1984977 - RNA, 19 nt, Shigella flexneri 2a str. 301
acaacgccauauaaauuuc

SEQ ID NO: 1984978 - RNA, 21 nt, Shigella flexneri 2a str. 301
acaacgaagccgugccacagg

SEQ ID NO: 1984979 - RNA, 22 nt, Shigella flexneri 2a str. 301
acaaccuugccauuccacaaaa

SEQ ID NO: 1984980 - RNA, 20 nt, Shigella flexneri 2a str. 301
acaaccugcuggaaaggccg

SEQ ID NO: 1984981 - RNA, 12 nt, Shigella flexneri 2a str. 301
acaaccggauau

SEQ ID NO: 1984982 - RNA, 16 nt, Shigella flexneri 2a str. 301
acaacccuaaagcacc

SEQ ID NO: 1984983 - RNA, 12 nt, Shigella flexneri 2a str. 301
acaacaucaaca

SEQ ID NO: 1984984 - RNA, 13 nt, Shigella flexneri 2a str. 301
acaacacucucug

SEQ ID NO: 1984985 - RNA, 21 nt, Shigella flexneri 2a str. 301
acaacagucccaggcagaagc

SEQ ID NO: 1984986 - RNA, 22 nt, Shigella flexneri 2a str. 301
acaacauuccugcugacggcac

SEQ ID NO: 1984987 - RNA, 23 nt, Shigella flexneri 2a str. 301
acaacaugcuauugcgccagccu

SEQ ID NO: 1984988 - RNA, 14 nt, Shigella flexneri 2a str. 301
acaacccacacauu

SEQ ID NO: 1984989 - RNA, 13 nt, Shigella flexneri 2a str. 301
acaacccacacau

SEQ ID NO: 1984990 - RNA, 21 nt, Shigella flexneri 2a str. 301
acaacccgugagucuccuuua

SEQ ID NO: 1984991 - RNA, 19 nt, Shigella flexneri 2a str. 301
aauuuucgccaucucaaaa

SEQ ID NO: 1984992 - RNA, 12 nt, Shigella flexneri 2a str. 301
aauuuuauguuu

SEQ ID NO: 1984993 - RNA, 14 nt, Shigella flexneri 2a str. 301
acaaaaaaaacagc

SEQ ID NO: 1984994 - RNA, 21 nt, Shigella flexneri 2a str. 301
aauuuuuccagcauuucuucc

SEQ ID NO: 1984995 - RNA, 22 nt, Shigella flexneri 2a str. 301
aauuuuucguuuaugaucauca

SEQ ID NO: 1984996 - RNA, 14 nt, Shigella flexneri 2a str. 301
acaaaacgggggcu

SEQ ID NO: 1984997 - RNA, 20 nt, Shigella flexneri 2a str. 301
acaaaagacgauaguaauuu

SEQ ID NO: 1984998 - RNA, 21 nt, Shigella flexneri 2a str. 301
acaaaagaauggcuguagggu

SEQ ID NO: 1984999 - RNA, 18 nt, Shigella flexneri 2a str. 301
acaaaagcacguaaauuc

SEQ ID NO: 1985000 - RNA, 16 nt, Shigella flexneri 2a str. 301
acaaaaauaccaccaa

SEQ ID NO: 1985001 - RNA, 20 nt, Shigella flexneri 2a str. 301
acaaaaagugcuuucugaac

SEQ ID NO: 1985002 - RNA, 21 nt, Shigella flexneri 2a str. 301
acaaaaccacgacuuuuuguc

SEQ ID NO: 1985003 - RNA, 12 nt, Shigella flexneri 2a str. 301
acaaaaccugca

SEQ ID NO: 1985004 - RNA, 12 nt, Shigella flexneri 2a str. 301
acaaaaccugcc

SEQ ID NO: 1985005 - RNA, 22 nt, Shigella flexneri 2a str. 301
acaaaaaagccaaucacaaaaa

SEQ ID NO: 1985006 - RNA, 14 nt, Shigella flexneri 2a str. 301
acaaaaaagaguaa

SEQ ID NO: 1985007 - RNA, 13 nt, Shigella flexneri 2a str. 301
acaaaaaacaaag

SEQ ID NO: 1985008 - RNA, 19 nt, Shigella flexneri 2a str. 301
acaaaaucuauugcaacau

SEQ ID NO: 1985009 - RNA, 21 nt, Shigella flexneri 2a str. 301
acaaaauccugccagcgugag

SEQ ID NO: 1985010 - RNA, 17 nt, Shigella flexneri 2a str. 301
acaaaaucggaaacaaa

SEQ ID NO: 1985011 - RNA, 22 nt, Shigella flexneri 2a str. 301
acaaaaucgugaaaaaucaaua

SEQ ID NO: 1985012 - RNA, 23 nt, Shigella flexneri 2a str. 301
acaaaaucgugaaaaaucaauau

SEQ ID NO: 1985013 - RNA, 22 nt, Shigella flexneri 2a str. 301
acaaaaucacgucgauuuuuaa

SEQ ID NO: 1985014 - RNA, 12 nt, Shigella flexneri 2a str. 301
acaaaauuuaac

SEQ ID NO: 1985015 - RNA, 15 nt, Shigella flexneri 2a str. 301
acaaaauggcaaagc

SEQ ID NO: 1985016 - RNA, 15 nt, Shigella flexneri 2a str. 301
acaaaaucuucguua

SEQ ID NO: 1985017 - RNA, 14 nt, Shigella flexneri 2a str. 301
acaaaaugugccag

SEQ ID NO: 1985018 - RNA, 18 nt, Shigella flexneri 2a str. 301
aauuugcuaccccugaga

SEQ ID NO: 1985019 - RNA, 14 nt, Shigella flexneri 2a str. 301
aauuugcuccagaa

SEQ ID NO: 1985020 - RNA, 17 nt, Shigella flexneri 2a str. 301
aauuugcaggucauggu

SEQ ID NO: 1985021 - RNA, 18 nt, Shigella flexneri 2a str. 301
aauuugcagccauaaauu

SEQ ID NO: 1985022 - RNA, 21 nt, Shigella flexneri 2a str. 301
aauuugcagccauaaauuuac

SEQ ID NO: 1985023 - RNA, 14 nt, Shigella flexneri 2a str. 301
aauuuguaacuguc

SEQ ID NO: 1985024 - RNA, 14 nt, Shigella flexneri 2a str. 301
aauuuggaagaauu

SEQ ID NO: 1985025 - RNA, 15 nt, Shigella flexneri 2a str. 301
aauuuggggccgucc

SEQ ID NO: 1985026 - RNA, 13 nt, Shigella flexneri 2a str. 301
aauuuggcugagu

SEQ ID NO: 1985027 - RNA, 23 nt, Shigella flexneri 2a str. 301
aauuuggcugagugaaucagaag

SEQ ID NO: 1985028 - RNA, 15 nt, Shigella flexneri 2a str. 301
aauuuggcuccucug

SEQ ID NO: 1985029 - RNA, 14 nt, Shigella flexneri 2a str. 301
aauuugcaauuuuc

SEQ ID NO: 1985030 - RNA, 20 nt, Shigella flexneri 2a str. 301
aauuuuaccuagcacuguaa

SEQ ID NO: 1985031 - RNA, 12 nt, Shigella flexneri 2a str. 301
aauuuuaggaug

SEQ ID NO: 1985032 - RNA, 12 nt, Shigella flexneri 2a str. 301
aauuuuacagcc

SEQ ID NO: 1985033 - RNA, 18 nt, Shigella flexneri 2a str. 301
aauuuguaggcuaaaaac

SEQ ID NO: 1985034 - RNA, 16 nt, Shigella flexneri 2a str. 301
aauuucugcaaaauag

SEQ ID NO: 1985035 - RNA, 23 nt, Shigella flexneri 2a str. 301
aauuucuggcggcuuauauauua

SEQ ID NO: 1985036 - RNA, 22 nt, Shigella flexneri 2a str. 301
aauuucucgcccagaucaccaa

SEQ ID NO: 1985037 - RNA, 23 nt, Shigella flexneri 2a str. 301
aauuucgcguaguuaugaaaaua

SEQ ID NO: 1985038 - RNA, 14 nt, Shigella flexneri 2a str. 301
aauuucgcuuucau

SEQ ID NO: 1985039 - RNA, 22 nt, Shigella flexneri 2a str. 301
aauuucaucacugaauuucgcc

SEQ ID NO: 1985040 - RNA, 23 nt, Shigella flexneri 2a str. 301
aauuucaucaucacgaaauccca

SEQ ID NO: 1985041 - RNA, 14 nt, Shigella flexneri 2a str. 301
aauuucauuuacug

SEQ ID NO: 1985042 - RNA, 23 nt, Shigella flexneri 2a str. 301
aauuuccccaaaacguaaccaug

SEQ ID NO: 1985043 - RNA, 16 nt, Shigella flexneri 2a str. 301
aauuauaauuccuuca

SEQ ID NO: 1985044 - RNA, 15 nt, Shigella flexneri 2a str. 301
acaauuucagcaaua

SEQ ID NO: 1985045 - RNA, 16 nt, Shigella flexneri 2a str. 301
acaauuucagcaauaa

SEQ ID NO: 1985046 - RNA, 12 nt, Shigella flexneri 2a str. 301
acaauuugccca

SEQ ID NO: 1985047 - RNA, 14 nt, Shigella flexneri 2a str. 301
acaauuguugaccg

SEQ ID NO: 1985048 - RNA, 15 nt, Shigella flexneri 2a str. 301
acaauugucgccaca

SEQ ID NO: 1985049 - RNA, 23 nt, Shigella flexneri 2a str. 301
acaauugucgccacaaacgccag

SEQ ID NO: 1985050 - RNA, 21 nt, Shigella flexneri 2a str. 301
acaauuucagaauagacaaaa

SEQ ID NO: 1985051 - RNA, 21 nt, Shigella flexneri 2a str. 301
acaauuuaccggcaggugacu

SEQ ID NO: 1985052 - RNA, 19 nt, Shigella flexneri 2a str. 301
acaauugccgccagcucac

SEQ ID NO: 1985053 - RNA, 11 nt, Shigella flexneri 2a str. 301
acaauucaggg

SEQ ID NO: 1985054 - RNA, 21 nt, Shigella flexneri 2a str. 301
acaauuacugagagaaaaaaa

SEQ ID NO: 1985055 - RNA, 21 nt, Shigella flexneri 2a str. 301
acaauuaccugucgccagagc

SEQ ID NO: 1985056 - RNA, 16 nt, Shigella flexneri 2a str. 301
acaauguuucugcaau

SEQ ID NO: 1985057 - RNA, 18 nt, Shigella flexneri 2a str. 301
acaauggagcuaaacagc

SEQ ID NO: 1985058 - RNA, 20 nt, Shigella flexneri 2a str. 301
acaauggagcacauugccug

SEQ ID NO: 1985059 - RNA, 21 nt, Shigella flexneri 2a str. 301
acaauggcggugaucccaaua

SEQ ID NO: 1985060 - RNA, 16 nt, Shigella flexneri 2a str. 301
acaaugggaaaacagg

SEQ ID NO: 1985061 - RNA, 16 nt, Shigella flexneri 2a str. 301
acaauggcggugaucc

SEQ ID NO: 1985062 - RNA, 21 nt, Shigella flexneri 2a str. 301
acaauggucaacauucccugc

SEQ ID NO: 1985063 - RNA, 21 nt, Shigella flexneri 2a str. 301
acaaugcaguuccauaugaau

SEQ ID NO: 1985064 - RNA, 17 nt, Shigella flexneri 2a str. 301
acaaugcuguaaccagc

SEQ ID NO: 1985065 - RNA, 22 nt, Shigella flexneri 2a str. 301
acaaugcggugugcggguuuuc

SEQ ID NO: 1985066 - RNA, 15 nt, Shigella flexneri 2a str. 301
acacauacuuauuau

SEQ ID NO: 1985067 - RNA, 14 nt, Shigella flexneri 2a str. 301
acacauaucacaau

SEQ ID NO: 1985068 - RNA, 20 nt, Shigella flexneri 2a str. 301
acacaguucuucaaaaauaa

SEQ ID NO: 1985069 - RNA, 13 nt, Shigella flexneri 2a str. 301
acacagccacagg

SEQ ID NO: 1985070 - RNA, 17 nt, Shigella flexneri 2a str. 301
acacagcgugcauagca

SEQ ID NO: 1985071 - RNA, 17 nt, Shigella flexneri 2a str. 301
acacaaccgaggcucaa

SEQ ID NO: 1985072 - RNA, 15 nt, Shigella flexneri 2a str. 301
acacaacaugcagcc

SEQ ID NO: 1985073 - RNA, 16 nt, Shigella flexneri 2a str. 301
acacaacaugcagccc

SEQ ID NO: 1985074 - RNA, 22 nt, Shigella flexneri 2a str. 301
acacaacaugcagcccagcauc

SEQ ID NO: 1985075 - RNA, 22 nt, Shigella flexneri 2a str. 301
acacaagguauccagacggcgc

SEQ ID NO: 1985076 - RNA, 21 nt, Shigella flexneri 2a str. 301
acacaagcguaagagaacaga

SEQ ID NO: 1985077 - RNA, 14 nt, Shigella flexneri 2a str. 301
acacaauuuuguag

SEQ ID NO: 1985078 - RNA, 16 nt, Shigella flexneri 2a str. 301
acacacgcccagcuca

SEQ ID NO: 1985079 - RNA, 15 nt, Shigella flexneri 2a str. 301
acacacuucauuuuc

SEQ ID NO: 1985080 - RNA, 12 nt, Shigella flexneri 2a str. 301
acacacaucacg

SEQ ID NO: 1985081 - RNA, 20 nt, Shigella flexneri 2a str. 301
acacacuucauuuuccacaa

SEQ ID NO: 1985082 - RNA, 16 nt, Shigella flexneri 2a str. 301
acacagacgguuuuuc

SEQ ID NO: 1985083 - RNA, 21 nt, Shigella flexneri 2a str. 301
acaagcuuacguuacccagca

SEQ ID NO: 1985084 - RNA, 22 nt, Shigella flexneri 2a str. 301
acaagguacgaaaaaaauuacu

SEQ ID NO: 1985085 - RNA, 15 nt, Shigella flexneri 2a str. 301
acaagggugagggag

SEQ ID NO: 1985086 - RNA, 18 nt, Shigella flexneri 2a str. 301
acaauacauagaaacuca

SEQ ID NO: 1985087 - RNA, 15 nt, Shigella flexneri 2a str. 301
acaauacaaaugccu

SEQ ID NO: 1985088 - RNA, 14 nt, Shigella flexneri 2a str. 301
acaauaauaucuuu

SEQ ID NO: 1985089 - RNA, 17 nt, Shigella flexneri 2a str. 301
acaauaauacccagcac

SEQ ID NO: 1985090 - RNA, 12 nt, Shigella flexneri 2a str. 301
acaauaauaucu

SEQ ID NO: 1985091 - RNA, 13 nt, Shigella flexneri 2a str. 301
acaauaauaucuu

SEQ ID NO: 1985092 - RNA, 19 nt, Shigella flexneri 2a str. 301
acaauagcgaacagacaaa

SEQ ID NO: 1985093 - RNA, 19 nt, Shigella flexneri 2a str. 301
acaauagccacauugcugc

SEQ ID NO: 1985094 - RNA, 18 nt, Shigella flexneri 2a str. 301
acaauagcaaucuguaac

SEQ ID NO: 1985095 - RNA, 16 nt, Shigella flexneri 2a str. 301
acaauacugaucauca

SEQ ID NO: 1985096 - RNA, 12 nt, Shigella flexneri 2a str. 301
acaauacuuaua

SEQ ID NO: 1985097 - RNA, 15 nt, Shigella flexneri 2a str. 301
acaauacgcccacgu

SEQ ID NO: 1985098 - RNA, 13 nt, Shigella flexneri 2a str. 301
acaaguucuucga

SEQ ID NO: 1985099 - RNA, 18 nt, Shigella flexneri 2a str. 301
acaaguuguuuacaguau

SEQ ID NO: 1985100 - RNA, 16 nt, Shigella flexneri 2a str. 301
acaauaugcucuccac

SEQ ID NO: 1985101 - RNA, 13 nt, Shigella flexneri 2a str. 301
acaaucagccaga

SEQ ID NO: 1985102 - RNA, 14 nt, Shigella flexneri 2a str. 301
acaaucacacuaac

SEQ ID NO: 1985103 - RNA, 21 nt, Shigella flexneri 2a str. 301
acaaucccgcuuacaucaacu

SEQ ID NO: 1985104 - RNA, 20 nt, Shigella flexneri 2a str. 301
acaaucccuuaguaacgcca

SEQ ID NO: 1985105 - RNA, 21 nt, Shigella flexneri 2a str. 301
acaaucccuuaguaacgccag

SEQ ID NO: 1985106 - RNA, 17 nt, Shigella flexneri 2a str. 301
acaaucccuuaguaacg

SEQ ID NO: 1985107 - RNA, 18 nt, Shigella flexneri 2a str. 301
acaauccgguagguucaa

SEQ ID NO: 1985108 - RNA, 16 nt, Shigella flexneri 2a str. 301
acaaucugcgcuggaa

SEQ ID NO: 1985109 - RNA, 14 nt, Shigella flexneri 2a str. 301
acaaugaagaaagu

SEQ ID NO: 1985110 - RNA, 23 nt, Shigella flexneri 2a str. 301
acaaucgggaaaaucugcgggaa

SEQ ID NO: 1985111 - RNA, 17 nt, Shigella flexneri 2a str. 301
acaaucgucagcucgcu

SEQ ID NO: 1985112 - RNA, 17 nt, Shigella flexneri 2a str. 301
acaaucguuucaugcca

SEQ ID NO: 1985113 - RNA, 18 nt, Shigella flexneri 2a str. 301
acaaucucaauuuucacu

SEQ ID NO: 1985114 - RNA, 19 nt, Shigella flexneri 2a str. 301
acaaucucacccgcuucau

SEQ ID NO: 1985115 - RNA, 18 nt, Shigella flexneri 2a str. 301
acaaucguugccugaugc

SEQ ID NO: 1985116 - RNA, 14 nt, Shigella flexneri 2a str. 301
acaccuucauccag

SEQ ID NO: 1985117 - RNA, 19 nt, Shigella flexneri 2a str. 301
acaccuucauccagcauca

SEQ ID NO: 1985118 - RNA, 15 nt, Shigella flexneri 2a str. 301
acaccuuaaggcugu

SEQ ID NO: 1985119 - RNA, 23 nt, Shigella flexneri 2a str. 301
acaccuguugcgcgucgcccagu

SEQ ID NO: 1985120 - RNA, 16 nt, Shigella flexneri 2a str. 301
acaccuguuccagugg

SEQ ID NO: 1985121 - RNA, 13 nt, Shigella flexneri 2a str. 301
acacgaucucacg

SEQ ID NO: 1985122 - RNA, 18 nt, Shigella flexneri 2a str. 301
acacgacauacaccgcag

SEQ ID NO: 1985123 - RNA, 16 nt, Shigella flexneri 2a str. 301
acaccggcaauaauua

SEQ ID NO: 1985124 - RNA, 19 nt, Shigella flexneri 2a str. 301
acaccgguuuaccggccag

SEQ ID NO: 1985125 - RNA, 19 nt, Shigella flexneri 2a str. 301
acaccguugcccgcauuau

SEQ ID NO: 1985126 - RNA, 16 nt, Shigella flexneri 2a str. 301
acaccgauugccccug

SEQ ID NO: 1985127 - RNA, 15 nt, Shigella flexneri 2a str. 301
acaccgcacgcagaa

SEQ ID NO: 1985128 - RNA, 21 nt, Shigella flexneri 2a str. 301
acaccgcagccgccacaauaa

SEQ ID NO: 1985129 - RNA, 21 nt, Shigella flexneri 2a str. 301
acaccgauuuuguaaaagaag

SEQ ID NO: 1985130 - RNA, 23 nt, Shigella flexneri 2a str. 301
acaccgauuuuguaaaagaaggc

SEQ ID NO: 1985131 - RNA, 20 nt, Shigella flexneri 2a str. 301
acaccauugauaauccauca

SEQ ID NO: 1985132 - RNA, 22 nt, Shigella flexneri 2a str. 301
acaccauugauaauccaucacu

SEQ ID NO: 1985133 - RNA, 17 nt, Shigella flexneri 2a str. 301
acacccgguaucaaacc

SEQ ID NO: 1985134 - RNA, 20 nt, Shigella flexneri 2a str. 301
acacccgguaucaaacccuu

SEQ ID NO: 1985135 - RNA, 15 nt, Shigella flexneri 2a str. 301
acaccccuucauuca

SEQ ID NO: 1985136 - RNA, 18 nt, Shigella flexneri 2a str. 301
acaccagagccugccaau

SEQ ID NO: 1985137 - RNA, 16 nt, Shigella flexneri 2a str. 301
acaccagcaauaaugc

SEQ ID NO: 1985138 - RNA, 12 nt, Shigella flexneri 2a str. 301
acaccagaugag

SEQ ID NO: 1985139 - RNA, 15 nt, Shigella flexneri 2a str. 301
acaccagaugauuag

SEQ ID NO: 1985140 - RNA, 12 nt, Shigella flexneri 2a str. 301
acaccaucaaca

SEQ ID NO: 1985141 - RNA, 14 nt, Shigella flexneri 2a str. 301
acaccaucaacaaa

SEQ ID NO: 1985142 - RNA, 14 nt, Shigella flexneri 2a str. 301
acaccaccugccag

SEQ ID NO: 1985143 - RNA, 15 nt, Shigella flexneri 2a str. 301
acaccaaggaacugu

SEQ ID NO: 1985144 - RNA, 17 nt, Shigella flexneri 2a str. 301
acaccaccuaacccgcu

SEQ ID NO: 1985145 - RNA, 16 nt, Shigella flexneri 2a str. 301
acaccagaaugcccca

SEQ ID NO: 1985146 - RNA, 20 nt, Shigella flexneri 2a str. 301
acaccaccaauggcuggccu

SEQ ID NO: 1985147 - RNA, 17 nt, Shigella flexneri 2a str. 301
acaccaauuucugaagg

SEQ ID NO: 1985148 - RNA, 16 nt, Shigella flexneri 2a str. 301
acacauuaucucaaca

SEQ ID NO: 1985149 - RNA, 15 nt, Shigella flexneri 2a str. 301
acaccaacaucacgc

SEQ ID NO: 1985150 - RNA, 22 nt, Shigella flexneri 2a str. 301
acacauugcuguaucacuauga

SEQ ID NO: 1985151 - RNA, 24 nt, Shigella flexneri 2a str. 301
acacauugcuguaucacuaugaaa

SEQ ID NO: 1985152 - RNA, 20 nt, Shigella flexneri 2a str. 301
acacauugugaaugaucagc

SEQ ID NO: 1985153 - RNA, 15 nt, Shigella flexneri 2a str. 301
acacucaaauaucua

SEQ ID NO: 1985154 - RNA, 22 nt, Shigella flexneri 2a str. 301
acacuauuuccccggaaccuga

SEQ ID NO: 1985155 - RNA, 12 nt, Shigella flexneri 2a str. 301
acacuauuuccu

SEQ ID NO: 1985156 - RNA, 19 nt, Shigella flexneri 2a str. 301
acacuauaaaauaaccaca

SEQ ID NO: 1985157 - RNA, 12 nt, Shigella flexneri 2a str. 301
acagaaauggua

SEQ ID NO: 1985158 - RNA, 23 nt, Shigella flexneri 2a str. 301
acagaacgcgccuuaaaaaccag

SEQ ID NO: 1985159 - RNA, 15 nt, Shigella flexneri 2a str. 301
acagaaaugaaaaaa

SEQ ID NO: 1985160 - RNA, 13 nt, Shigella flexneri 2a str. 301
acagaacaauaau

SEQ ID NO: 1985161 - RNA, 14 nt, Shigella flexneri 2a str. 301
acagaacagugcca

SEQ ID NO: 1985162 - RNA, 22 nt, Shigella flexneri 2a str. 301
acagaaacgccauccagccggg

SEQ ID NO: 1985163 - RNA, 16 nt, Shigella flexneri 2a str. 301
acacuaacagaacaau

SEQ ID NO: 1985164 - RNA, 18 nt, Shigella flexneri 2a str. 301
acacuaacagaacaauaa

SEQ ID NO: 1985165 - RNA, 19 nt, Shigella flexneri 2a str. 301
acacggcguauacaagaac

SEQ ID NO: 1985166 - RNA, 22 nt, Shigella flexneri 2a str. 301
acacgcugcgguuuacgccagg

SEQ ID NO: 1985167 - RNA, 20 nt, Shigella flexneri 2a str. 301
acacgcuaccaaaaaaucaa

SEQ ID NO: 1985168 - RNA, 22 nt, Shigella flexneri 2a str. 301
acacgccuggcucaagcaccau

SEQ ID NO: 1985169 - RNA, 13 nt, Shigella flexneri 2a str. 301
acagcaguccagc

SEQ ID NO: 1985170 - RNA, 15 nt, Shigella flexneri 2a str. 301
acagcauaaggcaca

SEQ ID NO: 1985171 - RNA, 13 nt, Shigella flexneri 2a str. 301
acagcauaccuuc

SEQ ID NO: 1985172 - RNA, 17 nt, Shigella flexneri 2a str. 301
acagcauauaaugcaac

SEQ ID NO: 1985173 - RNA, 17 nt, Shigella flexneri 2a str. 301
acagcaggcucagaaga

SEQ ID NO: 1985174 - RNA, 20 nt, Shigella flexneri 2a str. 301
acagcagguguuacccgcua

SEQ ID NO: 1985175 - RNA, 17 nt, Shigella flexneri 2a str. 301
acagcaucaucgcaaug

SEQ ID NO: 1985176 - RNA, 21 nt, Shigella flexneri 2a str. 301
acagcauggcuucuuccccgg

SEQ ID NO: 1985177 - RNA, 15 nt, Shigella flexneri 2a str. 301
acagcaucuggauga

SEQ ID NO: 1985178 - RNA, 20 nt, Shigella flexneri 2a str. 301
acagcaaagugcccccaacu

SEQ ID NO: 1985179 - RNA, 19 nt, Shigella flexneri 2a str. 301
acagcaaagugcccccaac

SEQ ID NO: 1985180 - RNA, 12 nt, Shigella flexneri 2a str. 301
acagcaaaacgc

SEQ ID NO: 1985181 - RNA, 21 nt, Shigella flexneri 2a str. 301
acagcaaagcgugcaaauaua

SEQ ID NO: 1985182 - RNA, 22 nt, Shigella flexneri 2a str. 301
acagauuuugccagcaugacua

SEQ ID NO: 1985183 - RNA, 15 nt, Shigella flexneri 2a str. 301
acagacucaaaccaa

SEQ ID NO: 1985184 - RNA, 20 nt, Shigella flexneri 2a str. 301
acagaccugcgucaccacau

SEQ ID NO: 1985185 - RNA, 17 nt, Shigella flexneri 2a str. 301
acagacgagggaaaaua

SEQ ID NO: 1985186 - RNA, 21 nt, Shigella flexneri 2a str. 301
acagaccuuucgaacccaacc

SEQ ID NO: 1985187 - RNA, 14 nt, Shigella flexneri 2a str. 301
acagaaggccagga

SEQ ID NO: 1985188 - RNA, 22 nt, Shigella flexneri 2a str. 301
acagaccggagccaaacaugca

SEQ ID NO: 1985189 - RNA, 14 nt, Shigella flexneri 2a str. 301
acagauaggcauca

SEQ ID NO: 1985190 - RNA, 24 nt, Shigella flexneri 2a str. 301
acagauauuuauuucagaacaguu

SEQ ID NO: 1985191 - RNA, 22 nt, Shigella flexneri 2a str. 301
acauaccuaaaagcacgccaga

SEQ ID NO: 1985192 - RNA, 23 nt, Shigella flexneri 2a str. 301
acauaccuaaaagcacgccagac

SEQ ID NO: 1985193 - RNA, 18 nt, Shigella flexneri 2a str. 301
acauagaucuaaaugcca

SEQ ID NO: 1985194 - RNA, 18 nt, Shigella flexneri 2a str. 301
acauacugagaaccuuua

SEQ ID NO: 1985195 - RNA, 15 nt, Shigella flexneri 2a str. 301
acauagcacaacagg

SEQ ID NO: 1985196 - RNA, 16 nt, Shigella flexneri 2a str. 301
acauagcgugacacca

SEQ ID NO: 1985197 - RNA, 20 nt, Shigella flexneri 2a str. 301
acauaacgccaauucauucc

SEQ ID NO: 1985198 - RNA, 19 nt, Shigella flexneri 2a str. 301
acauacccuugaucaccgu

SEQ ID NO: 1985199 - RNA, 20 nt, Shigella flexneri 2a str. 301
acaguuuucaagacgccguc

SEQ ID NO: 1985200 - RNA, 14 nt, Shigella flexneri 2a str. 301
acauaaaaaagccg

SEQ ID NO: 1985201 - RNA, 13 nt, Shigella flexneri 2a str. 301
acauaaaaaccug

SEQ ID NO: 1985202 - RNA, 13 nt, Shigella flexneri 2a str. 301
acagccaacacau

SEQ ID NO: 1985203 - RNA, 14 nt, Shigella flexneri 2a str. 301
acagccaacacauu

SEQ ID NO: 1985204 - RNA, 15 nt, Shigella flexneri 2a str. 301
acaguuucaccugcu

SEQ ID NO: 1985205 - RNA, 11 nt, Shigella flexneri 2a str. 301
acagcauuucc

SEQ ID NO: 1985206 - RNA, 18 nt, Shigella flexneri 2a str. 301
acaucaccaauacgcaua

SEQ ID NO: 1985207 - RNA, 22 nt, Shigella flexneri 2a str. 301
acaucaccgacguuugcgccca

SEQ ID NO: 1985208 - RNA, 13 nt, Shigella flexneri 2a str. 301
acaucaccgccac

SEQ ID NO: 1985209 - RNA, 21 nt, Shigella flexneri 2a str. 301
acaucaccguucagcuugcgu

SEQ ID NO: 1985210 - RNA, 18 nt, Shigella flexneri 2a str. 301
acaucaguuggaugcugc

SEQ ID NO: 1985211 - RNA, 14 nt, Shigella flexneri 2a str. 301
acaucaacccgccc

SEQ ID NO: 1985212 - RNA, 16 nt, Shigella flexneri 2a str. 301
acaucaacucugcaau

SEQ ID NO: 1985213 - RNA, 21 nt, Shigella flexneri 2a str. 301
acaucaauggaugcaaucaca

SEQ ID NO: 1985214 - RNA, 15 nt, Shigella flexneri 2a str. 301
acauaucacaauuga

SEQ ID NO: 1985215 - RNA, 18 nt, Shigella flexneri 2a str. 301
acauaucacaauugaugc

SEQ ID NO: 1985216 - RNA, 23 nt, Shigella flexneri 2a str. 301
acauaucaggcuccggaaauuug

SEQ ID NO: 1985217 - RNA, 12 nt, Shigella flexneri 2a str. 301
acauaugcacau

SEQ ID NO: 1985218 - RNA, 17 nt, Shigella flexneri 2a str. 301
acauauccuucacacau

SEQ ID NO: 1985219 - RNA, 15 nt, Shigella flexneri 2a str. 301
acaucaucugccacu

SEQ ID NO: 1985220 - RNA, 11 nt, Shigella flexneri 2a str. 301
acaucaucaga

SEQ ID NO: 1985221 - RNA, 16 nt, Shigella flexneri 2a str. 301
acaucaucaaagccaa

SEQ ID NO: 1985222 - RNA, 20 nt, Shigella flexneri 2a str. 301
acaucaucagaaaugccagu

SEQ ID NO: 1985223 - RNA, 20 nt, Shigella flexneri 2a str. 301
acaucauccugacccagcaa

SEQ ID NO: 1985224 - RNA, 16 nt, Shigella flexneri 2a str. 301
acaucaugccagugau

SEQ ID NO: 1985225 - RNA, 22 nt, Shigella flexneri 2a str. 301
acauccagacggguacaguuuu

SEQ ID NO: 1985226 - RNA, 15 nt, Shigella flexneri 2a str. 301
acauccagcagcaau

SEQ ID NO: 1985227 - RNA, 14 nt, Shigella flexneri 2a str. 301
acauccucuucaag

SEQ ID NO: 1985228 - RNA, 15 nt, Shigella flexneri 2a str. 301
acauccugcguuaau

SEQ ID NO: 1985229 - RNA, 13 nt, Shigella flexneri 2a str. 301
acaucccagcaga

SEQ ID NO: 1985230 - RNA, 22 nt, Shigella flexneri 2a str. 301
acaucuuucugcgcaucuuccc

SEQ ID NO: 1985231 - RNA, 19 nt, Shigella flexneri 2a str. 301
acaucuucuccagcgaauc

SEQ ID NO: 1985232 - RNA, 15 nt, Shigella flexneri 2a str. 301
acaugaaacagaaaa

SEQ ID NO: 1985233 - RNA, 24 nt, Shigella flexneri 2a str. 301
acaugaaaauaaccauauaugaua

SEQ ID NO: 1985234 - RNA, 13 nt, Shigella flexneri 2a str. 301
acaucgcuuucca

SEQ ID NO: 1985235 - RNA, 14 nt, Shigella flexneri 2a str. 301
acaucgcuuuccag

SEQ ID NO: 1985236 - RNA, 14 nt, Shigella flexneri 2a str. 301
acaucgucgccaga

SEQ ID NO: 1985237 - RNA, 23 nt, Shigella flexneri 2a str. 301
acauguugaaucuucgugcguuu

SEQ ID NO: 1985238 - RNA, 16 nt, Shigella flexneri 2a str. 301
acauguugaaucuuca

SEQ ID NO: 1985239 - RNA, 23 nt, Shigella flexneri 2a str. 301
acauguugaaucuucaugcguuu

SEQ ID NO: 1985240 - RNA, 13 nt, Shigella flexneri 2a str. 301
acauguucauuua

SEQ ID NO: 1985241 - RNA, 16 nt, Shigella flexneri 2a str. 301
acaugcggugauuuug

SEQ ID NO: 1985242 - RNA, 17 nt, Shigella flexneri 2a str. 301
acauguuaguugaagca

SEQ ID NO: 1985243 - RNA, 15 nt, Shigella flexneri 2a str. 301
acauguucaaaaaaa

SEQ ID NO: 1985244 - RNA, 18 nt, Shigella flexneri 2a str. 301
acaugcgaucccacgccg

SEQ ID NO: 1985245 - RNA, 18 nt, Shigella flexneri 2a str. 301
acaugcgauaaagcauac

SEQ ID NO: 1985246 - RNA, 12 nt, Shigella flexneri 2a str. 301
acaugcgauaaa

SEQ ID NO: 1985247 - RNA, 23 nt, Shigella flexneri 2a str. 301
acaugcgcgacaaaaauuacugc

SEQ ID NO: 1985248 - RNA, 16 nt, Shigella flexneri 2a str. 301
acauguuuuccagcac

SEQ ID NO: 1985249 - RNA, 17 nt, Shigella flexneri 2a str. 301
acauguuuuccagcaca

SEQ ID NO: 1985250 - RNA, 19 nt, Shigella flexneri 2a str. 301
acauguuguacaugcugcu

SEQ ID NO: 1985251 - RNA, 20 nt, Shigella flexneri 2a str. 301
acauugcuguaucacuauga

SEQ ID NO: 1985252 - RNA, 18 nt, Shigella flexneri 2a str. 301
acauuggcacaagaagua

SEQ ID NO: 1985253 - RNA, 15 nt, Shigella flexneri 2a str. 301
acauugcugcacauc

SEQ ID NO: 1985254 - RNA, 15 nt, Shigella flexneri 2a str. 301
acauugauguuuuca

SEQ ID NO: 1985255 - RNA, 18 nt, Shigella flexneri 2a str. 301
acauugauguuuucagac

SEQ ID NO: 1985256 - RNA, 21 nt, Shigella flexneri 2a str. 301
acauugagcuuugacgaccuu

SEQ ID NO: 1985257 - RNA, 18 nt, Shigella flexneri 2a str. 301
acauugaaggauaagacg

SEQ ID NO: 1985258 - RNA, 20 nt, Shigella flexneri 2a str. 301
acauugacgauagcgccgcc

SEQ ID NO: 1985259 - RNA, 14 nt, Shigella flexneri 2a str. 301
acauucccugcagu

SEQ ID NO: 1985260 - RNA, 22 nt, Shigella flexneri 2a str. 301
acauucaauaacacauugcugu

SEQ ID NO: 1985261 - RNA, 13 nt, Shigella flexneri 2a str. 301
acauuaucagaca

SEQ ID NO: 1985262 - RNA, 16 nt, Shigella flexneri 2a str. 301
acauuagauaaaaaug

SEQ ID NO: 1985263 - RNA, 14 nt, Shigella flexneri 2a str. 301
acauuggugccgga

SEQ ID NO: 1985264 - RNA, 14 nt, Shigella flexneri 2a str. 301
acauuguuuuccag

SEQ ID NO: 1985265 - RNA, 14 nt, Shigella flexneri 2a str. 301
acauuucugcugcc

SEQ ID NO: 1985266 - RNA, 18 nt, Shigella flexneri 2a str. 301
accaaauuccagaaaaga

SEQ ID NO: 1985267 - RNA, 21 nt, Shigella flexneri 2a str. 301
accaaaucugauuaauauuga

SEQ ID NO: 1985268 - RNA, 12 nt, Shigella flexneri 2a str. 301
acauuuucucua

SEQ ID NO: 1985269 - RNA, 12 nt, Shigella flexneri 2a str. 301
acauuuugaccc

SEQ ID NO: 1985270 - RNA, 14 nt, Shigella flexneri 2a str. 301
accaaacagcgcca

SEQ ID NO: 1985271 - RNA, 15 nt, Shigella flexneri 2a str. 301
accaaaacgugcagc

SEQ ID NO: 1985272 - RNA, 17 nt, Shigella flexneri 2a str. 301
accaaugacguuaauaa

SEQ ID NO: 1985273 - RNA, 18 nt, Shigella flexneri 2a str. 301
accaauaccgcccaccac

SEQ ID NO: 1985274 - RNA, 19 nt, Shigella flexneri 2a str. 301
accaauaccgcccaccacc

SEQ ID NO: 1985275 - RNA, 16 nt, Shigella flexneri 2a str. 301
accaauaaacgccagg

SEQ ID NO: 1985276 - RNA, 17 nt, Shigella flexneri 2a str. 301
accaauaacgcuuuucu

SEQ ID NO: 1985277 - RNA, 13 nt, Shigella flexneri 2a str. 301
accaauaaucaau

SEQ ID NO: 1985278 - RNA, 15 nt, Shigella flexneri 2a str. 301
accaauaaugaacgc

SEQ ID NO: 1985279 - RNA, 20 nt, Shigella flexneri 2a str. 301
accaauaaugaacgccaccc

SEQ ID NO: 1985280 - RNA, 19 nt, Shigella flexneri 2a str. 301
accaagaccaauccgccag

SEQ ID NO: 1985281 - RNA, 19 nt, Shigella flexneri 2a str. 301
accaacaauaaaauugagg

SEQ ID NO: 1985282 - RNA, 13 nt, Shigella flexneri 2a str. 301
accaauggcaaua

SEQ ID NO: 1985283 - RNA, 23 nt, Shigella flexneri 2a str. 301
accaaugucgaaagccccagccc

SEQ ID NO: 1985284 - RNA, 22 nt, Shigella flexneri 2a str. 301
accaauguuacgaccuuccuga

SEQ ID NO: 1985285 - RNA, 21 nt, Shigella flexneri 2a str. 301
accaaugauugggucauuucc

SEQ ID NO: 1985286 - RNA, 19 nt, Shigella flexneri 2a str. 301
accaaugauaaguuucacu

SEQ ID NO: 1985287 - RNA, 22 nt, Shigella flexneri 2a str. 301
accacaaacucuuuuccggaac

SEQ ID NO: 1985288 - RNA, 16 nt, Shigella flexneri 2a str. 301
accacaaugaagaaag

SEQ ID NO: 1985289 - RNA, 13 nt, Shigella flexneri 2a str. 301
accacaaccgccg

SEQ ID NO: 1985290 - RNA, 15 nt, Shigella flexneri 2a str. 301
accacagcaaaacac

SEQ ID NO: 1985291 - RNA, 12 nt, Shigella flexneri 2a str. 301
accacaccaacc

SEQ ID NO: 1985292 - RNA, 14 nt, Shigella flexneri 2a str. 301
accacaaugcaaua

SEQ ID NO: 1985293 - RNA, 13 nt, Shigella flexneri 2a str. 301
accacaccgucag

SEQ ID NO: 1985294 - RNA, 23 nt, Shigella flexneri 2a str. 301
accagcggccggaugcgccgcca

SEQ ID NO: 1985295 - RNA, 20 nt, Shigella flexneri 2a str. 301
accagccgcgacaucuucuc

SEQ ID NO: 1985296 - RNA, 24 nt, Shigella flexneri 2a str. 301
accagccccagaauucacgcacuu

SEQ ID NO: 1985297 - RNA, 15 nt, Shigella flexneri 2a str. 301
accagcuccagcaga

SEQ ID NO: 1985298 - RNA, 23 nt, Shigella flexneri 2a str. 301
accagcucccggagggguuuuug

SEQ ID NO: 1985299 - RNA, 14 nt, Shigella flexneri 2a str. 301
accagcuccagcag

SEQ ID NO: 1985300 - RNA, 18 nt, Shigella flexneri 2a str. 301
accagcggguugcugaga

SEQ ID NO: 1985301 - RNA, 17 nt, Shigella flexneri 2a str. 301
accagcguuuccagcac

SEQ ID NO: 1985302 - RNA, 18 nt, Shigella flexneri 2a str. 301
accagcguuuccagcacc

SEQ ID NO: 1985303 - RNA, 17 nt, Shigella flexneri 2a str. 301
accagcgucgcaucagg

SEQ ID NO: 1985304 - RNA, 17 nt, Shigella flexneri 2a str. 301
accagccauuaaccagc

SEQ ID NO: 1985305 - RNA, 16 nt, Shigella flexneri 2a str. 301
accagccaggccgcca

SEQ ID NO: 1985306 - RNA, 10 nt, Shigella flexneri 2a str. 301
accagcagca

SEQ ID NO: 1985307 - RNA, 14 nt, Shigella flexneri 2a str. 301
accagcacuucacu

SEQ ID NO: 1985308 - RNA, 22 nt, Shigella flexneri 2a str. 301
accagcacaucaucaaagccaa

SEQ ID NO: 1985309 - RNA, 18 nt, Shigella flexneri 2a str. 301
accagcaauuuacgcuuu

SEQ ID NO: 1985310 - RNA, 23 nt, Shigella flexneri 2a str. 301
accagcaacgcuucguagaagcc

SEQ ID NO: 1985311 - RNA, 22 nt, Shigella flexneri 2a str. 301
accagcaaccaacgccagcagc

SEQ ID NO: 1985312 - RNA, 19 nt, Shigella flexneri 2a str. 301
accagcaaccaacgccagc

SEQ ID NO: 1985313 - RNA, 17 nt, Shigella flexneri 2a str. 301
accacgccugccgccag

SEQ ID NO: 1985314 - RNA, 17 nt, Shigella flexneri 2a str. 301
accacgccaagaaacac

SEQ ID NO: 1985315 - RNA, 16 nt, Shigella flexneri 2a str. 301
accacgccgauaauca

SEQ ID NO: 1985316 - RNA, 16 nt, Shigella flexneri 2a str. 301
accacuuaauuauuaa

SEQ ID NO: 1985317 - RNA, 21 nt, Shigella flexneri 2a str. 301
accacuuaauuauuaacaaaa

SEQ ID NO: 1985318 - RNA, 20 nt, Shigella flexneri 2a str. 301
accacuuccagcagaccagc

SEQ ID NO: 1985319 - RNA, 21 nt, Shigella flexneri 2a str. 301
accacuucaugccccauggac

SEQ ID NO: 1985320 - RNA, 15 nt, Shigella flexneri 2a str. 301
accacuuccagcaga

SEQ ID NO: 1985321 - RNA, 17 nt, Shigella flexneri 2a str. 301
accacguugacaaacug

SEQ ID NO: 1985322 - RNA, 15 nt, Shigella flexneri 2a str. 301
accacuacaucaagu

SEQ ID NO: 1985323 - RNA, 15 nt, Shigella flexneri 2a str. 301
accacguucauuuca

SEQ ID NO: 1985324 - RNA, 20 nt, Shigella flexneri 2a str. 301
accaccuuacuuacacauca

SEQ ID NO: 1985325 - RNA, 21 nt, Shigella flexneri 2a str. 301
accaccuccacgcccagcgca

SEQ ID NO: 1985326 - RNA, 17 nt, Shigella flexneri 2a str. 301
accacgcagcguuggca

SEQ ID NO: 1985327 - RNA, 23 nt, Shigella flexneri 2a str. 301
accaccguuuuuucugccucugc

SEQ ID NO: 1985328 - RNA, 18 nt, Shigella flexneri 2a str. 301
accaccgucccaguaauu

SEQ ID NO: 1985329 - RNA, 15 nt, Shigella flexneri 2a str. 301
accaccagcaccgcg

SEQ ID NO: 1985330 - RNA, 14 nt, Shigella flexneri 2a str. 301
accaccagcacacu

SEQ ID NO: 1985331 - RNA, 13 nt, Shigella flexneri 2a str. 301
accaccagcacug

SEQ ID NO: 1985332 - RNA, 12 nt, Shigella flexneri 2a str. 301
accaccagcacg

SEQ ID NO: 1985333 - RNA, 12 nt, Shigella flexneri 2a str. 301
accaccagcaau

SEQ ID NO: 1985334 - RNA, 20 nt, Shigella flexneri 2a str. 301
accaccaugcuaauagcugc

SEQ ID NO: 1985335 - RNA, 11 nt, Shigella flexneri 2a str. 301
accaccaugcu

SEQ ID NO: 1985336 - RNA, 15 nt, Shigella flexneri 2a str. 301
accacccaccgcagc

SEQ ID NO: 1985337 - RNA, 23 nt, Shigella flexneri 2a str. 301
accaccagugccauuaacaggcc

SEQ ID NO: 1985338 - RNA, 21 nt, Shigella flexneri 2a str. 301
accaucggcaccaccaaaaac

SEQ ID NO: 1985339 - RNA, 16 nt, Shigella flexneri 2a str. 301
accaucggcagcgcca

SEQ ID NO: 1985340 - RNA, 21 nt, Shigella flexneri 2a str. 301
accaucgcuacauaacgcagc

SEQ ID NO: 1985341 - RNA, 17 nt, Shigella flexneri 2a str. 301
accaucggcaccaccaa

SEQ ID NO: 1985342 - RNA, 18 nt, Shigella flexneri 2a str. 301
accaucguacaggcacau

SEQ ID NO: 1985343 - RNA, 20 nt, Shigella flexneri 2a str. 301
accaucguacaggcacaugu

SEQ ID NO: 1985344 - RNA, 20 nt, Shigella flexneri 2a str. 301
accaucguccagcagcaaug

SEQ ID NO: 1985345 - RNA, 14 nt, Shigella flexneri 2a str. 301
accaucgccagccc

SEQ ID NO: 1985346 - RNA, 18 nt, Shigella flexneri 2a str. 301
accaucgccccacccaag

SEQ ID NO: 1985347 - RNA, 14 nt, Shigella flexneri 2a str. 301
accauccugcuccu

SEQ ID NO: 1985348 - RNA, 20 nt, Shigella flexneri 2a str. 301
accaucuuccaguugcacgc

SEQ ID NO: 1985349 - RNA, 19 nt, Shigella flexneri 2a str. 301
accaugcaauuaccgccac

SEQ ID NO: 1985350 - RNA, 23 nt, Shigella flexneri 2a str. 301
accaugcaauuaccgccaccagg

SEQ ID NO: 1985351 - RNA, 15 nt, Shigella flexneri 2a str. 301
accaucuucuucacu

SEQ ID NO: 1985352 - RNA, 21 nt, Shigella flexneri 2a str. 301
accagcuuaugccuguccucu

SEQ ID NO: 1985353 - RNA, 23 nt, Shigella flexneri 2a str. 301
accagcuuucgcuuaacgcccau

SEQ ID NO: 1985354 - RNA, 22 nt, Shigella flexneri 2a str. 301
accaucaaguagcagguaaucu

SEQ ID NO: 1985355 - RNA, 15 nt, Shigella flexneri 2a str. 301
accauccauuuuuca

SEQ ID NO: 1985356 - RNA, 16 nt, Shigella flexneri 2a str. 301
accaucaccaucgccc

SEQ ID NO: 1985357 - RNA, 15 nt, Shigella flexneri 2a str. 301
accaucaauggauga

SEQ ID NO: 1985358 - RNA, 22 nt, Shigella flexneri 2a str. 301
accaucaauccacuucgccaga

SEQ ID NO: 1985359 - RNA, 18 nt, Shigella flexneri 2a str. 301
accauggcagaagcauuu

SEQ ID NO: 1985360 - RNA, 18 nt, Shigella flexneri 2a str. 301
accauggcucaccagcag

SEQ ID NO: 1985361 - RNA, 15 nt, Shigella flexneri 2a str. 301
accaugcgcaucauc

SEQ ID NO: 1985362 - RNA, 13 nt, Shigella flexneri 2a str. 301
accaugucaucaa

SEQ ID NO: 1985363 - RNA, 14 nt, Shigella flexneri 2a str. 301
accaugucaucaau

SEQ ID NO: 1985364 - RNA, 22 nt, Shigella flexneri 2a str. 301
accauguugcgcagaguuucca

SEQ ID NO: 1985365 - RNA, 15 nt, Shigella flexneri 2a str. 301
accauguucacugcc

SEQ ID NO: 1985366 - RNA, 15 nt, Shigella flexneri 2a str. 301
acccaaaaaauagca

SEQ ID NO: 1985367 - RNA, 17 nt, Shigella flexneri 2a str. 301
acccaaaacaaagcccg

SEQ ID NO: 1985368 - RNA, 12 nt, Shigella flexneri 2a str. 301
acccaccgcagc

SEQ ID NO: 1985369 - RNA, 13 nt, Shigella flexneri 2a str. 301
acccaccgcagcc

SEQ ID NO: 1985370 - RNA, 14 nt, Shigella flexneri 2a str. 301
accauuucugcgag

SEQ ID NO: 1985371 - RNA, 19 nt, Shigella flexneri 2a str. 301
accauuugugcuggcaaau

SEQ ID NO: 1985372 - RNA, 18 nt, Shigella flexneri 2a str. 301
acccaucaacaacuggcg

SEQ ID NO: 1985373 - RNA, 21 nt, Shigella flexneri 2a str. 301
acccaccgguccuaacaacca

SEQ ID NO: 1985374 - RNA, 17 nt, Shigella flexneri 2a str. 301
acccacggauagauuuu

SEQ ID NO: 1985375 - RNA, 17 nt, Shigella flexneri 2a str. 301
acccaggagaugcccga

SEQ ID NO: 1985376 - RNA, 22 nt, Shigella flexneri 2a str. 301
acccaggcccgcgugccggaag

SEQ ID NO: 1985377 - RNA, 14 nt, Shigella flexneri 2a str. 301
acccgacaccgccu

SEQ ID NO: 1985378 - RNA, 16 nt, Shigella flexneri 2a str. 301
acccgacgugcagcau

SEQ ID NO: 1985379 - RNA, 14 nt, Shigella flexneri 2a str. 301
acccgaccacuucc

SEQ ID NO: 1985380 - RNA, 22 nt, Shigella flexneri 2a str. 301
acccgcccaccauguucacugc

SEQ ID NO: 1985381 - RNA, 18 nt, Shigella flexneri 2a str. 301
acccgccacgaaauugag

SEQ ID NO: 1985382 - RNA, 13 nt, Shigella flexneri 2a str. 301
acccgccagacca

SEQ ID NO: 1985383 - RNA, 21 nt, Shigella flexneri 2a str. 301
acccgcagugauugccgcaac

SEQ ID NO: 1985384 - RNA, 13 nt, Shigella flexneri 2a str. 301
acccgcaaucauc

SEQ ID NO: 1985385 - RNA, 21 nt, Shigella flexneri 2a str. 301
acccgcacggccgcaagcaga

SEQ ID NO: 1985386 - RNA, 14 nt, Shigella flexneri 2a str. 301
acccgcagccagca

SEQ ID NO: 1985387 - RNA, 17 nt, Shigella flexneri 2a str. 301
acccaucgccagauaga

SEQ ID NO: 1985388 - RNA, 15 nt, Shigella flexneri 2a str. 301
acccaugaacaaaau

SEQ ID NO: 1985389 - RNA, 24 nt, Shigella flexneri 2a str. 301
acccaugacuuugaucugaccgaa

SEQ ID NO: 1985390 - RNA, 14 nt, Shigella flexneri 2a str. 301
accccgucaccacu

SEQ ID NO: 1985391 - RNA, 15 nt, Shigella flexneri 2a str. 301
accccggcccucucc

SEQ ID NO: 1985392 - RNA, 16 nt, Shigella flexneri 2a str. 301
accccaaaaaguugga

SEQ ID NO: 1985393 - RNA, 18 nt, Shigella flexneri 2a str. 301
accccgcuugcuguuccu

SEQ ID NO: 1985394 - RNA, 20 nt, Shigella flexneri 2a str. 301
acccgguacaucaauaccau

SEQ ID NO: 1985395 - RNA, 19 nt, Shigella flexneri 2a str. 301
acccggucccuucagccac

SEQ ID NO: 1985396 - RNA, 13 nt, Shigella flexneri 2a str. 301
acccggccacagc

SEQ ID NO: 1985397 - RNA, 14 nt, Shigella flexneri 2a str. 301
acccggccacagcg

SEQ ID NO: 1985398 - RNA, 14 nt, Shigella flexneri 2a str. 301
acccggccugcucc

SEQ ID NO: 1985399 - RNA, 14 nt, Shigella flexneri 2a str. 301
acccggcggcgcgc

SEQ ID NO: 1985400 - RNA, 17 nt, Shigella flexneri 2a str. 301
acccgcucaaacaccgu

SEQ ID NO: 1985401 - RNA, 16 nt, Shigella flexneri 2a str. 301
acccgcucauaauaca

SEQ ID NO: 1985402 - RNA, 20 nt, Shigella flexneri 2a str. 301
acccgcuguaaaugcugcuc

SEQ ID NO: 1985403 - RNA, 16 nt, Shigella flexneri 2a str. 301
acccggaccgucuuuu

SEQ ID NO: 1985404 - RNA, 12 nt, Shigella flexneri 2a str. 301
acccgcuucagu

SEQ ID NO: 1985405 - RNA, 14 nt, Shigella flexneri 2a str. 301
acccgcgacgcgcu

SEQ ID NO: 1985406 - RNA, 16 nt, Shigella flexneri 2a str. 301
acccgcgacgcgcuuu

SEQ ID NO: 1985407 - RNA, 13 nt, Shigella flexneri 2a str. 301
accgcgaguaauc

SEQ ID NO: 1985408 - RNA, 22 nt, Shigella flexneri 2a str. 301
accgcgaggccuaacaccauca

SEQ ID NO: 1985409 - RNA, 21 nt, Shigella flexneri 2a str. 301
accgccgcuccagaaucucaa

SEQ ID NO: 1985410 - RNA, 14 nt, Shigella flexneri 2a str. 301
accgcgcaguacca

SEQ ID NO: 1985411 - RNA, 14 nt, Shigella flexneri 2a str. 301
accgcgaucuucca

SEQ ID NO: 1985412 - RNA, 15 nt, Shigella flexneri 2a str. 301
accgcgaucuuccac

SEQ ID NO: 1985413 - RNA, 17 nt, Shigella flexneri 2a str. 301
accgcgccauguugccu

SEQ ID NO: 1985414 - RNA, 14 nt, Shigella flexneri 2a str. 301
accggaaaaggugu

SEQ ID NO: 1985415 - RNA, 12 nt, Shigella flexneri 2a str. 301
accgcuuuucca

SEQ ID NO: 1985416 - RNA, 17 nt, Shigella flexneri 2a str. 301
accgcuuuugucggcac

SEQ ID NO: 1985417 - RNA, 13 nt, Shigella flexneri 2a str. 301
accggaaccagcg

SEQ ID NO: 1985418 - RNA, 21 nt, Shigella flexneri 2a str. 301
accggacacacuucauuuucc

SEQ ID NO: 1985419 - RNA, 22 nt, Shigella flexneri 2a str. 301
accggagaauuagcguccggcu

SEQ ID NO: 1985420 - RNA, 15 nt, Shigella flexneri 2a str. 301
accgcguagcaucug

SEQ ID NO: 1985421 - RNA, 15 nt, Shigella flexneri 2a str. 301
accgcguaugcccag

SEQ ID NO: 1985422 - RNA, 16 nt, Shigella flexneri 2a str. 301
accgcguaauacauca

SEQ ID NO: 1985423 - RNA, 13 nt, Shigella flexneri 2a str. 301
accgcguuuucca

SEQ ID NO: 1985424 - RNA, 19 nt, Shigella flexneri 2a str. 301
accgcguuuugucgcgcca

SEQ ID NO: 1985425 - RNA, 17 nt, Shigella flexneri 2a str. 301
accgcucccagcaugac

SEQ ID NO: 1985426 - RNA, 13 nt, Shigella flexneri 2a str. 301
accgccaguaguc

SEQ ID NO: 1985427 - RNA, 22 nt, Shigella flexneri 2a str. 301
accgcccgcgcgguaucaccac

SEQ ID NO: 1985428 - RNA, 23 nt, Shigella flexneri 2a str. 301
accgcccugcggcugaccaccac

SEQ ID NO: 1985429 - RNA, 17 nt, Shigella flexneri 2a str. 301
accgccacuaccaucag

SEQ ID NO: 1985430 - RNA, 13 nt, Shigella flexneri 2a str. 301
accgccagcaagg

SEQ ID NO: 1985431 - RNA, 19 nt, Shigella flexneri 2a str. 301
accgcauacgcagcaucau

SEQ ID NO: 1985432 - RNA, 16 nt, Shigella flexneri 2a str. 301
accgcagugaaauuuc

SEQ ID NO: 1985433 - RNA, 19 nt, Shigella flexneri 2a str. 301
accgcaagaauucaauaua

SEQ ID NO: 1985434 - RNA, 17 nt, Shigella flexneri 2a str. 301
accgcaaagguugcugc

SEQ ID NO: 1985435 - RNA, 21 nt, Shigella flexneri 2a str. 301
accgcaaacugccguugcugc

SEQ ID NO: 1985436 - RNA, 15 nt, Shigella flexneri 2a str. 301
accgauuuuguaaaa

SEQ ID NO: 1985437 - RNA, 20 nt, Shigella flexneri 2a str. 301
accgauuuucagccaucauc

SEQ ID NO: 1985438 - RNA, 15 nt, Shigella flexneri 2a str. 301
accgauuucacccac

SEQ ID NO: 1985439 - RNA, 12 nt, Shigella flexneri 2a str. 301
accgauuucacg

SEQ ID NO: 1985440 - RNA, 20 nt, Shigella flexneri 2a str. 301
accgcaauaaccaucagcug

SEQ ID NO: 1985441 - RNA, 18 nt, Shigella flexneri 2a str. 301
accgcaauaaccaucagc

SEQ ID NO: 1985442 - RNA, 15 nt, Shigella flexneri 2a str. 301
accgcagcauugcuc

SEQ ID NO: 1985443 - RNA, 20 nt, Shigella flexneri 2a str. 301
accgcagaagcgauaaccuu

SEQ ID NO: 1985444 - RNA, 21 nt, Shigella flexneri 2a str. 301
accgauccccggauucaugcu

SEQ ID NO: 1985445 - RNA, 17 nt, Shigella flexneri 2a str. 301
accgauccaguggcugu

SEQ ID NO: 1985446 - RNA, 20 nt, Shigella flexneri 2a str. 301
accgauuguaaucacauucg

SEQ ID NO: 1985447 - RNA, 14 nt, Shigella flexneri 2a str. 301
accgauauccgcca

SEQ ID NO: 1985448 - RNA, 14 nt, Shigella flexneri 2a str. 301
accgaccagaaugu

SEQ ID NO: 1985449 - RNA, 21 nt, Shigella flexneri 2a str. 301
accgacuggcuccgggaaaac

SEQ ID NO: 1985450 - RNA, 21 nt, Shigella flexneri 2a str. 301
accgacuccgacgcagugggu

SEQ ID NO: 1985451 - RNA, 17 nt, Shigella flexneri 2a str. 301
accgagauaaugguuuc

SEQ ID NO: 1985452 - RNA, 23 nt, Shigella flexneri 2a str. 301
accgaggccaaaaccacagugac

SEQ ID NO: 1985453 - RNA, 19 nt, Shigella flexneri 2a str. 301
accgagcagccacugcggc

SEQ ID NO: 1985454 - RNA, 18 nt, Shigella flexneri 2a str. 301
accgaacggagucggguc

SEQ ID NO: 1985455 - RNA, 15 nt, Shigella flexneri 2a str. 301
accgacaauccggua

SEQ ID NO: 1985456 - RNA, 22 nt, Shigella flexneri 2a str. 301
accgacaauccgguagguucaa

SEQ ID NO: 1985457 - RNA, 16 nt, Shigella flexneri 2a str. 301
accgaauucaaauccu

SEQ ID NO: 1985458 - RNA, 23 nt, Shigella flexneri 2a str. 301
acccuuucguuaaauucuucuga

SEQ ID NO: 1985459 - RNA, 16 nt, Shigella flexneri 2a str. 301
accgaacaacaagaag

SEQ ID NO: 1985460 - RNA, 13 nt, Shigella flexneri 2a str. 301
accgaacagauca

SEQ ID NO: 1985461 - RNA, 13 nt, Shigella flexneri 2a str. 301
acccuauccccaa

SEQ ID NO: 1985462 - RNA, 17 nt, Shigella flexneri 2a str. 301
acccucauucaccaguu

SEQ ID NO: 1985463 - RNA, 13 nt, Shigella flexneri 2a str. 301
acccucacgcauu

SEQ ID NO: 1985464 - RNA, 13 nt, Shigella flexneri 2a str. 301
acccuaaagcacc

SEQ ID NO: 1985465 - RNA, 17 nt, Shigella flexneri 2a str. 301
acccuaacccucucccc

SEQ ID NO: 1985466 - RNA, 19 nt, Shigella flexneri 2a str. 301
acccgugcuguuaauaucu

SEQ ID NO: 1985467 - RNA, 23 nt, Shigella flexneri 2a str. 301
acccguuaagcguucauccaaca

SEQ ID NO: 1985468 - RNA, 13 nt, Shigella flexneri 2a str. 301
acccuuacucacu

SEQ ID NO: 1985469 - RNA, 14 nt, Shigella flexneri 2a str. 301
acccuuccagcacg

SEQ ID NO: 1985470 - RNA, 21 nt, Shigella flexneri 2a str. 301
acccuuccuuagcaaaauagc

SEQ ID NO: 1985471 - RNA, 16 nt, Shigella flexneri 2a str. 301
acccugcucgcuggaa

SEQ ID NO: 1985472 - RNA, 21 nt, Shigella flexneri 2a str. 301
acccuguccgccauggcuucu

SEQ ID NO: 1985473 - RNA, 21 nt, Shigella flexneri 2a str. 301
acccuugaucaccguaaugau

SEQ ID NO: 1985474 - RNA, 16 nt, Shigella flexneri 2a str. 301
acccuugcguuucuga

SEQ ID NO: 1985475 - RNA, 17 nt, Shigella flexneri 2a str. 301
acccuucgucaaucagc

SEQ ID NO: 1985476 - RNA, 14 nt, Shigella flexneri 2a str. 301
acccugaucaauca

SEQ ID NO: 1985477 - RNA, 12 nt, Shigella flexneri 2a str. 301
acccugcggcug

SEQ ID NO: 1985478 - RNA, 15 nt, Shigella flexneri 2a str. 301
acccugcggcugcug

SEQ ID NO: 1985479 - RNA, 13 nt, Shigella flexneri 2a str. 301
acccugacccaga

SEQ ID NO: 1985480 - RNA, 15 nt, Shigella flexneri 2a str. 301
acccugaaucaauca

SEQ ID NO: 1985481 - RNA, 13 nt, Shigella flexneri 2a str. 301
acccucucccgaa

SEQ ID NO: 1985482 - RNA, 18 nt, Shigella flexneri 2a str. 301
acccugaacgccgggcuu

SEQ ID NO: 1985483 - RNA, 14 nt, Shigella flexneri 2a str. 301
acccucuccccaag

SEQ ID NO: 1985484 - RNA, 13 nt, Shigella flexneri 2a str. 301
acgggcauggugu

SEQ ID NO: 1985485 - RNA, 16 nt, Shigella flexneri 2a str. 301
acgggcaccaguaacg

SEQ ID NO: 1985486 - RNA, 22 nt, Shigella flexneri 2a str. 301
acgggcaauuucacguucaccc

SEQ ID NO: 1985487 - RNA, 14 nt, Shigella flexneri 2a str. 301
acgggcaaucuccu

SEQ ID NO: 1985488 - RNA, 17 nt, Shigella flexneri 2a str. 301
acgggcaagccagcaua

SEQ ID NO: 1985489 - RNA, 20 nt, Shigella flexneri 2a str. 301
acgggagaaacccggccaca

SEQ ID NO: 1985490 - RNA, 18 nt, Shigella flexneri 2a str. 301
acgggaaacucugcuggc

SEQ ID NO: 1985491 - RNA, 15 nt, Shigella flexneri 2a str. 301
acguagcuauauuuu

SEQ ID NO: 1985492 - RNA, 12 nt, Shigella flexneri 2a str. 301
acguagaaacca

SEQ ID NO: 1985493 - RNA, 16 nt, Shigella flexneri 2a str. 301
acguauugagaucacc

SEQ ID NO: 1985494 - RNA, 14 nt, Shigella flexneri 2a str. 301
acguauuauauaua

SEQ ID NO: 1985495 - RNA, 19 nt, Shigella flexneri 2a str. 301
acgucaaauaauuccugcg

SEQ ID NO: 1985496 - RNA, 15 nt, Shigella flexneri 2a str. 301
acguauuaaauucca

SEQ ID NO: 1985497 - RNA, 13 nt, Shigella flexneri 2a str. 301
acguaucaauuag

SEQ ID NO: 1985498 - RNA, 12 nt, Shigella flexneri 2a str. 301
acgucaccaucc

SEQ ID NO: 1985499 - RNA, 22 nt, Shigella flexneri 2a str. 301
acgucacaggccaucacauccu

SEQ ID NO: 1985500 - RNA, 16 nt, Shigella flexneri 2a str. 301
acgucacucuuuauga

SEQ ID NO: 1985501 - RNA, 18 nt, Shigella flexneri 2a str. 301
acgucacuggugugucau

SEQ ID NO: 1985502 - RNA, 17 nt, Shigella flexneri 2a str. 301
acgucaguaagaaacag

SEQ ID NO: 1985503 - RNA, 16 nt, Shigella flexneri 2a str. 301
acgucauuaccgcgaa

SEQ ID NO: 1985504 - RNA, 22 nt, Shigella flexneri 2a str. 301
acguccagccaggaaucagaua

SEQ ID NO: 1985505 - RNA, 14 nt, Shigella flexneri 2a str. 301
acgugacauucuga

SEQ ID NO: 1985506 - RNA, 16 nt, Shigella flexneri 2a str. 301
acgugaagaugccaac

SEQ ID NO: 1985507 - RNA, 13 nt, Shigella flexneri 2a str. 301
acgugacagcaua

SEQ ID NO: 1985508 - RNA, 18 nt, Shigella flexneri 2a str. 301
acgugaacggcuucgccu

SEQ ID NO: 1985509 - RNA, 18 nt, Shigella flexneri 2a str. 301
acgugaucgaacaucugc

SEQ ID NO: 1985510 - RNA, 16 nt, Shigella flexneri 2a str. 301
acgugagcuuuucugc

SEQ ID NO: 1985511 - RNA, 14 nt, Shigella flexneri 2a str. 301
acgugagagauaau

SEQ ID NO: 1985512 - RNA, 14 nt, Shigella flexneri 2a str. 301
acgugcacaggcaa

SEQ ID NO: 1985513 - RNA, 18 nt, Shigella flexneri 2a str. 301
acguguaggccugauaag

SEQ ID NO: 1985514 - RNA, 20 nt, Shigella flexneri 2a str. 301
acguguaggccugauaagcg

SEQ ID NO: 1985515 - RNA, 15 nt, Shigella flexneri 2a str. 301
acguguaaguacagu

SEQ ID NO: 1985516 - RNA, 19 nt, Shigella flexneri 2a str. 301
acguggucgaauccccuca

SEQ ID NO: 1985517 - RNA, 12 nt, Shigella flexneri 2a str. 301
acguuccagcaa

SEQ ID NO: 1985518 - RNA, 12 nt, Shigella flexneri 2a str. 301
acguucaguucc

SEQ ID NO: 1985519 - RNA, 15 nt, Shigella flexneri 2a str. 301
acguuacccagcacg

SEQ ID NO: 1985520 - RNA, 16 nt, Shigella flexneri 2a str. 301
acguucacgcagcuca

SEQ ID NO: 1985521 - RNA, 22 nt, Shigella flexneri 2a str. 301
acguuaacuuucguguguuuuc

SEQ ID NO: 1985522 - RNA, 20 nt, Shigella flexneri 2a str. 301
acguuaacuacaaucacgau

SEQ ID NO: 1985523 - RNA, 16 nt, Shigella flexneri 2a str. 301
acguuaaagaaagugg

SEQ ID NO: 1985524 - RNA, 23 nt, Shigella flexneri 2a str. 301
acuacucuauacaggauaauuag

SEQ ID NO: 1985525 - RNA, 14 nt, Shigella flexneri 2a str. 301
acuacguucaauca

SEQ ID NO: 1985526 - RNA, 19 nt, Shigella flexneri 2a str. 301
acuaaucugacaacaccaa

SEQ ID NO: 1985527 - RNA, 23 nt, Shigella flexneri 2a str. 301
acuaucgaaaguuuaccagccaa

SEQ ID NO: 1985528 - RNA, 15 nt, Shigella flexneri 2a str. 301
acuagcucaauaaaa

SEQ ID NO: 1985529 - RNA, 20 nt, Shigella flexneri 2a str. 301
acuagcucaauaaaagaaau

SEQ ID NO: 1985530 - RNA, 19 nt, Shigella flexneri 2a str. 301
acuagccugcucccuuauc

SEQ ID NO: 1985531 - RNA, 23 nt, Shigella flexneri 2a str. 301
acuaaucgacaguugcugcguga

SEQ ID NO: 1985532 - RNA, 16 nt, Shigella flexneri 2a str. 301
acuaacgcgucuuauc

SEQ ID NO: 1985533 - RNA, 23 nt, Shigella flexneri 2a str. 301
acuaacuucugaucuacagccuu

SEQ ID NO: 1985534 - RNA, 14 nt, Shigella flexneri 2a str. 301
acuaagauaaucca

SEQ ID NO: 1985535 - RNA, 19 nt, Shigella flexneri 2a str. 301
acuaacacuucaucacuac

SEQ ID NO: 1985536 - RNA, 13 nt, Shigella flexneri 2a str. 301
acuaaaugugcaa

SEQ ID NO: 1985537 - RNA, 15 nt, Shigella flexneri 2a str. 301
acuaaaugcugcagc

SEQ ID NO: 1985538 - RNA, 18 nt, Shigella flexneri 2a str. 301
acguugcucaaggguuuc

SEQ ID NO: 1985539 - RNA, 18 nt, Shigella flexneri 2a str. 301
acguugcguugcagcagg

SEQ ID NO: 1985540 - RNA, 22 nt, Shigella flexneri 2a str. 301
acguugccguaugcgccacagg

SEQ ID NO: 1985541 - RNA, 19 nt, Shigella flexneri 2a str. 301
acguucugaucuuucuuca

SEQ ID NO: 1985542 - RNA, 20 nt, Shigella flexneri 2a str. 301
acguucugaucuuucuucag

SEQ ID NO: 1985543 - RNA, 18 nt, Shigella flexneri 2a str. 301
acguucugaucuuucuuc

SEQ ID NO: 1985544 - RNA, 15 nt, Shigella flexneri 2a str. 301
acguucuccugaagu

SEQ ID NO: 1985545 - RNA, 22 nt, Shigella flexneri 2a str. 301
acguucggugauauacgucacu

SEQ ID NO: 1985546 - RNA, 12 nt, Shigella flexneri 2a str. 301
acguuccuuucu

SEQ ID NO: 1985547 - RNA, 14 nt, Shigella flexneri 2a str. 301
acucauugcccgca

SEQ ID NO: 1985548 - RNA, 14 nt, Shigella flexneri 2a str. 301
acucauuuuuuaau

SEQ ID NO: 1985549 - RNA, 20 nt, Shigella flexneri 2a str. 301
acucaucuuauugaucaucc

SEQ ID NO: 1985550 - RNA, 19 nt, Shigella flexneri 2a str. 301
acucaucaacguuuuuuug

SEQ ID NO: 1985551 - RNA, 17 nt, Shigella flexneri 2a str. 301
acucaucacuguaggcc

SEQ ID NO: 1985552 - RNA, 18 nt, Shigella flexneri 2a str. 301
acucauaugcagcaucca

SEQ ID NO: 1985553 - RNA, 15 nt, Shigella flexneri 2a str. 301
acucauccacugccu

SEQ ID NO: 1985554 - RNA, 20 nt, Shigella flexneri 2a str. 301
acuccauccagcaacaacag

SEQ ID NO: 1985555 - RNA, 21 nt, Shigella flexneri 2a str. 301
acuccauccagcaacaacagc

SEQ ID NO: 1985556 - RNA, 12 nt, Shigella flexneri 2a str. 301
acuccagcgcca

SEQ ID NO: 1985557 - RNA, 20 nt, Shigella flexneri 2a str. 301
acuccagcuaucguuaucca

SEQ ID NO: 1985558 - RNA, 14 nt, Shigella flexneri 2a str. 301
acuccagccagagc

SEQ ID NO: 1985559 - RNA, 11 nt, Shigella flexneri 2a str. 301
acuccagcccu

SEQ ID NO: 1985560 - RNA, 15 nt, Shigella flexneri 2a str. 301
acuccacuuccugcc

SEQ ID NO: 1985561 - RNA, 12 nt, Shigella flexneri 2a str. 301
acuccagaauac

SEQ ID NO: 1985562 - RNA, 14 nt, Shigella flexneri 2a str. 301
acuccacuggcugc

SEQ ID NO: 1985563 - RNA, 15 nt, Shigella flexneri 2a str. 301
acuccaacuuacuga

SEQ ID NO: 1985564 - RNA, 14 nt, Shigella flexneri 2a str. 301
acuccaccagcacc

SEQ ID NO: 1985565 - RNA, 17 nt, Shigella flexneri 2a str. 301
acucaggccaaaugaca

SEQ ID NO: 1985566 - RNA, 22 nt, Shigella flexneri 2a str. 301
acucaggccaaaugacauccga

SEQ ID NO: 1985567 - RNA, 18 nt, Shigella flexneri 2a str. 301
acucaggcuggcaagcug

SEQ ID NO: 1985568 - RNA, 16 nt, Shigella flexneri 2a str. 301
acucauaaauacucca

SEQ ID NO: 1985569 - RNA, 15 nt, Shigella flexneri 2a str. 301
acucacgccagcagc

SEQ ID NO: 1985570 - RNA, 15 nt, Shigella flexneri 2a str. 301
acuaucuugccgaag

SEQ ID NO: 1985571 - RNA, 19 nt, Shigella flexneri 2a str. 301
acuaugacugccacaaggg

SEQ ID NO: 1985572 - RNA, 14 nt, Shigella flexneri 2a str. 301
acuaugaaaauaaa

SEQ ID NO: 1985573 - RNA, 21 nt, Shigella flexneri 2a str. 301
acucaccagacaucccagugc

SEQ ID NO: 1985574 - RNA, 12 nt, Shigella flexneri 2a str. 301
acucaccagaca

SEQ ID NO: 1985575 - RNA, 12 nt, Shigella flexneri 2a str. 301
acucacagggcu

SEQ ID NO: 1985576 - RNA, 16 nt, Shigella flexneri 2a str. 301
acucaccuuuuuuguu

SEQ ID NO: 1985577 - RNA, 16 nt, Shigella flexneri 2a str. 301
acucacgaaucgccuc

SEQ ID NO: 1985578 - RNA, 22 nt, Shigella flexneri 2a str. 301
acucaccugcuuuacccagcca

SEQ ID NO: 1985579 - RNA, 20 nt, Shigella flexneri 2a str. 301
acucaccgagcagcacaaug

SEQ ID NO: 1985580 - RNA, 17 nt, Shigella flexneri 2a str. 301
acucaccgagcagcaca

SEQ ID NO: 1985581 - RNA, 19 nt, Shigella flexneri 2a str. 301
acucaccggcguuucacau

SEQ ID NO: 1985582 - RNA, 18 nt, Shigella flexneri 2a str. 301
acucaccgggcaucucag

SEQ ID NO: 1985583 - RNA, 21 nt, Shigella flexneri 2a str. 301
acucgugcgucgcauccggca

SEQ ID NO: 1985584 - RNA, 16 nt, Shigella flexneri 2a str. 301
acucggggcuuuucuc

SEQ ID NO: 1985585 - RNA, 22 nt, Shigella flexneri 2a str. 301
acucgucacgucgucaggcaac

SEQ ID NO: 1985586 - RNA, 15 nt, Shigella flexneri 2a str. 301
acucguaagaggcgu

SEQ ID NO: 1985587 - RNA, 20 nt, Shigella flexneri 2a str. 301
acuccccgcauuuacucuca

SEQ ID NO: 1985588 - RNA, 16 nt, Shigella flexneri 2a str. 301
acuccccgcacaacgg

SEQ ID NO: 1985589 - RNA, 17 nt, Shigella flexneri 2a str. 301
acuccccgcaacaguga

SEQ ID NO: 1985590 - RNA, 14 nt, Shigella flexneri 2a str. 301
acucccccuuucug

SEQ ID NO: 1985591 - RNA, 16 nt, Shigella flexneri 2a str. 301
acucccugccccaucu

SEQ ID NO: 1985592 - RNA, 21 nt, Shigella flexneri 2a str. 301
acuccgagaaucauaaauaca

SEQ ID NO: 1985593 - RNA, 15 nt, Shigella flexneri 2a str. 301
acucgccagaccgca

SEQ ID NO: 1985594 - RNA, 18 nt, Shigella flexneri 2a str. 301
acucgccagaccgcagaa

SEQ ID NO: 1985595 - RNA, 20 nt, Shigella flexneri 2a str. 301
acucgccagaccgcagaagc

SEQ ID NO: 1985596 - RNA, 24 nt, Shigella flexneri 2a str. 301
acucgccccgagaaaaauagcauu

SEQ ID NO: 1985597 - RNA, 23 nt, Shigella flexneri 2a str. 301
acucgcacguucaguuuugggga

SEQ ID NO: 1985598 - RNA, 14 nt, Shigella flexneri 2a str. 301
acucgcagaagcag

SEQ ID NO: 1985599 - RNA, 22 nt, Shigella flexneri 2a str. 301
acuccgcauuuguaggcaggau

SEQ ID NO: 1985600 - RNA, 23 nt, Shigella flexneri 2a str. 301
acucuuucgacggcaucagaaac

SEQ ID NO: 1985601 - RNA, 12 nt, Shigella flexneri 2a str. 301
acucuuucccgg

SEQ ID NO: 1985602 - RNA, 17 nt, Shigella flexneri 2a str. 301
acucuuuauuucauuuu

SEQ ID NO: 1985603 - RNA, 15 nt, Shigella flexneri 2a str. 301
acucuccuguuuaau

SEQ ID NO: 1985604 - RNA, 20 nt, Shigella flexneri 2a str. 301
acugaaugacgacguaccag

SEQ ID NO: 1985605 - RNA, 15 nt, Shigella flexneri 2a str. 301
acugacaaacugcgc

SEQ ID NO: 1985606 - RNA, 18 nt, Shigella flexneri 2a str. 301
acugacauuacggauuaa

SEQ ID NO: 1985607 - RNA, 21 nt, Shigella flexneri 2a str. 301
acugacagggugagcagggca

SEQ ID NO: 1985608 - RNA, 19 nt, Shigella flexneri 2a str. 301
acugacacaggcagcaauc

SEQ ID NO: 1985609 - RNA, 20 nt, Shigella flexneri 2a str. 301
acugacauuacggauuaaau

SEQ ID NO: 1985610 - RNA, 16 nt, Shigella flexneri 2a str. 301
acugaacaaaaaagag

SEQ ID NO: 1985611 - RNA, 23 nt, Shigella flexneri 2a str. 301
acugaacaaaaaagaguaaaguu

SEQ ID NO: 1985612 - RNA, 18 nt, Shigella flexneri 2a str. 301
acugaauaugagucguaa

SEQ ID NO: 1985613 - RNA, 13 nt, Shigella flexneri 2a str. 301
acgccgaaucagu

SEQ ID NO: 1985614 - RNA, 17 nt, Shigella flexneri 2a str. 301
acgccgacgcccugcgc

SEQ ID NO: 1985615 - RNA, 19 nt, Shigella flexneri 2a str. 301
acgccgacgggucagcggg

SEQ ID NO: 1985616 - RNA, 19 nt, Shigella flexneri 2a str. 301
acgccgaauaacgcgcagc

SEQ ID NO: 1985617 - RNA, 15 nt, Shigella flexneri 2a str. 301
acgccgaaaccgcgc

SEQ ID NO: 1985618 - RNA, 18 nt, Shigella flexneri 2a str. 301
acgccgcauccggcauaa

SEQ ID NO: 1985619 - RNA, 19 nt, Shigella flexneri 2a str. 301
acgccgauaaucaacgcgc

SEQ ID NO: 1985620 - RNA, 21 nt, Shigella flexneri 2a str. 301
acgccgcaucuggcauaaaca

SEQ ID NO: 1985621 - RNA, 20 nt, Shigella flexneri 2a str. 301
acgccgcccagagaacuggc

SEQ ID NO: 1985622 - RNA, 14 nt, Shigella flexneri 2a str. 301
acgccgccgagcac

SEQ ID NO: 1985623 - RNA, 20 nt, Shigella flexneri 2a str. 301
acgccgccguuagcuucagc

SEQ ID NO: 1985624 - RNA, 17 nt, Shigella flexneri 2a str. 301
acgccccacagacccag

SEQ ID NO: 1985625 - RNA, 14 nt, Shigella flexneri 2a str. 301
acgccccaacacaa

SEQ ID NO: 1985626 - RNA, 16 nt, Shigella flexneri 2a str. 301
acgcccaucauucagu

SEQ ID NO: 1985627 - RNA, 15 nt, Shigella flexneri 2a str. 301
acgccccagauugcc

SEQ ID NO: 1985628 - RNA, 16 nt, Shigella flexneri 2a str. 301
acgcccagcgcuuacc

SEQ ID NO: 1985629 - RNA, 12 nt, Shigella flexneri 2a str. 301
acgcccagcgca

SEQ ID NO: 1985630 - RNA, 21 nt, Shigella flexneri 2a str. 301
acgcccauaaauacgucuuua

SEQ ID NO: 1985631 - RNA, 16 nt, Shigella flexneri 2a str. 301
acgcccaaugcccaga

SEQ ID NO: 1985632 - RNA, 13 nt, Shigella flexneri 2a str. 301
acgcccuggaaga

SEQ ID NO: 1985633 - RNA, 22 nt, Shigella flexneri 2a str. 301
acgcccuggaagaaaaacuggc

SEQ ID NO: 1985634 - RNA, 21 nt, Shigella flexneri 2a str. 301
acgccguuuuuacccagcagc

SEQ ID NO: 1985635 - RNA, 20 nt, Shigella flexneri 2a str. 301
acgccguuauuaaaaagccu

SEQ ID NO: 1985636 - RNA, 23 nt, Shigella flexneri 2a str. 301
acgccguggaauaauuccgggcg

SEQ ID NO: 1985637 - RNA, 23 nt, Shigella flexneri 2a str. 301
acgccggugaccaucagcaugac

SEQ ID NO: 1985638 - RNA, 22 nt, Shigella flexneri 2a str. 301
acgccggugaccaucagcauga

SEQ ID NO: 1985639 - RNA, 18 nt, Shigella flexneri 2a str. 301
acgccgggaaauuuuucc

SEQ ID NO: 1985640 - RNA, 19 nt, Shigella flexneri 2a str. 301
acgccgcuuuuuuuacguc

SEQ ID NO: 1985641 - RNA, 15 nt, Shigella flexneri 2a str. 301
acgccggauuaugug

SEQ ID NO: 1985642 - RNA, 23 nt, Shigella flexneri 2a str. 301
acgccgcugucuaccagcaccug

SEQ ID NO: 1985643 - RNA, 21 nt, Shigella flexneri 2a str. 301
acgccgcugucuaccagcacc

SEQ ID NO: 1985644 - RNA, 14 nt, Shigella flexneri 2a str. 301
acgccucuauuaaa

SEQ ID NO: 1985645 - RNA, 17 nt, Shigella flexneri 2a str. 301
acgccugauagcccgca

SEQ ID NO: 1985646 - RNA, 20 nt, Shigella flexneri 2a str. 301
acgccugggcgagguggaua

SEQ ID NO: 1985647 - RNA, 15 nt, Shigella flexneri 2a str. 301
acgccuggaaagugu

SEQ ID NO: 1985648 - RNA, 15 nt, Shigella flexneri 2a str. 301
acgccugccagcucu

SEQ ID NO: 1985649 - RNA, 21 nt, Shigella flexneri 2a str. 301
acgccugcgggcauuucgcuu

SEQ ID NO: 1985650 - RNA, 13 nt, Shigella flexneri 2a str. 301
acgcgaacaacag

SEQ ID NO: 1985651 - RNA, 22 nt, Shigella flexneri 2a str. 301
acgccuuguuccugcuuggcgc

SEQ ID NO: 1985652 - RNA, 17 nt, Shigella flexneri 2a str. 301
acgccuuccgucagcaa

SEQ ID NO: 1985653 - RNA, 19 nt, Shigella flexneri 2a str. 301
acgccuugcggaaauucca

SEQ ID NO: 1985654 - RNA, 22 nt, Shigella flexneri 2a str. 301
acgccuuaguuauaaacuuuuc

SEQ ID NO: 1985655 - RNA, 19 nt, Shigella flexneri 2a str. 301
acgccuuauccgaccuaca

SEQ ID NO: 1985656 - RNA, 15 nt, Shigella flexneri 2a str. 301
acgccuuauccgacu

SEQ ID NO: 1985657 - RNA, 16 nt, Shigella flexneri 2a str. 301
accggauaaucggcaa

SEQ ID NO: 1985658 - RNA, 12 nt, Shigella flexneri 2a str. 301
acgcaccaugca

SEQ ID NO: 1985659 - RNA, 20 nt, Shigella flexneri 2a str. 301
acgcacagcccgccgccauc

SEQ ID NO: 1985660 - RNA, 22 nt, Shigella flexneri 2a str. 301
acgcacacaugcgauaaagcau

SEQ ID NO: 1985661 - RNA, 22 nt, Shigella flexneri 2a str. 301
acgcacuguuggcgaaaauccu

SEQ ID NO: 1985662 - RNA, 23 nt, Shigella flexneri 2a str. 301
acgcagacacugcugauaaucca

SEQ ID NO: 1985663 - RNA, 16 nt, Shigella flexneri 2a str. 301
acgcagaaucucugcg

SEQ ID NO: 1985664 - RNA, 21 nt, Shigella flexneri 2a str. 301
acgcagaccaaagucaaacug

SEQ ID NO: 1985665 - RNA, 19 nt, Shigella flexneri 2a str. 301
acgcaccgcguauugcucu

SEQ ID NO: 1985666 - RNA, 17 nt, Shigella flexneri 2a str. 301
acgcaccgccaccaccg

SEQ ID NO: 1985667 - RNA, 17 nt, Shigella flexneri 2a str. 301
acgcacgcgggugccug

SEQ ID NO: 1985668 - RNA, 14 nt, Shigella flexneri 2a str. 301
acgcacgcugucac

SEQ ID NO: 1985669 - RNA, 16 nt, Shigella flexneri 2a str. 301
acgcagagacaucacc

SEQ ID NO: 1985670 - RNA, 18 nt, Shigella flexneri 2a str. 301
acgcagagacaucaccaa

SEQ ID NO: 1985671 - RNA, 17 nt, Shigella flexneri 2a str. 301
acgcagcaucaucauaa

SEQ ID NO: 1985672 - RNA, 21 nt, Shigella flexneri 2a str. 301
acgcagcauuggguaaaaugg

SEQ ID NO: 1985673 - RNA, 15 nt, Shigella flexneri 2a str. 301
acgcagcucacuucg

SEQ ID NO: 1985674 - RNA, 16 nt, Shigella flexneri 2a str. 301
acgcaggcgagaauca

SEQ ID NO: 1985675 - RNA, 16 nt, Shigella flexneri 2a str. 301
acgcauaccagucuau

SEQ ID NO: 1985676 - RNA, 21 nt, Shigella flexneri 2a str. 301
acgcauacucuuugacaacau

SEQ ID NO: 1985677 - RNA, 22 nt, Shigella flexneri 2a str. 301
acgcauacucuuugacaacauc

SEQ ID NO: 1985678 - RNA, 23 nt, Shigella flexneri 2a str. 301
acgcaguuaacgcggauccccug

SEQ ID NO: 1985679 - RNA, 14 nt, Shigella flexneri 2a str. 301
acgcaguuccgcca

SEQ ID NO: 1985680 - RNA, 22 nt, Shigella flexneri 2a str. 301
acgcaguggguaaugcugugaa

SEQ ID NO: 1985681 - RNA, 13 nt, Shigella flexneri 2a str. 301
acgcauaaaacca

SEQ ID NO: 1985682 - RNA, 15 nt, Shigella flexneri 2a str. 301
acgcauaacagcccg

SEQ ID NO: 1985683 - RNA, 16 nt, Shigella flexneri 2a str. 301
acgcaucgccaaacag

SEQ ID NO: 1985684 - RNA, 15 nt, Shigella flexneri 2a str. 301
acgcaucgcccgguu

SEQ ID NO: 1985685 - RNA, 13 nt, Shigella flexneri 2a str. 301
acgcaucgccggg

SEQ ID NO: 1985686 - RNA, 21 nt, Shigella flexneri 2a str. 301
acgcauucucuuuucacgcaa

SEQ ID NO: 1985687 - RNA, 15 nt, Shigella flexneri 2a str. 301
acgccaaccagcuga

SEQ ID NO: 1985688 - RNA, 15 nt, Shigella flexneri 2a str. 301
acgccaaauucuuua

SEQ ID NO: 1985689 - RNA, 20 nt, Shigella flexneri 2a str. 301
acgccaauaccgcccagacc

SEQ ID NO: 1985690 - RNA, 16 nt, Shigella flexneri 2a str. 301
acgccaagaaagagcg

SEQ ID NO: 1985691 - RNA, 21 nt, Shigella flexneri 2a str. 301
acgccaaucugcaaaauacca

SEQ ID NO: 1985692 - RNA, 14 nt, Shigella flexneri 2a str. 301
acgccacagcaauu

SEQ ID NO: 1985693 - RNA, 17 nt, Shigella flexneri 2a str. 301
acgccaccccacaccag

SEQ ID NO: 1985694 - RNA, 20 nt, Shigella flexneri 2a str. 301
acgccacccgaaggaggcgu

SEQ ID NO: 1985695 - RNA, 15 nt, Shigella flexneri 2a str. 301
acgccaccccacacc

SEQ ID NO: 1985696 - RNA, 15 nt, Shigella flexneri 2a str. 301
acgccaggccacgcu

SEQ ID NO: 1985697 - RNA, 19 nt, Shigella flexneri 2a str. 301
acgccagcgcuuuuggcgc

SEQ ID NO: 1985698 - RNA, 20 nt, Shigella flexneri 2a str. 301
acgccaccuuucucggcauc

SEQ ID NO: 1985699 - RNA, 23 nt, Shigella flexneri 2a str. 301
acgccagaaacgcguugucuuuc

SEQ ID NO: 1985700 - RNA, 17 nt, Shigella flexneri 2a str. 301
acgccagaacagcuaca

SEQ ID NO: 1985701 - RNA, 16 nt, Shigella flexneri 2a str. 301
acgccaucgccaggaa

SEQ ID NO: 1985702 - RNA, 13 nt, Shigella flexneri 2a str. 301
acgccagguuguu

SEQ ID NO: 1985703 - RNA, 18 nt, Shigella flexneri 2a str. 301
acgccaucucccggcaua

SEQ ID NO: 1985704 - RNA, 18 nt, Shigella flexneri 2a str. 301
acgcuaccaaaaaaucaa

SEQ ID NO: 1985705 - RNA, 14 nt, Shigella flexneri 2a str. 301
acgcucaacguuua

SEQ ID NO: 1985706 - RNA, 12 nt, Shigella flexneri 2a str. 301
acgcucacugca

SEQ ID NO: 1985707 - RNA, 20 nt, Shigella flexneri 2a str. 301
acgcgucuugagagugcgaa

SEQ ID NO: 1985708 - RNA, 16 nt, Shigella flexneri 2a str. 301
acgcgucugaccgucu

SEQ ID NO: 1985709 - RNA, 16 nt, Shigella flexneri 2a str. 301
acgcguagagaaucca

SEQ ID NO: 1985710 - RNA, 15 nt, Shigella flexneri 2a str. 301
acgcguucacugccg

SEQ ID NO: 1985711 - RNA, 17 nt, Shigella flexneri 2a str. 301
acgcguuaauaccugau

SEQ ID NO: 1985712 - RNA, 19 nt, Shigella flexneri 2a str. 301
acgcguugcgcaugaccuu

SEQ ID NO: 1985713 - RNA, 21 nt, Shigella flexneri 2a str. 301
acgcucgcgcaguuugccaug

SEQ ID NO: 1985714 - RNA, 16 nt, Shigella flexneri 2a str. 301
acgcucgaacagcugg

SEQ ID NO: 1985715 - RNA, 17 nt, Shigella flexneri 2a str. 301
acgcucgaacagcuggu

SEQ ID NO: 1985716 - RNA, 19 nt, Shigella flexneri 2a str. 301
acgcuccgcaccugaguaa

SEQ ID NO: 1985717 - RNA, 16 nt, Shigella flexneri 2a str. 301
acgcucccagcagaga

SEQ ID NO: 1985718 - RNA, 20 nt, Shigella flexneri 2a str. 301
acgcuccaguguggccagag

SEQ ID NO: 1985719 - RNA, 23 nt, Shigella flexneri 2a str. 301
acgcucaggcuacuuuuccaggu

SEQ ID NO: 1985720 - RNA, 21 nt, Shigella flexneri 2a str. 301
acgcucaggcgaugaaacaaa

SEQ ID NO: 1985721 - RNA, 19 nt, Shigella flexneri 2a str. 301
acgcugaauacgcaccgcu

SEQ ID NO: 1985722 - RNA, 16 nt, Shigella flexneri 2a str. 301
acgcucuuccagggua

SEQ ID NO: 1985723 - RNA, 18 nt, Shigella flexneri 2a str. 301
acgcucuuccaggguaaa

SEQ ID NO: 1985724 - RNA, 17 nt, Shigella flexneri 2a str. 301
acgcucuguucugcgcu

SEQ ID NO: 1985725 - RNA, 22 nt, Shigella flexneri 2a str. 301
acgcucuguucugcgcuugguu

SEQ ID NO: 1985726 - RNA, 16 nt, Shigella flexneri 2a str. 301
acgcgguuaucccaaa

SEQ ID NO: 1985727 - RNA, 20 nt, Shigella flexneri 2a str. 301
acgcggcauuuuuacugcgc

SEQ ID NO: 1985728 - RNA, 15 nt, Shigella flexneri 2a str. 301
acgcgggcagcagaa

SEQ ID NO: 1985729 - RNA, 20 nt, Shigella flexneri 2a str. 301
acgcgggccauccaccagug

SEQ ID NO: 1985730 - RNA, 18 nt, Shigella flexneri 2a str. 301
acgcggcaacggcuucgc

SEQ ID NO: 1985731 - RNA, 15 nt, Shigella flexneri 2a str. 301
acgcgcuccaggagu

SEQ ID NO: 1985732 - RNA, 14 nt, Shigella flexneri 2a str. 301
acgcgccuuaaaaa

SEQ ID NO: 1985733 - RNA, 21 nt, Shigella flexneri 2a str. 301
acgcgccagagagaacugcgc

SEQ ID NO: 1985734 - RNA, 16 nt, Shigella flexneri 2a str. 301
acgcgccagcaccgca

SEQ ID NO: 1985735 - RNA, 17 nt, Shigella flexneri 2a str. 301
acgcgccacgcacgccu

SEQ ID NO: 1985736 - RNA, 13 nt, Shigella flexneri 2a str. 301
acgcgccagcacc

SEQ ID NO: 1985737 - RNA, 22 nt, Shigella flexneri 2a str. 301
acgcgcccguagucggugccau

SEQ ID NO: 1985738 - RNA, 23 nt, Shigella flexneri 2a str. 301
acgcgauaaaagacgccgacauc

SEQ ID NO: 1985739 - RNA, 18 nt, Shigella flexneri 2a str. 301
acgcugcaucgccaaucu

SEQ ID NO: 1985740 - RNA, 14 nt, Shigella flexneri 2a str. 301
acgcugccagccau

SEQ ID NO: 1985741 - RNA, 19 nt, Shigella flexneri 2a str. 301
acgcugaugucagcacuuc

SEQ ID NO: 1985742 - RNA, 23 nt, Shigella flexneri 2a str. 301
acgcugcaaggcucuauacgcau

SEQ ID NO: 1985743 - RNA, 13 nt, Shigella flexneri 2a str. 301
acgcugauugcau

SEQ ID NO: 1985744 - RNA, 19 nt, Shigella flexneri 2a str. 301
acgcugauuuuuuuucaac

SEQ ID NO: 1985745 - RNA, 18 nt, Shigella flexneri 2a str. 301
acggcacucgcuggcacu

SEQ ID NO: 1985746 - RNA, 17 nt, Shigella flexneri 2a str. 301
acggcacggaaagcagc

SEQ ID NO: 1985747 - RNA, 18 nt, Shigella flexneri 2a str. 301
acggcacggaaagcagca

SEQ ID NO: 1985748 - RNA, 21 nt, Shigella flexneri 2a str. 301
acggcagagaaaccacaucaa

SEQ ID NO: 1985749 - RNA, 15 nt, Shigella flexneri 2a str. 301
acggauagcagaaaa

SEQ ID NO: 1985750 - RNA, 22 nt, Shigella flexneri 2a str. 301
acggacucggcgucgguaaaga

SEQ ID NO: 1985751 - RNA, 14 nt, Shigella flexneri 2a str. 301
acggacuuccagcg

SEQ ID NO: 1985752 - RNA, 23 nt, Shigella flexneri 2a str. 301
acggacguccggugauaucggcc

SEQ ID NO: 1985753 - RNA, 15 nt, Shigella flexneri 2a str. 301
acggagcaaaaaacc

SEQ ID NO: 1985754 - RNA, 23 nt, Shigella flexneri 2a str. 301
acggagaucgagcgcgagcaggc

SEQ ID NO: 1985755 - RNA, 21 nt, Shigella flexneri 2a str. 301
acggagcugccaggccgcauc

SEQ ID NO: 1985756 - RNA, 22 nt, Shigella flexneri 2a str. 301
acgcuuucacccggaucaauua

SEQ ID NO: 1985757 - RNA, 14 nt, Shigella flexneri 2a str. 301
acgcuuucucacca

SEQ ID NO: 1985758 - RNA, 12 nt, Shigella flexneri 2a str. 301
acgcuuucccug

SEQ ID NO: 1985759 - RNA, 17 nt, Shigella flexneri 2a str. 301
acgcuuugcaggcuggu

SEQ ID NO: 1985760 - RNA, 18 nt, Shigella flexneri 2a str. 301
acggcugauaugccagac

SEQ ID NO: 1985761 - RNA, 13 nt, Shigella flexneri 2a str. 301
acggcuaaaaaaa

SEQ ID NO: 1985762 - RNA, 20 nt, Shigella flexneri 2a str. 301
acggcguuaacuguacaggc

SEQ ID NO: 1985763 - RNA, 13 nt, Shigella flexneri 2a str. 301
acggcuucucggc

SEQ ID NO: 1985764 - RNA, 15 nt, Shigella flexneri 2a str. 301
acggcuuguggugaa

SEQ ID NO: 1985765 - RNA, 18 nt, Shigella flexneri 2a str. 301
acggcugucauccagcag

SEQ ID NO: 1985766 - RNA, 17 nt, Shigella flexneri 2a str. 301
acggcugggaaaucacc

SEQ ID NO: 1985767 - RNA, 15 nt, Shigella flexneri 2a str. 301
acggcgcauugccag

SEQ ID NO: 1985768 - RNA, 19 nt, Shigella flexneri 2a str. 301
acggcgcuaaaaagcgccg

SEQ ID NO: 1985769 - RNA, 16 nt, Shigella flexneri 2a str. 301
acggcgcgguuuccac

SEQ ID NO: 1985770 - RNA, 15 nt, Shigella flexneri 2a str. 301
acggcgcaccagaau

SEQ ID NO: 1985771 - RNA, 18 nt, Shigella flexneri 2a str. 301
acggcaugaaagcgaugc

SEQ ID NO: 1985772 - RNA, 18 nt, Shigella flexneri 2a str. 301
acggcaucccaacucauu

SEQ ID NO: 1985773 - RNA, 13 nt, Shigella flexneri 2a str. 301
acggcagugaacg

SEQ ID NO: 1985774 - RNA, 13 nt, Shigella flexneri 2a str. 301
acggcagugaaca

SEQ ID NO: 1985775 - RNA, 17 nt, Shigella flexneri 2a str. 301
agaauaagcgcagcugc

SEQ ID NO: 1985776 - RNA, 22 nt, Shigella flexneri 2a str. 301
agaauaacggcugauaacaaua

SEQ ID NO: 1985777 - RNA, 23 nt, Shigella flexneri 2a str. 301
agaaguucaggguuaaaucucag

SEQ ID NO: 1985778 - RNA, 13 nt, Shigella flexneri 2a str. 301
agaauaaaacagg

SEQ ID NO: 1985779 - RNA, 16 nt, Shigella flexneri 2a str. 301
agaauaaaacaggcag

SEQ ID NO: 1985780 - RNA, 23 nt, Shigella flexneri 2a str. 301
agaauaaaacaggcagcugccag

SEQ ID NO: 1985781 - RNA, 20 nt, Shigella flexneri 2a str. 301
agaauguuaacgccaauuaa

SEQ ID NO: 1985782 - RNA, 11 nt, Shigella flexneri 2a str. 301
agaaugcccca

SEQ ID NO: 1985783 - RNA, 22 nt, Shigella flexneri 2a str. 301
agaaugccgcaaaacuuccaug

SEQ ID NO: 1985784 - RNA, 18 nt, Shigella flexneri 2a str. 301
agaauccaggaaagccau

SEQ ID NO: 1985785 - RNA, 17 nt, Shigella flexneri 2a str. 301
agaaugacaucaucgcc

SEQ ID NO: 1985786 - RNA, 15 nt, Shigella flexneri 2a str. 301
agaauccaggaaagc

SEQ ID NO: 1985787 - RNA, 20 nt, Shigella flexneri 2a str. 301
agaaucaccucuuuuuccac

SEQ ID NO: 1985788 - RNA, 15 nt, Shigella flexneri 2a str. 301
agaauaucuucuguu

SEQ ID NO: 1985789 - RNA, 13 nt, Shigella flexneri 2a str. 301
agaaauuauuucu

SEQ ID NO: 1985790 - RNA, 15 nt, Shigella flexneri 2a str. 301
agaaauuauuucuuu

SEQ ID NO: 1985791 - RNA, 16 nt, Shigella flexneri 2a str. 301
agaaaugguaaagaag

SEQ ID NO: 1985792 - RNA, 17 nt, Shigella flexneri 2a str. 301
agaaauggcccaaaagg

SEQ ID NO: 1985793 - RNA, 21 nt, Shigella flexneri 2a str. 301
agaagaucguggagaacaaua

SEQ ID NO: 1985794 - RNA, 15 nt, Shigella flexneri 2a str. 301
agaagagagauaauu

SEQ ID NO: 1985795 - RNA, 18 nt, Shigella flexneri 2a str. 301
agaagagcggcaaacgua

SEQ ID NO: 1985796 - RNA, 21 nt, Shigella flexneri 2a str. 301
agaagagcucguacgaaagug

SEQ ID NO: 1985797 - RNA, 22 nt, Shigella flexneri 2a str. 301
agaagccauuaaacaccaguac

SEQ ID NO: 1985798 - RNA, 15 nt, Shigella flexneri 2a str. 301
agaagcccauacccg

SEQ ID NO: 1985799 - RNA, 23 nt, Shigella flexneri 2a str. 301
agaaggcauaacuccccgagaaa

SEQ ID NO: 1985800 - RNA, 14 nt, Shigella flexneri 2a str. 301
agaauuuuucacuc

SEQ ID NO: 1985801 - RNA, 12 nt, Shigella flexneri 2a str. 301
agacaaaguaac

SEQ ID NO: 1985802 - RNA, 14 nt, Shigella flexneri 2a str. 301
agacaaaugaacac

SEQ ID NO: 1985803 - RNA, 16 nt, Shigella flexneri 2a str. 301
agacaaaugucacugc

SEQ ID NO: 1985804 - RNA, 16 nt, Shigella flexneri 2a str. 301
agacaaauuuugaaca

SEQ ID NO: 1985805 - RNA, 19 nt, Shigella flexneri 2a str. 301
agacaaauuuugaacagaa

SEQ ID NO: 1985806 - RNA, 20 nt, Shigella flexneri 2a str. 301
agacaaauuuugaacagaac

SEQ ID NO: 1985807 - RNA, 23 nt, Shigella flexneri 2a str. 301
agacaaauuguuuaaucaacugc

SEQ ID NO: 1985808 - RNA, 16 nt, Shigella flexneri 2a str. 301
agaauuaaaauaucag

SEQ ID NO: 1985809 - RNA, 18 nt, Shigella flexneri 2a str. 301
agaauuaaaacagguacu

SEQ ID NO: 1985810 - RNA, 14 nt, Shigella flexneri 2a str. 301
agaauuaacgcuga

SEQ ID NO: 1985811 - RNA, 13 nt, Shigella flexneri 2a str. 301
agaauuaaucgag

SEQ ID NO: 1985812 - RNA, 13 nt, Shigella flexneri 2a str. 301
agacaccaaggaa

SEQ ID NO: 1985813 - RNA, 12 nt, Shigella flexneri 2a str. 301
agacaauguuug

SEQ ID NO: 1985814 - RNA, 18 nt, Shigella flexneri 2a str. 301
agacagcaaagugccccc

SEQ ID NO: 1985815 - RNA, 13 nt, Shigella flexneri 2a str. 301
agacaacccacac

SEQ ID NO: 1985816 - RNA, 17 nt, Shigella flexneri 2a str. 301
agacaucccagugcaau

SEQ ID NO: 1985817 - RNA, 14 nt, Shigella flexneri 2a str. 301
agacaucgcaggga

SEQ ID NO: 1985818 - RNA, 15 nt, Shigella flexneri 2a str. 301
agacagcgacucucu

SEQ ID NO: 1985819 - RNA, 15 nt, Shigella flexneri 2a str. 301
agacagccuaccaga

SEQ ID NO: 1985820 - RNA, 17 nt, Shigella flexneri 2a str. 301
agaccgauacacaucgu

SEQ ID NO: 1985821 - RNA, 14 nt, Shigella flexneri 2a str. 301
agaccgcuucugcg

SEQ ID NO: 1985822 - RNA, 16 nt, Shigella flexneri 2a str. 301
agaccgcgcuaucagc

SEQ ID NO: 1985823 - RNA, 18 nt, Shigella flexneri 2a str. 301
agaccuuucgaacccaac

SEQ ID NO: 1985824 - RNA, 15 nt, Shigella flexneri 2a str. 301
agaccuucugccaga

SEQ ID NO: 1985825 - RNA, 14 nt, Shigella flexneri 2a str. 301
agaccuuaauugcu

SEQ ID NO: 1985826 - RNA, 22 nt, Shigella flexneri 2a str. 301
agaccuuaucacaaucggcuuu

SEQ ID NO: 1985827 - RNA, 21 nt, Shigella flexneri 2a str. 301
agacgccacaaucucacccgc

SEQ ID NO: 1985828 - RNA, 21 nt, Shigella flexneri 2a str. 301
agacccugcucuuucagcacc

SEQ ID NO: 1985829 - RNA, 13 nt, Shigella flexneri 2a str. 301
agacccgccaccc

SEQ ID NO: 1985830 - RNA, 23 nt, Shigella flexneri 2a str. 301
agacccaguuucggcaucagcag

SEQ ID NO: 1985831 - RNA, 15 nt, Shigella flexneri 2a str. 301
agaccccagguuuuc

SEQ ID NO: 1985832 - RNA, 13 nt, Shigella flexneri 2a str. 301
agaccaauagaaa

SEQ ID NO: 1985833 - RNA, 22 nt, Shigella flexneri 2a str. 301
agacauuacguccaucacaauc

SEQ ID NO: 1985834 - RNA, 14 nt, Shigella flexneri 2a str. 301
agacaugguaaaac

SEQ ID NO: 1985835 - RNA, 17 nt, Shigella flexneri 2a str. 301
agacgcugcauugacaa

SEQ ID NO: 1985836 - RNA, 15 nt, Shigella flexneri 2a str. 301
agacgcucugcggua

SEQ ID NO: 1985837 - RNA, 17 nt, Shigella flexneri 2a str. 301
agacgcgcuagccucag

SEQ ID NO: 1985838 - RNA, 23 nt, Shigella flexneri 2a str. 301
agacgcgcuagcgucgcaucagg

SEQ ID NO: 1985839 - RNA, 14 nt, Shigella flexneri 2a str. 301
agacgcgaccggcg

SEQ ID NO: 1985840 - RNA, 19 nt, Shigella flexneri 2a str. 301
agacgcguuaauaccugau

SEQ ID NO: 1985841 - RNA, 19 nt, Shigella flexneri 2a str. 301
agacgcgucuggcaucacc

SEQ ID NO: 1985842 - RNA, 16 nt, Shigella flexneri 2a str. 301
agacgcgcagcuucac

SEQ ID NO: 1985843 - RNA, 17 nt, Shigella flexneri 2a str. 301
agacucauauaaaaacc

SEQ ID NO: 1985844 - RNA, 20 nt, Shigella flexneri 2a str. 301
agacucccagccucccauuu

SEQ ID NO: 1985845 - RNA, 17 nt, Shigella flexneri 2a str. 301
agacugcgcuaccagga

SEQ ID NO: 1985846 - RNA, 16 nt, Shigella flexneri 2a str. 301
agacuggagcacugcg

SEQ ID NO: 1985847 - RNA, 16 nt, Shigella flexneri 2a str. 301
agacuggauugccagc

SEQ ID NO: 1985848 - RNA, 21 nt, Shigella flexneri 2a str. 301
agacuggcaaagcaggccaga

SEQ ID NO: 1985849 - RNA, 19 nt, Shigella flexneri 2a str. 301
agacuggcaaaugacauaa

SEQ ID NO: 1985850 - RNA, 21 nt, Shigella flexneri 2a str. 301
agacuggcaaaugacauaaac

SEQ ID NO: 1985851 - RNA, 15 nt, Shigella flexneri 2a str. 301
agacugcuccuguau

SEQ ID NO: 1985852 - RNA, 15 nt, Shigella flexneri 2a str. 301
agacugcgcuaccag

SEQ ID NO: 1985853 - RNA, 13 nt, Shigella flexneri 2a str. 301
agacugcgcgccg

SEQ ID NO: 1985854 - RNA, 23 nt, Shigella flexneri 2a str. 301
agacugcagcggucacauguucc

SEQ ID NO: 1985855 - RNA, 13 nt, Shigella flexneri 2a str. 301
agacugggcaaga

SEQ ID NO: 1985856 - RNA, 16 nt, Shigella flexneri 2a str. 301
agacugaugacuaaag

SEQ ID NO: 1985857 - RNA, 14 nt, Shigella flexneri 2a str. 301
agacugcaagaaua

SEQ ID NO: 1985858 - RNA, 15 nt, Shigella flexneri 2a str. 301
agacugaucaucgcc

SEQ ID NO: 1985859 - RNA, 14 nt, Shigella flexneri 2a str. 301
agacugaugacaaa

SEQ ID NO: 1985860 - RNA, 16 nt, Shigella flexneri 2a str. 301
agacucucauuuuuca

SEQ ID NO: 1985861 - RNA, 21 nt, Shigella flexneri 2a str. 301
agacuucccucccguuucccu

SEQ ID NO: 1985862 - RNA, 21 nt, Shigella flexneri 2a str. 301
agagaaagaacgaguaaaagg

SEQ ID NO: 1985863 - RNA, 12 nt, Shigella flexneri 2a str. 301
agagaaaguaaa

SEQ ID NO: 1985864 - RNA, 16 nt, Shigella flexneri 2a str. 301
agagaaaccacaucaa

SEQ ID NO: 1985865 - RNA, 18 nt, Shigella flexneri 2a str. 301
agagaaacgccagcagca

SEQ ID NO: 1985866 - RNA, 14 nt, Shigella flexneri 2a str. 301
agagaaaaucacac

SEQ ID NO: 1985867 - RNA, 12 nt, Shigella flexneri 2a str. 301
agagaaaauaau

SEQ ID NO: 1985868 - RNA, 13 nt, Shigella flexneri 2a str. 301
agagaaaaccaau

SEQ ID NO: 1985869 - RNA, 18 nt, Shigella flexneri 2a str. 301
agagaauggggucagcag

SEQ ID NO: 1985870 - RNA, 21 nt, Shigella flexneri 2a str. 301
agagaauauuaacggucauuc

SEQ ID NO: 1985871 - RNA, 20 nt, Shigella flexneri 2a str. 301
agagaacuguagacaaaaug

SEQ ID NO: 1985872 - RNA, 20 nt, Shigella flexneri 2a str. 301
agagaacaucaauccaaaca

SEQ ID NO: 1985873 - RNA, 13 nt, Shigella flexneri 2a str. 301
agagaaccagcug

SEQ ID NO: 1985874 - RNA, 16 nt, Shigella flexneri 2a str. 301
agauaacccagcagcc

SEQ ID NO: 1985875 - RNA, 13 nt, Shigella flexneri 2a str. 301
agauaaauuacug

SEQ ID NO: 1985876 - RNA, 12 nt, Shigella flexneri 2a str. 301
agauaaacaacc

SEQ ID NO: 1985877 - RNA, 22 nt, Shigella flexneri 2a str. 301
agauaaaucacgcuucacccuu

SEQ ID NO: 1985878 - RNA, 14 nt, Shigella flexneri 2a str. 301
agauaaaccccuuu

SEQ ID NO: 1985879 - RNA, 22 nt, Shigella flexneri 2a str. 301
agaguuccggcccuaaacucuu

SEQ ID NO: 1985880 - RNA, 18 nt, Shigella flexneri 2a str. 301
agaguggauuaucuucac

SEQ ID NO: 1985881 - RNA, 20 nt, Shigella flexneri 2a str. 301
agagugccgaagaacauaaa

SEQ ID NO: 1985882 - RNA, 15 nt, Shigella flexneri 2a str. 301
agaguacugccggga

SEQ ID NO: 1985883 - RNA, 14 nt, Shigella flexneri 2a str. 301
agaggcgugccagg

SEQ ID NO: 1985884 - RNA, 18 nt, Shigella flexneri 2a str. 301
agaggcguuccugcaacg

SEQ ID NO: 1985885 - RNA, 23 nt, Shigella flexneri 2a str. 301
agaggcugaaggcgcuccccugc

SEQ ID NO: 1985886 - RNA, 13 nt, Shigella flexneri 2a str. 301
agaggagccauca

SEQ ID NO: 1985887 - RNA, 13 nt, Shigella flexneri 2a str. 301
agaggcccuggaa

SEQ ID NO: 1985888 - RNA, 14 nt, Shigella flexneri 2a str. 301
agagcggagcaaug

SEQ ID NO: 1985889 - RNA, 16 nt, Shigella flexneri 2a str. 301
agagccggacugacau

SEQ ID NO: 1985890 - RNA, 21 nt, Shigella flexneri 2a str. 301
agagccgcgauaaaaucccau

SEQ ID NO: 1985891 - RNA, 19 nt, Shigella flexneri 2a str. 301
agagccagccccacagcag

SEQ ID NO: 1985892 - RNA, 12 nt, Shigella flexneri 2a str. 301
agagcauuacac

SEQ ID NO: 1985893 - RNA, 20 nt, Shigella flexneri 2a str. 301
agagcaugaaaugaaaauca

SEQ ID NO: 1985894 - RNA, 14 nt, Shigella flexneri 2a str. 301
agagcaucaugaau

SEQ ID NO: 1985895 - RNA, 21 nt, Shigella flexneri 2a str. 301
agagacguucgcguacugcug

SEQ ID NO: 1985896 - RNA, 20 nt, Shigella flexneri 2a str. 301
agagacagccgaaaagguag

SEQ ID NO: 1985897 - RNA, 23 nt, Shigella flexneri 2a str. 301
agagcagcaucaauaacccuggu

SEQ ID NO: 1985898 - RNA, 22 nt, Shigella flexneri 2a str. 301
agagcaucaguuaacggcacca

SEQ ID NO: 1985899 - RNA, 13 nt, Shigella flexneri 2a str. 301
agaaaaaaaguag

SEQ ID NO: 1985900 - RNA, 16 nt, Shigella flexneri 2a str. 301
acuuuuauuaacucag

SEQ ID NO: 1985901 - RNA, 22 nt, Shigella flexneri 2a str. 301
acuuuucaggcuagccgccagc

SEQ ID NO: 1985902 - RNA, 22 nt, Shigella flexneri 2a str. 301
acuuuucccuacugcugacaua

SEQ ID NO: 1985903 - RNA, 16 nt, Shigella flexneri 2a str. 301
acuuuucccuacugcu

SEQ ID NO: 1985904 - RNA, 16 nt, Shigella flexneri 2a str. 301
acuuuucgcacugcag

SEQ ID NO: 1985905 - RNA, 14 nt, Shigella flexneri 2a str. 301
agaaaaacuggcgc

SEQ ID NO: 1985906 - RNA, 17 nt, Shigella flexneri 2a str. 301
agaaaaaccuccggcgu

SEQ ID NO: 1985907 - RNA, 14 nt, Shigella flexneri 2a str. 301
agaaaacgaauacu

SEQ ID NO: 1985908 - RNA, 23 nt, Shigella flexneri 2a str. 301
agaaaacgaaagcgccaucaaug

SEQ ID NO: 1985909 - RNA, 18 nt, Shigella flexneri 2a str. 301
agaaaagccaaugaaauu

SEQ ID NO: 1985910 - RNA, 12 nt, Shigella flexneri 2a str. 301
agaaacaauaag

SEQ ID NO: 1985911 - RNA, 13 nt, Shigella flexneri 2a str. 301
agaaacaaccuga

SEQ ID NO: 1985912 - RNA, 14 nt, Shigella flexneri 2a str. 301
agaaagagcgucug

SEQ ID NO: 1985913 - RNA, 15 nt, Shigella flexneri 2a str. 301
agaaagagcgucugg

SEQ ID NO: 1985914 - RNA, 19 nt, Shigella flexneri 2a str. 301
agaaagagcgucuggaaga

SEQ ID NO: 1985915 - RNA, 20 nt, Shigella flexneri 2a str. 301
agaaaguugccagauaaaua

SEQ ID NO: 1985916 - RNA, 22 nt, Shigella flexneri 2a str. 301
agaaaguugccagauaaauauu

SEQ ID NO: 1985917 - RNA, 13 nt, Shigella flexneri 2a str. 301
agaaaguuguuuu

SEQ ID NO: 1985918 - RNA, 16 nt, Shigella flexneri 2a str. 301
agaaacagucuggagc

SEQ ID NO: 1985919 - RNA, 15 nt, Shigella flexneri 2a str. 301
agaaacaccagaaug

SEQ ID NO: 1985920 - RNA, 19 nt, Shigella flexneri 2a str. 301
agaaacagagguuucucau

SEQ ID NO: 1985921 - RNA, 21 nt, Shigella flexneri 2a str. 301
agaaacagccauaaccccacc

SEQ ID NO: 1985922 - RNA, 22 nt, Shigella flexneri 2a str. 301
agaaaucccccagcaucacgcc

SEQ ID NO: 1985923 - RNA, 15 nt, Shigella flexneri 2a str. 301
agaaauccacaaauu

SEQ ID NO: 1985924 - RNA, 14 nt, Shigella flexneri 2a str. 301
agaaaugaaaaaau

SEQ ID NO: 1985925 - RNA, 17 nt, Shigella flexneri 2a str. 301
agaaaugaaaaaauaga

SEQ ID NO: 1985926 - RNA, 23 nt, Shigella flexneri 2a str. 301
agaaauccaggcccgcauuaaaa

SEQ ID NO: 1985927 - RNA, 9 nt, Shigella flexneri 2a str. 301
agaaaucag

SEQ ID NO: 1985928 - RNA, 18 nt, Shigella flexneri 2a str. 301
agaaauacuggcuaagaa

SEQ ID NO: 1985929 - RNA, 16 nt, Shigella flexneri 2a str. 301
acuuuaaucaccugcc

SEQ ID NO: 1985930 - RNA, 19 nt, Shigella flexneri 2a str. 301
acuuuaauuuugugcagca

SEQ ID NO: 1985931 - RNA, 14 nt, Shigella flexneri 2a str. 301
acuuuaauuuugug

SEQ ID NO: 1985932 - RNA, 23 nt, Shigella flexneri 2a str. 301
acuuuaaugccacauuagauaaa

SEQ ID NO: 1985933 - RNA, 21 nt, Shigella flexneri 2a str. 301
acuuuaccgguuucaauccag

SEQ ID NO: 1985934 - RNA, 18 nt, Shigella flexneri 2a str. 301
acuuucaaacgccacagc

SEQ ID NO: 1985935 - RNA, 16 nt, Shigella flexneri 2a str. 301
acuuucacgcccauaa

SEQ ID NO: 1985936 - RNA, 16 nt, Shigella flexneri 2a str. 301
acuuucagaccgccaa

SEQ ID NO: 1985937 - RNA, 14 nt, Shigella flexneri 2a str. 301
acuuucaucagcac

SEQ ID NO: 1985938 - RNA, 16 nt, Shigella flexneri 2a str. 301
acuuuaucugauuuga

SEQ ID NO: 1985939 - RNA, 17 nt, Shigella flexneri 2a str. 301
acuuuagcgcaaucgca

SEQ ID NO: 1985940 - RNA, 17 nt, Shigella flexneri 2a str. 301
acuuuacucuuuuuugu

SEQ ID NO: 1985941 - RNA, 16 nt, Shigella flexneri 2a str. 301
acuuuuacucucugga

SEQ ID NO: 1985942 - RNA, 18 nt, Shigella flexneri 2a str. 301
acuuuguuagcgaauaaa

SEQ ID NO: 1985943 - RNA, 17 nt, Shigella flexneri 2a str. 301
acuuuguucugaaucac

SEQ ID NO: 1985944 - RNA, 18 nt, Shigella flexneri 2a str. 301
acuuugccgucagccacu

SEQ ID NO: 1985945 - RNA, 18 nt, Shigella flexneri 2a str. 301
acuuucucuucaucuaua

SEQ ID NO: 1985946 - RNA, 16 nt, Shigella flexneri 2a str. 301
acuuucucuucaucua

SEQ ID NO: 1985947 - RNA, 20 nt, Shigella flexneri 2a str. 301
acuuucuggcacgaccuggc

SEQ ID NO: 1985948 - RNA, 22 nt, Shigella flexneri 2a str. 301
acuuucuuuuuguugcgcugaa

SEQ ID NO: 1985949 - RNA, 14 nt, Shigella flexneri 2a str. 301
acuuuccagccaca

SEQ ID NO: 1985950 - RNA, 20 nt, Shigella flexneri 2a str. 301
acuuuccaugccaucugcca

SEQ ID NO: 1985951 - RNA, 20 nt, Shigella flexneri 2a str. 301
acuuuccuuaacuccucgcc

SEQ ID NO: 1985952 - RNA, 22 nt, Shigella flexneri 2a str. 301
acuuucggcagaaaauccacca

SEQ ID NO: 1985953 - RNA, 21 nt, Shigella flexneri 2a str. 301
acuuucgagcaauuuuccuug

SEQ ID NO: 1985954 - RNA, 18 nt, Shigella flexneri 2a str. 301
acuuacugauaguguuuu

SEQ ID NO: 1985955 - RNA, 20 nt, Shigella flexneri 2a str. 301
acuuacugauaguguuuuau

SEQ ID NO: 1985956 - RNA, 17 nt, Shigella flexneri 2a str. 301
acuuacucauuaaugca

SEQ ID NO: 1985957 - RNA, 20 nt, Shigella flexneri 2a str. 301
acuuaaugucauacacuuca

SEQ ID NO: 1985958 - RNA, 20 nt, Shigella flexneri 2a str. 301
acuuauucaaucucuucaca

SEQ ID NO: 1985959 - RNA, 16 nt, Shigella flexneri 2a str. 301
acuuauggcuggcugg

SEQ ID NO: 1985960 - RNA, 13 nt, Shigella flexneri 2a str. 301
acuuacuuuccuu

SEQ ID NO: 1985961 - RNA, 12 nt, Shigella flexneri 2a str. 301
acuucaaacaaa

SEQ ID NO: 1985962 - RNA, 13 nt, Shigella flexneri 2a str. 301
acuucaaccacau

SEQ ID NO: 1985963 - RNA, 22 nt, Shigella flexneri 2a str. 301
acuucaacgcaagaacgugccg

SEQ ID NO: 1985964 - RNA, 16 nt, Shigella flexneri 2a str. 301
acuucauuaaccacga

SEQ ID NO: 1985965 - RNA, 12 nt, Shigella flexneri 2a str. 301
acuucaugcccc

SEQ ID NO: 1985966 - RNA, 17 nt, Shigella flexneri 2a str. 301
acuucaucacgaugcaa

SEQ ID NO: 1985967 - RNA, 19 nt, Shigella flexneri 2a str. 301
acuucaucggaaugcaccg

SEQ ID NO: 1985968 - RNA, 23 nt, Shigella flexneri 2a str. 301
acuucaucggcggugaccagcag

SEQ ID NO: 1985969 - RNA, 16 nt, Shigella flexneri 2a str. 301
acuguuuaucuuccca

SEQ ID NO: 1985970 - RNA, 21 nt, Shigella flexneri 2a str. 301
acuguuugacaacucaucacu

SEQ ID NO: 1985971 - RNA, 13 nt, Shigella flexneri 2a str. 301
acuguuucacugu

SEQ ID NO: 1985972 - RNA, 14 nt, Shigella flexneri 2a str. 301
acuuaauugguugc

SEQ ID NO: 1985973 - RNA, 22 nt, Shigella flexneri 2a str. 301
acuguuuuaccaaauuggcaaa

SEQ ID NO: 1985974 - RNA, 22 nt, Shigella flexneri 2a str. 301
acugugcacccgcuucagugac

SEQ ID NO: 1985975 - RNA, 20 nt, Shigella flexneri 2a str. 301
acugugcagguggaauaucc

SEQ ID NO: 1985976 - RNA, 13 nt, Shigella flexneri 2a str. 301
acugugcacccgc

SEQ ID NO: 1985977 - RNA, 16 nt, Shigella flexneri 2a str. 301
acuguccgucagacca

SEQ ID NO: 1985978 - RNA, 22 nt, Shigella flexneri 2a str. 301
acuguaggccggauaaggcauu

SEQ ID NO: 1985979 - RNA, 23 nt, Shigella flexneri 2a str. 301
acugacgcccguuaaccgcucug

SEQ ID NO: 1985980 - RNA, 18 nt, Shigella flexneri 2a str. 301
acugacgaaucaaauaaa

SEQ ID NO: 1985981 - RNA, 22 nt, Shigella flexneri 2a str. 301
acugacggaucccgccaacagg

SEQ ID NO: 1985982 - RNA, 20 nt, Shigella flexneri 2a str. 301
acugacgggaaacucugcug

SEQ ID NO: 1985983 - RNA, 15 nt, Shigella flexneri 2a str. 301
acuguagugcuccca

SEQ ID NO: 1985984 - RNA, 18 nt, Shigella flexneri 2a str. 301
acuucgcugguguacugc

SEQ ID NO: 1985985 - RNA, 17 nt, Shigella flexneri 2a str. 301
acuuccacguuccccag

SEQ ID NO: 1985986 - RNA, 14 nt, Shigella flexneri 2a str. 301
acuuccaccacuuc

SEQ ID NO: 1985987 - RNA, 20 nt, Shigella flexneri 2a str. 301
acuuccagcaguucgcccgc

SEQ ID NO: 1985988 - RNA, 20 nt, Shigella flexneri 2a str. 301
acuuccagcagaccagcaau

SEQ ID NO: 1985989 - RNA, 16 nt, Shigella flexneri 2a str. 301
acuucuuuuaccuuca

SEQ ID NO: 1985990 - RNA, 16 nt, Shigella flexneri 2a str. 301
acuucuucauucaucc

SEQ ID NO: 1985991 - RNA, 22 nt, Shigella flexneri 2a str. 301
acuucuucguagcguuuuuuca

SEQ ID NO: 1985992 - RNA, 23 nt, Shigella flexneri 2a str. 301
acuucuucccaccauacugcuua

SEQ ID NO: 1985993 - RNA, 17 nt, Shigella flexneri 2a str. 301
acuucuuccuugaaaug

SEQ ID NO: 1985994 - RNA, 18 nt, Shigella flexneri 2a str. 301
acuucuuccuugaaaugg

SEQ ID NO: 1985995 - RNA, 14 nt, Shigella flexneri 2a str. 301
acuucuucuucgcu

SEQ ID NO: 1985996 - RNA, 16 nt, Shigella flexneri 2a str. 301
acuucuucuuguucau

SEQ ID NO: 1985997 - RNA, 17 nt, Shigella flexneri 2a str. 301
acuucuucugucgggca

SEQ ID NO: 1985998 - RNA, 16 nt, Shigella flexneri 2a str. 301
acuucuuaccgcuuca

SEQ ID NO: 1985999 - RNA, 24 nt, Shigella flexneri 2a str. 301
acuucuuagucccaaacagcagaa

SEQ ID NO: 1986000 - RNA, 20 nt, Shigella flexneri 2a str. 301
acuucuuaaugcccaucucu

SEQ ID NO: 1986001 - RNA, 16 nt, Shigella flexneri 2a str. 301
acuucugccagcugcu

SEQ ID NO: 1986002 - RNA, 18 nt, Shigella flexneri 2a str. 301
acuucugauguuguuuuu

SEQ ID NO: 1986003 - RNA, 13 nt, Shigella flexneri 2a str. 301
acuugaaaauuau

SEQ ID NO: 1986004 - RNA, 12 nt, Shigella flexneri 2a str. 301
acuugaaccagc

SEQ ID NO: 1986005 - RNA, 14 nt, Shigella flexneri 2a str. 301
acuucuuuuugaac

SEQ ID NO: 1986006 - RNA, 13 nt, Shigella flexneri 2a str. 301
acuugcagcuccu

SEQ ID NO: 1986007 - RNA, 22 nt, Shigella flexneri 2a str. 301
acuugggcgauuuuugcagcaa

SEQ ID NO: 1986008 - RNA, 19 nt, Shigella flexneri 2a str. 301
agccaaauccagcgccaca

SEQ ID NO: 1986009 - RNA, 20 nt, Shigella flexneri 2a str. 301
agccaaacgcccagcuaauc

SEQ ID NO: 1986010 - RNA, 22 nt, Shigella flexneri 2a str. 301
agccaacgaugaugacguaauc

SEQ ID NO: 1986011 - RNA, 23 nt, Shigella flexneri 2a str. 301
agccaacguuucuggaaguaauc

SEQ ID NO: 1986012 - RNA, 13 nt, Shigella flexneri 2a str. 301
agccaacagcagc

SEQ ID NO: 1986013 - RNA, 19 nt, Shigella flexneri 2a str. 301
agccaacagcagccacacc

SEQ ID NO: 1986014 - RNA, 13 nt, Shigella flexneri 2a str. 301
agccaaaacugca

SEQ ID NO: 1986015 - RNA, 17 nt, Shigella flexneri 2a str. 301
agccaaaacugcacugg

SEQ ID NO: 1986016 - RNA, 13 nt, Shigella flexneri 2a str. 301
agccaaaaugccu

SEQ ID NO: 1986017 - RNA, 18 nt, Shigella flexneri 2a str. 301
agcauuucuuccagcguu

SEQ ID NO: 1986018 - RNA, 16 nt, Shigella flexneri 2a str. 301
agcauuugcaccuuuu

SEQ ID NO: 1986019 - RNA, 17 nt, Shigella flexneri 2a str. 301
agccaccacgccaagaa

SEQ ID NO: 1986020 - RNA, 12 nt, Shigella flexneri 2a str. 301
agccaccaugcg

SEQ ID NO: 1986021 - RNA, 18 nt, Shigella flexneri 2a str. 301
agccaccaugcgguguca

SEQ ID NO: 1986022 - RNA, 13 nt, Shigella flexneri 2a str. 301
agccaccaucccg

SEQ ID NO: 1986023 - RNA, 16 nt, Shigella flexneri 2a str. 301
agccaccacgccaaga

SEQ ID NO: 1986024 - RNA, 18 nt, Shigella flexneri 2a str. 301
agccaccacaauugacca

SEQ ID NO: 1986025 - RNA, 16 nt, Shigella flexneri 2a str. 301
agccacagggugauca

SEQ ID NO: 1986026 - RNA, 23 nt, Shigella flexneri 2a str. 301
agccacaggcuuuccugauaauc

SEQ ID NO: 1986027 - RNA, 12 nt, Shigella flexneri 2a str. 301
agccacaauaaa

SEQ ID NO: 1986028 - RNA, 17 nt, Shigella flexneri 2a str. 301
agccacaauaaacgcgc

SEQ ID NO: 1986029 - RNA, 20 nt, Shigella flexneri 2a str. 301
agccaauaaaugccaccaca

SEQ ID NO: 1986030 - RNA, 19 nt, Shigella flexneri 2a str. 301
agccaagcgccgccucagc

SEQ ID NO: 1986031 - RNA, 20 nt, Shigella flexneri 2a str. 301
agccaagcgccgccucagcc

SEQ ID NO: 1986032 - RNA, 17 nt, Shigella flexneri 2a str. 301
agccaauuacgcaggca

SEQ ID NO: 1986033 - RNA, 13 nt, Shigella flexneri 2a str. 301
agccaaugcaggc

SEQ ID NO: 1986034 - RNA, 13 nt, Shigella flexneri 2a str. 301
agccaaucccgga

SEQ ID NO: 1986035 - RNA, 19 nt, Shigella flexneri 2a str. 301
agcauuacuuucggugacu

SEQ ID NO: 1986036 - RNA, 15 nt, Shigella flexneri 2a str. 301
agcauuauuuuuaaa

SEQ ID NO: 1986037 - RNA, 18 nt, Shigella flexneri 2a str. 301
agcauuauuuuuaaacau

SEQ ID NO: 1986038 - RNA, 20 nt, Shigella flexneri 2a str. 301
agcauuauuuuuaaacauca

SEQ ID NO: 1986039 - RNA, 13 nt, Shigella flexneri 2a str. 301
agcauuauuuuua

SEQ ID NO: 1986040 - RNA, 20 nt, Shigella flexneri 2a str. 301
agcauucagacacgccgcca

SEQ ID NO: 1986041 - RNA, 22 nt, Shigella flexneri 2a str. 301
agcauuauuuuuaaacaucaaa

SEQ ID NO: 1986042 - RNA, 17 nt, Shigella flexneri 2a str. 301
agcauguguaaccgcuu

SEQ ID NO: 1986043 - RNA, 17 nt, Shigella flexneri 2a str. 301
agcauuaaggcaagaaa

SEQ ID NO: 1986044 - RNA, 18 nt, Shigella flexneri 2a str. 301
agcauuacccagauaaua

SEQ ID NO: 1986045 - RNA, 16 nt, Shigella flexneri 2a str. 301
agcauuaaugcgccca

SEQ ID NO: 1986046 - RNA, 12 nt, Shigella flexneri 2a str. 301
agcauucaguua

SEQ ID NO: 1986047 - RNA, 23 nt, Shigella flexneri 2a str. 301
agcauuucaaaacggucacggcu

SEQ ID NO: 1986048 - RNA, 20 nt, Shigella flexneri 2a str. 301
agcauuuccuuaaaagugag

SEQ ID NO: 1986049 - RNA, 18 nt, Shigella flexneri 2a str. 301
agcauugcgccugcaggu

SEQ ID NO: 1986050 - RNA, 17 nt, Shigella flexneri 2a str. 301
agcaugcauaacagaua

SEQ ID NO: 1986051 - RNA, 19 nt, Shigella flexneri 2a str. 301
agcaugcauaacagauaaa

SEQ ID NO: 1986052 - RNA, 22 nt, Shigella flexneri 2a str. 301
agcaugaaaugaaaaucaccau

SEQ ID NO: 1986053 - RNA, 18 nt, Shigella flexneri 2a str. 301
agcaugaacauugcugcu

SEQ ID NO: 1986054 - RNA, 18 nt, Shigella flexneri 2a str. 301
agcaugaaaugaaaauca

SEQ ID NO: 1986055 - RNA, 21 nt, Shigella flexneri 2a str. 301
agcaugacuaccggggacagg

SEQ ID NO: 1986056 - RNA, 14 nt, Shigella flexneri 2a str. 301
agcaugauauucac

SEQ ID NO: 1986057 - RNA, 19 nt, Shigella flexneri 2a str. 301
agccacggcuccagcaaug

SEQ ID NO: 1986058 - RNA, 18 nt, Shigella flexneri 2a str. 301
agccacgaugauagccau

SEQ ID NO: 1986059 - RNA, 16 nt, Shigella flexneri 2a str. 301
agccacggcuccagca

SEQ ID NO: 1986060 - RNA, 18 nt, Shigella flexneri 2a str. 301
agccacggcuccagcaau

SEQ ID NO: 1986061 - RNA, 22 nt, Shigella flexneri 2a str. 301
agccacgagugagucuucccuu

SEQ ID NO: 1986062 - RNA, 12 nt, Shigella flexneri 2a str. 301
agccaccgccag

SEQ ID NO: 1986063 - RNA, 18 nt, Shigella flexneri 2a str. 301
agccaccgcccagagaau

SEQ ID NO: 1986064 - RNA, 13 nt, Shigella flexneri 2a str. 301
agccaccgccagc

SEQ ID NO: 1986065 - RNA, 21 nt, Shigella flexneri 2a str. 301
agccacuucuuccagcggcag

SEQ ID NO: 1986066 - RNA, 16 nt, Shigella flexneri 2a str. 301
agccagacgccagcca

SEQ ID NO: 1986067 - RNA, 18 nt, Shigella flexneri 2a str. 301
agccagaacagcggugca

SEQ ID NO: 1986068 - RNA, 14 nt, Shigella flexneri 2a str. 301
agccagaaagaacc

SEQ ID NO: 1986069 - RNA, 20 nt, Shigella flexneri 2a str. 301
agccagaaaguacggccacu

SEQ ID NO: 1986070 - RNA, 13 nt, Shigella flexneri 2a str. 301
agccacugcgcca

SEQ ID NO: 1986071 - RNA, 14 nt, Shigella flexneri 2a str. 301
agccagccagaauc

SEQ ID NO: 1986072 - RNA, 15 nt, Shigella flexneri 2a str. 301
agccagccccacagc

SEQ ID NO: 1986073 - RNA, 12 nt, Shigella flexneri 2a str. 301
agccagccagaa

SEQ ID NO: 1986074 - RNA, 21 nt, Shigella flexneri 2a str. 301
agccagccgcuaacuuccugc

SEQ ID NO: 1986075 - RNA, 18 nt, Shigella flexneri 2a str. 301
agccagccguugcccgua

SEQ ID NO: 1986076 - RNA, 14 nt, Shigella flexneri 2a str. 301
agccagcgcuggca

SEQ ID NO: 1986077 - RNA, 19 nt, Shigella flexneri 2a str. 301
agccagcgcuggcaauaaa

SEQ ID NO: 1986078 - RNA, 14 nt, Shigella flexneri 2a str. 301
agccagcgcauccu

SEQ ID NO: 1986079 - RNA, 16 nt, Shigella flexneri 2a str. 301
agccagcaccaggcuu

SEQ ID NO: 1986080 - RNA, 17 nt, Shigella flexneri 2a str. 301
agccagcagagcaaaaa

SEQ ID NO: 1986081 - RNA, 15 nt, Shigella flexneri 2a str. 301
agccagcaccaggcu

SEQ ID NO: 1986082 - RNA, 18 nt, Shigella flexneri 2a str. 301
agccagccaagcauguca

SEQ ID NO: 1986083 - RNA, 12 nt, Shigella flexneri 2a str. 301
agccagccaacg

SEQ ID NO: 1986084 - RNA, 12 nt, Shigella flexneri 2a str. 301
agccagccaagc

SEQ ID NO: 1986085 - RNA, 20 nt, Shigella flexneri 2a str. 301
agccagagaagcgacuugug

SEQ ID NO: 1986086 - RNA, 15 nt, Shigella flexneri 2a str. 301
agccauuaaacacca

SEQ ID NO: 1986087 - RNA, 19 nt, Shigella flexneri 2a str. 301
agccaugcccgugcugaca

SEQ ID NO: 1986088 - RNA, 23 nt, Shigella flexneri 2a str. 301
agccaugcuuugcaucccagaaa

SEQ ID NO: 1986089 - RNA, 11 nt, Shigella flexneri 2a str. 301
agccaucaucc

SEQ ID NO: 1986090 - RNA, 16 nt, Shigella flexneri 2a str. 301
agccauccaguuuaau

SEQ ID NO: 1986091 - RNA, 17 nt, Shigella flexneri 2a str. 301
agccauccgucauccau

SEQ ID NO: 1986092 - RNA, 12 nt, Shigella flexneri 2a str. 301
agccaucaccau

SEQ ID NO: 1986093 - RNA, 24 nt, Shigella flexneri 2a str. 301
agccauaaucacucuuccccgcuu

SEQ ID NO: 1986094 - RNA, 18 nt, Shigella flexneri 2a str. 301
agccaguucucaccaaag

SEQ ID NO: 1986095 - RNA, 17 nt, Shigella flexneri 2a str. 301
agccaguucgagaaaaa

SEQ ID NO: 1986096 - RNA, 16 nt, Shigella flexneri 2a str. 301
agccaguccagaaaug

SEQ ID NO: 1986097 - RNA, 17 nt, Shigella flexneri 2a str. 301
agccaguauaauauaca

SEQ ID NO: 1986098 - RNA, 19 nt, Shigella flexneri 2a str. 301
agccagguuuaccagcagc

SEQ ID NO: 1986099 - RNA, 19 nt, Shigella flexneri 2a str. 301
agccaggaaccaccgaugc

SEQ ID NO: 1986100 - RNA, 24 nt, Shigella flexneri 2a str. 301
agccaggaaauacgcuggcugaac

SEQ ID NO: 1986101 - RNA, 17 nt, Shigella flexneri 2a str. 301
agccaggagccaacacu

SEQ ID NO: 1986102 - RNA, 23 nt, Shigella flexneri 2a str. 301
agccaggagccaacacuuucacu

SEQ ID NO: 1986103 - RNA, 15 nt, Shigella flexneri 2a str. 301
agccaggcacgccgc

SEQ ID NO: 1986104 - RNA, 18 nt, Shigella flexneri 2a str. 301
agccagggucaacauaaa

SEQ ID NO: 1986105 - RNA, 21 nt, Shigella flexneri 2a str. 301
agccaggguuauauaaaaccg

SEQ ID NO: 1986106 - RNA, 15 nt, Shigella flexneri 2a str. 301
agcaucaaacuuuua

SEQ ID NO: 1986107 - RNA, 21 nt, Shigella flexneri 2a str. 301
agcaucaacaacaauuucacu

SEQ ID NO: 1986108 - RNA, 21 nt, Shigella flexneri 2a str. 301
agcaucaacccgcucauaaua

SEQ ID NO: 1986109 - RNA, 14 nt, Shigella flexneri 2a str. 301
agcaucaauugcua

SEQ ID NO: 1986110 - RNA, 12 nt, Shigella flexneri 2a str. 301
agcaucaaugac

SEQ ID NO: 1986111 - RNA, 22 nt, Shigella flexneri 2a str. 301
agcaucacauaaucgaaaacau

SEQ ID NO: 1986112 - RNA, 13 nt, Shigella flexneri 2a str. 301
agcaucagcgcca

SEQ ID NO: 1986113 - RNA, 17 nt, Shigella flexneri 2a str. 301
agcaucagcagugccag

SEQ ID NO: 1986114 - RNA, 23 nt, Shigella flexneri 2a str. 301
agcaucaucgcaaugauuuugau

SEQ ID NO: 1986115 - RNA, 15 nt, Shigella flexneri 2a str. 301
agcaucaucgcaaug

SEQ ID NO: 1986116 - RNA, 20 nt, Shigella flexneri 2a str. 301
agcaucauaguggguuucug

SEQ ID NO: 1986117 - RNA, 22 nt, Shigella flexneri 2a str. 301
agcaucaguucggaaacagugc

SEQ ID NO: 1986118 - RNA, 14 nt, Shigella flexneri 2a str. 301
agcaucaugaauau

SEQ ID NO: 1986119 - RNA, 22 nt, Shigella flexneri 2a str. 301
agcauccccggcaaccacaccc

SEQ ID NO: 1986120 - RNA, 19 nt, Shigella flexneri 2a str. 301
agcaucccggcagccccaa

SEQ ID NO: 1986121 - RNA, 21 nt, Shigella flexneri 2a str. 301
agcaucgcaacaugcuggccu

SEQ ID NO: 1986122 - RNA, 14 nt, Shigella flexneri 2a str. 301
agcaucgcaacaug

SEQ ID NO: 1986123 - RNA, 19 nt, Shigella flexneri 2a str. 301
agcaucgcccaggcgacca

SEQ ID NO: 1986124 - RNA, 23 nt, Shigella flexneri 2a str. 301
agcaucccggcagccccaaacag

SEQ ID NO: 1986125 - RNA, 23 nt, Shigella flexneri 2a str. 301
agcaucccguuaugguuauccac

SEQ ID NO: 1986126 - RNA, 16 nt, Shigella flexneri 2a str. 301
agcaucgcccccaucg

SEQ ID NO: 1986127 - RNA, 13 nt, Shigella flexneri 2a str. 301
agcaucuggauga

SEQ ID NO: 1986128 - RNA, 14 nt, Shigella flexneri 2a str. 301
agcaucugguaacc

SEQ ID NO: 1986129 - RNA, 15 nt, Shigella flexneri 2a str. 301
agcaucguccgccag

SEQ ID NO: 1986130 - RNA, 20 nt, Shigella flexneri 2a str. 301
agcaucgucaucagcuccau

SEQ ID NO: 1986131 - RNA, 18 nt, Shigella flexneri 2a str. 301
agcaucucuacagcgccc

SEQ ID NO: 1986132 - RNA, 17 nt, Shigella flexneri 2a str. 301
agcaucugcaaaauuuc

SEQ ID NO: 1986133 - RNA, 18 nt, Shigella flexneri 2a str. 301
agcauaaugugcgcacau

SEQ ID NO: 1986134 - RNA, 14 nt, Shigella flexneri 2a str. 301
agcauaaucaccag

SEQ ID NO: 1986135 - RNA, 17 nt, Shigella flexneri 2a str. 301
agcaguuucaccagcag

SEQ ID NO: 1986136 - RNA, 16 nt, Shigella flexneri 2a str. 301
agcaguuucaccagca

SEQ ID NO: 1986137 - RNA, 22 nt, Shigella flexneri 2a str. 301
agcauauaaugcaacauuuuga

SEQ ID NO: 1986138 - RNA, 19 nt, Shigella flexneri 2a str. 301
agcauauaggaggccucgg

SEQ ID NO: 1986139 - RNA, 18 nt, Shigella flexneri 2a str. 301
agcauaggcauuaaacau

SEQ ID NO: 1986140 - RNA, 15 nt, Shigella flexneri 2a str. 301
agcauaggcauuaaa

SEQ ID NO: 1986141 - RNA, 21 nt, Shigella flexneri 2a str. 301
agcauagcucgcuucaucugc

SEQ ID NO: 1986142 - RNA, 23 nt, Shigella flexneri 2a str. 301
agcauagccccagcgcagacggc

SEQ ID NO: 1986143 - RNA, 15 nt, Shigella flexneri 2a str. 301
agcauaccuuccagc

SEQ ID NO: 1986144 - RNA, 22 nt, Shigella flexneri 2a str. 301
agcaguucuacuggaauuucau

SEQ ID NO: 1986145 - RNA, 19 nt, Shigella flexneri 2a str. 301
agcaguucagucagcagug

SEQ ID NO: 1986146 - RNA, 15 nt, Shigella flexneri 2a str. 301
agcaguucacgcagc

SEQ ID NO: 1986147 - RNA, 13 nt, Shigella flexneri 2a str. 301
agcaguucacgca

SEQ ID NO: 1986148 - RNA, 18 nt, Shigella flexneri 2a str. 301
agcaguucaccgccgagg

SEQ ID NO: 1986149 - RNA, 17 nt, Shigella flexneri 2a str. 301
agcagugaauacccaga

SEQ ID NO: 1986150 - RNA, 18 nt, Shigella flexneri 2a str. 301
agcagugacucacgaauc

SEQ ID NO: 1986151 - RNA, 20 nt, Shigella flexneri 2a str. 301
agcagugaauacccagaauc

SEQ ID NO: 1986152 - RNA, 22 nt, Shigella flexneri 2a str. 301
agcagucgcaacggcuuuggca

SEQ ID NO: 1986153 - RNA, 19 nt, Shigella flexneri 2a str. 301
agcaguaauugcagcagcu

SEQ ID NO: 1986154 - RNA, 16 nt, Shigella flexneri 2a str. 301
agcagucaucugauga

SEQ ID NO: 1986155 - RNA, 16 nt, Shigella flexneri 2a str. 301
agcagcgaagcauuca

SEQ ID NO: 1986156 - RNA, 16 nt, Shigella flexneri 2a str. 301
agcagcgaauuucuca

SEQ ID NO: 1986157 - RNA, 13 nt, Shigella flexneri 2a str. 301
agcagccgguauc

SEQ ID NO: 1986158 - RNA, 16 nt, Shigella flexneri 2a str. 301
agcagccaucugauga

SEQ ID NO: 1986159 - RNA, 21 nt, Shigella flexneri 2a str. 301
agcagcguaccucuaucuuga

SEQ ID NO: 1986160 - RNA, 19 nt, Shigella flexneri 2a str. 301
agcagcgguugagagaaga

SEQ ID NO: 1986161 - RNA, 20 nt, Shigella flexneri 2a str. 301
agcagcggucggcuucccug

SEQ ID NO: 1986162 - RNA, 19 nt, Shigella flexneri 2a str. 301
agcagcggcagaucaaauu

SEQ ID NO: 1986163 - RNA, 20 nt, Shigella flexneri 2a str. 301
agcagcgccacacgagucau

SEQ ID NO: 1986164 - RNA, 22 nt, Shigella flexneri 2a str. 301
agcagcgccaacggugaaaaac

SEQ ID NO: 1986165 - RNA, 19 nt, Shigella flexneri 2a str. 301
agcagcugcucccagcgca

SEQ ID NO: 1986166 - RNA, 16 nt, Shigella flexneri 2a str. 301
agcagcugcucccagc

SEQ ID NO: 1986167 - RNA, 18 nt, Shigella flexneri 2a str. 301
agcagcugacuuccagcc

SEQ ID NO: 1986168 - RNA, 16 nt, Shigella flexneri 2a str. 301
agcagcguuaaugaua

SEQ ID NO: 1986169 - RNA, 13 nt, Shigella flexneri 2a str. 301
agcagcuccgcca

SEQ ID NO: 1986170 - RNA, 12 nt, Shigella flexneri 2a str. 301
agcaggagucau

SEQ ID NO: 1986171 - RNA, 14 nt, Shigella flexneri 2a str. 301
agcaggagcagcag

SEQ ID NO: 1986172 - RNA, 14 nt, Shigella flexneri 2a str. 301
agcaggauggcugg

SEQ ID NO: 1986173 - RNA, 21 nt, Shigella flexneri 2a str. 301
agcaggauggcuggccgugca

SEQ ID NO: 1986174 - RNA, 17 nt, Shigella flexneri 2a str. 301
agcaggccgucgcgcag

SEQ ID NO: 1986175 - RNA, 14 nt, Shigella flexneri 2a str. 301
agcaggguugcagc

SEQ ID NO: 1986176 - RNA, 22 nt, Shigella flexneri 2a str. 301
agcagguccccgagcacaugca

SEQ ID NO: 1986177 - RNA, 13 nt, Shigella flexneri 2a str. 301
agcaggcucagaa

SEQ ID NO: 1986178 - RNA, 15 nt, Shigella flexneri 2a str. 301
agcaggcugcacugg

SEQ ID NO: 1986179 - RNA, 24 nt, Shigella flexneri 2a str. 301
agcacacugguucccaacaacagc

SEQ ID NO: 1986180 - RNA, 23 nt, Shigella flexneri 2a str. 301
agcacacauaagagcgggacaac

SEQ ID NO: 1986181 - RNA, 23 nt, Shigella flexneri 2a str. 301
agcacacauuauaggccugauaa

SEQ ID NO: 1986182 - RNA, 12 nt, Shigella flexneri 2a str. 301
agcaauuuugcc

SEQ ID NO: 1986183 - RNA, 22 nt, Shigella flexneri 2a str. 301
agcaauuuuccuugaaaaagag

SEQ ID NO: 1986184 - RNA, 21 nt, Shigella flexneri 2a str. 301
agcaauuuuccuugaaaaaga

SEQ ID NO: 1986185 - RNA, 21 nt, Shigella flexneri 2a str. 301
agcaauuugcgcucaauaauc

SEQ ID NO: 1986186 - RNA, 14 nt, Shigella flexneri 2a str. 301
agcaauuucuccgc

SEQ ID NO: 1986187 - RNA, 17 nt, Shigella flexneri 2a str. 301
agcacaaaaauagcccc

SEQ ID NO: 1986188 - RNA, 14 nt, Shigella flexneri 2a str. 301
agcacaugcugaca

SEQ ID NO: 1986189 - RNA, 13 nt, Shigella flexneri 2a str. 301
agcacauuucaga

SEQ ID NO: 1986190 - RNA, 20 nt, Shigella flexneri 2a str. 301
agcacacuguaagccaccga

SEQ ID NO: 1986191 - RNA, 14 nt, Shigella flexneri 2a str. 301
agcacaucaucaaa

SEQ ID NO: 1986192 - RNA, 14 nt, Shigella flexneri 2a str. 301
agcacaucagccag

SEQ ID NO: 1986193 - RNA, 21 nt, Shigella flexneri 2a str. 301
agcacaucacucauaaugaug

SEQ ID NO: 1986194 - RNA, 23 nt, Shigella flexneri 2a str. 301
agcacaucuggcgagucaccaua

SEQ ID NO: 1986195 - RNA, 18 nt, Shigella flexneri 2a str. 301
agcaccgcgaauuuuuuc

SEQ ID NO: 1986196 - RNA, 17 nt, Shigella flexneri 2a str. 301
agcaccgcgacaaucag

SEQ ID NO: 1986197 - RNA, 19 nt, Shigella flexneri 2a str. 301
agcaccggacuauccgccu

SEQ ID NO: 1986198 - RNA, 20 nt, Shigella flexneri 2a str. 301
agcacccugaguuuucagua

SEQ ID NO: 1986199 - RNA, 17 nt, Shigella flexneri 2a str. 301
agcaccugcgcaggcau

SEQ ID NO: 1986200 - RNA, 14 nt, Shigella flexneri 2a str. 301
agcacccgccagcg

SEQ ID NO: 1986201 - RNA, 14 nt, Shigella flexneri 2a str. 301
agcacccgcgcugg

SEQ ID NO: 1986202 - RNA, 13 nt, Shigella flexneri 2a str. 301
agcaccaucgcug

SEQ ID NO: 1986203 - RNA, 14 nt, Shigella flexneri 2a str. 301
agcacccagcaauc

SEQ ID NO: 1986204 - RNA, 15 nt, Shigella flexneri 2a str. 301
agcacccagcaaucc

SEQ ID NO: 1986205 - RNA, 19 nt, Shigella flexneri 2a str. 301
agcacccagaacgccgaau

SEQ ID NO: 1986206 - RNA, 17 nt, Shigella flexneri 2a str. 301
agcaccagggaaauaau

SEQ ID NO: 1986207 - RNA, 18 nt, Shigella flexneri 2a str. 301
agcaccaggguaaaugca

SEQ ID NO: 1986208 - RNA, 15 nt, Shigella flexneri 2a str. 301
agcaccagcagguga

SEQ ID NO: 1986209 - RNA, 19 nt, Shigella flexneri 2a str. 301
agcaccagauaaugagaaa

SEQ ID NO: 1986210 - RNA, 12 nt, Shigella flexneri 2a str. 301
agcaccagcaac

SEQ ID NO: 1986211 - RNA, 14 nt, Shigella flexneri 2a str. 301
agcacgaccgccau

SEQ ID NO: 1986212 - RNA, 13 nt, Shigella flexneri 2a str. 301
agcacgauuuugu

SEQ ID NO: 1986213 - RNA, 16 nt, Shigella flexneri 2a str. 301
agcacgaaugucguuu

SEQ ID NO: 1986214 - RNA, 17 nt, Shigella flexneri 2a str. 301
agcacggucaggcuaaa

SEQ ID NO: 1986215 - RNA, 15 nt, Shigella flexneri 2a str. 301
agcacggcagcaacg

SEQ ID NO: 1986216 - RNA, 15 nt, Shigella flexneri 2a str. 301
agcacuccugccacc

SEQ ID NO: 1986217 - RNA, 13 nt, Shigella flexneri 2a str. 301
agcacugcaucaa

SEQ ID NO: 1986218 - RNA, 14 nt, Shigella flexneri 2a str. 301
agcacuaucuugcu

SEQ ID NO: 1986219 - RNA, 15 nt, Shigella flexneri 2a str. 301
agcacuguaaaccuc

SEQ ID NO: 1986220 - RNA, 17 nt, Shigella flexneri 2a str. 301
agcacuguaaaccucuu

SEQ ID NO: 1986221 - RNA, 18 nt, Shigella flexneri 2a str. 301
agcacugcgcccgccagc

SEQ ID NO: 1986222 - RNA, 18 nt, Shigella flexneri 2a str. 301
agcacguaaaucuuuacc

SEQ ID NO: 1986223 - RNA, 14 nt, Shigella flexneri 2a str. 301
agcacguugaacug

SEQ ID NO: 1986224 - RNA, 18 nt, Shigella flexneri 2a str. 301
agcacguuaaucaaauca

SEQ ID NO: 1986225 - RNA, 20 nt, Shigella flexneri 2a str. 301
agcagauaucccgccagcac

SEQ ID NO: 1986226 - RNA, 14 nt, Shigella flexneri 2a str. 301
agcagauaugccag

SEQ ID NO: 1986227 - RNA, 17 nt, Shigella flexneri 2a str. 301
agcagauguagcucacc

SEQ ID NO: 1986228 - RNA, 16 nt, Shigella flexneri 2a str. 301
agcagagaaacgccag

SEQ ID NO: 1986229 - RNA, 20 nt, Shigella flexneri 2a str. 301
agcagagaaacgccagcagc

SEQ ID NO: 1986230 - RNA, 15 nt, Shigella flexneri 2a str. 301
agcagagcaugguua

SEQ ID NO: 1986231 - RNA, 18 nt, Shigella flexneri 2a str. 301
agcagauaacccagcagc

SEQ ID NO: 1986232 - RNA, 20 nt, Shigella flexneri 2a str. 301
agcagauaacccagcagccc

SEQ ID NO: 1986233 - RNA, 17 nt, Shigella flexneri 2a str. 301
agcagaguuuuuuaugc

SEQ ID NO: 1986234 - RNA, 14 nt, Shigella flexneri 2a str. 301
agcagaguugcuga

SEQ ID NO: 1986235 - RNA, 13 nt, Shigella flexneri 2a str. 301
agcagcagauaug

SEQ ID NO: 1986236 - RNA, 17 nt, Shigella flexneri 2a str. 301
agcagcaccaccgcccg

SEQ ID NO: 1986237 - RNA, 22 nt, Shigella flexneri 2a str. 301
agcagcaaugcaggcaccugcc

SEQ ID NO: 1986238 - RNA, 13 nt, Shigella flexneri 2a str. 301
agcagaacaucag

SEQ ID NO: 1986239 - RNA, 13 nt, Shigella flexneri 2a str. 301
agcagaaagcgga

SEQ ID NO: 1986240 - RNA, 14 nt, Shigella flexneri 2a str. 301
agcacuugcaggcg

SEQ ID NO: 1986241 - RNA, 14 nt, Shigella flexneri 2a str. 301
agcacuugcaggaa

SEQ ID NO: 1986242 - RNA, 18 nt, Shigella flexneri 2a str. 301
agcacuucacccaucgcc

SEQ ID NO: 1986243 - RNA, 16 nt, Shigella flexneri 2a str. 301
agcagaccagcaaaaa

SEQ ID NO: 1986244 - RNA, 14 nt, Shigella flexneri 2a str. 301
agcagaccagcaaa

SEQ ID NO: 1986245 - RNA, 16 nt, Shigella flexneri 2a str. 301
agcagaccagcaauaa

SEQ ID NO: 1986246 - RNA, 17 nt, Shigella flexneri 2a str. 301
agcagacaacccacaca

SEQ ID NO: 1986247 - RNA, 20 nt, Shigella flexneri 2a str. 301
agcagaccaauguuacgacc

SEQ ID NO: 1986248 - RNA, 14 nt, Shigella flexneri 2a str. 301
agcagaaccgccau

SEQ ID NO: 1986249 - RNA, 18 nt, Shigella flexneri 2a str. 301
agauuuauuuauuauuaa

SEQ ID NO: 1986250 - RNA, 21 nt, Shigella flexneri 2a str. 301
agauuuccaagcgcggcaggc

SEQ ID NO: 1986251 - RNA, 17 nt, Shigella flexneri 2a str. 301
agauuucccauucuugg

SEQ ID NO: 1986252 - RNA, 16 nt, Shigella flexneri 2a str. 301
agauuuaacggcagca

SEQ ID NO: 1986253 - RNA, 22 nt, Shigella flexneri 2a str. 301
agauuguugauuaacaggcugc

SEQ ID NO: 1986254 - RNA, 14 nt, Shigella flexneri 2a str. 301
agauaauggcuguu

SEQ ID NO: 1986255 - RNA, 19 nt, Shigella flexneri 2a str. 301
agauaaggugccaauccuu

SEQ ID NO: 1986256 - RNA, 14 nt, Shigella flexneri 2a str. 301
agauaaucaccugc

SEQ ID NO: 1986257 - RNA, 21 nt, Shigella flexneri 2a str. 301
agcaaaucgcggcaguggcua

SEQ ID NO: 1986258 - RNA, 22 nt, Shigella flexneri 2a str. 301
agcaaaggugccuuuaauacca

SEQ ID NO: 1986259 - RNA, 22 nt, Shigella flexneri 2a str. 301
agcaaaguaccaucguccagca

SEQ ID NO: 1986260 - RNA, 16 nt, Shigella flexneri 2a str. 301
agcaaauagauaaaau

SEQ ID NO: 1986261 - RNA, 22 nt, Shigella flexneri 2a str. 301
agcaaaguggcgcagagccuga

SEQ ID NO: 1986262 - RNA, 17 nt, Shigella flexneri 2a str. 301
agcaaauaaaacaucac

SEQ ID NO: 1986263 - RNA, 17 nt, Shigella flexneri 2a str. 301
agcaaaggaauggucgg

SEQ ID NO: 1986264 - RNA, 22 nt, Shigella flexneri 2a str. 301
agcaaacuugaacuuaucauca

SEQ ID NO: 1986265 - RNA, 15 nt, Shigella flexneri 2a str. 301
agcaaacgauucaaa

SEQ ID NO: 1986266 - RNA, 19 nt, Shigella flexneri 2a str. 301
agcaaacaauaauuaucau

SEQ ID NO: 1986267 - RNA, 17 nt, Shigella flexneri 2a str. 301
agcaaacccgaccacca

SEQ ID NO: 1986268 - RNA, 21 nt, Shigella flexneri 2a str. 301
agcaaacccgaccaccauuuu

SEQ ID NO: 1986269 - RNA, 20 nt, Shigella flexneri 2a str. 301
agcaaaaauaaaugcuugac

SEQ ID NO: 1986270 - RNA, 16 nt, Shigella flexneri 2a str. 301
agcaaaagugguguug

SEQ ID NO: 1986271 - RNA, 19 nt, Shigella flexneri 2a str. 301
agcaaaaucguaagcagga

SEQ ID NO: 1986272 - RNA, 11 nt, Shigella flexneri 2a str. 301
agauuuugcuu

SEQ ID NO: 1986273 - RNA, 21 nt, Shigella flexneri 2a str. 301
agcaaccucgcccauuuuuca

SEQ ID NO: 1986274 - RNA, 22 nt, Shigella flexneri 2a str. 301
agcaaccucgcccauuuuucau

SEQ ID NO: 1986275 - RNA, 16 nt, Shigella flexneri 2a str. 301
agcaaccugcacguua

SEQ ID NO: 1986276 - RNA, 17 nt, Shigella flexneri 2a str. 301
agcaaccggugucauca

SEQ ID NO: 1986277 - RNA, 18 nt, Shigella flexneri 2a str. 301
agcaaccgguaaagaaga

SEQ ID NO: 1986278 - RNA, 17 nt, Shigella flexneri 2a str. 301
agcaacaggccaguucg

SEQ ID NO: 1986279 - RNA, 13 nt, Shigella flexneri 2a str. 301
agcaacaguaaua

SEQ ID NO: 1986280 - RNA, 17 nt, Shigella flexneri 2a str. 301
agcaaccaacgccagca

SEQ ID NO: 1986281 - RNA, 21 nt, Shigella flexneri 2a str. 301
agcaaccaaugccaccaggga

SEQ ID NO: 1986282 - RNA, 14 nt, Shigella flexneri 2a str. 301
agcaaccagguaau

SEQ ID NO: 1986283 - RNA, 22 nt, Shigella flexneri 2a str. 301
agcaacacaaacgaauuaucac

SEQ ID NO: 1986284 - RNA, 15 nt, Shigella flexneri 2a str. 301
agcaacacaaucaga

SEQ ID NO: 1986285 - RNA, 11 nt, Shigella flexneri 2a str. 301
agcaacaacag

SEQ ID NO: 1986286 - RNA, 12 nt, Shigella flexneri 2a str. 301
agcaacaggcca

SEQ ID NO: 1986287 - RNA, 18 nt, Shigella flexneri 2a str. 301
agcaacagcgccgagcac

SEQ ID NO: 1986288 - RNA, 17 nt, Shigella flexneri 2a str. 301
agcaaauuaucccccag

SEQ ID NO: 1986289 - RNA, 20 nt, Shigella flexneri 2a str. 301
agcaaauuaucccccagcac

SEQ ID NO: 1986290 - RNA, 13 nt, Shigella flexneri 2a str. 301
agcaacaaauaac

SEQ ID NO: 1986291 - RNA, 14 nt, Shigella flexneri 2a str. 301
agcaacaaaauggc

SEQ ID NO: 1986292 - RNA, 23 nt, Shigella flexneri 2a str. 301
agcaacaaaauggcaaagcgaua

SEQ ID NO: 1986293 - RNA, 21 nt, Shigella flexneri 2a str. 301
agcaacucuuuuuccugcugc

SEQ ID NO: 1986294 - RNA, 16 nt, Shigella flexneri 2a str. 301
agcaacugauuuauag

SEQ ID NO: 1986295 - RNA, 21 nt, Shigella flexneri 2a str. 301
agcaacuggcgaaucccuugu

SEQ ID NO: 1986296 - RNA, 11 nt, Shigella flexneri 2a str. 301
agcaacugcgc

SEQ ID NO: 1986297 - RNA, 22 nt, Shigella flexneri 2a str. 301
agcaacuuaaucaucaaugcca

SEQ ID NO: 1986298 - RNA, 13 nt, Shigella flexneri 2a str. 301
agcaagagcaaau

SEQ ID NO: 1986299 - RNA, 16 nt, Shigella flexneri 2a str. 301
agcaagacaauguuug

SEQ ID NO: 1986300 - RNA, 16 nt, Shigella flexneri 2a str. 301
agcaacuuaaucauca

SEQ ID NO: 1986301 - RNA, 19 nt, Shigella flexneri 2a str. 301
agcaacuuaaucaucaaug

SEQ ID NO: 1986302 - RNA, 21 nt, Shigella flexneri 2a str. 301
agcaaccugcacguuaucaga

SEQ ID NO: 1986303 - RNA, 17 nt, Shigella flexneri 2a str. 301
agcaacgaaacgccggu

SEQ ID NO: 1986304 - RNA, 23 nt, Shigella flexneri 2a str. 301
agcaacgccaaauuuaaacgaca

SEQ ID NO: 1986305 - RNA, 17 nt, Shigella flexneri 2a str. 301
agcaacggcgaaucuac

SEQ ID NO: 1986306 - RNA, 13 nt, Shigella flexneri 2a str. 301
agcaacgcggcgg

SEQ ID NO: 1986307 - RNA, 19 nt, Shigella flexneri 2a str. 301
agcaaucugauugacauca

SEQ ID NO: 1986308 - RNA, 22 nt, Shigella flexneri 2a str. 301
agcaaucggcuuuuuaugacgc

SEQ ID NO: 1986309 - RNA, 18 nt, Shigella flexneri 2a str. 301
agcaauccauaccagcac

SEQ ID NO: 1986310 - RNA, 22 nt, Shigella flexneri 2a str. 301
agcaaucgaccaggccaucagc

SEQ ID NO: 1986311 - RNA, 21 nt, Shigella flexneri 2a str. 301
agcaauagccgccauacggaa

SEQ ID NO: 1986312 - RNA, 16 nt, Shigella flexneri 2a str. 301
agcaauagacaguucu

SEQ ID NO: 1986313 - RNA, 19 nt, Shigella flexneri 2a str. 301
agcaauaccgcgaaucaua

SEQ ID NO: 1986314 - RNA, 23 nt, Shigella flexneri 2a str. 301
agcaauagccgccauacggaaaa

SEQ ID NO: 1986315 - RNA, 17 nt, Shigella flexneri 2a str. 301
agcaauguaaggugcau

SEQ ID NO: 1986316 - RNA, 14 nt, Shigella flexneri 2a str. 301
agcaauguugaacg

SEQ ID NO: 1986317 - RNA, 19 nt, Shigella flexneri 2a str. 301
agcaauguuucucuggcgc

SEQ ID NO: 1986318 - RNA, 18 nt, Shigella flexneri 2a str. 301
agcaaugcaggcaccugc

SEQ ID NO: 1986319 - RNA, 15 nt, Shigella flexneri 2a str. 301
agcaaugaucucaau

SEQ ID NO: 1986320 - RNA, 17 nt, Shigella flexneri 2a str. 301
agcaaugcgcaucaaag

SEQ ID NO: 1986321 - RNA, 14 nt, Shigella flexneri 2a str. 301
agcaagagcaaaua

SEQ ID NO: 1986322 - RNA, 16 nt, Shigella flexneri 2a str. 301
agcaagagcaaauaaa

SEQ ID NO: 1986323 - RNA, 23 nt, Shigella flexneri 2a str. 301
agcaagagcaaauaaaacaucac

SEQ ID NO: 1986324 - RNA, 20 nt, Shigella flexneri 2a str. 301
agcaagauaguuaaucaaua

SEQ ID NO: 1986325 - RNA, 15 nt, Shigella flexneri 2a str. 301
agcaagcauuauaua

SEQ ID NO: 1986326 - RNA, 22 nt, Shigella flexneri 2a str. 301
agcaagcauuauauaaugccag

SEQ ID NO: 1986327 - RNA, 15 nt, Shigella flexneri 2a str. 301
agcaaggaaaaccag

SEQ ID NO: 1986328 - RNA, 15 nt, Shigella flexneri 2a str. 301
agcaaggcaaucugc

SEQ ID NO: 1986329 - RNA, 22 nt, Shigella flexneri 2a str. 301
agcaagugcggcgcaccagcag

SEQ ID NO: 1986330 - RNA, 18 nt, Shigella flexneri 2a str. 301
agcaagucggcaucgcca

SEQ ID NO: 1986331 - RNA, 19 nt, Shigella flexneri 2a str. 301
agcaagucggcaucgccac

SEQ ID NO: 1986332 - RNA, 18 nt, Shigella flexneri 2a str. 301
agcuggcaacgcgccgcc

SEQ ID NO: 1986333 - RNA, 19 nt, Shigella flexneri 2a str. 301
agcuggcaacgcgccgcca

SEQ ID NO: 1986334 - RNA, 20 nt, Shigella flexneri 2a str. 301
agcugcugacggugauaauc

SEQ ID NO: 1986335 - RNA, 20 nt, Shigella flexneri 2a str. 301
agcugauugaaauagccaau

SEQ ID NO: 1986336 - RNA, 18 nt, Shigella flexneri 2a str. 301
agcugaugauuaacagca

SEQ ID NO: 1986337 - RNA, 23 nt, Shigella flexneri 2a str. 301
agcugauacgggaggucaucagc

SEQ ID NO: 1986338 - RNA, 15 nt, Shigella flexneri 2a str. 301
agcugauucagauaa

SEQ ID NO: 1986339 - RNA, 13 nt, Shigella flexneri 2a str. 301
agcugagaaaaag

SEQ ID NO: 1986340 - RNA, 19 nt, Shigella flexneri 2a str. 301
agcucgguggcgauguaau

SEQ ID NO: 1986341 - RNA, 15 nt, Shigella flexneri 2a str. 301
agcucuuucgacagc

SEQ ID NO: 1986342 - RNA, 19 nt, Shigella flexneri 2a str. 301
agcucuuucgacagcgauu

SEQ ID NO: 1986343 - RNA, 13 nt, Shigella flexneri 2a str. 301
agcugacguagca

SEQ ID NO: 1986344 - RNA, 15 nt, Shigella flexneri 2a str. 301
agcuccguccagcca

SEQ ID NO: 1986345 - RNA, 20 nt, Shigella flexneri 2a str. 301
agcuccguuaaccgugggaa

SEQ ID NO: 1986346 - RNA, 18 nt, Shigella flexneri 2a str. 301
agcuccgggcugguuuuc

SEQ ID NO: 1986347 - RNA, 20 nt, Shigella flexneri 2a str. 301
agcucccggagggguuuuug

SEQ ID NO: 1986348 - RNA, 18 nt, Shigella flexneri 2a str. 301
agcuccauccaccagccc

SEQ ID NO: 1986349 - RNA, 18 nt, Shigella flexneri 2a str. 301
agcuccacaagaaugccu

SEQ ID NO: 1986350 - RNA, 21 nt, Shigella flexneri 2a str. 301
agcuccacaagaaugccugcc

SEQ ID NO: 1986351 - RNA, 19 nt, Shigella flexneri 2a str. 301
agcucaugggcuuucauca

SEQ ID NO: 1986352 - RNA, 21 nt, Shigella flexneri 2a str. 301
agcuccaccgauuuugagaac

SEQ ID NO: 1986353 - RNA, 14 nt, Shigella flexneri 2a str. 301
agcuccagcaaaaa

SEQ ID NO: 1986354 - RNA, 16 nt, Shigella flexneri 2a str. 301
agcuccagccgcuccc

SEQ ID NO: 1986355 - RNA, 11 nt, Shigella flexneri 2a str. 301
agcuccagguc

SEQ ID NO: 1986356 - RNA, 14 nt, Shigella flexneri 2a str. 301
agcuccagguccuc

SEQ ID NO: 1986357 - RNA, 20 nt, Shigella flexneri 2a str. 301
agcuauauuuugccggacgc

SEQ ID NO: 1986358 - RNA, 17 nt, Shigella flexneri 2a str. 301
agcucggcaaucuguua

SEQ ID NO: 1986359 - RNA, 15 nt, Shigella flexneri 2a str. 301
agcuccugcauugac

SEQ ID NO: 1986360 - RNA, 18 nt, Shigella flexneri 2a str. 301
agcuccucgaguccuucc

SEQ ID NO: 1986361 - RNA, 20 nt, Shigella flexneri 2a str. 301
agcucgcaagccacgccgaa

SEQ ID NO: 1986362 - RNA, 17 nt, Shigella flexneri 2a str. 301
agcucgacaccaaacag

SEQ ID NO: 1986363 - RNA, 22 nt, Shigella flexneri 2a str. 301
agcguaacggcucacgcccauc

SEQ ID NO: 1986364 - RNA, 22 nt, Shigella flexneri 2a str. 301
agcguaaaggcggcagaacaga

SEQ ID NO: 1986365 - RNA, 21 nt, Shigella flexneri 2a str. 301
agcgguuucgccuccuguucu

SEQ ID NO: 1986366 - RNA, 21 nt, Shigella flexneri 2a str. 301
agcgguugaacugaccgugcg

SEQ ID NO: 1986367 - RNA, 15 nt, Shigella flexneri 2a str. 301
agcgucacccagaca

SEQ ID NO: 1986368 - RNA, 15 nt, Shigella flexneri 2a str. 301
agcguccggcugcca

SEQ ID NO: 1986369 - RNA, 20 nt, Shigella flexneri 2a str. 301
agcguccggcugccagccag

SEQ ID NO: 1986370 - RNA, 19 nt, Shigella flexneri 2a str. 301
agcguccacagccaacaca

SEQ ID NO: 1986371 - RNA, 21 nt, Shigella flexneri 2a str. 301
agcguccacagccaacacauu

SEQ ID NO: 1986372 - RNA, 11 nt, Shigella flexneri 2a str. 301
agcgucaguuc

SEQ ID NO: 1986373 - RNA, 21 nt, Shigella flexneri 2a str. 301
agcgucagccagaaagaaccg

SEQ ID NO: 1986374 - RNA, 12 nt, Shigella flexneri 2a str. 301
agcgucagccug

SEQ ID NO: 1986375 - RNA, 12 nt, Shigella flexneri 2a str. 301
agcgucacuucg

SEQ ID NO: 1986376 - RNA, 18 nt, Shigella flexneri 2a str. 301
agcgucagccagaaagaa

SEQ ID NO: 1986377 - RNA, 17 nt, Shigella flexneri 2a str. 301
agcgggguguauuucac

SEQ ID NO: 1986378 - RNA, 14 nt, Shigella flexneri 2a str. 301
agcgguuacacaug

SEQ ID NO: 1986379 - RNA, 13 nt, Shigella flexneri 2a str. 301
agcgguugcaggc

SEQ ID NO: 1986380 - RNA, 17 nt, Shigella flexneri 2a str. 301
agcgguaaaauggucag

SEQ ID NO: 1986381 - RNA, 18 nt, Shigella flexneri 2a str. 301
agcggguuaagcgcgcua

SEQ ID NO: 1986382 - RNA, 15 nt, Shigella flexneri 2a str. 301
agcguuuccagccag

SEQ ID NO: 1986383 - RNA, 19 nt, Shigella flexneri 2a str. 301
agcguuuuauaccaacaaa

SEQ ID NO: 1986384 - RNA, 21 nt, Shigella flexneri 2a str. 301
agcguugcccgauugguucag

SEQ ID NO: 1986385 - RNA, 14 nt, Shigella flexneri 2a str. 301
agcguugcgccugu

SEQ ID NO: 1986386 - RNA, 22 nt, Shigella flexneri 2a str. 301
agcguugaaugcaugcccggca

SEQ ID NO: 1986387 - RNA, 15 nt, Shigella flexneri 2a str. 301
agcgugacaccagca

SEQ ID NO: 1986388 - RNA, 18 nt, Shigella flexneri 2a str. 301
agcgugaaacaaaucacu

SEQ ID NO: 1986389 - RNA, 12 nt, Shigella flexneri 2a str. 301
agcgucuugaau

SEQ ID NO: 1986390 - RNA, 17 nt, Shigella flexneri 2a str. 301
agcgucuucugguuuuu

SEQ ID NO: 1986391 - RNA, 20 nt, Shigella flexneri 2a str. 301
agcuaaacagcccaaucauc

SEQ ID NO: 1986392 - RNA, 15 nt, Shigella flexneri 2a str. 301
agcuaaacagcccaa

SEQ ID NO: 1986393 - RNA, 13 nt, Shigella flexneri 2a str. 301
agcuaccagcccc

SEQ ID NO: 1986394 - RNA, 15 nt, Shigella flexneri 2a str. 301
agcuaccacgccgau

SEQ ID NO: 1986395 - RNA, 22 nt, Shigella flexneri 2a str. 301
agcgcguucuguucaaaugcgc

SEQ ID NO: 1986396 - RNA, 20 nt, Shigella flexneri 2a str. 301
agcgccuucuacagcuucac

SEQ ID NO: 1986397 - RNA, 22 nt, Shigella flexneri 2a str. 301
agcggauacaggaagcgaauca

SEQ ID NO: 1986398 - RNA, 19 nt, Shigella flexneri 2a str. 301
agcggaucaguuccagcag

SEQ ID NO: 1986399 - RNA, 14 nt, Shigella flexneri 2a str. 301
agcggagguaauaa

SEQ ID NO: 1986400 - RNA, 20 nt, Shigella flexneri 2a str. 301
agcgcuuuugcuacuuuuuu

SEQ ID NO: 1986401 - RNA, 22 nt, Shigella flexneri 2a str. 301
agcggaucgccgccggagaggg

SEQ ID NO: 1986402 - RNA, 19 nt, Shigella flexneri 2a str. 301
agcgcuaguccgggcauaa

SEQ ID NO: 1986403 - RNA, 20 nt, Shigella flexneri 2a str. 301
agcgccgcaacuaccagcag

SEQ ID NO: 1986404 - RNA, 23 nt, Shigella flexneri 2a str. 301
agcgccgccagaaucaccucuuu

SEQ ID NO: 1986405 - RNA, 16 nt, Shigella flexneri 2a str. 301
agcgcccgccagcacc

SEQ ID NO: 1986406 - RNA, 15 nt, Shigella flexneri 2a str. 301
agcgcccgcuugcga

SEQ ID NO: 1986407 - RNA, 14 nt, Shigella flexneri 2a str. 301
agcgcccugcaaug

SEQ ID NO: 1986408 - RNA, 17 nt, Shigella flexneri 2a str. 301
agcgccccgagaaguac

SEQ ID NO: 1986409 - RNA, 21 nt, Shigella flexneri 2a str. 301
agcgccucgucguuguucuac

SEQ ID NO: 1986410 - RNA, 23 nt, Shigella flexneri 2a str. 301
agcgccucggggccacagguaua

SEQ ID NO: 1986411 - RNA, 16 nt, Shigella flexneri 2a str. 301
agcgccucaagcucgc

SEQ ID NO: 1986412 - RNA, 14 nt, Shigella flexneri 2a str. 301
agcgccugcugcug

SEQ ID NO: 1986413 - RNA, 23 nt, Shigella flexneri 2a str. 301
agcgccgucaguuuuucacccgc

SEQ ID NO: 1986414 - RNA, 20 nt, Shigella flexneri 2a str. 301
agcgccgcuuuuugugcgga

SEQ ID NO: 1986415 - RNA, 15 nt, Shigella flexneri 2a str. 301
agcgcaaauugcugg

SEQ ID NO: 1986416 - RNA, 15 nt, Shigella flexneri 2a str. 301
agcgcaaauggugac

SEQ ID NO: 1986417 - RNA, 19 nt, Shigella flexneri 2a str. 301
agcgcaaaggccagcaauc

SEQ ID NO: 1986418 - RNA, 17 nt, Shigella flexneri 2a str. 301
agcgcaagggccgcagc

SEQ ID NO: 1986419 - RNA, 16 nt, Shigella flexneri 2a str. 301
agcgauuuaugauauu

SEQ ID NO: 1986420 - RNA, 15 nt, Shigella flexneri 2a str. 301
agcgauuccaguucg

SEQ ID NO: 1986421 - RNA, 18 nt, Shigella flexneri 2a str. 301
agcgauuaccauuucacc

SEQ ID NO: 1986422 - RNA, 21 nt, Shigella flexneri 2a str. 301
agcgauucccguuuauggucg

SEQ ID NO: 1986423 - RNA, 17 nt, Shigella flexneri 2a str. 301
agcgauucguugguaau

SEQ ID NO: 1986424 - RNA, 19 nt, Shigella flexneri 2a str. 301
agcgauuuugccagccgca

SEQ ID NO: 1986425 - RNA, 14 nt, Shigella flexneri 2a str. 301
agcgcagacaccag

SEQ ID NO: 1986426 - RNA, 16 nt, Shigella flexneri 2a str. 301
agcgcagauagcccgg

SEQ ID NO: 1986427 - RNA, 21 nt, Shigella flexneri 2a str. 301
agcgcacuuugucaucagucu

SEQ ID NO: 1986428 - RNA, 15 nt, Shigella flexneri 2a str. 301
agcgcagcagcgcgc

SEQ ID NO: 1986429 - RNA, 23 nt, Shigella flexneri 2a str. 301
agcgaugguacuucaaucgccac

SEQ ID NO: 1986430 - RNA, 22 nt, Shigella flexneri 2a str. 301
agcgaugguggugggggaagga

SEQ ID NO: 1986431 - RNA, 23 nt, Shigella flexneri 2a str. 301
agcgaugguggugggggaaggau

SEQ ID NO: 1986432 - RNA, 22 nt, Shigella flexneri 2a str. 301
agcgaugguacuucaaucgcca

SEQ ID NO: 1986433 - RNA, 22 nt, Shigella flexneri 2a str. 301
agcgaugcugauguacccgcug

SEQ ID NO: 1986434 - RNA, 21 nt, Shigella flexneri 2a str. 301
agcgaugcccagugaccaaag

SEQ ID NO: 1986435 - RNA, 14 nt, Shigella flexneri 2a str. 301
agcgaugaugcugu

SEQ ID NO: 1986436 - RNA, 22 nt, Shigella flexneri 2a str. 301
agcgauauccagugccagaaug

SEQ ID NO: 1986437 - RNA, 20 nt, Shigella flexneri 2a str. 301
agcgauaacguguuccaguu

SEQ ID NO: 1986438 - RNA, 14 nt, Shigella flexneri 2a str. 301
agcgcauaaaagcu

SEQ ID NO: 1986439 - RNA, 15 nt, Shigella flexneri 2a str. 301
agcgcagucaccagc

SEQ ID NO: 1986440 - RNA, 20 nt, Shigella flexneri 2a str. 301
agcgcagugacauucaccuc

SEQ ID NO: 1986441 - RNA, 21 nt, Shigella flexneri 2a str. 301
agcgcauccggcaccagcgca

SEQ ID NO: 1986442 - RNA, 16 nt, Shigella flexneri 2a str. 301
agcgcaucaggcaaug

SEQ ID NO: 1986443 - RNA, 19 nt, Shigella flexneri 2a str. 301
agcgcauuuccaagauuaa

SEQ ID NO: 1986444 - RNA, 14 nt, Shigella flexneri 2a str. 301
agcgccaccacccu

SEQ ID NO: 1986445 - RNA, 16 nt, Shigella flexneri 2a str. 301
agcgccaccaccagca

SEQ ID NO: 1986446 - RNA, 17 nt, Shigella flexneri 2a str. 301
agcgccaccaccagcac

SEQ ID NO: 1986447 - RNA, 20 nt, Shigella flexneri 2a str. 301
agcgccaccacaaaagcggu

SEQ ID NO: 1986448 - RNA, 15 nt, Shigella flexneri 2a str. 301
agcgcaucugccgga

SEQ ID NO: 1986449 - RNA, 19 nt, Shigella flexneri 2a str. 301
agcgccaguugcucgacac

SEQ ID NO: 1986450 - RNA, 16 nt, Shigella flexneri 2a str. 301
agcgccaguuuuuguu

SEQ ID NO: 1986451 - RNA, 19 nt, Shigella flexneri 2a str. 301
agcgccagcgaagccagcu

SEQ ID NO: 1986452 - RNA, 13 nt, Shigella flexneri 2a str. 301
agcgccagcgaag

SEQ ID NO: 1986453 - RNA, 19 nt, Shigella flexneri 2a str. 301
agcgccagggcaugguacc

SEQ ID NO: 1986454 - RNA, 20 nt, Shigella flexneri 2a str. 301
agcgccagcaagagcaaaua

SEQ ID NO: 1986455 - RNA, 12 nt, Shigella flexneri 2a str. 301
agcgccagcaug

SEQ ID NO: 1986456 - RNA, 20 nt, Shigella flexneri 2a str. 301
agcgccagaaguugcucaag

SEQ ID NO: 1986457 - RNA, 18 nt, Shigella flexneri 2a str. 301
agcgccagacacuggaaa

SEQ ID NO: 1986458 - RNA, 14 nt, Shigella flexneri 2a str. 301
agcgccagaaggga

SEQ ID NO: 1986459 - RNA, 16 nt, Shigella flexneri 2a str. 301
agcgccagaagggaca

SEQ ID NO: 1986460 - RNA, 14 nt, Shigella flexneri 2a str. 301
agcgccaccgguuu

SEQ ID NO: 1986461 - RNA, 15 nt, Shigella flexneri 2a str. 301
agcccgccaucgccc

SEQ ID NO: 1986462 - RNA, 22 nt, Shigella flexneri 2a str. 301
agcccgcgcgaugagccgcugg

SEQ ID NO: 1986463 - RNA, 13 nt, Shigella flexneri 2a str. 301
agcccgcagcgcc

SEQ ID NO: 1986464 - RNA, 23 nt, Shigella flexneri 2a str. 301
agcccgccaaccaccgccaguag

SEQ ID NO: 1986465 - RNA, 20 nt, Shigella flexneri 2a str. 301
agcccgauggcaucaccauc

SEQ ID NO: 1986466 - RNA, 22 nt, Shigella flexneri 2a str. 301
agccccgcgaacggggcugcca

SEQ ID NO: 1986467 - RNA, 13 nt, Shigella flexneri 2a str. 301
agccccguagcca

SEQ ID NO: 1986468 - RNA, 12 nt, Shigella flexneri 2a str. 301
agccccuccaca

SEQ ID NO: 1986469 - RNA, 18 nt, Shigella flexneri 2a str. 301
agcccucaccgaagcgag

SEQ ID NO: 1986470 - RNA, 17 nt, Shigella flexneri 2a str. 301
agcccucauuccucccc

SEQ ID NO: 1986471 - RNA, 16 nt, Shigella flexneri 2a str. 301
agcccucgacauguuc

SEQ ID NO: 1986472 - RNA, 14 nt, Shigella flexneri 2a str. 301
agcccuggaucugg

SEQ ID NO: 1986473 - RNA, 20 nt, Shigella flexneri 2a str. 301
agcccguguuucugauacag

SEQ ID NO: 1986474 - RNA, 14 nt, Shigella flexneri 2a str. 301
agcccggucaucag

SEQ ID NO: 1986475 - RNA, 16 nt, Shigella flexneri 2a str. 301
agcccgguagcaugaa

SEQ ID NO: 1986476 - RNA, 17 nt, Shigella flexneri 2a str. 301
agcccguaacucacuga

SEQ ID NO: 1986477 - RNA, 23 nt, Shigella flexneri 2a str. 301
agcccacauccaugugggcugcc

SEQ ID NO: 1986478 - RNA, 23 nt, Shigella flexneri 2a str. 301
agccauugagauagcaucuucca

SEQ ID NO: 1986479 - RNA, 11 nt, Shigella flexneri 2a str. 301
agcccagaaca

SEQ ID NO: 1986480 - RNA, 23 nt, Shigella flexneri 2a str. 301
agcccagacaaaugaacaccaaa

SEQ ID NO: 1986481 - RNA, 14 nt, Shigella flexneri 2a str. 301
agcccagaugccgg

SEQ ID NO: 1986482 - RNA, 15 nt, Shigella flexneri 2a str. 301
agcccagcaucagac

SEQ ID NO: 1986483 - RNA, 16 nt, Shigella flexneri 2a str. 301
agcccacaugccugca

SEQ ID NO: 1986484 - RNA, 20 nt, Shigella flexneri 2a str. 301
agcccaucaguacaccaccu

SEQ ID NO: 1986485 - RNA, 21 nt, Shigella flexneri 2a str. 301
agcccaugcacucgaccacgc

SEQ ID NO: 1986486 - RNA, 17 nt, Shigella flexneri 2a str. 301
agcccaguucagcggcu

SEQ ID NO: 1986487 - RNA, 22 nt, Shigella flexneri 2a str. 301
agcccaguaccgccagugcagc

SEQ ID NO: 1986488 - RNA, 14 nt, Shigella flexneri 2a str. 301
agccccaccagcaa

SEQ ID NO: 1986489 - RNA, 12 nt, Shigella flexneri 2a str. 301
agccccaguucc

SEQ ID NO: 1986490 - RNA, 23 nt, Shigella flexneri 2a str. 301
agccgccgagcaaaccacaggcc

SEQ ID NO: 1986491 - RNA, 17 nt, Shigella flexneri 2a str. 301
agccgccgcuaucggca

SEQ ID NO: 1986492 - RNA, 22 nt, Shigella flexneri 2a str. 301
agccgccgcuaucggcaaggaa

SEQ ID NO: 1986493 - RNA, 14 nt, Shigella flexneri 2a str. 301
agccgccagacaau

SEQ ID NO: 1986494 - RNA, 17 nt, Shigella flexneri 2a str. 301
agccgcgcuuucuucuu

SEQ ID NO: 1986495 - RNA, 14 nt, Shigella flexneri 2a str. 301
agccggagcuucac

SEQ ID NO: 1986496 - RNA, 17 nt, Shigella flexneri 2a str. 301
agccggacugggcgcgc

SEQ ID NO: 1986497 - RNA, 17 nt, Shigella flexneri 2a str. 301
agccggaguugcagauu

SEQ ID NO: 1986498 - RNA, 14 nt, Shigella flexneri 2a str. 301
agccggaugucugg

SEQ ID NO: 1986499 - RNA, 14 nt, Shigella flexneri 2a str. 301
agccgcuucugcag

SEQ ID NO: 1986500 - RNA, 15 nt, Shigella flexneri 2a str. 301
agccggacccacacc

SEQ ID NO: 1986501 - RNA, 21 nt, Shigella flexneri 2a str. 301
agccggaaaaccaccacuccc

SEQ ID NO: 1986502 - RNA, 20 nt, Shigella flexneri 2a str. 301
agcccuuuaauggcuuucau

SEQ ID NO: 1986503 - RNA, 17 nt, Shigella flexneri 2a str. 301
agcccuggcucugcacu

SEQ ID NO: 1986504 - RNA, 12 nt, Shigella flexneri 2a str. 301
agcccuucacgc

SEQ ID NO: 1986505 - RNA, 22 nt, Shigella flexneri 2a str. 301
agcccuucguaggccagauaag

SEQ ID NO: 1986506 - RNA, 17 nt, Shigella flexneri 2a str. 301
agcccuucgccauuccu

SEQ ID NO: 1986507 - RNA, 16 nt, Shigella flexneri 2a str. 301
agcccuugccgaugcg

SEQ ID NO: 1986508 - RNA, 14 nt, Shigella flexneri 2a str. 301
agccgaccgcaagg

SEQ ID NO: 1986509 - RNA, 21 nt, Shigella flexneri 2a str. 301
agccgaccauugccaguaaca

SEQ ID NO: 1986510 - RNA, 23 nt, Shigella flexneri 2a str. 301
agccgaagccguuagucaucauc

SEQ ID NO: 1986511 - RNA, 17 nt, Shigella flexneri 2a str. 301
agccgacaaugccacaa

SEQ ID NO: 1986512 - RNA, 16 nt, Shigella flexneri 2a str. 301
agccgcagccaucagc

SEQ ID NO: 1986513 - RNA, 12 nt, Shigella flexneri 2a str. 301
agccgauuaaaa

SEQ ID NO: 1986514 - RNA, 21 nt, Shigella flexneri 2a str. 301
agccgauuaaucuuccagauc

SEQ ID NO: 1986515 - RNA, 13 nt, Shigella flexneri 2a str. 301
agccgcaaaccug

SEQ ID NO: 1986516 - RNA, 16 nt, Shigella flexneri 2a str. 301
agccgcaaacuccgug

SEQ ID NO: 1986517 - RNA, 15 nt, Shigella flexneri 2a str. 301
agccgaugccgcugc

SEQ ID NO: 1986518 - RNA, 16 nt, Shigella flexneri 2a str. 301
agccuuccuugugcaa

SEQ ID NO: 1986519 - RNA, 14 nt, Shigella flexneri 2a str. 301
agccuucagugccg

SEQ ID NO: 1986520 - RNA, 15 nt, Shigella flexneri 2a str. 301
agccuucagugccgu

SEQ ID NO: 1986521 - RNA, 18 nt, Shigella flexneri 2a str. 301
agccugugucaggccggc

SEQ ID NO: 1986522 - RNA, 19 nt, Shigella flexneri 2a str. 301
agccugugucaggccggca

SEQ ID NO: 1986523 - RNA, 17 nt, Shigella flexneri 2a str. 301
agccuguaccacaaccu

SEQ ID NO: 1986524 - RNA, 16 nt, Shigella flexneri 2a str. 301
agccuguccacaccca

SEQ ID NO: 1986525 - RNA, 19 nt, Shigella flexneri 2a str. 301
agccugcuguccggcgaga

SEQ ID NO: 1986526 - RNA, 21 nt, Shigella flexneri 2a str. 301
agccuucgccaccguguucau

SEQ ID NO: 1986527 - RNA, 22 nt, Shigella flexneri 2a str. 301
agccuucgcgcaaccaacggcc

SEQ ID NO: 1986528 - RNA, 21 nt, Shigella flexneri 2a str. 301
agccuucggacguuugccaug

SEQ ID NO: 1986529 - RNA, 22 nt, Shigella flexneri 2a str. 301
agccuucgggcuggcauuuuuu

SEQ ID NO: 1986530 - RNA, 19 nt, Shigella flexneri 2a str. 301
agcgaaacauacaggcuaa

SEQ ID NO: 1986531 - RNA, 21 nt, Shigella flexneri 2a str. 301
agcgaaaaagucccuucccag

SEQ ID NO: 1986532 - RNA, 18 nt, Shigella flexneri 2a str. 301
agccuuuuucagccgcaa

SEQ ID NO: 1986533 - RNA, 19 nt, Shigella flexneri 2a str. 301
agcgacuugucgcccguca

SEQ ID NO: 1986534 - RNA, 19 nt, Shigella flexneri 2a str. 301
agcgacucgguugcacaga

SEQ ID NO: 1986535 - RNA, 16 nt, Shigella flexneri 2a str. 301
agcgacucucugagcc

SEQ ID NO: 1986536 - RNA, 21 nt, Shigella flexneri 2a str. 301
agcgacgggcgacaaacgcug

SEQ ID NO: 1986537 - RNA, 18 nt, Shigella flexneri 2a str. 301
agcgaccauacagcagca

SEQ ID NO: 1986538 - RNA, 14 nt, Shigella flexneri 2a str. 301
agcgaaugaaagaa

SEQ ID NO: 1986539 - RNA, 14 nt, Shigella flexneri 2a str. 301
agcgaauuccaguu

SEQ ID NO: 1986540 - RNA, 12 nt, Shigella flexneri 2a str. 301
agcgaauuuuuc

SEQ ID NO: 1986541 - RNA, 19 nt, Shigella flexneri 2a str. 301
agcgacagggccaggaauc

SEQ ID NO: 1986542 - RNA, 20 nt, Shigella flexneri 2a str. 301
agcgacaggucagcgccugg

SEQ ID NO: 1986543 - RNA, 21 nt, Shigella flexneri 2a str. 301
agcgaacaggaguagcucugg

SEQ ID NO: 1986544 - RNA, 15 nt, Shigella flexneri 2a str. 301
agcgaagcccacgcc

SEQ ID NO: 1986545 - RNA, 21 nt, Shigella flexneri 2a str. 301
agcgaauaccgggcaguacca

SEQ ID NO: 1986546 - RNA, 14 nt, Shigella flexneri 2a str. 301
agcgaaggaucacc

SEQ ID NO: 1986547 - RNA, 17 nt, Shigella flexneri 2a str. 301
agcgaagcggcacugcu

SEQ ID NO: 1986548 - RNA, 17 nt, Shigella flexneri 2a str. 301
agcgaagcgaacaucga

SEQ ID NO: 1986549 - RNA, 23 nt, Shigella flexneri 2a str. 301
agccuaagccauuuaacucaccg

SEQ ID NO: 1986550 - RNA, 14 nt, Shigella flexneri 2a str. 301
agccuauaacgaaa

SEQ ID NO: 1986551 - RNA, 13 nt, Shigella flexneri 2a str. 301
agccuaccagacc

SEQ ID NO: 1986552 - RNA, 18 nt, Shigella flexneri 2a str. 301
agccuaccagaccgcaca

SEQ ID NO: 1986553 - RNA, 19 nt, Shigella flexneri 2a str. 301
agccucacgguucauuagu

SEQ ID NO: 1986554 - RNA, 15 nt, Shigella flexneri 2a str. 301
agccucaaauuccuu

SEQ ID NO: 1986555 - RNA, 21 nt, Shigella flexneri 2a str. 301
agccuaucgucauuuugguca

SEQ ID NO: 1986556 - RNA, 14 nt, Shigella flexneri 2a str. 301
agccucccauuucc

SEQ ID NO: 1986557 - RNA, 22 nt, Shigella flexneri 2a str. 301
agccugcagugaaauuaaacug

SEQ ID NO: 1986558 - RNA, 18 nt, Shigella flexneri 2a str. 301
agccugauacaggaaggc

SEQ ID NO: 1986559 - RNA, 19 nt, Shigella flexneri 2a str. 301
agccugauacaggaaggcc

SEQ ID NO: 1986560 - RNA, 14 nt, Shigella flexneri 2a str. 301
agccugaugaugag

SEQ ID NO: 1986561 - RNA, 14 nt, Shigella flexneri 2a str. 301
agccugccagcaug

SEQ ID NO: 1986562 - RNA, 19 nt, Shigella flexneri 2a str. 301
agccugccaucuggcaggc

SEQ ID NO: 1986563 - RNA, 22 nt, Shigella flexneri 2a str. 301
agccugccauuggcaggcucug

SEQ ID NO: 1986564 - RNA, 21 nt, Shigella flexneri 2a str. 301
agccugacgcccguuuucacc

SEQ ID NO: 1986565 - RNA, 15 nt, Shigella flexneri 2a str. 301
agccugaaaacgaaa

SEQ ID NO: 1986566 - RNA, 22 nt, Shigella flexneri 2a str. 301
agccugaacuaaagccuuuugc

SEQ ID NO: 1986567 - RNA, 13 nt, Shigella flexneri 2a str. 301
agccucgccgagc

SEQ ID NO: 1986568 - RNA, 19 nt, Shigella flexneri 2a str. 301
agccguacugcauaaugcc

SEQ ID NO: 1986569 - RNA, 12 nt, Shigella flexneri 2a str. 301
agccgguuuugg

SEQ ID NO: 1986570 - RNA, 23 nt, Shigella flexneri 2a str. 301
agccgguugccugaugcgacgcu

SEQ ID NO: 1986571 - RNA, 17 nt, Shigella flexneri 2a str. 301
agccggugcuugcaccg

SEQ ID NO: 1986572 - RNA, 21 nt, Shigella flexneri 2a str. 301
agccguaggucggauaagacg

SEQ ID NO: 1986573 - RNA, 16 nt, Shigella flexneri 2a str. 301
agccgugaaucacucc

SEQ ID NO: 1986574 - RNA, 18 nt, Shigella flexneri 2a str. 301
agccgugaaucacuccau

SEQ ID NO: 1986575 - RNA, 14 nt, Shigella flexneri 2a str. 301
agccgugccacagg

SEQ ID NO: 1986576 - RNA, 13 nt, Shigella flexneri 2a str. 301
agccgggaagaau

SEQ ID NO: 1986577 - RNA, 19 nt, Shigella flexneri 2a str. 301
agccgguaacguccaucac

SEQ ID NO: 1986578 - RNA, 22 nt, Shigella flexneri 2a str. 301
agcuggcgacgccucuauuaaa

SEQ ID NO: 1986579 - RNA, 16 nt, Shigella flexneri 2a str. 301
agcuggcgauauuauc

SEQ ID NO: 1986580 - RNA, 15 nt, Shigella flexneri 2a str. 301
aguacgaaauaacug

SEQ ID NO: 1986581 - RNA, 19 nt, Shigella flexneri 2a str. 301
aguacgcguacacuuuccu

SEQ ID NO: 1986582 - RNA, 13 nt, Shigella flexneri 2a str. 301
aguacggcagcaa

SEQ ID NO: 1986583 - RNA, 15 nt, Shigella flexneri 2a str. 301
aguacggcagcaauc

SEQ ID NO: 1986584 - RNA, 14 nt, Shigella flexneri 2a str. 301
aguacggccacugg

SEQ ID NO: 1986585 - RNA, 21 nt, Shigella flexneri 2a str. 301
aguacgcccacgccagccugc

SEQ ID NO: 1986586 - RNA, 20 nt, Shigella flexneri 2a str. 301
aguacgcccacgccagccug

SEQ ID NO: 1986587 - RNA, 19 nt, Shigella flexneri 2a str. 301
aguacgccaaucugcaaaa

SEQ ID NO: 1986588 - RNA, 18 nt, Shigella flexneri 2a str. 301
aguacgcguacacuuucc

SEQ ID NO: 1986589 - RNA, 23 nt, Shigella flexneri 2a str. 301
aguacugugaaccucgaucagag

SEQ ID NO: 1986590 - RNA, 20 nt, Shigella flexneri 2a str. 301
aguacugaugaauaaauaca

SEQ ID NO: 1986591 - RNA, 18 nt, Shigella flexneri 2a str. 301
aguacuuuggaaguauaa

SEQ ID NO: 1986592 - RNA, 14 nt, Shigella flexneri 2a str. 301
aguacuuuggaagu

SEQ ID NO: 1986593 - RNA, 15 nt, Shigella flexneri 2a str. 301
aguagaaauuauuuc

SEQ ID NO: 1986594 - RNA, 22 nt, Shigella flexneri 2a str. 301
aguagaauaaucuguuuuucau

SEQ ID NO: 1986595 - RNA, 17 nt, Shigella flexneri 2a str. 301
aguagauucaacauaau

SEQ ID NO: 1986596 - RNA, 10 nt, Shigella flexneri 2a str. 301
aguagcaaag

SEQ ID NO: 1986597 - RNA, 20 nt, Shigella flexneri 2a str. 301
aguagcccaccuacaccggc

SEQ ID NO: 1986598 - RNA, 15 nt, Shigella flexneri 2a str. 301
aguagccaguaccac

SEQ ID NO: 1986599 - RNA, 14 nt, Shigella flexneri 2a str. 301
aguagccauuugau

SEQ ID NO: 1986600 - RNA, 20 nt, Shigella flexneri 2a str. 301
aguagccaauaccaaaauca

SEQ ID NO: 1986601 - RNA, 12 nt, Shigella flexneri 2a str. 301
aguagcggguga

SEQ ID NO: 1986602 - RNA, 16 nt, Shigella flexneri 2a str. 301
aguagcgucgccagca

SEQ ID NO: 1986603 - RNA, 16 nt, Shigella flexneri 2a str. 301
aguagcaaucggcuuu

SEQ ID NO: 1986604 - RNA, 17 nt, Shigella flexneri 2a str. 301
aguagguagaauauuuu

SEQ ID NO: 1986605 - RNA, 16 nt, Shigella flexneri 2a str. 301
aguagggcugauaaac

SEQ ID NO: 1986606 - RNA, 23 nt, Shigella flexneri 2a str. 301
aguagugauuuuaauaaaucacg

SEQ ID NO: 1986607 - RNA, 17 nt, Shigella flexneri 2a str. 301
aguaguucauccagugc

SEQ ID NO: 1986608 - RNA, 18 nt, Shigella flexneri 2a str. 301
aguaguguagcacuugca

SEQ ID NO: 1986609 - RNA, 14 nt, Shigella flexneri 2a str. 301
aguauaaguaauga

SEQ ID NO: 1986610 - RNA, 15 nt, Shigella flexneri 2a str. 301
aguauaacuacugau

SEQ ID NO: 1986611 - RNA, 16 nt, Shigella flexneri 2a str. 301
aguauacgccacauca

SEQ ID NO: 1986612 - RNA, 17 nt, Shigella flexneri 2a str. 301
aguauacgccacaucau

SEQ ID NO: 1986613 - RNA, 14 nt, Shigella flexneri 2a str. 301
aguauagcggcaug

SEQ ID NO: 1986614 - RNA, 23 nt, Shigella flexneri 2a str. 301
agucacguuguaccacugguuga

SEQ ID NO: 1986615 - RNA, 22 nt, Shigella flexneri 2a str. 301
agucagacccugcucuuucagc

SEQ ID NO: 1986616 - RNA, 12 nt, Shigella flexneri 2a str. 301
agucacuucaca

SEQ ID NO: 1986617 - RNA, 13 nt, Shigella flexneri 2a str. 301
agucacuuuacga

SEQ ID NO: 1986618 - RNA, 19 nt, Shigella flexneri 2a str. 301
agucacuuuacgaccagcc

SEQ ID NO: 1986619 - RNA, 16 nt, Shigella flexneri 2a str. 301
agucagcgaacaccag

SEQ ID NO: 1986620 - RNA, 15 nt, Shigella flexneri 2a str. 301
agucagcccaacaaa

SEQ ID NO: 1986621 - RNA, 14 nt, Shigella flexneri 2a str. 301
agucagaaacugua

SEQ ID NO: 1986622 - RNA, 21 nt, Shigella flexneri 2a str. 301
agucaguguuaucaaaucacc

SEQ ID NO: 1986623 - RNA, 16 nt, Shigella flexneri 2a str. 301
agucaguggcagcaaa

SEQ ID NO: 1986624 - RNA, 17 nt, Shigella flexneri 2a str. 301
agucagucucaagggag

SEQ ID NO: 1986625 - RNA, 17 nt, Shigella flexneri 2a str. 301
agucauaaccaguccau

SEQ ID NO: 1986626 - RNA, 19 nt, Shigella flexneri 2a str. 301
agucaaaagccuccgaccg

SEQ ID NO: 1986627 - RNA, 22 nt, Shigella flexneri 2a str. 301
agucaacgucauuaucugcaga

SEQ ID NO: 1986628 - RNA, 14 nt, Shigella flexneri 2a str. 301
agucaccagcauca

SEQ ID NO: 1986629 - RNA, 16 nt, Shigella flexneri 2a str. 301
agucacgacaaagaca

SEQ ID NO: 1986630 - RNA, 14 nt, Shigella flexneri 2a str. 301
agucacaaacauca

SEQ ID NO: 1986631 - RNA, 15 nt, Shigella flexneri 2a str. 301
agucacaaacaucau

SEQ ID NO: 1986632 - RNA, 16 nt, Shigella flexneri 2a str. 301
agucacaccagcgaug

SEQ ID NO: 1986633 - RNA, 23 nt, Shigella flexneri 2a str. 301
agucaaugaaauuacuuuccauc

SEQ ID NO: 1986634 - RNA, 13 nt, Shigella flexneri 2a str. 301
aguauccacacca

SEQ ID NO: 1986635 - RNA, 14 nt, Shigella flexneri 2a str. 301
aguauccacaggua

SEQ ID NO: 1986636 - RNA, 11 nt, Shigella flexneri 2a str. 301
aguaucaucau

SEQ ID NO: 1986637 - RNA, 15 nt, Shigella flexneri 2a str. 301
aguaucaauuauaug

SEQ ID NO: 1986638 - RNA, 18 nt, Shigella flexneri 2a str. 301
aguauccacacagacaau

SEQ ID NO: 1986639 - RNA, 14 nt, Shigella flexneri 2a str. 301
aguaucggcaaggu

SEQ ID NO: 1986640 - RNA, 17 nt, Shigella flexneri 2a str. 301
aguaugacaacuuucau

SEQ ID NO: 1986641 - RNA, 16 nt, Shigella flexneri 2a str. 301
aguaugagcaaacaau

SEQ ID NO: 1986642 - RNA, 13 nt, Shigella flexneri 2a str. 301
aguaugaucuugc

SEQ ID NO: 1986643 - RNA, 19 nt, Shigella flexneri 2a str. 301
aguaugacuuuaugcugaa

SEQ ID NO: 1986644 - RNA, 14 nt, Shigella flexneri 2a str. 301
aguaugcaauaaca

SEQ ID NO: 1986645 - RNA, 15 nt, Shigella flexneri 2a str. 301
aguaugcgcgucaga

SEQ ID NO: 1986646 - RNA, 18 nt, Shigella flexneri 2a str. 301
aguauggaucaaaucucg

SEQ ID NO: 1986647 - RNA, 11 nt, Shigella flexneri 2a str. 301
aguaucuauuc

SEQ ID NO: 1986648 - RNA, 17 nt, Shigella flexneri 2a str. 301
aguaucugaaucaaaau

SEQ ID NO: 1986649 - RNA, 14 nt, Shigella flexneri 2a str. 301
aguaucuauucauc

SEQ ID NO: 1986650 - RNA, 16 nt, Shigella flexneri 2a str. 301
aguaucuauucaucaa

SEQ ID NO: 1986651 - RNA, 22 nt, Shigella flexneri 2a str. 301
aguauuaagccaguucucacca

SEQ ID NO: 1986652 - RNA, 15 nt, Shigella flexneri 2a str. 301
aguauuaccggcaga

SEQ ID NO: 1986653 - RNA, 18 nt, Shigella flexneri 2a str. 301
aguauugcgcaaauguuu

SEQ ID NO: 1986654 - RNA, 18 nt, Shigella flexneri 2a str. 301
aguauucgcuccccugca

SEQ ID NO: 1986655 - RNA, 19 nt, Shigella flexneri 2a str. 301
aguauuuggcggaauuucu

SEQ ID NO: 1986656 - RNA, 23 nt, Shigella flexneri 2a str. 301
aguauuuuuaaccguauuuuggu

SEQ ID NO: 1986657 - RNA, 14 nt, Shigella flexneri 2a str. 301
aguccgccuucaac

SEQ ID NO: 1986658 - RNA, 14 nt, Shigella flexneri 2a str. 301
agucccuuucaggu

SEQ ID NO: 1986659 - RNA, 22 nt, Shigella flexneri 2a str. 301
agucccuuucccaccggcaaug

SEQ ID NO: 1986660 - RNA, 18 nt, Shigella flexneri 2a str. 301
agucccggcaagauucca

SEQ ID NO: 1986661 - RNA, 18 nt, Shigella flexneri 2a str. 301
agucccguacccagcaag

SEQ ID NO: 1986662 - RNA, 14 nt, Shigella flexneri 2a str. 301
agucccggcaagau

SEQ ID NO: 1986663 - RNA, 19 nt, Shigella flexneri 2a str. 301
agucgcuccugccacauau

SEQ ID NO: 1986664 - RNA, 16 nt, Shigella flexneri 2a str. 301
agucgcuugcaggauc

SEQ ID NO: 1986665 - RNA, 17 nt, Shigella flexneri 2a str. 301
aguccuguugucuuucc

SEQ ID NO: 1986666 - RNA, 13 nt, Shigella flexneri 2a str. 301
agucgacuucaga

SEQ ID NO: 1986667 - RNA, 22 nt, Shigella flexneri 2a str. 301
agucgaugaugcagccagugau

SEQ ID NO: 1986668 - RNA, 23 nt, Shigella flexneri 2a str. 301
agucgcaacggcuuuggcaaacc

SEQ ID NO: 1986669 - RNA, 22 nt, Shigella flexneri 2a str. 301
aguccagccccgcgcggcgcag

SEQ ID NO: 1986670 - RNA, 15 nt, Shigella flexneri 2a str. 301
aguccagcgccugaa

SEQ ID NO: 1986671 - RNA, 17 nt, Shigella flexneri 2a str. 301
aguccagcgccugaaau

SEQ ID NO: 1986672 - RNA, 16 nt, Shigella flexneri 2a str. 301
aguccaggcugcaaag

SEQ ID NO: 1986673 - RNA, 19 nt, Shigella flexneri 2a str. 301
aguccaggcugcaaagucu

SEQ ID NO: 1986674 - RNA, 20 nt, Shigella flexneri 2a str. 301
aguccaugucgguacagagc

SEQ ID NO: 1986675 - RNA, 23 nt, Shigella flexneri 2a str. 301
aguccccacgccauaccugcaca

SEQ ID NO: 1986676 - RNA, 14 nt, Shigella flexneri 2a str. 301
aguccccaguaauc

SEQ ID NO: 1986677 - RNA, 12 nt, Shigella flexneri 2a str. 301
agucccaguuca

SEQ ID NO: 1986678 - RNA, 20 nt, Shigella flexneri 2a str. 301
agucauccuuaaagaaaaag

SEQ ID NO: 1986679 - RNA, 21 nt, Shigella flexneri 2a str. 301
agucauccucucgggcgguua

SEQ ID NO: 1986680 - RNA, 13 nt, Shigella flexneri 2a str. 301
agucauccggcgu

SEQ ID NO: 1986681 - RNA, 16 nt, Shigella flexneri 2a str. 301
agucaucgcuuucgga

SEQ ID NO: 1986682 - RNA, 13 nt, Shigella flexneri 2a str. 301
agucaucaucagg

SEQ ID NO: 1986683 - RNA, 15 nt, Shigella flexneri 2a str. 301
agucaucagucugag

SEQ ID NO: 1986684 - RNA, 16 nt, Shigella flexneri 2a str. 301
agucaucacuuucaga

SEQ ID NO: 1986685 - RNA, 14 nt, Shigella flexneri 2a str. 301
agucauauuucugu

SEQ ID NO: 1986686 - RNA, 20 nt, Shigella flexneri 2a str. 301
agucauguuguuccuuuuau

SEQ ID NO: 1986687 - RNA, 19 nt, Shigella flexneri 2a str. 301
agucauuaccgaacaacaa

SEQ ID NO: 1986688 - RNA, 21 nt, Shigella flexneri 2a str. 301
agucauuaccugaaaaaacaa

SEQ ID NO: 1986689 - RNA, 22 nt, Shigella flexneri 2a str. 301
agucauuaccugaaaaaacaaa

SEQ ID NO: 1986690 - RNA, 16 nt, Shigella flexneri 2a str. 301
agucauuaugcuggaa

SEQ ID NO: 1986691 - RNA, 15 nt, Shigella flexneri 2a str. 301
agucauuccggcccc

SEQ ID NO: 1986692 - RNA, 14 nt, Shigella flexneri 2a str. 301
agucauuccuucaa

SEQ ID NO: 1986693 - RNA, 18 nt, Shigella flexneri 2a str. 301
agucauugagcuucucga

SEQ ID NO: 1986694 - RNA, 17 nt, Shigella flexneri 2a str. 301
agugcgguaaauuuuuu

SEQ ID NO: 1986695 - RNA, 18 nt, Shigella flexneri 2a str. 301
agugcuuucugaacugaa

SEQ ID NO: 1986696 - RNA, 22 nt, Shigella flexneri 2a str. 301
agugcuucgcggacaucgucca

SEQ ID NO: 1986697 - RNA, 22 nt, Shigella flexneri 2a str. 301
agugcuucuccguguucgucac

SEQ ID NO: 1986698 - RNA, 16 nt, Shigella flexneri 2a str. 301
agugcugccaucuucu

SEQ ID NO: 1986699 - RNA, 13 nt, Shigella flexneri 2a str. 301
agugcccccaacu

SEQ ID NO: 1986700 - RNA, 19 nt, Shigella flexneri 2a str. 301
agugcccgaccacuucaug

SEQ ID NO: 1986701 - RNA, 18 nt, Shigella flexneri 2a str. 301
agugcaaucaguggugua

SEQ ID NO: 1986702 - RNA, 20 nt, Shigella flexneri 2a str. 301
agugcacgaaccagagacag

SEQ ID NO: 1986703 - RNA, 22 nt, Shigella flexneri 2a str. 301
agugcaaaugccagauaagaca

SEQ ID NO: 1986704 - RNA, 16 nt, Shigella flexneri 2a str. 301
agugcaaaugccagau

SEQ ID NO: 1986705 - RNA, 13 nt, Shigella flexneri 2a str. 301
agugcaaauccac

SEQ ID NO: 1986706 - RNA, 19 nt, Shigella flexneri 2a str. 301
agugauuaacgcuuguaaa

SEQ ID NO: 1986707 - RNA, 15 nt, Shigella flexneri 2a str. 301
agugauuaacagcgc

SEQ ID NO: 1986708 - RNA, 22 nt, Shigella flexneri 2a str. 301
agugaugguggugggggaagga

SEQ ID NO: 1986709 - RNA, 23 nt, Shigella flexneri 2a str. 301
agugaugguggugggggaaggau

SEQ ID NO: 1986710 - RNA, 18 nt, Shigella flexneri 2a str. 301
agugaugccauacuucau

SEQ ID NO: 1986711 - RNA, 15 nt, Shigella flexneri 2a str. 301
agugaugaaaacgaa

SEQ ID NO: 1986712 - RNA, 18 nt, Shigella flexneri 2a str. 301
agugaugaaaacgaaggc

SEQ ID NO: 1986713 - RNA, 18 nt, Shigella flexneri 2a str. 301
agugaguaucaauuauau

SEQ ID NO: 1986714 - RNA, 20 nt, Shigella flexneri 2a str. 301
agugaaucgggaccagcauu

SEQ ID NO: 1986715 - RNA, 16 nt, Shigella flexneri 2a str. 301
agugaagucgggcaga

SEQ ID NO: 1986716 - RNA, 18 nt, Shigella flexneri 2a str. 301
agugaggcuauuccacgc

SEQ ID NO: 1986717 - RNA, 15 nt, Shigella flexneri 2a str. 301
agugaaauuuugggc

SEQ ID NO: 1986718 - RNA, 13 nt, Shigella flexneri 2a str. 301
agugaaauuaaac

SEQ ID NO: 1986719 - RNA, 21 nt, Shigella flexneri 2a str. 301
agugaaagaggcggagguuuu

SEQ ID NO: 1986720 - RNA, 22 nt, Shigella flexneri 2a str. 301
agucgucugucgggaacacuuu

SEQ ID NO: 1986721 - RNA, 16 nt, Shigella flexneri 2a str. 301
agucuccauuuuuuug

SEQ ID NO: 1986722 - RNA, 16 nt, Shigella flexneri 2a str. 301
auaaauuucugccauu

SEQ ID NO: 1986723 - RNA, 23 nt, Shigella flexneri 2a str. 301
auaaauugcuguaaauucucaau

SEQ ID NO: 1986724 - RNA, 22 nt, Shigella flexneri 2a str. 301
auaacgccaauucauuccuuga

SEQ ID NO: 1986725 - RNA, 10 nt, Shigella flexneri 2a str. 301
auaaccaucg

SEQ ID NO: 1986726 - RNA, 15 nt, Shigella flexneri 2a str. 301
auaaccaucagcugu

SEQ ID NO: 1986727 - RNA, 15 nt, Shigella flexneri 2a str. 301
auaaccauauaugau

SEQ ID NO: 1986728 - RNA, 18 nt, Shigella flexneri 2a str. 301
auaaccugugcaccagaa

SEQ ID NO: 1986729 - RNA, 21 nt, Shigella flexneri 2a str. 301
auaaccaauguggguguuaag

SEQ ID NO: 1986730 - RNA, 10 nt, Shigella flexneri 2a str. 301
auaaaucccg

SEQ ID NO: 1986731 - RNA, 16 nt, Shigella flexneri 2a str. 301
auaaauccaucgggcu

SEQ ID NO: 1986732 - RNA, 22 nt, Shigella flexneri 2a str. 301
auaaauccaacaacacauucaa

SEQ ID NO: 1986733 - RNA, 11 nt, Shigella flexneri 2a str. 301
auaaaucagau

SEQ ID NO: 1986734 - RNA, 13 nt, Shigella flexneri 2a str. 301
auaaauggcgaac

SEQ ID NO: 1986735 - RNA, 20 nt, Shigella flexneri 2a str. 301
auaaauauauaaaaaaacaa

SEQ ID NO: 1986736 - RNA, 18 nt, Shigella flexneri 2a str. 301
auaaauacagcguuaaaa

SEQ ID NO: 1986737 - RNA, 15 nt, Shigella flexneri 2a str. 301
auaaauauauaaaaa

SEQ ID NO: 1986738 - RNA, 15 nt, Shigella flexneri 2a str. 301
auaaauaucaaagac

SEQ ID NO: 1986739 - RNA, 20 nt, Shigella flexneri 2a str. 301
auaaauauaaucaacaugau

SEQ ID NO: 1986740 - RNA, 23 nt, Shigella flexneri 2a str. 301
auaaauagauccaggaacagaag

SEQ ID NO: 1986741 - RNA, 18 nt, Shigella flexneri 2a str. 301
auaaauacuccauaacua

SEQ ID NO: 1986742 - RNA, 22 nt, Shigella flexneri 2a str. 301
auaaagacguuaacuacaauca

SEQ ID NO: 1986743 - RNA, 23 nt, Shigella flexneri 2a str. 301
auaaacaucagcuauucuuauaa

SEQ ID NO: 1986744 - RNA, 15 nt, Shigella flexneri 2a str. 301
auaaacaucagcuau

SEQ ID NO: 1986745 - RNA, 14 nt, Shigella flexneri 2a str. 301
auaaacagggcuuu

SEQ ID NO: 1986746 - RNA, 19 nt, Shigella flexneri 2a str. 301
auaaacaucgggacaugau

SEQ ID NO: 1986747 - RNA, 11 nt, Shigella flexneri 2a str. 301
auaaacagcag

SEQ ID NO: 1986748 - RNA, 15 nt, Shigella flexneri 2a str. 301
auaaacaccagcaau

SEQ ID NO: 1986749 - RNA, 22 nt, Shigella flexneri 2a str. 301
auaaacgccggaugacacauca

SEQ ID NO: 1986750 - RNA, 21 nt, Shigella flexneri 2a str. 301
auaaacgccgucaucacaccg

SEQ ID NO: 1986751 - RNA, 22 nt, Shigella flexneri 2a str. 301
auaaacgccauauucugaucgu

SEQ ID NO: 1986752 - RNA, 16 nt, Shigella flexneri 2a str. 301
auaaagaaaaucugaa

SEQ ID NO: 1986753 - RNA, 21 nt, Shigella flexneri 2a str. 301
auaaacuuuucccuacugcug

SEQ ID NO: 1986754 - RNA, 20 nt, Shigella flexneri 2a str. 301
auaaacgguuucagcagcgg

SEQ ID NO: 1986755 - RNA, 22 nt, Shigella flexneri 2a str. 301
auaaacggucuacauugcucau

SEQ ID NO: 1986756 - RNA, 22 nt, Shigella flexneri 2a str. 301
auaaacguacauccaugcacuc

SEQ ID NO: 1986757 - RNA, 18 nt, Shigella flexneri 2a str. 301
auaaaaugauuucgcaac

SEQ ID NO: 1986758 - RNA, 15 nt, Shigella flexneri 2a str. 301
auaaaauucauucaa

SEQ ID NO: 1986759 - RNA, 22 nt, Shigella flexneri 2a str. 301
auaaaaucuauuauuauuuuug

SEQ ID NO: 1986760 - RNA, 17 nt, Shigella flexneri 2a str. 301
auaaaagcccugggcac

SEQ ID NO: 1986761 - RNA, 13 nt, Shigella flexneri 2a str. 301
auaaaagaaaaaa

SEQ ID NO: 1986762 - RNA, 12 nt, Shigella flexneri 2a str. 301
auaaaacuuccc

SEQ ID NO: 1986763 - RNA, 15 nt, Shigella flexneri 2a str. 301
auaaaauaaccacaa

SEQ ID NO: 1986764 - RNA, 19 nt, Shigella flexneri 2a str. 301
auaaaaggcaccuggaaau

SEQ ID NO: 1986765 - RNA, 21 nt, Shigella flexneri 2a str. 301
auaaaacguugucaguucuuu

SEQ ID NO: 1986766 - RNA, 21 nt, Shigella flexneri 2a str. 301
auaaaacgcagucuucccagc

SEQ ID NO: 1986767 - RNA, 19 nt, Shigella flexneri 2a str. 301
auaaaacgcagucuuccca

SEQ ID NO: 1986768 - RNA, 22 nt, Shigella flexneri 2a str. 301
auaaaacaacggaacgaaaaaa

SEQ ID NO: 1986769 - RNA, 10 nt, Shigella flexneri 2a str. 301
auaaaacauc

SEQ ID NO: 1986770 - RNA, 13 nt, Shigella flexneri 2a str. 301
auaaaacagggcg

SEQ ID NO: 1986771 - RNA, 21 nt, Shigella flexneri 2a str. 301
auaaaaauccgccagaaauca

SEQ ID NO: 1986772 - RNA, 21 nt, Shigella flexneri 2a str. 301
aguucauccccucuuccauuu

SEQ ID NO: 1986773 - RNA, 15 nt, Shigella flexneri 2a str. 301
aguucauuaagcugc

SEQ ID NO: 1986774 - RNA, 16 nt, Shigella flexneri 2a str. 301
aguucauccccucuuc

SEQ ID NO: 1986775 - RNA, 13 nt, Shigella flexneri 2a str. 301
aguucccccugcc

SEQ ID NO: 1986776 - RNA, 14 nt, Shigella flexneri 2a str. 301
aguucagcggcuga

SEQ ID NO: 1986777 - RNA, 12 nt, Shigella flexneri 2a str. 301
aguucaucaacg

SEQ ID NO: 1986778 - RNA, 14 nt, Shigella flexneri 2a str. 301
aguucauccagugc

SEQ ID NO: 1986779 - RNA, 19 nt, Shigella flexneri 2a str. 301
aguucauccagugcuucaa

SEQ ID NO: 1986780 - RNA, 22 nt, Shigella flexneri 2a str. 301
aguuccgggaucugauucugau

SEQ ID NO: 1986781 - RNA, 17 nt, Shigella flexneri 2a str. 301
aguuccgggaucaccag

SEQ ID NO: 1986782 - RNA, 14 nt, Shigella flexneri 2a str. 301
aguuccggguuuuc

SEQ ID NO: 1986783 - RNA, 14 nt, Shigella flexneri 2a str. 301
aguuccggcaucga

SEQ ID NO: 1986784 - RNA, 23 nt, Shigella flexneri 2a str. 301
aguuccgcuucgccaaugugggu

SEQ ID NO: 1986785 - RNA, 22 nt, Shigella flexneri 2a str. 301
aguucgaucucuucgccugccu

SEQ ID NO: 1986786 - RNA, 19 nt, Shigella flexneri 2a str. 301
aguucgcgcgcugccagaa

SEQ ID NO: 1986787 - RNA, 17 nt, Shigella flexneri 2a str. 301
aguuacagcucucacuu

SEQ ID NO: 1986788 - RNA, 13 nt, Shigella flexneri 2a str. 301
aguuacacaucau

SEQ ID NO: 1986789 - RNA, 11 nt, Shigella flexneri 2a str. 301
aguuauucauu

SEQ ID NO: 1986790 - RNA, 15 nt, Shigella flexneri 2a str. 301
aguuauugcgcugcu

SEQ ID NO: 1986791 - RNA, 20 nt, Shigella flexneri 2a str. 301
aguucacgcagguuagaaua

SEQ ID NO: 1986792 - RNA, 19 nt, Shigella flexneri 2a str. 301
aguucacgcgauuucucau

SEQ ID NO: 1986793 - RNA, 12 nt, Shigella flexneri 2a str. 301
aguucacugccg

SEQ ID NO: 1986794 - RNA, 17 nt, Shigella flexneri 2a str. 301
aguucacgcagcuucuc

SEQ ID NO: 1986795 - RNA, 16 nt, Shigella flexneri 2a str. 301
aguuaauccacagcaa

SEQ ID NO: 1986796 - RNA, 20 nt, Shigella flexneri 2a str. 301
aguuaaccugaaaccggaaa

SEQ ID NO: 1986797 - RNA, 17 nt, Shigella flexneri 2a str. 301
aguggcgcucucaagcc

SEQ ID NO: 1986798 - RNA, 19 nt, Shigella flexneri 2a str. 301
aguuaaaggugguguugac

SEQ ID NO: 1986799 - RNA, 20 nt, Shigella flexneri 2a str. 301
aguugucgauaaacaguuuc

SEQ ID NO: 1986800 - RNA, 23 nt, Shigella flexneri 2a str. 301
aguuguaaucauauuaaauuuuu

SEQ ID NO: 1986801 - RNA, 17 nt, Shigella flexneri 2a str. 301
aguugcauuccagucca

SEQ ID NO: 1986802 - RNA, 13 nt, Shigella flexneri 2a str. 301
aguugaucaccag

SEQ ID NO: 1986803 - RNA, 14 nt, Shigella flexneri 2a str. 301
aguugcgccaguag

SEQ ID NO: 1986804 - RNA, 17 nt, Shigella flexneri 2a str. 301
aguugccguucuucccg

SEQ ID NO: 1986805 - RNA, 17 nt, Shigella flexneri 2a str. 301
aguugccacccggcuga

SEQ ID NO: 1986806 - RNA, 15 nt, Shigella flexneri 2a str. 301
aguuuuugcccauca

SEQ ID NO: 1986807 - RNA, 18 nt, Shigella flexneri 2a str. 301
aguuuuccaucaguugau

SEQ ID NO: 1986808 - RNA, 12 nt, Shigella flexneri 2a str. 301
aguuuuucaaca

SEQ ID NO: 1986809 - RNA, 13 nt, Shigella flexneri 2a str. 301
auaaaaaagagcg

SEQ ID NO: 1986810 - RNA, 17 nt, Shigella flexneri 2a str. 301
aguuucaccaaacuuca

SEQ ID NO: 1986811 - RNA, 17 nt, Shigella flexneri 2a str. 301
aguuucagccccaucaa

SEQ ID NO: 1986812 - RNA, 16 nt, Shigella flexneri 2a str. 301
aguuucagccccauca

SEQ ID NO: 1986813 - RNA, 13 nt, Shigella flexneri 2a str. 301
aguuucacgcugg

SEQ ID NO: 1986814 - RNA, 21 nt, Shigella flexneri 2a str. 301
aguuugccuucacaggccgcc

SEQ ID NO: 1986815 - RNA, 23 nt, Shigella flexneri 2a str. 301
aguuuuaguugccguucuucccg

SEQ ID NO: 1986816 - RNA, 18 nt, Shigella flexneri 2a str. 301
aguuuggugagaacacca

SEQ ID NO: 1986817 - RNA, 22 nt, Shigella flexneri 2a str. 301
aguuuggucuggcaaaaauaag

SEQ ID NO: 1986818 - RNA, 20 nt, Shigella flexneri 2a str. 301
aguuuggcuucguguacaaa

SEQ ID NO: 1986819 - RNA, 18 nt, Shigella flexneri 2a str. 301
auagaacaguuacgcaga

SEQ ID NO: 1986820 - RNA, 18 nt, Shigella flexneri 2a str. 301
auagaacaaaagaccuga

SEQ ID NO: 1986821 - RNA, 16 nt, Shigella flexneri 2a str. 301
auagaacaucucuucc

SEQ ID NO: 1986822 - RNA, 13 nt, Shigella flexneri 2a str. 301
auagaacggcaga

SEQ ID NO: 1986823 - RNA, 22 nt, Shigella flexneri 2a str. 301
auagaaccuuccauguugguau

SEQ ID NO: 1986824 - RNA, 14 nt, Shigella flexneri 2a str. 301
auagaaccacgcaa

SEQ ID NO: 1986825 - RNA, 15 nt, Shigella flexneri 2a str. 301
auagaaagugacugc

SEQ ID NO: 1986826 - RNA, 17 nt, Shigella flexneri 2a str. 301
auagaaagugacagccc

SEQ ID NO: 1986827 - RNA, 11 nt, Shigella flexneri 2a str. 301
auagaauagcc

SEQ ID NO: 1986828 - RNA, 19 nt, Shigella flexneri 2a str. 301
auagaaacucauaugcagc

SEQ ID NO: 1986829 - RNA, 22 nt, Shigella flexneri 2a str. 301
auacuucauaacguuuuuucgu

SEQ ID NO: 1986830 - RNA, 17 nt, Shigella flexneri 2a str. 301
auagauaucaugcucug

SEQ ID NO: 1986831 - RNA, 14 nt, Shigella flexneri 2a str. 301
auagccgcaaagau

SEQ ID NO: 1986832 - RNA, 16 nt, Shigella flexneri 2a str. 301
auagccgcaaagaugu

SEQ ID NO: 1986833 - RNA, 18 nt, Shigella flexneri 2a str. 301
auagcauccaccacaucg

SEQ ID NO: 1986834 - RNA, 18 nt, Shigella flexneri 2a str. 301
auagcaacagcagccaac

SEQ ID NO: 1986835 - RNA, 15 nt, Shigella flexneri 2a str. 301
auagcaacagcagcc

SEQ ID NO: 1986836 - RNA, 18 nt, Shigella flexneri 2a str. 301
auagcauaauauaacagc

SEQ ID NO: 1986837 - RNA, 16 nt, Shigella flexneri 2a str. 301
auacgcuggcugaaca

SEQ ID NO: 1986838 - RNA, 14 nt, Shigella flexneri 2a str. 301
auacgcuggcugaa

SEQ ID NO: 1986839 - RNA, 15 nt, Shigella flexneri 2a str. 301
auacgcucgaacagc

SEQ ID NO: 1986840 - RNA, 19 nt, Shigella flexneri 2a str. 301
auacgccucacagggcucu

SEQ ID NO: 1986841 - RNA, 14 nt, Shigella flexneri 2a str. 301
auacgccucacagg

SEQ ID NO: 1986842 - RNA, 13 nt, Shigella flexneri 2a str. 301
auacguuugccag

SEQ ID NO: 1986843 - RNA, 14 nt, Shigella flexneri 2a str. 301
auacguuucaccag

SEQ ID NO: 1986844 - RNA, 18 nt, Shigella flexneri 2a str. 301
auaccgccugcaaauaaa

SEQ ID NO: 1986845 - RNA, 16 nt, Shigella flexneri 2a str. 301
auaccgccgccagcaa

SEQ ID NO: 1986846 - RNA, 22 nt, Shigella flexneri 2a str. 301
auaccguuucgcagucgccagc

SEQ ID NO: 1986847 - RNA, 22 nt, Shigella flexneri 2a str. 301
auaccgagcagccacugcggca

SEQ ID NO: 1986848 - RNA, 18 nt, Shigella flexneri 2a str. 301
auaccgaagaguaaccaa

SEQ ID NO: 1986849 - RNA, 17 nt, Shigella flexneri 2a str. 301
auaccgcacgcucaaag

SEQ ID NO: 1986850 - RNA, 14 nt, Shigella flexneri 2a str. 301
auaccgcaucagca

SEQ ID NO: 1986851 - RNA, 17 nt, Shigella flexneri 2a str. 301
auaccgaaccaaaauag

SEQ ID NO: 1986852 - RNA, 14 nt, Shigella flexneri 2a str. 301
auaccuaaaagcac

SEQ ID NO: 1986853 - RNA, 16 nt, Shigella flexneri 2a str. 301
auaccaucacaccucg

SEQ ID NO: 1986854 - RNA, 12 nt, Shigella flexneri 2a str. 301
auaccaugcacc

SEQ ID NO: 1986855 - RNA, 23 nt, Shigella flexneri 2a str. 301
auaccaucggcagcgccaaucgc

SEQ ID NO: 1986856 - RNA, 15 nt, Shigella flexneri 2a str. 301
auacccaaaaaauag

SEQ ID NO: 1986857 - RNA, 19 nt, Shigella flexneri 2a str. 301
auacccaacguaacaaaac

SEQ ID NO: 1986858 - RNA, 20 nt, Shigella flexneri 2a str. 301
auacccaacguaacaaaacu

SEQ ID NO: 1986859 - RNA, 19 nt, Shigella flexneri 2a str. 301
auacccaaaaaauagcaaa

SEQ ID NO: 1986860 - RNA, 17 nt, Shigella flexneri 2a str. 301
auacccaccgguccuaa

SEQ ID NO: 1986861 - RNA, 13 nt, Shigella flexneri 2a str. 301
auaccccagcgca

SEQ ID NO: 1986862 - RNA, 20 nt, Shigella flexneri 2a str. 301
auacccgcauucgccgcugg

SEQ ID NO: 1986863 - RNA, 16 nt, Shigella flexneri 2a str. 301
auacccugaaucaauc

SEQ ID NO: 1986864 - RNA, 12 nt, Shigella flexneri 2a str. 301
auaccacacccg

SEQ ID NO: 1986865 - RNA, 15 nt, Shigella flexneri 2a str. 301
auaccacgucugaag

SEQ ID NO: 1986866 - RNA, 16 nt, Shigella flexneri 2a str. 301
auaccacccgcaguga

SEQ ID NO: 1986867 - RNA, 11 nt, Shigella flexneri 2a str. 301
auaccagccuu

SEQ ID NO: 1986868 - RNA, 16 nt, Shigella flexneri 2a str. 301
auaccacuuccagcag

SEQ ID NO: 1986869 - RNA, 21 nt, Shigella flexneri 2a str. 301
auaccaaaaucaucaauugcc

SEQ ID NO: 1986870 - RNA, 22 nt, Shigella flexneri 2a str. 301
auaauuucauuuacuggaugga

SEQ ID NO: 1986871 - RNA, 17 nt, Shigella flexneri 2a str. 301
auaauugucaacggcac

SEQ ID NO: 1986872 - RNA, 21 nt, Shigella flexneri 2a str. 301
auaauuguuccguuauuaugc

SEQ ID NO: 1986873 - RNA, 16 nt, Shigella flexneri 2a str. 301
auaauugcgaugccag

SEQ ID NO: 1986874 - RNA, 21 nt, Shigella flexneri 2a str. 301
auaauuccauucaccauuuuu

SEQ ID NO: 1986875 - RNA, 13 nt, Shigella flexneri 2a str. 301
auaaugucugaug

SEQ ID NO: 1986876 - RNA, 22 nt, Shigella flexneri 2a str. 301
auaauuauuacuaccuuaauca

SEQ ID NO: 1986877 - RNA, 12 nt, Shigella flexneri 2a str. 301
auaauuauuaua

SEQ ID NO: 1986878 - RNA, 14 nt, Shigella flexneri 2a str. 301
auaauuauuauaau

SEQ ID NO: 1986879 - RNA, 23 nt, Shigella flexneri 2a str. 301
auaauuccucccguuaugaucag

SEQ ID NO: 1986880 - RNA, 14 nt, Shigella flexneri 2a str. 301
auaauuaugaagug

SEQ ID NO: 1986881 - RNA, 15 nt, Shigella flexneri 2a str. 301
auaacggcagaagcu

SEQ ID NO: 1986882 - RNA, 17 nt, Shigella flexneri 2a str. 301
auaacgccuggcagugg

SEQ ID NO: 1986883 - RNA, 18 nt, Shigella flexneri 2a str. 301
auaacgcggcagcaggau

SEQ ID NO: 1986884 - RNA, 18 nt, Shigella flexneri 2a str. 301
auaacgccggagagaaaa

SEQ ID NO: 1986885 - RNA, 20 nt, Shigella flexneri 2a str. 301
auaacgcaucggcuaaacca

SEQ ID NO: 1986886 - RNA, 14 nt, Shigella flexneri 2a str. 301
auaacggcucaaac

SEQ ID NO: 1986887 - RNA, 13 nt, Shigella flexneri 2a str. 301
auaacgcuuuucu

SEQ ID NO: 1986888 - RNA, 15 nt, Shigella flexneri 2a str. 301
auaacgcuuuucuca

SEQ ID NO: 1986889 - RNA, 23 nt, Shigella flexneri 2a str. 301
auaacggugcaacccgccagguu

SEQ ID NO: 1986890 - RNA, 22 nt, Shigella flexneri 2a str. 301
auaacguaaugcuuauuucacc

SEQ ID NO: 1986891 - RNA, 19 nt, Shigella flexneri 2a str. 301
auaaucauuucgccugaaa

SEQ ID NO: 1986892 - RNA, 15 nt, Shigella flexneri 2a str. 301
auaauccaucacuuc

SEQ ID NO: 1986893 - RNA, 15 nt, Shigella flexneri 2a str. 301
auaaucccggcacca

SEQ ID NO: 1986894 - RNA, 17 nt, Shigella flexneri 2a str. 301
auaauccgcuguaauug

SEQ ID NO: 1986895 - RNA, 19 nt, Shigella flexneri 2a str. 301
auaauccaucacuucauca

SEQ ID NO: 1986896 - RNA, 19 nt, Shigella flexneri 2a str. 301
auaaucccgcgcaacaaau

SEQ ID NO: 1986897 - RNA, 21 nt, Shigella flexneri 2a str. 301
auaaucccgcgcaacaaauaa

SEQ ID NO: 1986898 - RNA, 20 nt, Shigella flexneri 2a str. 301
auaauccugccgagauacag

SEQ ID NO: 1986899 - RNA, 20 nt, Shigella flexneri 2a str. 301
auaaucgaaaacaucauggu

SEQ ID NO: 1986900 - RNA, 14 nt, Shigella flexneri 2a str. 301
auaaucgaaaacau

SEQ ID NO: 1986901 - RNA, 15 nt, Shigella flexneri 2a str. 301
auaaucgaaccaaac

SEQ ID NO: 1986902 - RNA, 15 nt, Shigella flexneri 2a str. 301
auaaucucuacacca

SEQ ID NO: 1986903 - RNA, 20 nt, Shigella flexneri 2a str. 301
auaaucucuacaccauuacc

SEQ ID NO: 1986904 - RNA, 17 nt, Shigella flexneri 2a str. 301
auaaucuguuucaucuc

SEQ ID NO: 1986905 - RNA, 13 nt, Shigella flexneri 2a str. 301
auaaugcccagca

SEQ ID NO: 1986906 - RNA, 11 nt, Shigella flexneri 2a str. 301
auaauggcugu

SEQ ID NO: 1986907 - RNA, 17 nt, Shigella flexneri 2a str. 301
auaaugacggagaguac

SEQ ID NO: 1986908 - RNA, 20 nt, Shigella flexneri 2a str. 301
auacacuaacagaacaauaa

SEQ ID NO: 1986909 - RNA, 17 nt, Shigella flexneri 2a str. 301
auacacgccgccgagca

SEQ ID NO: 1986910 - RNA, 15 nt, Shigella flexneri 2a str. 301
auacacgaggcauau

SEQ ID NO: 1986911 - RNA, 18 nt, Shigella flexneri 2a str. 301
auacacuucacacacuuu

SEQ ID NO: 1986912 - RNA, 13 nt, Shigella flexneri 2a str. 301
auacacacaucaa

SEQ ID NO: 1986913 - RNA, 17 nt, Shigella flexneri 2a str. 301
auacaaggccaauccag

SEQ ID NO: 1986914 - RNA, 22 nt, Shigella flexneri 2a str. 301
auacaagagauaugaauaugaa

SEQ ID NO: 1986915 - RNA, 13 nt, Shigella flexneri 2a str. 301
auacaacgccaug

SEQ ID NO: 1986916 - RNA, 14 nt, Shigella flexneri 2a str. 301
auacaaccaaucgc

SEQ ID NO: 1986917 - RNA, 15 nt, Shigella flexneri 2a str. 301
auacaaauagccaau

SEQ ID NO: 1986918 - RNA, 21 nt, Shigella flexneri 2a str. 301
auaauuuucgguaaugacucc

SEQ ID NO: 1986919 - RNA, 13 nt, Shigella flexneri 2a str. 301
auacagguuucaa

SEQ ID NO: 1986920 - RNA, 18 nt, Shigella flexneri 2a str. 301
auacagaugcugcucuuc

SEQ ID NO: 1986921 - RNA, 15 nt, Shigella flexneri 2a str. 301
auacagcaauggaaa

SEQ ID NO: 1986922 - RNA, 21 nt, Shigella flexneri 2a str. 301
auacagauucgcuugucacuu

SEQ ID NO: 1986923 - RNA, 15 nt, Shigella flexneri 2a str. 301
auacagcucagguuc

SEQ ID NO: 1986924 - RNA, 18 nt, Shigella flexneri 2a str. 301
auacagcucaugggcuuu

SEQ ID NO: 1986925 - RNA, 22 nt, Shigella flexneri 2a str. 301
auacaggcggguaaucuuucca

SEQ ID NO: 1986926 - RNA, 21 nt, Shigella flexneri 2a str. 301
auacauguacauggugcacau

SEQ ID NO: 1986927 - RNA, 19 nt, Shigella flexneri 2a str. 301
auacaugaaugaugauuug

SEQ ID NO: 1986928 - RNA, 22 nt, Shigella flexneri 2a str. 301
auacaucgcgcuuaucgccagc

SEQ ID NO: 1986929 - RNA, 19 nt, Shigella flexneri 2a str. 301
auacaucugcaaauccugu

SEQ ID NO: 1986930 - RNA, 15 nt, Shigella flexneri 2a str. 301
auacaucgcauaaaa

SEQ ID NO: 1986931 - RNA, 15 nt, Shigella flexneri 2a str. 301
auacaucagcgacaa

SEQ ID NO: 1986932 - RNA, 17 nt, Shigella flexneri 2a str. 301
auacauagcacaacagg

SEQ ID NO: 1986933 - RNA, 16 nt, Shigella flexneri 2a str. 301
auacauagcacaacag

SEQ ID NO: 1986934 - RNA, 13 nt, Shigella flexneri 2a str. 301
auauuucuauauc

SEQ ID NO: 1986935 - RNA, 16 nt, Shigella flexneri 2a str. 301
auauuuccuuccuugg

SEQ ID NO: 1986936 - RNA, 15 nt, Shigella flexneri 2a str. 301
auauuucaggccaac

SEQ ID NO: 1986937 - RNA, 18 nt, Shigella flexneri 2a str. 301
auauuucucggcaaauuc

SEQ ID NO: 1986938 - RNA, 14 nt, Shigella flexneri 2a str. 301
aucaaaaucaucau

SEQ ID NO: 1986939 - RNA, 22 nt, Shigella flexneri 2a str. 301
aucaaagaugaugucacagccg

SEQ ID NO: 1986940 - RNA, 13 nt, Shigella flexneri 2a str. 301
aucaaauaaaaau

SEQ ID NO: 1986941 - RNA, 13 nt, Shigella flexneri 2a str. 301
aucaaaguaauuu

SEQ ID NO: 1986942 - RNA, 16 nt, Shigella flexneri 2a str. 301
aucaaauuauuaccau

SEQ ID NO: 1986943 - RNA, 14 nt, Shigella flexneri 2a str. 301
aucaaauucaagau

SEQ ID NO: 1986944 - RNA, 21 nt, Shigella flexneri 2a str. 301
aucaaauacuucaauauaugc

SEQ ID NO: 1986945 - RNA, 23 nt, Shigella flexneri 2a str. 301
aucaaaucaacaaccugcauuug

SEQ ID NO: 1986946 - RNA, 13 nt, Shigella flexneri 2a str. 301
aucaaaucaccau

SEQ ID NO: 1986947 - RNA, 22 nt, Shigella flexneri 2a str. 301
aucaaaucaccauauucagcag

SEQ ID NO: 1986948 - RNA, 23 nt, Shigella flexneri 2a str. 301
aucaaaucaccauauucagcagc

SEQ ID NO: 1986949 - RNA, 18 nt, Shigella flexneri 2a str. 301
aucaacaguuuguugcau

SEQ ID NO: 1986950 - RNA, 15 nt, Shigella flexneri 2a str. 301
aucaacauauuaaaa

SEQ ID NO: 1986951 - RNA, 23 nt, Shigella flexneri 2a str. 301
aucaacaauugcgggccaaagac

SEQ ID NO: 1986952 - RNA, 14 nt, Shigella flexneri 2a str. 301
aucaacaaagugca

SEQ ID NO: 1986953 - RNA, 22 nt, Shigella flexneri 2a str. 301
aucaacaauaaaaccaguaaug

SEQ ID NO: 1986954 - RNA, 15 nt, Shigella flexneri 2a str. 301
aucaacucugcaaug

SEQ ID NO: 1986955 - RNA, 21 nt, Shigella flexneri 2a str. 301
aucaacuuauugguaaacuca

SEQ ID NO: 1986956 - RNA, 18 nt, Shigella flexneri 2a str. 301
aucaacugcguucugucg

SEQ ID NO: 1986957 - RNA, 20 nt, Shigella flexneri 2a str. 301
aucaacaugaaaauaaccau

SEQ ID NO: 1986958 - RNA, 17 nt, Shigella flexneri 2a str. 301
aucaacauauuccccug

SEQ ID NO: 1986959 - RNA, 14 nt, Shigella flexneri 2a str. 301
aucaacaugaaaau

SEQ ID NO: 1986960 - RNA, 18 nt, Shigella flexneri 2a str. 301
aucaacuccgccagcaac

SEQ ID NO: 1986961 - RNA, 22 nt, Shigella flexneri 2a str. 301
aucaacuagcuguuguaaugau

SEQ ID NO: 1986962 - RNA, 14 nt, Shigella flexneri 2a str. 301
aucaacuaaauauc

SEQ ID NO: 1986963 - RNA, 20 nt, Shigella flexneri 2a str. 301
aucaauaccauuaucauuga

SEQ ID NO: 1986964 - RNA, 23 nt, Shigella flexneri 2a str. 301
aucaauacaggcgacgaguugcu

SEQ ID NO: 1986965 - RNA, 23 nt, Shigella flexneri 2a str. 301
aucaauaccugguccuucaucuu

SEQ ID NO: 1986966 - RNA, 22 nt, Shigella flexneri 2a str. 301
aucaauaccugguccuucaucu

SEQ ID NO: 1986967 - RNA, 15 nt, Shigella flexneri 2a str. 301
aucaaucagagccau

SEQ ID NO: 1986968 - RNA, 21 nt, Shigella flexneri 2a str. 301
aucaauacuuuccagcauaug

SEQ ID NO: 1986969 - RNA, 14 nt, Shigella flexneri 2a str. 301
aucaaucaccgcuu

SEQ ID NO: 1986970 - RNA, 13 nt, Shigella flexneri 2a str. 301
aucaagacaugau

SEQ ID NO: 1986971 - RNA, 22 nt, Shigella flexneri 2a str. 301
aucaacuuuguucugaaucacg

SEQ ID NO: 1986972 - RNA, 14 nt, Shigella flexneri 2a str. 301
auauugcuguacuu

SEQ ID NO: 1986973 - RNA, 18 nt, Shigella flexneri 2a str. 301
auauugguguugugaagu

SEQ ID NO: 1986974 - RNA, 14 nt, Shigella flexneri 2a str. 301
auauugguguugug

SEQ ID NO: 1986975 - RNA, 18 nt, Shigella flexneri 2a str. 301
auauuuaaucaguucuac

SEQ ID NO: 1986976 - RNA, 21 nt, Shigella flexneri 2a str. 301
auauuuacaaaucuuuauaau

SEQ ID NO: 1986977 - RNA, 18 nt, Shigella flexneri 2a str. 301
auauuuagccagcaacug

SEQ ID NO: 1986978 - RNA, 20 nt, Shigella flexneri 2a str. 301
auauuccugaauggugaccu

SEQ ID NO: 1986979 - RNA, 15 nt, Shigella flexneri 2a str. 301
auauuccccagacga

SEQ ID NO: 1986980 - RNA, 21 nt, Shigella flexneri 2a str. 301
auauuccccggucagcagcac

SEQ ID NO: 1986981 - RNA, 18 nt, Shigella flexneri 2a str. 301
auauggggcagaugggcu

SEQ ID NO: 1986982 - RNA, 14 nt, Shigella flexneri 2a str. 301
auauggugaaagua

SEQ ID NO: 1986983 - RNA, 16 nt, Shigella flexneri 2a str. 301
auauguaagcagaaaa

SEQ ID NO: 1986984 - RNA, 17 nt, Shigella flexneri 2a str. 301
auauguaagcagaaaag

SEQ ID NO: 1986985 - RNA, 21 nt, Shigella flexneri 2a str. 301
auauguaagcagaaaagccaa

SEQ ID NO: 1986986 - RNA, 17 nt, Shigella flexneri 2a str. 301
auauguuuuugcaguag

SEQ ID NO: 1986987 - RNA, 14 nt, Shigella flexneri 2a str. 301
auaugugaaauuua

SEQ ID NO: 1986988 - RNA, 13 nt, Shigella flexneri 2a str. 301
auauguucagaaa

SEQ ID NO: 1986989 - RNA, 20 nt, Shigella flexneri 2a str. 301
auauuagccgccagcucuuu

SEQ ID NO: 1986990 - RNA, 17 nt, Shigella flexneri 2a str. 301
auauuagcauuaaguaa

SEQ ID NO: 1986991 - RNA, 17 nt, Shigella flexneri 2a str. 301
auauuagucaauuaaaa

SEQ ID NO: 1986992 - RNA, 18 nt, Shigella flexneri 2a str. 301
auauuagucaauuaaaaa

SEQ ID NO: 1986993 - RNA, 22 nt, Shigella flexneri 2a str. 301
auauuaaauuuuuucacuguuc

SEQ ID NO: 1986994 - RNA, 14 nt, Shigella flexneri 2a str. 301
auauuaaucaucau

SEQ ID NO: 1986995 - RNA, 18 nt, Shigella flexneri 2a str. 301
auauauaauuaaaaauag

SEQ ID NO: 1986996 - RNA, 17 nt, Shigella flexneri 2a str. 301
auauauaaaaaaacaau

SEQ ID NO: 1986997 - RNA, 22 nt, Shigella flexneri 2a str. 301
auauaguagaucuugauuuacu

SEQ ID NO: 1986998 - RNA, 17 nt, Shigella flexneri 2a str. 301
auauaggucacaucacc

SEQ ID NO: 1986999 - RNA, 19 nt, Shigella flexneri 2a str. 301
auauagcgcacaugcaacu

SEQ ID NO: 1987000 - RNA, 13 nt, Shigella flexneri 2a str. 301
auauagauaucau

SEQ ID NO: 1987001 - RNA, 14 nt, Shigella flexneri 2a str. 301
auauagauaucaau

SEQ ID NO: 1987002 - RNA, 19 nt, Shigella flexneri 2a str. 301
auauacauaaagucuuucu

SEQ ID NO: 1987003 - RNA, 21 nt, Shigella flexneri 2a str. 301
auauaccuuccgguuucaaau

SEQ ID NO: 1987004 - RNA, 19 nt, Shigella flexneri 2a str. 301
auauaccucagcagacuga

SEQ ID NO: 1987005 - RNA, 17 nt, Shigella flexneri 2a str. 301
auauaagcauguucuuu

SEQ ID NO: 1987006 - RNA, 15 nt, Shigella flexneri 2a str. 301
auagucaucucuucc

SEQ ID NO: 1987007 - RNA, 16 nt, Shigella flexneri 2a str. 301
auagucaugaugacgc

SEQ ID NO: 1987008 - RNA, 19 nt, Shigella flexneri 2a str. 301
auagcgaaguagacagcgu

SEQ ID NO: 1987009 - RNA, 23 nt, Shigella flexneri 2a str. 301
auagcgacuugggcgauuuuugc

SEQ ID NO: 1987010 - RNA, 17 nt, Shigella flexneri 2a str. 301
auagcgaaguagacagc

SEQ ID NO: 1987011 - RNA, 19 nt, Shigella flexneri 2a str. 301
auagccuuuauuaaugaca

SEQ ID NO: 1987012 - RNA, 18 nt, Shigella flexneri 2a str. 301
auaguucaaugauaguuc

SEQ ID NO: 1987013 - RNA, 20 nt, Shigella flexneri 2a str. 301
auaguuccacuauuucaaua

SEQ ID NO: 1987014 - RNA, 12 nt, Shigella flexneri 2a str. 301
auagucuuuucg

SEQ ID NO: 1987015 - RNA, 12 nt, Shigella flexneri 2a str. 301
auaucaucauuu

SEQ ID NO: 1987016 - RNA, 13 nt, Shigella flexneri 2a str. 301
auaucauuaaagu

SEQ ID NO: 1987017 - RNA, 20 nt, Shigella flexneri 2a str. 301
auauauccccccaugaaaua

SEQ ID NO: 1987018 - RNA, 22 nt, Shigella flexneri 2a str. 301
auauaugggucguuggugauau

SEQ ID NO: 1987019 - RNA, 22 nt, Shigella flexneri 2a str. 301
auaucagugauauauuuuuaaa

SEQ ID NO: 1987020 - RNA, 23 nt, Shigella flexneri 2a str. 301
auaucagugauauauuuuuaaau

SEQ ID NO: 1987021 - RNA, 19 nt, Shigella flexneri 2a str. 301
auaucggcccggcuuucuu

SEQ ID NO: 1987022 - RNA, 14 nt, Shigella flexneri 2a str. 301
auaucggcaccagc

SEQ ID NO: 1987023 - RNA, 22 nt, Shigella flexneri 2a str. 301
auauccugcgcuuccugcaacg

SEQ ID NO: 1987024 - RNA, 20 nt, Shigella flexneri 2a str. 301
auauccugcgcuuccugcaa

SEQ ID NO: 1987025 - RNA, 17 nt, Shigella flexneri 2a str. 301
auaucgcggauaugcag

SEQ ID NO: 1987026 - RNA, 18 nt, Shigella flexneri 2a str. 301
auauccgucacuucagga

SEQ ID NO: 1987027 - RNA, 14 nt, Shigella flexneri 2a str. 301
auauccugauacuc

SEQ ID NO: 1987028 - RNA, 20 nt, Shigella flexneri 2a str. 301
auauccucaguugucugaau

SEQ ID NO: 1987029 - RNA, 19 nt, Shigella flexneri 2a str. 301
auauccugcgcuuccugca

SEQ ID NO: 1987030 - RNA, 19 nt, Shigella flexneri 2a str. 301
auaucccgccagcaccagc

SEQ ID NO: 1987031 - RNA, 14 nt, Shigella flexneri 2a str. 301
auauccgccaggcu

SEQ ID NO: 1987032 - RNA, 14 nt, Shigella flexneri 2a str. 301
auaucguuaucacc

SEQ ID NO: 1987033 - RNA, 23 nt, Shigella flexneri 2a str. 301
auaucuaugguuuuuucuacaca

SEQ ID NO: 1987034 - RNA, 15 nt, Shigella flexneri 2a str. 301
auaucuccauucuga

SEQ ID NO: 1987035 - RNA, 13 nt, Shigella flexneri 2a str. 301
auaucuccucugc

SEQ ID NO: 1987036 - RNA, 14 nt, Shigella flexneri 2a str. 301
auaugauucuuacu

SEQ ID NO: 1987037 - RNA, 14 nt, Shigella flexneri 2a str. 301
auaugauuuaaaaa

SEQ ID NO: 1987038 - RNA, 15 nt, Shigella flexneri 2a str. 301
auaugauuuaaaaaa

SEQ ID NO: 1987039 - RNA, 22 nt, Shigella flexneri 2a str. 301
auaugcacaugaugauggcuau

SEQ ID NO: 1987040 - RNA, 16 nt, Shigella flexneri 2a str. 301
auaugcagcagccagu

SEQ ID NO: 1987041 - RNA, 22 nt, Shigella flexneri 2a str. 301
auaugcgggcguuuugcuuuuu

SEQ ID NO: 1987042 - RNA, 15 nt, Shigella flexneri 2a str. 301
auaugccggcaucaa

SEQ ID NO: 1987043 - RNA, 16 nt, Shigella flexneri 2a str. 301
auaugccggcaucaaa

SEQ ID NO: 1987044 - RNA, 22 nt, Shigella flexneri 2a str. 301
auauggaacggaugcagcauca

SEQ ID NO: 1987045 - RNA, 12 nt, Shigella flexneri 2a str. 301
auauggagcaaa

SEQ ID NO: 1987046 - RNA, 14 nt, Shigella flexneri 2a str. 301
auauggagcaaaag

SEQ ID NO: 1987047 - RNA, 18 nt, Shigella flexneri 2a str. 301
auauggaagaaacgcuua

SEQ ID NO: 1987048 - RNA, 21 nt, Shigella flexneri 2a str. 301
auauggaaaaauauucaccaa

SEQ ID NO: 1987049 - RNA, 22 nt, Shigella flexneri 2a str. 301
auaugcggugccauuaaaccaa

SEQ ID NO: 1987050 - RNA, 21 nt, Shigella flexneri 2a str. 301
aucuuauagaaagcaaaacgg

SEQ ID NO: 1987051 - RNA, 20 nt, Shigella flexneri 2a str. 301
aucuuaugauguaaauaaca

SEQ ID NO: 1987052 - RNA, 22 nt, Shigella flexneri 2a str. 301
aucuuaugauguaaauaacaga

SEQ ID NO: 1987053 - RNA, 20 nt, Shigella flexneri 2a str. 301
aucuuauugcucgaccuaaa

SEQ ID NO: 1987054 - RNA, 20 nt, Shigella flexneri 2a str. 301
aucuucaaccgucaccagcc

SEQ ID NO: 1987055 - RNA, 16 nt, Shigella flexneri 2a str. 301
aucuucacacacaucg

SEQ ID NO: 1987056 - RNA, 16 nt, Shigella flexneri 2a str. 301
aucuucacaucaucau

SEQ ID NO: 1987057 - RNA, 21 nt, Shigella flexneri 2a str. 301
aucuucaggguaucccgccug

SEQ ID NO: 1987058 - RNA, 16 nt, Shigella flexneri 2a str. 301
aucuguugugccacau

SEQ ID NO: 1987059 - RNA, 11 nt, Shigella flexneri 2a str. 301
aucuuacccuu

SEQ ID NO: 1987060 - RNA, 23 nt, Shigella flexneri 2a str. 301
aucuguaacggagguacaaccgc

SEQ ID NO: 1987061 - RNA, 15 nt, Shigella flexneri 2a str. 301
aucugucauaacaca

SEQ ID NO: 1987062 - RNA, 23 nt, Shigella flexneri 2a str. 301
aucuguauggcccggaaacccug

SEQ ID NO: 1987063 - RNA, 23 nt, Shigella flexneri 2a str. 301
aucugucuguacggcagugaaca

SEQ ID NO: 1987064 - RNA, 18 nt, Shigella flexneri 2a str. 301
aucugucuguacggcagu

SEQ ID NO: 1987065 - RNA, 13 nt, Shigella flexneri 2a str. 301
aucugugaacuca

SEQ ID NO: 1987066 - RNA, 22 nt, Shigella flexneri 2a str. 301
aucugugugggcacucgaagau

SEQ ID NO: 1987067 - RNA, 14 nt, Shigella flexneri 2a str. 301
aucuacaaaaaacu

SEQ ID NO: 1987068 - RNA, 23 nt, Shigella flexneri 2a str. 301
aucugcuugcgauguucuucacc

SEQ ID NO: 1987069 - RNA, 16 nt, Shigella flexneri 2a str. 301
aucuaagaucccugcc

SEQ ID NO: 1987070 - RNA, 20 nt, Shigella flexneri 2a str. 301
aucuaagccgcgagaauaug

SEQ ID NO: 1987071 - RNA, 23 nt, Shigella flexneri 2a str. 301
aucuucgugucuacgcccggcag

SEQ ID NO: 1987072 - RNA, 14 nt, Shigella flexneri 2a str. 301
aucuucuccacgcc

SEQ ID NO: 1987073 - RNA, 22 nt, Shigella flexneri 2a str. 301
aucuugcaaauucaauauauug

SEQ ID NO: 1987074 - RNA, 17 nt, Shigella flexneri 2a str. 301
aucuugcaaaaucaaua

SEQ ID NO: 1987075 - RNA, 15 nt, Shigella flexneri 2a str. 301
aucuugcgaccgcuc

SEQ ID NO: 1987076 - RNA, 19 nt, Shigella flexneri 2a str. 301
aucuugcuucugacuauau

SEQ ID NO: 1987077 - RNA, 21 nt, Shigella flexneri 2a str. 301
aucuuccagaucaccgcagaa

SEQ ID NO: 1987078 - RNA, 17 nt, Shigella flexneri 2a str. 301
aucuuccaccuggaacc

SEQ ID NO: 1987079 - RNA, 15 nt, Shigella flexneri 2a str. 301
aucuucauggagaac

SEQ ID NO: 1987080 - RNA, 19 nt, Shigella flexneri 2a str. 301
aucuucaugcuccagcaga

SEQ ID NO: 1987081 - RNA, 13 nt, Shigella flexneri 2a str. 301
aucuucccagccc

SEQ ID NO: 1987082 - RNA, 14 nt, Shigella flexneri 2a str. 301
aucuucccagcgca

SEQ ID NO: 1987083 - RNA, 18 nt, Shigella flexneri 2a str. 301
aucuuccucacacccuug

SEQ ID NO: 1987084 - RNA, 23 nt, Shigella flexneri 2a str. 301
aucuuccguggaacaaaaucuua

SEQ ID NO: 1987085 - RNA, 16 nt, Shigella flexneri 2a str. 301
aucuucgagauucuua

SEQ ID NO: 1987086 - RNA, 19 nt, Shigella flexneri 2a str. 301
aucuucggcgucagaaaua

SEQ ID NO: 1987087 - RNA, 13 nt, Shigella flexneri 2a str. 301
augaaaacgcuga

SEQ ID NO: 1987088 - RNA, 18 nt, Shigella flexneri 2a str. 301
augaaaaaaccagaaagg

SEQ ID NO: 1987089 - RNA, 19 nt, Shigella flexneri 2a str. 301
aucuuuuugggguuuuaau

SEQ ID NO: 1987090 - RNA, 15 nt, Shigella flexneri 2a str. 301
augaacaaaauucca

SEQ ID NO: 1987091 - RNA, 15 nt, Shigella flexneri 2a str. 301
augaaauuuagcgcc

SEQ ID NO: 1987092 - RNA, 10 nt, Shigella flexneri 2a str. 301
augaaauuca

SEQ ID NO: 1987093 - RNA, 13 nt, Shigella flexneri 2a str. 301
aucuuuauauauu

SEQ ID NO: 1987094 - RNA, 15 nt, Shigella flexneri 2a str. 301
aucuuuaugaaauau

SEQ ID NO: 1987095 - RNA, 24 nt, Shigella flexneri 2a str. 301
aucuuuacugauaauuuuuucacu

SEQ ID NO: 1987096 - RNA, 15 nt, Shigella flexneri 2a str. 301
aucuuugaaaucacg

SEQ ID NO: 1987097 - RNA, 16 nt, Shigella flexneri 2a str. 301
aucuuugacugaaauu

SEQ ID NO: 1987098 - RNA, 21 nt, Shigella flexneri 2a str. 301
aucuuugauugaagaaaucag

SEQ ID NO: 1987099 - RNA, 17 nt, Shigella flexneri 2a str. 301
aucuuugacugaaauuu

SEQ ID NO: 1987100 - RNA, 18 nt, Shigella flexneri 2a str. 301
aucuuuugucaugacuac

SEQ ID NO: 1987101 - RNA, 15 nt, Shigella flexneri 2a str. 301
augaccccagguauc

SEQ ID NO: 1987102 - RNA, 14 nt, Shigella flexneri 2a str. 301
augacccgagccac

SEQ ID NO: 1987103 - RNA, 18 nt, Shigella flexneri 2a str. 301
augaccgaggcgcggcga

SEQ ID NO: 1987104 - RNA, 13 nt, Shigella flexneri 2a str. 301
augaccgcgcugg

SEQ ID NO: 1987105 - RNA, 23 nt, Shigella flexneri 2a str. 301
augacagcgccgacuguuaccuc

SEQ ID NO: 1987106 - RNA, 14 nt, Shigella flexneri 2a str. 301
augacagccagcaa

SEQ ID NO: 1987107 - RNA, 19 nt, Shigella flexneri 2a str. 301
augacguccuguacuguuu

SEQ ID NO: 1987108 - RNA, 15 nt, Shigella flexneri 2a str. 301
augacggcagauuua

SEQ ID NO: 1987109 - RNA, 18 nt, Shigella flexneri 2a str. 301
augaccgggcgcggcugu

SEQ ID NO: 1987110 - RNA, 13 nt, Shigella flexneri 2a str. 301
augaccugcaaau

SEQ ID NO: 1987111 - RNA, 20 nt, Shigella flexneri 2a str. 301
augacaacuuucaucagcac

SEQ ID NO: 1987112 - RNA, 19 nt, Shigella flexneri 2a str. 301
augacaaacgcaaaacugc

SEQ ID NO: 1987113 - RNA, 13 nt, Shigella flexneri 2a str. 301
augaacgccuggg

SEQ ID NO: 1987114 - RNA, 14 nt, Shigella flexneri 2a str. 301
augaaccugccgcc

SEQ ID NO: 1987115 - RNA, 18 nt, Shigella flexneri 2a str. 301
augagcagguacuggaaa

SEQ ID NO: 1987116 - RNA, 21 nt, Shigella flexneri 2a str. 301
augagcgauuuuuuauaguac

SEQ ID NO: 1987117 - RNA, 17 nt, Shigella flexneri 2a str. 301
augacuccaacuuacug

SEQ ID NO: 1987118 - RNA, 18 nt, Shigella flexneri 2a str. 301
augacuccaacuuacuga

SEQ ID NO: 1987119 - RNA, 22 nt, Shigella flexneri 2a str. 301
augacuaucauugcgugguuuu

SEQ ID NO: 1987120 - RNA, 23 nt, Shigella flexneri 2a str. 301
augacuacgacauugaagaauua

SEQ ID NO: 1987121 - RNA, 22 nt, Shigella flexneri 2a str. 301
augauacguuuauuaccaacca

SEQ ID NO: 1987122 - RNA, 21 nt, Shigella flexneri 2a str. 301
augauaucccugcuguccuga

SEQ ID NO: 1987123 - RNA, 16 nt, Shigella flexneri 2a str. 301
augauaggucauauca

SEQ ID NO: 1987124 - RNA, 16 nt, Shigella flexneri 2a str. 301
augauaccgauuacuc

SEQ ID NO: 1987125 - RNA, 21 nt, Shigella flexneri 2a str. 301
augauacagccgacaaugcca

SEQ ID NO: 1987126 - RNA, 19 nt, Shigella flexneri 2a str. 301
augagcuuucgcuucuuga

SEQ ID NO: 1987127 - RNA, 18 nt, Shigella flexneri 2a str. 301
augaggcuuuaauaccug

SEQ ID NO: 1987128 - RNA, 19 nt, Shigella flexneri 2a str. 301
augaggcguuaacagcgca

SEQ ID NO: 1987129 - RNA, 17 nt, Shigella flexneri 2a str. 301
augaucaaaaucauaua

SEQ ID NO: 1987130 - RNA, 15 nt, Shigella flexneri 2a str. 301
augaucaagcgcaca

SEQ ID NO: 1987131 - RNA, 20 nt, Shigella flexneri 2a str. 301
augaucaccugcauacaaau

SEQ ID NO: 1987132 - RNA, 23 nt, Shigella flexneri 2a str. 301
augaucaccugcauacaaauaag

SEQ ID NO: 1987133 - RNA, 13 nt, Shigella flexneri 2a str. 301
augaucaucaagg

SEQ ID NO: 1987134 - RNA, 19 nt, Shigella flexneri 2a str. 301
augaucagcgguuuugcca

SEQ ID NO: 1987135 - RNA, 17 nt, Shigella flexneri 2a str. 301
augauauggucaaugau

SEQ ID NO: 1987136 - RNA, 19 nt, Shigella flexneri 2a str. 301
augaucgaggcaaagaguu

SEQ ID NO: 1987137 - RNA, 14 nt, Shigella flexneri 2a str. 301
augauccuggauuu

SEQ ID NO: 1987138 - RNA, 14 nt, Shigella flexneri 2a str. 301
augaugaugcaaac

SEQ ID NO: 1987139 - RNA, 20 nt, Shigella flexneri 2a str. 301
augaucugcgcccaauaucc

SEQ ID NO: 1987140 - RNA, 22 nt, Shigella flexneri 2a str. 301
augaucugcgcccaauauccug

SEQ ID NO: 1987141 - RNA, 23 nt, Shigella flexneri 2a str. 301
augaugcaccaccugauugcugc

SEQ ID NO: 1987142 - RNA, 15 nt, Shigella flexneri 2a str. 301
augauuacucguauu

SEQ ID NO: 1987143 - RNA, 15 nt, Shigella flexneri 2a str. 301
augaugcugauggcu

SEQ ID NO: 1987144 - RNA, 18 nt, Shigella flexneri 2a str. 301
augcacgcucuguucugc

SEQ ID NO: 1987145 - RNA, 17 nt, Shigella flexneri 2a str. 301
augcacgcucuguucug

SEQ ID NO: 1987146 - RNA, 12 nt, Shigella flexneri 2a str. 301
augcagaaacca

SEQ ID NO: 1987147 - RNA, 18 nt, Shigella flexneri 2a str. 301
augcacucgaccacgccc

SEQ ID NO: 1987148 - RNA, 18 nt, Shigella flexneri 2a str. 301
augcacucgcauccucuu

SEQ ID NO: 1987149 - RNA, 16 nt, Shigella flexneri 2a str. 301
augcauccggcaguca

SEQ ID NO: 1987150 - RNA, 17 nt, Shigella flexneri 2a str. 301
augcauccggcagucag

SEQ ID NO: 1987151 - RNA, 14 nt, Shigella flexneri 2a str. 301
augcaucagccaac

SEQ ID NO: 1987152 - RNA, 19 nt, Shigella flexneri 2a str. 301
augcaucaggaccugcucu

SEQ ID NO: 1987153 - RNA, 22 nt, Shigella flexneri 2a str. 301
augcaucaggaccugcucugcc

SEQ ID NO: 1987154 - RNA, 23 nt, Shigella flexneri 2a str. 301
augcagauccuguuggccaaccc

SEQ ID NO: 1987155 - RNA, 17 nt, Shigella flexneri 2a str. 301
augcaccaacaaauaga

SEQ ID NO: 1987156 - RNA, 14 nt, Shigella flexneri 2a str. 301
augcaaacauggaa

SEQ ID NO: 1987157 - RNA, 18 nt, Shigella flexneri 2a str. 301
augcaccgacaauccggu

SEQ ID NO: 1987158 - RNA, 19 nt, Shigella flexneri 2a str. 301
augauuuugauggaagaaa

SEQ ID NO: 1987159 - RNA, 19 nt, Shigella flexneri 2a str. 301
auggcggugagggggggau

SEQ ID NO: 1987160 - RNA, 13 nt, Shigella flexneri 2a str. 301
auggcguacucaa

SEQ ID NO: 1987161 - RNA, 20 nt, Shigella flexneri 2a str. 301
auggcuaaaguacguaaaac

SEQ ID NO: 1987162 - RNA, 20 nt, Shigella flexneri 2a str. 301
auggcuggcuauacacaagg

SEQ ID NO: 1987163 - RNA, 16 nt, Shigella flexneri 2a str. 301
auggcuggcaauacug

SEQ ID NO: 1987164 - RNA, 16 nt, Shigella flexneri 2a str. 301
auggcuggcagaugcu

SEQ ID NO: 1987165 - RNA, 17 nt, Shigella flexneri 2a str. 301
auggcgcacucaaaacu

SEQ ID NO: 1987166 - RNA, 16 nt, Shigella flexneri 2a str. 301
auggcgacuucugcuu

SEQ ID NO: 1987167 - RNA, 14 nt, Shigella flexneri 2a str. 301
auggcgaauggcac

SEQ ID NO: 1987168 - RNA, 17 nt, Shigella flexneri 2a str. 301
auggcgccaguuauuaa

SEQ ID NO: 1987169 - RNA, 22 nt, Shigella flexneri 2a str. 301
auggcggggagggaauccagca

SEQ ID NO: 1987170 - RNA, 17 nt, Shigella flexneri 2a str. 301
auggcaaaaacuuccau

SEQ ID NO: 1987171 - RNA, 16 nt, Shigella flexneri 2a str. 301
auggcaaaacggcucu

SEQ ID NO: 1987172 - RNA, 15 nt, Shigella flexneri 2a str. 301
auggcaaacaaacug

SEQ ID NO: 1987173 - RNA, 16 nt, Shigella flexneri 2a str. 301
auggcaaacaaacugc

SEQ ID NO: 1987174 - RNA, 12 nt, Shigella flexneri 2a str. 301
auggcaaacuga

SEQ ID NO: 1987175 - RNA, 21 nt, Shigella flexneri 2a str. 301
auggcaauaaagacauccgcc

SEQ ID NO: 1987176 - RNA, 13 nt, Shigella flexneri 2a str. 301
auggccuuucugg

SEQ ID NO: 1987177 - RNA, 20 nt, Shigella flexneri 2a str. 301
auggccugaugugacgcugu

SEQ ID NO: 1987178 - RNA, 17 nt, Shigella flexneri 2a str. 301
auggccgcuccaagguc

SEQ ID NO: 1987179 - RNA, 12 nt, Shigella flexneri 2a str. 301
auggcacaaaug

SEQ ID NO: 1987180 - RNA, 13 nt, Shigella flexneri 2a str. 301
auggcccuucugg

SEQ ID NO: 1987181 - RNA, 21 nt, Shigella flexneri 2a str. 301
augggguggaacggugaaaac

SEQ ID NO: 1987182 - RNA, 11 nt, Shigella flexneri 2a str. 301
augggguggaa

SEQ ID NO: 1987183 - RNA, 18 nt, Shigella flexneri 2a str. 301
auggggguccugagcacu

SEQ ID NO: 1987184 - RNA, 19 nt, Shigella flexneri 2a str. 301
auggucaacgucaacuuug

SEQ ID NO: 1987185 - RNA, 21 nt, Shigella flexneri 2a str. 301
augguaugcgaagguggcgga

SEQ ID NO: 1987186 - RNA, 20 nt, Shigella flexneri 2a str. 301
augggugcaaugagaaugcg

SEQ ID NO: 1987187 - RNA, 14 nt, Shigella flexneri 2a str. 301
auggucagccagcg

SEQ ID NO: 1987188 - RNA, 14 nt, Shigella flexneri 2a str. 301
auggucagcuucac

SEQ ID NO: 1987189 - RNA, 18 nt, Shigella flexneri 2a str. 301
augguggagauaaacucc

SEQ ID NO: 1987190 - RNA, 22 nt, Shigella flexneri 2a str. 301
augguggcccggauucagauug

SEQ ID NO: 1987191 - RNA, 20 nt, Shigella flexneri 2a str. 301
augguuagccuguaauguca

SEQ ID NO: 1987192 - RNA, 13 nt, Shigella flexneri 2a str. 301
auguaaauaacag

SEQ ID NO: 1987193 - RNA, 16 nt, Shigella flexneri 2a str. 301
augguugucacugcau

SEQ ID NO: 1987194 - RNA, 21 nt, Shigella flexneri 2a str. 301
auguacucuuuauugcaaaca

SEQ ID NO: 1987195 - RNA, 16 nt, Shigella flexneri 2a str. 301
auguagcgcugcaaac

SEQ ID NO: 1987196 - RNA, 24 nt, Shigella flexneri 2a str. 301
auguagcgcugcaaaccacgguuc

SEQ ID NO: 1987197 - RNA, 23 nt, Shigella flexneri 2a str. 301
auguagcguuuuauaccaacaaa

SEQ ID NO: 1987198 - RNA, 14 nt, Shigella flexneri 2a str. 301
augucaucagcauu

SEQ ID NO: 1987199 - RNA, 24 nt, Shigella flexneri 2a str. 301
augucaucagcauucucaucacca

SEQ ID NO: 1987200 - RNA, 18 nt, Shigella flexneri 2a str. 301
augucgcucaaugugcug

SEQ ID NO: 1987201 - RNA, 18 nt, Shigella flexneri 2a str. 301
augucgcuguuucuggac

SEQ ID NO: 1987202 - RNA, 21 nt, Shigella flexneri 2a str. 301
augucgcuuccauugagaaag

SEQ ID NO: 1987203 - RNA, 20 nt, Shigella flexneri 2a str. 301
augucggcagugauuuuccc

SEQ ID NO: 1987204 - RNA, 19 nt, Shigella flexneri 2a str. 301
augucacugcuuuggcucu

SEQ ID NO: 1987205 - RNA, 21 nt, Shigella flexneri 2a str. 301
auguuccggcgacacaucuaa

SEQ ID NO: 1987206 - RNA, 22 nt, Shigella flexneri 2a str. 301
auguuccggguuugccacauca

SEQ ID NO: 1987207 - RNA, 19 nt, Shigella flexneri 2a str. 301
auguuccggcgacacaucu

SEQ ID NO: 1987208 - RNA, 20 nt, Shigella flexneri 2a str. 301
auguucuaugaagaacugga

SEQ ID NO: 1987209 - RNA, 21 nt, Shigella flexneri 2a str. 301
auguucucuggcgaauaugac

SEQ ID NO: 1987210 - RNA, 20 nt, Shigella flexneri 2a str. 301
auguucggcgucuuguugaa

SEQ ID NO: 1987211 - RNA, 21 nt, Shigella flexneri 2a str. 301
auguuacgugaagucucaauu

SEQ ID NO: 1987212 - RNA, 15 nt, Shigella flexneri 2a str. 301
auguuacguuucucu

SEQ ID NO: 1987213 - RNA, 18 nt, Shigella flexneri 2a str. 301
augugccggaugcaucac

SEQ ID NO: 1987214 - RNA, 19 nt, Shigella flexneri 2a str. 301
augugcucuaacccuucca

SEQ ID NO: 1987215 - RNA, 17 nt, Shigella flexneri 2a str. 301
augugcucuaacccuuc

SEQ ID NO: 1987216 - RNA, 18 nt, Shigella flexneri 2a str. 301
auguguaagaaaggcaga

SEQ ID NO: 1987217 - RNA, 20 nt, Shigella flexneri 2a str. 301
augucuggcgagcuccaggg

SEQ ID NO: 1987218 - RNA, 21 nt, Shigella flexneri 2a str. 301
augugccagcuucccgcuggu

SEQ ID NO: 1987219 - RNA, 19 nt, Shigella flexneri 2a str. 301
augucguauuuauuuucca

SEQ ID NO: 1987220 - RNA, 16 nt, Shigella flexneri 2a str. 301
auggacacuauuuccc

SEQ ID NO: 1987221 - RNA, 18 nt, Shigella flexneri 2a str. 301
auggacaccagcucagug

SEQ ID NO: 1987222 - RNA, 13 nt, Shigella flexneri 2a str. 301
auggacgcagacc

SEQ ID NO: 1987223 - RNA, 19 nt, Shigella flexneri 2a str. 301
auggaucagaguugaaaaa

SEQ ID NO: 1987224 - RNA, 16 nt, Shigella flexneri 2a str. 301
auggagcuaaacagcg

SEQ ID NO: 1987225 - RNA, 21 nt, Shigella flexneri 2a str. 301
auggaucagaguugaaaaaca

SEQ ID NO: 1987226 - RNA, 20 nt, Shigella flexneri 2a str. 301
auggaucuuugacugaaauu

SEQ ID NO: 1987227 - RNA, 17 nt, Shigella flexneri 2a str. 301
auggauuaccgugaauc

SEQ ID NO: 1987228 - RNA, 15 nt, Shigella flexneri 2a str. 301
auggaaaaucaucag

SEQ ID NO: 1987229 - RNA, 18 nt, Shigella flexneri 2a str. 301
auggaaacagcaccaucc

SEQ ID NO: 1987230 - RNA, 13 nt, Shigella flexneri 2a str. 301
auggaaacagcac

SEQ ID NO: 1987231 - RNA, 14 nt, Shigella flexneri 2a str. 301
augcuuuuuccugc

SEQ ID NO: 1987232 - RNA, 18 nt, Shigella flexneri 2a str. 301
auggaaaucacccagcga

SEQ ID NO: 1987233 - RNA, 14 nt, Shigella flexneri 2a str. 301
augcugcaauaaaa

SEQ ID NO: 1987234 - RNA, 12 nt, Shigella flexneri 2a str. 301
augcugaaguaa

SEQ ID NO: 1987235 - RNA, 14 nt, Shigella flexneri 2a str. 301
augcugaaguaaga

SEQ ID NO: 1987236 - RNA, 23 nt, Shigella flexneri 2a str. 301
augcugccgauggcgcaaacuua

SEQ ID NO: 1987237 - RNA, 16 nt, Shigella flexneri 2a str. 301
augcugcggaucaauc

SEQ ID NO: 1987238 - RNA, 17 nt, Shigella flexneri 2a str. 301
augcugcggaucaaucg

SEQ ID NO: 1987239 - RNA, 18 nt, Shigella flexneri 2a str. 301
augcugguaauccgagaa

SEQ ID NO: 1987240 - RNA, 16 nt, Shigella flexneri 2a str. 301
augcuuccuuccuggg

SEQ ID NO: 1987241 - RNA, 22 nt, Shigella flexneri 2a str. 301
augcuuccgccagcggcggcaa

SEQ ID NO: 1987242 - RNA, 19 nt, Shigella flexneri 2a str. 301
augcuugcgauauucuuca

SEQ ID NO: 1987243 - RNA, 22 nt, Shigella flexneri 2a str. 301
augcuugcgauauucuucagua

SEQ ID NO: 1987244 - RNA, 14 nt, Shigella flexneri 2a str. 301
augcuuuaaaugcu

SEQ ID NO: 1987245 - RNA, 17 nt, Shigella flexneri 2a str. 301
augcugucggcugccag

SEQ ID NO: 1987246 - RNA, 16 nt, Shigella flexneri 2a str. 301
augcugugaagauggc

SEQ ID NO: 1987247 - RNA, 15 nt, Shigella flexneri 2a str. 301
augcuguauucuuca

SEQ ID NO: 1987248 - RNA, 21 nt, Shigella flexneri 2a str. 301
augcuguccuaaaaaauuaac

SEQ ID NO: 1987249 - RNA, 22 nt, Shigella flexneri 2a str. 301
augcuguccuaaaaaauuaaca

SEQ ID NO: 1987250 - RNA, 14 nt, Shigella flexneri 2a str. 301
augcugguuccuga

SEQ ID NO: 1987251 - RNA, 19 nt, Shigella flexneri 2a str. 301
augcugugcgccacagaca

SEQ ID NO: 1987252 - RNA, 23 nt, Shigella flexneri 2a str. 301
augcucacugcgaaguuuuuccg

SEQ ID NO: 1987253 - RNA, 18 nt, Shigella flexneri 2a str. 301
augcucaacaauaaacug

SEQ ID NO: 1987254 - RNA, 16 nt, Shigella flexneri 2a str. 301
augcuaagccgugcau

SEQ ID NO: 1987255 - RNA, 16 nt, Shigella flexneri 2a str. 301
augcuccagcagaugg

SEQ ID NO: 1987256 - RNA, 15 nt, Shigella flexneri 2a str. 301
augcucucaucacua

SEQ ID NO: 1987257 - RNA, 16 nt, Shigella flexneri 2a str. 301
augcgucuuccgugcc

SEQ ID NO: 1987258 - RNA, 19 nt, Shigella flexneri 2a str. 301
augcgucagcaacaugccg

SEQ ID NO: 1987259 - RNA, 14 nt, Shigella flexneri 2a str. 301
augcuaaaaacauc

SEQ ID NO: 1987260 - RNA, 19 nt, Shigella flexneri 2a str. 301
augcuaaaaacaucaugau

SEQ ID NO: 1987261 - RNA, 13 nt, Shigella flexneri 2a str. 301
augcuaaaaacau

SEQ ID NO: 1987262 - RNA, 14 nt, Shigella flexneri 2a str. 301
augcguucucccuc

SEQ ID NO: 1987263 - RNA, 16 nt, Shigella flexneri 2a str. 301
augcggcgugaaugcc

SEQ ID NO: 1987264 - RNA, 18 nt, Shigella flexneri 2a str. 301
augcggggauuacucccc

SEQ ID NO: 1987265 - RNA, 20 nt, Shigella flexneri 2a str. 301
augcguagcugagcaacaaa

SEQ ID NO: 1987266 - RNA, 23 nt, Shigella flexneri 2a str. 301
augcggucguaaucgcccgcuuc

SEQ ID NO: 1987267 - RNA, 16 nt, Shigella flexneri 2a str. 301
augcgggugaacgcgu

SEQ ID NO: 1987268 - RNA, 13 nt, Shigella flexneri 2a str. 301
augccaaaaggga

SEQ ID NO: 1987269 - RNA, 23 nt, Shigella flexneri 2a str. 301
augcauuuuuuagugauuaacag

SEQ ID NO: 1987270 - RNA, 16 nt, Shigella flexneri 2a str. 301
augccaaauauuucuu

SEQ ID NO: 1987271 - RNA, 22 nt, Shigella flexneri 2a str. 301
augccaaauauuucuuuaucac

SEQ ID NO: 1987272 - RNA, 23 nt, Shigella flexneri 2a str. 301
augcaucgcauccgacaucaacc

SEQ ID NO: 1987273 - RNA, 14 nt, Shigella flexneri 2a str. 301
augcaugcccggca

SEQ ID NO: 1987274 - RNA, 17 nt, Shigella flexneri 2a str. 301
augcgacaacuggcagc

SEQ ID NO: 1987275 - RNA, 14 nt, Shigella flexneri 2a str. 301
augcgacaacagaa

SEQ ID NO: 1987276 - RNA, 13 nt, Shigella flexneri 2a str. 301
augcgacacuguu

SEQ ID NO: 1987277 - RNA, 17 nt, Shigella flexneri 2a str. 301
augcgagauguccccug

SEQ ID NO: 1987278 - RNA, 12 nt, Shigella flexneri 2a str. 301
augcgacggcac

SEQ ID NO: 1987279 - RNA, 19 nt, Shigella flexneri 2a str. 301
augcgaccauaugaauaua

SEQ ID NO: 1987280 - RNA, 17 nt, Shigella flexneri 2a str. 301
augcgcauugccagagu

SEQ ID NO: 1987281 - RNA, 20 nt, Shigella flexneri 2a str. 301
augcgaguaaacaggggcug

SEQ ID NO: 1987282 - RNA, 20 nt, Shigella flexneri 2a str. 301
augcgacguaaaaacuacaa

SEQ ID NO: 1987283 - RNA, 16 nt, Shigella flexneri 2a str. 301
augcgauaacccgcuc

SEQ ID NO: 1987284 - RNA, 22 nt, Shigella flexneri 2a str. 301
augcggcaucuucuccacgcca

SEQ ID NO: 1987285 - RNA, 19 nt, Shigella flexneri 2a str. 301
augcggagacucaaacccc

SEQ ID NO: 1987286 - RNA, 13 nt, Shigella flexneri 2a str. 301
augcgcuuccugc

SEQ ID NO: 1987287 - RNA, 21 nt, Shigella flexneri 2a str. 301
augcgcuucgcuuaccaugcc

SEQ ID NO: 1987288 - RNA, 14 nt, Shigella flexneri 2a str. 301
augcgcugagugua

SEQ ID NO: 1987289 - RNA, 19 nt, Shigella flexneri 2a str. 301
augcgcucccguaauuccg

SEQ ID NO: 1987290 - RNA, 13 nt, Shigella flexneri 2a str. 301
augcgcugggcaa

SEQ ID NO: 1987291 - RNA, 14 nt, Shigella flexneri 2a str. 301
augcgcgaacugga

SEQ ID NO: 1987292 - RNA, 21 nt, Shigella flexneri 2a str. 301
augcgcauugccagagugaaa

SEQ ID NO: 1987293 - RNA, 23 nt, Shigella flexneri 2a str. 301
augcgcauugccagagugaaaau

SEQ ID NO: 1987294 - RNA, 15 nt, Shigella flexneri 2a str. 301
augcgccagcauccg

SEQ ID NO: 1987295 - RNA, 12 nt, Shigella flexneri 2a str. 301
augcgcccagcg

SEQ ID NO: 1987296 - RNA, 10 nt, Shigella flexneri 2a str. 301
aucaggaaac

SEQ ID NO: 1987297 - RNA, 17 nt, Shigella flexneri 2a str. 301
aucaaucgcaaucuggc

SEQ ID NO: 1987298 - RNA, 13 nt, Shigella flexneri 2a str. 301
aucaaucgccccu

SEQ ID NO: 1987299 - RNA, 17 nt, Shigella flexneri 2a str. 301
aucaggcaucugagcau

SEQ ID NO: 1987300 - RNA, 16 nt, Shigella flexneri 2a str. 301
aucaggcaucgugcac

SEQ ID NO: 1987301 - RNA, 18 nt, Shigella flexneri 2a str. 301
aucaggcaguuuugcguu

SEQ ID NO: 1987302 - RNA, 15 nt, Shigella flexneri 2a str. 301
aucaggcauucuuuu

SEQ ID NO: 1987303 - RNA, 17 nt, Shigella flexneri 2a str. 301
aucaggccuacagcaua

SEQ ID NO: 1987304 - RNA, 18 nt, Shigella flexneri 2a str. 301
aucaggccaaacagacca

SEQ ID NO: 1987305 - RNA, 22 nt, Shigella flexneri 2a str. 301
aucaggcagauacaaccaaucg

SEQ ID NO: 1987306 - RNA, 15 nt, Shigella flexneri 2a str. 301
aucaggcaauuuuac

SEQ ID NO: 1987307 - RNA, 18 nt, Shigella flexneri 2a str. 301
aucaggcaauauuuaaau

SEQ ID NO: 1987308 - RNA, 18 nt, Shigella flexneri 2a str. 301
aucaggcuucuguaccug

SEQ ID NO: 1987309 - RNA, 18 nt, Shigella flexneri 2a str. 301
aucagggagucuugcugg

SEQ ID NO: 1987310 - RNA, 18 nt, Shigella flexneri 2a str. 301
aucagggaagggucuuuu

SEQ ID NO: 1987311 - RNA, 19 nt, Shigella flexneri 2a str. 301
aucaggccuacauuuucuc

SEQ ID NO: 1987312 - RNA, 22 nt, Shigella flexneri 2a str. 301
aucagguugaugcgaguaauca

SEQ ID NO: 1987313 - RNA, 17 nt, Shigella flexneri 2a str. 301
aucaggguuaaaauacc

SEQ ID NO: 1987314 - RNA, 14 nt, Shigella flexneri 2a str. 301
aucaggguaaauuu

SEQ ID NO: 1987315 - RNA, 22 nt, Shigella flexneri 2a str. 301
aucaggucaucaaucaguucau

SEQ ID NO: 1987316 - RNA, 14 nt, Shigella flexneri 2a str. 301
aucaguuaaggauc

SEQ ID NO: 1987317 - RNA, 14 nt, Shigella flexneri 2a str. 301
aucagucucaaacc

SEQ ID NO: 1987318 - RNA, 22 nt, Shigella flexneri 2a str. 301
aucaguuuuuucauugaaugcg

SEQ ID NO: 1987319 - RNA, 13 nt, Shigella flexneri 2a str. 301
aucauaaaaauca

SEQ ID NO: 1987320 - RNA, 18 nt, Shigella flexneri 2a str. 301
aucaguugaugaaucugc

SEQ ID NO: 1987321 - RNA, 18 nt, Shigella flexneri 2a str. 301
aucaguuguucagaaugc

SEQ ID NO: 1987322 - RNA, 14 nt, Shigella flexneri 2a str. 301
aucaguuccagcag

SEQ ID NO: 1987323 - RNA, 16 nt, Shigella flexneri 2a str. 301
aucaguuccaguucau

SEQ ID NO: 1987324 - RNA, 16 nt, Shigella flexneri 2a str. 301
aucaguucaccacuuu

SEQ ID NO: 1987325 - RNA, 16 nt, Shigella flexneri 2a str. 301
aucauagacuucccuc

SEQ ID NO: 1987326 - RNA, 15 nt, Shigella flexneri 2a str. 301
aucauacugaacuua

SEQ ID NO: 1987327 - RNA, 22 nt, Shigella flexneri 2a str. 301
aucauaccuccgcaauaugcgc

SEQ ID NO: 1987328 - RNA, 14 nt, Shigella flexneri 2a str. 301
aucauaauggcugc

SEQ ID NO: 1987329 - RNA, 11 nt, Shigella flexneri 2a str. 301
aucauauuaaa

SEQ ID NO: 1987330 - RNA, 22 nt, Shigella flexneri 2a str. 301
aucauauuaaauuuuuucacug

SEQ ID NO: 1987331 - RNA, 16 nt, Shigella flexneri 2a str. 301
aucauccggcaccuuu

SEQ ID NO: 1987332 - RNA, 14 nt, Shigella flexneri 2a str. 301
aucaucgaccccag

SEQ ID NO: 1987333 - RNA, 21 nt, Shigella flexneri 2a str. 301
aucauccgcucccuggcccau

SEQ ID NO: 1987334 - RNA, 19 nt, Shigella flexneri 2a str. 301
aucauccugcugcacgccc

SEQ ID NO: 1987335 - RNA, 17 nt, Shigella flexneri 2a str. 301
aucaucgcggcacacag

SEQ ID NO: 1987336 - RNA, 23 nt, Shigella flexneri 2a str. 301
aucaucgccgucacgguaauaac

SEQ ID NO: 1987337 - RNA, 19 nt, Shigella flexneri 2a str. 301
aucaucgcguacucaccgc

SEQ ID NO: 1987338 - RNA, 20 nt, Shigella flexneri 2a str. 301
aucaucgcgugacagccuug

SEQ ID NO: 1987339 - RNA, 17 nt, Shigella flexneri 2a str. 301
aucaucgcauccagugc

SEQ ID NO: 1987340 - RNA, 22 nt, Shigella flexneri 2a str. 301
aucaucuggcugugauccauuc

SEQ ID NO: 1987341 - RNA, 16 nt, Shigella flexneri 2a str. 301
aucaucugccacuucu

SEQ ID NO: 1987342 - RNA, 21 nt, Shigella flexneri 2a str. 301
aucaucgguaccgccagcagg

SEQ ID NO: 1987343 - RNA, 22 nt, Shigella flexneri 2a str. 301
aucaucagcauuuucuauuucu

SEQ ID NO: 1987344 - RNA, 20 nt, Shigella flexneri 2a str. 301
aucaucaauaccagcccguc

SEQ ID NO: 1987345 - RNA, 17 nt, Shigella flexneri 2a str. 301
aucaucaauaccagccc

SEQ ID NO: 1987346 - RNA, 16 nt, Shigella flexneri 2a str. 301
aucaucaaacuuuaau

SEQ ID NO: 1987347 - RNA, 14 nt, Shigella flexneri 2a str. 301
aucauauuguuccc

SEQ ID NO: 1987348 - RNA, 13 nt, Shigella flexneri 2a str. 301
aucauauuuucca

SEQ ID NO: 1987349 - RNA, 14 nt, Shigella flexneri 2a str. 301
aucaucaaagccaa

SEQ ID NO: 1987350 - RNA, 19 nt, Shigella flexneri 2a str. 301
aucauccccguaucuucau

SEQ ID NO: 1987351 - RNA, 15 nt, Shigella flexneri 2a str. 301
aucauccauauuuuc

SEQ ID NO: 1987352 - RNA, 23 nt, Shigella flexneri 2a str. 301
aucauccagaccgcucagcuccu

SEQ ID NO: 1987353 - RNA, 15 nt, Shigella flexneri 2a str. 301
aucauccagacugcu

SEQ ID NO: 1987354 - RNA, 16 nt, Shigella flexneri 2a str. 301
aucaucauuuuuucac

SEQ ID NO: 1987355 - RNA, 19 nt, Shigella flexneri 2a str. 301
aucauccaccuuaaaacaa

SEQ ID NO: 1987356 - RNA, 18 nt, Shigella flexneri 2a str. 301
aucauccagaccgcucag

SEQ ID NO: 1987357 - RNA, 22 nt, Shigella flexneri 2a str. 301
aucaucaggggcagcaccauca

SEQ ID NO: 1987358 - RNA, 15 nt, Shigella flexneri 2a str. 301
aucaucaggggcagc

SEQ ID NO: 1987359 - RNA, 14 nt, Shigella flexneri 2a str. 301
aucaucauuauuaa

SEQ ID NO: 1987360 - RNA, 13 nt, Shigella flexneri 2a str. 301
aucaucauuugca

SEQ ID NO: 1987361 - RNA, 22 nt, Shigella flexneri 2a str. 301
aucaugccgaucgucugggcau

SEQ ID NO: 1987362 - RNA, 17 nt, Shigella flexneri 2a str. 301
aucauggcauccuguuu

SEQ ID NO: 1987363 - RNA, 18 nt, Shigella flexneri 2a str. 301
aucaugcaguaccagaua

SEQ ID NO: 1987364 - RNA, 15 nt, Shigella flexneri 2a str. 301
aucaugauucacagu

SEQ ID NO: 1987365 - RNA, 17 nt, Shigella flexneri 2a str. 301
aucaugccaaaaauaau

SEQ ID NO: 1987366 - RNA, 13 nt, Shigella flexneri 2a str. 301
aucaugaccccag

SEQ ID NO: 1987367 - RNA, 15 nt, Shigella flexneri 2a str. 301
aucauuagucacaaa

SEQ ID NO: 1987368 - RNA, 22 nt, Shigella flexneri 2a str. 301
aucauuaguaccuuccuuauuu

SEQ ID NO: 1987369 - RNA, 13 nt, Shigella flexneri 2a str. 301
aucauuagcccaa

SEQ ID NO: 1987370 - RNA, 15 nt, Shigella flexneri 2a str. 301
aucauucaccagccc

SEQ ID NO: 1987371 - RNA, 20 nt, Shigella flexneri 2a str. 301
aucauguggacgaggggaga

SEQ ID NO: 1987372 - RNA, 20 nt, Shigella flexneri 2a str. 301
aucaugguuuauuucccaga

SEQ ID NO: 1987373 - RNA, 13 nt, Shigella flexneri 2a str. 301
aucauucccgccc

SEQ ID NO: 1987374 - RNA, 21 nt, Shigella flexneri 2a str. 301
aucauucccauuuauuuuucc

SEQ ID NO: 1987375 - RNA, 20 nt, Shigella flexneri 2a str. 301
aucauugccgguuggcgacu

SEQ ID NO: 1987376 - RNA, 23 nt, Shigella flexneri 2a str. 301
aucauugcgugguuuuugcugac

SEQ ID NO: 1987377 - RNA, 20 nt, Shigella flexneri 2a str. 301
aucauuggccggaauaccac

SEQ ID NO: 1987378 - RNA, 13 nt, Shigella flexneri 2a str. 301
aucauuuaaaaag

SEQ ID NO: 1987379 - RNA, 15 nt, Shigella flexneri 2a str. 301
auccaaacauggcac

SEQ ID NO: 1987380 - RNA, 23 nt, Shigella flexneri 2a str. 301
auccaaaccgggugguaauacca

SEQ ID NO: 1987381 - RNA, 15 nt, Shigella flexneri 2a str. 301
auccaacaauagugc

SEQ ID NO: 1987382 - RNA, 17 nt, Shigella flexneri 2a str. 301
auccaacugauuuucau

SEQ ID NO: 1987383 - RNA, 22 nt, Shigella flexneri 2a str. 301
aucauuuuacguugcauuucca

SEQ ID NO: 1987384 - RNA, 14 nt, Shigella flexneri 2a str. 301
aucauuuuuuuaau

SEQ ID NO: 1987385 - RNA, 12 nt, Shigella flexneri 2a str. 301
auccaaugccgc

SEQ ID NO: 1987386 - RNA, 19 nt, Shigella flexneri 2a str. 301
auccaaugccgcagcggcg

SEQ ID NO: 1987387 - RNA, 20 nt, Shigella flexneri 2a str. 301
auccacaacgugggccuggc

SEQ ID NO: 1987388 - RNA, 22 nt, Shigella flexneri 2a str. 301
auccaagucaacgucauuaucu

SEQ ID NO: 1987389 - RNA, 20 nt, Shigella flexneri 2a str. 301
auccaccaguggacggcuga

SEQ ID NO: 1987390 - RNA, 13 nt, Shigella flexneri 2a str. 301
auccacccgcagc

SEQ ID NO: 1987391 - RNA, 14 nt, Shigella flexneri 2a str. 301
auccacccgcagcc

SEQ ID NO: 1987392 - RNA, 16 nt, Shigella flexneri 2a str. 301
auccacccgcagccau

SEQ ID NO: 1987393 - RNA, 15 nt, Shigella flexneri 2a str. 301
auccacagcaaugca

SEQ ID NO: 1987394 - RNA, 14 nt, Shigella flexneri 2a str. 301
auccacagcaaugc

SEQ ID NO: 1987395 - RNA, 13 nt, Shigella flexneri 2a str. 301
auccacagcaaug

SEQ ID NO: 1987396 - RNA, 16 nt, Shigella flexneri 2a str. 301
auccacagcaaugcau

SEQ ID NO: 1987397 - RNA, 15 nt, Shigella flexneri 2a str. 301
auccagauagaacau

SEQ ID NO: 1987398 - RNA, 14 nt, Shigella flexneri 2a str. 301
auccagauggcuau

SEQ ID NO: 1987399 - RNA, 21 nt, Shigella flexneri 2a str. 301
auccagauuuauaaaagaaaa

SEQ ID NO: 1987400 - RNA, 19 nt, Shigella flexneri 2a str. 301
auccacugucaaauccaga

SEQ ID NO: 1987401 - RNA, 18 nt, Shigella flexneri 2a str. 301
auccacgauacgcugcac

SEQ ID NO: 1987402 - RNA, 19 nt, Shigella flexneri 2a str. 301
auccacgauacgcugcaca

SEQ ID NO: 1987403 - RNA, 22 nt, Shigella flexneri 2a str. 301
auccaccuucuguaacuggaag

SEQ ID NO: 1987404 - RNA, 18 nt, Shigella flexneri 2a str. 301
auccacgccuuuuuucac

SEQ ID NO: 1987405 - RNA, 14 nt, Shigella flexneri 2a str. 301
auccaccgcguuca

SEQ ID NO: 1987406 - RNA, 22 nt, Shigella flexneri 2a str. 301
auccaccuccagcuccgccagc

SEQ ID NO: 1987407 - RNA, 15 nt, Shigella flexneri 2a str. 301
auccauacucuuucc

SEQ ID NO: 1987408 - RNA, 15 nt, Shigella flexneri 2a str. 301
auccauaccagcaca

SEQ ID NO: 1987409 - RNA, 22 nt, Shigella flexneri 2a str. 301
auccauaguguguuccucugcu

SEQ ID NO: 1987410 - RNA, 18 nt, Shigella flexneri 2a str. 301
auccauaucgauuucuac

SEQ ID NO: 1987411 - RNA, 18 nt, Shigella flexneri 2a str. 301
auccaucgccagcucaaa

SEQ ID NO: 1987412 - RNA, 18 nt, Shigella flexneri 2a str. 301
auccaugacaucuccagc

SEQ ID NO: 1987413 - RNA, 21 nt, Shigella flexneri 2a str. 301
auccauucggcgauuaacaag

SEQ ID NO: 1987414 - RNA, 20 nt, Shigella flexneri 2a str. 301
auccauucggcgauuaacaa

SEQ ID NO: 1987415 - RNA, 20 nt, Shigella flexneri 2a str. 301
auccaugcgcauuaagccau

SEQ ID NO: 1987416 - RNA, 19 nt, Shigella flexneri 2a str. 301
auccaugccgaguggcauu

SEQ ID NO: 1987417 - RNA, 19 nt, Shigella flexneri 2a str. 301
aucccaguucgauuuccca

SEQ ID NO: 1987418 - RNA, 16 nt, Shigella flexneri 2a str. 301
aucccagugccugcau

SEQ ID NO: 1987419 - RNA, 11 nt, Shigella flexneri 2a str. 301
aucccagcagu

SEQ ID NO: 1987420 - RNA, 16 nt, Shigella flexneri 2a str. 301
aucccagucuucauca

SEQ ID NO: 1987421 - RNA, 21 nt, Shigella flexneri 2a str. 301
aucccagcugccgccaggcuu

SEQ ID NO: 1987422 - RNA, 17 nt, Shigella flexneri 2a str. 301
aucccagaucgcuuucc

SEQ ID NO: 1987423 - RNA, 17 nt, Shigella flexneri 2a str. 301
aucccaauacccgcaac

SEQ ID NO: 1987424 - RNA, 22 nt, Shigella flexneri 2a str. 301
aucccacagccgucgagggcaa

SEQ ID NO: 1987425 - RNA, 16 nt, Shigella flexneri 2a str. 301
aucccaccaccagcaa

SEQ ID NO: 1987426 - RNA, 11 nt, Shigella flexneri 2a str. 301
aucccaaagcu

SEQ ID NO: 1987427 - RNA, 15 nt, Shigella flexneri 2a str. 301
auccaguuccuucaa

SEQ ID NO: 1987428 - RNA, 14 nt, Shigella flexneri 2a str. 301
auccauaagguccu

SEQ ID NO: 1987429 - RNA, 16 nt, Shigella flexneri 2a str. 301
auccagugaaacgcuu

SEQ ID NO: 1987430 - RNA, 13 nt, Shigella flexneri 2a str. 301
auccagucccccc

SEQ ID NO: 1987431 - RNA, 17 nt, Shigella flexneri 2a str. 301
auccaguacgccuucac

SEQ ID NO: 1987432 - RNA, 14 nt, Shigella flexneri 2a str. 301
auccaguacaugaa

SEQ ID NO: 1987433 - RNA, 23 nt, Shigella flexneri 2a str. 301
auccaguggcuguguaagaaucc

SEQ ID NO: 1987434 - RNA, 20 nt, Shigella flexneri 2a str. 301
auccagugcguaucaauagc

SEQ ID NO: 1987435 - RNA, 16 nt, Shigella flexneri 2a str. 301
auccagugauuccagu

SEQ ID NO: 1987436 - RNA, 20 nt, Shigella flexneri 2a str. 301
auccaguguaaaacagcacu

SEQ ID NO: 1987437 - RNA, 19 nt, Shigella flexneri 2a str. 301
auccagggaucaacauuca

SEQ ID NO: 1987438 - RNA, 14 nt, Shigella flexneri 2a str. 301
auccaggagcucca

SEQ ID NO: 1987439 - RNA, 20 nt, Shigella flexneri 2a str. 301
auccaggagcuccagguccu

SEQ ID NO: 1987440 - RNA, 15 nt, Shigella flexneri 2a str. 301
auccaggguuuuauu

SEQ ID NO: 1987441 - RNA, 18 nt, Shigella flexneri 2a str. 301
auccagguuacgcaccag

SEQ ID NO: 1987442 - RNA, 20 nt, Shigella flexneri 2a str. 301
auccagcagugacucacgaa

SEQ ID NO: 1987443 - RNA, 19 nt, Shigella flexneri 2a str. 301
auccagcagugacucacga

SEQ ID NO: 1987444 - RNA, 22 nt, Shigella flexneri 2a str. 301
auccagcagcggaucgaacucc

SEQ ID NO: 1987445 - RNA, 16 nt, Shigella flexneri 2a str. 301
auccagcagugacuca

SEQ ID NO: 1987446 - RNA, 16 nt, Shigella flexneri 2a str. 301
auccagcaccuuuugc

SEQ ID NO: 1987447 - RNA, 21 nt, Shigella flexneri 2a str. 301
auccagccuacaaauuugugc

SEQ ID NO: 1987448 - RNA, 18 nt, Shigella flexneri 2a str. 301
auccagccggcaaagugg

SEQ ID NO: 1987449 - RNA, 23 nt, Shigella flexneri 2a str. 301
auccagcccugccaggucaucau

SEQ ID NO: 1987450 - RNA, 11 nt, Shigella flexneri 2a str. 301
auccagccaaa

SEQ ID NO: 1987451 - RNA, 14 nt, Shigella flexneri 2a str. 301
auccagccacggcu

SEQ ID NO: 1987452 - RNA, 14 nt, Shigella flexneri 2a str. 301
auccagccagucuu

SEQ ID NO: 1987453 - RNA, 17 nt, Shigella flexneri 2a str. 301
auccagccacggcucca

SEQ ID NO: 1987454 - RNA, 16 nt, Shigella flexneri 2a str. 301
auccagcucuuuucca

SEQ ID NO: 1987455 - RNA, 17 nt, Shigella flexneri 2a str. 301
auccagcuuuucccagc

SEQ ID NO: 1987456 - RNA, 13 nt, Shigella flexneri 2a str. 301
auccaggaacucc

SEQ ID NO: 1987457 - RNA, 14 nt, Shigella flexneri 2a str. 301
auccaggaacucca

SEQ ID NO: 1987458 - RNA, 17 nt, Shigella flexneri 2a str. 301
auccaggaacuccagau

SEQ ID NO: 1987459 - RNA, 20 nt, Shigella flexneri 2a str. 301
auccagcgacugacgugccu

SEQ ID NO: 1987460 - RNA, 11 nt, Shigella flexneri 2a str. 301
aucccucuuuc

SEQ ID NO: 1987461 - RNA, 22 nt, Shigella flexneri 2a str. 301
aucccuccacgacguguuccug

SEQ ID NO: 1987462 - RNA, 20 nt, Shigella flexneri 2a str. 301
aucccggcuccaaugacuau

SEQ ID NO: 1987463 - RNA, 18 nt, Shigella flexneri 2a str. 301
aucccgcgcguuuuucuu

SEQ ID NO: 1987464 - RNA, 20 nt, Shigella flexneri 2a str. 301
aucccgcucuguaagacauu

SEQ ID NO: 1987465 - RNA, 17 nt, Shigella flexneri 2a str. 301
aucccggauaucaccac

SEQ ID NO: 1987466 - RNA, 14 nt, Shigella flexneri 2a str. 301
aucccggaagccac

SEQ ID NO: 1987467 - RNA, 21 nt, Shigella flexneri 2a str. 301
auccccgcucucccaguaacc

SEQ ID NO: 1987468 - RNA, 19 nt, Shigella flexneri 2a str. 301
auccccgggcggccucuuc

SEQ ID NO: 1987469 - RNA, 14 nt, Shigella flexneri 2a str. 301
auccccgggcggcc

SEQ ID NO: 1987470 - RNA, 19 nt, Shigella flexneri 2a str. 301
auccccaccaaaacagcga

SEQ ID NO: 1987471 - RNA, 20 nt, Shigella flexneri 2a str. 301
auccccaccaaaacagcgac

SEQ ID NO: 1987472 - RNA, 13 nt, Shigella flexneri 2a str. 301
auccccagccuaa

SEQ ID NO: 1987473 - RNA, 18 nt, Shigella flexneri 2a str. 301
auccccagccuaagccau

SEQ ID NO: 1987474 - RNA, 12 nt, Shigella flexneri 2a str. 301
aucccccacuuu

SEQ ID NO: 1987475 - RNA, 17 nt, Shigella flexneri 2a str. 301
aucccccacuuuuaaau

SEQ ID NO: 1987476 - RNA, 14 nt, Shigella flexneri 2a str. 301
auccgccagccaau

SEQ ID NO: 1987477 - RNA, 19 nt, Shigella flexneri 2a str. 301
auccgccaguuuguagcca

SEQ ID NO: 1987478 - RNA, 16 nt, Shigella flexneri 2a str. 301
auccgcagucccuuuc

SEQ ID NO: 1987479 - RNA, 19 nt, Shigella flexneri 2a str. 301
auccgcagucccuuuccca

SEQ ID NO: 1987480 - RNA, 16 nt, Shigella flexneri 2a str. 301
auccgcuggcccauca

SEQ ID NO: 1987481 - RNA, 19 nt, Shigella flexneri 2a str. 301
auccgcuucgguauauuuc

SEQ ID NO: 1987482 - RNA, 21 nt, Shigella flexneri 2a str. 301
auccggaucgagaauauucac

SEQ ID NO: 1987483 - RNA, 22 nt, Shigella flexneri 2a str. 301
auccggcaacaaaauauccugu

SEQ ID NO: 1987484 - RNA, 16 nt, Shigella flexneri 2a str. 301
auccggcaagaucacc

SEQ ID NO: 1987485 - RNA, 18 nt, Shigella flexneri 2a str. 301
auccggauucaaaccuaa

SEQ ID NO: 1987486 - RNA, 13 nt, Shigella flexneri 2a str. 301
auccgcaaugugu

SEQ ID NO: 1987487 - RNA, 17 nt, Shigella flexneri 2a str. 301
auccgcacaaucccuua

SEQ ID NO: 1987488 - RNA, 17 nt, Shigella flexneri 2a str. 301
auccgacgguuucacga

SEQ ID NO: 1987489 - RNA, 21 nt, Shigella flexneri 2a str. 301
auccgaccuacaaaaccugca

SEQ ID NO: 1987490 - RNA, 15 nt, Shigella flexneri 2a str. 301
aucccugcuguccug

SEQ ID NO: 1987491 - RNA, 20 nt, Shigella flexneri 2a str. 301
auccgacauuucugcugccu

SEQ ID NO: 1987492 - RNA, 14 nt, Shigella flexneri 2a str. 301
auccgacacuggca

SEQ ID NO: 1987493 - RNA, 14 nt, Shigella flexneri 2a str. 301
auccuauauuccuu

SEQ ID NO: 1987494 - RNA, 18 nt, Shigella flexneri 2a str. 301
auccuacgaccgcaugcg

SEQ ID NO: 1987495 - RNA, 16 nt, Shigella flexneri 2a str. 301
auccucaacgccgcau

SEQ ID NO: 1987496 - RNA, 14 nt, Shigella flexneri 2a str. 301
auccuaaaggcaaa

SEQ ID NO: 1987497 - RNA, 20 nt, Shigella flexneri 2a str. 301
auccguuuugugguguuuuu

SEQ ID NO: 1987498 - RNA, 22 nt, Shigella flexneri 2a str. 301
auccgugguggcagccagccau

SEQ ID NO: 1987499 - RNA, 13 nt, Shigella flexneri 2a str. 301
auccguuucccug

SEQ ID NO: 1987500 - RNA, 22 nt, Shigella flexneri 2a str. 301
auccggucuaccgauccggcac

SEQ ID NO: 1987501 - RNA, 21 nt, Shigella flexneri 2a str. 301
auccguccuccguaucuuguc

SEQ ID NO: 1987502 - RNA, 18 nt, Shigella flexneri 2a str. 301
auccguaaagcccauacc

SEQ ID NO: 1987503 - RNA, 17 nt, Shigella flexneri 2a str. 301
auccgucacuucaggau

SEQ ID NO: 1987504 - RNA, 15 nt, Shigella flexneri 2a str. 301
auccggcucguaauc

SEQ ID NO: 1987505 - RNA, 19 nt, Shigella flexneri 2a str. 301
auccggcuauauugcagga

SEQ ID NO: 1987506 - RNA, 19 nt, Shigella flexneri 2a str. 301
auccggcguggaaaccuug

SEQ ID NO: 1987507 - RNA, 22 nt, Shigella flexneri 2a str. 301
auccggcaccuuuucaucaggu

SEQ ID NO: 1987508 - RNA, 14 nt, Shigella flexneri 2a str. 301
auccggcaugaaca

SEQ ID NO: 1987509 - RNA, 20 nt, Shigella flexneri 2a str. 301
auccggcauuugagcaggau

SEQ ID NO: 1987510 - RNA, 23 nt, Shigella flexneri 2a str. 301
auccugagccaguuuuucuuuuu

SEQ ID NO: 1987511 - RNA, 14 nt, Shigella flexneri 2a str. 301
auccugagcagcca

SEQ ID NO: 1987512 - RNA, 22 nt, Shigella flexneri 2a str. 301
auccugacgagcuuucuuauuu

SEQ ID NO: 1987513 - RNA, 18 nt, Shigella flexneri 2a str. 301
auccugaucaagcacaug

SEQ ID NO: 1987514 - RNA, 15 nt, Shigella flexneri 2a str. 301
auccugauacagacc

SEQ ID NO: 1987515 - RNA, 19 nt, Shigella flexneri 2a str. 301
auccugauccugcaacagc

SEQ ID NO: 1987516 - RNA, 18 nt, Shigella flexneri 2a str. 301
auccucuuugcuuccuga

SEQ ID NO: 1987517 - RNA, 22 nt, Shigella flexneri 2a str. 301
auccugaaauuccugagaggau

SEQ ID NO: 1987518 - RNA, 23 nt, Shigella flexneri 2a str. 301
auccugaagacgccucgcauuuu

SEQ ID NO: 1987519 - RNA, 14 nt, Shigella flexneri 2a str. 301
auccugaaucaccu

SEQ ID NO: 1987520 - RNA, 12 nt, Shigella flexneri 2a str. 301
auccucuucagc

SEQ ID NO: 1987521 - RNA, 20 nt, Shigella flexneri 2a str. 301
auccucuaucuguuugccag

SEQ ID NO: 1987522 - RNA, 19 nt, Shigella flexneri 2a str. 301
auccugcgcuuccugcaac

SEQ ID NO: 1987523 - RNA, 17 nt, Shigella flexneri 2a str. 301
auccugcggcagcucca

SEQ ID NO: 1987524 - RNA, 16 nt, Shigella flexneri 2a str. 301
auccugccgagauaca

SEQ ID NO: 1987525 - RNA, 18 nt, Shigella flexneri 2a str. 301
auccugcgcacaagccca

SEQ ID NO: 1987526 - RNA, 20 nt, Shigella flexneri 2a str. 301
auccugcugcacgcccugau

SEQ ID NO: 1987527 - RNA, 13 nt, Shigella flexneri 2a str. 301
auccugcagugcg

SEQ ID NO: 1987528 - RNA, 13 nt, Shigella flexneri 2a str. 301
auccuggcacagc

SEQ ID NO: 1987529 - RNA, 16 nt, Shigella flexneri 2a str. 301
auccuggacuuuaaac

SEQ ID NO: 1987530 - RNA, 21 nt, Shigella flexneri 2a str. 301
auccuggggguucaucaccac

SEQ ID NO: 1987531 - RNA, 24 nt, Shigella flexneri 2a str. 301
auccuguacgacaaaagaauggcu

SEQ ID NO: 1987532 - RNA, 17 nt, Shigella flexneri 2a str. 301
aucgguuuucagcucgc

SEQ ID NO: 1987533 - RNA, 19 nt, Shigella flexneri 2a str. 301
aucggcggugaccagcagc

SEQ ID NO: 1987534 - RNA, 22 nt, Shigella flexneri 2a str. 301
aucggcgcuacggcguuucacu

SEQ ID NO: 1987535 - RNA, 21 nt, Shigella flexneri 2a str. 301
aucggcggugaccagcagcau

SEQ ID NO: 1987536 - RNA, 17 nt, Shigella flexneri 2a str. 301
aucggcguuuucugacc

SEQ ID NO: 1987537 - RNA, 21 nt, Shigella flexneri 2a str. 301
aucgucacgcgcgccaagccc

SEQ ID NO: 1987538 - RNA, 21 nt, Shigella flexneri 2a str. 301
aucgucacgaucgcgccagcc

SEQ ID NO: 1987539 - RNA, 21 nt, Shigella flexneri 2a str. 301
aucguauugguacauaacaca

SEQ ID NO: 1987540 - RNA, 20 nt, Shigella flexneri 2a str. 301
aucguacaggcacaugucca

SEQ ID NO: 1987541 - RNA, 14 nt, Shigella flexneri 2a str. 301
aucguaaucagcau

SEQ ID NO: 1987542 - RNA, 15 nt, Shigella flexneri 2a str. 301
aucguacaggcacau

SEQ ID NO: 1987543 - RNA, 12 nt, Shigella flexneri 2a str. 301
aucgugaaacaa

SEQ ID NO: 1987544 - RNA, 23 nt, Shigella flexneri 2a str. 301
aucgugacaauaauacccagcac

SEQ ID NO: 1987545 - RNA, 19 nt, Shigella flexneri 2a str. 301
aucgugagcguauugguga

SEQ ID NO: 1987546 - RNA, 18 nt, Shigella flexneri 2a str. 301
aucgucugcgccaccaca

SEQ ID NO: 1987547 - RNA, 20 nt, Shigella flexneri 2a str. 301
aucgucugcgccaccacaac

SEQ ID NO: 1987548 - RNA, 16 nt, Shigella flexneri 2a str. 301
aucgucaguuuuucac

SEQ ID NO: 1987549 - RNA, 21 nt, Shigella flexneri 2a str. 301
aucuaaccauuauuaaauuua

SEQ ID NO: 1987550 - RNA, 16 nt, Shigella flexneri 2a str. 301
aucuaacgcccgagcc

SEQ ID NO: 1987551 - RNA, 21 nt, Shigella flexneri 2a str. 301
aucguuguuacaacaucaaca

SEQ ID NO: 1987552 - RNA, 16 nt, Shigella flexneri 2a str. 301
aucgcugaaagauggc

SEQ ID NO: 1987553 - RNA, 13 nt, Shigella flexneri 2a str. 301
aucgcugauauac

SEQ ID NO: 1987554 - RNA, 17 nt, Shigella flexneri 2a str. 301
aucgcugacacgggaaa

SEQ ID NO: 1987555 - RNA, 18 nt, Shigella flexneri 2a str. 301
aucgcugaacgcaccuuc

SEQ ID NO: 1987556 - RNA, 15 nt, Shigella flexneri 2a str. 301
aucgcugcuaauuua

SEQ ID NO: 1987557 - RNA, 20 nt, Shigella flexneri 2a str. 301
aucgcugcgcucuaaaauca

SEQ ID NO: 1987558 - RNA, 22 nt, Shigella flexneri 2a str. 301
aucgcuauuaacccgcaacagc

SEQ ID NO: 1987559 - RNA, 12 nt, Shigella flexneri 2a str. 301
aucgcgaccaau

SEQ ID NO: 1987560 - RNA, 13 nt, Shigella flexneri 2a str. 301
aucgcuacaccaa

SEQ ID NO: 1987561 - RNA, 16 nt, Shigella flexneri 2a str. 301
aucgcgaagaaagcgg

SEQ ID NO: 1987562 - RNA, 23 nt, Shigella flexneri 2a str. 301
aucgccuuuugcccggcaacaac

SEQ ID NO: 1987563 - RNA, 21 nt, Shigella flexneri 2a str. 301
aucgccuucgcaaaaaaccau

SEQ ID NO: 1987564 - RNA, 18 nt, Shigella flexneri 2a str. 301
aucgccuuaauaacccac

SEQ ID NO: 1987565 - RNA, 15 nt, Shigella flexneri 2a str. 301
aucgccugguaccag

SEQ ID NO: 1987566 - RNA, 14 nt, Shigella flexneri 2a str. 301
aucgccuggugacc

SEQ ID NO: 1987567 - RNA, 14 nt, Shigella flexneri 2a str. 301
aucgcugugcugcu

SEQ ID NO: 1987568 - RNA, 19 nt, Shigella flexneri 2a str. 301
aucgcuguggaacaucacc

SEQ ID NO: 1987569 - RNA, 21 nt, Shigella flexneri 2a str. 301
aucgcuuucuucaaccaggcg

SEQ ID NO: 1987570 - RNA, 14 nt, Shigella flexneri 2a str. 301
aucgcuuucagugu

SEQ ID NO: 1987571 - RNA, 18 nt, Shigella flexneri 2a str. 301
aucggaaacaaauacaug

SEQ ID NO: 1987572 - RNA, 19 nt, Shigella flexneri 2a str. 301
aucgcuuucgcuuucucuu

SEQ ID NO: 1987573 - RNA, 14 nt, Shigella flexneri 2a str. 301
aucggaacaacagu

SEQ ID NO: 1987574 - RNA, 14 nt, Shigella flexneri 2a str. 301
aucggcaaucacau

SEQ ID NO: 1987575 - RNA, 12 nt, Shigella flexneri 2a str. 301
aucggcaaggaa

SEQ ID NO: 1987576 - RNA, 13 nt, Shigella flexneri 2a str. 301
aucggcaccacca

SEQ ID NO: 1987577 - RNA, 21 nt, Shigella flexneri 2a str. 301
aucggcaccauuuaaaucaau

SEQ ID NO: 1987578 - RNA, 23 nt, Shigella flexneri 2a str. 301
aucggcagagugaagguuucugc

SEQ ID NO: 1987579 - RNA, 19 nt, Shigella flexneri 2a str. 301
aucggcauacagcgacaga

SEQ ID NO: 1987580 - RNA, 12 nt, Shigella flexneri 2a str. 301
aucggcaggcag

SEQ ID NO: 1987581 - RNA, 23 nt, Shigella flexneri 2a str. 301
aucgccgcguagagaaaaccaau

SEQ ID NO: 1987582 - RNA, 17 nt, Shigella flexneri 2a str. 301
aucgccgcuggaaauga

SEQ ID NO: 1987583 - RNA, 15 nt, Shigella flexneri 2a str. 301
aucgccagcagccau

SEQ ID NO: 1987584 - RNA, 12 nt, Shigella flexneri 2a str. 301
aucgccagcauc

SEQ ID NO: 1987585 - RNA, 23 nt, Shigella flexneri 2a str. 301
aucgccagcaaaaucaccaucac

SEQ ID NO: 1987586 - RNA, 14 nt, Shigella flexneri 2a str. 301
aucgccagcucaag

SEQ ID NO: 1987587 - RNA, 13 nt, Shigella flexneri 2a str. 301
aucgccagugccg

SEQ ID NO: 1987588 - RNA, 19 nt, Shigella flexneri 2a str. 301
aucgccagugccgcccacc

SEQ ID NO: 1987589 - RNA, 23 nt, Shigella flexneri 2a str. 301
aucgagagaauggggucagcagg

SEQ ID NO: 1987590 - RNA, 12 nt, Shigella flexneri 2a str. 301
aucgagaaucag

SEQ ID NO: 1987591 - RNA, 18 nt, Shigella flexneri 2a str. 301
aucgaucauauuuccuuc

SEQ ID NO: 1987592 - RNA, 20 nt, Shigella flexneri 2a str. 301
aucgacuaacuucugaucua

SEQ ID NO: 1987593 - RNA, 13 nt, Shigella flexneri 2a str. 301
aucgccaaauuug

SEQ ID NO: 1987594 - RNA, 18 nt, Shigella flexneri 2a str. 301
aucgccaauaucaaucuu

SEQ ID NO: 1987595 - RNA, 22 nt, Shigella flexneri 2a str. 301
aucgccaccguuauccugauaa

SEQ ID NO: 1987596 - RNA, 21 nt, Shigella flexneri 2a str. 301
aucgccacggcaugaaagcga

SEQ ID NO: 1987597 - RNA, 18 nt, Shigella flexneri 2a str. 301
aucgaugggauauaaccc

SEQ ID NO: 1987598 - RNA, 16 nt, Shigella flexneri 2a str. 301
aucgccaaagcggcag

SEQ ID NO: 1987599 - RNA, 17 nt, Shigella flexneri 2a str. 301
aucgauugcacauuccc

SEQ ID NO: 1987600 - RNA, 13 nt, Shigella flexneri 2a str. 301
aucgaccaaccuu

SEQ ID NO: 1987601 - RNA, 22 nt, Shigella flexneri 2a str. 301
aucgaccaggccaucagcagcg

SEQ ID NO: 1987602 - RNA, 16 nt, Shigella flexneri 2a str. 301
aucgacaaaaucggaa

SEQ ID NO: 1987603 - RNA, 20 nt, Shigella flexneri 2a str. 301
auccuuuccuuaagccagcg

SEQ ID NO: 1987604 - RNA, 13 nt, Shigella flexneri 2a str. 301
aucgaagagacaa

SEQ ID NO: 1987605 - RNA, 14 nt, Shigella flexneri 2a str. 301
auccuuccagcucc

SEQ ID NO: 1987606 - RNA, 19 nt, Shigella flexneri 2a str. 301
auccuuccagcuccagccg

SEQ ID NO: 1987607 - RNA, 16 nt, Shigella flexneri 2a str. 301
auccuucacacugccu

SEQ ID NO: 1987608 - RNA, 17 nt, Shigella flexneri 2a str. 301
auccuucacacugccuc

SEQ ID NO: 1987609 - RNA, 17 nt, Shigella flexneri 2a str. 301
auccuucacuuuugcca

SEQ ID NO: 1987610 - RNA, 19 nt, Shigella flexneri 2a str. 301
auccuucagcaacuuguuc

SEQ ID NO: 1987611 - RNA, 16 nt, Shigella flexneri 2a str. 301
auccuuuaccggaugu

SEQ ID NO: 1987612 - RNA, 17 nt, Shigella flexneri 2a str. 301
caauuccagcaagccac

SEQ ID NO: 1987613 - RNA, 20 nt, Shigella flexneri 2a str. 301
caauuccagcaagccacugg

SEQ ID NO: 1987614 - RNA, 15 nt, Shigella flexneri 2a str. 301
caauucauuccuuga

SEQ ID NO: 1987615 - RNA, 14 nt, Shigella flexneri 2a str. 301
caauuccagcgcca

SEQ ID NO: 1987616 - RNA, 13 nt, Shigella flexneri 2a str. 301
caauuccauuucc

SEQ ID NO: 1987617 - RNA, 21 nt, Shigella flexneri 2a str. 301
caauuccauuucccugacaaa

SEQ ID NO: 1987618 - RNA, 20 nt, Shigella flexneri 2a str. 301
caauucccggaccgucaucu

SEQ ID NO: 1987619 - RNA, 16 nt, Shigella flexneri 2a str. 301
caauuccuucugggcg

SEQ ID NO: 1987620 - RNA, 15 nt, Shigella flexneri 2a str. 301
caauugaccaguaau

SEQ ID NO: 1987621 - RNA, 17 nt, Shigella flexneri 2a str. 301
caauugacaguuuauuu

SEQ ID NO: 1987622 - RNA, 15 nt, Shigella flexneri 2a str. 301
caauugaagaauauc

SEQ ID NO: 1987623 - RNA, 23 nt, Shigella flexneri 2a str. 301
caauugcgcaccagcuugcgaca

SEQ ID NO: 1987624 - RNA, 16 nt, Shigella flexneri 2a str. 301
caauugcgggccaaag

SEQ ID NO: 1987625 - RNA, 18 nt, Shigella flexneri 2a str. 301
caauugcgggccaaagac

SEQ ID NO: 1987626 - RNA, 19 nt, Shigella flexneri 2a str. 301
caauuguucugcgcugaaa

SEQ ID NO: 1987627 - RNA, 20 nt, Shigella flexneri 2a str. 301
caauucaauuaauucuccgc

SEQ ID NO: 1987628 - RNA, 23 nt, Shigella flexneri 2a str. 301
caauucacacagugaaucucuua

SEQ ID NO: 1987629 - RNA, 19 nt, Shigella flexneri 2a str. 301
caauucacgaauauuuccc

SEQ ID NO: 1987630 - RNA, 20 nt, Shigella flexneri 2a str. 301
caauucacgaauauuucccg

SEQ ID NO: 1987631 - RNA, 22 nt, Shigella flexneri 2a str. 301
caauuaucuggaauuccuuucc

SEQ ID NO: 1987632 - RNA, 21 nt, Shigella flexneri 2a str. 301
caauuaucccugcggaaaaaa

SEQ ID NO: 1987633 - RNA, 23 nt, Shigella flexneri 2a str. 301
caauuaucccugcggaaaaaaga

SEQ ID NO: 1987634 - RNA, 14 nt, Shigella flexneri 2a str. 301
caauuaucuggaau

SEQ ID NO: 1987635 - RNA, 21 nt, Shigella flexneri 2a str. 301
caauuacugcauugaauuucu

SEQ ID NO: 1987636 - RNA, 20 nt, Shigella flexneri 2a str. 301
caauuacugagagaaaaaaa

SEQ ID NO: 1987637 - RNA, 18 nt, Shigella flexneri 2a str. 301
caauuaccaacucaucgc

SEQ ID NO: 1987638 - RNA, 17 nt, Shigella flexneri 2a str. 301
caauuaccacaaguaaa

SEQ ID NO: 1987639 - RNA, 15 nt, Shigella flexneri 2a str. 301
caauuacaugcuggu

SEQ ID NO: 1987640 - RNA, 16 nt, Shigella flexneri 2a str. 301
caauuacaguuucuga

SEQ ID NO: 1987641 - RNA, 12 nt, Shigella flexneri 2a str. 301
caauuaccuucc

SEQ ID NO: 1987642 - RNA, 22 nt, Shigella flexneri 2a str. 301
caauuagugggauucaccaauc

SEQ ID NO: 1987643 - RNA, 23 nt, Shigella flexneri 2a str. 301
caauuagugggauucaccaaucg

SEQ ID NO: 1987644 - RNA, 23 nt, Shigella flexneri 2a str. 301
caauuauaguaucguuaaauucu

SEQ ID NO: 1987645 - RNA, 14 nt, Shigella flexneri 2a str. 301
caauuagauuuaau

SEQ ID NO: 1987646 - RNA, 17 nt, Shigella flexneri 2a str. 301
caauuaauucuccgcuc

SEQ ID NO: 1987647 - RNA, 21 nt, Shigella flexneri 2a str. 301
caauuaauugccagccgucau

SEQ ID NO: 1987648 - RNA, 22 nt, Shigella flexneri 2a str. 301
caauuaaugcaccaacaaauag

SEQ ID NO: 1987649 - RNA, 19 nt, Shigella flexneri 2a str. 301
caauuaaugcaccaacaaa

SEQ ID NO: 1987650 - RNA, 21 nt, Shigella flexneri 2a str. 301
caauuaaugcaccaacaaaua

SEQ ID NO: 1987651 - RNA, 17 nt, Shigella flexneri 2a str. 301
caauuaauaacacauau

SEQ ID NO: 1987652 - RNA, 22 nt, Shigella flexneri 2a str. 301
caauuaacgguaauaauucucc

SEQ ID NO: 1987653 - RNA, 16 nt, Shigella flexneri 2a str. 301
caauuaacgaaaucuc

SEQ ID NO: 1987654 - RNA, 17 nt, Shigella flexneri 2a str. 301
caaucacugccagaaua

SEQ ID NO: 1987655 - RNA, 22 nt, Shigella flexneri 2a str. 301
caaucacuuugucgaucuccgc

SEQ ID NO: 1987656 - RNA, 14 nt, Shigella flexneri 2a str. 301
caaucagauaaaau

SEQ ID NO: 1987657 - RNA, 21 nt, Shigella flexneri 2a str. 301
caaucagauaaaauacacuuu

SEQ ID NO: 1987658 - RNA, 15 nt, Shigella flexneri 2a str. 301
caaucagcacacaua

SEQ ID NO: 1987659 - RNA, 12 nt, Shigella flexneri 2a str. 301
caaucagaugug

SEQ ID NO: 1987660 - RNA, 22 nt, Shigella flexneri 2a str. 301
caaucagguaagcgauaaaaau

SEQ ID NO: 1987661 - RNA, 19 nt, Shigella flexneri 2a str. 301
caauuuuaccuagcacugu

SEQ ID NO: 1987662 - RNA, 17 nt, Shigella flexneri 2a str. 301
caauuuuucaucggcaa

SEQ ID NO: 1987663 - RNA, 17 nt, Shigella flexneri 2a str. 301
cacaaaaauagccccaa

SEQ ID NO: 1987664 - RNA, 19 nt, Shigella flexneri 2a str. 301
cacaaaacacucuucaaca

SEQ ID NO: 1987665 - RNA, 14 nt, Shigella flexneri 2a str. 301
cacaaaagacgaua

SEQ ID NO: 1987666 - RNA, 14 nt, Shigella flexneri 2a str. 301
caauuucacguuca

SEQ ID NO: 1987667 - RNA, 12 nt, Shigella flexneri 2a str. 301
caauuuccaguu

SEQ ID NO: 1987668 - RNA, 19 nt, Shigella flexneri 2a str. 301
caauuuacguuuuaaaccu

SEQ ID NO: 1987669 - RNA, 20 nt, Shigella flexneri 2a str. 301
caauuucucguuggucauca

SEQ ID NO: 1987670 - RNA, 14 nt, Shigella flexneri 2a str. 301
caauuugcaauuuu

SEQ ID NO: 1987671 - RNA, 22 nt, Shigella flexneri 2a str. 301
caauuucugugcagccaaaaau

SEQ ID NO: 1987672 - RNA, 14 nt, Shigella flexneri 2a str. 301
cacaaacagcgccu

SEQ ID NO: 1987673 - RNA, 12 nt, Shigella flexneri 2a str. 301
cacaaacaucau

SEQ ID NO: 1987674 - RNA, 20 nt, Shigella flexneri 2a str. 301
cacaaacgaauuaucacucu

SEQ ID NO: 1987675 - RNA, 15 nt, Shigella flexneri 2a str. 301
cacaaacgccgugca

SEQ ID NO: 1987676 - RNA, 17 nt, Shigella flexneri 2a str. 301
cacaaacgccgugcaca

SEQ ID NO: 1987677 - RNA, 13 nt, Shigella flexneri 2a str. 301
cacaaacaauuug

SEQ ID NO: 1987678 - RNA, 13 nt, Shigella flexneri 2a str. 301
cacaaaaccugcc

SEQ ID NO: 1987679 - RNA, 23 nt, Shigella flexneri 2a str. 301
cacaaaaucacgucgauuuuuaa

SEQ ID NO: 1987680 - RNA, 14 nt, Shigella flexneri 2a str. 301
cacaaaaucaugag

SEQ ID NO: 1987681 - RNA, 17 nt, Shigella flexneri 2a str. 301
cacaaauacgcuuuuuc

SEQ ID NO: 1987682 - RNA, 16 nt, Shigella flexneri 2a str. 301
cacaaaguaaacaaua

SEQ ID NO: 1987683 - RNA, 18 nt, Shigella flexneri 2a str. 301
cacaaacucuuuuccgga

SEQ ID NO: 1987684 - RNA, 19 nt, Shigella flexneri 2a str. 301
cacaaagcuguaucccagc

SEQ ID NO: 1987685 - RNA, 19 nt, Shigella flexneri 2a str. 301
cacaaaggcgcgaagcugg

SEQ ID NO: 1987686 - RNA, 18 nt, Shigella flexneri 2a str. 301
cacaacgagcgcaaugaa

SEQ ID NO: 1987687 - RNA, 12 nt, Shigella flexneri 2a str. 301
cacaacaggcua

SEQ ID NO: 1987688 - RNA, 14 nt, Shigella flexneri 2a str. 301
cacaaccacuuugu

SEQ ID NO: 1987689 - RNA, 21 nt, Shigella flexneri 2a str. 301
cacaacauucccaucaguagc

SEQ ID NO: 1987690 - RNA, 16 nt, Shigella flexneri 2a str. 301
cacaacgcuuucaaca

SEQ ID NO: 1987691 - RNA, 20 nt, Shigella flexneri 2a str. 301
cacaacgcuuucaacaaccu

SEQ ID NO: 1987692 - RNA, 14 nt, Shigella flexneri 2a str. 301
cacaacgcuuucaa

SEQ ID NO: 1987693 - RNA, 11 nt, Shigella flexneri 2a str. 301
cacaagacugu

SEQ ID NO: 1987694 - RNA, 19 nt, Shigella flexneri 2a str. 301
cacaacuggcuugguaaca

SEQ ID NO: 1987695 - RNA, 22 nt, Shigella flexneri 2a str. 301
cacaacugcgaccguacaacca

SEQ ID NO: 1987696 - RNA, 23 nt, Shigella flexneri 2a str. 301
cacaacugcgaccguacaaccaa

SEQ ID NO: 1987697 - RNA, 14 nt, Shigella flexneri 2a str. 301
cacaacuccauaca

SEQ ID NO: 1987698 - RNA, 20 nt, Shigella flexneri 2a str. 301
cacacugguucccaacaaca

SEQ ID NO: 1987699 - RNA, 15 nt, Shigella flexneri 2a str. 301
cacacugguucccaa

SEQ ID NO: 1987700 - RNA, 13 nt, Shigella flexneri 2a str. 301
cacacugcuuaac

SEQ ID NO: 1987701 - RNA, 20 nt, Shigella flexneri 2a str. 301
cacacuucaauauuaaugcu

SEQ ID NO: 1987702 - RNA, 17 nt, Shigella flexneri 2a str. 301
cacagaaccggagucag

SEQ ID NO: 1987703 - RNA, 14 nt, Shigella flexneri 2a str. 301
cacacgcgcugagg

SEQ ID NO: 1987704 - RNA, 18 nt, Shigella flexneri 2a str. 301
cacacugaugacaggcua

SEQ ID NO: 1987705 - RNA, 13 nt, Shigella flexneri 2a str. 301
cacaccugcucag

SEQ ID NO: 1987706 - RNA, 13 nt, Shigella flexneri 2a str. 301
cacacgcgcugag

SEQ ID NO: 1987707 - RNA, 19 nt, Shigella flexneri 2a str. 301
cacacgccgcgaggcaaau

SEQ ID NO: 1987708 - RNA, 18 nt, Shigella flexneri 2a str. 301
cacacgccaggccacgcu

SEQ ID NO: 1987709 - RNA, 14 nt, Shigella flexneri 2a str. 301
cacaccagucagcg

SEQ ID NO: 1987710 - RNA, 22 nt, Shigella flexneri 2a str. 301
cacaccauugauaauccaucac

SEQ ID NO: 1987711 - RNA, 14 nt, Shigella flexneri 2a str. 301
cacaccaguaaagc

SEQ ID NO: 1987712 - RNA, 19 nt, Shigella flexneri 2a str. 301
cacacccgguaucaaaccc

SEQ ID NO: 1987713 - RNA, 13 nt, Shigella flexneri 2a str. 301
cacacccccgcug

SEQ ID NO: 1987714 - RNA, 21 nt, Shigella flexneri 2a str. 301
cacaccgcgaucuuccacgcc

SEQ ID NO: 1987715 - RNA, 16 nt, Shigella flexneri 2a str. 301
cacaagcuaccagccc

SEQ ID NO: 1987716 - RNA, 17 nt, Shigella flexneri 2a str. 301
cacaagcauuaaggcaa

SEQ ID NO: 1987717 - RNA, 22 nt, Shigella flexneri 2a str. 301
cacaagccaggacgcaguccag

SEQ ID NO: 1987718 - RNA, 14 nt, Shigella flexneri 2a str. 301
cacaagcccaugca

SEQ ID NO: 1987719 - RNA, 19 nt, Shigella flexneri 2a str. 301
cacaaguuguuuacaguau

SEQ ID NO: 1987720 - RNA, 20 nt, Shigella flexneri 2a str. 301
cacaaguaaaaggagauaaa

SEQ ID NO: 1987721 - RNA, 11 nt, Shigella flexneri 2a str. 301
cacaauaccuu

SEQ ID NO: 1987722 - RNA, 19 nt, Shigella flexneri 2a str. 301
cacaauacugaucaucauu

SEQ ID NO: 1987723 - RNA, 15 nt, Shigella flexneri 2a str. 301
cacaaucaaauccug

SEQ ID NO: 1987724 - RNA, 19 nt, Shigella flexneri 2a str. 301
cacaaucaaauccugcauc

SEQ ID NO: 1987725 - RNA, 23 nt, Shigella flexneri 2a str. 301
cacaaucugauaauccagacuau

SEQ ID NO: 1987726 - RNA, 21 nt, Shigella flexneri 2a str. 301
cacaaucguguggcaucaucc

SEQ ID NO: 1987727 - RNA, 21 nt, Shigella flexneri 2a str. 301
cacaaucggcuuucaccgccu

SEQ ID NO: 1987728 - RNA, 20 nt, Shigella flexneri 2a str. 301
cacaaucauccuaccgccag

SEQ ID NO: 1987729 - RNA, 22 nt, Shigella flexneri 2a str. 301
cacacacugcuuaacugcgcuu

SEQ ID NO: 1987730 - RNA, 19 nt, Shigella flexneri 2a str. 301
cacacaauuaccuuccaca

SEQ ID NO: 1987731 - RNA, 13 nt, Shigella flexneri 2a str. 301
cacacauaucaca

SEQ ID NO: 1987732 - RNA, 12 nt, Shigella flexneri 2a str. 301
cacaccaccaug

SEQ ID NO: 1987733 - RNA, 14 nt, Shigella flexneri 2a str. 301
cacaauuaccuucc

SEQ ID NO: 1987734 - RNA, 12 nt, Shigella flexneri 2a str. 301
cacaauuaccuu

SEQ ID NO: 1987735 - RNA, 23 nt, Shigella flexneri 2a str. 301
cacaauuaccuuccacaauggca

SEQ ID NO: 1987736 - RNA, 18 nt, Shigella flexneri 2a str. 301
cacaauuacugagagaaa

SEQ ID NO: 1987737 - RNA, 22 nt, Shigella flexneri 2a str. 301
cacacaagccgugaaucacucc

SEQ ID NO: 1987738 - RNA, 20 nt, Shigella flexneri 2a str. 301
cacaauggcggugaucccaa

SEQ ID NO: 1987739 - RNA, 15 nt, Shigella flexneri 2a str. 301
cacaauggucaacau

SEQ ID NO: 1987740 - RNA, 22 nt, Shigella flexneri 2a str. 301
cacaauggcacaaauggcaaug

SEQ ID NO: 1987741 - RNA, 18 nt, Shigella flexneri 2a str. 301
cacaauggagcuaaacag

SEQ ID NO: 1987742 - RNA, 17 nt, Shigella flexneri 2a str. 301
cacagggugaucaccag

SEQ ID NO: 1987743 - RNA, 20 nt, Shigella flexneri 2a str. 301
cacaggguggcccaaauggc

SEQ ID NO: 1987744 - RNA, 20 nt, Shigella flexneri 2a str. 301
cacaggguguauucaugccc

SEQ ID NO: 1987745 - RNA, 13 nt, Shigella flexneri 2a str. 301
cacagggugauca

SEQ ID NO: 1987746 - RNA, 15 nt, Shigella flexneri 2a str. 301
cacaggccaucacau

SEQ ID NO: 1987747 - RNA, 20 nt, Shigella flexneri 2a str. 301
cacaggccggagccagccgu

SEQ ID NO: 1987748 - RNA, 12 nt, Shigella flexneri 2a str. 301
cacaggccgcca

SEQ ID NO: 1987749 - RNA, 19 nt, Shigella flexneri 2a str. 301
cacaggccggagccagccg

SEQ ID NO: 1987750 - RNA, 19 nt, Shigella flexneri 2a str. 301
cacaggcggucgaacaggu

SEQ ID NO: 1987751 - RNA, 22 nt, Shigella flexneri 2a str. 301
cacauacgacgcuucaguucag

SEQ ID NO: 1987752 - RNA, 13 nt, Shigella flexneri 2a str. 301
cacauauauuaau

SEQ ID NO: 1987753 - RNA, 17 nt, Shigella flexneri 2a str. 301
cacauaagaucaucggc

SEQ ID NO: 1987754 - RNA, 21 nt, Shigella flexneri 2a str. 301
cacauaaccguacaaucguuu

SEQ ID NO: 1987755 - RNA, 15 nt, Shigella flexneri 2a str. 301
cacauaauccagaca

SEQ ID NO: 1987756 - RNA, 16 nt, Shigella flexneri 2a str. 301
cacaguuuuacugcag

SEQ ID NO: 1987757 - RNA, 18 nt, Shigella flexneri 2a str. 301
cacaguuuuacugcagcc

SEQ ID NO: 1987758 - RNA, 17 nt, Shigella flexneri 2a str. 301
cacaguuuuacugcagc

SEQ ID NO: 1987759 - RNA, 14 nt, Shigella flexneri 2a str. 301
cacaguuauaaaau

SEQ ID NO: 1987760 - RNA, 20 nt, Shigella flexneri 2a str. 301
cacaguggcgagcuuccugu

SEQ ID NO: 1987761 - RNA, 14 nt, Shigella flexneri 2a str. 301
cacaguugcucaau

SEQ ID NO: 1987762 - RNA, 22 nt, Shigella flexneri 2a str. 301
cacagugcugauuuugcaacaa

SEQ ID NO: 1987763 - RNA, 18 nt, Shigella flexneri 2a str. 301
cacagugaugaaaacgaa

SEQ ID NO: 1987764 - RNA, 22 nt, Shigella flexneri 2a str. 301
cacagugacccgcagccagcac

SEQ ID NO: 1987765 - RNA, 13 nt, Shigella flexneri 2a str. 301
cacagccaacaca

SEQ ID NO: 1987766 - RNA, 14 nt, Shigella flexneri 2a str. 301
cacagccaacacau

SEQ ID NO: 1987767 - RNA, 15 nt, Shigella flexneri 2a str. 301
cacagcaguugugug

SEQ ID NO: 1987768 - RNA, 18 nt, Shigella flexneri 2a str. 301
cacagccgagcgccacca

SEQ ID NO: 1987769 - RNA, 15 nt, Shigella flexneri 2a str. 301
cacagccgcaggccu

SEQ ID NO: 1987770 - RNA, 11 nt, Shigella flexneri 2a str. 301
cacagccgcag

SEQ ID NO: 1987771 - RNA, 15 nt, Shigella flexneri 2a str. 301
cacagcccgccgcca

SEQ ID NO: 1987772 - RNA, 22 nt, Shigella flexneri 2a str. 301
cacagcggaguaaucgccagca

SEQ ID NO: 1987773 - RNA, 14 nt, Shigella flexneri 2a str. 301
cacagacuuaauau

SEQ ID NO: 1987774 - RNA, 17 nt, Shigella flexneri 2a str. 301
cacagagcugauuuccg

SEQ ID NO: 1987775 - RNA, 16 nt, Shigella flexneri 2a str. 301
cacagaggucuuuucu

SEQ ID NO: 1987776 - RNA, 14 nt, Shigella flexneri 2a str. 301
cacagacaaacagc

SEQ ID NO: 1987777 - RNA, 21 nt, Shigella flexneri 2a str. 301
cacagaauucccccauugaaa

SEQ ID NO: 1987778 - RNA, 12 nt, Shigella flexneri 2a str. 301
cacagacaaaca

SEQ ID NO: 1987779 - RNA, 22 nt, Shigella flexneri 2a str. 301
cacagauaauaauguguucaac

SEQ ID NO: 1987780 - RNA, 18 nt, Shigella flexneri 2a str. 301
cacagcaaaacacccgca

SEQ ID NO: 1987781 - RNA, 20 nt, Shigella flexneri 2a str. 301
cacagauuuccaagcgcggc

SEQ ID NO: 1987782 - RNA, 10 nt, Shigella flexneri 2a str. 301
cacauguugc

SEQ ID NO: 1987783 - RNA, 21 nt, Shigella flexneri 2a str. 301
cacauguuguacaugcugcuu

SEQ ID NO: 1987784 - RNA, 13 nt, Shigella flexneri 2a str. 301
cacaugcagcgcc

SEQ ID NO: 1987785 - RNA, 13 nt, Shigella flexneri 2a str. 301
cacaugcugacau

SEQ ID NO: 1987786 - RNA, 23 nt, Shigella flexneri 2a str. 301
cacaugcaacgucaucaccggcu

SEQ ID NO: 1987787 - RNA, 22 nt, Shigella flexneri 2a str. 301
cacaugcaacgucaucaccggc

SEQ ID NO: 1987788 - RNA, 15 nt, Shigella flexneri 2a str. 301
cacaugaugauggcu

SEQ ID NO: 1987789 - RNA, 16 nt, Shigella flexneri 2a str. 301
cacaugaguugcugga

SEQ ID NO: 1987790 - RNA, 15 nt, Shigella flexneri 2a str. 301
cacaucgcugugcug

SEQ ID NO: 1987791 - RNA, 16 nt, Shigella flexneri 2a str. 301
cacaucaccuccagcg

SEQ ID NO: 1987792 - RNA, 13 nt, Shigella flexneri 2a str. 301
cacaucacuccau

SEQ ID NO: 1987793 - RNA, 14 nt, Shigella flexneri 2a str. 301
cacaucaucaucgc

SEQ ID NO: 1987794 - RNA, 23 nt, Shigella flexneri 2a str. 301
cacauauucgccgcccugcagca

SEQ ID NO: 1987795 - RNA, 21 nt, Shigella flexneri 2a str. 301
cacauauuauugaaaucacua

SEQ ID NO: 1987796 - RNA, 14 nt, Shigella flexneri 2a str. 301
cacaucaauuugcc

SEQ ID NO: 1987797 - RNA, 23 nt, Shigella flexneri 2a str. 301
cacaucaaugaugaacgccacau

SEQ ID NO: 1987798 - RNA, 20 nt, Shigella flexneri 2a str. 301
cacaucaauggaugcaauca

SEQ ID NO: 1987799 - RNA, 22 nt, Shigella flexneri 2a str. 301
cacaucaauggaugcaaucaca

SEQ ID NO: 1987800 - RNA, 21 nt, Shigella flexneri 2a str. 301
cacauccggccaguaagcagu

SEQ ID NO: 1987801 - RNA, 19 nt, Shigella flexneri 2a str. 301
cacauccguccuccguauc

SEQ ID NO: 1987802 - RNA, 22 nt, Shigella flexneri 2a str. 301
cacauccguggguugccagagg

SEQ ID NO: 1987803 - RNA, 18 nt, Shigella flexneri 2a str. 301
cacaucccagcagagauc

SEQ ID NO: 1987804 - RNA, 16 nt, Shigella flexneri 2a str. 301
cacauccaguggcaga

SEQ ID NO: 1987805 - RNA, 22 nt, Shigella flexneri 2a str. 301
cacauccacgccuuuuuucacu

SEQ ID NO: 1987806 - RNA, 13 nt, Shigella flexneri 2a str. 301
cacauuagauaaa

SEQ ID NO: 1987807 - RNA, 18 nt, Shigella flexneri 2a str. 301
cacauuacugcuugcucu

SEQ ID NO: 1987808 - RNA, 19 nt, Shigella flexneri 2a str. 301
cacauuacaccguacuccc

SEQ ID NO: 1987809 - RNA, 20 nt, Shigella flexneri 2a str. 301
cacauuacaccguacucccg

SEQ ID NO: 1987810 - RNA, 16 nt, Shigella flexneri 2a str. 301
cacauuagauaaaaau

SEQ ID NO: 1987811 - RNA, 20 nt, Shigella flexneri 2a str. 301
cacauuggacaggcucuuga

SEQ ID NO: 1987812 - RNA, 11 nt, Shigella flexneri 2a str. 301
cacauuucacu

SEQ ID NO: 1987813 - RNA, 20 nt, Shigella flexneri 2a str. 301
cacauugucggcaucguaau

SEQ ID NO: 1987814 - RNA, 14 nt, Shigella flexneri 2a str. 301
caccaaacagacca

SEQ ID NO: 1987815 - RNA, 14 nt, Shigella flexneri 2a str. 301
cacauuuuccauca

SEQ ID NO: 1987816 - RNA, 11 nt, Shigella flexneri 2a str. 301
cacauuuuuaa

SEQ ID NO: 1987817 - RNA, 13 nt, Shigella flexneri 2a str. 301
caccaacaaauag

SEQ ID NO: 1987818 - RNA, 18 nt, Shigella flexneri 2a str. 301
caccaaacugauuuagca

SEQ ID NO: 1987819 - RNA, 13 nt, Shigella flexneri 2a str. 301
caccaacaggugc

SEQ ID NO: 1987820 - RNA, 17 nt, Shigella flexneri 2a str. 301
caccaacuccacuucac

SEQ ID NO: 1987821 - RNA, 13 nt, Shigella flexneri 2a str. 301
caccaauacgcau

SEQ ID NO: 1987822 - RNA, 18 nt, Shigella flexneri 2a str. 301
caccaauacgcauaugca

SEQ ID NO: 1987823 - RNA, 18 nt, Shigella flexneri 2a str. 301
caccaauagccgcgccga

SEQ ID NO: 1987824 - RNA, 13 nt, Shigella flexneri 2a str. 301
caccaaucagcgg

SEQ ID NO: 1987825 - RNA, 12 nt, Shigella flexneri 2a str. 301
caccaaucggca

SEQ ID NO: 1987826 - RNA, 23 nt, Shigella flexneri 2a str. 301
caccaaucaacaauugcgggcca

SEQ ID NO: 1987827 - RNA, 23 nt, Shigella flexneri 2a str. 301
caccaaugaaagccccaccagca

SEQ ID NO: 1987828 - RNA, 12 nt, Shigella flexneri 2a str. 301
caccacuccuca

SEQ ID NO: 1987829 - RNA, 19 nt, Shigella flexneri 2a str. 301
caccacugaauaacauuau

SEQ ID NO: 1987830 - RNA, 19 nt, Shigella flexneri 2a str. 301
caccacgcuguagccgccg

SEQ ID NO: 1987831 - RNA, 19 nt, Shigella flexneri 2a str. 301
caccacgcugagagaagca

SEQ ID NO: 1987832 - RNA, 20 nt, Shigella flexneri 2a str. 301
caccacgccugccgccagca

SEQ ID NO: 1987833 - RNA, 14 nt, Shigella flexneri 2a str. 301
caccacgccaagaa

SEQ ID NO: 1987834 - RNA, 19 nt, Shigella flexneri 2a str. 301
caccaccuggcuugccggg

SEQ ID NO: 1987835 - RNA, 13 nt, Shigella flexneri 2a str. 301
caccaccugggug

SEQ ID NO: 1987836 - RNA, 17 nt, Shigella flexneri 2a str. 301
caccacgaccacgaacg

SEQ ID NO: 1987837 - RNA, 14 nt, Shigella flexneri 2a str. 301
caccacgaaaacag

SEQ ID NO: 1987838 - RNA, 20 nt, Shigella flexneri 2a str. 301
caccagcaacaagccagucc

SEQ ID NO: 1987839 - RNA, 16 nt, Shigella flexneri 2a str. 301
caccagcaacagcgcc

SEQ ID NO: 1987840 - RNA, 22 nt, Shigella flexneri 2a str. 301
caccagauugugaaucgccugg

SEQ ID NO: 1987841 - RNA, 14 nt, Shigella flexneri 2a str. 301
caccagauggcuuu

SEQ ID NO: 1987842 - RNA, 17 nt, Shigella flexneri 2a str. 301
caccagauggcuuucca

SEQ ID NO: 1987843 - RNA, 17 nt, Shigella flexneri 2a str. 301
caccagaaucgccagca

SEQ ID NO: 1987844 - RNA, 19 nt, Shigella flexneri 2a str. 301
caccagaaucgccagcauc

SEQ ID NO: 1987845 - RNA, 14 nt, Shigella flexneri 2a str. 301
caccagaaucgcca

SEQ ID NO: 1987846 - RNA, 14 nt, Shigella flexneri 2a str. 301
caccagagaacuga

SEQ ID NO: 1987847 - RNA, 14 nt, Shigella flexneri 2a str. 301
caccagaccugaaa

SEQ ID NO: 1987848 - RNA, 19 nt, Shigella flexneri 2a str. 301
caccagacaucccagugca

SEQ ID NO: 1987849 - RNA, 18 nt, Shigella flexneri 2a str. 301
caccagaaacaauaagua

SEQ ID NO: 1987850 - RNA, 22 nt, Shigella flexneri 2a str. 301
caccagaaaguuuuucaacacc

SEQ ID NO: 1987851 - RNA, 23 nt, Shigella flexneri 2a str. 301
caccacugcgcauaauccacuuu

SEQ ID NO: 1987852 - RNA, 14 nt, Shigella flexneri 2a str. 301
caccacuuuugcuc

SEQ ID NO: 1987853 - RNA, 16 nt, Shigella flexneri 2a str. 301
caccacuuuugcucca

SEQ ID NO: 1987854 - RNA, 22 nt, Shigella flexneri 2a str. 301
caccacuuuacgggcaaucucc

SEQ ID NO: 1987855 - RNA, 22 nt, Shigella flexneri 2a str. 301
caccacuugcagcucauauucc

SEQ ID NO: 1987856 - RNA, 18 nt, Shigella flexneri 2a str. 301
caccaauggcuggccugg

SEQ ID NO: 1987857 - RNA, 19 nt, Shigella flexneri 2a str. 301
caccaauggcuggccugga

SEQ ID NO: 1987858 - RNA, 19 nt, Shigella flexneri 2a str. 301
caccacagacaaucgccag

SEQ ID NO: 1987859 - RNA, 14 nt, Shigella flexneri 2a str. 301
caccaccagcaccg

SEQ ID NO: 1987860 - RNA, 15 nt, Shigella flexneri 2a str. 301
caccaccaaagguua

SEQ ID NO: 1987861 - RNA, 17 nt, Shigella flexneri 2a str. 301
caccaccaaaaacgcca

SEQ ID NO: 1987862 - RNA, 24 nt, Shigella flexneri 2a str. 301
caccaccgacggacccgccggcgu

SEQ ID NO: 1987863 - RNA, 20 nt, Shigella flexneri 2a str. 301
caccaccgcaaucgccagua

SEQ ID NO: 1987864 - RNA, 15 nt, Shigella flexneri 2a str. 301
caccaccgcaaaaua

SEQ ID NO: 1987865 - RNA, 13 nt, Shigella flexneri 2a str. 301
caccacccugccc

SEQ ID NO: 1987866 - RNA, 15 nt, Shigella flexneri 2a str. 301
caccacccagcgccc

SEQ ID NO: 1987867 - RNA, 19 nt, Shigella flexneri 2a str. 301
caccaccgcccguuccacc

SEQ ID NO: 1987868 - RNA, 22 nt, Shigella flexneri 2a str. 301
caccauggcuauaccccacccc

SEQ ID NO: 1987869 - RNA, 17 nt, Shigella flexneri 2a str. 301
caccaucgcaaacagua

SEQ ID NO: 1987870 - RNA, 21 nt, Shigella flexneri 2a str. 301
caccaucgggaucgaguucau

SEQ ID NO: 1987871 - RNA, 17 nt, Shigella flexneri 2a str. 301
caccauccgcccacacc

SEQ ID NO: 1987872 - RNA, 19 nt, Shigella flexneri 2a str. 301
caccauccccaccaaaaca

SEQ ID NO: 1987873 - RNA, 13 nt, Shigella flexneri 2a str. 301
caccaucaguggc

SEQ ID NO: 1987874 - RNA, 15 nt, Shigella flexneri 2a str. 301
caccaucagcagcaa

SEQ ID NO: 1987875 - RNA, 17 nt, Shigella flexneri 2a str. 301
caccauuacgcaaugcg

SEQ ID NO: 1987876 - RNA, 17 nt, Shigella flexneri 2a str. 301
caccauguucacugccg

SEQ ID NO: 1987877 - RNA, 20 nt, Shigella flexneri 2a str. 301
caccauguaggaguugcggc

SEQ ID NO: 1987878 - RNA, 14 nt, Shigella flexneri 2a str. 301
cacccaacaugccg

SEQ ID NO: 1987879 - RNA, 16 nt, Shigella flexneri 2a str. 301
caccauuggucuuugu

SEQ ID NO: 1987880 - RNA, 21 nt, Shigella flexneri 2a str. 301
caccauuuccggagacagcuu

SEQ ID NO: 1987881 - RNA, 16 nt, Shigella flexneri 2a str. 301
cacccacuaaucgucc

SEQ ID NO: 1987882 - RNA, 17 nt, Shigella flexneri 2a str. 301
cacccagaacgccgaau

SEQ ID NO: 1987883 - RNA, 15 nt, Shigella flexneri 2a str. 301
cacccaccagcgccg

SEQ ID NO: 1987884 - RNA, 15 nt, Shigella flexneri 2a str. 301
cacccaccauaagcc

SEQ ID NO: 1987885 - RNA, 14 nt, Shigella flexneri 2a str. 301
cacccaauccagua

SEQ ID NO: 1987886 - RNA, 16 nt, Shigella flexneri 2a str. 301
cacccccaccccggcc

SEQ ID NO: 1987887 - RNA, 16 nt, Shigella flexneri 2a str. 301
caccccaccuuaccug

SEQ ID NO: 1987888 - RNA, 19 nt, Shigella flexneri 2a str. 301
cacccauuuuaaugugucu

SEQ ID NO: 1987889 - RNA, 14 nt, Shigella flexneri 2a str. 301
cacccagcaucugc

SEQ ID NO: 1987890 - RNA, 15 nt, Shigella flexneri 2a str. 301
cacccagcgaagcaa

SEQ ID NO: 1987891 - RNA, 18 nt, Shigella flexneri 2a str. 301
cacccauagauaccuucu

SEQ ID NO: 1987892 - RNA, 21 nt, Shigella flexneri 2a str. 301
caccccuuuacugacuguccc

SEQ ID NO: 1987893 - RNA, 22 nt, Shigella flexneri 2a str. 301
cacccgcagcaagcguuugagc

SEQ ID NO: 1987894 - RNA, 16 nt, Shigella flexneri 2a str. 301
cacccgcagcaagcgu

SEQ ID NO: 1987895 - RNA, 20 nt, Shigella flexneri 2a str. 301
caccccgcgcagcugagaaa

SEQ ID NO: 1987896 - RNA, 19 nt, Shigella flexneri 2a str. 301
caccccgaaaugcccgcuu

SEQ ID NO: 1987897 - RNA, 22 nt, Shigella flexneri 2a str. 301
caccagcaguaaaccacccacc

SEQ ID NO: 1987898 - RNA, 17 nt, Shigella flexneri 2a str. 301
caccagcaucaacaaca

SEQ ID NO: 1987899 - RNA, 12 nt, Shigella flexneri 2a str. 301
caccagccagaa

SEQ ID NO: 1987900 - RNA, 23 nt, Shigella flexneri 2a str. 301
caccagccauuaaccagccacug

SEQ ID NO: 1987901 - RNA, 22 nt, Shigella flexneri 2a str. 301
caccagcacaucaucaaagcca

SEQ ID NO: 1987902 - RNA, 14 nt, Shigella flexneri 2a str. 301
caccagcaccagcg

SEQ ID NO: 1987903 - RNA, 16 nt, Shigella flexneri 2a str. 301
caccagcaaauccagc

SEQ ID NO: 1987904 - RNA, 23 nt, Shigella flexneri 2a str. 301
caccagcaauaauagcauccacc

SEQ ID NO: 1987905 - RNA, 21 nt, Shigella flexneri 2a str. 301
caccagcaauaaugccagucc

SEQ ID NO: 1987906 - RNA, 22 nt, Shigella flexneri 2a str. 301
caccagcacuucacugacauug

SEQ ID NO: 1987907 - RNA, 20 nt, Shigella flexneri 2a str. 301
caccagcgaaaucaccgcca

SEQ ID NO: 1987908 - RNA, 23 nt, Shigella flexneri 2a str. 301
caccagcgaaaguaacaccaucc

SEQ ID NO: 1987909 - RNA, 16 nt, Shigella flexneri 2a str. 301
caccagcgccgcgcca

SEQ ID NO: 1987910 - RNA, 17 nt, Shigella flexneri 2a str. 301
caccagcuccggcaccu

SEQ ID NO: 1987911 - RNA, 14 nt, Shigella flexneri 2a str. 301
caccaguccagcgc

SEQ ID NO: 1987912 - RNA, 20 nt, Shigella flexneri 2a str. 301
caccaguaaggcaucuucuu

SEQ ID NO: 1987913 - RNA, 21 nt, Shigella flexneri 2a str. 301
caccaguaaggcaucuucuuc

SEQ ID NO: 1987914 - RNA, 23 nt, Shigella flexneri 2a str. 301
caccaguaccucuucgcuggcaa

SEQ ID NO: 1987915 - RNA, 12 nt, Shigella flexneri 2a str. 301
caccaguaaaua

SEQ ID NO: 1987916 - RNA, 12 nt, Shigella flexneri 2a str. 301
caccaguaaauu

SEQ ID NO: 1987917 - RNA, 15 nt, Shigella flexneri 2a str. 301
caccaguucgcgcag

SEQ ID NO: 1987918 - RNA, 23 nt, Shigella flexneri 2a str. 301
caccaguugguagguccagccgc

SEQ ID NO: 1987919 - RNA, 20 nt, Shigella flexneri 2a str. 301
caccauaaauccaacaacac

SEQ ID NO: 1987920 - RNA, 22 nt, Shigella flexneri 2a str. 301
caccauaaauccaacaacacau

SEQ ID NO: 1987921 - RNA, 14 nt, Shigella flexneri 2a str. 301
caccauaagcccgg

SEQ ID NO: 1987922 - RNA, 22 nt, Shigella flexneri 2a str. 301
caccaggcucuuuaaacaguuu

SEQ ID NO: 1987923 - RNA, 16 nt, Shigella flexneri 2a str. 301
caccagggaaauaauc

SEQ ID NO: 1987924 - RNA, 20 nt, Shigella flexneri 2a str. 301
caccaggaacgcgccaagau

SEQ ID NO: 1987925 - RNA, 20 nt, Shigella flexneri 2a str. 301
caccaggcaguuuauccagc

SEQ ID NO: 1987926 - RNA, 18 nt, Shigella flexneri 2a str. 301
caccguaauaguuucuga

SEQ ID NO: 1987927 - RNA, 14 nt, Shigella flexneri 2a str. 301
caccgggugcagac

SEQ ID NO: 1987928 - RNA, 17 nt, Shigella flexneri 2a str. 301
caccguauugcgccggu

SEQ ID NO: 1987929 - RNA, 16 nt, Shigella flexneri 2a str. 301
caccgucacuucuucg

SEQ ID NO: 1987930 - RNA, 18 nt, Shigella flexneri 2a str. 301
caccgucagccugacgga

SEQ ID NO: 1987931 - RNA, 15 nt, Shigella flexneri 2a str. 301
caccgucacuucuuc

SEQ ID NO: 1987932 - RNA, 22 nt, Shigella flexneri 2a str. 301
caccgucaucgacaaaaacccu

SEQ ID NO: 1987933 - RNA, 18 nt, Shigella flexneri 2a str. 301
caccgucaaacacagcac

SEQ ID NO: 1987934 - RNA, 15 nt, Shigella flexneri 2a str. 301
caccgucgccuucau

SEQ ID NO: 1987935 - RNA, 12 nt, Shigella flexneri 2a str. 301
caccuacagcca

SEQ ID NO: 1987936 - RNA, 18 nt, Shigella flexneri 2a str. 301
caccuaauaacucuccuc

SEQ ID NO: 1987937 - RNA, 23 nt, Shigella flexneri 2a str. 301
caccguuucuacaagcagagaga

SEQ ID NO: 1987938 - RNA, 21 nt, Shigella flexneri 2a str. 301
caccguuucuacaagcagaga

SEQ ID NO: 1987939 - RNA, 17 nt, Shigella flexneri 2a str. 301
caccguuucuacaagca

SEQ ID NO: 1987940 - RNA, 12 nt, Shigella flexneri 2a str. 301
caccguuaaaua

SEQ ID NO: 1987941 - RNA, 15 nt, Shigella flexneri 2a str. 301
caccguguucaugac

SEQ ID NO: 1987942 - RNA, 18 nt, Shigella flexneri 2a str. 301
caccgugauccgccgcug

SEQ ID NO: 1987943 - RNA, 13 nt, Shigella flexneri 2a str. 301
caccugccaggga

SEQ ID NO: 1987944 - RNA, 19 nt, Shigella flexneri 2a str. 301
caccugccagggugcuggc

SEQ ID NO: 1987945 - RNA, 17 nt, Shigella flexneri 2a str. 301
caccugccggagcgcca

SEQ ID NO: 1987946 - RNA, 14 nt, Shigella flexneri 2a str. 301
caccugccagcgcc

SEQ ID NO: 1987947 - RNA, 19 nt, Shigella flexneri 2a str. 301
caccugauccagcucuucu

SEQ ID NO: 1987948 - RNA, 20 nt, Shigella flexneri 2a str. 301
caccugauccagcucuucuu

SEQ ID NO: 1987949 - RNA, 14 nt, Shigella flexneri 2a str. 301
caccugcacaugca

SEQ ID NO: 1987950 - RNA, 20 nt, Shigella flexneri 2a str. 301
caccugaaauggucgccccg

SEQ ID NO: 1987951 - RNA, 14 nt, Shigella flexneri 2a str. 301
caccucuuuuucca

SEQ ID NO: 1987952 - RNA, 15 nt, Shigella flexneri 2a str. 301
caccucucgcccgcu

SEQ ID NO: 1987953 - RNA, 19 nt, Shigella flexneri 2a str. 301
caccucugucgaugcgcuc

SEQ ID NO: 1987954 - RNA, 21 nt, Shigella flexneri 2a str. 301
caccucaucaccacagacaaa

SEQ ID NO: 1987955 - RNA, 19 nt, Shigella flexneri 2a str. 301
caccuccagcuccgccagc

SEQ ID NO: 1987956 - RNA, 18 nt, Shigella flexneri 2a str. 301
caccuccacgcccagcgc

SEQ ID NO: 1987957 - RNA, 21 nt, Shigella flexneri 2a str. 301
caccucccgucgcccacacca

SEQ ID NO: 1987958 - RNA, 21 nt, Shigella flexneri 2a str. 301
cacgaggaagauuacgcugca

SEQ ID NO: 1987959 - RNA, 15 nt, Shigella flexneri 2a str. 301
cacgaggaagauuac

SEQ ID NO: 1987960 - RNA, 23 nt, Shigella flexneri 2a str. 301
cacgaggcuggcuuuaucacuga

SEQ ID NO: 1987961 - RNA, 18 nt, Shigella flexneri 2a str. 301
cacgaguagguagaauau

SEQ ID NO: 1987962 - RNA, 21 nt, Shigella flexneri 2a str. 301
cacgaccuguaccuucagcgg

SEQ ID NO: 1987963 - RNA, 13 nt, Shigella flexneri 2a str. 301
cacgaccgcagca

SEQ ID NO: 1987964 - RNA, 16 nt, Shigella flexneri 2a str. 301
caccuuuuuuuaugcu

SEQ ID NO: 1987965 - RNA, 22 nt, Shigella flexneri 2a str. 301
caccuuuuuuuaugcuuccuuc

SEQ ID NO: 1987966 - RNA, 18 nt, Shigella flexneri 2a str. 301
cacgaaaccacugcaaca

SEQ ID NO: 1987967 - RNA, 18 nt, Shigella flexneri 2a str. 301
cacgaaaccgacugccau

SEQ ID NO: 1987968 - RNA, 23 nt, Shigella flexneri 2a str. 301
cacgaaaacagcgcagcucuggc

SEQ ID NO: 1987969 - RNA, 13 nt, Shigella flexneri 2a str. 301
caccuuuuuucug

SEQ ID NO: 1987970 - RNA, 16 nt, Shigella flexneri 2a str. 301
cacgaaccagagacag

SEQ ID NO: 1987971 - RNA, 19 nt, Shigella flexneri 2a str. 301
cacgacauacaccgcagcc

SEQ ID NO: 1987972 - RNA, 12 nt, Shigella flexneri 2a str. 301
cacgacacugcu

SEQ ID NO: 1987973 - RNA, 18 nt, Shigella flexneri 2a str. 301
cacgacagaacucguuca

SEQ ID NO: 1987974 - RNA, 19 nt, Shigella flexneri 2a str. 301
cacgacaaaugcgccgcca

SEQ ID NO: 1987975 - RNA, 18 nt, Shigella flexneri 2a str. 301
cacgaaucgucaguucac

SEQ ID NO: 1987976 - RNA, 13 nt, Shigella flexneri 2a str. 301
cacgaagcauugc

SEQ ID NO: 1987977 - RNA, 16 nt, Shigella flexneri 2a str. 301
cacgaagcucucugcu

SEQ ID NO: 1987978 - RNA, 18 nt, Shigella flexneri 2a str. 301
cacgaagcucucugcuau

SEQ ID NO: 1987979 - RNA, 16 nt, Shigella flexneri 2a str. 301
cacgaauuccaagcag

SEQ ID NO: 1987980 - RNA, 23 nt, Shigella flexneri 2a str. 301
cacgaauugauuuucgaaaaaaa

SEQ ID NO: 1987981 - RNA, 12 nt, Shigella flexneri 2a str. 301
caccuuuaaccu

SEQ ID NO: 1987982 - RNA, 20 nt, Shigella flexneri 2a str. 301
caccuuuaaugcaucagcca

SEQ ID NO: 1987983 - RNA, 17 nt, Shigella flexneri 2a str. 301
caccuucuuuacugccc

SEQ ID NO: 1987984 - RNA, 20 nt, Shigella flexneri 2a str. 301
caccuucuuuacugcccgcu

SEQ ID NO: 1987985 - RNA, 15 nt, Shigella flexneri 2a str. 301
caccuucauccagca

SEQ ID NO: 1987986 - RNA, 22 nt, Shigella flexneri 2a str. 301
caccuucagcgaagcccacgcc

SEQ ID NO: 1987987 - RNA, 23 nt, Shigella flexneri 2a str. 301
caccuucaacguuaggugggaac

SEQ ID NO: 1987988 - RNA, 20 nt, Shigella flexneri 2a str. 301
caccuucaaguaauucauuc

SEQ ID NO: 1987989 - RNA, 20 nt, Shigella flexneri 2a str. 301
caccuuacggcacuccucuu

SEQ ID NO: 1987990 - RNA, 20 nt, Shigella flexneri 2a str. 301
caccugcggugcagccggag

SEQ ID NO: 1987991 - RNA, 22 nt, Shigella flexneri 2a str. 301
caccugcucgucauccgccagu

SEQ ID NO: 1987992 - RNA, 21 nt, Shigella flexneri 2a str. 301
caccuggcgcauuaacggcaa

SEQ ID NO: 1987993 - RNA, 11 nt, Shigella flexneri 2a str. 301
caccuggcgcu

SEQ ID NO: 1987994 - RNA, 21 nt, Shigella flexneri 2a str. 301
caccugggcaauggugaacug

SEQ ID NO: 1987995 - RNA, 23 nt, Shigella flexneri 2a str. 301
caccuguugccauuucugcugcc

SEQ ID NO: 1987996 - RNA, 18 nt, Shigella flexneri 2a str. 301
caccuuacggcacuccuc

SEQ ID NO: 1987997 - RNA, 23 nt, Shigella flexneri 2a str. 301
caccuguaguguguugcaauaca

SEQ ID NO: 1987998 - RNA, 16 nt, Shigella flexneri 2a str. 301
caccuguaccagcccg

SEQ ID NO: 1987999 - RNA, 16 nt, Shigella flexneri 2a str. 301
caccuggggcuugcca

SEQ ID NO: 1988000 - RNA, 22 nt, Shigella flexneri 2a str. 301
caccgcgaucuuccacgccugc

SEQ ID NO: 1988001 - RNA, 13 nt, Shigella flexneri 2a str. 301
caccgcguagcau

SEQ ID NO: 1988002 - RNA, 16 nt, Shigella flexneri 2a str. 301
caccgcggaacgcacu

SEQ ID NO: 1988003 - RNA, 22 nt, Shigella flexneri 2a str. 301
caccgccguuaccuucggcccc

SEQ ID NO: 1988004 - RNA, 14 nt, Shigella flexneri 2a str. 301
caccgccgccgcca

SEQ ID NO: 1988005 - RNA, 20 nt, Shigella flexneri 2a str. 301
caccgcccuccgguccgccg

SEQ ID NO: 1988006 - RNA, 15 nt, Shigella flexneri 2a str. 301
caccgggccgaugcg

SEQ ID NO: 1988007 - RNA, 22 nt, Shigella flexneri 2a str. 301
caccggaauaaugaugucucug

SEQ ID NO: 1988008 - RNA, 13 nt, Shigella flexneri 2a str. 301
caccggaccagac

SEQ ID NO: 1988009 - RNA, 20 nt, Shigella flexneri 2a str. 301
caccgcuucacucccugccc

SEQ ID NO: 1988010 - RNA, 20 nt, Shigella flexneri 2a str. 301
caccgcucuucauacgcggc

SEQ ID NO: 1988011 - RNA, 14 nt, Shigella flexneri 2a str. 301
caccgcguuuucca

SEQ ID NO: 1988012 - RNA, 13 nt, Shigella flexneri 2a str. 301
caccggcaccacu

SEQ ID NO: 1988013 - RNA, 16 nt, Shigella flexneri 2a str. 301
caccggcaaucugcug

SEQ ID NO: 1988014 - RNA, 19 nt, Shigella flexneri 2a str. 301
caccggauguagcaacgga

SEQ ID NO: 1988015 - RNA, 18 nt, Shigella flexneri 2a str. 301
caccggacggacuuccag

SEQ ID NO: 1988016 - RNA, 19 nt, Shigella flexneri 2a str. 301
caccggauaauuccggcuu

SEQ ID NO: 1988017 - RNA, 15 nt, Shigella flexneri 2a str. 301
caccgaccaucggca

SEQ ID NO: 1988018 - RNA, 23 nt, Shigella flexneri 2a str. 301
caccgaccaucccaccaccagca

SEQ ID NO: 1988019 - RNA, 14 nt, Shigella flexneri 2a str. 301
caccgacgcaguca

SEQ ID NO: 1988020 - RNA, 17 nt, Shigella flexneri 2a str. 301
caccgaggccaaaacca

SEQ ID NO: 1988021 - RNA, 16 nt, Shigella flexneri 2a str. 301
caccgagcagcacaau

SEQ ID NO: 1988022 - RNA, 23 nt, Shigella flexneri 2a str. 301
caccgagauaaugguuuccagca

SEQ ID NO: 1988023 - RNA, 20 nt, Shigella flexneri 2a str. 301
caccgaggcauucagccagu

SEQ ID NO: 1988024 - RNA, 19 nt, Shigella flexneri 2a str. 301
caccgcagccgccacaaua

SEQ ID NO: 1988025 - RNA, 15 nt, Shigella flexneri 2a str. 301
caccgcacagaccau

SEQ ID NO: 1988026 - RNA, 19 nt, Shigella flexneri 2a str. 301
caccgcagagaucgccccg

SEQ ID NO: 1988027 - RNA, 15 nt, Shigella flexneri 2a str. 301
caccgcaaucgccag

SEQ ID NO: 1988028 - RNA, 17 nt, Shigella flexneri 2a str. 301
caccgcaccuaaaaauu

SEQ ID NO: 1988029 - RNA, 17 nt, Shigella flexneri 2a str. 301
caccgcacagaccauca

SEQ ID NO: 1988030 - RNA, 14 nt, Shigella flexneri 2a str. 301
caccgcaccacacc

SEQ ID NO: 1988031 - RNA, 21 nt, Shigella flexneri 2a str. 301
caccgaugaucaacagcauca

SEQ ID NO: 1988032 - RNA, 20 nt, Shigella flexneri 2a str. 301
caccgcaagccaaauacauu

SEQ ID NO: 1988033 - RNA, 22 nt, Shigella flexneri 2a str. 301
caccgauuuuguaaaagaaggc

SEQ ID NO: 1988034 - RNA, 20 nt, Shigella flexneri 2a str. 301
caccgauuuuguaaaagaag

SEQ ID NO: 1988035 - RNA, 13 nt, Shigella flexneri 2a str. 301
caccgccaccacc

SEQ ID NO: 1988036 - RNA, 17 nt, Shigella flexneri 2a str. 301
caccgcauugagggcau

SEQ ID NO: 1988037 - RNA, 14 nt, Shigella flexneri 2a str. 301
caccgccaaagaua

SEQ ID NO: 1988038 - RNA, 18 nt, Shigella flexneri 2a str. 301
caccgcaucaauauuaag

SEQ ID NO: 1988039 - RNA, 22 nt, Shigella flexneri 2a str. 301
cacccguacagggugagggcaa

SEQ ID NO: 1988040 - RNA, 19 nt, Shigella flexneri 2a str. 301
cacccguuuucuccaugcg

SEQ ID NO: 1988041 - RNA, 20 nt, Shigella flexneri 2a str. 301
cacccuaacccucuccccga

SEQ ID NO: 1988042 - RNA, 20 nt, Shigella flexneri 2a str. 301
cacccucaaaauuucuccuu

SEQ ID NO: 1988043 - RNA, 22 nt, Shigella flexneri 2a str. 301
cacccucaaaauuucuccuuca

SEQ ID NO: 1988044 - RNA, 19 nt, Shigella flexneri 2a str. 301
cacccugacgaccacccag

SEQ ID NO: 1988045 - RNA, 22 nt, Shigella flexneri 2a str. 301
caccgaaaacgugguccacauc

SEQ ID NO: 1988046 - RNA, 21 nt, Shigella flexneri 2a str. 301
cacccgguaucaaacccuucc

SEQ ID NO: 1988047 - RNA, 19 nt, Shigella flexneri 2a str. 301
cacccggaggaaagcaccu

SEQ ID NO: 1988048 - RNA, 22 nt, Shigella flexneri 2a str. 301
cacccgccuguugcgucgccgc

SEQ ID NO: 1988049 - RNA, 22 nt, Shigella flexneri 2a str. 301
cacccgccguuagccagcgcac

SEQ ID NO: 1988050 - RNA, 18 nt, Shigella flexneri 2a str. 301
cacggcuaccguugcggc

SEQ ID NO: 1988051 - RNA, 16 nt, Shigella flexneri 2a str. 301
cacggcgcaugccuca

SEQ ID NO: 1988052 - RNA, 15 nt, Shigella flexneri 2a str. 301
cacggccacagccag

SEQ ID NO: 1988053 - RNA, 13 nt, Shigella flexneri 2a str. 301
cacggccacucug

SEQ ID NO: 1988054 - RNA, 16 nt, Shigella flexneri 2a str. 301
cacggccacucugccu

SEQ ID NO: 1988055 - RNA, 18 nt, Shigella flexneri 2a str. 301
cacggcauaagccguccc

SEQ ID NO: 1988056 - RNA, 13 nt, Shigella flexneri 2a str. 301
cacggcagcaacu

SEQ ID NO: 1988057 - RNA, 20 nt, Shigella flexneri 2a str. 301
cacggaucaggcggcucacc

SEQ ID NO: 1988058 - RNA, 21 nt, Shigella flexneri 2a str. 301
cacggauauauccguggcuuu

SEQ ID NO: 1988059 - RNA, 13 nt, Shigella flexneri 2a str. 301
cacggcaacacgc

SEQ ID NO: 1988060 - RNA, 15 nt, Shigella flexneri 2a str. 301
cacgcuuaacaaccc

SEQ ID NO: 1988061 - RNA, 18 nt, Shigella flexneri 2a str. 301
cacgcuuaaccccgggcu

SEQ ID NO: 1988062 - RNA, 18 nt, Shigella flexneri 2a str. 301
cacggaaaggcaacauga

SEQ ID NO: 1988063 - RNA, 21 nt, Shigella flexneri 2a str. 301
cacgcuuuacaauauccagcg

SEQ ID NO: 1988064 - RNA, 17 nt, Shigella flexneri 2a str. 301
cacggagauauccagcg

SEQ ID NO: 1988065 - RNA, 11 nt, Shigella flexneri 2a str. 301
cacggacaggu

SEQ ID NO: 1988066 - RNA, 15 nt, Shigella flexneri 2a str. 301
cacggaaucaccgcc

SEQ ID NO: 1988067 - RNA, 15 nt, Shigella flexneri 2a str. 301
cacgcgcuccaggag

SEQ ID NO: 1988068 - RNA, 13 nt, Shigella flexneri 2a str. 301
cacgcgcuccagg

SEQ ID NO: 1988069 - RNA, 21 nt, Shigella flexneri 2a str. 301
cacgcgcuucagucgccagcg

SEQ ID NO: 1988070 - RNA, 15 nt, Shigella flexneri 2a str. 301
cacgcgccacgcacg

SEQ ID NO: 1988071 - RNA, 13 nt, Shigella flexneri 2a str. 301
cacgccuccuggc

SEQ ID NO: 1988072 - RNA, 12 nt, Shigella flexneri 2a str. 301
cacgccuccugg

SEQ ID NO: 1988073 - RNA, 13 nt, Shigella flexneri 2a str. 301
cacgccugccgcc

SEQ ID NO: 1988074 - RNA, 16 nt, Shigella flexneri 2a str. 301
cacgccugccgccagc

SEQ ID NO: 1988075 - RNA, 22 nt, Shigella flexneri 2a str. 301
cacgccugaaacggaugccaau

SEQ ID NO: 1988076 - RNA, 12 nt, Shigella flexneri 2a str. 301
cacgccuucuuc

SEQ ID NO: 1988077 - RNA, 23 nt, Shigella flexneri 2a str. 301
cacgcgaacaacagaucaacaua

SEQ ID NO: 1988078 - RNA, 17 nt, Shigella flexneri 2a str. 301
cacgcgauacuuuuuca

SEQ ID NO: 1988079 - RNA, 19 nt, Shigella flexneri 2a str. 301
cacgcucgcgguuggcaau

SEQ ID NO: 1988080 - RNA, 13 nt, Shigella flexneri 2a str. 301
cacgcucccagca

SEQ ID NO: 1988081 - RNA, 15 nt, Shigella flexneri 2a str. 301
cacgcucagcaauug

SEQ ID NO: 1988082 - RNA, 22 nt, Shigella flexneri 2a str. 301
cacgcucacucaucacuccccg

SEQ ID NO: 1988083 - RNA, 13 nt, Shigella flexneri 2a str. 301
cacgcugccccug

SEQ ID NO: 1988084 - RNA, 17 nt, Shigella flexneri 2a str. 301
cacgcugcgguuuacgc

SEQ ID NO: 1988085 - RNA, 14 nt, Shigella flexneri 2a str. 301
cacgcugcucaucu

SEQ ID NO: 1988086 - RNA, 17 nt, Shigella flexneri 2a str. 301
cacgcucuguucugcgc

SEQ ID NO: 1988087 - RNA, 17 nt, Shigella flexneri 2a str. 301
cacgcugucggcacuga

SEQ ID NO: 1988088 - RNA, 22 nt, Shigella flexneri 2a str. 301
cacgcugucuggcgucuccugc

SEQ ID NO: 1988089 - RNA, 18 nt, Shigella flexneri 2a str. 301
cacgcuguagccgccguc

SEQ ID NO: 1988090 - RNA, 22 nt, Shigella flexneri 2a str. 301
cacgccgauaaucaacaaacca

SEQ ID NO: 1988091 - RNA, 18 nt, Shigella flexneri 2a str. 301
cacgccgaggccaaacuc

SEQ ID NO: 1988092 - RNA, 23 nt, Shigella flexneri 2a str. 301
cacgccgaggccaaacucaccau

SEQ ID NO: 1988093 - RNA, 21 nt, Shigella flexneri 2a str. 301
cacgccgcauccggcagccgu

SEQ ID NO: 1988094 - RNA, 17 nt, Shigella flexneri 2a str. 301
cacgccgguucccagac

SEQ ID NO: 1988095 - RNA, 18 nt, Shigella flexneri 2a str. 301
cacgccgguucccagacc

SEQ ID NO: 1988096 - RNA, 21 nt, Shigella flexneri 2a str. 301
cacgccaauguguuuauaagc

SEQ ID NO: 1988097 - RNA, 11 nt, Shigella flexneri 2a str. 301
cacgccaagcu

SEQ ID NO: 1988098 - RNA, 13 nt, Shigella flexneri 2a str. 301
cacgccaauaccg

SEQ ID NO: 1988099 - RNA, 22 nt, Shigella flexneri 2a str. 301
cacgccagacaucaccaguacc

SEQ ID NO: 1988100 - RNA, 22 nt, Shigella flexneri 2a str. 301
cacgcauaucguagccccaguc

SEQ ID NO: 1988101 - RNA, 14 nt, Shigella flexneri 2a str. 301
cacgccaacaaaca

SEQ ID NO: 1988102 - RNA, 13 nt, Shigella flexneri 2a str. 301
cacgcauuaauaa

SEQ ID NO: 1988103 - RNA, 17 nt, Shigella flexneri 2a str. 301
cacgcccagcucaaacg

SEQ ID NO: 1988104 - RNA, 13 nt, Shigella flexneri 2a str. 301
cacgcccauugag

SEQ ID NO: 1988105 - RNA, 22 nt, Shigella flexneri 2a str. 301
cacgccauauguguuugugcug

SEQ ID NO: 1988106 - RNA, 17 nt, Shigella flexneri 2a str. 301
cacgccaggccacgcuu

SEQ ID NO: 1988107 - RNA, 19 nt, Shigella flexneri 2a str. 301
cacgaucgaugugauaaau

SEQ ID NO: 1988108 - RNA, 13 nt, Shigella flexneri 2a str. 301
cacgaucgcgcca

SEQ ID NO: 1988109 - RNA, 16 nt, Shigella flexneri 2a str. 301
cacgaucccuugcagu

SEQ ID NO: 1988110 - RNA, 16 nt, Shigella flexneri 2a str. 301
cacgauaaucucugcu

SEQ ID NO: 1988111 - RNA, 12 nt, Shigella flexneri 2a str. 301
cacgauugcugc

SEQ ID NO: 1988112 - RNA, 12 nt, Shigella flexneri 2a str. 301
cacgaugcuaaa

SEQ ID NO: 1988113 - RNA, 12 nt, Shigella flexneri 2a str. 301
cacgcagcucac

SEQ ID NO: 1988114 - RNA, 24 nt, Shigella flexneri 2a str. 301
cacgcagcuucucgugaaacucac

SEQ ID NO: 1988115 - RNA, 17 nt, Shigella flexneri 2a str. 301
cacgcagcagccaagca

SEQ ID NO: 1988116 - RNA, 15 nt, Shigella flexneri 2a str. 301
cacgcagcaagccgu

SEQ ID NO: 1988117 - RNA, 15 nt, Shigella flexneri 2a str. 301
cacgcagacacugcu

SEQ ID NO: 1988118 - RNA, 19 nt, Shigella flexneri 2a str. 301
cacgcaagguuucaguaac

SEQ ID NO: 1988119 - RNA, 20 nt, Shigella flexneri 2a str. 301
cacgcaauaccuggcgcagc

SEQ ID NO: 1988120 - RNA, 15 nt, Shigella flexneri 2a str. 301
cacgcacagcccgcc

SEQ ID NO: 1988121 - RNA, 17 nt, Shigella flexneri 2a str. 301
cacgcaaacuucgguua

SEQ ID NO: 1988122 - RNA, 16 nt, Shigella flexneri 2a str. 301
cacgcaaaaucccacu

SEQ ID NO: 1988123 - RNA, 16 nt, Shigella flexneri 2a str. 301
cacgcaaccacaacgc

SEQ ID NO: 1988124 - RNA, 21 nt, Shigella flexneri 2a str. 301
cacgggcaauaucgacgccag

SEQ ID NO: 1988125 - RNA, 13 nt, Shigella flexneri 2a str. 301
cacggguuuccca

SEQ ID NO: 1988126 - RNA, 14 nt, Shigella flexneri 2a str. 301
cacgguaaugacuc

SEQ ID NO: 1988127 - RNA, 20 nt, Shigella flexneri 2a str. 301
cacggguucgugacgucuca

SEQ ID NO: 1988128 - RNA, 14 nt, Shigella flexneri 2a str. 301
cacgguacuggcag

SEQ ID NO: 1988129 - RNA, 16 nt, Shigella flexneri 2a str. 301
cacgguuuuuccagcu

SEQ ID NO: 1988130 - RNA, 13 nt, Shigella flexneri 2a str. 301
cacgguucuccac

SEQ ID NO: 1988131 - RNA, 15 nt, Shigella flexneri 2a str. 301
cacguaccagaugca

SEQ ID NO: 1988132 - RNA, 13 nt, Shigella flexneri 2a str. 301
cacguaccacggc

SEQ ID NO: 1988133 - RNA, 19 nt, Shigella flexneri 2a str. 301
cacguaccagaugcaucac

SEQ ID NO: 1988134 - RNA, 23 nt, Shigella flexneri 2a str. 301
cacguuccguauaccgucaggau

SEQ ID NO: 1988135 - RNA, 16 nt, Shigella flexneri 2a str. 301
cacguugagagguaaa

SEQ ID NO: 1988136 - RNA, 20 nt, Shigella flexneri 2a str. 301
cacguugcugcggcguuccc

SEQ ID NO: 1988137 - RNA, 15 nt, Shigella flexneri 2a str. 301
cacgugccagauguu

SEQ ID NO: 1988138 - RNA, 18 nt, Shigella flexneri 2a str. 301
cacgucuuugccgcgcuc

SEQ ID NO: 1988139 - RNA, 18 nt, Shigella flexneri 2a str. 301
cacgucuuaauguaaugc

SEQ ID NO: 1988140 - RNA, 22 nt, Shigella flexneri 2a str. 301
cacgucuuccauugccgcuuuc

SEQ ID NO: 1988141 - RNA, 22 nt, Shigella flexneri 2a str. 301
cacguuagaaacaaaaaaaccg

SEQ ID NO: 1988142 - RNA, 18 nt, Shigella flexneri 2a str. 301
cacuaacgcgucuuaucu

SEQ ID NO: 1988143 - RNA, 20 nt, Shigella flexneri 2a str. 301
cacuaacgcgucuuaucugg

SEQ ID NO: 1988144 - RNA, 15 nt, Shigella flexneri 2a str. 301
cacuaacgcauugaa

SEQ ID NO: 1988145 - RNA, 19 nt, Shigella flexneri 2a str. 301
cacuaacagaacaauaaua

SEQ ID NO: 1988146 - RNA, 22 nt, Shigella flexneri 2a str. 301
cacuaagaauguccauuauuuc

SEQ ID NO: 1988147 - RNA, 21 nt, Shigella flexneri 2a str. 301
cacuaaccguuucuaauauua

SEQ ID NO: 1988148 - RNA, 20 nt, Shigella flexneri 2a str. 301
cacuaaacccgaccacuucc

SEQ ID NO: 1988149 - RNA, 21 nt, Shigella flexneri 2a str. 301
cacuaccauuuguucuuuuuu

SEQ ID NO: 1988150 - RNA, 15 nt, Shigella flexneri 2a str. 301
cacuacccauauuua

SEQ ID NO: 1988151 - RNA, 18 nt, Shigella flexneri 2a str. 301
cacuaaggguaaaacgac

SEQ ID NO: 1988152 - RNA, 21 nt, Shigella flexneri 2a str. 301
cacuaucuugcuucugacuau

SEQ ID NO: 1988153 - RNA, 18 nt, Shigella flexneri 2a str. 301
cacuaucgccaucaggca

SEQ ID NO: 1988154 - RNA, 17 nt, Shigella flexneri 2a str. 301
cacuaucgaaaguuuac

SEQ ID NO: 1988155 - RNA, 22 nt, Shigella flexneri 2a str. 301
cacuaucccaacaacucuuccu

SEQ ID NO: 1988156 - RNA, 14 nt, Shigella flexneri 2a str. 301
cacuacgugaucgu

SEQ ID NO: 1988157 - RNA, 20 nt, Shigella flexneri 2a str. 301
cacuauuucaauaugauaaa

SEQ ID NO: 1988158 - RNA, 10 nt, Shigella flexneri 2a str. 301
cacuauuucu

SEQ ID NO: 1988159 - RNA, 24 nt, Shigella flexneri 2a str. 301
cacucaaauaucuauauacaauca

SEQ ID NO: 1988160 - RNA, 21 nt, Shigella flexneri 2a str. 301
cacucacgauagugacucauu

SEQ ID NO: 1988161 - RNA, 11 nt, Shigella flexneri 2a str. 301
cacucaccgca

SEQ ID NO: 1988162 - RNA, 23 nt, Shigella flexneri 2a str. 301
cacucccauacggcgucugaauc

SEQ ID NO: 1988163 - RNA, 21 nt, Shigella flexneri 2a str. 301
cacuccauccagcaacaacag

SEQ ID NO: 1988164 - RNA, 21 nt, Shigella flexneri 2a str. 301
cacucaucuuauugaucaucc

SEQ ID NO: 1988165 - RNA, 16 nt, Shigella flexneri 2a str. 301
cacucauacucaccgu

SEQ ID NO: 1988166 - RNA, 16 nt, Shigella flexneri 2a str. 301
cacucaggccaaauga

SEQ ID NO: 1988167 - RNA, 12 nt, Shigella flexneri 2a str. 301
cacucuucaaca

SEQ ID NO: 1988168 - RNA, 18 nt, Shigella flexneri 2a str. 301
cacucuugagcuccacau

SEQ ID NO: 1988169 - RNA, 22 nt, Shigella flexneri 2a str. 301
cacucugccguaccaucgccag

SEQ ID NO: 1988170 - RNA, 19 nt, Shigella flexneri 2a str. 301
cacucugcugccacauucc

SEQ ID NO: 1988171 - RNA, 21 nt, Shigella flexneri 2a str. 301
cacugaauagugccacaccag

SEQ ID NO: 1988172 - RNA, 20 nt, Shigella flexneri 2a str. 301
cacugacgaggcgucagcgu

SEQ ID NO: 1988173 - RNA, 14 nt, Shigella flexneri 2a str. 301
cacugacuucucug

SEQ ID NO: 1988174 - RNA, 17 nt, Shigella flexneri 2a str. 301
cacuccccgcaacagug

SEQ ID NO: 1988175 - RNA, 13 nt, Shigella flexneri 2a str. 301
cacucgcauccuc

SEQ ID NO: 1988176 - RNA, 14 nt, Shigella flexneri 2a str. 301
cacucgacagcacc

SEQ ID NO: 1988177 - RNA, 15 nt, Shigella flexneri 2a str. 301
cacucucgccccuuc

SEQ ID NO: 1988178 - RNA, 21 nt, Shigella flexneri 2a str. 301
cacucucgggaaggcccuucc

SEQ ID NO: 1988179 - RNA, 14 nt, Shigella flexneri 2a str. 301
cacucucaccacgc

SEQ ID NO: 1988180 - RNA, 22 nt, Shigella flexneri 2a str. 301
cacucucaccacgcuccaucau

SEQ ID NO: 1988181 - RNA, 15 nt, Shigella flexneri 2a str. 301
cacucggugucguua

SEQ ID NO: 1988182 - RNA, 22 nt, Shigella flexneri 2a str. 301
cacucgcugcagguauugcuuc

SEQ ID NO: 1988183 - RNA, 17 nt, Shigella flexneri 2a str. 301
cacucgcccugaccugc

SEQ ID NO: 1988184 - RNA, 21 nt, Shigella flexneri 2a str. 301
cacucgccagaccgcagaagc

SEQ ID NO: 1988185 - RNA, 14 nt, Shigella flexneri 2a str. 301
auucugauaugcag

SEQ ID NO: 1988186 - RNA, 13 nt, Shigella flexneri 2a str. 301
auucugauccugc

SEQ ID NO: 1988187 - RNA, 13 nt, Shigella flexneri 2a str. 301
auucugacugggu

SEQ ID NO: 1988188 - RNA, 15 nt, Shigella flexneri 2a str. 301
auucugacuggguca

SEQ ID NO: 1988189 - RNA, 22 nt, Shigella flexneri 2a str. 301
auucugacugucagaugcggcu

SEQ ID NO: 1988190 - RNA, 22 nt, Shigella flexneri 2a str. 301
auucugcaaggcaaaauacguu

SEQ ID NO: 1988191 - RNA, 15 nt, Shigella flexneri 2a str. 301
auugaagaauuuuug

SEQ ID NO: 1988192 - RNA, 14 nt, Shigella flexneri 2a str. 301
auucuuuuccucuc

SEQ ID NO: 1988193 - RNA, 20 nt, Shigella flexneri 2a str. 301
auucgucguauagaucacuu

SEQ ID NO: 1988194 - RNA, 15 nt, Shigella flexneri 2a str. 301
auucguauuuaaaac

SEQ ID NO: 1988195 - RNA, 23 nt, Shigella flexneri 2a str. 301
auucguucuucagacuccugaag

SEQ ID NO: 1988196 - RNA, 21 nt, Shigella flexneri 2a str. 301
auucguuuuucuucagcagcc

SEQ ID NO: 1988197 - RNA, 22 nt, Shigella flexneri 2a str. 301
auucuccaaugccguucucugg

SEQ ID NO: 1988198 - RNA, 13 nt, Shigella flexneri 2a str. 301
auucuccagcgcc

SEQ ID NO: 1988199 - RNA, 18 nt, Shigella flexneri 2a str. 301
auucucuauuucacccgc

SEQ ID NO: 1988200 - RNA, 18 nt, Shigella flexneri 2a str. 301
auucucaauaaaaggaaa

SEQ ID NO: 1988201 - RNA, 19 nt, Shigella flexneri 2a str. 301
auucucagcugcaagauga

SEQ ID NO: 1988202 - RNA, 15 nt, Shigella flexneri 2a str. 301
auucuaccguuggcc

SEQ ID NO: 1988203 - RNA, 17 nt, Shigella flexneri 2a str. 301
auucuaccguuggccug

SEQ ID NO: 1988204 - RNA, 15 nt, Shigella flexneri 2a str. 301
auugcgggccaggaa

SEQ ID NO: 1988205 - RNA, 12 nt, Shigella flexneri 2a str. 301
auugcugaaaua

SEQ ID NO: 1988206 - RNA, 20 nt, Shigella flexneri 2a str. 301
auugcgugguuuuugcugac

SEQ ID NO: 1988207 - RNA, 14 nt, Shigella flexneri 2a str. 301
auugcgggccaaag

SEQ ID NO: 1988208 - RNA, 18 nt, Shigella flexneri 2a str. 301
auugcgcugcuuguugau

SEQ ID NO: 1988209 - RNA, 17 nt, Shigella flexneri 2a str. 301
auugcgcgacuuuuucc

SEQ ID NO: 1988210 - RNA, 23 nt, Shigella flexneri 2a str. 301
auugccaguaacagaacgcauaa

SEQ ID NO: 1988211 - RNA, 18 nt, Shigella flexneri 2a str. 301
auugccacuucguaacca

SEQ ID NO: 1988212 - RNA, 17 nt, Shigella flexneri 2a str. 301
auugccacccugcggcu

SEQ ID NO: 1988213 - RNA, 17 nt, Shigella flexneri 2a str. 301
auugcaucgaggaaaac

SEQ ID NO: 1988214 - RNA, 19 nt, Shigella flexneri 2a str. 301
auugcaucgaggaaaacca

SEQ ID NO: 1988215 - RNA, 24 nt, Shigella flexneri 2a str. 301
auuggcauccgugguggcagccag

SEQ ID NO: 1988216 - RNA, 18 nt, Shigella flexneri 2a str. 301
auuggacgguaaaaagaa

SEQ ID NO: 1988217 - RNA, 17 nt, Shigella flexneri 2a str. 301
auuggaauacauauauu

SEQ ID NO: 1988218 - RNA, 14 nt, Shigella flexneri 2a str. 301
auuggaauacauau

SEQ ID NO: 1988219 - RNA, 16 nt, Shigella flexneri 2a str. 301
auuggaauacauauau

SEQ ID NO: 1988220 - RNA, 13 nt, Shigella flexneri 2a str. 301
auuggaauacaua

SEQ ID NO: 1988221 - RNA, 22 nt, Shigella flexneri 2a str. 301
auuggcgcgcguaugcgucagc

SEQ ID NO: 1988222 - RNA, 18 nt, Shigella flexneri 2a str. 301
auugcugcacauccggua

SEQ ID NO: 1988223 - RNA, 23 nt, Shigella flexneri 2a str. 301
auugcugccgauggcacaaucuc

SEQ ID NO: 1988224 - RNA, 20 nt, Shigella flexneri 2a str. 301
auugcugcugaagcaacagu

SEQ ID NO: 1988225 - RNA, 16 nt, Shigella flexneri 2a str. 301
auugcugcugccgcgc

SEQ ID NO: 1988226 - RNA, 22 nt, Shigella flexneri 2a str. 301
auugcugguacuuucacaggga

SEQ ID NO: 1988227 - RNA, 23 nt, Shigella flexneri 2a str. 301
auugcugguauaaaauagcaaua

SEQ ID NO: 1988228 - RNA, 20 nt, Shigella flexneri 2a str. 301
auugcuuuuaccauacugga

SEQ ID NO: 1988229 - RNA, 21 nt, Shigella flexneri 2a str. 301
auugcuuuuuuccauaagccc

SEQ ID NO: 1988230 - RNA, 18 nt, Shigella flexneri 2a str. 301
auugaucucguugaucac

SEQ ID NO: 1988231 - RNA, 22 nt, Shigella flexneri 2a str. 301
auugauccccgcuuccugcagc

SEQ ID NO: 1988232 - RNA, 22 nt, Shigella flexneri 2a str. 301
auugauaaucucccguuccugg

SEQ ID NO: 1988233 - RNA, 15 nt, Shigella flexneri 2a str. 301
auugaucaauucuaa

SEQ ID NO: 1988234 - RNA, 22 nt, Shigella flexneri 2a str. 301
auugaaugucugucugacaacc

SEQ ID NO: 1988235 - RNA, 16 nt, Shigella flexneri 2a str. 301
auugauuaaaggaagg

SEQ ID NO: 1988236 - RNA, 21 nt, Shigella flexneri 2a str. 301
auugauucaucucuucuuccg

SEQ ID NO: 1988237 - RNA, 19 nt, Shigella flexneri 2a str. 301
auugauucgaucaaacaau

SEQ ID NO: 1988238 - RNA, 22 nt, Shigella flexneri 2a str. 301
auugcaggguuuuguuuaaaua

SEQ ID NO: 1988239 - RNA, 17 nt, Shigella flexneri 2a str. 301
auugcaguggcgugcca

SEQ ID NO: 1988240 - RNA, 21 nt, Shigella flexneri 2a str. 301
auugcaggguuuuguuuaaau

SEQ ID NO: 1988241 - RNA, 16 nt, Shigella flexneri 2a str. 301
auugcaggggagcugc

SEQ ID NO: 1988242 - RNA, 12 nt, Shigella flexneri 2a str. 301
auugcagcagcu

SEQ ID NO: 1988243 - RNA, 19 nt, Shigella flexneri 2a str. 301
auugcagauaccacaucaa

SEQ ID NO: 1988244 - RNA, 16 nt, Shigella flexneri 2a str. 301
auugcaggaagguuuu

SEQ ID NO: 1988245 - RNA, 18 nt, Shigella flexneri 2a str. 301
auugauuuaacagcaaaa

SEQ ID NO: 1988246 - RNA, 16 nt, Shigella flexneri 2a str. 301
auugcagauaccacau

SEQ ID NO: 1988247 - RNA, 21 nt, Shigella flexneri 2a str. 301
auucauuuugcuggaaaagua

SEQ ID NO: 1988248 - RNA, 13 nt, Shigella flexneri 2a str. 301
auucauuuugcug

SEQ ID NO: 1988249 - RNA, 18 nt, Shigella flexneri 2a str. 301
auucauuugaauaguuaa

SEQ ID NO: 1988250 - RNA, 17 nt, Shigella flexneri 2a str. 301
auucauuugcaucaacg

SEQ ID NO: 1988251 - RNA, 22 nt, Shigella flexneri 2a str. 301
auucauuacuuaacgucaaacg

SEQ ID NO: 1988252 - RNA, 22 nt, Shigella flexneri 2a str. 301
auucauucaauuaauaacacau

SEQ ID NO: 1988253 - RNA, 17 nt, Shigella flexneri 2a str. 301
auucauuguucucccau

SEQ ID NO: 1988254 - RNA, 13 nt, Shigella flexneri 2a str. 301
auucauuccuuga

SEQ ID NO: 1988255 - RNA, 22 nt, Shigella flexneri 2a str. 301
auuccauccugcucaaguaaua

SEQ ID NO: 1988256 - RNA, 20 nt, Shigella flexneri 2a str. 301
auuccaucaccuuccacaua

SEQ ID NO: 1988257 - RNA, 20 nt, Shigella flexneri 2a str. 301
auuccaucgcuacgccuucg

SEQ ID NO: 1988258 - RNA, 15 nt, Shigella flexneri 2a str. 301
auuccagugccgcau

SEQ ID NO: 1988259 - RNA, 21 nt, Shigella flexneri 2a str. 301
auuccauuucccugacaaauc

SEQ ID NO: 1988260 - RNA, 15 nt, Shigella flexneri 2a str. 301
auuccauuucccuga

SEQ ID NO: 1988261 - RNA, 13 nt, Shigella flexneri 2a str. 301
auuccacgcauca

SEQ ID NO: 1988262 - RNA, 18 nt, Shigella flexneri 2a str. 301
auuccaccgaaacuuuua

SEQ ID NO: 1988263 - RNA, 15 nt, Shigella flexneri 2a str. 301
auuccagcgccgcca

SEQ ID NO: 1988264 - RNA, 13 nt, Shigella flexneri 2a str. 301
auguugccacacg

SEQ ID NO: 1988265 - RNA, 16 nt, Shigella flexneri 2a str. 301
auguugccacacgccc

SEQ ID NO: 1988266 - RNA, 21 nt, Shigella flexneri 2a str. 301
auguucuggucacucucgacc

SEQ ID NO: 1988267 - RNA, 20 nt, Shigella flexneri 2a str. 301
auguugacgccgucaaaacg

SEQ ID NO: 1988268 - RNA, 23 nt, Shigella flexneri 2a str. 301
auucaguucaacggugugagcac

SEQ ID NO: 1988269 - RNA, 18 nt, Shigella flexneri 2a str. 301
auucagugacagguugcu

SEQ ID NO: 1988270 - RNA, 16 nt, Shigella flexneri 2a str. 301
auucauaaugcccagc

SEQ ID NO: 1988271 - RNA, 16 nt, Shigella flexneri 2a str. 301
auucauaauugcgaug

SEQ ID NO: 1988272 - RNA, 18 nt, Shigella flexneri 2a str. 301
auucauaagaagcuuuuc

SEQ ID NO: 1988273 - RNA, 15 nt, Shigella flexneri 2a str. 301
auucauacccugaau

SEQ ID NO: 1988274 - RNA, 19 nt, Shigella flexneri 2a str. 301
auucauacccugaaucaau

SEQ ID NO: 1988275 - RNA, 16 nt, Shigella flexneri 2a str. 301
auucaucgccuucuug

SEQ ID NO: 1988276 - RNA, 17 nt, Shigella flexneri 2a str. 301
auucauccguuucccug

SEQ ID NO: 1988277 - RNA, 15 nt, Shigella flexneri 2a str. 301
auucauggugaauau

SEQ ID NO: 1988278 - RNA, 16 nt, Shigella flexneri 2a str. 301
auucauggugaauauc

SEQ ID NO: 1988279 - RNA, 18 nt, Shigella flexneri 2a str. 301
auucauggcauuuucucg

SEQ ID NO: 1988280 - RNA, 14 nt, Shigella flexneri 2a str. 301
auucaucuccagca

SEQ ID NO: 1988281 - RNA, 16 nt, Shigella flexneri 2a str. 301
auucgcugcugcggcg

SEQ ID NO: 1988282 - RNA, 15 nt, Shigella flexneri 2a str. 301
auucgcuuucacuca

SEQ ID NO: 1988283 - RNA, 14 nt, Shigella flexneri 2a str. 301
auucggcaaucacc

SEQ ID NO: 1988284 - RNA, 16 nt, Shigella flexneri 2a str. 301
auucggcggcgugccu

SEQ ID NO: 1988285 - RNA, 13 nt, Shigella flexneri 2a str. 301
auucggccaguaa

SEQ ID NO: 1988286 - RNA, 18 nt, Shigella flexneri 2a str. 301
auucgccgguuccagcuu

SEQ ID NO: 1988287 - RNA, 12 nt, Shigella flexneri 2a str. 301
auucgccgccga

SEQ ID NO: 1988288 - RNA, 15 nt, Shigella flexneri 2a str. 301
auucgauacauucag

SEQ ID NO: 1988289 - RNA, 18 nt, Shigella flexneri 2a str. 301
auucgauucacauuuaaa

SEQ ID NO: 1988290 - RNA, 20 nt, Shigella flexneri 2a str. 301
auucgauucacauuuaaaca

SEQ ID NO: 1988291 - RNA, 16 nt, Shigella flexneri 2a str. 301
auucgacgcgcgcaca

SEQ ID NO: 1988292 - RNA, 21 nt, Shigella flexneri 2a str. 301
auucgaaauagagaaaguaaa

SEQ ID NO: 1988293 - RNA, 15 nt, Shigella flexneri 2a str. 301
auucgaaauagagaa

SEQ ID NO: 1988294 - RNA, 22 nt, Shigella flexneri 2a str. 301
auuccuuucccuauuuuuucgu

SEQ ID NO: 1988295 - RNA, 20 nt, Shigella flexneri 2a str. 301
auuccugacccagcaccagu

SEQ ID NO: 1988296 - RNA, 22 nt, Shigella flexneri 2a str. 301
auuccugccgcguuggcaaugu

SEQ ID NO: 1988297 - RNA, 17 nt, Shigella flexneri 2a str. 301
auucccgggcacacuua

SEQ ID NO: 1988298 - RNA, 15 nt, Shigella flexneri 2a str. 301
auucccuugcucugg

SEQ ID NO: 1988299 - RNA, 19 nt, Shigella flexneri 2a str. 301
auuccccggucagcagcac

SEQ ID NO: 1988300 - RNA, 15 nt, Shigella flexneri 2a str. 301
auucccgcagcucca

SEQ ID NO: 1988301 - RNA, 22 nt, Shigella flexneri 2a str. 301
auucccgagcugcucgucagcc

SEQ ID NO: 1988302 - RNA, 18 nt, Shigella flexneri 2a str. 301
auucccauuuauuuuucc

SEQ ID NO: 1988303 - RNA, 22 nt, Shigella flexneri 2a str. 301
auucccagucgcgcaauugcca

SEQ ID NO: 1988304 - RNA, 12 nt, Shigella flexneri 2a str. 301
auuccgaaucca

SEQ ID NO: 1988305 - RNA, 20 nt, Shigella flexneri 2a str. 301
auuccgaauuucauccugua

SEQ ID NO: 1988306 - RNA, 23 nt, Shigella flexneri 2a str. 301
auuccgccaccugcgaacuguaa

SEQ ID NO: 1988307 - RNA, 15 nt, Shigella flexneri 2a str. 301
auuccgccaguugcg

SEQ ID NO: 1988308 - RNA, 23 nt, Shigella flexneri 2a str. 301
auuccgggaaacgaaccauaaaa

SEQ ID NO: 1988309 - RNA, 23 nt, Shigella flexneri 2a str. 301
auuccggcgcaguaugacuacau

SEQ ID NO: 1988310 - RNA, 22 nt, Shigella flexneri 2a str. 301
auuccggcuuguucaucaccau

SEQ ID NO: 1988311 - RNA, 19 nt, Shigella flexneri 2a str. 301
auuccggugcugcgucagu

SEQ ID NO: 1988312 - RNA, 21 nt, Shigella flexneri 2a str. 301
auuccucccguuaugaucagc

SEQ ID NO: 1988313 - RNA, 22 nt, Shigella flexneri 2a str. 301
auuccucauuucccuguugccu

SEQ ID NO: 1988314 - RNA, 20 nt, Shigella flexneri 2a str. 301
auuccuaugcaacaacugaa

SEQ ID NO: 1988315 - RNA, 15 nt, Shigella flexneri 2a str. 301
auuccuaucgaugaa

SEQ ID NO: 1988316 - RNA, 14 nt, Shigella flexneri 2a str. 301
auuccuauuuuguu

SEQ ID NO: 1988317 - RNA, 14 nt, Shigella flexneri 2a str. 301
auuccguuucucca

SEQ ID NO: 1988318 - RNA, 18 nt, Shigella flexneri 2a str. 301
auuuauggugcuaguuau

SEQ ID NO: 1988319 - RNA, 21 nt, Shigella flexneri 2a str. 301
auuuaucuuugauugaagaaa

SEQ ID NO: 1988320 - RNA, 14 nt, Shigella flexneri 2a str. 301
auuuaucuucgagc

SEQ ID NO: 1988321 - RNA, 13 nt, Shigella flexneri 2a str. 301
auuuaugacaaac

SEQ ID NO: 1988322 - RNA, 17 nt, Shigella flexneri 2a str. 301
auuuaugggguggaacg

SEQ ID NO: 1988323 - RNA, 19 nt, Shigella flexneri 2a str. 301
auuuaugcgcuaaauguuu

SEQ ID NO: 1988324 - RNA, 18 nt, Shigella flexneri 2a str. 301
auuucacaccaucaacaa

SEQ ID NO: 1988325 - RNA, 15 nt, Shigella flexneri 2a str. 301
auuucacacauauca

SEQ ID NO: 1988326 - RNA, 13 nt, Shigella flexneri 2a str. 301
auuucaccaucuu

SEQ ID NO: 1988327 - RNA, 19 nt, Shigella flexneri 2a str. 301
auuucacaguaaugauuua

SEQ ID NO: 1988328 - RNA, 19 nt, Shigella flexneri 2a str. 301
auuucaccugcauuugcug

SEQ ID NO: 1988329 - RNA, 22 nt, Shigella flexneri 2a str. 301
auuucacguucacguaaguacu

SEQ ID NO: 1988330 - RNA, 13 nt, Shigella flexneri 2a str. 301
auuucacugccuu

SEQ ID NO: 1988331 - RNA, 20 nt, Shigella flexneri 2a str. 301
auuucacuauguuaguuaca

SEQ ID NO: 1988332 - RNA, 21 nt, Shigella flexneri 2a str. 301
auuucacuugcuguaauuuca

SEQ ID NO: 1988333 - RNA, 22 nt, Shigella flexneri 2a str. 301
auuucagaacaguuuucagugc

SEQ ID NO: 1988334 - RNA, 20 nt, Shigella flexneri 2a str. 301
auuucaguauugagcaaugu

SEQ ID NO: 1988335 - RNA, 22 nt, Shigella flexneri 2a str. 301
auuucaguaauauauauucucu

SEQ ID NO: 1988336 - RNA, 23 nt, Shigella flexneri 2a str. 301
auuucaguaauauauauucucug

SEQ ID NO: 1988337 - RNA, 14 nt, Shigella flexneri 2a str. 301
auuucauuaauauc

SEQ ID NO: 1988338 - RNA, 14 nt, Shigella flexneri 2a str. 301
auuucauguuugaa

SEQ ID NO: 1988339 - RNA, 17 nt, Shigella flexneri 2a str. 301
auuuccaccgcuauuga

SEQ ID NO: 1988340 - RNA, 21 nt, Shigella flexneri 2a str. 301
auuuccacccagccgucacga

SEQ ID NO: 1988341 - RNA, 19 nt, Shigella flexneri 2a str. 301
auuucauuuuuuaauuugg

SEQ ID NO: 1988342 - RNA, 21 nt, Shigella flexneri 2a str. 301
auuuccaucuccagcugcucg

SEQ ID NO: 1988343 - RNA, 13 nt, Shigella flexneri 2a str. 301
auuuccaguuugc

SEQ ID NO: 1988344 - RNA, 13 nt, Shigella flexneri 2a str. 301
auuuccaucucca

SEQ ID NO: 1988345 - RNA, 19 nt, Shigella flexneri 2a str. 301
auuucccaacuguuugccg

SEQ ID NO: 1988346 - RNA, 12 nt, Shigella flexneri 2a str. 301
auuucccacucu

SEQ ID NO: 1988347 - RNA, 22 nt, Shigella flexneri 2a str. 301
auuucccaccacuauuguugaa

SEQ ID NO: 1988348 - RNA, 20 nt, Shigella flexneri 2a str. 301
auuuccaguccagcugccgu

SEQ ID NO: 1988349 - RNA, 17 nt, Shigella flexneri 2a str. 301
auuuccaguuugcguuc

SEQ ID NO: 1988350 - RNA, 17 nt, Shigella flexneri 2a str. 301
auuuccauaaauugcug

SEQ ID NO: 1988351 - RNA, 22 nt, Shigella flexneri 2a str. 301
auuuccagggccucuccuuuac

SEQ ID NO: 1988352 - RNA, 17 nt, Shigella flexneri 2a str. 301
auuuccagggccucucc

SEQ ID NO: 1988353 - RNA, 14 nt, Shigella flexneri 2a str. 301
auuuccaccucccc

SEQ ID NO: 1988354 - RNA, 15 nt, Shigella flexneri 2a str. 301
auuuccagaaaguga

SEQ ID NO: 1988355 - RNA, 20 nt, Shigella flexneri 2a str. 301
auuuccggucgcaggcagua

SEQ ID NO: 1988356 - RNA, 23 nt, Shigella flexneri 2a str. 301
auuuccgcugauucaagauuagc

SEQ ID NO: 1988357 - RNA, 23 nt, Shigella flexneri 2a str. 301
auuuccggauacgguuuuuugaa

SEQ ID NO: 1988358 - RNA, 15 nt, Shigella flexneri 2a str. 301
auuuccgccaaucaa

SEQ ID NO: 1988359 - RNA, 15 nt, Shigella flexneri 2a str. 301
auuuccgccaccuga

SEQ ID NO: 1988360 - RNA, 14 nt, Shigella flexneri 2a str. 301
auuucccugacaaa

SEQ ID NO: 1988361 - RNA, 16 nt, Shigella flexneri 2a str. 301
auuucccgucgaagac

SEQ ID NO: 1988362 - RNA, 16 nt, Shigella flexneri 2a str. 301
auuucccggcacauac

SEQ ID NO: 1988363 - RNA, 20 nt, Shigella flexneri 2a str. 301
auuucgaagaaaccgaugac

SEQ ID NO: 1988364 - RNA, 20 nt, Shigella flexneri 2a str. 301
auuuccuuugguuauucuuu

SEQ ID NO: 1988365 - RNA, 16 nt, Shigella flexneri 2a str. 301
auuucgacgggcuggu

SEQ ID NO: 1988366 - RNA, 19 nt, Shigella flexneri 2a str. 301
auuucgcuuucaucgauuu

SEQ ID NO: 1988367 - RNA, 16 nt, Shigella flexneri 2a str. 301
auuuccuuaaaaguga

SEQ ID NO: 1988368 - RNA, 15 nt, Shigella flexneri 2a str. 301
auuuccuguaacacu

SEQ ID NO: 1988369 - RNA, 22 nt, Shigella flexneri 2a str. 301
auuuccugccagaccuuaucac

SEQ ID NO: 1988370 - RNA, 14 nt, Shigella flexneri 2a str. 301
auuuccugagcacu

SEQ ID NO: 1988371 - RNA, 16 nt, Shigella flexneri 2a str. 301
auuuacacaauuuugu

SEQ ID NO: 1988372 - RNA, 21 nt, Shigella flexneri 2a str. 301
auuuacaagcguuuacccaaa

SEQ ID NO: 1988373 - RNA, 16 nt, Shigella flexneri 2a str. 301
auuuacagccugccag

SEQ ID NO: 1988374 - RNA, 21 nt, Shigella flexneri 2a str. 301
auuuacagccugccagcaugc

SEQ ID NO: 1988375 - RNA, 16 nt, Shigella flexneri 2a str. 301
auuuaccggcagguga

SEQ ID NO: 1988376 - RNA, 20 nt, Shigella flexneri 2a str. 301
auuuaccggcaggugacugg

SEQ ID NO: 1988377 - RNA, 19 nt, Shigella flexneri 2a str. 301
auuuacguuuuaaaccuac

SEQ ID NO: 1988378 - RNA, 15 nt, Shigella flexneri 2a str. 301
auuuacguucuuaca

SEQ ID NO: 1988379 - RNA, 17 nt, Shigella flexneri 2a str. 301
auuuacguuuuaaaccu

SEQ ID NO: 1988380 - RNA, 16 nt, Shigella flexneri 2a str. 301
auuuacgugaagaugc

SEQ ID NO: 1988381 - RNA, 16 nt, Shigella flexneri 2a str. 301
auuuacgcuuuucuuc

SEQ ID NO: 1988382 - RNA, 21 nt, Shigella flexneri 2a str. 301
auuuacggguacgcagcugac

SEQ ID NO: 1988383 - RNA, 16 nt, Shigella flexneri 2a str. 301
auuuacgguauaaccc

SEQ ID NO: 1988384 - RNA, 23 nt, Shigella flexneri 2a str. 301
auuuacgccgacguuggcuauau

SEQ ID NO: 1988385 - RNA, 13 nt, Shigella flexneri 2a str. 301
auuuauauaaaua

SEQ ID NO: 1988386 - RNA, 13 nt, Shigella flexneri 2a str. 301
auuuaaaaagaaa

SEQ ID NO: 1988387 - RNA, 17 nt, Shigella flexneri 2a str. 301
auuguuuugaugaauca

SEQ ID NO: 1988388 - RNA, 20 nt, Shigella flexneri 2a str. 301
auuuaaaaccacuacccaua

SEQ ID NO: 1988389 - RNA, 11 nt, Shigella flexneri 2a str. 301
auuuaaaacca

SEQ ID NO: 1988390 - RNA, 20 nt, Shigella flexneri 2a str. 301
auuuaaaaagaaaaaacuaa

SEQ ID NO: 1988391 - RNA, 18 nt, Shigella flexneri 2a str. 301
auugguacauaacacaau

SEQ ID NO: 1988392 - RNA, 19 nt, Shigella flexneri 2a str. 301
auuggucauuagugauuaa

SEQ ID NO: 1988393 - RNA, 18 nt, Shigella flexneri 2a str. 301
auugguaguguguuugau

SEQ ID NO: 1988394 - RNA, 17 nt, Shigella flexneri 2a str. 301
auuggucuggaacuggc

SEQ ID NO: 1988395 - RNA, 23 nt, Shigella flexneri 2a str. 301
auuuaauaagaauaagcuauaaa

SEQ ID NO: 1988396 - RNA, 14 nt, Shigella flexneri 2a str. 301
auuuaauuacugag

SEQ ID NO: 1988397 - RNA, 20 nt, Shigella flexneri 2a str. 301
auuucguccauguuggagau

SEQ ID NO: 1988398 - RNA, 22 nt, Shigella flexneri 2a str. 301
auuucguccauguuggagauaa

SEQ ID NO: 1988399 - RNA, 19 nt, Shigella flexneri 2a str. 301
auuucguagacugcagcgg

SEQ ID NO: 1988400 - RNA, 14 nt, Shigella flexneri 2a str. 301
auuucguccagcga

SEQ ID NO: 1988401 - RNA, 16 nt, Shigella flexneri 2a str. 301
auuucggcauuuuugg

SEQ ID NO: 1988402 - RNA, 17 nt, Shigella flexneri 2a str. 301
auuucugccuugaguuu

SEQ ID NO: 1988403 - RNA, 19 nt, Shigella flexneri 2a str. 301
auuucugccuugaguuuuu

SEQ ID NO: 1988404 - RNA, 19 nt, Shigella flexneri 2a str. 301
auuucuguauuacagaggu

SEQ ID NO: 1988405 - RNA, 17 nt, Shigella flexneri 2a str. 301
auuucuuuacugacagg

SEQ ID NO: 1988406 - RNA, 22 nt, Shigella flexneri 2a str. 301
auuucuuuguagaugauuuuuu

SEQ ID NO: 1988407 - RNA, 16 nt, Shigella flexneri 2a str. 301
auuugguggggcuugc

SEQ ID NO: 1988408 - RNA, 20 nt, Shigella flexneri 2a str. 301
auuugcuuguuucauuacuc

SEQ ID NO: 1988409 - RNA, 16 nt, Shigella flexneri 2a str. 301
auuuguagcuguugcu

SEQ ID NO: 1988410 - RNA, 21 nt, Shigella flexneri 2a str. 301
auuugcuuguuucauuacucg

SEQ ID NO: 1988411 - RNA, 18 nt, Shigella flexneri 2a str. 301
auuugcuuuucauacaau

SEQ ID NO: 1988412 - RNA, 13 nt, Shigella flexneri 2a str. 301
auuugcugacaau

SEQ ID NO: 1988413 - RNA, 21 nt, Shigella flexneri 2a str. 301
auuugaggaguuuaauaaauu

SEQ ID NO: 1988414 - RNA, 17 nt, Shigella flexneri 2a str. 301
auuugaggaagcugccu

SEQ ID NO: 1988415 - RNA, 23 nt, Shigella flexneri 2a str. 301
auuuuuaacuucgcguucugugg

SEQ ID NO: 1988416 - RNA, 18 nt, Shigella flexneri 2a str. 301
auuuuuacuccacuuccu

SEQ ID NO: 1988417 - RNA, 15 nt, Shigella flexneri 2a str. 301
auuuuuaagcgccau

SEQ ID NO: 1988418 - RNA, 19 nt, Shigella flexneri 2a str. 301
auuuuggguuccacuucug

SEQ ID NO: 1988419 - RNA, 22 nt, Shigella flexneri 2a str. 301
auuuuggguauagauugaugag

SEQ ID NO: 1988420 - RNA, 17 nt, Shigella flexneri 2a str. 301
auuuugcuuuugauguu

SEQ ID NO: 1988421 - RNA, 18 nt, Shigella flexneri 2a str. 301
auuuugcaguaacaauau

SEQ ID NO: 1988422 - RNA, 17 nt, Shigella flexneri 2a str. 301
auuuugccagcaugacu

SEQ ID NO: 1988423 - RNA, 18 nt, Shigella flexneri 2a str. 301
auuuugaagucuuuuuuc

SEQ ID NO: 1988424 - RNA, 17 nt, Shigella flexneri 2a str. 301
auuuugccagccgcagc

SEQ ID NO: 1988425 - RNA, 18 nt, Shigella flexneri 2a str. 301
auuuugcugugcuuuaca

SEQ ID NO: 1988426 - RNA, 19 nt, Shigella flexneri 2a str. 301
auuuugcugccguuuucaa

SEQ ID NO: 1988427 - RNA, 17 nt, Shigella flexneri 2a str. 301
auuuugcugauauuuau

SEQ ID NO: 1988428 - RNA, 18 nt, Shigella flexneri 2a str. 301
auuuugcguguuucagaa

SEQ ID NO: 1988429 - RNA, 16 nt, Shigella flexneri 2a str. 301
auuuuauuucuguauu

SEQ ID NO: 1988430 - RNA, 22 nt, Shigella flexneri 2a str. 301
auuuucaaaauaucgacauuca

SEQ ID NO: 1988431 - RNA, 21 nt, Shigella flexneri 2a str. 301
auuuucauuugcgcggcaguc

SEQ ID NO: 1988432 - RNA, 22 nt, Shigella flexneri 2a str. 301
auuuucccuucugagaucaaug

SEQ ID NO: 1988433 - RNA, 20 nt, Shigella flexneri 2a str. 301
auuuuaggaugcugcaauaa

SEQ ID NO: 1988434 - RNA, 18 nt, Shigella flexneri 2a str. 301
caacgguugcggaaccca

SEQ ID NO: 1988435 - RNA, 13 nt, Shigella flexneri 2a str. 301
caacguaacaaaa

SEQ ID NO: 1988436 - RNA, 14 nt, Shigella flexneri 2a str. 301
caacguaacaaaac

SEQ ID NO: 1988437 - RNA, 15 nt, Shigella flexneri 2a str. 301
caacgggcugaagaa

SEQ ID NO: 1988438 - RNA, 16 nt, Shigella flexneri 2a str. 301
caacgcgcggaacuga

SEQ ID NO: 1988439 - RNA, 18 nt, Shigella flexneri 2a str. 301
caacgcgcgugaaguggc

SEQ ID NO: 1988440 - RNA, 14 nt, Shigella flexneri 2a str. 301
caacgccuucuucg

SEQ ID NO: 1988441 - RNA, 18 nt, Shigella flexneri 2a str. 301
caacgcaucgcugcgcuu

SEQ ID NO: 1988442 - RNA, 23 nt, Shigella flexneri 2a str. 301
caacgccuaaacuaaucgacagu

SEQ ID NO: 1988443 - RNA, 22 nt, Shigella flexneri 2a str. 301
caacguggaacaaauagacaca

SEQ ID NO: 1988444 - RNA, 13 nt, Shigella flexneri 2a str. 301
caacgugcuucgc

SEQ ID NO: 1988445 - RNA, 17 nt, Shigella flexneri 2a str. 301
caacguggaacaaauag

SEQ ID NO: 1988446 - RNA, 16 nt, Shigella flexneri 2a str. 301
caacuccagaauaccg

SEQ ID NO: 1988447 - RNA, 19 nt, Shigella flexneri 2a str. 301
caacuccgccagcaacuga

SEQ ID NO: 1988448 - RNA, 17 nt, Shigella flexneri 2a str. 301
caacuccgucgcggugu

SEQ ID NO: 1988449 - RNA, 21 nt, Shigella flexneri 2a str. 301
caaccuucuucuuucaguacg

SEQ ID NO: 1988450 - RNA, 18 nt, Shigella flexneri 2a str. 301
caaccuuauuuccagaua

SEQ ID NO: 1988451 - RNA, 14 nt, Shigella flexneri 2a str. 301
caaccugcuuuaaa

SEQ ID NO: 1988452 - RNA, 22 nt, Shigella flexneri 2a str. 301
caacauccuguaaacgaaaacu

SEQ ID NO: 1988453 - RNA, 21 nt, Shigella flexneri 2a str. 301
caacaucgcaauccuuucccu

SEQ ID NO: 1988454 - RNA, 15 nt, Shigella flexneri 2a str. 301
caacaucgcauucga

SEQ ID NO: 1988455 - RNA, 22 nt, Shigella flexneri 2a str. 301
caacaucgcauucgacauugaa

SEQ ID NO: 1988456 - RNA, 20 nt, Shigella flexneri 2a str. 301
caacauccuguaaacgaaaa

SEQ ID NO: 1988457 - RNA, 22 nt, Shigella flexneri 2a str. 301
caacauccgaggacagcaucgu

SEQ ID NO: 1988458 - RNA, 21 nt, Shigella flexneri 2a str. 301
caacaucaaauuacagcaccu

SEQ ID NO: 1988459 - RNA, 23 nt, Shigella flexneri 2a str. 301
caacauauuccgcaccugccagc

SEQ ID NO: 1988460 - RNA, 19 nt, Shigella flexneri 2a str. 301
caacauauaucgaaaaauc

SEQ ID NO: 1988461 - RNA, 18 nt, Shigella flexneri 2a str. 301
caacgagccaauaaaaau

SEQ ID NO: 1988462 - RNA, 15 nt, Shigella flexneri 2a str. 301
caacgagauaaaauu

SEQ ID NO: 1988463 - RNA, 13 nt, Shigella flexneri 2a str. 301
caacgcaaagaga

SEQ ID NO: 1988464 - RNA, 20 nt, Shigella flexneri 2a str. 301
caacgcaaacgcccguccau

SEQ ID NO: 1988465 - RNA, 20 nt, Shigella flexneri 2a str. 301
caacgcaauauccgccacuu

SEQ ID NO: 1988466 - RNA, 14 nt, Shigella flexneri 2a str. 301
caacgaagaaaacg

SEQ ID NO: 1988467 - RNA, 12 nt, Shigella flexneri 2a str. 301
caacgaagaaaa

SEQ ID NO: 1988468 - RNA, 21 nt, Shigella flexneri 2a str. 301
caacgacaccguuaaauaacu

SEQ ID NO: 1988469 - RNA, 23 nt, Shigella flexneri 2a str. 301
caacgacgcugaugucagcacuu

SEQ ID NO: 1988470 - RNA, 18 nt, Shigella flexneri 2a str. 301
caacgacguaccaacuga

SEQ ID NO: 1988471 - RNA, 16 nt, Shigella flexneri 2a str. 301
caagagacugcuggcu

SEQ ID NO: 1988472 - RNA, 20 nt, Shigella flexneri 2a str. 301
caagaaucaugccaaaaaua

SEQ ID NO: 1988473 - RNA, 15 nt, Shigella flexneri 2a str. 301
caagaauuaaaauau

SEQ ID NO: 1988474 - RNA, 21 nt, Shigella flexneri 2a str. 301
caagacaucaauaaacaauga

SEQ ID NO: 1988475 - RNA, 13 nt, Shigella flexneri 2a str. 301
caagauagaacca

SEQ ID NO: 1988476 - RNA, 21 nt, Shigella flexneri 2a str. 301
caagauauugccgauuacgua

SEQ ID NO: 1988477 - RNA, 15 nt, Shigella flexneri 2a str. 301
caagauccugauacu

SEQ ID NO: 1988478 - RNA, 19 nt, Shigella flexneri 2a str. 301
caagaucagcauccauauc

SEQ ID NO: 1988479 - RNA, 15 nt, Shigella flexneri 2a str. 301
caagaucgcgcauca

SEQ ID NO: 1988480 - RNA, 14 nt, Shigella flexneri 2a str. 301
caacuuucacgcgc

SEQ ID NO: 1988481 - RNA, 15 nt, Shigella flexneri 2a str. 301
caacuuuagcgaugu

SEQ ID NO: 1988482 - RNA, 23 nt, Shigella flexneri 2a str. 301
caacuuuuggggugcaguucaga

SEQ ID NO: 1988483 - RNA, 23 nt, Shigella flexneri 2a str. 301
caacuucucuuucggcagugcca

SEQ ID NO: 1988484 - RNA, 12 nt, Shigella flexneri 2a str. 301
caacuucugcug

SEQ ID NO: 1988485 - RNA, 22 nt, Shigella flexneri 2a str. 301
caagaacgugcuacgguugacu

SEQ ID NO: 1988486 - RNA, 15 nt, Shigella flexneri 2a str. 301
caagaacagccuuaa

SEQ ID NO: 1988487 - RNA, 19 nt, Shigella flexneri 2a str. 301
caagaaccaaagaaaucag

SEQ ID NO: 1988488 - RNA, 15 nt, Shigella flexneri 2a str. 301
caagaaaccgaaguu

SEQ ID NO: 1988489 - RNA, 12 nt, Shigella flexneri 2a str. 301
caagaaaugaca

SEQ ID NO: 1988490 - RNA, 23 nt, Shigella flexneri 2a str. 301
caagaaagagaagguaaagaagg

SEQ ID NO: 1988491 - RNA, 22 nt, Shigella flexneri 2a str. 301
caagaauagccgcaaagauguu

SEQ ID NO: 1988492 - RNA, 19 nt, Shigella flexneri 2a str. 301
caagaaucaugccaaaaau

SEQ ID NO: 1988493 - RNA, 17 nt, Shigella flexneri 2a str. 301
caagaaugaccgccugc

SEQ ID NO: 1988494 - RNA, 15 nt, Shigella flexneri 2a str. 301
caagaaguaacaacu

SEQ ID NO: 1988495 - RNA, 21 nt, Shigella flexneri 2a str. 301
caaucaccacacgaauuccaa

SEQ ID NO: 1988496 - RNA, 16 nt, Shigella flexneri 2a str. 301
caaucacaucaccaua

SEQ ID NO: 1988497 - RNA, 15 nt, Shigella flexneri 2a str. 301
caaucacaauagaaa

SEQ ID NO: 1988498 - RNA, 13 nt, Shigella flexneri 2a str. 301
caaucacaagacc

SEQ ID NO: 1988499 - RNA, 17 nt, Shigella flexneri 2a str. 301
caaucacaaaaccgucg

SEQ ID NO: 1988500 - RNA, 13 nt, Shigella flexneri 2a str. 301
caaucacaaauag

SEQ ID NO: 1988501 - RNA, 13 nt, Shigella flexneri 2a str. 301
caaucacaaaaag

SEQ ID NO: 1988502 - RNA, 18 nt, Shigella flexneri 2a str. 301
caaucaccgccagcaagg

SEQ ID NO: 1988503 - RNA, 17 nt, Shigella flexneri 2a str. 301
caaucaccgccagcggc

SEQ ID NO: 1988504 - RNA, 11 nt, Shigella flexneri 2a str. 301
caaucaccgca

SEQ ID NO: 1988505 - RNA, 15 nt, Shigella flexneri 2a str. 301
caaucacucaccugc

SEQ ID NO: 1988506 - RNA, 15 nt, Shigella flexneri 2a str. 301
caauaugauaaaccu

SEQ ID NO: 1988507 - RNA, 19 nt, Shigella flexneri 2a str. 301
caauaugucguuauauaaa

SEQ ID NO: 1988508 - RNA, 23 nt, Shigella flexneri 2a str. 301
caauaccuucugcgcccgcccgc

SEQ ID NO: 1988509 - RNA, 17 nt, Shigella flexneri 2a str. 301
caauaccuucugcgccc

SEQ ID NO: 1988510 - RNA, 22 nt, Shigella flexneri 2a str. 301
caauaccugucauggcaguuca

SEQ ID NO: 1988511 - RNA, 18 nt, Shigella flexneri 2a str. 301
caauagcaacugauuuau

SEQ ID NO: 1988512 - RNA, 21 nt, Shigella flexneri 2a str. 301
caauagcaccauuaaauccgg

SEQ ID NO: 1988513 - RNA, 19 nt, Shigella flexneri 2a str. 301
caauauauugcaaucaucu

SEQ ID NO: 1988514 - RNA, 13 nt, Shigella flexneri 2a str. 301
caauagcaacuga

SEQ ID NO: 1988515 - RNA, 15 nt, Shigella flexneri 2a str. 301
caauacccugaccca

SEQ ID NO: 1988516 - RNA, 17 nt, Shigella flexneri 2a str. 301
caauaccauuaucauug

SEQ ID NO: 1988517 - RNA, 17 nt, Shigella flexneri 2a str. 301
caauaccgccugacggu

SEQ ID NO: 1988518 - RNA, 13 nt, Shigella flexneri 2a str. 301
caauacccugacc

SEQ ID NO: 1988519 - RNA, 13 nt, Shigella flexneri 2a str. 301
caauacauagaaa

SEQ ID NO: 1988520 - RNA, 12 nt, Shigella flexneri 2a str. 301
caauacagccag

SEQ ID NO: 1988521 - RNA, 16 nt, Shigella flexneri 2a str. 301
caauacagguuucaau

SEQ ID NO: 1988522 - RNA, 16 nt, Shigella flexneri 2a str. 301
caauaauuaaucuggu

SEQ ID NO: 1988523 - RNA, 15 nt, Shigella flexneri 2a str. 301
caaguugauuuuucg

SEQ ID NO: 1988524 - RNA, 18 nt, Shigella flexneri 2a str. 301
caaguuguauugcucaac

SEQ ID NO: 1988525 - RNA, 12 nt, Shigella flexneri 2a str. 301
caauaacgccau

SEQ ID NO: 1988526 - RNA, 18 nt, Shigella flexneri 2a str. 301
caauaagcgcagccaaaa

SEQ ID NO: 1988527 - RNA, 13 nt, Shigella flexneri 2a str. 301
caauaaucaccgu

SEQ ID NO: 1988528 - RNA, 22 nt, Shigella flexneri 2a str. 301
caauaacucuuugaugaaacau

SEQ ID NO: 1988529 - RNA, 14 nt, Shigella flexneri 2a str. 301
caauaacuccaucu

SEQ ID NO: 1988530 - RNA, 15 nt, Shigella flexneri 2a str. 301
caagugagucggcuu

SEQ ID NO: 1988531 - RNA, 20 nt, Shigella flexneri 2a str. 301
caagugagucggcuuuuuug

SEQ ID NO: 1988532 - RNA, 16 nt, Shigella flexneri 2a str. 301
caagucuucacugcuc

SEQ ID NO: 1988533 - RNA, 17 nt, Shigella flexneri 2a str. 301
caagucgaaccuugguc

SEQ ID NO: 1988534 - RNA, 14 nt, Shigella flexneri 2a str. 301
caaguuacuccugg

SEQ ID NO: 1988535 - RNA, 15 nt, Shigella flexneri 2a str. 301
caaguuacuccuggu

SEQ ID NO: 1988536 - RNA, 21 nt, Shigella flexneri 2a str. 301
caagggaaauaagaaaagcga

SEQ ID NO: 1988537 - RNA, 18 nt, Shigella flexneri 2a str. 301
caaguaauaauaucucca

SEQ ID NO: 1988538 - RNA, 13 nt, Shigella flexneri 2a str. 301
caaguaauaaagc

SEQ ID NO: 1988539 - RNA, 13 nt, Shigella flexneri 2a str. 301
caagcgccgccag

SEQ ID NO: 1988540 - RNA, 15 nt, Shigella flexneri 2a str. 301
caagcgauaauuuau

SEQ ID NO: 1988541 - RNA, 17 nt, Shigella flexneri 2a str. 301
caagcgaaugaggcagc

SEQ ID NO: 1988542 - RNA, 16 nt, Shigella flexneri 2a str. 301
caagcucaaaauaaua

SEQ ID NO: 1988543 - RNA, 14 nt, Shigella flexneri 2a str. 301
caagcgcgcuguca

SEQ ID NO: 1988544 - RNA, 23 nt, Shigella flexneri 2a str. 301
caagauugauccccgcuuccugc

SEQ ID NO: 1988545 - RNA, 17 nt, Shigella flexneri 2a str. 301
caagauugccugaugcg

SEQ ID NO: 1988546 - RNA, 17 nt, Shigella flexneri 2a str. 301
caagauuaaaagugauu

SEQ ID NO: 1988547 - RNA, 12 nt, Shigella flexneri 2a str. 301
caagauuuuugc

SEQ ID NO: 1988548 - RNA, 12 nt, Shigella flexneri 2a str. 301
caagcaaaugaa

SEQ ID NO: 1988549 - RNA, 18 nt, Shigella flexneri 2a str. 301
caagcuuacguuacccag

SEQ ID NO: 1988550 - RNA, 20 nt, Shigella flexneri 2a str. 301
caagcuuacguuacccagca

SEQ ID NO: 1988551 - RNA, 22 nt, Shigella flexneri 2a str. 301
caagcuuacguuacccagcacg

SEQ ID NO: 1988552 - RNA, 14 nt, Shigella flexneri 2a str. 301
caagcuguucuucc

SEQ ID NO: 1988553 - RNA, 18 nt, Shigella flexneri 2a str. 301
caagcuccggcuuuuuac

SEQ ID NO: 1988554 - RNA, 17 nt, Shigella flexneri 2a str. 301
caagcuuacguuaccca

SEQ ID NO: 1988555 - RNA, 18 nt, Shigella flexneri 2a str. 301
caaggcagagucauuucu

SEQ ID NO: 1988556 - RNA, 13 nt, Shigella flexneri 2a str. 301
caacaguucaugg

SEQ ID NO: 1988557 - RNA, 23 nt, Shigella flexneri 2a str. 301
caacaguacgguaaagccgugcu

SEQ ID NO: 1988558 - RNA, 15 nt, Shigella flexneri 2a str. 301
caacaguaauaaugc

SEQ ID NO: 1988559 - RNA, 12 nt, Shigella flexneri 2a str. 301
caacagugaaau

SEQ ID NO: 1988560 - RNA, 19 nt, Shigella flexneri 2a str. 301
caacaguaauaaugcccau

SEQ ID NO: 1988561 - RNA, 18 nt, Shigella flexneri 2a str. 301
caacauacuuugcuggcu

SEQ ID NO: 1988562 - RNA, 17 nt, Shigella flexneri 2a str. 301
caacauacugcuccaua

SEQ ID NO: 1988563 - RNA, 12 nt, Shigella flexneri 2a str. 301
caacauaaagcc

SEQ ID NO: 1988564 - RNA, 14 nt, Shigella flexneri 2a str. 301
caacagcgguuuug

SEQ ID NO: 1988565 - RNA, 22 nt, Shigella flexneri 2a str. 301
caacagcgguuuugcuauccag

SEQ ID NO: 1988566 - RNA, 14 nt, Shigella flexneri 2a str. 301
caacaacugaaaaa

SEQ ID NO: 1988567 - RNA, 16 nt, Shigella flexneri 2a str. 301
caacaacugaaaaaaa

SEQ ID NO: 1988568 - RNA, 20 nt, Shigella flexneri 2a str. 301
caacaagugggugcuucacu

SEQ ID NO: 1988569 - RNA, 17 nt, Shigella flexneri 2a str. 301
caacaaggguaugcugu

SEQ ID NO: 1988570 - RNA, 10 nt, Shigella flexneri 2a str. 301
caacaacugg

SEQ ID NO: 1988571 - RNA, 13 nt, Shigella flexneri 2a str. 301
caacaacacccau

SEQ ID NO: 1988572 - RNA, 20 nt, Shigella flexneri 2a str. 301
caacaacacauucaauaaca

SEQ ID NO: 1988573 - RNA, 13 nt, Shigella flexneri 2a str. 301
caacaauaaaauu

SEQ ID NO: 1988574 - RNA, 23 nt, Shigella flexneri 2a str. 301
caacaauaaaaccaguaaugauc

SEQ ID NO: 1988575 - RNA, 13 nt, Shigella flexneri 2a str. 301
caaauggcauccu

SEQ ID NO: 1988576 - RNA, 11 nt, Shigella flexneri 2a str. 301
caaauggcgcu

SEQ ID NO: 1988577 - RNA, 23 nt, Shigella flexneri 2a str. 301
caaauguggcgguuaccuuggca

SEQ ID NO: 1988578 - RNA, 17 nt, Shigella flexneri 2a str. 301
caaaugucaccagccga

SEQ ID NO: 1988579 - RNA, 17 nt, Shigella flexneri 2a str. 301
caaaugucagcugccag

SEQ ID NO: 1988580 - RNA, 21 nt, Shigella flexneri 2a str. 301
caaauucaauaaauugcagga

SEQ ID NO: 1988581 - RNA, 14 nt, Shigella flexneri 2a str. 301
caaaucuuuucugc

SEQ ID NO: 1988582 - RNA, 17 nt, Shigella flexneri 2a str. 301
caaaucuucgucgugaa

SEQ ID NO: 1988583 - RNA, 18 nt, Shigella flexneri 2a str. 301
caaaucuucgucgugaaa

SEQ ID NO: 1988584 - RNA, 21 nt, Shigella flexneri 2a str. 301
caaaucuucgucgugaaagga

SEQ ID NO: 1988585 - RNA, 14 nt, Shigella flexneri 2a str. 301
caaaugcgccgcca

SEQ ID NO: 1988586 - RNA, 14 nt, Shigella flexneri 2a str. 301
caaaugaaugccaa

SEQ ID NO: 1988587 - RNA, 15 nt, Shigella flexneri 2a str. 301
caaaugaacaccaaa

SEQ ID NO: 1988588 - RNA, 15 nt, Shigella flexneri 2a str. 301
caaauccuucagacu

SEQ ID NO: 1988589 - RNA, 15 nt, Shigella flexneri 2a str. 301
caaauccgcuguaau

SEQ ID NO: 1988590 - RNA, 16 nt, Shigella flexneri 2a str. 301
caaauucaauauauug

SEQ ID NO: 1988591 - RNA, 18 nt, Shigella flexneri 2a str. 301
caaauucaauauauugca

SEQ ID NO: 1988592 - RNA, 15 nt, Shigella flexneri 2a str. 301
caaauucauuaccaa

SEQ ID NO: 1988593 - RNA, 19 nt, Shigella flexneri 2a str. 301
caaauucauugcguaacau

SEQ ID NO: 1988594 - RNA, 13 nt, Shigella flexneri 2a str. 301
caacaaaguugca

SEQ ID NO: 1988595 - RNA, 12 nt, Shigella flexneri 2a str. 301
caacaaagcgcg

SEQ ID NO: 1988596 - RNA, 15 nt, Shigella flexneri 2a str. 301
caacaaacgauuuau

SEQ ID NO: 1988597 - RNA, 21 nt, Shigella flexneri 2a str. 301
caacaaacgcggcuacuuucu

SEQ ID NO: 1988598 - RNA, 14 nt, Shigella flexneri 2a str. 301
caacaaacgugaag

SEQ ID NO: 1988599 - RNA, 19 nt, Shigella flexneri 2a str. 301
caacaaaaaacggaaagca

SEQ ID NO: 1988600 - RNA, 15 nt, Shigella flexneri 2a str. 301
caacaaaauggcaaa

SEQ ID NO: 1988601 - RNA, 14 nt, Shigella flexneri 2a str. 301
caaaggccagcaau

SEQ ID NO: 1988602 - RNA, 14 nt, Shigella flexneri 2a str. 301
caaaggccagccag

SEQ ID NO: 1988603 - RNA, 22 nt, Shigella flexneri 2a str. 301
caaauaccggacacacuucauu

SEQ ID NO: 1988604 - RNA, 20 nt, Shigella flexneri 2a str. 301
caaauacccaaaaaauagca

SEQ ID NO: 1988605 - RNA, 18 nt, Shigella flexneri 2a str. 301
caaauaacguaaaaaccc

SEQ ID NO: 1988606 - RNA, 18 nt, Shigella flexneri 2a str. 301
caaagggggcgacauuua

SEQ ID NO: 1988607 - RNA, 19 nt, Shigella flexneri 2a str. 301
caaagggggcgacauuuag

SEQ ID NO: 1988608 - RNA, 12 nt, Shigella flexneri 2a str. 301
caaauaaauacc

SEQ ID NO: 1988609 - RNA, 20 nt, Shigella flexneri 2a str. 301
caaauacuuuuuccaguaga

SEQ ID NO: 1988610 - RNA, 16 nt, Shigella flexneri 2a str. 301
caaauacuucaauaua

SEQ ID NO: 1988611 - RNA, 14 nt, Shigella flexneri 2a str. 301
caaauacuucaaua

SEQ ID NO: 1988612 - RNA, 19 nt, Shigella flexneri 2a str. 301
caaauacgcuuuuucccug

SEQ ID NO: 1988613 - RNA, 16 nt, Shigella flexneri 2a str. 301
caaauacugacuggca

SEQ ID NO: 1988614 - RNA, 14 nt, Shigella flexneri 2a str. 301
caaauccagcgcca

SEQ ID NO: 1988615 - RNA, 12 nt, Shigella flexneri 2a str. 301
caaauccagcgc

SEQ ID NO: 1988616 - RNA, 15 nt, Shigella flexneri 2a str. 301
caaauauuaauaaua

SEQ ID NO: 1988617 - RNA, 18 nt, Shigella flexneri 2a str. 301
caaagacguuaaaaaagg

SEQ ID NO: 1988618 - RNA, 19 nt, Shigella flexneri 2a str. 301
caaagagcuuucauuucaa

SEQ ID NO: 1988619 - RNA, 21 nt, Shigella flexneri 2a str. 301
caaacugcucguucagcacuu

SEQ ID NO: 1988620 - RNA, 14 nt, Shigella flexneri 2a str. 301
caaacuuaacacug

SEQ ID NO: 1988621 - RNA, 19 nt, Shigella flexneri 2a str. 301
caaacuucucgccaucaaa

SEQ ID NO: 1988622 - RNA, 13 nt, Shigella flexneri 2a str. 301
caaacuucuucag

SEQ ID NO: 1988623 - RNA, 16 nt, Shigella flexneri 2a str. 301
caaacuucgucacagc

SEQ ID NO: 1988624 - RNA, 20 nt, Shigella flexneri 2a str. 301
caaacuugauagaacaaaag

SEQ ID NO: 1988625 - RNA, 22 nt, Shigella flexneri 2a str. 301
caaagcgcacuuugucaaaaau

SEQ ID NO: 1988626 - RNA, 16 nt, Shigella flexneri 2a str. 301
caaagauguugucauu

SEQ ID NO: 1988627 - RNA, 18 nt, Shigella flexneri 2a str. 301
caaagaugaugucacagc

SEQ ID NO: 1988628 - RNA, 20 nt, Shigella flexneri 2a str. 301
caaagcugguggcaagaccu

SEQ ID NO: 1988629 - RNA, 23 nt, Shigella flexneri 2a str. 301
caaagcucuuuugacgcccccaa

SEQ ID NO: 1988630 - RNA, 18 nt, Shigella flexneri 2a str. 301
caaagcuguaucccagcc

SEQ ID NO: 1988631 - RNA, 16 nt, Shigella flexneri 2a str. 301
caaagcugucaccaau

SEQ ID NO: 1988632 - RNA, 21 nt, Shigella flexneri 2a str. 301
caaagcucauugcggcaacaa

SEQ ID NO: 1988633 - RNA, 15 nt, Shigella flexneri 2a str. 301
caaagcugcuuuucc

SEQ ID NO: 1988634 - RNA, 17 nt, Shigella flexneri 2a str. 301
caaacacaaaacugccu

SEQ ID NO: 1988635 - RNA, 15 nt, Shigella flexneri 2a str. 301
caaacacaucaauga

SEQ ID NO: 1988636 - RNA, 15 nt, Shigella flexneri 2a str. 301
caaacaccagcgaau

SEQ ID NO: 1988637 - RNA, 20 nt, Shigella flexneri 2a str. 301
caaacagaugaugcgucuca

SEQ ID NO: 1988638 - RNA, 12 nt, Shigella flexneri 2a str. 301
caaacagaccau

SEQ ID NO: 1988639 - RNA, 19 nt, Shigella flexneri 2a str. 301
caaacagcgcaaaacgcag

SEQ ID NO: 1988640 - RNA, 21 nt, Shigella flexneri 2a str. 301
caaacagggcaauuaaaaauu

SEQ ID NO: 1988641 - RNA, 22 nt, Shigella flexneri 2a str. 301
caaacaguacaucuuccacuuu

SEQ ID NO: 1988642 - RNA, 23 nt, Shigella flexneri 2a str. 301
caaacagucacuuucgagcaauu

SEQ ID NO: 1988643 - RNA, 17 nt, Shigella flexneri 2a str. 301
caaacagggugcagcga

SEQ ID NO: 1988644 - RNA, 21 nt, Shigella flexneri 2a str. 301
caaacaguuucugcagcucca

SEQ ID NO: 1988645 - RNA, 14 nt, Shigella flexneri 2a str. 301
caaacccugaguga

SEQ ID NO: 1988646 - RNA, 16 nt, Shigella flexneri 2a str. 301
caaacccuucuucaau

SEQ ID NO: 1988647 - RNA, 17 nt, Shigella flexneri 2a str. 301
caaacccgaccaccauu

SEQ ID NO: 1988648 - RNA, 20 nt, Shigella flexneri 2a str. 301
caaacaugccaacaaaaucu

SEQ ID NO: 1988649 - RNA, 17 nt, Shigella flexneri 2a str. 301
caaacaucggcuuauuc

SEQ ID NO: 1988650 - RNA, 14 nt, Shigella flexneri 2a str. 301
caaacauggaaacc

SEQ ID NO: 1988651 - RNA, 19 nt, Shigella flexneri 2a str. 301
caaacauugcugccagaaa

SEQ ID NO: 1988652 - RNA, 23 nt, Shigella flexneri 2a str. 301
caaacgacgggccaguuucauag

SEQ ID NO: 1988653 - RNA, 13 nt, Shigella flexneri 2a str. 301
caaacgacgcaga

SEQ ID NO: 1988654 - RNA, 15 nt, Shigella flexneri 2a str. 301
caaaccgacugccug

SEQ ID NO: 1988655 - RNA, 18 nt, Shigella flexneri 2a str. 301
caaacgcaaaacugccug

SEQ ID NO: 1988656 - RNA, 16 nt, Shigella flexneri 2a str. 301
caaacgcaaacaccag

SEQ ID NO: 1988657 - RNA, 23 nt, Shigella flexneri 2a str. 301
caaacgccggaugcaaaaaaaau

SEQ ID NO: 1988658 - RNA, 16 nt, Shigella flexneri 2a str. 301
caaacgccagauacau

SEQ ID NO: 1988659 - RNA, 15 nt, Shigella flexneri 2a str. 301
caaacgcuggugagu

SEQ ID NO: 1988660 - RNA, 14 nt, Shigella flexneri 2a str. 301
caaacgcucccugc

SEQ ID NO: 1988661 - RNA, 19 nt, Shigella flexneri 2a str. 301
caaacugaguggaguccag

SEQ ID NO: 1988662 - RNA, 21 nt, Shigella flexneri 2a str. 301
caaacucgcgcaggcugacau

SEQ ID NO: 1988663 - RNA, 23 nt, Shigella flexneri 2a str. 301
caaacucggcuucgcuaagauac

SEQ ID NO: 1988664 - RNA, 21 nt, Shigella flexneri 2a str. 301
caaacgucgcaucugaccaga

SEQ ID NO: 1988665 - RNA, 14 nt, Shigella flexneri 2a str. 301
caaacgguuguagc

SEQ ID NO: 1988666 - RNA, 22 nt, Shigella flexneri 2a str. 301
caaacgugacauucugacuggu

SEQ ID NO: 1988667 - RNA, 20 nt, Shigella flexneri 2a str. 301
caaacguggucgccagcauu

SEQ ID NO: 1988668 - RNA, 13 nt, Shigella flexneri 2a str. 301
caaacucaccauc

SEQ ID NO: 1988669 - RNA, 18 nt, Shigella flexneri 2a str. 301
auuuuucaauauccaaca

SEQ ID NO: 1988670 - RNA, 17 nt, Shigella flexneri 2a str. 301
caaaaguagccauuuga

SEQ ID NO: 1988671 - RNA, 18 nt, Shigella flexneri 2a str. 301
auuuuucacccuucaauc

SEQ ID NO: 1988672 - RNA, 19 nt, Shigella flexneri 2a str. 301
caaaauagucaucucuucc

SEQ ID NO: 1988673 - RNA, 22 nt, Shigella flexneri 2a str. 301
caaaauacuguuuaucuuccca

SEQ ID NO: 1988674 - RNA, 21 nt, Shigella flexneri 2a str. 301
caaaauacguucucaccucug

SEQ ID NO: 1988675 - RNA, 23 nt, Shigella flexneri 2a str. 301
caaaauacuguuuaucuucccag

SEQ ID NO: 1988676 - RNA, 14 nt, Shigella flexneri 2a str. 301
caaaauacuguuua

SEQ ID NO: 1988677 - RNA, 15 nt, Shigella flexneri 2a str. 301
caaaauaauaaauua

SEQ ID NO: 1988678 - RNA, 23 nt, Shigella flexneri 2a str. 301
caaaauaauaaauuaacugcgcg

SEQ ID NO: 1988679 - RNA, 12 nt, Shigella flexneri 2a str. 301
caaaauaauaca

SEQ ID NO: 1988680 - RNA, 14 nt, Shigella flexneri 2a str. 301
caaaauaauacaca

SEQ ID NO: 1988681 - RNA, 16 nt, Shigella flexneri 2a str. 301
caaaauaauacacaca

SEQ ID NO: 1988682 - RNA, 14 nt, Shigella flexneri 2a str. 301
caaaauucugcuga

SEQ ID NO: 1988683 - RNA, 19 nt, Shigella flexneri 2a str. 301
caaaauugcuguuacgcca

SEQ ID NO: 1988684 - RNA, 21 nt, Shigella flexneri 2a str. 301
caaaauuuagcaaauuuuuaa

SEQ ID NO: 1988685 - RNA, 22 nt, Shigella flexneri 2a str. 301
caaaauuuaacaccaucauauu

SEQ ID NO: 1988686 - RNA, 16 nt, Shigella flexneri 2a str. 301
caaaauuagaaaggga

SEQ ID NO: 1988687 - RNA, 23 nt, Shigella flexneri 2a str. 301
caaacaauuuucauugaaaaagu

SEQ ID NO: 1988688 - RNA, 14 nt, Shigella flexneri 2a str. 301
caaacaauuuucau

SEQ ID NO: 1988689 - RNA, 19 nt, Shigella flexneri 2a str. 301
caaacaaugagaauaccga

SEQ ID NO: 1988690 - RNA, 15 nt, Shigella flexneri 2a str. 301
caaacaacgccucgu

SEQ ID NO: 1988691 - RNA, 19 nt, Shigella flexneri 2a str. 301
caaacaacggcacuucaau

SEQ ID NO: 1988692 - RNA, 13 nt, Shigella flexneri 2a str. 301
caaaauguuuaug

SEQ ID NO: 1988693 - RNA, 17 nt, Shigella flexneri 2a str. 301
caaaauguuuaugccug

SEQ ID NO: 1988694 - RNA, 19 nt, Shigella flexneri 2a str. 301
caaaauguuuaugccuggu

SEQ ID NO: 1988695 - RNA, 19 nt, Shigella flexneri 2a str. 301
caaaauggguauauuugcc

SEQ ID NO: 1988696 - RNA, 15 nt, Shigella flexneri 2a str. 301
caaaaugcaucggca

SEQ ID NO: 1988697 - RNA, 16 nt, Shigella flexneri 2a str. 301
caaaauggacgcaacu

SEQ ID NO: 1988698 - RNA, 12 nt, Shigella flexneri 2a str. 301
caaaaucuauug

SEQ ID NO: 1988699 - RNA, 16 nt, Shigella flexneri 2a str. 301
caaaaucguaagcagg

SEQ ID NO: 1988700 - RNA, 14 nt, Shigella flexneri 2a str. 301
caaaaucuucguua

SEQ ID NO: 1988701 - RNA, 20 nt, Shigella flexneri 2a str. 301
caaaaucuucguuaucccag

SEQ ID NO: 1988702 - RNA, 16 nt, Shigella flexneri 2a str. 301
caaaaucuugcaaaau

SEQ ID NO: 1988703 - RNA, 15 nt, Shigella flexneri 2a str. 301
caaaauccugccagc

SEQ ID NO: 1988704 - RNA, 19 nt, Shigella flexneri 2a str. 301
caaaaucggcaacaugacu

SEQ ID NO: 1988705 - RNA, 19 nt, Shigella flexneri 2a str. 301
caaaauccauuuucuauuu

SEQ ID NO: 1988706 - RNA, 22 nt, Shigella flexneri 2a str. 301
cauccagcuuuuuaaucgccau

SEQ ID NO: 1988707 - RNA, 20 nt, Shigella flexneri 2a str. 301
cauccaggugaaaaauaaaa

SEQ ID NO: 1988708 - RNA, 19 nt, Shigella flexneri 2a str. 301
cauccaguacgccuucacg

SEQ ID NO: 1988709 - RNA, 14 nt, Shigella flexneri 2a str. 301
cauccaucugcuuu

SEQ ID NO: 1988710 - RNA, 20 nt, Shigella flexneri 2a str. 301
cauccagcagcccuugcuuc

SEQ ID NO: 1988711 - RNA, 20 nt, Shigella flexneri 2a str. 301
cauccagcagacgcuccauu

SEQ ID NO: 1988712 - RNA, 21 nt, Shigella flexneri 2a str. 301
cauccagcagagauacaggcc

SEQ ID NO: 1988713 - RNA, 12 nt, Shigella flexneri 2a str. 301
cauccagcacuu

SEQ ID NO: 1988714 - RNA, 14 nt, Shigella flexneri 2a str. 301
cauccagcagcccu

SEQ ID NO: 1988715 - RNA, 22 nt, Shigella flexneri 2a str. 301
cauccagcagcggaucgaacuc

SEQ ID NO: 1988716 - RNA, 17 nt, Shigella flexneri 2a str. 301
caucaggaaacccgcca

SEQ ID NO: 1988717 - RNA, 21 nt, Shigella flexneri 2a str. 301
caucaggacgaauacaagaga

SEQ ID NO: 1988718 - RNA, 19 nt, Shigella flexneri 2a str. 301
caucagcggcgaagccuaa

SEQ ID NO: 1988719 - RNA, 22 nt, Shigella flexneri 2a str. 301
caucauggcgaugagaaucagu

SEQ ID NO: 1988720 - RNA, 20 nt, Shigella flexneri 2a str. 301
caucaugcucagaugccuga

SEQ ID NO: 1988721 - RNA, 16 nt, Shigella flexneri 2a str. 301
caucaugcugccgggc

SEQ ID NO: 1988722 - RNA, 14 nt, Shigella flexneri 2a str. 301
caucauggcauuuc

SEQ ID NO: 1988723 - RNA, 22 nt, Shigella flexneri 2a str. 301
caucaggcaaucucugguuugu

SEQ ID NO: 1988724 - RNA, 22 nt, Shigella flexneri 2a str. 301
cauccggcaaucggugcaaaug

SEQ ID NO: 1988725 - RNA, 19 nt, Shigella flexneri 2a str. 301
cauccggcaaguuguauug

SEQ ID NO: 1988726 - RNA, 21 nt, Shigella flexneri 2a str. 301
cauccggcaacaucaaauuac

SEQ ID NO: 1988727 - RNA, 15 nt, Shigella flexneri 2a str. 301
cauccggcaauaagc

SEQ ID NO: 1988728 - RNA, 19 nt, Shigella flexneri 2a str. 301
cauccggcaauucucucug

SEQ ID NO: 1988729 - RNA, 15 nt, Shigella flexneri 2a str. 301
cauccggcagcaaau

SEQ ID NO: 1988730 - RNA, 22 nt, Shigella flexneri 2a str. 301
cauccggcauucagugcaaaug

SEQ ID NO: 1988731 - RNA, 16 nt, Shigella flexneri 2a str. 301
cauccggcauauuaac

SEQ ID NO: 1988732 - RNA, 12 nt, Shigella flexneri 2a str. 301
cauccugccaug

SEQ ID NO: 1988733 - RNA, 17 nt, Shigella flexneri 2a str. 301
cauccgacauuugcaca

SEQ ID NO: 1988734 - RNA, 21 nt, Shigella flexneri 2a str. 301
cauccgacaaggcaucagauc

SEQ ID NO: 1988735 - RNA, 18 nt, Shigella flexneri 2a str. 301
cauccgacaaggcaucag

SEQ ID NO: 1988736 - RNA, 21 nt, Shigella flexneri 2a str. 301
caucccguuaugguuauccac

SEQ ID NO: 1988737 - RNA, 14 nt, Shigella flexneri 2a str. 301
cauccauuuuucac

SEQ ID NO: 1988738 - RNA, 20 nt, Shigella flexneri 2a str. 301
cauccccaaaaaaucaacga

SEQ ID NO: 1988739 - RNA, 18 nt, Shigella flexneri 2a str. 301
caucccagacaccgccca

SEQ ID NO: 1988740 - RNA, 21 nt, Shigella flexneri 2a str. 301
cauccccggcaaccacaccca

SEQ ID NO: 1988741 - RNA, 13 nt, Shigella flexneri 2a str. 301
cauccccucuucc

SEQ ID NO: 1988742 - RNA, 17 nt, Shigella flexneri 2a str. 301
cauccccgcccuuccag

SEQ ID NO: 1988743 - RNA, 19 nt, Shigella flexneri 2a str. 301
cauccccggcaaccacacc

SEQ ID NO: 1988744 - RNA, 15 nt, Shigella flexneri 2a str. 301
caucccgguuauuaa

SEQ ID NO: 1988745 - RNA, 16 nt, Shigella flexneri 2a str. 301
caucccggcagagaaa

SEQ ID NO: 1988746 - RNA, 20 nt, Shigella flexneri 2a str. 301
caucggcaaucacaucacca

SEQ ID NO: 1988747 - RNA, 17 nt, Shigella flexneri 2a str. 301
caucggcaaucacauca

SEQ ID NO: 1988748 - RNA, 19 nt, Shigella flexneri 2a str. 301
caucgcuucaugcccgcca

SEQ ID NO: 1988749 - RNA, 15 nt, Shigella flexneri 2a str. 301
caucgcugugcugcu

SEQ ID NO: 1988750 - RNA, 23 nt, Shigella flexneri 2a str. 301
caucgcugauuucaccaucuuca

SEQ ID NO: 1988751 - RNA, 14 nt, Shigella flexneri 2a str. 301
caucgccagaaauc

SEQ ID NO: 1988752 - RNA, 18 nt, Shigella flexneri 2a str. 301
caucgccagagaagaaca

SEQ ID NO: 1988753 - RNA, 23 nt, Shigella flexneri 2a str. 301
caucgccgguaaaaaugcgcagu

SEQ ID NO: 1988754 - RNA, 13 nt, Shigella flexneri 2a str. 301
caucgccgggaac

SEQ ID NO: 1988755 - RNA, 17 nt, Shigella flexneri 2a str. 301
caucgaugagaugacgc

SEQ ID NO: 1988756 - RNA, 22 nt, Shigella flexneri 2a str. 301
caucgaugguugcccugcuggu

SEQ ID NO: 1988757 - RNA, 21 nt, Shigella flexneri 2a str. 301
cauccugguaguccaggaugu

SEQ ID NO: 1988758 - RNA, 19 nt, Shigella flexneri 2a str. 301
cauccuguacgacaaaaga

SEQ ID NO: 1988759 - RNA, 21 nt, Shigella flexneri 2a str. 301
cauccugcggcagcuccagca

SEQ ID NO: 1988760 - RNA, 11 nt, Shigella flexneri 2a str. 301
cauccugcugg

SEQ ID NO: 1988761 - RNA, 21 nt, Shigella flexneri 2a str. 301
cauccuggggguucaucacca

SEQ ID NO: 1988762 - RNA, 19 nt, Shigella flexneri 2a str. 301
caucgcaaaccagacgcgc

SEQ ID NO: 1988763 - RNA, 19 nt, Shigella flexneri 2a str. 301
caucgcauaaaccacagac

SEQ ID NO: 1988764 - RNA, 18 nt, Shigella flexneri 2a str. 301
caucgcaggccaguugcg

SEQ ID NO: 1988765 - RNA, 21 nt, Shigella flexneri 2a str. 301
caucgcaggccaguugcgccg

SEQ ID NO: 1988766 - RNA, 15 nt, Shigella flexneri 2a str. 301
caucgcaucuucgcc

SEQ ID NO: 1988767 - RNA, 15 nt, Shigella flexneri 2a str. 301
caucggcauuaaucu

SEQ ID NO: 1988768 - RNA, 13 nt, Shigella flexneri 2a str. 301
caucggcaucaaa

SEQ ID NO: 1988769 - RNA, 16 nt, Shigella flexneri 2a str. 301
caucggcagcgccaau

SEQ ID NO: 1988770 - RNA, 18 nt, Shigella flexneri 2a str. 301
caucguuugcugccuuca

SEQ ID NO: 1988771 - RNA, 14 nt, Shigella flexneri 2a str. 301
caucgugcaccaau

SEQ ID NO: 1988772 - RNA, 19 nt, Shigella flexneri 2a str. 301
caucgugcucgcuuuccau

SEQ ID NO: 1988773 - RNA, 20 nt, Shigella flexneri 2a str. 301
caucgucggccuuaaugccc

SEQ ID NO: 1988774 - RNA, 17 nt, Shigella flexneri 2a str. 301
caucuaccgccagccag

SEQ ID NO: 1988775 - RNA, 20 nt, Shigella flexneri 2a str. 301
caucguugacauuugcuuuu

SEQ ID NO: 1988776 - RNA, 16 nt, Shigella flexneri 2a str. 301
caucucauagcgcccu

SEQ ID NO: 1988777 - RNA, 14 nt, Shigella flexneri 2a str. 301
caucuccacaguca

SEQ ID NO: 1988778 - RNA, 19 nt, Shigella flexneri 2a str. 301
caucuccacagucaggcug

SEQ ID NO: 1988779 - RNA, 20 nt, Shigella flexneri 2a str. 301
caucucaacuuucuuggcac

SEQ ID NO: 1988780 - RNA, 12 nt, Shigella flexneri 2a str. 301
caucuacaaaaa

SEQ ID NO: 1988781 - RNA, 22 nt, Shigella flexneri 2a str. 301
caucucaggcaguacgcggcgg

SEQ ID NO: 1988782 - RNA, 17 nt, Shigella flexneri 2a str. 301
caucucaccguugccaa

SEQ ID NO: 1988783 - RNA, 23 nt, Shigella flexneri 2a str. 301
caucacugcaaauacccaaaaaa

SEQ ID NO: 1988784 - RNA, 19 nt, Shigella flexneri 2a str. 301
caucagaaacacacuuucc

SEQ ID NO: 1988785 - RNA, 21 nt, Shigella flexneri 2a str. 301
caucagaaacacacuuuccag

SEQ ID NO: 1988786 - RNA, 21 nt, Shigella flexneri 2a str. 301
caucagacaaaugucacugcu

SEQ ID NO: 1988787 - RNA, 14 nt, Shigella flexneri 2a str. 301
caucagacauuauu

SEQ ID NO: 1988788 - RNA, 21 nt, Shigella flexneri 2a str. 301
caucagaccuucgcuaucaaa

SEQ ID NO: 1988789 - RNA, 22 nt, Shigella flexneri 2a str. 301
caucagaggcgaaccgcuguca

SEQ ID NO: 1988790 - RNA, 14 nt, Shigella flexneri 2a str. 301
caucagaggaauga

SEQ ID NO: 1988791 - RNA, 20 nt, Shigella flexneri 2a str. 301
caucagcacaaaucggcaac

SEQ ID NO: 1988792 - RNA, 17 nt, Shigella flexneri 2a str. 301
caucagauaaucgccau

SEQ ID NO: 1988793 - RNA, 19 nt, Shigella flexneri 2a str. 301
caucagcauaaucaccagu

SEQ ID NO: 1988794 - RNA, 12 nt, Shigella flexneri 2a str. 301
caucagcagcaa

SEQ ID NO: 1988795 - RNA, 16 nt, Shigella flexneri 2a str. 301
caucagcagaaucgca

SEQ ID NO: 1988796 - RNA, 23 nt, Shigella flexneri 2a str. 301
caucagcaguuuuuccccugcca

SEQ ID NO: 1988797 - RNA, 14 nt, Shigella flexneri 2a str. 301
caucagcgccuuac

SEQ ID NO: 1988798 - RNA, 18 nt, Shigella flexneri 2a str. 301
caucacauagcgguaagc

SEQ ID NO: 1988799 - RNA, 23 nt, Shigella flexneri 2a str. 301
caucacaccgcgaucuuccacgc

SEQ ID NO: 1988800 - RNA, 22 nt, Shigella flexneri 2a str. 301
caucaccaauacgcauaugcau

SEQ ID NO: 1988801 - RNA, 13 nt, Shigella flexneri 2a str. 301
caucaccaacacc

SEQ ID NO: 1988802 - RNA, 23 nt, Shigella flexneri 2a str. 301
caucacaauuccggugcgccaga

SEQ ID NO: 1988803 - RNA, 19 nt, Shigella flexneri 2a str. 301
caucacuccauccagcaac

SEQ ID NO: 1988804 - RNA, 23 nt, Shigella flexneri 2a str. 301
caucacuccauccagcaacaaca

SEQ ID NO: 1988805 - RNA, 17 nt, Shigella flexneri 2a str. 301
caucacuccauccagca

SEQ ID NO: 1988806 - RNA, 17 nt, Shigella flexneri 2a str. 301
caucacucccuuucugc

SEQ ID NO: 1988807 - RNA, 14 nt, Shigella flexneri 2a str. 301
caucacuccacacc

SEQ ID NO: 1988808 - RNA, 14 nt, Shigella flexneri 2a str. 301
caucacgucggcgu

SEQ ID NO: 1988809 - RNA, 23 nt, Shigella flexneri 2a str. 301
caucacgguugagggcaaacacc

SEQ ID NO: 1988810 - RNA, 13 nt, Shigella flexneri 2a str. 301
caucaccacgcug

SEQ ID NO: 1988811 - RNA, 20 nt, Shigella flexneri 2a str. 301
caucaccacgcugagagaag

SEQ ID NO: 1988812 - RNA, 21 nt, Shigella flexneri 2a str. 301
caucaauaccugguccuucau

SEQ ID NO: 1988813 - RNA, 13 nt, Shigella flexneri 2a str. 301
caucaaucacuuu

SEQ ID NO: 1988814 - RNA, 20 nt, Shigella flexneri 2a str. 301
caucaauagcuaacgaaaga

SEQ ID NO: 1988815 - RNA, 15 nt, Shigella flexneri 2a str. 301
caucaauccaaacau

SEQ ID NO: 1988816 - RNA, 21 nt, Shigella flexneri 2a str. 301
caucaaucccuucgacuuuca

SEQ ID NO: 1988817 - RNA, 13 nt, Shigella flexneri 2a str. 301
caucaaucauuuu

SEQ ID NO: 1988818 - RNA, 16 nt, Shigella flexneri 2a str. 301
caucaaugccagcaua

SEQ ID NO: 1988819 - RNA, 13 nt, Shigella flexneri 2a str. 301
caucaaugccagc

SEQ ID NO: 1988820 - RNA, 14 nt, Shigella flexneri 2a str. 301
caucaauggaugaa

SEQ ID NO: 1988821 - RNA, 22 nt, Shigella flexneri 2a str. 301
caucaauggaugaacgagcugc

SEQ ID NO: 1988822 - RNA, 20 nt, Shigella flexneri 2a str. 301
caucaauggaugcaaucaca

SEQ ID NO: 1988823 - RNA, 13 nt, Shigella flexneri 2a str. 301
caucaaagucucc

SEQ ID NO: 1988824 - RNA, 15 nt, Shigella flexneri 2a str. 301
caucaaaguuuuuau

SEQ ID NO: 1988825 - RNA, 14 nt, Shigella flexneri 2a str. 301
caucaaaucacuaa

SEQ ID NO: 1988826 - RNA, 20 nt, Shigella flexneri 2a str. 301
caucaacaagcgaauuuccc

SEQ ID NO: 1988827 - RNA, 20 nt, Shigella flexneri 2a str. 301
cauauuuccuuccuuggaua

SEQ ID NO: 1988828 - RNA, 14 nt, Shigella flexneri 2a str. 301
cauauuucuccauu

SEQ ID NO: 1988829 - RNA, 18 nt, Shigella flexneri 2a str. 301
cauauuuaaucaguucua

SEQ ID NO: 1988830 - RNA, 19 nt, Shigella flexneri 2a str. 301
cauauuuaaucaguucuac

SEQ ID NO: 1988831 - RNA, 18 nt, Shigella flexneri 2a str. 301
cauauucugaucgugcuc

SEQ ID NO: 1988832 - RNA, 19 nt, Shigella flexneri 2a str. 301
cauauuccgcaccugccag

SEQ ID NO: 1988833 - RNA, 13 nt, Shigella flexneri 2a str. 301
cauauuccccugg

SEQ ID NO: 1988834 - RNA, 19 nt, Shigella flexneri 2a str. 301
cauaucgaaccagcggaca

SEQ ID NO: 1988835 - RNA, 14 nt, Shigella flexneri 2a str. 301
cauauccaccaccc

SEQ ID NO: 1988836 - RNA, 20 nt, Shigella flexneri 2a str. 301
cauauccaccacccagcgcc

SEQ ID NO: 1988837 - RNA, 19 nt, Shigella flexneri 2a str. 301
cauaguguguuccucugcu

SEQ ID NO: 1988838 - RNA, 20 nt, Shigella flexneri 2a str. 301
cauaguguguuccucugcuc

SEQ ID NO: 1988839 - RNA, 20 nt, Shigella flexneri 2a str. 301
cauagucuuugcgaggcgcg

SEQ ID NO: 1988840 - RNA, 18 nt, Shigella flexneri 2a str. 301
cauaguggguuucugccg

SEQ ID NO: 1988841 - RNA, 20 nt, Shigella flexneri 2a str. 301
cauagucacuaccuguuuaa

SEQ ID NO: 1988842 - RNA, 17 nt, Shigella flexneri 2a str. 301
cauauaccucagcagac

SEQ ID NO: 1988843 - RNA, 18 nt, Shigella flexneri 2a str. 301
cauauaccgucagcgucu

SEQ ID NO: 1988844 - RNA, 20 nt, Shigella flexneri 2a str. 301
cauauaccgcaucagcaucg

SEQ ID NO: 1988845 - RNA, 18 nt, Shigella flexneri 2a str. 301
cauauaccgcaucagcau

SEQ ID NO: 1988846 - RNA, 23 nt, Shigella flexneri 2a str. 301
cauauacgccaucgccagcagcc

SEQ ID NO: 1988847 - RNA, 19 nt, Shigella flexneri 2a str. 301
cauauagccgcgcaguuuc

SEQ ID NO: 1988848 - RNA, 18 nt, Shigella flexneri 2a str. 301
cauauagaucuuuagugc

SEQ ID NO: 1988849 - RNA, 20 nt, Shigella flexneri 2a str. 301
cauauagccgccuuguugua

SEQ ID NO: 1988850 - RNA, 23 nt, Shigella flexneri 2a str. 301
cauauagccgccuuguuguaaug

SEQ ID NO: 1988851 - RNA, 15 nt, Shigella flexneri 2a str. 301
cauaggcauuaaaca

SEQ ID NO: 1988852 - RNA, 16 nt, Shigella flexneri 2a str. 301
cauagcgugacaccag

SEQ ID NO: 1988853 - RNA, 15 nt, Shigella flexneri 2a str. 301
cauaggcggcaaaca

SEQ ID NO: 1988854 - RNA, 14 nt, Shigella flexneri 2a str. 301
cauaguauuuaucc

SEQ ID NO: 1988855 - RNA, 22 nt, Shigella flexneri 2a str. 301
cauaguauuuauccauaauuug

SEQ ID NO: 1988856 - RNA, 15 nt, Shigella flexneri 2a str. 301
cauaguagguccuga

SEQ ID NO: 1988857 - RNA, 19 nt, Shigella flexneri 2a str. 301
cauaguagccagccagaau

SEQ ID NO: 1988858 - RNA, 13 nt, Shigella flexneri 2a str. 301
cauaguaagcaga

SEQ ID NO: 1988859 - RNA, 17 nt, Shigella flexneri 2a str. 301
cauagacuggaaacuca

SEQ ID NO: 1988860 - RNA, 21 nt, Shigella flexneri 2a str. 301
cauagaaacucauaugcagca

SEQ ID NO: 1988861 - RNA, 13 nt, Shigella flexneri 2a str. 301
cauacaacgccau

SEQ ID NO: 1988862 - RNA, 17 nt, Shigella flexneri 2a str. 301
cauaauggcugccgaug

SEQ ID NO: 1988863 - RNA, 22 nt, Shigella flexneri 2a str. 301
cauagcgccucuuuauaaauau

SEQ ID NO: 1988864 - RNA, 21 nt, Shigella flexneri 2a str. 301
cauagcaucccaauacccgca

SEQ ID NO: 1988865 - RNA, 19 nt, Shigella flexneri 2a str. 301
cauagcagcacaccacauc

SEQ ID NO: 1988866 - RNA, 22 nt, Shigella flexneri 2a str. 301
cauagcaaccgcgacugggagg

SEQ ID NO: 1988867 - RNA, 17 nt, Shigella flexneri 2a str. 301
cauagauaccuucuuga

SEQ ID NO: 1988868 - RNA, 22 nt, Shigella flexneri 2a str. 301
cauagagacuuuuccagccgac

SEQ ID NO: 1988869 - RNA, 21 nt, Shigella flexneri 2a str. 301
cauucaguuaccugaaugcuc

SEQ ID NO: 1988870 - RNA, 16 nt, Shigella flexneri 2a str. 301
cauucaguuaccugaa

SEQ ID NO: 1988871 - RNA, 21 nt, Shigella flexneri 2a str. 301
cauucaggccgccgucaucac

SEQ ID NO: 1988872 - RNA, 16 nt, Shigella flexneri 2a str. 301
cauucagccaguucuu

SEQ ID NO: 1988873 - RNA, 20 nt, Shigella flexneri 2a str. 301
cauucacgcugucggcacug

SEQ ID NO: 1988874 - RNA, 21 nt, Shigella flexneri 2a str. 301
cauucacgcugucggcacuga

SEQ ID NO: 1988875 - RNA, 13 nt, Shigella flexneri 2a str. 301
cauuccaguaauu

SEQ ID NO: 1988876 - RNA, 21 nt, Shigella flexneri 2a str. 301
cauuccaguccacaucaacca

SEQ ID NO: 1988877 - RNA, 13 nt, Shigella flexneri 2a str. 301
cauuccacuuuca

SEQ ID NO: 1988878 - RNA, 18 nt, Shigella flexneri 2a str. 301
cauucaugaacacacccg

SEQ ID NO: 1988879 - RNA, 19 nt, Shigella flexneri 2a str. 301
cauucaugcgaauacaccc

SEQ ID NO: 1988880 - RNA, 21 nt, Shigella flexneri 2a str. 301
cauucaugcgaauacacccug

SEQ ID NO: 1988881 - RNA, 23 nt, Shigella flexneri 2a str. 301
cauuccgggaaacgaaccauaaa

SEQ ID NO: 1988882 - RNA, 22 nt, Shigella flexneri 2a str. 301
cauuccggaguuuaugaggcac

SEQ ID NO: 1988883 - RNA, 19 nt, Shigella flexneri 2a str. 301
cauuccgcaugauucugag

SEQ ID NO: 1988884 - RNA, 17 nt, Shigella flexneri 2a str. 301
cauuccggccaucgccu

SEQ ID NO: 1988885 - RNA, 21 nt, Shigella flexneri 2a str. 301
cauucccagcgcguucuggua

SEQ ID NO: 1988886 - RNA, 18 nt, Shigella flexneri 2a str. 301
cauucccuacgcgauaaa

SEQ ID NO: 1988887 - RNA, 23 nt, Shigella flexneri 2a str. 301
cauucccugcagucaccugcccu

SEQ ID NO: 1988888 - RNA, 22 nt, Shigella flexneri 2a str. 301
cauucgccgccgaagacaaauu

SEQ ID NO: 1988889 - RNA, 15 nt, Shigella flexneri 2a str. 301
cauucgccaguccuu

SEQ ID NO: 1988890 - RNA, 18 nt, Shigella flexneri 2a str. 301
cauucgagaagcccauac

SEQ ID NO: 1988891 - RNA, 16 nt, Shigella flexneri 2a str. 301
cauuccugcugacggc

SEQ ID NO: 1988892 - RNA, 16 nt, Shigella flexneri 2a str. 301
cauucgacaacugcug

SEQ ID NO: 1988893 - RNA, 21 nt, Shigella flexneri 2a str. 301
cauuauuucccggcugauaaa

SEQ ID NO: 1988894 - RNA, 19 nt, Shigella flexneri 2a str. 301
cauucaacuuaagucucca

SEQ ID NO: 1988895 - RNA, 14 nt, Shigella flexneri 2a str. 301
cauucaccaagcaa

SEQ ID NO: 1988896 - RNA, 19 nt, Shigella flexneri 2a str. 301
cauucaccagcccacaugc

SEQ ID NO: 1988897 - RNA, 14 nt, Shigella flexneri 2a str. 301
cauuauugcgcaca

SEQ ID NO: 1988898 - RNA, 18 nt, Shigella flexneri 2a str. 301
cauuauucauuguucucc

SEQ ID NO: 1988899 - RNA, 22 nt, Shigella flexneri 2a str. 301
cauuauucauuguucucccaua

SEQ ID NO: 1988900 - RNA, 15 nt, Shigella flexneri 2a str. 301
cauuauucucagcgg

SEQ ID NO: 1988901 - RNA, 22 nt, Shigella flexneri 2a str. 301
cauuauucucagcgguugcaag

SEQ ID NO: 1988902 - RNA, 20 nt, Shigella flexneri 2a str. 301
cauuauuaaacagacaguaa

SEQ ID NO: 1988903 - RNA, 13 nt, Shigella flexneri 2a str. 301
cauguucaaaaaa

SEQ ID NO: 1988904 - RNA, 19 nt, Shigella flexneri 2a str. 301
cauuaccugaaaaaacaaa

SEQ ID NO: 1988905 - RNA, 17 nt, Shigella flexneri 2a str. 301
cauuacgccagucacgg

SEQ ID NO: 1988906 - RNA, 13 nt, Shigella flexneri 2a str. 301
cauuagucacaaa

SEQ ID NO: 1988907 - RNA, 20 nt, Shigella flexneri 2a str. 301
cauuauaaauucuggccacu

SEQ ID NO: 1988908 - RNA, 17 nt, Shigella flexneri 2a str. 301
cauuauauaaugccagg

SEQ ID NO: 1988909 - RNA, 24 nt, Shigella flexneri 2a str. 301
cauuacuacgguaauacaaccugc

SEQ ID NO: 1988910 - RNA, 19 nt, Shigella flexneri 2a str. 301
cauuaccuucaacacuggc

SEQ ID NO: 1988911 - RNA, 20 nt, Shigella flexneri 2a str. 301
cauuacguccaucacaauca

SEQ ID NO: 1988912 - RNA, 14 nt, Shigella flexneri 2a str. 301
cauuacucguccuu

SEQ ID NO: 1988913 - RNA, 20 nt, Shigella flexneri 2a str. 301
cauucuugcgcggauggccu

SEQ ID NO: 1988914 - RNA, 23 nt, Shigella flexneri 2a str. 301
cauucuugccaucaaucacuuug

SEQ ID NO: 1988915 - RNA, 17 nt, Shigella flexneri 2a str. 301
cauucuuccuccagcgg

SEQ ID NO: 1988916 - RNA, 15 nt, Shigella flexneri 2a str. 301
cauugcaguuaucug

SEQ ID NO: 1988917 - RNA, 19 nt, Shigella flexneri 2a str. 301
cauugcaucgaggaaaacc

SEQ ID NO: 1988918 - RNA, 14 nt, Shigella flexneri 2a str. 301
cauugccauguuga

SEQ ID NO: 1988919 - RNA, 20 nt, Shigella flexneri 2a str. 301
cauugcccgcccgacaaagc

SEQ ID NO: 1988920 - RNA, 16 nt, Shigella flexneri 2a str. 301
cauuggccguugccau

SEQ ID NO: 1988921 - RNA, 19 nt, Shigella flexneri 2a str. 301
cauugggccacucaacauc

SEQ ID NO: 1988922 - RNA, 17 nt, Shigella flexneri 2a str. 301
cauuggcucaucaaaca

SEQ ID NO: 1988923 - RNA, 17 nt, Shigella flexneri 2a str. 301
cauuggggauuaucuga

SEQ ID NO: 1988924 - RNA, 21 nt, Shigella flexneri 2a str. 301
cauugcguuuaguuacaccac

SEQ ID NO: 1988925 - RNA, 21 nt, Shigella flexneri 2a str. 301
cauugcgguucguugauaaua

SEQ ID NO: 1988926 - RNA, 17 nt, Shigella flexneri 2a str. 301
cauugcggcaacaaugc

SEQ ID NO: 1988927 - RNA, 13 nt, Shigella flexneri 2a str. 301
cauugcuauuucc

SEQ ID NO: 1988928 - RNA, 16 nt, Shigella flexneri 2a str. 301
cauugcuauuuccacc

SEQ ID NO: 1988929 - RNA, 16 nt, Shigella flexneri 2a str. 301
cauugcucacuuccuu

SEQ ID NO: 1988930 - RNA, 16 nt, Shigella flexneri 2a str. 301
cauugcucucuucucc

SEQ ID NO: 1988931 - RNA, 17 nt, Shigella flexneri 2a str. 301
cauugcucuggcaaacu

SEQ ID NO: 1988932 - RNA, 15 nt, Shigella flexneri 2a str. 301
cauugcugccgccag

SEQ ID NO: 1988933 - RNA, 20 nt, Shigella flexneri 2a str. 301
cauuuaccgcaacucauuua

SEQ ID NO: 1988934 - RNA, 23 nt, Shigella flexneri 2a str. 301
cauuuaccgcaacucauuuacag

SEQ ID NO: 1988935 - RNA, 21 nt, Shigella flexneri 2a str. 301
cauuuauggugcuaguuaucu

SEQ ID NO: 1988936 - RNA, 17 nt, Shigella flexneri 2a str. 301
cauuuaugccauguuca

SEQ ID NO: 1988937 - RNA, 23 nt, Shigella flexneri 2a str. 301
cauuucaaucaucucucgcauca

SEQ ID NO: 1988938 - RNA, 16 nt, Shigella flexneri 2a str. 301
cauuucacguucacgu

SEQ ID NO: 1988939 - RNA, 22 nt, Shigella flexneri 2a str. 301
cauuucaccgucaucgacaaaa

SEQ ID NO: 1988940 - RNA, 15 nt, Shigella flexneri 2a str. 301
cauuuccaagauuaa

SEQ ID NO: 1988941 - RNA, 17 nt, Shigella flexneri 2a str. 301
cauuucaucggcuagua

SEQ ID NO: 1988942 - RNA, 19 nt, Shigella flexneri 2a str. 301
cauuucauauucaaaaucc

SEQ ID NO: 1988943 - RNA, 18 nt, Shigella flexneri 2a str. 301
cauuuccccaaucuucuc

SEQ ID NO: 1988944 - RNA, 18 nt, Shigella flexneri 2a str. 301
caucucucguugccuugc

SEQ ID NO: 1988945 - RNA, 13 nt, Shigella flexneri 2a str. 301
caucucuucccau

SEQ ID NO: 1988946 - RNA, 19 nt, Shigella flexneri 2a str. 301
caucucuuccggcaccaca

SEQ ID NO: 1988947 - RNA, 22 nt, Shigella flexneri 2a str. 301
caucucuucuucaagccaggcu

SEQ ID NO: 1988948 - RNA, 17 nt, Shigella flexneri 2a str. 301
caucucuucacgcuuug

SEQ ID NO: 1988949 - RNA, 18 nt, Shigella flexneri 2a str. 301
caugaacaaagcgcaccu

SEQ ID NO: 1988950 - RNA, 24 nt, Shigella flexneri 2a str. 301
caugaagauggucuguaccaccag

SEQ ID NO: 1988951 - RNA, 22 nt, Shigella flexneri 2a str. 301
caugaagcugacaggcgcugau

SEQ ID NO: 1988952 - RNA, 17 nt, Shigella flexneri 2a str. 301
caugaaucagcaaggaa

SEQ ID NO: 1988953 - RNA, 13 nt, Shigella flexneri 2a str. 301
caugaauaucaag

SEQ ID NO: 1988954 - RNA, 15 nt, Shigella flexneri 2a str. 301
caugaauauauaauu

SEQ ID NO: 1988955 - RNA, 17 nt, Shigella flexneri 2a str. 301
caugacugcggcguggg

SEQ ID NO: 1988956 - RNA, 15 nt, Shigella flexneri 2a str. 301
caugacuuugaucug

SEQ ID NO: 1988957 - RNA, 19 nt, Shigella flexneri 2a str. 301
caugacuuuguaggccgga

SEQ ID NO: 1988958 - RNA, 16 nt, Shigella flexneri 2a str. 301
caugacguccuguacu

SEQ ID NO: 1988959 - RNA, 19 nt, Shigella flexneri 2a str. 301
caugacgggcaagaauauc

SEQ ID NO: 1988960 - RNA, 18 nt, Shigella flexneri 2a str. 301
caugaccgcuccgccauc

SEQ ID NO: 1988961 - RNA, 15 nt, Shigella flexneri 2a str. 301
caugaccgugaucgu

SEQ ID NO: 1988962 - RNA, 18 nt, Shigella flexneri 2a str. 301
caugacgaucaacccagu

SEQ ID NO: 1988963 - RNA, 20 nt, Shigella flexneri 2a str. 301
caugacgaucaacccaguug

SEQ ID NO: 1988964 - RNA, 13 nt, Shigella flexneri 2a str. 301
caugacgccacca

SEQ ID NO: 1988965 - RNA, 16 nt, Shigella flexneri 2a str. 301
caugacaaaaaagcca

SEQ ID NO: 1988966 - RNA, 18 nt, Shigella flexneri 2a str. 301
caugaauucgacuuucuc

SEQ ID NO: 1988967 - RNA, 23 nt, Shigella flexneri 2a str. 301
caugaccagugaggaugcggguc

SEQ ID NO: 1988968 - RNA, 13 nt, Shigella flexneri 2a str. 301
caugacagcgccc

SEQ ID NO: 1988969 - RNA, 20 nt, Shigella flexneri 2a str. 301
caugaugccggguuuacuuc

SEQ ID NO: 1988970 - RNA, 23 nt, Shigella flexneri 2a str. 301
caugaugcgcggcuccagaauau

SEQ ID NO: 1988971 - RNA, 18 nt, Shigella flexneri 2a str. 301
caugaugauaucacuggu

SEQ ID NO: 1988972 - RNA, 22 nt, Shigella flexneri 2a str. 301
caugauucggcgguaguuaagc

SEQ ID NO: 1988973 - RNA, 15 nt, Shigella flexneri 2a str. 301
caugcaggcuggcac

SEQ ID NO: 1988974 - RNA, 13 nt, Shigella flexneri 2a str. 301
caugcagcuccac

SEQ ID NO: 1988975 - RNA, 15 nt, Shigella flexneri 2a str. 301
caugcagcuccaccg

SEQ ID NO: 1988976 - RNA, 14 nt, Shigella flexneri 2a str. 301
caugcagcccagca

SEQ ID NO: 1988977 - RNA, 21 nt, Shigella flexneri 2a str. 301
caugcagcccagcaucagacu

SEQ ID NO: 1988978 - RNA, 13 nt, Shigella flexneri 2a str. 301
caugcagcauggu

SEQ ID NO: 1988979 - RNA, 14 nt, Shigella flexneri 2a str. 301
caugauuucauaac

SEQ ID NO: 1988980 - RNA, 16 nt, Shigella flexneri 2a str. 301
caugcaucgguuuugc

SEQ ID NO: 1988981 - RNA, 14 nt, Shigella flexneri 2a str. 301
caugccaaaaggga

SEQ ID NO: 1988982 - RNA, 21 nt, Shigella flexneri 2a str. 301
caugcaguugauuacacaaau

SEQ ID NO: 1988983 - RNA, 16 nt, Shigella flexneri 2a str. 301
caugcaguaccagaua

SEQ ID NO: 1988984 - RNA, 16 nt, Shigella flexneri 2a str. 301
caugaguuccacuggu

SEQ ID NO: 1988985 - RNA, 16 nt, Shigella flexneri 2a str. 301
caugaguaaaauaaca

SEQ ID NO: 1988986 - RNA, 22 nt, Shigella flexneri 2a str. 301
caugagagaaaaucacacuacc

SEQ ID NO: 1988987 - RNA, 16 nt, Shigella flexneri 2a str. 301
caugagccgccgccac

SEQ ID NO: 1988988 - RNA, 14 nt, Shigella flexneri 2a str. 301
caugauccuggauu

SEQ ID NO: 1988989 - RNA, 14 nt, Shigella flexneri 2a str. 301
caugaucuuuuuug

SEQ ID NO: 1988990 - RNA, 18 nt, Shigella flexneri 2a str. 301
caugauaccgauuacuca

SEQ ID NO: 1988991 - RNA, 21 nt, Shigella flexneri 2a str. 301
caugauagcucgggcgauaau

SEQ ID NO: 1988992 - RNA, 13 nt, Shigella flexneri 2a str. 301
caugauaugccug

SEQ ID NO: 1988993 - RNA, 15 nt, Shigella flexneri 2a str. 301
caugccauccgcauc

SEQ ID NO: 1988994 - RNA, 12 nt, Shigella flexneri 2a str. 301
caugccauuucc

SEQ ID NO: 1988995 - RNA, 17 nt, Shigella flexneri 2a str. 301
caugccaaucagcagaa

SEQ ID NO: 1988996 - RNA, 15 nt, Shigella flexneri 2a str. 301
caugccaaaucaaug

SEQ ID NO: 1988997 - RNA, 22 nt, Shigella flexneri 2a str. 301
caugccaacgcggaugaggcgu

SEQ ID NO: 1988998 - RNA, 18 nt, Shigella flexneri 2a str. 301
caugccagugaugggcag

SEQ ID NO: 1988999 - RNA, 13 nt, Shigella flexneri 2a str. 301
caugcuauuccuu

SEQ ID NO: 1989000 - RNA, 23 nt, Shigella flexneri 2a str. 301
caugccgggcaaaagucaccagu

SEQ ID NO: 1989001 - RNA, 17 nt, Shigella flexneri 2a str. 301
caugccggccagcgcca

SEQ ID NO: 1989002 - RNA, 22 nt, Shigella flexneri 2a str. 301
caugcugucggcugccagccau

SEQ ID NO: 1989003 - RNA, 19 nt, Shigella flexneri 2a str. 301
caugcuggaaccacagcgc

SEQ ID NO: 1989004 - RNA, 22 nt, Shigella flexneri 2a str. 301
caugcugccggaaaucaucauu

SEQ ID NO: 1989005 - RNA, 14 nt, Shigella flexneri 2a str. 301
caugcucacagagu

SEQ ID NO: 1989006 - RNA, 20 nt, Shigella flexneri 2a str. 301
caugcuuaccaaaaugcugc

SEQ ID NO: 1989007 - RNA, 14 nt, Shigella flexneri 2a str. 301
caugcuggcugcgc

SEQ ID NO: 1989008 - RNA, 12 nt, Shigella flexneri 2a str. 301
caugcuucugca

SEQ ID NO: 1989009 - RNA, 13 nt, Shigella flexneri 2a str. 301
cauggcauuuucu

SEQ ID NO: 1989010 - RNA, 17 nt, Shigella flexneri 2a str. 301
cauggcgcgacauggcg

SEQ ID NO: 1989011 - RNA, 16 nt, Shigella flexneri 2a str. 301
cauggcgcagcgauuc

SEQ ID NO: 1989012 - RNA, 16 nt, Shigella flexneri 2a str. 301
cauggcgaauggcacg

SEQ ID NO: 1989013 - RNA, 14 nt, Shigella flexneri 2a str. 301
cauggccuguguua

SEQ ID NO: 1989014 - RNA, 20 nt, Shigella flexneri 2a str. 301
caugucgguuguacaaaaaa

SEQ ID NO: 1989015 - RNA, 17 nt, Shigella flexneri 2a str. 301
cauguccuucuucugcc

SEQ ID NO: 1989016 - RNA, 12 nt, Shigella flexneri 2a str. 301
cauguccagcuu

SEQ ID NO: 1989017 - RNA, 11 nt, Shigella flexneri 2a str. 301
caugucaucaa

SEQ ID NO: 1989018 - RNA, 17 nt, Shigella flexneri 2a str. 301
cauguagccgcuuuuuc

SEQ ID NO: 1989019 - RNA, 20 nt, Shigella flexneri 2a str. 301
cauguagccgcuuuuucugc

SEQ ID NO: 1989020 - RNA, 16 nt, Shigella flexneri 2a str. 301
cauggcucaccagcag

SEQ ID NO: 1989021 - RNA, 21 nt, Shigella flexneri 2a str. 301
caugguuuggaucuguugcug

SEQ ID NO: 1989022 - RNA, 22 nt, Shigella flexneri 2a str. 301
cauguaaaaggcgcuaaaaaua

SEQ ID NO: 1989023 - RNA, 12 nt, Shigella flexneri 2a str. 301
cauggcguccgu

SEQ ID NO: 1989024 - RNA, 19 nt, Shigella flexneri 2a str. 301
cauguaacgaugcaugaca

SEQ ID NO: 1989025 - RNA, 15 nt, Shigella flexneri 2a str. 301
cagcgugaacugggc

SEQ ID NO: 1989026 - RNA, 14 nt, Shigella flexneri 2a str. 301
cagcgugacuggca

SEQ ID NO: 1989027 - RNA, 18 nt, Shigella flexneri 2a str. 301
cagcgugcucucaaauau

SEQ ID NO: 1989028 - RNA, 17 nt, Shigella flexneri 2a str. 301
cagcguggcaucgggca

SEQ ID NO: 1989029 - RNA, 17 nt, Shigella flexneri 2a str. 301
cagcgucgcacccggca

SEQ ID NO: 1989030 - RNA, 18 nt, Shigella flexneri 2a str. 301
cagcgucgcaucaggcau

SEQ ID NO: 1989031 - RNA, 22 nt, Shigella flexneri 2a str. 301
cagcgucgcauccgacauugaa

SEQ ID NO: 1989032 - RNA, 15 nt, Shigella flexneri 2a str. 301
cagcgucgcaucugg

SEQ ID NO: 1989033 - RNA, 17 nt, Shigella flexneri 2a str. 301
cagcgucgcaucuggca

SEQ ID NO: 1989034 - RNA, 20 nt, Shigella flexneri 2a str. 301
cagcguuuccagcaccaguu

SEQ ID NO: 1989035 - RNA, 14 nt, Shigella flexneri 2a str. 301
cagcguuccccaga

SEQ ID NO: 1989036 - RNA, 19 nt, Shigella flexneri 2a str. 301
cagcguuaucccaucccac

SEQ ID NO: 1989037 - RNA, 22 nt, Shigella flexneri 2a str. 301
cagcguucauaaauacagagca

SEQ ID NO: 1989038 - RNA, 16 nt, Shigella flexneri 2a str. 301
cagcguguugaggaag

SEQ ID NO: 1989039 - RNA, 15 nt, Shigella flexneri 2a str. 301
cagcguguugaggaa

SEQ ID NO: 1989040 - RNA, 15 nt, Shigella flexneri 2a str. 301
cagcguuccccagaa

SEQ ID NO: 1989041 - RNA, 18 nt, Shigella flexneri 2a str. 301
cagcguucgccaaaccca

SEQ ID NO: 1989042 - RNA, 22 nt, Shigella flexneri 2a str. 301
cagcguugcccccugaagcagu

SEQ ID NO: 1989043 - RNA, 15 nt, Shigella flexneri 2a str. 301
cagcguugaaugcau

SEQ ID NO: 1989044 - RNA, 16 nt, Shigella flexneri 2a str. 301
cagcguagucggcaga

SEQ ID NO: 1989045 - RNA, 17 nt, Shigella flexneri 2a str. 301
cagcguacaauagccac

SEQ ID NO: 1989046 - RNA, 15 nt, Shigella flexneri 2a str. 301
cagcgguuuugccag

SEQ ID NO: 1989047 - RNA, 21 nt, Shigella flexneri 2a str. 301
cagcgguuuuugcgccauuca

SEQ ID NO: 1989048 - RNA, 18 nt, Shigella flexneri 2a str. 301
cagcgguuucacaggaaa

SEQ ID NO: 1989049 - RNA, 23 nt, Shigella flexneri 2a str. 301
cagcguaaaggcggcagaacaga

SEQ ID NO: 1989050 - RNA, 22 nt, Shigella flexneri 2a str. 301
cagcguaaaggucaauuccuuc

SEQ ID NO: 1989051 - RNA, 21 nt, Shigella flexneri 2a str. 301
cagcguaaauccugacgcugg

SEQ ID NO: 1989052 - RNA, 18 nt, Shigella flexneri 2a str. 301
cagcguaaaggcggcaga

SEQ ID NO: 1989053 - RNA, 12 nt, Shigella flexneri 2a str. 301
cagcgucaucaa

SEQ ID NO: 1989054 - RNA, 18 nt, Shigella flexneri 2a str. 301
cagcgucacccagacaaa

SEQ ID NO: 1989055 - RNA, 17 nt, Shigella flexneri 2a str. 301
cagcgucagcauaaaaa

SEQ ID NO: 1989056 - RNA, 14 nt, Shigella flexneri 2a str. 301
cagcgucacaucag

SEQ ID NO: 1989057 - RNA, 14 nt, Shigella flexneri 2a str. 301
cagcgucagaaaca

SEQ ID NO: 1989058 - RNA, 16 nt, Shigella flexneri 2a str. 301
cagcguccagcccucc

SEQ ID NO: 1989059 - RNA, 22 nt, Shigella flexneri 2a str. 301
cagcggugcgaauugccaccau

SEQ ID NO: 1989060 - RNA, 12 nt, Shigella flexneri 2a str. 301
cagcggguuaau

SEQ ID NO: 1989061 - RNA, 18 nt, Shigella flexneri 2a str. 301
cagcgguaaagcggcgcu

SEQ ID NO: 1989062 - RNA, 17 nt, Shigella flexneri 2a str. 301
cagcgggccggagggca

SEQ ID NO: 1989063 - RNA, 16 nt, Shigella flexneri 2a str. 301
cacugaugacaggcua

SEQ ID NO: 1989064 - RNA, 15 nt, Shigella flexneri 2a str. 301
cacugagucagccca

SEQ ID NO: 1989065 - RNA, 20 nt, Shigella flexneri 2a str. 301
cagcugacaaucgcugcggc

SEQ ID NO: 1989066 - RNA, 14 nt, Shigella flexneri 2a str. 301
cagcugacuuccag

SEQ ID NO: 1989067 - RNA, 17 nt, Shigella flexneri 2a str. 301
cagcugauccuucuguu

SEQ ID NO: 1989068 - RNA, 12 nt, Shigella flexneri 2a str. 301
cagcucuuccuu

SEQ ID NO: 1989069 - RNA, 20 nt, Shigella flexneri 2a str. 301
cagcucuuuuccagccauca

SEQ ID NO: 1989070 - RNA, 22 nt, Shigella flexneri 2a str. 301
cagcucugcugucaccgaagcg

SEQ ID NO: 1989071 - RNA, 17 nt, Shigella flexneri 2a str. 301
cagcugccgacgccagu

SEQ ID NO: 1989072 - RNA, 15 nt, Shigella flexneri 2a str. 301
cagcugccgccaggc

SEQ ID NO: 1989073 - RNA, 18 nt, Shigella flexneri 2a str. 301
cagcugccgccaggcuuc

SEQ ID NO: 1989074 - RNA, 16 nt, Shigella flexneri 2a str. 301
cagcugcgcguuaucu

SEQ ID NO: 1989075 - RNA, 23 nt, Shigella flexneri 2a str. 301
cagcucauauuccugcauugcuu

SEQ ID NO: 1989076 - RNA, 18 nt, Shigella flexneri 2a str. 301
cagcuccucuuucaucuc

SEQ ID NO: 1989077 - RNA, 19 nt, Shigella flexneri 2a str. 301
cagcuucucgugaaacuca

SEQ ID NO: 1989078 - RNA, 21 nt, Shigella flexneri 2a str. 301
cagcuucgcuucccaacgcag

SEQ ID NO: 1989079 - RNA, 13 nt, Shigella flexneri 2a str. 301
cagcugcucccag

SEQ ID NO: 1989080 - RNA, 20 nt, Shigella flexneri 2a str. 301
cagcugcucauagcggcugc

SEQ ID NO: 1989081 - RNA, 20 nt, Shigella flexneri 2a str. 301
cagcugcgugccuaauuccg

SEQ ID NO: 1989082 - RNA, 12 nt, Shigella flexneri 2a str. 301
cagcugcgugcc

SEQ ID NO: 1989083 - RNA, 18 nt, Shigella flexneri 2a str. 301
cagcuuucccuucaggcg

SEQ ID NO: 1989084 - RNA, 19 nt, Shigella flexneri 2a str. 301
cagcuuucagcagcggcuc

SEQ ID NO: 1989085 - RNA, 13 nt, Shigella flexneri 2a str. 301
cagcuuuggugaa

SEQ ID NO: 1989086 - RNA, 13 nt, Shigella flexneri 2a str. 301
cagcuuuuacagc

SEQ ID NO: 1989087 - RNA, 21 nt, Shigella flexneri 2a str. 301
cagcuuugcccgaucaucaaa

SEQ ID NO: 1989088 - RNA, 20 nt, Shigella flexneri 2a str. 301
cagcuuugcccgaucaucaa

SEQ ID NO: 1989089 - RNA, 23 nt, Shigella flexneri 2a str. 301
cagcuuuucgauaacccggcggc

SEQ ID NO: 1989090 - RNA, 21 nt, Shigella flexneri 2a str. 301
caggaaaaucagcaucaaccc

SEQ ID NO: 1989091 - RNA, 21 nt, Shigella flexneri 2a str. 301
caggaaacccaacgcaaagag

SEQ ID NO: 1989092 - RNA, 22 nt, Shigella flexneri 2a str. 301
caggccaauagugcggcauggu

SEQ ID NO: 1989093 - RNA, 20 nt, Shigella flexneri 2a str. 301
caggccacgaaucagcaccg

SEQ ID NO: 1989094 - RNA, 18 nt, Shigella flexneri 2a str. 301
caggcaucacgucggcgu

SEQ ID NO: 1989095 - RNA, 14 nt, Shigella flexneri 2a str. 301
caggcaucacuuua

SEQ ID NO: 1989096 - RNA, 18 nt, Shigella flexneri 2a str. 301
caggcauuugcuccagac

SEQ ID NO: 1989097 - RNA, 16 nt, Shigella flexneri 2a str. 301
caggccaucagcagcg

SEQ ID NO: 1989098 - RNA, 15 nt, Shigella flexneri 2a str. 301
caggcccgcauuaaa

SEQ ID NO: 1989099 - RNA, 14 nt, Shigella flexneri 2a str. 301
caggcccgcauaga

SEQ ID NO: 1989100 - RNA, 15 nt, Shigella flexneri 2a str. 301
caggcaaaccaguac

SEQ ID NO: 1989101 - RNA, 14 nt, Shigella flexneri 2a str. 301
caggcaaaccagua

SEQ ID NO: 1989102 - RNA, 16 nt, Shigella flexneri 2a str. 301
caggcaagcauaugac

SEQ ID NO: 1989103 - RNA, 21 nt, Shigella flexneri 2a str. 301
caggcaagccgcuaacagcag

SEQ ID NO: 1989104 - RNA, 18 nt, Shigella flexneri 2a str. 301
caggcaacuucaagguca

SEQ ID NO: 1989105 - RNA, 16 nt, Shigella flexneri 2a str. 301
caggcaacagggaaau

SEQ ID NO: 1989106 - RNA, 16 nt, Shigella flexneri 2a str. 301
caggaugggcaacgcg

SEQ ID NO: 1989107 - RNA, 16 nt, Shigella flexneri 2a str. 301
caggaugggcauauuu

SEQ ID NO: 1989108 - RNA, 15 nt, Shigella flexneri 2a str. 301
caggcacaccgccgc

SEQ ID NO: 1989109 - RNA, 17 nt, Shigella flexneri 2a str. 301
caggcacaccgccgccg

SEQ ID NO: 1989110 - RNA, 20 nt, Shigella flexneri 2a str. 301
caggcaaucccacagccguc

SEQ ID NO: 1989111 - RNA, 20 nt, Shigella flexneri 2a str. 301
caggcaaguagcgccauacu

SEQ ID NO: 1989112 - RNA, 14 nt, Shigella flexneri 2a str. 301
caggcaccagcccc

SEQ ID NO: 1989113 - RNA, 12 nt, Shigella flexneri 2a str. 301
caggaaauaaau

SEQ ID NO: 1989114 - RNA, 15 nt, Shigella flexneri 2a str. 301
caggaaauaaauaau

SEQ ID NO: 1989115 - RNA, 17 nt, Shigella flexneri 2a str. 301
caggaaaucgucgaggg

SEQ ID NO: 1989116 - RNA, 22 nt, Shigella flexneri 2a str. 301
caggaaccccauaagccugaua

SEQ ID NO: 1989117 - RNA, 16 nt, Shigella flexneri 2a str. 301
caggauauuuauauuu

SEQ ID NO: 1989118 - RNA, 22 nt, Shigella flexneri 2a str. 301
caggauaucguggcacguacca

SEQ ID NO: 1989119 - RNA, 18 nt, Shigella flexneri 2a str. 301
caggaugauuccggcaaa

SEQ ID NO: 1989120 - RNA, 18 nt, Shigella flexneri 2a str. 301
caggaugcagaaaccaaa

SEQ ID NO: 1989121 - RNA, 22 nt, Shigella flexneri 2a str. 301
caggcuugcugaugcacgcaga

SEQ ID NO: 1989122 - RNA, 17 nt, Shigella flexneri 2a str. 301
caggcuuuuaacaccug

SEQ ID NO: 1989123 - RNA, 17 nt, Shigella flexneri 2a str. 301
cagggagucuugcugga

SEQ ID NO: 1989124 - RNA, 16 nt, Shigella flexneri 2a str. 301
cagggauaaagccccc

SEQ ID NO: 1989125 - RNA, 20 nt, Shigella flexneri 2a str. 301
cagggagucuugcuggaugc

SEQ ID NO: 1989126 - RNA, 13 nt, Shigella flexneri 2a str. 301
cagggaaaaauug

SEQ ID NO: 1989127 - RNA, 18 nt, Shigella flexneri 2a str. 301
cagggaaaaaagccccgu

SEQ ID NO: 1989128 - RNA, 20 nt, Shigella flexneri 2a str. 301
caggcuguuaccccugcggc

SEQ ID NO: 1989129 - RNA, 22 nt, Shigella flexneri 2a str. 301
caggcuguuaaggaaauccugc

SEQ ID NO: 1989130 - RNA, 12 nt, Shigella flexneri 2a str. 301
caggcugguggu

SEQ ID NO: 1989131 - RNA, 14 nt, Shigella flexneri 2a str. 301
caggcuucaacaca

SEQ ID NO: 1989132 - RNA, 19 nt, Shigella flexneri 2a str. 301
caggcuuauggcucgccau

SEQ ID NO: 1989133 - RNA, 14 nt, Shigella flexneri 2a str. 301
caggcucugguguu

SEQ ID NO: 1989134 - RNA, 18 nt, Shigella flexneri 2a str. 301
caggcucucauuuuucag

SEQ ID NO: 1989135 - RNA, 21 nt, Shigella flexneri 2a str. 301
caggcucgccgccgcuggcgu

SEQ ID NO: 1989136 - RNA, 16 nt, Shigella flexneri 2a str. 301
caggcucgccgccgcu

SEQ ID NO: 1989137 - RNA, 17 nt, Shigella flexneri 2a str. 301
caggcugcgaguccugu

SEQ ID NO: 1989138 - RNA, 12 nt, Shigella flexneri 2a str. 301
caggcugaugga

SEQ ID NO: 1989139 - RNA, 18 nt, Shigella flexneri 2a str. 301
caggcugcaaagucuggg

SEQ ID NO: 1989140 - RNA, 22 nt, Shigella flexneri 2a str. 301
caggcgcuugucgucccaggca

SEQ ID NO: 1989141 - RNA, 13 nt, Shigella flexneri 2a str. 301
caggcgcugaaag

SEQ ID NO: 1989142 - RNA, 23 nt, Shigella flexneri 2a str. 301
caggcgaucucguuuuugucucu

SEQ ID NO: 1989143 - RNA, 18 nt, Shigella flexneri 2a str. 301
caggcgagucgagauccc

SEQ ID NO: 1989144 - RNA, 20 nt, Shigella flexneri 2a str. 301
caggcgaccguuuucaccag

SEQ ID NO: 1989145 - RNA, 19 nt, Shigella flexneri 2a str. 301
caggccugauaagcgcagc

SEQ ID NO: 1989146 - RNA, 16 nt, Shigella flexneri 2a str. 301
caggccuggguaaaaa

SEQ ID NO: 1989147 - RNA, 13 nt, Shigella flexneri 2a str. 301
caggcccugcugu

SEQ ID NO: 1989148 - RNA, 18 nt, Shigella flexneri 2a str. 301
caggccuacgugaggcau

SEQ ID NO: 1989149 - RNA, 19 nt, Shigella flexneri 2a str. 301
caggccuauugacgcuguu

SEQ ID NO: 1989150 - RNA, 19 nt, Shigella flexneri 2a str. 301
caguuccacuucugcacgg

SEQ ID NO: 1989151 - RNA, 14 nt, Shigella flexneri 2a str. 301
caguucccccugcc

SEQ ID NO: 1989152 - RNA, 18 nt, Shigella flexneri 2a str. 301
caguucccagggcuuucg

SEQ ID NO: 1989153 - RNA, 13 nt, Shigella flexneri 2a str. 301
caguuccagcagc

SEQ ID NO: 1989154 - RNA, 23 nt, Shigella flexneri 2a str. 301
caguuccggcaucgacaguuuca

SEQ ID NO: 1989155 - RNA, 22 nt, Shigella flexneri 2a str. 301
caguuccggcaucgacaguuuc

SEQ ID NO: 1989156 - RNA, 12 nt, Shigella flexneri 2a str. 301
caguuccgggau

SEQ ID NO: 1989157 - RNA, 21 nt, Shigella flexneri 2a str. 301
caguuccuuaacuucaucagc

SEQ ID NO: 1989158 - RNA, 19 nt, Shigella flexneri 2a str. 301
caguuccgcaaagcccauc

SEQ ID NO: 1989159 - RNA, 15 nt, Shigella flexneri 2a str. 301
caguuccgccagcuu

SEQ ID NO: 1989160 - RNA, 15 nt, Shigella flexneri 2a str. 301
caguucggaaacagu

SEQ ID NO: 1989161 - RNA, 16 nt, Shigella flexneri 2a str. 301
caguucggcaucaucg

SEQ ID NO: 1989162 - RNA, 14 nt, Shigella flexneri 2a str. 301
caguucgauuuccc

SEQ ID NO: 1989163 - RNA, 16 nt, Shigella flexneri 2a str. 301
caguucgauauccagu

SEQ ID NO: 1989164 - RNA, 23 nt, Shigella flexneri 2a str. 301
caguucgaucucuucgccugccu

SEQ ID NO: 1989165 - RNA, 22 nt, Shigella flexneri 2a str. 301
caguucgcgauccugauacaga

SEQ ID NO: 1989166 - RNA, 15 nt, Shigella flexneri 2a str. 301
caguuaaguuaauuc

SEQ ID NO: 1989167 - RNA, 12 nt, Shigella flexneri 2a str. 301
caguuauaaaau

SEQ ID NO: 1989168 - RNA, 18 nt, Shigella flexneri 2a str. 301
caguucaccgccgaggcg

SEQ ID NO: 1989169 - RNA, 21 nt, Shigella flexneri 2a str. 301
caguucaaauucauugucggg

SEQ ID NO: 1989170 - RNA, 21 nt, Shigella flexneri 2a str. 301
caguucaaagcguggugauac

SEQ ID NO: 1989171 - RNA, 23 nt, Shigella flexneri 2a str. 301
caguucaagugcuacccacuucc

SEQ ID NO: 1989172 - RNA, 16 nt, Shigella flexneri 2a str. 301
caguucaacgcggcgc

SEQ ID NO: 1989173 - RNA, 18 nt, Shigella flexneri 2a str. 301
caguucagaagcugaagc

SEQ ID NO: 1989174 - RNA, 20 nt, Shigella flexneri 2a str. 301
caguucagaaggacgggauu

SEQ ID NO: 1989175 - RNA, 13 nt, Shigella flexneri 2a str. 301
caguucagaaagc

SEQ ID NO: 1989176 - RNA, 12 nt, Shigella flexneri 2a str. 301
caguucagaagc

SEQ ID NO: 1989177 - RNA, 17 nt, Shigella flexneri 2a str. 301
caguucauuugaacugg

SEQ ID NO: 1989178 - RNA, 21 nt, Shigella flexneri 2a str. 301
cagugccugcauaaacgccgu

SEQ ID NO: 1989179 - RNA, 19 nt, Shigella flexneri 2a str. 301
cagugccgaaaugucuucc

SEQ ID NO: 1989180 - RNA, 19 nt, Shigella flexneri 2a str. 301
cagugcccggcccggagga

SEQ ID NO: 1989181 - RNA, 17 nt, Shigella flexneri 2a str. 301
cagugccgguggaaggg

SEQ ID NO: 1989182 - RNA, 16 nt, Shigella flexneri 2a str. 301
cagugccguuccagcc

SEQ ID NO: 1989183 - RNA, 18 nt, Shigella flexneri 2a str. 301
cagugccucacgaucaca

SEQ ID NO: 1989184 - RNA, 18 nt, Shigella flexneri 2a str. 301
cagugccgcccaccacuc

SEQ ID NO: 1989185 - RNA, 14 nt, Shigella flexneri 2a str. 301
cagugcguaagcgc

SEQ ID NO: 1989186 - RNA, 20 nt, Shigella flexneri 2a str. 301
cagugcgucgcugcucuuca

SEQ ID NO: 1989187 - RNA, 14 nt, Shigella flexneri 2a str. 301
caguggcuccagcg

SEQ ID NO: 1989188 - RNA, 15 nt, Shigella flexneri 2a str. 301
caguggcuccagcgc

SEQ ID NO: 1989189 - RNA, 16 nt, Shigella flexneri 2a str. 301
cagugggccagaaaaa

SEQ ID NO: 1989190 - RNA, 14 nt, Shigella flexneri 2a str. 301
cagugggcgcugcu

SEQ ID NO: 1989191 - RNA, 23 nt, Shigella flexneri 2a str. 301
caguggguaaugcugugaagaug

SEQ ID NO: 1989192 - RNA, 23 nt, Shigella flexneri 2a str. 301
caguggguuaugaaacuccaccg

SEQ ID NO: 1989193 - RNA, 14 nt, Shigella flexneri 2a str. 301
cagugccaguucuu

SEQ ID NO: 1989194 - RNA, 19 nt, Shigella flexneri 2a str. 301
cagugauuucuucauuaaa

SEQ ID NO: 1989195 - RNA, 15 nt, Shigella flexneri 2a str. 301
cagugcaaaugccag

SEQ ID NO: 1989196 - RNA, 21 nt, Shigella flexneri 2a str. 301
caguccgcucgccgcagagau

SEQ ID NO: 1989197 - RNA, 18 nt, Shigella flexneri 2a str. 301
cauaaggaaacuccagcc

SEQ ID NO: 1989198 - RNA, 23 nt, Shigella flexneri 2a str. 301
cauaaggaaacucucaaaacaac

SEQ ID NO: 1989199 - RNA, 19 nt, Shigella flexneri 2a str. 301
cauaagguccuccagcucc

SEQ ID NO: 1989200 - RNA, 17 nt, Shigella flexneri 2a str. 301
cauaagcaucccuuuaa

SEQ ID NO: 1989201 - RNA, 18 nt, Shigella flexneri 2a str. 301
cauaagcaucccuuuaau

SEQ ID NO: 1989202 - RNA, 19 nt, Shigella flexneri 2a str. 301
cauaagcccagaacaaaua

SEQ ID NO: 1989203 - RNA, 13 nt, Shigella flexneri 2a str. 301
cauaagagaugga

SEQ ID NO: 1989204 - RNA, 21 nt, Shigella flexneri 2a str. 301
cauaagagauggaaugagcau

SEQ ID NO: 1989205 - RNA, 17 nt, Shigella flexneri 2a str. 301
cauaacuggucaucaaa

SEQ ID NO: 1989206 - RNA, 22 nt, Shigella flexneri 2a str. 301
cauaauaagcgccauaucggca

SEQ ID NO: 1989207 - RNA, 14 nt, Shigella flexneri 2a str. 301
cauaaggugggagg

SEQ ID NO: 1989208 - RNA, 12 nt, Shigella flexneri 2a str. 301
cauaaucaauac

SEQ ID NO: 1989209 - RNA, 20 nt, Shigella flexneri 2a str. 301
cauaaucaccaucagcagca

SEQ ID NO: 1989210 - RNA, 15 nt, Shigella flexneri 2a str. 301
cauaauaugaccuga

SEQ ID NO: 1989211 - RNA, 19 nt, Shigella flexneri 2a str. 301
cauaauauauaaagauuca

SEQ ID NO: 1989212 - RNA, 16 nt, Shigella flexneri 2a str. 301
cauaauccacuuucuu

SEQ ID NO: 1989213 - RNA, 14 nt, Shigella flexneri 2a str. 301
cauaaugcaaaaug

SEQ ID NO: 1989214 - RNA, 13 nt, Shigella flexneri 2a str. 301
cauaaugcagcca

SEQ ID NO: 1989215 - RNA, 16 nt, Shigella flexneri 2a str. 301
cauaaugcccagcguu

SEQ ID NO: 1989216 - RNA, 15 nt, Shigella flexneri 2a str. 301
cauaaugcugacaaa

SEQ ID NO: 1989217 - RNA, 21 nt, Shigella flexneri 2a str. 301
caguuuuugcaaucagauaaa

SEQ ID NO: 1989218 - RNA, 16 nt, Shigella flexneri 2a str. 301
caguuuuucuuuuuca

SEQ ID NO: 1989219 - RNA, 21 nt, Shigella flexneri 2a str. 301
caguuuucauauaccgcauca

SEQ ID NO: 1989220 - RNA, 14 nt, Shigella flexneri 2a str. 301
caguuuugucuucg

SEQ ID NO: 1989221 - RNA, 22 nt, Shigella flexneri 2a str. 301
caguuuugucuucggccauuga

SEQ ID NO: 1989222 - RNA, 17 nt, Shigella flexneri 2a str. 301
cauaaagcgguuuucaa

SEQ ID NO: 1989223 - RNA, 14 nt, Shigella flexneri 2a str. 301
cauaaaaucacagg

SEQ ID NO: 1989224 - RNA, 21 nt, Shigella flexneri 2a str. 301
caguuucuuaccuacuugcuc

SEQ ID NO: 1989225 - RNA, 18 nt, Shigella flexneri 2a str. 301
caguuucugauacugcuc

SEQ ID NO: 1989226 - RNA, 14 nt, Shigella flexneri 2a str. 301
caguuucugcagcu

SEQ ID NO: 1989227 - RNA, 14 nt, Shigella flexneri 2a str. 301
caguuucgccaggg

SEQ ID NO: 1989228 - RNA, 18 nt, Shigella flexneri 2a str. 301
caguuucggaccagccgc

SEQ ID NO: 1989229 - RNA, 16 nt, Shigella flexneri 2a str. 301
caguuuccgcgccggc

SEQ ID NO: 1989230 - RNA, 17 nt, Shigella flexneri 2a str. 301
caguuugcucaaaucca

SEQ ID NO: 1989231 - RNA, 20 nt, Shigella flexneri 2a str. 301
caguuugcgcgugcugggau

SEQ ID NO: 1989232 - RNA, 12 nt, Shigella flexneri 2a str. 301
caguuugccaug

SEQ ID NO: 1989233 - RNA, 16 nt, Shigella flexneri 2a str. 301
caguuugucuucaaug

SEQ ID NO: 1989234 - RNA, 22 nt, Shigella flexneri 2a str. 301
caguucguuuuacgcacuucuu

SEQ ID NO: 1989235 - RNA, 16 nt, Shigella flexneri 2a str. 301
caguucgguugggauc

SEQ ID NO: 1989236 - RNA, 22 nt, Shigella flexneri 2a str. 301
caguuucaugauauguuuuaaa

SEQ ID NO: 1989237 - RNA, 13 nt, Shigella flexneri 2a str. 301
caguuucauagug

SEQ ID NO: 1989238 - RNA, 17 nt, Shigella flexneri 2a str. 301
caguuucagccccauca

SEQ ID NO: 1989239 - RNA, 14 nt, Shigella flexneri 2a str. 301
caguuuauuuucug

SEQ ID NO: 1989240 - RNA, 15 nt, Shigella flexneri 2a str. 301
caguuucaccugcug

SEQ ID NO: 1989241 - RNA, 13 nt, Shigella flexneri 2a str. 301
caguuuauacagc

SEQ ID NO: 1989242 - RNA, 18 nt, Shigella flexneri 2a str. 301
cagucaugcgagaagcaa

SEQ ID NO: 1989243 - RNA, 19 nt, Shigella flexneri 2a str. 301
caguauuaccggcagagug

SEQ ID NO: 1989244 - RNA, 18 nt, Shigella flexneri 2a str. 301
caguccagacuccgagaa

SEQ ID NO: 1989245 - RNA, 19 nt, Shigella flexneri 2a str. 301
caguccaccugaccugcga

SEQ ID NO: 1989246 - RNA, 16 nt, Shigella flexneri 2a str. 301
caguccaccugaccug

SEQ ID NO: 1989247 - RNA, 16 nt, Shigella flexneri 2a str. 301
caguccacgguugguu

SEQ ID NO: 1989248 - RNA, 12 nt, Shigella flexneri 2a str. 301
caguccaucggc

SEQ ID NO: 1989249 - RNA, 23 nt, Shigella flexneri 2a str. 301
caguccccacaucacuccaucca

SEQ ID NO: 1989250 - RNA, 14 nt, Shigella flexneri 2a str. 301
caguccccacgcca

SEQ ID NO: 1989251 - RNA, 14 nt, Shigella flexneri 2a str. 301
cagucccaguucau

SEQ ID NO: 1989252 - RNA, 14 nt, Shigella flexneri 2a str. 301
cagucccaggcaga

SEQ ID NO: 1989253 - RNA, 17 nt, Shigella flexneri 2a str. 301
cagucccaggcagaagc

SEQ ID NO: 1989254 - RNA, 19 nt, Shigella flexneri 2a str. 301
caguccccucgccccuccg

SEQ ID NO: 1989255 - RNA, 15 nt, Shigella flexneri 2a str. 301
caguagccuuuaucu

SEQ ID NO: 1989256 - RNA, 20 nt, Shigella flexneri 2a str. 301
caguagcgcaaucaccacca

SEQ ID NO: 1989257 - RNA, 17 nt, Shigella flexneri 2a str. 301
caguagcgccucuucca

SEQ ID NO: 1989258 - RNA, 20 nt, Shigella flexneri 2a str. 301
caguagcuauaaaccugcug

SEQ ID NO: 1989259 - RNA, 15 nt, Shigella flexneri 2a str. 301
caguaucgauuuucc

SEQ ID NO: 1989260 - RNA, 21 nt, Shigella flexneri 2a str. 301
caguagggugauuucaccugc

SEQ ID NO: 1989261 - RNA, 20 nt, Shigella flexneri 2a str. 301
caguacgaaauaacugaaua

SEQ ID NO: 1989262 - RNA, 20 nt, Shigella flexneri 2a str. 301
caguacgcccacgccagccu

SEQ ID NO: 1989263 - RNA, 17 nt, Shigella flexneri 2a str. 301
caguacgcgcccgccgc

SEQ ID NO: 1989264 - RNA, 20 nt, Shigella flexneri 2a str. 301
caguacgguaaagccgugcu

SEQ ID NO: 1989265 - RNA, 12 nt, Shigella flexneri 2a str. 301
caguacggcagc

SEQ ID NO: 1989266 - RNA, 21 nt, Shigella flexneri 2a str. 301
caguacggcagcaaucgacca

SEQ ID NO: 1989267 - RNA, 19 nt, Shigella flexneri 2a str. 301
cagguuccgcauaccccuu

SEQ ID NO: 1989268 - RNA, 21 nt, Shigella flexneri 2a str. 301
cagguuccgcauaccccuuca

SEQ ID NO: 1989269 - RNA, 11 nt, Shigella flexneri 2a str. 301
caggugcagcc

SEQ ID NO: 1989270 - RNA, 21 nt, Shigella flexneri 2a str. 301
caggugcagcccguaagcaaa

SEQ ID NO: 1989271 - RNA, 19 nt, Shigella flexneri 2a str. 301
cagguuaaugacccacccc

SEQ ID NO: 1989272 - RNA, 21 nt, Shigella flexneri 2a str. 301
cagguuaaugacccaccccag

SEQ ID NO: 1989273 - RNA, 12 nt, Shigella flexneri 2a str. 301
cagguucaacag

SEQ ID NO: 1989274 - RNA, 15 nt, Shigella flexneri 2a str. 301
caguaaccaaaagcu

SEQ ID NO: 1989275 - RNA, 15 nt, Shigella flexneri 2a str. 301
caguaaauuuaucaa

SEQ ID NO: 1989276 - RNA, 13 nt, Shigella flexneri 2a str. 301
caguaaccgcuuu

SEQ ID NO: 1989277 - RNA, 18 nt, Shigella flexneri 2a str. 301
caguaaccgcuuuuucaa

SEQ ID NO: 1989278 - RNA, 17 nt, Shigella flexneri 2a str. 301
caguaaccggaaauaaa

SEQ ID NO: 1989279 - RNA, 19 nt, Shigella flexneri 2a str. 301
caguaaccuuucagauguu

SEQ ID NO: 1989280 - RNA, 17 nt, Shigella flexneri 2a str. 301
caguaacgccugguaac

SEQ ID NO: 1989281 - RNA, 14 nt, Shigella flexneri 2a str. 301
caguaaauccauaa

SEQ ID NO: 1989282 - RNA, 23 nt, Shigella flexneri 2a str. 301
caguaaagcgcaaaauaccagca

SEQ ID NO: 1989283 - RNA, 17 nt, Shigella flexneri 2a str. 301
cagguuucaaugcacaa

SEQ ID NO: 1989284 - RNA, 14 nt, Shigella flexneri 2a str. 301
cagguuuaccagca

SEQ ID NO: 1989285 - RNA, 23 nt, Shigella flexneri 2a str. 301
cagguuuaaacagagauuacuuu

SEQ ID NO: 1989286 - RNA, 16 nt, Shigella flexneri 2a str. 301
cagguuuaccagcagc

SEQ ID NO: 1989287 - RNA, 23 nt, Shigella flexneri 2a str. 301
cagguuguacuuuccagccacag

SEQ ID NO: 1989288 - RNA, 15 nt, Shigella flexneri 2a str. 301
caggucggcucagcc

SEQ ID NO: 1989289 - RNA, 22 nt, Shigella flexneri 2a str. 301
caggucgucuuuuacagcgcca

SEQ ID NO: 1989290 - RNA, 16 nt, Shigella flexneri 2a str. 301
caggugaaaaauaaaa

SEQ ID NO: 1989291 - RNA, 17 nt, Shigella flexneri 2a str. 301
caggugacgcgggcagc

SEQ ID NO: 1989292 - RNA, 19 nt, Shigella flexneri 2a str. 301
caggugacgcgggcagcag

SEQ ID NO: 1989293 - RNA, 21 nt, Shigella flexneri 2a str. 301
caggugaugcauagcaaccgc

SEQ ID NO: 1989294 - RNA, 17 nt, Shigella flexneri 2a str. 301
caggugauacugacagc

SEQ ID NO: 1989295 - RNA, 15 nt, Shigella flexneri 2a str. 301
cagguccccgcuucg

SEQ ID NO: 1989296 - RNA, 17 nt, Shigella flexneri 2a str. 301
caggucagcaggagcag

SEQ ID NO: 1989297 - RNA, 22 nt, Shigella flexneri 2a str. 301
caggucagauuucaaucuggcc

SEQ ID NO: 1989298 - RNA, 19 nt, Shigella flexneri 2a str. 301
cagguauucggugugcagc

SEQ ID NO: 1989299 - RNA, 20 nt, Shigella flexneri 2a str. 301
cagguauucggugugcagcg

SEQ ID NO: 1989300 - RNA, 19 nt, Shigella flexneri 2a str. 301
cagguauaccggaccaaua

SEQ ID NO: 1989301 - RNA, 19 nt, Shigella flexneri 2a str. 301
cagguaguggucaggauua

SEQ ID NO: 1989302 - RNA, 18 nt, Shigella flexneri 2a str. 301
cagguagcgcauaagcca

SEQ ID NO: 1989303 - RNA, 20 nt, Shigella flexneri 2a str. 301
cagguagcgcauaagccacc

SEQ ID NO: 1989304 - RNA, 16 nt, Shigella flexneri 2a str. 301
cagguacuuuugaaug

SEQ ID NO: 1989305 - RNA, 21 nt, Shigella flexneri 2a str. 301
cagguaaugaauggacuccac

SEQ ID NO: 1989306 - RNA, 20 nt, Shigella flexneri 2a str. 301
cagguaauuugaucaaauac

SEQ ID NO: 1989307 - RNA, 17 nt, Shigella flexneri 2a str. 301
cagggcaaaauuucccc

SEQ ID NO: 1989308 - RNA, 21 nt, Shigella flexneri 2a str. 301
cagguaagaguuucaacauca

SEQ ID NO: 1989309 - RNA, 18 nt, Shigella flexneri 2a str. 301
cagguaagaguuucaaca

SEQ ID NO: 1989310 - RNA, 18 nt, Shigella flexneri 2a str. 301
cagggaucauccacccgc

SEQ ID NO: 1989311 - RNA, 21 nt, Shigella flexneri 2a str. 301
cagggaucucuuccagugccu

SEQ ID NO: 1989312 - RNA, 20 nt, Shigella flexneri 2a str. 301
ccaaaauaacuuaaugucau

SEQ ID NO: 1989313 - RNA, 13 nt, Shigella flexneri 2a str. 301
ccaaaauaaaaau

SEQ ID NO: 1989314 - RNA, 18 nt, Shigella flexneri 2a str. 301
ccaaaauaauaaauuaac

SEQ ID NO: 1989315 - RNA, 11 nt, Shigella flexneri 2a str. 301
ccaaaaugccu

SEQ ID NO: 1989316 - RNA, 15 nt, Shigella flexneri 2a str. 301
ccaaaccucagaguu

SEQ ID NO: 1989317 - RNA, 16 nt, Shigella flexneri 2a str. 301
ccaaaccgacugccug

SEQ ID NO: 1989318 - RNA, 18 nt, Shigella flexneri 2a str. 301
ccaaacaugcaaaccauc

SEQ ID NO: 1989319 - RNA, 13 nt, Shigella flexneri 2a str. 301
ccaaaagguccuu

SEQ ID NO: 1989320 - RNA, 16 nt, Shigella flexneri 2a str. 301
ccaaaacagcgacacc

SEQ ID NO: 1989321 - RNA, 20 nt, Shigella flexneri 2a str. 301
ccaaaacagcgacaccagcc

SEQ ID NO: 1989322 - RNA, 13 nt, Shigella flexneri 2a str. 301
ccaaaacaccagc

SEQ ID NO: 1989323 - RNA, 11 nt, Shigella flexneri 2a str. 301
ccaaaaacauu

SEQ ID NO: 1989324 - RNA, 20 nt, Shigella flexneri 2a str. 301
ccaaaaagaaccugaacgcc

SEQ ID NO: 1989325 - RNA, 14 nt, Shigella flexneri 2a str. 301
cauuucgucuucau

SEQ ID NO: 1989326 - RNA, 23 nt, Shigella flexneri 2a str. 301
cauuucgugcggguaaccagcca

SEQ ID NO: 1989327 - RNA, 19 nt, Shigella flexneri 2a str. 301
cauuucucgguauuacaau

SEQ ID NO: 1989328 - RNA, 19 nt, Shigella flexneri 2a str. 301
cauuucuccagcaguucua

SEQ ID NO: 1989329 - RNA, 19 nt, Shigella flexneri 2a str. 301
cauuucugcugccuacaca

SEQ ID NO: 1989330 - RNA, 21 nt, Shigella flexneri 2a str. 301
cauuucugcgcaacuuguugu

SEQ ID NO: 1989331 - RNA, 16 nt, Shigella flexneri 2a str. 301
ccaaagcagaguugcu

SEQ ID NO: 1989332 - RNA, 19 nt, Shigella flexneri 2a str. 301
ccaaagcaccacuccucaa

SEQ ID NO: 1989333 - RNA, 18 nt, Shigella flexneri 2a str. 301
ccaaagcaccacuccuca

SEQ ID NO: 1989334 - RNA, 15 nt, Shigella flexneri 2a str. 301
ccaaagcaccacucc

SEQ ID NO: 1989335 - RNA, 17 nt, Shigella flexneri 2a str. 301
ccaaagcugauuucugg

SEQ ID NO: 1989336 - RNA, 22 nt, Shigella flexneri 2a str. 301
ccaaaggcgaguucaaucaacu

SEQ ID NO: 1989337 - RNA, 19 nt, Shigella flexneri 2a str. 301
ccaaacuggaacugaaagg

SEQ ID NO: 1989338 - RNA, 21 nt, Shigella flexneri 2a str. 301
ccaaagaccaggaaacccaac

SEQ ID NO: 1989339 - RNA, 15 nt, Shigella flexneri 2a str. 301
ccaaacgccuagaug

SEQ ID NO: 1989340 - RNA, 15 nt, Shigella flexneri 2a str. 301
ccaaacgcucccugc

SEQ ID NO: 1989341 - RNA, 14 nt, Shigella flexneri 2a str. 301
ccaaagguuuccuc

SEQ ID NO: 1989342 - RNA, 17 nt, Shigella flexneri 2a str. 301
ccaaauacauugauaua

SEQ ID NO: 1989343 - RNA, 18 nt, Shigella flexneri 2a str. 301
ccaaaucgcccagcaaau

SEQ ID NO: 1989344 - RNA, 17 nt, Shigella flexneri 2a str. 301
ccaaaucgcccagcaaa

SEQ ID NO: 1989345 - RNA, 21 nt, Shigella flexneri 2a str. 301
ccaaaucgauaaaacuucccg

SEQ ID NO: 1989346 - RNA, 17 nt, Shigella flexneri 2a str. 301
ccaaaucggaacaacag

SEQ ID NO: 1989347 - RNA, 18 nt, Shigella flexneri 2a str. 301
ccaaaucugauuaauauu

SEQ ID NO: 1989348 - RNA, 20 nt, Shigella flexneri 2a str. 301
ccaaaucauccagacugcuc

SEQ ID NO: 1989349 - RNA, 15 nt, Shigella flexneri 2a str. 301
ccaaauccagcgcca

SEQ ID NO: 1989350 - RNA, 12 nt, Shigella flexneri 2a str. 301
ccaaauauuucu

SEQ ID NO: 1989351 - RNA, 14 nt, Shigella flexneri 2a str. 301
ccaaccuugcgccu

SEQ ID NO: 1989352 - RNA, 19 nt, Shigella flexneri 2a str. 301
ccaacgauaauucagcaau

SEQ ID NO: 1989353 - RNA, 21 nt, Shigella flexneri 2a str. 301
ccaaccguggcguaaaucauc

SEQ ID NO: 1989354 - RNA, 19 nt, Shigella flexneri 2a str. 301
ccaacgcgccaccgaccag

SEQ ID NO: 1989355 - RNA, 17 nt, Shigella flexneri 2a str. 301
ccaacggugaaaaacca

SEQ ID NO: 1989356 - RNA, 21 nt, Shigella flexneri 2a str. 301
ccaacguuucuggaaguaauc

SEQ ID NO: 1989357 - RNA, 19 nt, Shigella flexneri 2a str. 301
ccaacguucguacugcccu

SEQ ID NO: 1989358 - RNA, 23 nt, Shigella flexneri 2a str. 301
ccaacguucaccacgacuucugu

SEQ ID NO: 1989359 - RNA, 14 nt, Shigella flexneri 2a str. 301
ccaacuguaccagc

SEQ ID NO: 1989360 - RNA, 19 nt, Shigella flexneri 2a str. 301
ccaacuguugauccaggag

SEQ ID NO: 1989361 - RNA, 21 nt, Shigella flexneri 2a str. 301
ccaacuguugauccaggagcu

SEQ ID NO: 1989362 - RNA, 23 nt, Shigella flexneri 2a str. 301
ccaacuuaccgccggugcaugau

SEQ ID NO: 1989363 - RNA, 22 nt, Shigella flexneri 2a str. 301
ccaacuuacugauaguguuuua

SEQ ID NO: 1989364 - RNA, 15 nt, Shigella flexneri 2a str. 301
ccaacuugcccaggu

SEQ ID NO: 1989365 - RNA, 18 nt, Shigella flexneri 2a str. 301
ccaacugauuuucaucuu

SEQ ID NO: 1989366 - RNA, 15 nt, Shigella flexneri 2a str. 301
ccaacugccugaugc

SEQ ID NO: 1989367 - RNA, 13 nt, Shigella flexneri 2a str. 301
ccaacaaacagua

SEQ ID NO: 1989368 - RNA, 22 nt, Shigella flexneri 2a str. 301
ccaacaaauggaaggucacgcc

SEQ ID NO: 1989369 - RNA, 19 nt, Shigella flexneri 2a str. 301
ccaacaacacauucaauaa

SEQ ID NO: 1989370 - RNA, 20 nt, Shigella flexneri 2a str. 301
ccaacaaacaguacacagac

SEQ ID NO: 1989371 - RNA, 14 nt, Shigella flexneri 2a str. 301
ccaacaaauagaga

SEQ ID NO: 1989372 - RNA, 15 nt, Shigella flexneri 2a str. 301
ccaaaugaaacaggg

SEQ ID NO: 1989373 - RNA, 14 nt, Shigella flexneri 2a str. 301
ccaacaauaaaauu

SEQ ID NO: 1989374 - RNA, 15 nt, Shigella flexneri 2a str. 301
ccaacaaucucuucc

SEQ ID NO: 1989375 - RNA, 15 nt, Shigella flexneri 2a str. 301
ccaacagcagccaca

SEQ ID NO: 1989376 - RNA, 13 nt, Shigella flexneri 2a str. 301
ccaacagcagcca

SEQ ID NO: 1989377 - RNA, 19 nt, Shigella flexneri 2a str. 301
ccaacacuuccccggacgc

SEQ ID NO: 1989378 - RNA, 23 nt, Shigella flexneri 2a str. 301
ccaaccgcggcacguuccugcau

SEQ ID NO: 1989379 - RNA, 22 nt, Shigella flexneri 2a str. 301
ccaacaucgaaaacgccaccgc

SEQ ID NO: 1989380 - RNA, 14 nt, Shigella flexneri 2a str. 301
ccaacaugacuaau

SEQ ID NO: 1989381 - RNA, 21 nt, Shigella flexneri 2a str. 301
ccaacauucgagaagcccaua

SEQ ID NO: 1989382 - RNA, 17 nt, Shigella flexneri 2a str. 301
ccaacaucgaaaacgcc

SEQ ID NO: 1989383 - RNA, 14 nt, Shigella flexneri 2a str. 301
ccaaguaauagaac

SEQ ID NO: 1989384 - RNA, 15 nt, Shigella flexneri 2a str. 301
ccaagugauuuuuaa

SEQ ID NO: 1989385 - RNA, 18 nt, Shigella flexneri 2a str. 301
ccaaggucuccgcccagc

SEQ ID NO: 1989386 - RNA, 17 nt, Shigella flexneri 2a str. 301
ccaagcgcggcaggcau

SEQ ID NO: 1989387 - RNA, 19 nt, Shigella flexneri 2a str. 301
ccaagcagcgcgcagaaca

SEQ ID NO: 1989388 - RNA, 16 nt, Shigella flexneri 2a str. 301
ccaaugacuauuugcg

SEQ ID NO: 1989389 - RNA, 19 nt, Shigella flexneri 2a str. 301
ccaaugacagccagcaagu

SEQ ID NO: 1989390 - RNA, 15 nt, Shigella flexneri 2a str. 301
ccaaugaccacuccg

SEQ ID NO: 1989391 - RNA, 11 nt, Shigella flexneri 2a str. 301
ccaaugaaauu

SEQ ID NO: 1989392 - RNA, 15 nt, Shigella flexneri 2a str. 301
ccaaucugugccgcu

SEQ ID NO: 1989393 - RNA, 13 nt, Shigella flexneri 2a str. 301
ccaaucugcaaaa

SEQ ID NO: 1989394 - RNA, 20 nt, Shigella flexneri 2a str. 301
ccaaucccccacuuuuaaau

SEQ ID NO: 1989395 - RNA, 14 nt, Shigella flexneri 2a str. 301
ccaaucccgccaua

SEQ ID NO: 1989396 - RNA, 15 nt, Shigella flexneri 2a str. 301
ccaauccccagaccu

SEQ ID NO: 1989397 - RNA, 17 nt, Shigella flexneri 2a str. 301
ccaauccccagaccugc

SEQ ID NO: 1989398 - RNA, 19 nt, Shigella flexneri 2a str. 301
ccaauccccagaccugcug

SEQ ID NO: 1989399 - RNA, 23 nt, Shigella flexneri 2a str. 301
ccaaucagacucauauaaaaacc

SEQ ID NO: 1989400 - RNA, 14 nt, Shigella flexneri 2a str. 301
ccaaucagcacaca

SEQ ID NO: 1989401 - RNA, 17 nt, Shigella flexneri 2a str. 301
ccaaucagcacacauaa

SEQ ID NO: 1989402 - RNA, 16 nt, Shigella flexneri 2a str. 301
ccaauauugcaccuga

SEQ ID NO: 1989403 - RNA, 23 nt, Shigella flexneri 2a str. 301
ccaaucaaauacccuugcagaua

SEQ ID NO: 1989404 - RNA, 16 nt, Shigella flexneri 2a str. 301
ccaauacaaaauuuaa

SEQ ID NO: 1989405 - RNA, 18 nt, Shigella flexneri 2a str. 301
ccaauaauccccaauacg

SEQ ID NO: 1989406 - RNA, 22 nt, Shigella flexneri 2a str. 301
ccaauaguuccacuauuucaau

SEQ ID NO: 1989407 - RNA, 14 nt, Shigella flexneri 2a str. 301
ccaauagccgcgcc

SEQ ID NO: 1989408 - RNA, 17 nt, Shigella flexneri 2a str. 301
ccaauagguugaguaug

SEQ ID NO: 1989409 - RNA, 11 nt, Shigella flexneri 2a str. 301
ccaauauccug

SEQ ID NO: 1989410 - RNA, 23 nt, Shigella flexneri 2a str. 301
ccaauagaaagugacagcccggc

SEQ ID NO: 1989411 - RNA, 18 nt, Shigella flexneri 2a str. 301
ccaauagaaagugacagc

SEQ ID NO: 1989412 - RNA, 22 nt, Shigella flexneri 2a str. 301
ccaauaccgcccaccaccagcg

SEQ ID NO: 1989413 - RNA, 22 nt, Shigella flexneri 2a str. 301
ccacagacaaaauccugccagc

SEQ ID NO: 1989414 - RNA, 19 nt, Shigella flexneri 2a str. 301
ccacagacaaacagcucga

SEQ ID NO: 1989415 - RNA, 16 nt, Shigella flexneri 2a str. 301
ccacacgcccaacuaa

SEQ ID NO: 1989416 - RNA, 18 nt, Shigella flexneri 2a str. 301
ccacacgcguaaaacgau

SEQ ID NO: 1989417 - RNA, 22 nt, Shigella flexneri 2a str. 301
ccacacggagaguaaugccagu

SEQ ID NO: 1989418 - RNA, 15 nt, Shigella flexneri 2a str. 301
ccacacgaauuccaa

SEQ ID NO: 1989419 - RNA, 16 nt, Shigella flexneri 2a str. 301
ccacaccuggugcagc

SEQ ID NO: 1989420 - RNA, 14 nt, Shigella flexneri 2a str. 301
ccacacccgcaaga

SEQ ID NO: 1989421 - RNA, 15 nt, Shigella flexneri 2a str. 301
ccacaccacugcgca

SEQ ID NO: 1989422 - RNA, 14 nt, Shigella flexneri 2a str. 301
ccacaccagugacg

SEQ ID NO: 1989423 - RNA, 23 nt, Shigella flexneri 2a str. 301
ccacaccaacugugccgccgcca

SEQ ID NO: 1989424 - RNA, 15 nt, Shigella flexneri 2a str. 301
ccacaccagcuuucg

SEQ ID NO: 1989425 - RNA, 16 nt, Shigella flexneri 2a str. 301
ccacaccaccaugcua

SEQ ID NO: 1989426 - RNA, 19 nt, Shigella flexneri 2a str. 301
ccacaccaccguuuucccg

SEQ ID NO: 1989427 - RNA, 19 nt, Shigella flexneri 2a str. 301
ccacagcagccuucgccac

SEQ ID NO: 1989428 - RNA, 15 nt, Shigella flexneri 2a str. 301
ccacagcaaugcauu

SEQ ID NO: 1989429 - RNA, 17 nt, Shigella flexneri 2a str. 301
ccacagcucacggcccu

SEQ ID NO: 1989430 - RNA, 16 nt, Shigella flexneri 2a str. 301
ccacagggugaucacc

SEQ ID NO: 1989431 - RNA, 18 nt, Shigella flexneri 2a str. 301
ccaauggcuuuugccgcc

SEQ ID NO: 1989432 - RNA, 19 nt, Shigella flexneri 2a str. 301
ccaauggcaauaaagacau

SEQ ID NO: 1989433 - RNA, 22 nt, Shigella flexneri 2a str. 301
ccaaugucgaaagccccagccc

SEQ ID NO: 1989434 - RNA, 23 nt, Shigella flexneri 2a str. 301
ccaauguagccgcacgcuggcgu

SEQ ID NO: 1989435 - RNA, 22 nt, Shigella flexneri 2a str. 301
ccaaugccaccagggauaaagc

SEQ ID NO: 1989436 - RNA, 14 nt, Shigella flexneri 2a str. 301
ccaaugccugaugc

SEQ ID NO: 1989437 - RNA, 13 nt, Shigella flexneri 2a str. 301
ccaauugaacucu

SEQ ID NO: 1989438 - RNA, 23 nt, Shigella flexneri 2a str. 301
ccaauucguaaguacauuaaaau

SEQ ID NO: 1989439 - RNA, 20 nt, Shigella flexneri 2a str. 301
ccacaaccggcgggaaaaau

SEQ ID NO: 1989440 - RNA, 11 nt, Shigella flexneri 2a str. 301
ccaauugcugu

SEQ ID NO: 1989441 - RNA, 23 nt, Shigella flexneri 2a str. 301
ccacaaagcagacaacccacaca

SEQ ID NO: 1989442 - RNA, 18 nt, Shigella flexneri 2a str. 301
ccacaaagggagagggau

SEQ ID NO: 1989443 - RNA, 18 nt, Shigella flexneri 2a str. 301
ccacaaaccuuaaauggc

SEQ ID NO: 1989444 - RNA, 14 nt, Shigella flexneri 2a str. 301
ccacaacaguggcg

SEQ ID NO: 1989445 - RNA, 16 nt, Shigella flexneri 2a str. 301
ccacccaccagcgccg

SEQ ID NO: 1989446 - RNA, 21 nt, Shigella flexneri 2a str. 301
ccaccauuuuacguccgcgca

SEQ ID NO: 1989447 - RNA, 15 nt, Shigella flexneri 2a str. 301
ccacccaacgccacu

SEQ ID NO: 1989448 - RNA, 22 nt, Shigella flexneri 2a str. 301
ccaccaugcuaauagcugcgcc

SEQ ID NO: 1989449 - RNA, 22 nt, Shigella flexneri 2a str. 301
ccacccagucccguacccagca

SEQ ID NO: 1989450 - RNA, 13 nt, Shigella flexneri 2a str. 301
ccacccagcagcg

SEQ ID NO: 1989451 - RNA, 15 nt, Shigella flexneri 2a str. 301
ccacccaccgcagcc

SEQ ID NO: 1989452 - RNA, 9 nt, Shigella flexneri 2a str. 301
ccaccaguc

SEQ ID NO: 1989453 - RNA, 13 nt, Shigella flexneri 2a str. 301
ccaccaguccuuc

SEQ ID NO: 1989454 - RNA, 19 nt, Shigella flexneri 2a str. 301
ccaccaguaccucuucgcu

SEQ ID NO: 1989455 - RNA, 15 nt, Shigella flexneri 2a str. 301
ccaccaggccacggc

SEQ ID NO: 1989456 - RNA, 20 nt, Shigella flexneri 2a str. 301
ccaccagggauaaagccccc

SEQ ID NO: 1989457 - RNA, 13 nt, Shigella flexneri 2a str. 301
ccaccaggaacgc

SEQ ID NO: 1989458 - RNA, 16 nt, Shigella flexneri 2a str. 301
ccaccagcgucagaaa

SEQ ID NO: 1989459 - RNA, 13 nt, Shigella flexneri 2a str. 301
ccaccacgcugua

SEQ ID NO: 1989460 - RNA, 23 nt, Shigella flexneri 2a str. 301
ccacauucagccguaacucaucc

SEQ ID NO: 1989461 - RNA, 17 nt, Shigella flexneri 2a str. 301
ccacauuagauaaaaau

SEQ ID NO: 1989462 - RNA, 17 nt, Shigella flexneri 2a str. 301
ccacaugccugcauaaa

SEQ ID NO: 1989463 - RNA, 23 nt, Shigella flexneri 2a str. 301
ccacaugaucauucaccagccca

SEQ ID NO: 1989464 - RNA, 21 nt, Shigella flexneri 2a str. 301
ccacaucgguuugcgcagcuu

SEQ ID NO: 1989465 - RNA, 23 nt, Shigella flexneri 2a str. 301
ccacauccagcuuuuuaaucgcc

SEQ ID NO: 1989466 - RNA, 21 nt, Shigella flexneri 2a str. 301
ccacaguuucauaucugccag

SEQ ID NO: 1989467 - RNA, 17 nt, Shigella flexneri 2a str. 301
ccacaguuucagcccca

SEQ ID NO: 1989468 - RNA, 19 nt, Shigella flexneri 2a str. 301
ccacaguuuuacugcagcc

SEQ ID NO: 1989469 - RNA, 19 nt, Shigella flexneri 2a str. 301
ccacauccggcaaaaacaa

SEQ ID NO: 1989470 - RNA, 21 nt, Shigella flexneri 2a str. 301
ccacauccggcauauuaacca

SEQ ID NO: 1989471 - RNA, 13 nt, Shigella flexneri 2a str. 301
ccacauccggccu

SEQ ID NO: 1989472 - RNA, 16 nt, Shigella flexneri 2a str. 301
ccacauccggccuaua

SEQ ID NO: 1989473 - RNA, 21 nt, Shigella flexneri 2a str. 301
ccaccaaugacguuaauaaaa

SEQ ID NO: 1989474 - RNA, 16 nt, Shigella flexneri 2a str. 301
ccaccaaacugcgccc

SEQ ID NO: 1989475 - RNA, 15 nt, Shigella flexneri 2a str. 301
ccaccaaacugcgcc

SEQ ID NO: 1989476 - RNA, 21 nt, Shigella flexneri 2a str. 301
ccacauugugggauuccagcg

SEQ ID NO: 1989477 - RNA, 12 nt, Shigella flexneri 2a str. 301
ccaccaccagac

SEQ ID NO: 1989478 - RNA, 17 nt, Shigella flexneri 2a str. 301
ccaccaccagcaauaau

SEQ ID NO: 1989479 - RNA, 17 nt, Shigella flexneri 2a str. 301
ccaccacaucgcaaaau

SEQ ID NO: 1989480 - RNA, 21 nt, Shigella flexneri 2a str. 301
ccaccacagacaaucgccagu

SEQ ID NO: 1989481 - RNA, 18 nt, Shigella flexneri 2a str. 301
ccaccaccgcaaaauagg

SEQ ID NO: 1989482 - RNA, 15 nt, Shigella flexneri 2a str. 301
ccacgauacgcugca

SEQ ID NO: 1989483 - RNA, 21 nt, Shigella flexneri 2a str. 301
ccacgauagagagcagucagg

SEQ ID NO: 1989484 - RNA, 20 nt, Shigella flexneri 2a str. 301
ccaccuccacgcccagcgca

SEQ ID NO: 1989485 - RNA, 14 nt, Shigella flexneri 2a str. 301
ccaccuucaacguu

SEQ ID NO: 1989486 - RNA, 14 nt, Shigella flexneri 2a str. 301
ccaccuuauaaccc

SEQ ID NO: 1989487 - RNA, 21 nt, Shigella flexneri 2a str. 301
ccaccuugcggaaacugucaa

SEQ ID NO: 1989488 - RNA, 14 nt, Shigella flexneri 2a str. 301
ccaccguuauccug

SEQ ID NO: 1989489 - RNA, 13 nt, Shigella flexneri 2a str. 301
ccacccuggcaac

SEQ ID NO: 1989490 - RNA, 17 nt, Shigella flexneri 2a str. 301
ccacggaagcaguucgc

SEQ ID NO: 1989491 - RNA, 15 nt, Shigella flexneri 2a str. 301
ccacgcugccgcgca

SEQ ID NO: 1989492 - RNA, 17 nt, Shigella flexneri 2a str. 301
ccacgcuguagccgccg

SEQ ID NO: 1989493 - RNA, 22 nt, Shigella flexneri 2a str. 301
ccacgcugcaucgccaaucugc

SEQ ID NO: 1989494 - RNA, 15 nt, Shigella flexneri 2a str. 301
ccacgccacgcugcc

SEQ ID NO: 1989495 - RNA, 16 nt, Shigella flexneri 2a str. 301
ccacgcugagagaagc

SEQ ID NO: 1989496 - RNA, 19 nt, Shigella flexneri 2a str. 301
ccacgcugagagaagcacg

SEQ ID NO: 1989497 - RNA, 13 nt, Shigella flexneri 2a str. 301
ccacggcuccagc

SEQ ID NO: 1989498 - RNA, 21 nt, Shigella flexneri 2a str. 301
ccacgguacgccagaguggau

SEQ ID NO: 1989499 - RNA, 15 nt, Shigella flexneri 2a str. 301
ccacgguauuugcca

SEQ ID NO: 1989500 - RNA, 16 nt, Shigella flexneri 2a str. 301
ccacggcaugaaagcg

SEQ ID NO: 1989501 - RNA, 18 nt, Shigella flexneri 2a str. 301
ccagcaucacgcccgcuu

SEQ ID NO: 1989502 - RNA, 13 nt, Shigella flexneri 2a str. 301
ccagcaucaacaa

SEQ ID NO: 1989503 - RNA, 16 nt, Shigella flexneri 2a str. 301
ccagcagcgccgcgcc

SEQ ID NO: 1989504 - RNA, 16 nt, Shigella flexneri 2a str. 301
ccagcauggcaauaac

SEQ ID NO: 1989505 - RNA, 22 nt, Shigella flexneri 2a str. 301
ccagcaugaugcucucccaaau

SEQ ID NO: 1989506 - RNA, 17 nt, Shigella flexneri 2a str. 301
ccagcaugguaccgugu

SEQ ID NO: 1989507 - RNA, 13 nt, Shigella flexneri 2a str. 301
ccagcaucgacca

SEQ ID NO: 1989508 - RNA, 21 nt, Shigella flexneri 2a str. 301
ccagcaugaucagcgcauaga

SEQ ID NO: 1989509 - RNA, 15 nt, Shigella flexneri 2a str. 301
ccagcaucugcaugg

SEQ ID NO: 1989510 - RNA, 22 nt, Shigella flexneri 2a str. 301
ccagccagguguugauccacgg

SEQ ID NO: 1989511 - RNA, 23 nt, Shigella flexneri 2a str. 301
ccagccaguauugccaugcacgc

SEQ ID NO: 1989512 - RNA, 14 nt, Shigella flexneri 2a str. 301
ccagccagguguug

SEQ ID NO: 1989513 - RNA, 13 nt, Shigella flexneri 2a str. 301
ccagccaggaauc

SEQ ID NO: 1989514 - RNA, 14 nt, Shigella flexneri 2a str. 301
ccagccaacgcccu

SEQ ID NO: 1989515 - RNA, 15 nt, Shigella flexneri 2a str. 301
ccagcauucccgcca

SEQ ID NO: 1989516 - RNA, 14 nt, Shigella flexneri 2a str. 301
ccagccacugcgcc

SEQ ID NO: 1989517 - RNA, 15 nt, Shigella flexneri 2a str. 301
ccagccagacgccag

SEQ ID NO: 1989518 - RNA, 12 nt, Shigella flexneri 2a str. 301
ccagccaccaug

SEQ ID NO: 1989519 - RNA, 15 nt, Shigella flexneri 2a str. 301
ccagcacuucgcugg

SEQ ID NO: 1989520 - RNA, 13 nt, Shigella flexneri 2a str. 301
ccagcacugccgc

SEQ ID NO: 1989521 - RNA, 17 nt, Shigella flexneri 2a str. 301
ccagcagaauccgguga

SEQ ID NO: 1989522 - RNA, 23 nt, Shigella flexneri 2a str. 301
ccagcacuuuucgcacugcaggc

SEQ ID NO: 1989523 - RNA, 13 nt, Shigella flexneri 2a str. 301
ccagcagagauac

SEQ ID NO: 1989524 - RNA, 18 nt, Shigella flexneri 2a str. 301
ccagcagagaucuuucac

SEQ ID NO: 1989525 - RNA, 15 nt, Shigella flexneri 2a str. 301
ccagcacuaccgccc

SEQ ID NO: 1989526 - RNA, 23 nt, Shigella flexneri 2a str. 301
ccagcacggugaagaagcggaaa

SEQ ID NO: 1989527 - RNA, 18 nt, Shigella flexneri 2a str. 301
ccagcacccaguaagcug

SEQ ID NO: 1989528 - RNA, 15 nt, Shigella flexneri 2a str. 301
ccagcacaaaguggc

SEQ ID NO: 1989529 - RNA, 16 nt, Shigella flexneri 2a str. 301
ccagcaccaggcuugc

SEQ ID NO: 1989530 - RNA, 22 nt, Shigella flexneri 2a str. 301
ccagcacacugguucccaacaa

SEQ ID NO: 1989531 - RNA, 17 nt, Shigella flexneri 2a str. 301
ccagcaauccccagaca

SEQ ID NO: 1989532 - RNA, 15 nt, Shigella flexneri 2a str. 301
ccagcaauccccaga

SEQ ID NO: 1989533 - RNA, 19 nt, Shigella flexneri 2a str. 301
ccagcaauccccagacaaa

SEQ ID NO: 1989534 - RNA, 19 nt, Shigella flexneri 2a str. 301
ccagcaaggcgcuaaaagc

SEQ ID NO: 1989535 - RNA, 21 nt, Shigella flexneri 2a str. 301
ccagcaaggguucaccgguga

SEQ ID NO: 1989536 - RNA, 15 nt, Shigella flexneri 2a str. 301
ccagcaagucuucac

SEQ ID NO: 1989537 - RNA, 18 nt, Shigella flexneri 2a str. 301
ccagcaacugauggccca

SEQ ID NO: 1989538 - RNA, 16 nt, Shigella flexneri 2a str. 301
ccagcaagagcaaaua

SEQ ID NO: 1989539 - RNA, 20 nt, Shigella flexneri 2a str. 301
ccagaucgcucaucugcugc

SEQ ID NO: 1989540 - RNA, 15 nt, Shigella flexneri 2a str. 301
ccagaucgccugccg

SEQ ID NO: 1989541 - RNA, 14 nt, Shigella flexneri 2a str. 301
ccagaucuucauca

SEQ ID NO: 1989542 - RNA, 21 nt, Shigella flexneri 2a str. 301
ccagcaaccaaugccaccagg

SEQ ID NO: 1989543 - RNA, 23 nt, Shigella flexneri 2a str. 301
ccagcaaccaacgccagcagcag

SEQ ID NO: 1989544 - RNA, 20 nt, Shigella flexneri 2a str. 301
ccagcaacauuggcucauca

SEQ ID NO: 1989545 - RNA, 17 nt, Shigella flexneri 2a str. 301
ccagcaaccaacgccag

SEQ ID NO: 1989546 - RNA, 15 nt, Shigella flexneri 2a str. 301
ccagaccaaacagca

SEQ ID NO: 1989547 - RNA, 14 nt, Shigella flexneri 2a str. 301
ccagaccaauagaa

SEQ ID NO: 1989548 - RNA, 19 nt, Shigella flexneri 2a str. 301
ccagacauguggauuaaau

SEQ ID NO: 1989549 - RNA, 19 nt, Shigella flexneri 2a str. 301
ccagacagcacauuucaga

SEQ ID NO: 1989550 - RNA, 19 nt, Shigella flexneri 2a str. 301
ccagacaucaccaguaccg

SEQ ID NO: 1989551 - RNA, 23 nt, Shigella flexneri 2a str. 301
ccagacaucaccaguaccgccac

SEQ ID NO: 1989552 - RNA, 16 nt, Shigella flexneri 2a str. 301
ccagacaucccagugc

SEQ ID NO: 1989553 - RNA, 14 nt, Shigella flexneri 2a str. 301
ccagaccgcacacc

SEQ ID NO: 1989554 - RNA, 12 nt, Shigella flexneri 2a str. 301
ccagaccugaau

SEQ ID NO: 1989555 - RNA, 20 nt, Shigella flexneri 2a str. 301
ccagaccugaauuugcucca

SEQ ID NO: 1989556 - RNA, 16 nt, Shigella flexneri 2a str. 301
ccagacgcaacagaaa

SEQ ID NO: 1989557 - RNA, 15 nt, Shigella flexneri 2a str. 301
ccagacgacggcugc

SEQ ID NO: 1989558 - RNA, 23 nt, Shigella flexneri 2a str. 301
ccagacgcucuucaauggucagc

SEQ ID NO: 1989559 - RNA, 20 nt, Shigella flexneri 2a str. 301
ccagacgcgcagcuucacuu

SEQ ID NO: 1989560 - RNA, 20 nt, Shigella flexneri 2a str. 301
ccagacgccagaugcggcgu

SEQ ID NO: 1989561 - RNA, 19 nt, Shigella flexneri 2a str. 301
ccagacgcgcguccccugc

SEQ ID NO: 1989562 - RNA, 18 nt, Shigella flexneri 2a str. 301
ccagacgcgcagcuucac

SEQ ID NO: 1989563 - RNA, 14 nt, Shigella flexneri 2a str. 301
ccagagccaccaac

SEQ ID NO: 1989564 - RNA, 16 nt, Shigella flexneri 2a str. 301
ccagagcaucuacugg

SEQ ID NO: 1989565 - RNA, 19 nt, Shigella flexneri 2a str. 301
ccagaggagccaucaccau

SEQ ID NO: 1989566 - RNA, 20 nt, Shigella flexneri 2a str. 301
ccagacgugauaaacaucca

SEQ ID NO: 1989567 - RNA, 15 nt, Shigella flexneri 2a str. 301
ccagacucaacaggc

SEQ ID NO: 1989568 - RNA, 16 nt, Shigella flexneri 2a str. 301
ccagacucaacaggcc

SEQ ID NO: 1989569 - RNA, 17 nt, Shigella flexneri 2a str. 301
ccagacuggagcacugc

SEQ ID NO: 1989570 - RNA, 14 nt, Shigella flexneri 2a str. 301
ccagagagaagcug

SEQ ID NO: 1989571 - RNA, 19 nt, Shigella flexneri 2a str. 301
ccagagagcggagcaauga

SEQ ID NO: 1989572 - RNA, 13 nt, Shigella flexneri 2a str. 301
ccacgucugaagu

SEQ ID NO: 1989573 - RNA, 19 nt, Shigella flexneri 2a str. 301
ccacguuaguguggccagu

SEQ ID NO: 1989574 - RNA, 18 nt, Shigella flexneri 2a str. 301
ccacguucugaucuuucu

SEQ ID NO: 1989575 - RNA, 23 nt, Shigella flexneri 2a str. 301
ccacguucugaucuuucuucagc

SEQ ID NO: 1989576 - RNA, 16 nt, Shigella flexneri 2a str. 301
ccacuuucacgccgcc

SEQ ID NO: 1989577 - RNA, 17 nt, Shigella flexneri 2a str. 301
ccacuuucacgccgcca

SEQ ID NO: 1989578 - RNA, 15 nt, Shigella flexneri 2a str. 301
ccacuuuacgggcaa

SEQ ID NO: 1989579 - RNA, 22 nt, Shigella flexneri 2a str. 301
ccacuuuacgggcaaucuccug

SEQ ID NO: 1989580 - RNA, 13 nt, Shigella flexneri 2a str. 301
ccacuuuccucau

SEQ ID NO: 1989581 - RNA, 23 nt, Shigella flexneri 2a str. 301
ccagaaaaaacguugucgccgcu

SEQ ID NO: 1989582 - RNA, 22 nt, Shigella flexneri 2a str. 301
ccacuuuuuucaccgagucguc

SEQ ID NO: 1989583 - RNA, 18 nt, Shigella flexneri 2a str. 301
ccagaaaaccuggcgcag

SEQ ID NO: 1989584 - RNA, 21 nt, Shigella flexneri 2a str. 301
ccagaaaagagacgcugaaaa

SEQ ID NO: 1989585 - RNA, 13 nt, Shigella flexneri 2a str. 301
ccagaaaaccugg

SEQ ID NO: 1989586 - RNA, 16 nt, Shigella flexneri 2a str. 301
ccacuuugcgcuccug

SEQ ID NO: 1989587 - RNA, 13 nt, Shigella flexneri 2a str. 301
ccacuuugcgcuc

SEQ ID NO: 1989588 - RNA, 22 nt, Shigella flexneri 2a str. 301
ccacuuuugcuccauaugaacg

SEQ ID NO: 1989589 - RNA, 17 nt, Shigella flexneri 2a str. 301
ccacuuucacgcccaua

SEQ ID NO: 1989590 - RNA, 18 nt, Shigella flexneri 2a str. 301
ccacuuuuaaaucgccaa

SEQ ID NO: 1989591 - RNA, 20 nt, Shigella flexneri 2a str. 301
ccagaaagcguauccaucac

SEQ ID NO: 1989592 - RNA, 20 nt, Shigella flexneri 2a str. 301
ccagaaacagugaccugaac

SEQ ID NO: 1989593 - RNA, 17 nt, Shigella flexneri 2a str. 301
ccagaaacgccaccauu

SEQ ID NO: 1989594 - RNA, 22 nt, Shigella flexneri 2a str. 301
ccagacacaguucuucaaaaau

SEQ ID NO: 1989595 - RNA, 14 nt, Shigella flexneri 2a str. 301
ccagacaccccuuc

SEQ ID NO: 1989596 - RNA, 15 nt, Shigella flexneri 2a str. 301
ccagacacaguucuu

SEQ ID NO: 1989597 - RNA, 19 nt, Shigella flexneri 2a str. 301
ccagacaauggcccgccgc

SEQ ID NO: 1989598 - RNA, 15 nt, Shigella flexneri 2a str. 301
ccagacaccgcugcu

SEQ ID NO: 1989599 - RNA, 23 nt, Shigella flexneri 2a str. 301
ccagacaaucgaaaaagaaucga

SEQ ID NO: 1989600 - RNA, 20 nt, Shigella flexneri 2a str. 301
ccagaauucacgcacuuccg

SEQ ID NO: 1989601 - RNA, 17 nt, Shigella flexneri 2a str. 301
ccagaaugucggaugca

SEQ ID NO: 1989602 - RNA, 17 nt, Shigella flexneri 2a str. 301
ccagaaucuggcgcagg

SEQ ID NO: 1989603 - RNA, 14 nt, Shigella flexneri 2a str. 301
ccagguuucuucca

SEQ ID NO: 1989604 - RNA, 22 nt, Shigella flexneri 2a str. 301
ccaguaaucacgaucucgccag

SEQ ID NO: 1989605 - RNA, 21 nt, Shigella flexneri 2a str. 301
ccaguaagcugugcgauagca

SEQ ID NO: 1989606 - RNA, 14 nt, Shigella flexneri 2a str. 301
ccaguaaucuggcc

SEQ ID NO: 1989607 - RNA, 21 nt, Shigella flexneri 2a str. 301
ccaguaaucuggccaaugccu

SEQ ID NO: 1989608 - RNA, 21 nt, Shigella flexneri 2a str. 301
ccaguaaucgggcaacugcug

SEQ ID NO: 1989609 - RNA, 23 nt, Shigella flexneri 2a str. 301
ccaguaacucauugccaguccua

SEQ ID NO: 1989610 - RNA, 19 nt, Shigella flexneri 2a str. 301
ccaguaaccuuucagaugu

SEQ ID NO: 1989611 - RNA, 23 nt, Shigella flexneri 2a str. 301
ccaguaagacaccccacagcucu

SEQ ID NO: 1989612 - RNA, 22 nt, Shigella flexneri 2a str. 301
ccaguaacgucccccagauccc

SEQ ID NO: 1989613 - RNA, 23 nt, Shigella flexneri 2a str. 301
ccaguaaccacgcagcguuggca

SEQ ID NO: 1989614 - RNA, 17 nt, Shigella flexneri 2a str. 301
ccagguuguucacggca

SEQ ID NO: 1989615 - RNA, 14 nt, Shigella flexneri 2a str. 301
ccagguggugcagg

SEQ ID NO: 1989616 - RNA, 15 nt, Shigella flexneri 2a str. 301
ccagguaacgaagau

SEQ ID NO: 1989617 - RNA, 13 nt, Shigella flexneri 2a str. 301
ccagguaauuuga

SEQ ID NO: 1989618 - RNA, 20 nt, Shigella flexneri 2a str. 301
ccagggcuuuuuuauuucau

SEQ ID NO: 1989619 - RNA, 16 nt, Shigella flexneri 2a str. 301
ccagggcuuuauucac

SEQ ID NO: 1989620 - RNA, 16 nt, Shigella flexneri 2a str. 301
ccaggugaaaaauaaa

SEQ ID NO: 1989621 - RNA, 22 nt, Shigella flexneri 2a str. 301
ccaggcagaagcgcgugcuaac

SEQ ID NO: 1989622 - RNA, 18 nt, Shigella flexneri 2a str. 301
ccaggcaccgcacuggcu

SEQ ID NO: 1989623 - RNA, 20 nt, Shigella flexneri 2a str. 301
ccaggcaguuuauccagcca

SEQ ID NO: 1989624 - RNA, 16 nt, Shigella flexneri 2a str. 301
ccaggcgcgaauggaa

SEQ ID NO: 1989625 - RNA, 22 nt, Shigella flexneri 2a str. 301
ccagggaucgggucaccgccga

SEQ ID NO: 1989626 - RNA, 20 nt, Shigella flexneri 2a str. 301
ccagggcagcaguucaugca

SEQ ID NO: 1989627 - RNA, 15 nt, Shigella flexneri 2a str. 301
ccagggauaaagccc

SEQ ID NO: 1989628 - RNA, 12 nt, Shigella flexneri 2a str. 301
ccagcuccagcc

SEQ ID NO: 1989629 - RNA, 17 nt, Shigella flexneri 2a str. 301
ccagcuccguccagcca

SEQ ID NO: 1989630 - RNA, 18 nt, Shigella flexneri 2a str. 301
ccagcuccguccagccac

SEQ ID NO: 1989631 - RNA, 21 nt, Shigella flexneri 2a str. 301
ccagcguggcgaacggauagc

SEQ ID NO: 1989632 - RNA, 18 nt, Shigella flexneri 2a str. 301
ccagcguagugaaggcaa

SEQ ID NO: 1989633 - RNA, 23 nt, Shigella flexneri 2a str. 301
ccagcguaaauccugacgcuggg

SEQ ID NO: 1989634 - RNA, 15 nt, Shigella flexneri 2a str. 301
ccagcguaaauccug

SEQ ID NO: 1989635 - RNA, 21 nt, Shigella flexneri 2a str. 301
ccagcgguucacuccacuggc

SEQ ID NO: 1989636 - RNA, 18 nt, Shigella flexneri 2a str. 301
ccagcggcgggauuuuuu

SEQ ID NO: 1989637 - RNA, 17 nt, Shigella flexneri 2a str. 301
ccagcccgaucggcugg

SEQ ID NO: 1989638 - RNA, 14 nt, Shigella flexneri 2a str. 301
ccagcggcagcucg

SEQ ID NO: 1989639 - RNA, 21 nt, Shigella flexneri 2a str. 301
ccagcuucccaaagaucuccu

SEQ ID NO: 1989640 - RNA, 18 nt, Shigella flexneri 2a str. 301
ccagcuucaacgauucaa

SEQ ID NO: 1989641 - RNA, 17 nt, Shigella flexneri 2a str. 301
ccagcuugcgacaugcg

SEQ ID NO: 1989642 - RNA, 22 nt, Shigella flexneri 2a str. 301
ccagcuguggucuuuaaugaca

SEQ ID NO: 1989643 - RNA, 15 nt, Shigella flexneri 2a str. 301
ccagcuguccgauuu

SEQ ID NO: 1989644 - RNA, 14 nt, Shigella flexneri 2a str. 301
ccagcucuucuuca

SEQ ID NO: 1989645 - RNA, 14 nt, Shigella flexneri 2a str. 301
ccaggagauuaacg

SEQ ID NO: 1989646 - RNA, 18 nt, Shigella flexneri 2a str. 301
ccaggagcguauucagca

SEQ ID NO: 1989647 - RNA, 19 nt, Shigella flexneri 2a str. 301
ccagcuugucauacggauu

SEQ ID NO: 1989648 - RNA, 21 nt, Shigella flexneri 2a str. 301
ccaggaaccugugacagcagc

SEQ ID NO: 1989649 - RNA, 21 nt, Shigella flexneri 2a str. 301
ccaggaacgcgccaagauaga

SEQ ID NO: 1989650 - RNA, 18 nt, Shigella flexneri 2a str. 301
ccaggaacuccagaucca

SEQ ID NO: 1989651 - RNA, 23 nt, Shigella flexneri 2a str. 301
ccaggaacuccagauccauaagg

SEQ ID NO: 1989652 - RNA, 17 nt, Shigella flexneri 2a str. 301
ccaguuuguucagcugc

SEQ ID NO: 1989653 - RNA, 15 nt, Shigella flexneri 2a str. 301
ccaguuuucggauuu

SEQ ID NO: 1989654 - RNA, 21 nt, Shigella flexneri 2a str. 301
ccauaaaaggcaccuggaaau

SEQ ID NO: 1989655 - RNA, 15 nt, Shigella flexneri 2a str. 301
ccauaagcccagaac

SEQ ID NO: 1989656 - RNA, 14 nt, Shigella flexneri 2a str. 301
ccauaauaagcgcc

SEQ ID NO: 1989657 - RNA, 13 nt, Shigella flexneri 2a str. 301
ccauaauaaucau

SEQ ID NO: 1989658 - RNA, 20 nt, Shigella flexneri 2a str. 301
ccaguuucggcaucagcaga

SEQ ID NO: 1989659 - RNA, 15 nt, Shigella flexneri 2a str. 301
ccaguuugccuucac

SEQ ID NO: 1989660 - RNA, 14 nt, Shigella flexneri 2a str. 301
ccaguuucggacgc

SEQ ID NO: 1989661 - RNA, 12 nt, Shigella flexneri 2a str. 301
ccaguucacacc

SEQ ID NO: 1989662 - RNA, 17 nt, Shigella flexneri 2a str. 301
ccaguucacaccagcca

SEQ ID NO: 1989663 - RNA, 16 nt, Shigella flexneri 2a str. 301
ccaguucacgaauauu

SEQ ID NO: 1989664 - RNA, 15 nt, Shigella flexneri 2a str. 301
ccaguucagcggcug

SEQ ID NO: 1989665 - RNA, 21 nt, Shigella flexneri 2a str. 301
ccaguucauguucgacaugcu

SEQ ID NO: 1989666 - RNA, 17 nt, Shigella flexneri 2a str. 301
ccaguguaaaacagcac

SEQ ID NO: 1989667 - RNA, 13 nt, Shigella flexneri 2a str. 301
ccaguagacagca

SEQ ID NO: 1989668 - RNA, 18 nt, Shigella flexneri 2a str. 301
ccaguuaaccugcuccuc

SEQ ID NO: 1989669 - RNA, 23 nt, Shigella flexneri 2a str. 301
ccaguguucuggcgacagcgaaa

SEQ ID NO: 1989670 - RNA, 23 nt, Shigella flexneri 2a str. 301
ccaguuacccagcggauaaagca

SEQ ID NO: 1989671 - RNA, 15 nt, Shigella flexneri 2a str. 301
ccaguaccgccgcca

SEQ ID NO: 1989672 - RNA, 15 nt, Shigella flexneri 2a str. 301
ccaguacgccaaucu

SEQ ID NO: 1989673 - RNA, 23 nt, Shigella flexneri 2a str. 301
ccaguacggcuucgaucaggaac

SEQ ID NO: 1989674 - RNA, 22 nt, Shigella flexneri 2a str. 301
ccaguacgcguacacuuuccug

SEQ ID NO: 1989675 - RNA, 14 nt, Shigella flexneri 2a str. 301
ccaguaccagcagc

SEQ ID NO: 1989676 - RNA, 20 nt, Shigella flexneri 2a str. 301
ccaguaccacccccagacga

SEQ ID NO: 1989677 - RNA, 21 nt, Shigella flexneri 2a str. 301
ccaguaauucagccgcgcgcu

SEQ ID NO: 1989678 - RNA, 14 nt, Shigella flexneri 2a str. 301
ccaguaaugcgccc

SEQ ID NO: 1989679 - RNA, 20 nt, Shigella flexneri 2a str. 301
ccaucaacgccaucgccagg

SEQ ID NO: 1989680 - RNA, 12 nt, Shigella flexneri 2a str. 301
ccaucacaccuc

SEQ ID NO: 1989681 - RNA, 17 nt, Shigella flexneri 2a str. 301
ccaucacauccugauag

SEQ ID NO: 1989682 - RNA, 15 nt, Shigella flexneri 2a str. 301
ccaucaacaagcgaa

SEQ ID NO: 1989683 - RNA, 12 nt, Shigella flexneri 2a str. 301
ccaucaaaucug

SEQ ID NO: 1989684 - RNA, 19 nt, Shigella flexneri 2a str. 301
ccauauucugaucgugcuc

SEQ ID NO: 1989685 - RNA, 20 nt, Shigella flexneri 2a str. 301
ccauauucguuaucguacca

SEQ ID NO: 1989686 - RNA, 13 nt, Shigella flexneri 2a str. 301
ccauauagcgcac

SEQ ID NO: 1989687 - RNA, 22 nt, Shigella flexneri 2a str. 301
ccauaguguguuccucugcucc

SEQ ID NO: 1989688 - RNA, 16 nt, Shigella flexneri 2a str. 301
ccauacgggcaugugu

SEQ ID NO: 1989689 - RNA, 13 nt, Shigella flexneri 2a str. 301
ccauacugacgga

SEQ ID NO: 1989690 - RNA, 13 nt, Shigella flexneri 2a str. 301
ccaucaccgcgag

SEQ ID NO: 1989691 - RNA, 10 nt, Shigella flexneri 2a str. 301
ccauccauac

SEQ ID NO: 1989692 - RNA, 14 nt, Shigella flexneri 2a str. 301
ccauccagugaaac

SEQ ID NO: 1989693 - RNA, 15 nt, Shigella flexneri 2a str. 301
ccauccauuuuucac

SEQ ID NO: 1989694 - RNA, 21 nt, Shigella flexneri 2a str. 301
ccauccccaaaaaaucaacga

SEQ ID NO: 1989695 - RNA, 13 nt, Shigella flexneri 2a str. 301
ccauccggcagca

SEQ ID NO: 1989696 - RNA, 15 nt, Shigella flexneri 2a str. 301
ccauccgucauccau

SEQ ID NO: 1989697 - RNA, 20 nt, Shigella flexneri 2a str. 301
ccauccgggaucacaucaua

SEQ ID NO: 1989698 - RNA, 18 nt, Shigella flexneri 2a str. 301
ccaucgaaccaucggcuu

SEQ ID NO: 1989699 - RNA, 18 nt, Shigella flexneri 2a str. 301
ccauccugacggauagcc

SEQ ID NO: 1989700 - RNA, 23 nt, Shigella flexneri 2a str. 301
ccaucugaugauauuuuucccug

SEQ ID NO: 1989701 - RNA, 18 nt, Shigella flexneri 2a str. 301
ccaucuccgcauguuucg

SEQ ID NO: 1989702 - RNA, 15 nt, Shigella flexneri 2a str. 301
ccaucgcugauugcu

SEQ ID NO: 1989703 - RNA, 22 nt, Shigella flexneri 2a str. 301
ccaucgcuuuuaccagcauacg

SEQ ID NO: 1989704 - RNA, 18 nt, Shigella flexneri 2a str. 301
ccaucgccuggugaccgc

SEQ ID NO: 1989705 - RNA, 11 nt, Shigella flexneri 2a str. 301
ccaugcauauc

SEQ ID NO: 1989706 - RNA, 17 nt, Shigella flexneri 2a str. 301
ccaugcaccaacccuaa

SEQ ID NO: 1989707 - RNA, 17 nt, Shigella flexneri 2a str. 301
ccaugaugacaacauag

SEQ ID NO: 1989708 - RNA, 16 nt, Shigella flexneri 2a str. 301
ccaugccuuguuugau

SEQ ID NO: 1989709 - RNA, 21 nt, Shigella flexneri 2a str. 301
ccaugccuuguuugaucaucg

SEQ ID NO: 1989710 - RNA, 19 nt, Shigella flexneri 2a str. 301
ccaugccggaugcgccagc

SEQ ID NO: 1989711 - RNA, 21 nt, Shigella flexneri 2a str. 301
ccaugccggaugcgccagcau

SEQ ID NO: 1989712 - RNA, 13 nt, Shigella flexneri 2a str. 301
ccaugccaucugc

SEQ ID NO: 1989713 - RNA, 14 nt, Shigella flexneri 2a str. 301
ccaucuucaccgcc

SEQ ID NO: 1989714 - RNA, 13 nt, Shigella flexneri 2a str. 301
ccaucuuccagca

SEQ ID NO: 1989715 - RNA, 16 nt, Shigella flexneri 2a str. 301
ccaugauaguguccau

SEQ ID NO: 1989716 - RNA, 17 nt, Shigella flexneri 2a str. 301
ccaugagaagcugaaau

SEQ ID NO: 1989717 - RNA, 23 nt, Shigella flexneri 2a str. 301
ccaugacuuucuggcacgaccug

SEQ ID NO: 1989718 - RNA, 13 nt, Shigella flexneri 2a str. 301
ccaugacgcacuu

SEQ ID NO: 1989719 - RNA, 20 nt, Shigella flexneri 2a str. 301
ccaugaccgccgcagcaacc

SEQ ID NO: 1989720 - RNA, 12 nt, Shigella flexneri 2a str. 301
ccaugaccgccg

SEQ ID NO: 1989721 - RNA, 13 nt, Shigella flexneri 2a str. 301
ccaugaccgccgc

SEQ ID NO: 1989722 - RNA, 18 nt, Shigella flexneri 2a str. 301
ccaugaccgcuccgccau

SEQ ID NO: 1989723 - RNA, 23 nt, Shigella flexneri 2a str. 301
ccaugaccugcaaauucaauaaa

SEQ ID NO: 1989724 - RNA, 13 nt, Shigella flexneri 2a str. 301
cccccuuccugcu

SEQ ID NO: 1989725 - RNA, 23 nt, Shigella flexneri 2a str. 301
cccccuuugaccagccagucagu

SEQ ID NO: 1989726 - RNA, 18 nt, Shigella flexneri 2a str. 301
ccccggcagugcuuucau

SEQ ID NO: 1989727 - RNA, 18 nt, Shigella flexneri 2a str. 301
ccccgggcggccucuuca

SEQ ID NO: 1989728 - RNA, 17 nt, Shigella flexneri 2a str. 301
ccccggcccucucccua

SEQ ID NO: 1989729 - RNA, 12 nt, Shigella flexneri 2a str. 301
ccccuccagcga

SEQ ID NO: 1989730 - RNA, 21 nt, Shigella flexneri 2a str. 301
ccccucacccuaacccucucc

SEQ ID NO: 1989731 - RNA, 14 nt, Shigella flexneri 2a str. 301
ccccguucugccag

SEQ ID NO: 1989732 - RNA, 19 nt, Shigella flexneri 2a str. 301
ccccgugaugaacugcggu

SEQ ID NO: 1989733 - RNA, 18 nt, Shigella flexneri 2a str. 301
ccccggucagcagcacca

SEQ ID NO: 1989734 - RNA, 12 nt, Shigella flexneri 2a str. 301
cccauuucucca

SEQ ID NO: 1989735 - RNA, 15 nt, Shigella flexneri 2a str. 301
cccauuucuccagca

SEQ ID NO: 1989736 - RNA, 17 nt, Shigella flexneri 2a str. 301
ccccagugguuucgcca

SEQ ID NO: 1989737 - RNA, 21 nt, Shigella flexneri 2a str. 301
ccccagugguuucgccagcac

SEQ ID NO: 1989738 - RNA, 12 nt, Shigella flexneri 2a str. 301
ccccaguaauuc

SEQ ID NO: 1989739 - RNA, 14 nt, Shigella flexneri 2a str. 301
ccccagguuccccc

SEQ ID NO: 1989740 - RNA, 12 nt, Shigella flexneri 2a str. 301
ccccagcuuuug

SEQ ID NO: 1989741 - RNA, 18 nt, Shigella flexneri 2a str. 301
cccccgcucuuccaggca

SEQ ID NO: 1989742 - RNA, 11 nt, Shigella flexneri 2a str. 301
cccccucugau

SEQ ID NO: 1989743 - RNA, 20 nt, Shigella flexneri 2a str. 301
cccccguuuuguugucaggu

SEQ ID NO: 1989744 - RNA, 23 nt, Shigella flexneri 2a str. 301
ccccauaaacuaucccucagcca

SEQ ID NO: 1989745 - RNA, 21 nt, Shigella flexneri 2a str. 301
ccccaucaacgccaucgccag

SEQ ID NO: 1989746 - RNA, 13 nt, Shigella flexneri 2a str. 301
ccccauccacgca

SEQ ID NO: 1989747 - RNA, 21 nt, Shigella flexneri 2a str. 301
ccccaucuuccgucacaggca

SEQ ID NO: 1989748 - RNA, 16 nt, Shigella flexneri 2a str. 301
cccauccugauccaca

SEQ ID NO: 1989749 - RNA, 23 nt, Shigella flexneri 2a str. 301
cccauccggcgaauuaccagcca

SEQ ID NO: 1989750 - RNA, 14 nt, Shigella flexneri 2a str. 301
cccaugacuuugau

SEQ ID NO: 1989751 - RNA, 15 nt, Shigella flexneri 2a str. 301
cccaucucaauauua

SEQ ID NO: 1989752 - RNA, 14 nt, Shigella flexneri 2a str. 301
cccauccuucugug

SEQ ID NO: 1989753 - RNA, 19 nt, Shigella flexneri 2a str. 301
cccaucgcgcccgccgcca

SEQ ID NO: 1989754 - RNA, 22 nt, Shigella flexneri 2a str. 301
cccagugguuucgccagcaccg

SEQ ID NO: 1989755 - RNA, 15 nt, Shigella flexneri 2a str. 301
cccaguggcagcaau

SEQ ID NO: 1989756 - RNA, 14 nt, Shigella flexneri 2a str. 301
cccaguucagcggc

SEQ ID NO: 1989757 - RNA, 20 nt, Shigella flexneri 2a str. 301
cccaguuacugccaucuucc

SEQ ID NO: 1989758 - RNA, 23 nt, Shigella flexneri 2a str. 301
cccaguuucggcaucagcagaau

SEQ ID NO: 1989759 - RNA, 23 nt, Shigella flexneri 2a str. 301
cccaguugugggugcccacaaac

SEQ ID NO: 1989760 - RNA, 11 nt, Shigella flexneri 2a str. 301
cccaguuucau

SEQ ID NO: 1989761 - RNA, 19 nt, Shigella flexneri 2a str. 301
cccauacuugcaagaucgc

SEQ ID NO: 1989762 - RNA, 17 nt, Shigella flexneri 2a str. 301
cccauaucaggcacauu

SEQ ID NO: 1989763 - RNA, 23 nt, Shigella flexneri 2a str. 301
cccauauuuaaucaguucuacca

SEQ ID NO: 1989764 - RNA, 23 nt, Shigella flexneri 2a str. 301
cccauaacggagcuaccggauuu

SEQ ID NO: 1989765 - RNA, 22 nt, Shigella flexneri 2a str. 301
cccagccagacgccagccacag

SEQ ID NO: 1989766 - RNA, 16 nt, Shigella flexneri 2a str. 301
cccagccagacgccag

SEQ ID NO: 1989767 - RNA, 15 nt, Shigella flexneri 2a str. 301
cccagccagucacuu

SEQ ID NO: 1989768 - RNA, 22 nt, Shigella flexneri 2a str. 301
cccagccagucacuucacaguu

SEQ ID NO: 1989769 - RNA, 19 nt, Shigella flexneri 2a str. 301
cccagcaucugcauggugc

SEQ ID NO: 1989770 - RNA, 15 nt, Shigella flexneri 2a str. 301
cccagugcagugccu

SEQ ID NO: 1989771 - RNA, 16 nt, Shigella flexneri 2a str. 301
cccagugccagcacca

SEQ ID NO: 1989772 - RNA, 13 nt, Shigella flexneri 2a str. 301
cccaguaauucag

SEQ ID NO: 1989773 - RNA, 15 nt, Shigella flexneri 2a str. 301
cccaguagacagcaa

SEQ ID NO: 1989774 - RNA, 16 nt, Shigella flexneri 2a str. 301
cccaguagacgagccg

SEQ ID NO: 1989775 - RNA, 19 nt, Shigella flexneri 2a str. 301
ccaugcgaagaagggacua

SEQ ID NO: 1989776 - RNA, 13 nt, Shigella flexneri 2a str. 301
ccaugcggcaucu

SEQ ID NO: 1989777 - RNA, 16 nt, Shigella flexneri 2a str. 301
ccaugcugagcuucuu

SEQ ID NO: 1989778 - RNA, 19 nt, Shigella flexneri 2a str. 301
ccaugcguuuuaccgccuc

SEQ ID NO: 1989779 - RNA, 23 nt, Shigella flexneri 2a str. 301
ccaugcugugcgccacagacaua

SEQ ID NO: 1989780 - RNA, 14 nt, Shigella flexneri 2a str. 301
ccaugcugagcuuc

SEQ ID NO: 1989781 - RNA, 20 nt, Shigella flexneri 2a str. 301
ccauggcucaccagcagcgg

SEQ ID NO: 1989782 - RNA, 20 nt, Shigella flexneri 2a str. 301
ccauguuauuaguguguaua

SEQ ID NO: 1989783 - RNA, 15 nt, Shigella flexneri 2a str. 301
ccauguugacuucaa

SEQ ID NO: 1989784 - RNA, 20 nt, Shigella flexneri 2a str. 301
ccaugucgguacagagcaau

SEQ ID NO: 1989785 - RNA, 16 nt, Shigella flexneri 2a str. 301
ccauuaacuacaccgu

SEQ ID NO: 1989786 - RNA, 14 nt, Shigella flexneri 2a str. 301
ccauuaccgccacu

SEQ ID NO: 1989787 - RNA, 17 nt, Shigella flexneri 2a str. 301
ccauuacaagcccgcug

SEQ ID NO: 1989788 - RNA, 12 nt, Shigella flexneri 2a str. 301
ccauuaaacacc

SEQ ID NO: 1989789 - RNA, 13 nt, Shigella flexneri 2a str. 301
ccauuaaaagaau

SEQ ID NO: 1989790 - RNA, 15 nt, Shigella flexneri 2a str. 301
ccauuaacauuaacu

SEQ ID NO: 1989791 - RNA, 23 nt, Shigella flexneri 2a str. 301
ccauguuuaauucacgcaggcga

SEQ ID NO: 1989792 - RNA, 21 nt, Shigella flexneri 2a str. 301
ccauuagcaaauuauccccca

SEQ ID NO: 1989793 - RNA, 19 nt, Shigella flexneri 2a str. 301
ccauuagacaguuugccuu

SEQ ID NO: 1989794 - RNA, 20 nt, Shigella flexneri 2a str. 301
ccauuagcaaauuauccccc

SEQ ID NO: 1989795 - RNA, 17 nt, Shigella flexneri 2a str. 301
ccauucaccauuuuuua

SEQ ID NO: 1989796 - RNA, 13 nt, Shigella flexneri 2a str. 301
ccauuauuucaau

SEQ ID NO: 1989797 - RNA, 13 nt, Shigella flexneri 2a str. 301
ccauuggcaggcu

SEQ ID NO: 1989798 - RNA, 19 nt, Shigella flexneri 2a str. 301
ccauuggcggcguccugga

SEQ ID NO: 1989799 - RNA, 15 nt, Shigella flexneri 2a str. 301
ccauugggccacuca

SEQ ID NO: 1989800 - RNA, 22 nt, Shigella flexneri 2a str. 301
ccauuccaguaauugacgcauc

SEQ ID NO: 1989801 - RNA, 19 nt, Shigella flexneri 2a str. 301
ccauucccccuuugaccag

SEQ ID NO: 1989802 - RNA, 17 nt, Shigella flexneri 2a str. 301
ccauucguuauaaugcu

SEQ ID NO: 1989803 - RNA, 22 nt, Shigella flexneri 2a str. 301
cccaauguagccgcacgcuggc

SEQ ID NO: 1989804 - RNA, 11 nt, Shigella flexneri 2a str. 301
cccaaugaccu

SEQ ID NO: 1989805 - RNA, 13 nt, Shigella flexneri 2a str. 301
cccaaugaccuuu

SEQ ID NO: 1989806 - RNA, 20 nt, Shigella flexneri 2a str. 301
cccaaucucaccaaucgaaa

SEQ ID NO: 1989807 - RNA, 19 nt, Shigella flexneri 2a str. 301
cccacaguuucauaucugc

SEQ ID NO: 1989808 - RNA, 15 nt, Shigella flexneri 2a str. 301
cccacauccaugugg

SEQ ID NO: 1989809 - RNA, 21 nt, Shigella flexneri 2a str. 301
cccacauguugcgcuucacca

SEQ ID NO: 1989810 - RNA, 19 nt, Shigella flexneri 2a str. 301
cccaccccagcagcagccg

SEQ ID NO: 1989811 - RNA, 20 nt, Shigella flexneri 2a str. 301
cccaauccaguacaugaagc

SEQ ID NO: 1989812 - RNA, 18 nt, Shigella flexneri 2a str. 301
cccaacgugaccaguacc

SEQ ID NO: 1989813 - RNA, 17 nt, Shigella flexneri 2a str. 301
cccaacguaacaaaacu

SEQ ID NO: 1989814 - RNA, 14 nt, Shigella flexneri 2a str. 301
cccaacguaacaaa

SEQ ID NO: 1989815 - RNA, 15 nt, Shigella flexneri 2a str. 301
cccacgccagccugc

SEQ ID NO: 1989816 - RNA, 17 nt, Shigella flexneri 2a str. 301
cccacucgccccgagaa

SEQ ID NO: 1989817 - RNA, 12 nt, Shigella flexneri 2a str. 301
cccacugcaugg

SEQ ID NO: 1989818 - RNA, 19 nt, Shigella flexneri 2a str. 301
cccacgauguauccggcaa

SEQ ID NO: 1989819 - RNA, 13 nt, Shigella flexneri 2a str. 301
cccaccccagcag

SEQ ID NO: 1989820 - RNA, 18 nt, Shigella flexneri 2a str. 301
cccacuggaaguuauagc

SEQ ID NO: 1989821 - RNA, 18 nt, Shigella flexneri 2a str. 301
cccacugugggauugcuu

SEQ ID NO: 1989822 - RNA, 17 nt, Shigella flexneri 2a str. 301
cccacuuucugcgcaau

SEQ ID NO: 1989823 - RNA, 16 nt, Shigella flexneri 2a str. 301
cccacuuucugcgcaa

SEQ ID NO: 1989824 - RNA, 19 nt, Shigella flexneri 2a str. 301
cccacuuucaggccagcgg

SEQ ID NO: 1989825 - RNA, 19 nt, Shigella flexneri 2a str. 301
cccacuuuuauuucacccc

SEQ ID NO: 1989826 - RNA, 16 nt, Shigella flexneri 2a str. 301
cccagaacuaucauac

SEQ ID NO: 1989827 - RNA, 18 nt, Shigella flexneri 2a str. 301
cccagaccugcguucagc

SEQ ID NO: 1989828 - RNA, 14 nt, Shigella flexneri 2a str. 301
cccagacgagagug

SEQ ID NO: 1989829 - RNA, 22 nt, Shigella flexneri 2a str. 301
cccagaccuaacuuggcaaagc

SEQ ID NO: 1989830 - RNA, 17 nt, Shigella flexneri 2a str. 301
cccagacguuucgccag

SEQ ID NO: 1989831 - RNA, 20 nt, Shigella flexneri 2a str. 301
cccagacguuucgccagccg

SEQ ID NO: 1989832 - RNA, 21 nt, Shigella flexneri 2a str. 301
cccagaagcuuuccaucggag

SEQ ID NO: 1989833 - RNA, 17 nt, Shigella flexneri 2a str. 301
cccagaacaacccggcg

SEQ ID NO: 1989834 - RNA, 18 nt, Shigella flexneri 2a str. 301
cccagaauguuaacgcca

SEQ ID NO: 1989835 - RNA, 22 nt, Shigella flexneri 2a str. 301
cccagaaucucuuuuguuuccc

SEQ ID NO: 1989836 - RNA, 15 nt, Shigella flexneri 2a str. 301
cccagcaucacgccc

SEQ ID NO: 1989837 - RNA, 22 nt, Shigella flexneri 2a str. 301
cccagcaucacgcccgcuuuuu

SEQ ID NO: 1989838 - RNA, 15 nt, Shigella flexneri 2a str. 301
cccagauagcaacag

SEQ ID NO: 1989839 - RNA, 15 nt, Shigella flexneri 2a str. 301
cgaccgaacagauca

SEQ ID NO: 1989840 - RNA, 19 nt, Shigella flexneri 2a str. 301
cgaccuaaacguuuaaaaa

SEQ ID NO: 1989841 - RNA, 18 nt, Shigella flexneri 2a str. 301
cgaccuacgcgcccgcgc

SEQ ID NO: 1989842 - RNA, 18 nt, Shigella flexneri 2a str. 301
cgaccugcgccugcacca

SEQ ID NO: 1989843 - RNA, 12 nt, Shigella flexneri 2a str. 301
cgaccugauuuu

SEQ ID NO: 1989844 - RNA, 15 nt, Shigella flexneri 2a str. 301
cgaccguuccauuca

SEQ ID NO: 1989845 - RNA, 12 nt, Shigella flexneri 2a str. 301
cgacgauugcuu

SEQ ID NO: 1989846 - RNA, 20 nt, Shigella flexneri 2a str. 301
cgacgcaaacgacgagcgcu

SEQ ID NO: 1989847 - RNA, 20 nt, Shigella flexneri 2a str. 301
cgacgacugccgcucaccug

SEQ ID NO: 1989848 - RNA, 14 nt, Shigella flexneri 2a str. 301
cgacgacgcgcgcg

SEQ ID NO: 1989849 - RNA, 15 nt, Shigella flexneri 2a str. 301
cgacgaacagcucag

SEQ ID NO: 1989850 - RNA, 14 nt, Shigella flexneri 2a str. 301
cgaccuugcaauaa

SEQ ID NO: 1989851 - RNA, 15 nt, Shigella flexneri 2a str. 301
cgaccuugcaauaau

SEQ ID NO: 1989852 - RNA, 12 nt, Shigella flexneri 2a str. 301
cgaccacuucau

SEQ ID NO: 1989853 - RNA, 15 nt, Shigella flexneri 2a str. 301
cgaccacucuuucga

SEQ ID NO: 1989854 - RNA, 12 nt, Shigella flexneri 2a str. 301
cgaccagaaaug

SEQ ID NO: 1989855 - RNA, 14 nt, Shigella flexneri 2a str. 301
cgaccagaaaugca

SEQ ID NO: 1989856 - RNA, 21 nt, Shigella flexneri 2a str. 301
cgaccagauaagaacugacuu

SEQ ID NO: 1989857 - RNA, 18 nt, Shigella flexneri 2a str. 301
cgaccagaauaagucugg

SEQ ID NO: 1989858 - RNA, 12 nt, Shigella flexneri 2a str. 301
cgaccaccagcg

SEQ ID NO: 1989859 - RNA, 17 nt, Shigella flexneri 2a str. 301
cgaccacccaccgcagc

SEQ ID NO: 1989860 - RNA, 18 nt, Shigella flexneri 2a str. 301
cgaccauacagcagcaac

SEQ ID NO: 1989861 - RNA, 19 nt, Shigella flexneri 2a str. 301
cgaccaggccaucagcagc

SEQ ID NO: 1989862 - RNA, 13 nt, Shigella flexneri 2a str. 301
cgaccaggcaaac

SEQ ID NO: 1989863 - RNA, 15 nt, Shigella flexneri 2a str. 301
cgacccgcgacuggu

SEQ ID NO: 1989864 - RNA, 19 nt, Shigella flexneri 2a str. 301
cgacccagccagacgccag

SEQ ID NO: 1989865 - RNA, 12 nt, Shigella flexneri 2a str. 301
cgacaucgccac

SEQ ID NO: 1989866 - RNA, 14 nt, Shigella flexneri 2a str. 301
cgacauagccaucc

SEQ ID NO: 1989867 - RNA, 15 nt, Shigella flexneri 2a str. 301
cgacauauucaccau

SEQ ID NO: 1989868 - RNA, 12 nt, Shigella flexneri 2a str. 301
cgacauggcaac

SEQ ID NO: 1989869 - RNA, 19 nt, Shigella flexneri 2a str. 301
cgacauggcaauagcuucu

SEQ ID NO: 1989870 - RNA, 19 nt, Shigella flexneri 2a str. 301
cgacauggcgaaaauuggu

SEQ ID NO: 1989871 - RNA, 14 nt, Shigella flexneri 2a str. 301
cgaccaaaugaaac

SEQ ID NO: 1989872 - RNA, 18 nt, Shigella flexneri 2a str. 301
cgacauugauguuuucag

SEQ ID NO: 1989873 - RNA, 14 nt, Shigella flexneri 2a str. 301
cgacauuuccuggc

SEQ ID NO: 1989874 - RNA, 16 nt, Shigella flexneri 2a str. 301
cgacauuucugcugcc

SEQ ID NO: 1989875 - RNA, 23 nt, Shigella flexneri 2a str. 301
cgacagccauaaagaaaucaccu

SEQ ID NO: 1989876 - RNA, 18 nt, Shigella flexneri 2a str. 301
cgacagcgaaaucccuuc

SEQ ID NO: 1989877 - RNA, 17 nt, Shigella flexneri 2a str. 301
cgacaguuucaccugcu

SEQ ID NO: 1989878 - RNA, 23 nt, Shigella flexneri 2a str. 301
cgacaguugcugcgugaccgcca

SEQ ID NO: 1989879 - RNA, 17 nt, Shigella flexneri 2a str. 301
cgacagggaucucuucc

SEQ ID NO: 1989880 - RNA, 15 nt, Shigella flexneri 2a str. 301
cgaauguggcagcaa

SEQ ID NO: 1989881 - RNA, 10 nt, Shigella flexneri 2a str. 301
cgaauuccaa

SEQ ID NO: 1989882 - RNA, 16 nt, Shigella flexneri 2a str. 301
cgaauucuaucaugca

SEQ ID NO: 1989883 - RNA, 16 nt, Shigella flexneri 2a str. 301
cgaauucauaagaagc

SEQ ID NO: 1989884 - RNA, 16 nt, Shigella flexneri 2a str. 301
cgaaugcgaaaauccu

SEQ ID NO: 1989885 - RNA, 13 nt, Shigella flexneri 2a str. 301
cgaaugacaugcc

SEQ ID NO: 1989886 - RNA, 13 nt, Shigella flexneri 2a str. 301
cgaauaccuucuu

SEQ ID NO: 1989887 - RNA, 15 nt, Shigella flexneri 2a str. 301
cgaauaagcugcgug

SEQ ID NO: 1989888 - RNA, 12 nt, Shigella flexneri 2a str. 301
cgaauacacccu

SEQ ID NO: 1989889 - RNA, 22 nt, Shigella flexneri 2a str. 301
cgaauacggauauguuuacuuc

SEQ ID NO: 1989890 - RNA, 22 nt, Shigella flexneri 2a str. 301
cgaauacuccccuuucuuauuu

SEQ ID NO: 1989891 - RNA, 23 nt, Shigella flexneri 2a str. 301
cgaaucaugguuuauuucccaga

SEQ ID NO: 1989892 - RNA, 12 nt, Shigella flexneri 2a str. 301
cgaauauuuccc

SEQ ID NO: 1989893 - RNA, 16 nt, Shigella flexneri 2a str. 301
cgaauccagcaugcuc

SEQ ID NO: 1989894 - RNA, 17 nt, Shigella flexneri 2a str. 301
cgacacgccuccuggcu

SEQ ID NO: 1989895 - RNA, 16 nt, Shigella flexneri 2a str. 301
cgacaccguuaaauaa

SEQ ID NO: 1989896 - RNA, 16 nt, Shigella flexneri 2a str. 301
cgacagacgacgacgc

SEQ ID NO: 1989897 - RNA, 19 nt, Shigella flexneri 2a str. 301
cgacacuggcagugugucu

SEQ ID NO: 1989898 - RNA, 14 nt, Shigella flexneri 2a str. 301
cgacagcagccccg

SEQ ID NO: 1989899 - RNA, 16 nt, Shigella flexneri 2a str. 301
cgacacaaccaccguu

SEQ ID NO: 1989900 - RNA, 15 nt, Shigella flexneri 2a str. 301
cgacacaauccaugc

SEQ ID NO: 1989901 - RNA, 23 nt, Shigella flexneri 2a str. 301
cgaauuuuccaugaccugccagg

SEQ ID NO: 1989902 - RNA, 20 nt, Shigella flexneri 2a str. 301
cgacaaaaauaccaccaaug

SEQ ID NO: 1989903 - RNA, 18 nt, Shigella flexneri 2a str. 301
cgacaaaaauuacugccu

SEQ ID NO: 1989904 - RNA, 15 nt, Shigella flexneri 2a str. 301
cgacaaacaccgaac

SEQ ID NO: 1989905 - RNA, 18 nt, Shigella flexneri 2a str. 301
cgaauuugaauauauaca

SEQ ID NO: 1989906 - RNA, 24 nt, Shigella flexneri 2a str. 301
cgaauuucauccuguacgacaaaa

SEQ ID NO: 1989907 - RNA, 18 nt, Shigella flexneri 2a str. 301
cgacaacugacgaaucaa

SEQ ID NO: 1989908 - RNA, 14 nt, Shigella flexneri 2a str. 301
cgacaaauguugca

SEQ ID NO: 1989909 - RNA, 13 nt, Shigella flexneri 2a str. 301
cgacaacagaaau

SEQ ID NO: 1989910 - RNA, 19 nt, Shigella flexneri 2a str. 301
cgacaaccugaccuuuuuu

SEQ ID NO: 1989911 - RNA, 20 nt, Shigella flexneri 2a str. 301
cgaagauguuguacagcgaa

SEQ ID NO: 1989912 - RNA, 14 nt, Shigella flexneri 2a str. 301
cgaagcauugcgcc

SEQ ID NO: 1989913 - RNA, 20 nt, Shigella flexneri 2a str. 301
cgaagcccagaaugcucagu

SEQ ID NO: 1989914 - RNA, 23 nt, Shigella flexneri 2a str. 301
cgaagcccaucaguacaccaccu

SEQ ID NO: 1989915 - RNA, 22 nt, Shigella flexneri 2a str. 301
cgaagaagugguucauguugcg

SEQ ID NO: 1989916 - RNA, 22 nt, Shigella flexneri 2a str. 301
cgaagacaaauuguuuaaucaa

SEQ ID NO: 1989917 - RNA, 13 nt, Shigella flexneri 2a str. 301
cgaagaaagcaau

SEQ ID NO: 1989918 - RNA, 20 nt, Shigella flexneri 2a str. 301
cgaagaaauagaaacuggcc

SEQ ID NO: 1989919 - RNA, 16 nt, Shigella flexneri 2a str. 301
cgaagagacaaaaaag

SEQ ID NO: 1989920 - RNA, 16 nt, Shigella flexneri 2a str. 301
cgaagagagcgccaga

SEQ ID NO: 1989921 - RNA, 22 nt, Shigella flexneri 2a str. 301
cgaagacaucgcagggaucauc

SEQ ID NO: 1989922 - RNA, 16 nt, Shigella flexneri 2a str. 301
cgaacuaaccgcgcuc

SEQ ID NO: 1989923 - RNA, 22 nt, Shigella flexneri 2a str. 301
cgaacucauacaccagcggcac

SEQ ID NO: 1989924 - RNA, 22 nt, Shigella flexneri 2a str. 301
cgaacgggauaaacgaaaugcg

SEQ ID NO: 1989925 - RNA, 15 nt, Shigella flexneri 2a str. 301
cgaacguacgcaauc

SEQ ID NO: 1989926 - RNA, 10 nt, Shigella flexneri 2a str. 301
cgaacgcugc

SEQ ID NO: 1989927 - RNA, 22 nt, Shigella flexneri 2a str. 301
cgaacggcgcgguuuccaccuu

SEQ ID NO: 1989928 - RNA, 19 nt, Shigella flexneri 2a str. 301
cgaacuccgccccggcaau

SEQ ID NO: 1989929 - RNA, 21 nt, Shigella flexneri 2a str. 301
cgaacuggaugaaaaaauccc

SEQ ID NO: 1989930 - RNA, 21 nt, Shigella flexneri 2a str. 301
cgaacugucgguuuguacucu

SEQ ID NO: 1989931 - RNA, 13 nt, Shigella flexneri 2a str. 301
cgaaggacggccg

SEQ ID NO: 1989932 - RNA, 19 nt, Shigella flexneri 2a str. 301
cgaaggaauuuuacagccc

SEQ ID NO: 1989933 - RNA, 15 nt, Shigella flexneri 2a str. 301
cgaagcgcaguuuaa

SEQ ID NO: 1989934 - RNA, 13 nt, Shigella flexneri 2a str. 301
cgaagcggcugcg

SEQ ID NO: 1989935 - RNA, 20 nt, Shigella flexneri 2a str. 301
cgaaggugccugcccagccg

SEQ ID NO: 1989936 - RNA, 15 nt, Shigella flexneri 2a str. 301
ccuucuccacaccgu

SEQ ID NO: 1989937 - RNA, 13 nt, Shigella flexneri 2a str. 301
ccuucucagcggu

SEQ ID NO: 1989938 - RNA, 14 nt, Shigella flexneri 2a str. 301
ccuucguucucugc

SEQ ID NO: 1989939 - RNA, 19 nt, Shigella flexneri 2a str. 301
ccuucuauaaggccccuuc

SEQ ID NO: 1989940 - RNA, 20 nt, Shigella flexneri 2a str. 301
ccuucuauaaggccccuucc

SEQ ID NO: 1989941 - RNA, 14 nt, Shigella flexneri 2a str. 301
ccuucgugcggcug

SEQ ID NO: 1989942 - RNA, 14 nt, Shigella flexneri 2a str. 301
ccuucggucagagu

SEQ ID NO: 1989943 - RNA, 20 nt, Shigella flexneri 2a str. 301
ccuucgguagcagcuuucag

SEQ ID NO: 1989944 - RNA, 22 nt, Shigella flexneri 2a str. 301
ccuucgguagcagcuuucagca

SEQ ID NO: 1989945 - RNA, 19 nt, Shigella flexneri 2a str. 301
ccuucugagaucaaugcgc

SEQ ID NO: 1989946 - RNA, 20 nt, Shigella flexneri 2a str. 301
ccuucugcacgccaggauuc

SEQ ID NO: 1989947 - RNA, 18 nt, Shigella flexneri 2a str. 301
ccuucugcgcccgcccgc

SEQ ID NO: 1989948 - RNA, 14 nt, Shigella flexneri 2a str. 301
ccuucuuccugcug

SEQ ID NO: 1989949 - RNA, 19 nt, Shigella flexneri 2a str. 301
ccuucuguggacugauuua

SEQ ID NO: 1989950 - RNA, 15 nt, Shigella flexneri 2a str. 301
ccuucuggcgacccg

SEQ ID NO: 1989951 - RNA, 20 nt, Shigella flexneri 2a str. 301
ccuucuuuacugcccgcuug

SEQ ID NO: 1989952 - RNA, 13 nt, Shigella flexneri 2a str. 301
ccuucuucugccg

SEQ ID NO: 1989953 - RNA, 13 nt, Shigella flexneri 2a str. 301
ccuucuucuuuca

SEQ ID NO: 1989954 - RNA, 12 nt, Shigella flexneri 2a str. 301
ccuucccuuuca

SEQ ID NO: 1989955 - RNA, 20 nt, Shigella flexneri 2a str. 301
ccuuccgcaauacagccagc

SEQ ID NO: 1989956 - RNA, 21 nt, Shigella flexneri 2a str. 301
ccuucccgucuacaaaaacug

SEQ ID NO: 1989957 - RNA, 17 nt, Shigella flexneri 2a str. 301
ccuuccccguucugcca

SEQ ID NO: 1989958 - RNA, 19 nt, Shigella flexneri 2a str. 301
ccuuccugaacggucgagg

SEQ ID NO: 1989959 - RNA, 14 nt, Shigella flexneri 2a str. 301
ccuuccacaccacu

SEQ ID NO: 1989960 - RNA, 22 nt, Shigella flexneri 2a str. 301
ccuguuaagaagggcuggccaa

SEQ ID NO: 1989961 - RNA, 23 nt, Shigella flexneri 2a str. 301
ccuguuaaucagcuaauggcugc

SEQ ID NO: 1989962 - RNA, 15 nt, Shigella flexneri 2a str. 301
ccuguguccuguuga

SEQ ID NO: 1989963 - RNA, 16 nt, Shigella flexneri 2a str. 301
ccuucccagccgggaa

SEQ ID NO: 1989964 - RNA, 18 nt, Shigella flexneri 2a str. 301
ccuuccagcgcguucugu

SEQ ID NO: 1989965 - RNA, 20 nt, Shigella flexneri 2a str. 301
ccuucggggcuaaugccagu

SEQ ID NO: 1989966 - RNA, 23 nt, Shigella flexneri 2a str. 301
ccuucggggcggcuaucccaaag

SEQ ID NO: 1989967 - RNA, 21 nt, Shigella flexneri 2a str. 301
ccuucgcggaauuucagaaaa

SEQ ID NO: 1989968 - RNA, 13 nt, Shigella flexneri 2a str. 301
ccuucgccaccgu

SEQ ID NO: 1989969 - RNA, 16 nt, Shigella flexneri 2a str. 301
ccuuccuuauuucuug

SEQ ID NO: 1989970 - RNA, 18 nt, Shigella flexneri 2a str. 301
ccuucgaagaucagcaua

SEQ ID NO: 1989971 - RNA, 19 nt, Shigella flexneri 2a str. 301
ccuucgagcgauacaucau

SEQ ID NO: 1989972 - RNA, 11 nt, Shigella flexneri 2a str. 301
ccuuguuucuu

SEQ ID NO: 1989973 - RNA, 15 nt, Shigella flexneri 2a str. 301
ccuugugcacgcgcu

SEQ ID NO: 1989974 - RNA, 14 nt, Shigella flexneri 2a str. 301
ccuuuaccaugcuu

SEQ ID NO: 1989975 - RNA, 19 nt, Shigella flexneri 2a str. 301
ccuuuacggcgcgucagau

SEQ ID NO: 1989976 - RNA, 18 nt, Shigella flexneri 2a str. 301
ccuugucaugcagcucca

SEQ ID NO: 1989977 - RNA, 16 nt, Shigella flexneri 2a str. 301
ccuugcaguugaucua

SEQ ID NO: 1989978 - RNA, 17 nt, Shigella flexneri 2a str. 301
ccuugaguuuuucaucc

SEQ ID NO: 1989979 - RNA, 14 nt, Shigella flexneri 2a str. 301
ccuugcguuucuga

SEQ ID NO: 1989980 - RNA, 21 nt, Shigella flexneri 2a str. 301
ccuugcguacaccaacaucac

SEQ ID NO: 1989981 - RNA, 18 nt, Shigella flexneri 2a str. 301
ccuugcugacuccccgau

SEQ ID NO: 1989982 - RNA, 17 nt, Shigella flexneri 2a str. 301
ccuugcggaaauuccag

SEQ ID NO: 1989983 - RNA, 20 nt, Shigella flexneri 2a str. 301
ccuugcggaaauuccagcgg

SEQ ID NO: 1989984 - RNA, 23 nt, Shigella flexneri 2a str. 301
ccuugccggaugcggcguaaaug

SEQ ID NO: 1989985 - RNA, 15 nt, Shigella flexneri 2a str. 301
ccuuucgaacccaac

SEQ ID NO: 1989986 - RNA, 14 nt, Shigella flexneri 2a str. 301
ccuuuccugacuca

SEQ ID NO: 1989987 - RNA, 17 nt, Shigella flexneri 2a str. 301
ccuuuccugacucagca

SEQ ID NO: 1989988 - RNA, 16 nt, Shigella flexneri 2a str. 301
ccuuucggcugcagca

SEQ ID NO: 1989989 - RNA, 18 nt, Shigella flexneri 2a str. 301
ccuuuccagucuucuugc

SEQ ID NO: 1989990 - RNA, 17 nt, Shigella flexneri 2a str. 301
ccuuuccccucuaccgc

SEQ ID NO: 1989991 - RNA, 14 nt, Shigella flexneri 2a str. 301
ccuuuauuuucugg

SEQ ID NO: 1989992 - RNA, 21 nt, Shigella flexneri 2a str. 301
ccuuucagauguuccgccauu

SEQ ID NO: 1989993 - RNA, 22 nt, Shigella flexneri 2a str. 301
ccuuucaugguugucaccgcca

SEQ ID NO: 1989994 - RNA, 13 nt, Shigella flexneri 2a str. 301
ccuuucagcgcau

SEQ ID NO: 1989995 - RNA, 23 nt, Shigella flexneri 2a str. 301
ccuuuaucgaaguacuccugcuc

SEQ ID NO: 1989996 - RNA, 18 nt, Shigella flexneri 2a str. 301
ccuuuaucgcgcagcaga

SEQ ID NO: 1989997 - RNA, 21 nt, Shigella flexneri 2a str. 301
ccuuucugcauccguucuucg

SEQ ID NO: 1989998 - RNA, 21 nt, Shigella flexneri 2a str. 301
ccuuucugaugcauaaaaaaa

SEQ ID NO: 1989999 - RNA, 18 nt, Shigella flexneri 2a str. 301
ccuuucuggacacagcgu

SEQ ID NO: 1990000 - RNA, 21 nt, Shigella flexneri 2a str. 301
ccuuucuguuccauaaucgcc

SEQ ID NO: 1990001 - RNA, 13 nt, Shigella flexneri 2a str. 301
ccuuugccaaaau

SEQ ID NO: 1990002 - RNA, 21 nt, Shigella flexneri 2a str. 301
ccuuugaaaauaacaucgcca

SEQ ID NO: 1990003 - RNA, 16 nt, Shigella flexneri 2a str. 301
ccuuugaacaaccaga

SEQ ID NO: 1990004 - RNA, 18 nt, Shigella flexneri 2a str. 301
ccuuugaaaauaacaucg

SEQ ID NO: 1990005 - RNA, 21 nt, Shigella flexneri 2a str. 301
ccuuugaccagccagucagua

SEQ ID NO: 1990006 - RNA, 15 nt, Shigella flexneri 2a str. 301
ccuuuuauuuaaccg

SEQ ID NO: 1990007 - RNA, 15 nt, Shigella flexneri 2a str. 301
ccuuugccuuccagc

SEQ ID NO: 1990008 - RNA, 16 nt, Shigella flexneri 2a str. 301
ccuuuguaugccuggc

SEQ ID NO: 1990009 - RNA, 16 nt, Shigella flexneri 2a str. 301
cgaaaagcuucuuccu

SEQ ID NO: 1990010 - RNA, 21 nt, Shigella flexneri 2a str. 301
cgaaaacgccaccgcgccggg

SEQ ID NO: 1990011 - RNA, 16 nt, Shigella flexneri 2a str. 301
cgaaaacaacuggcaa

SEQ ID NO: 1990012 - RNA, 20 nt, Shigella flexneri 2a str. 301
cgaaaaaagucauuaccagc

SEQ ID NO: 1990013 - RNA, 13 nt, Shigella flexneri 2a str. 301
cgaaaaaagggca

SEQ ID NO: 1990014 - RNA, 14 nt, Shigella flexneri 2a str. 301
cgaaaaaaauuacu

SEQ ID NO: 1990015 - RNA, 17 nt, Shigella flexneri 2a str. 301
cgaaaaaaauuacucau

SEQ ID NO: 1990016 - RNA, 16 nt, Shigella flexneri 2a str. 301
cgaaacaucaaaaagc

SEQ ID NO: 1990017 - RNA, 17 nt, Shigella flexneri 2a str. 301
cgaaacagggcuggaag

SEQ ID NO: 1990018 - RNA, 13 nt, Shigella flexneri 2a str. 301
cgaaaccacugca

SEQ ID NO: 1990019 - RNA, 20 nt, Shigella flexneri 2a str. 301
ccuuuuuugcggcuacacua

SEQ ID NO: 1990020 - RNA, 13 nt, Shigella flexneri 2a str. 301
cgaaaaaaaagaa

SEQ ID NO: 1990021 - RNA, 19 nt, Shigella flexneri 2a str. 301
cgaaaaaaaagaagaccug

SEQ ID NO: 1990022 - RNA, 22 nt, Shigella flexneri 2a str. 301
ccuuuucgccaccggcaaucug

SEQ ID NO: 1990023 - RNA, 21 nt, Shigella flexneri 2a str. 301
ccuuuuguuuguucuucucga

SEQ ID NO: 1990024 - RNA, 20 nt, Shigella flexneri 2a str. 301
ccuuuuguuuguucuucucg

SEQ ID NO: 1990025 - RNA, 15 nt, Shigella flexneri 2a str. 301
ccuuuuggcaaaggu

SEQ ID NO: 1990026 - RNA, 15 nt, Shigella flexneri 2a str. 301
cgaacagcugguuga

SEQ ID NO: 1990027 - RNA, 14 nt, Shigella flexneri 2a str. 301
cgaacaggauugcc

SEQ ID NO: 1990028 - RNA, 14 nt, Shigella flexneri 2a str. 301
cgaacagaccaaac

SEQ ID NO: 1990029 - RNA, 14 nt, Shigella flexneri 2a str. 301
cgaacagcacaacg

SEQ ID NO: 1990030 - RNA, 13 nt, Shigella flexneri 2a str. 301
cgaaccaggaaga

SEQ ID NO: 1990031 - RNA, 16 nt, Shigella flexneri 2a str. 301
cgaaccaggaagaugu

SEQ ID NO: 1990032 - RNA, 12 nt, Shigella flexneri 2a str. 301
cgaaccagcgga

SEQ ID NO: 1990033 - RNA, 14 nt, Shigella flexneri 2a str. 301
cgaacaugcggguc

SEQ ID NO: 1990034 - RNA, 22 nt, Shigella flexneri 2a str. 301
cgaaccggaccagcaacaaaua

SEQ ID NO: 1990035 - RNA, 23 nt, Shigella flexneri 2a str. 301
cgaaccggacgaucccaaccauu

SEQ ID NO: 1990036 - RNA, 16 nt, Shigella flexneri 2a str. 301
cgaaccucggaaugcc

SEQ ID NO: 1990037 - RNA, 15 nt, Shigella flexneri 2a str. 301
cgaaccauaaaauca

SEQ ID NO: 1990038 - RNA, 13 nt, Shigella flexneri 2a str. 301
cgaaccagugcuc

SEQ ID NO: 1990039 - RNA, 21 nt, Shigella flexneri 2a str. 301
cgaacgcagugauaacucaaa

SEQ ID NO: 1990040 - RNA, 17 nt, Shigella flexneri 2a str. 301
cgaaccuuggucgaagc

SEQ ID NO: 1990041 - RNA, 18 nt, Shigella flexneri 2a str. 301
cgaaaccguggcggaaau

SEQ ID NO: 1990042 - RNA, 17 nt, Shigella flexneri 2a str. 301
cgaaacccgcugccauc

SEQ ID NO: 1990043 - RNA, 16 nt, Shigella flexneri 2a str. 301
cgaaaccgacugccau

SEQ ID NO: 1990044 - RNA, 17 nt, Shigella flexneri 2a str. 301
cgaaacguuccagcgcg

SEQ ID NO: 1990045 - RNA, 21 nt, Shigella flexneri 2a str. 301
cgaaacgggcugauuucaccc

SEQ ID NO: 1990046 - RNA, 19 nt, Shigella flexneri 2a str. 301
cgaaagcuggcacugggau

SEQ ID NO: 1990047 - RNA, 17 nt, Shigella flexneri 2a str. 301
cgaaagcgucagcuuuc

SEQ ID NO: 1990048 - RNA, 12 nt, Shigella flexneri 2a str. 301
cgaaaguaccau

SEQ ID NO: 1990049 - RNA, 17 nt, Shigella flexneri 2a str. 301
cgaaagaggcgcagaug

SEQ ID NO: 1990050 - RNA, 21 nt, Shigella flexneri 2a str. 301
cgaacaccagcaguaaaccac

SEQ ID NO: 1990051 - RNA, 22 nt, Shigella flexneri 2a str. 301
cgaaauuuugcaacguccugca

SEQ ID NO: 1990052 - RNA, 20 nt, Shigella flexneri 2a str. 301
cgaaauggcugccaaugaua

SEQ ID NO: 1990053 - RNA, 19 nt, Shigella flexneri 2a str. 301
cgaaaucaccgccaccagc

SEQ ID NO: 1990054 - RNA, 21 nt, Shigella flexneri 2a str. 301
cgaaaucccuucguucucugc

SEQ ID NO: 1990055 - RNA, 16 nt, Shigella flexneri 2a str. 301
cgaaauaacugcuauu

SEQ ID NO: 1990056 - RNA, 12 nt, Shigella flexneri 2a str. 301
cgauggucuguu

SEQ ID NO: 1990057 - RNA, 20 nt, Shigella flexneri 2a str. 301
cgauggugaagucauugaag

SEQ ID NO: 1990058 - RNA, 18 nt, Shigella flexneri 2a str. 301
cgauggucagcuucaccu

SEQ ID NO: 1990059 - RNA, 18 nt, Shigella flexneri 2a str. 301
cgaugucgcccacuuuca

SEQ ID NO: 1990060 - RNA, 19 nt, Shigella flexneri 2a str. 301
cgaugugaacccugauuuc

SEQ ID NO: 1990061 - RNA, 19 nt, Shigella flexneri 2a str. 301
cgauggcaaacaaacugcg

SEQ ID NO: 1990062 - RNA, 19 nt, Shigella flexneri 2a str. 301
cgauggaaccguacagcau

SEQ ID NO: 1990063 - RNA, 23 nt, Shigella flexneri 2a str. 301
cgaugcgaucauuaacaccacgc

SEQ ID NO: 1990064 - RNA, 12 nt, Shigella flexneri 2a str. 301
cgaucacagcag

SEQ ID NO: 1990065 - RNA, 16 nt, Shigella flexneri 2a str. 301
cgauguuuucugccuc

SEQ ID NO: 1990066 - RNA, 22 nt, Shigella flexneri 2a str. 301
cgauucucugcguaacccacug

SEQ ID NO: 1990067 - RNA, 21 nt, Shigella flexneri 2a str. 301
cgauucgguucaauacccacu

SEQ ID NO: 1990068 - RNA, 15 nt, Shigella flexneri 2a str. 301
cgauucggcaaucac

SEQ ID NO: 1990069 - RNA, 22 nt, Shigella flexneri 2a str. 301
cgauucguuuggggguaaccca

SEQ ID NO: 1990070 - RNA, 17 nt, Shigella flexneri 2a str. 301
cgauucgcccugcauau

SEQ ID NO: 1990071 - RNA, 23 nt, Shigella flexneri 2a str. 301
cgauugauuuaucagguauugau

SEQ ID NO: 1990072 - RNA, 19 nt, Shigella flexneri 2a str. 301
cgauugucguguuaagccg

SEQ ID NO: 1990073 - RNA, 17 nt, Shigella flexneri 2a str. 301
cgauugucagcuggugg

SEQ ID NO: 1990074 - RNA, 18 nt, Shigella flexneri 2a str. 301
cgauuguaaucacauucg

SEQ ID NO: 1990075 - RNA, 14 nt, Shigella flexneri 2a str. 301
cgauuuaucgauuu

SEQ ID NO: 1990076 - RNA, 23 nt, Shigella flexneri 2a str. 301
cgauugugauucgauucacauuu

SEQ ID NO: 1990077 - RNA, 13 nt, Shigella flexneri 2a str. 301
cgcaaaaccucuu

SEQ ID NO: 1990078 - RNA, 13 nt, Shigella flexneri 2a str. 301
cgauuuuuuccag

SEQ ID NO: 1990079 - RNA, 16 nt, Shigella flexneri 2a str. 301
cgauuuuuuccagcgc

SEQ ID NO: 1990080 - RNA, 22 nt, Shigella flexneri 2a str. 301
cgauuuuggguuccacuucugc

SEQ ID NO: 1990081 - RNA, 16 nt, Shigella flexneri 2a str. 301
cgauuuuguaaaagaa

SEQ ID NO: 1990082 - RNA, 18 nt, Shigella flexneri 2a str. 301
cgauuuugccagccgcag

SEQ ID NO: 1990083 - RNA, 13 nt, Shigella flexneri 2a str. 301
cgauuuugaaguc

SEQ ID NO: 1990084 - RNA, 12 nt, Shigella flexneri 2a str. 301
cgauuuucaaaa

SEQ ID NO: 1990085 - RNA, 21 nt, Shigella flexneri 2a str. 301
cgauuugccgucucuuucaug

SEQ ID NO: 1990086 - RNA, 19 nt, Shigella flexneri 2a str. 301
cgauuucuacacccagccc

SEQ ID NO: 1990087 - RNA, 11 nt, Shigella flexneri 2a str. 301
cgauuucugac

SEQ ID NO: 1990088 - RNA, 15 nt, Shigella flexneri 2a str. 301
cgauuucuuuauccg

SEQ ID NO: 1990089 - RNA, 16 nt, Shigella flexneri 2a str. 301
cgcaccaccagcagcu

SEQ ID NO: 1990090 - RNA, 19 nt, Shigella flexneri 2a str. 301
cgcacgaggaacagcgcgc

SEQ ID NO: 1990091 - RNA, 17 nt, Shigella flexneri 2a str. 301
cgcaccgggcuuccggc

SEQ ID NO: 1990092 - RNA, 18 nt, Shigella flexneri 2a str. 301
cgcaccgugacaguaauc

SEQ ID NO: 1990093 - RNA, 22 nt, Shigella flexneri 2a str. 301
cgcacgcagggaguuaccgugu

SEQ ID NO: 1990094 - RNA, 16 nt, Shigella flexneri 2a str. 301
cgcagaucagaccaau

SEQ ID NO: 1990095 - RNA, 15 nt, Shigella flexneri 2a str. 301
cgcagauacagccuc

SEQ ID NO: 1990096 - RNA, 17 nt, Shigella flexneri 2a str. 301
cgcagagacaucaccaa

SEQ ID NO: 1990097 - RNA, 19 nt, Shigella flexneri 2a str. 301
cgcacgucagccucgcugg

SEQ ID NO: 1990098 - RNA, 17 nt, Shigella flexneri 2a str. 301
cgcacguugucagcaac

SEQ ID NO: 1990099 - RNA, 13 nt, Shigella flexneri 2a str. 301
cgcagacaccaga

SEQ ID NO: 1990100 - RNA, 22 nt, Shigella flexneri 2a str. 301
cgcagacaaucacaucacugcc

SEQ ID NO: 1990101 - RNA, 23 nt, Shigella flexneri 2a str. 301
cgcaaucgcccagcgcguaaaua

SEQ ID NO: 1990102 - RNA, 21 nt, Shigella flexneri 2a str. 301
cgcaaucgccuccagcgcugg

SEQ ID NO: 1990103 - RNA, 18 nt, Shigella flexneri 2a str. 301
cgcaaucagcaccgcgcg

SEQ ID NO: 1990104 - RNA, 12 nt, Shigella flexneri 2a str. 301
cgcaauguugcg

SEQ ID NO: 1990105 - RNA, 21 nt, Shigella flexneri 2a str. 301
cgcaauggccguuccggcaac

SEQ ID NO: 1990106 - RNA, 18 nt, Shigella flexneri 2a str. 301
cgcaauuuugacaauaau

SEQ ID NO: 1990107 - RNA, 22 nt, Shigella flexneri 2a str. 301
cgcacaauggcggugaucccaa

SEQ ID NO: 1990108 - RNA, 15 nt, Shigella flexneri 2a str. 301
cgcacauugguaauc

SEQ ID NO: 1990109 - RNA, 16 nt, Shigella flexneri 2a str. 301
cgcaaccaacggccuu

SEQ ID NO: 1990110 - RNA, 15 nt, Shigella flexneri 2a str. 301
cgcaaccagcgucag

SEQ ID NO: 1990111 - RNA, 14 nt, Shigella flexneri 2a str. 301
cgcaacagaccaga

SEQ ID NO: 1990112 - RNA, 18 nt, Shigella flexneri 2a str. 301
cgcaaaaccucuuccagc

SEQ ID NO: 1990113 - RNA, 18 nt, Shigella flexneri 2a str. 301
cgcaaaacguggccucca

SEQ ID NO: 1990114 - RNA, 21 nt, Shigella flexneri 2a str. 301
cgcaacagugaaauacaguua

SEQ ID NO: 1990115 - RNA, 18 nt, Shigella flexneri 2a str. 301
cgcaaaaucucacacuca

SEQ ID NO: 1990116 - RNA, 17 nt, Shigella flexneri 2a str. 301
cgcaacgccuaucacca

SEQ ID NO: 1990117 - RNA, 15 nt, Shigella flexneri 2a str. 301
cgcaacgccucaugc

SEQ ID NO: 1990118 - RNA, 20 nt, Shigella flexneri 2a str. 301
cgcaagcgaaugaggcagca

SEQ ID NO: 1990119 - RNA, 15 nt, Shigella flexneri 2a str. 301
cgcaagcggcaucca

SEQ ID NO: 1990120 - RNA, 20 nt, Shigella flexneri 2a str. 301
cgccagaccuaccaucuccu

SEQ ID NO: 1990121 - RNA, 21 nt, Shigella flexneri 2a str. 301
cgccagacugaucaucgccca

SEQ ID NO: 1990122 - RNA, 16 nt, Shigella flexneri 2a str. 301
cgccagagcuucaacc

SEQ ID NO: 1990123 - RNA, 16 nt, Shigella flexneri 2a str. 301
cgccagaacagcuaca

SEQ ID NO: 1990124 - RNA, 22 nt, Shigella flexneri 2a str. 301
cgccagaacgacgacugccgcu

SEQ ID NO: 1990125 - RNA, 18 nt, Shigella flexneri 2a str. 301
cgccagacaauugccgcc

SEQ ID NO: 1990126 - RNA, 17 nt, Shigella flexneri 2a str. 301
cgccagaagcguucggc

SEQ ID NO: 1990127 - RNA, 13 nt, Shigella flexneri 2a str. 301
cgccagaaaucag

SEQ ID NO: 1990128 - RNA, 19 nt, Shigella flexneri 2a str. 301
cgccagaacacgcucccag

SEQ ID NO: 1990129 - RNA, 16 nt, Shigella flexneri 2a str. 301
cgccacuuucacgccg

SEQ ID NO: 1990130 - RNA, 15 nt, Shigella flexneri 2a str. 301
cgccagaaaaccugg

SEQ ID NO: 1990131 - RNA, 20 nt, Shigella flexneri 2a str. 301
cgccagaaaaccuggcgcag

SEQ ID NO: 1990132 - RNA, 20 nt, Shigella flexneri 2a str. 301
cgccacgcuuaaccccgggc

SEQ ID NO: 1990133 - RNA, 12 nt, Shigella flexneri 2a str. 301
cgccacuucugc

SEQ ID NO: 1990134 - RNA, 19 nt, Shigella flexneri 2a str. 301
cgccacgcucacucaucac

SEQ ID NO: 1990135 - RNA, 16 nt, Shigella flexneri 2a str. 301
cgccaccgaccaggca

SEQ ID NO: 1990136 - RNA, 23 nt, Shigella flexneri 2a str. 301
cgccaagcagcgcgcagaacaua

SEQ ID NO: 1990137 - RNA, 22 nt, Shigella flexneri 2a str. 301
cgccaaguuuuuucuucccaag

SEQ ID NO: 1990138 - RNA, 13 nt, Shigella flexneri 2a str. 301
cgccaauaaucag

SEQ ID NO: 1990139 - RNA, 18 nt, Shigella flexneri 2a str. 301
cgccaauagcuggcaacg

SEQ ID NO: 1990140 - RNA, 20 nt, Shigella flexneri 2a str. 301
cgccaaucagcgcagcaccc

SEQ ID NO: 1990141 - RNA, 16 nt, Shigella flexneri 2a str. 301
cgccaaacccaccagc

SEQ ID NO: 1990142 - RNA, 20 nt, Shigella flexneri 2a str. 301
cgccaaagaaaccgcgcgau

SEQ ID NO: 1990143 - RNA, 17 nt, Shigella flexneri 2a str. 301
cgccaaacggauacgaa

SEQ ID NO: 1990144 - RNA, 15 nt, Shigella flexneri 2a str. 301
cgccaaagcggcagu

SEQ ID NO: 1990145 - RNA, 18 nt, Shigella flexneri 2a str. 301
cgccaaaucgcugcugcu

SEQ ID NO: 1990146 - RNA, 23 nt, Shigella flexneri 2a str. 301
cgccaaaucgauaaaacuucccg

SEQ ID NO: 1990147 - RNA, 15 nt, Shigella flexneri 2a str. 301
cgccaacgcaccuga

SEQ ID NO: 1990148 - RNA, 22 nt, Shigella flexneri 2a str. 301
cgccaaccgauaucuuuccggc

SEQ ID NO: 1990149 - RNA, 23 nt, Shigella flexneri 2a str. 301
cgccaaccguggcguaaaucauc

SEQ ID NO: 1990150 - RNA, 22 nt, Shigella flexneri 2a str. 301
cgcauuaagccaugaaugaugu

SEQ ID NO: 1990151 - RNA, 24 nt, Shigella flexneri 2a str. 301
cgcauuaaaaacccgccaugcaug

SEQ ID NO: 1990152 - RNA, 23 nt, Shigella flexneri 2a str. 301
cgcauggccguuauccugaucaa

SEQ ID NO: 1990153 - RNA, 13 nt, Shigella flexneri 2a str. 301
cgcauugcuggcu

SEQ ID NO: 1990154 - RNA, 23 nt, Shigella flexneri 2a str. 301
cgcauuuugacuagcucaauaaa

SEQ ID NO: 1990155 - RNA, 19 nt, Shigella flexneri 2a str. 301
cgcagcugcgcguuaucua

SEQ ID NO: 1990156 - RNA, 18 nt, Shigella flexneri 2a str. 301
cgcagcgguuucacagga

SEQ ID NO: 1990157 - RNA, 18 nt, Shigella flexneri 2a str. 301
cgcagcgguuugcgcauc

SEQ ID NO: 1990158 - RNA, 13 nt, Shigella flexneri 2a str. 301
cgcagcgucagca

SEQ ID NO: 1990159 - RNA, 17 nt, Shigella flexneri 2a str. 301
cgcagcuccagcccgcg

SEQ ID NO: 1990160 - RNA, 12 nt, Shigella flexneri 2a str. 301
cgcagcacggcg

SEQ ID NO: 1990161 - RNA, 18 nt, Shigella flexneri 2a str. 301
cgcagaugaagcuggcaa

SEQ ID NO: 1990162 - RNA, 19 nt, Shigella flexneri 2a str. 301
cgcagaugaagcuggcaaa

SEQ ID NO: 1990163 - RNA, 16 nt, Shigella flexneri 2a str. 301
cgcagauuaugccgcu

SEQ ID NO: 1990164 - RNA, 15 nt, Shigella flexneri 2a str. 301
cgcagauuucuucug

SEQ ID NO: 1990165 - RNA, 16 nt, Shigella flexneri 2a str. 301
cgcaggcgcaauggcg

SEQ ID NO: 1990166 - RNA, 19 nt, Shigella flexneri 2a str. 301
cgcaggcgcaauggcgcaa

SEQ ID NO: 1990167 - RNA, 23 nt, Shigella flexneri 2a str. 301
cgcagggaucauccacccgcagc

SEQ ID NO: 1990168 - RNA, 20 nt, Shigella flexneri 2a str. 301
cgcagggcuguuuaucguga

SEQ ID NO: 1990169 - RNA, 17 nt, Shigella flexneri 2a str. 301
cgcaggugauacugaca

SEQ ID NO: 1990170 - RNA, 21 nt, Shigella flexneri 2a str. 301
cgcaguguagcguaucugugg

SEQ ID NO: 1990171 - RNA, 21 nt, Shigella flexneri 2a str. 301
cgcagugagaagccaccgcgc

SEQ ID NO: 1990172 - RNA, 16 nt, Shigella flexneri 2a str. 301
cgcaucgggcaauggc

SEQ ID NO: 1990173 - RNA, 12 nt, Shigella flexneri 2a str. 301
cgcaucggucag

SEQ ID NO: 1990174 - RNA, 18 nt, Shigella flexneri 2a str. 301
cgcaucuacgcgggucag

SEQ ID NO: 1990175 - RNA, 21 nt, Shigella flexneri 2a str. 301
cgcaucugccggaaccagcca

SEQ ID NO: 1990176 - RNA, 17 nt, Shigella flexneri 2a str. 301
cgcaucugaccagaugc

SEQ ID NO: 1990177 - RNA, 21 nt, Shigella flexneri 2a str. 301
cgcaugcauuuucaauaacug

SEQ ID NO: 1990178 - RNA, 12 nt, Shigella flexneri 2a str. 301
cgcaucuucucc

SEQ ID NO: 1990179 - RNA, 23 nt, Shigella flexneri 2a str. 301
cgcaucuguuucgaucagcaauu

SEQ ID NO: 1990180 - RNA, 15 nt, Shigella flexneri 2a str. 301
cgcauccgacacugg

SEQ ID NO: 1990181 - RNA, 16 nt, Shigella flexneri 2a str. 301
cgcauccgacauugaa

SEQ ID NO: 1990182 - RNA, 15 nt, Shigella flexneri 2a str. 301
cgcauccgacauuug

SEQ ID NO: 1990183 - RNA, 19 nt, Shigella flexneri 2a str. 301
cgcauccggcauaaacaaa

SEQ ID NO: 1990184 - RNA, 15 nt, Shigella flexneri 2a str. 301
cgcauccggcaugaa

SEQ ID NO: 1990185 - RNA, 13 nt, Shigella flexneri 2a str. 301
cgcauccggcaag

SEQ ID NO: 1990186 - RNA, 17 nt, Shigella flexneri 2a str. 301
cgcauccggcauuuuac

SEQ ID NO: 1990187 - RNA, 18 nt, Shigella flexneri 2a str. 301
cgcauccggcauuuugug

SEQ ID NO: 1990188 - RNA, 13 nt, Shigella flexneri 2a str. 301
cgcauccggcauu

SEQ ID NO: 1990189 - RNA, 23 nt, Shigella flexneri 2a str. 301
cgcauccggcauucagugcaaau

SEQ ID NO: 1990190 - RNA, 21 nt, Shigella flexneri 2a str. 301
cgcauccgacaaauguguuca

SEQ ID NO: 1990191 - RNA, 17 nt, Shigella flexneri 2a str. 301
cgcaucccauuucucca

SEQ ID NO: 1990192 - RNA, 13 nt, Shigella flexneri 2a str. 301
cgcauccaccaga

SEQ ID NO: 1990193 - RNA, 22 nt, Shigella flexneri 2a str. 301
cgcaucaggcauugugcacgau

SEQ ID NO: 1990194 - RNA, 21 nt, Shigella flexneri 2a str. 301
cgcaucaggcauugugcucca

SEQ ID NO: 1990195 - RNA, 14 nt, Shigella flexneri 2a str. 301
cgcaucaauauuaa

SEQ ID NO: 1990196 - RNA, 15 nt, Shigella flexneri 2a str. 301
cgcaguuccgccagc

SEQ ID NO: 1990197 - RNA, 21 nt, Shigella flexneri 2a str. 301
cgcaguuccgccagcuugccg

SEQ ID NO: 1990198 - RNA, 15 nt, Shigella flexneri 2a str. 301
cgagccauaaacuga

SEQ ID NO: 1990199 - RNA, 12 nt, Shigella flexneri 2a str. 301
cgagcaggucag

SEQ ID NO: 1990200 - RNA, 16 nt, Shigella flexneri 2a str. 301
cgagcaggucagucag

SEQ ID NO: 1990201 - RNA, 18 nt, Shigella flexneri 2a str. 301
cgagcaggucagucagug

SEQ ID NO: 1990202 - RNA, 24 nt, Shigella flexneri 2a str. 301
cgagcaggucagucaguggcagca

SEQ ID NO: 1990203 - RNA, 16 nt, Shigella flexneri 2a str. 301
cgagcaaagcgcagcc

SEQ ID NO: 1990204 - RNA, 22 nt, Shigella flexneri 2a str. 301
cgagcaaaucgcggcaguggcu

SEQ ID NO: 1990205 - RNA, 23 nt, Shigella flexneri 2a str. 301
cgagcaauagacaguucuuccug

SEQ ID NO: 1990206 - RNA, 22 nt, Shigella flexneri 2a str. 301
cgagcaauaaaaacuccgccgc

SEQ ID NO: 1990207 - RNA, 19 nt, Shigella flexneri 2a str. 301
cgagauaaccccgcuugcu

SEQ ID NO: 1990208 - RNA, 13 nt, Shigella flexneri 2a str. 301
cgagauaauguuc

SEQ ID NO: 1990209 - RNA, 15 nt, Shigella flexneri 2a str. 301
cgagagaagagacag

SEQ ID NO: 1990210 - RNA, 16 nt, Shigella flexneri 2a str. 301
cgagauucuuaaaguc

SEQ ID NO: 1990211 - RNA, 20 nt, Shigella flexneri 2a str. 301
cgagauuagacggcgcaaca

SEQ ID NO: 1990212 - RNA, 15 nt, Shigella flexneri 2a str. 301
cgagaucggccagca

SEQ ID NO: 1990213 - RNA, 21 nt, Shigella flexneri 2a str. 301
cgagaauggacaccagcucag

SEQ ID NO: 1990214 - RNA, 14 nt, Shigella flexneri 2a str. 301
cgagaauaaaacag

SEQ ID NO: 1990215 - RNA, 23 nt, Shigella flexneri 2a str. 301
cgagaauaaaacaggcagcugcc

SEQ ID NO: 1990216 - RNA, 21 nt, Shigella flexneri 2a str. 301
cgagaaucagcgagacaacaa

SEQ ID NO: 1990217 - RNA, 22 nt, Shigella flexneri 2a str. 301
cgagacgguuaaaaacagccag

SEQ ID NO: 1990218 - RNA, 13 nt, Shigella flexneri 2a str. 301
cgagaagcaacug

SEQ ID NO: 1990219 - RNA, 21 nt, Shigella flexneri 2a str. 301
cgagaagcagcaacacaauca

SEQ ID NO: 1990220 - RNA, 22 nt, Shigella flexneri 2a str. 301
cgagaacgacauggcccagccc

SEQ ID NO: 1990221 - RNA, 14 nt, Shigella flexneri 2a str. 301
cgagaaauuuuuau

SEQ ID NO: 1990222 - RNA, 13 nt, Shigella flexneri 2a str. 301
cgagaaaaugacg

SEQ ID NO: 1990223 - RNA, 21 nt, Shigella flexneri 2a str. 301
cgagaaacuucacaucaccau

SEQ ID NO: 1990224 - RNA, 22 nt, Shigella flexneri 2a str. 301
cgacggcgggugacuucccgca

SEQ ID NO: 1990225 - RNA, 14 nt, Shigella flexneri 2a str. 301
cgacggcuggcaaa

SEQ ID NO: 1990226 - RNA, 21 nt, Shigella flexneri 2a str. 301
cgacggcuggacaaaauacug

SEQ ID NO: 1990227 - RNA, 13 nt, Shigella flexneri 2a str. 301
cgacguaauuuag

SEQ ID NO: 1990228 - RNA, 19 nt, Shigella flexneri 2a str. 301
cgacgucgauuucugggug

SEQ ID NO: 1990229 - RNA, 18 nt, Shigella flexneri 2a str. 301
cgacgucaguuuccagca

SEQ ID NO: 1990230 - RNA, 15 nt, Shigella flexneri 2a str. 301
cgacgcgccagcacc

SEQ ID NO: 1990231 - RNA, 23 nt, Shigella flexneri 2a str. 301
cgacgcgcuuuuacugcauucac

SEQ ID NO: 1990232 - RNA, 19 nt, Shigella flexneri 2a str. 301
cgacgcguccaggcucgcc

SEQ ID NO: 1990233 - RNA, 15 nt, Shigella flexneri 2a str. 301
cgacggcaucgccau

SEQ ID NO: 1990234 - RNA, 23 nt, Shigella flexneri 2a str. 301
cgacugcaaaccaugacgcacuu

SEQ ID NO: 1990235 - RNA, 18 nt, Shigella flexneri 2a str. 301
cgacuuauucuucaacaa

SEQ ID NO: 1990236 - RNA, 20 nt, Shigella flexneri 2a str. 301
cgacuugggcgauuuuugca

SEQ ID NO: 1990237 - RNA, 17 nt, Shigella flexneri 2a str. 301
cgacucaaccccagcca

SEQ ID NO: 1990238 - RNA, 15 nt, Shigella flexneri 2a str. 301
cgacucucugagcca

SEQ ID NO: 1990239 - RNA, 19 nt, Shigella flexneri 2a str. 301
cgacucgcaauuauaauac

SEQ ID NO: 1990240 - RNA, 23 nt, Shigella flexneri 2a str. 301
cgacucgccauuaacauuaacuc

SEQ ID NO: 1990241 - RNA, 19 nt, Shigella flexneri 2a str. 301
cgacuacgggcaccaguaa

SEQ ID NO: 1990242 - RNA, 20 nt, Shigella flexneri 2a str. 301
cgacuacaggacaucuugaa

SEQ ID NO: 1990243 - RNA, 16 nt, Shigella flexneri 2a str. 301
cgacguuuuacagcaa

SEQ ID NO: 1990244 - RNA, 18 nt, Shigella flexneri 2a str. 301
cgacguucugccaaacgc

SEQ ID NO: 1990245 - RNA, 19 nt, Shigella flexneri 2a str. 301
cgaguggcgauugccgcac

SEQ ID NO: 1990246 - RNA, 16 nt, Shigella flexneri 2a str. 301
cgaguccuuccagguc

SEQ ID NO: 1990247 - RNA, 17 nt, Shigella flexneri 2a str. 301
cgagucgcugagcgugc

SEQ ID NO: 1990248 - RNA, 20 nt, Shigella flexneri 2a str. 301
cgaguccuguugucuuucca

SEQ ID NO: 1990249 - RNA, 22 nt, Shigella flexneri 2a str. 301
cgaguauugucuccgcugagac

SEQ ID NO: 1990250 - RNA, 15 nt, Shigella flexneri 2a str. 301
cgaguaguuauauuc

SEQ ID NO: 1990251 - RNA, 15 nt, Shigella flexneri 2a str. 301
cgaguaaaaaaacau

SEQ ID NO: 1990252 - RNA, 19 nt, Shigella flexneri 2a str. 301
cgaguaaacaggggcugua

SEQ ID NO: 1990253 - RNA, 14 nt, Shigella flexneri 2a str. 301
cgaguagaucaaca

SEQ ID NO: 1990254 - RNA, 18 nt, Shigella flexneri 2a str. 301
cgagguacgcccagcgcu

SEQ ID NO: 1990255 - RNA, 19 nt, Shigella flexneri 2a str. 301
cgagguacgcuccagcagg

SEQ ID NO: 1990256 - RNA, 15 nt, Shigella flexneri 2a str. 301
cgagguccagcuccg

SEQ ID NO: 1990257 - RNA, 13 nt, Shigella flexneri 2a str. 301
cgaggucacacgc

SEQ ID NO: 1990258 - RNA, 17 nt, Shigella flexneri 2a str. 301
cgaggggaccgccccug

SEQ ID NO: 1990259 - RNA, 16 nt, Shigella flexneri 2a str. 301
cgagguuggcucauca

SEQ ID NO: 1990260 - RNA, 18 nt, Shigella flexneri 2a str. 301
cgaggugucuucgcgcac

SEQ ID NO: 1990261 - RNA, 22 nt, Shigella flexneri 2a str. 301
cgauaccaauguagccgcggau

SEQ ID NO: 1990262 - RNA, 21 nt, Shigella flexneri 2a str. 301
cgauacaucaucacugccagg

SEQ ID NO: 1990263 - RNA, 12 nt, Shigella flexneri 2a str. 301
cgauaccacccg

SEQ ID NO: 1990264 - RNA, 18 nt, Shigella flexneri 2a str. 301
cgauaccgcuguccacgc

SEQ ID NO: 1990265 - RNA, 19 nt, Shigella flexneri 2a str. 301
cgauauggacuuuaugaac

SEQ ID NO: 1990266 - RNA, 15 nt, Shigella flexneri 2a str. 301
cgauaugccggcauc

SEQ ID NO: 1990267 - RNA, 16 nt, Shigella flexneri 2a str. 301
cgauauugccaccugc

SEQ ID NO: 1990268 - RNA, 16 nt, Shigella flexneri 2a str. 301
cgauauucauuuugcu

SEQ ID NO: 1990269 - RNA, 23 nt, Shigella flexneri 2a str. 301
cgauagcgcacgcgcuucacaug

SEQ ID NO: 1990270 - RNA, 14 nt, Shigella flexneri 2a str. 301
cgauagcgccgcca

SEQ ID NO: 1990271 - RNA, 21 nt, Shigella flexneri 2a str. 301
cgauaggggggauugccgcga

SEQ ID NO: 1990272 - RNA, 13 nt, Shigella flexneri 2a str. 301
cgauaaugcccag

SEQ ID NO: 1990273 - RNA, 23 nt, Shigella flexneri 2a str. 301
cgauaauuaggauacuuaucugg

SEQ ID NO: 1990274 - RNA, 15 nt, Shigella flexneri 2a str. 301
cgauaauuuaugccu

SEQ ID NO: 1990275 - RNA, 19 nt, Shigella flexneri 2a str. 301
cgauaauauugaugcacac

SEQ ID NO: 1990276 - RNA, 15 nt, Shigella flexneri 2a str. 301
cgaguuuuucagucc

SEQ ID NO: 1990277 - RNA, 14 nt, Shigella flexneri 2a str. 301
cgauaacggucgua

SEQ ID NO: 1990278 - RNA, 15 nt, Shigella flexneri 2a str. 301
cgauaacucgcuuug

SEQ ID NO: 1990279 - RNA, 17 nt, Shigella flexneri 2a str. 301
cgauaagcaacgcggcg

SEQ ID NO: 1990280 - RNA, 22 nt, Shigella flexneri 2a str. 301
cgauaagguaucgcgaaaaaaa

SEQ ID NO: 1990281 - RNA, 23 nt, Shigella flexneri 2a str. 301
cgauaagguaucgcgaaaaaaaa

SEQ ID NO: 1990282 - RNA, 16 nt, Shigella flexneri 2a str. 301
cgauaaggcgcugaag

SEQ ID NO: 1990283 - RNA, 19 nt, Shigella flexneri 2a str. 301
cgaguucaucacaccaguc

SEQ ID NO: 1990284 - RNA, 18 nt, Shigella flexneri 2a str. 301
cgaguucauuaagcugcg

SEQ ID NO: 1990285 - RNA, 14 nt, Shigella flexneri 2a str. 301
cgaguucagaucag

SEQ ID NO: 1990286 - RNA, 20 nt, Shigella flexneri 2a str. 301
cgaguucggcuucauuggcg

SEQ ID NO: 1990287 - RNA, 16 nt, Shigella flexneri 2a str. 301
cgagccgguugccuga

SEQ ID NO: 1990288 - RNA, 22 nt, Shigella flexneri 2a str. 301
cgagccguuccuaacaugccac

SEQ ID NO: 1990289 - RNA, 19 nt, Shigella flexneri 2a str. 301
cgagcgccuuauccugccu

SEQ ID NO: 1990290 - RNA, 14 nt, Shigella flexneri 2a str. 301
cgagcugcccgcug

SEQ ID NO: 1990291 - RNA, 21 nt, Shigella flexneri 2a str. 301
cgagcgucauauagccgccuu

SEQ ID NO: 1990292 - RNA, 13 nt, Shigella flexneri 2a str. 301
cgagcguggaacu

SEQ ID NO: 1990293 - RNA, 14 nt, Shigella flexneri 2a str. 301
cgagcguggaacuu

SEQ ID NO: 1990294 - RNA, 16 nt, Shigella flexneri 2a str. 301
cgaggacagcaucguc

SEQ ID NO: 1990295 - RNA, 16 nt, Shigella flexneri 2a str. 301
cgaggcgcuggcagaa

SEQ ID NO: 1990296 - RNA, 15 nt, Shigella flexneri 2a str. 301
cgaggcgaacaugcg

SEQ ID NO: 1990297 - RNA, 18 nt, Shigella flexneri 2a str. 301
cgaggcucugauugccuu

SEQ ID NO: 1990298 - RNA, 19 nt, Shigella flexneri 2a str. 301
cgagggagaaaacccggcc

SEQ ID NO: 1990299 - RNA, 18 nt, Shigella flexneri 2a str. 301
cgagggaaaauaaaaugu

SEQ ID NO: 1990300 - RNA, 21 nt, Shigella flexneri 2a str. 301
cgaggcucugauugccuucca

SEQ ID NO: 1990301 - RNA, 18 nt, Shigella flexneri 2a str. 301
cgaggccauauuucacau

SEQ ID NO: 1990302 - RNA, 14 nt, Shigella flexneri 2a str. 301
cgaggccaauuugg

SEQ ID NO: 1990303 - RNA, 16 nt, Shigella flexneri 2a str. 301
cgaggccuaacaccau

SEQ ID NO: 1990304 - RNA, 16 nt, Shigella flexneri 2a str. 301
cgaggcaaccagcacg

SEQ ID NO: 1990305 - RNA, 12 nt, Shigella flexneri 2a str. 301
cgaggcaaagag

SEQ ID NO: 1990306 - RNA, 13 nt, Shigella flexneri 2a str. 301
cgaggcacagcag

SEQ ID NO: 1990307 - RNA, 13 nt, Shigella flexneri 2a str. 301
ccggcucccgcag

SEQ ID NO: 1990308 - RNA, 16 nt, Shigella flexneri 2a str. 301
ccggcucccgcagcca

SEQ ID NO: 1990309 - RNA, 18 nt, Shigella flexneri 2a str. 301
ccggcguuuucaaccagc

SEQ ID NO: 1990310 - RNA, 14 nt, Shigella flexneri 2a str. 301
ccggcguuucacau

SEQ ID NO: 1990311 - RNA, 18 nt, Shigella flexneri 2a str. 301
ccggcgucgcauccggca

SEQ ID NO: 1990312 - RNA, 23 nt, Shigella flexneri 2a str. 301
ccggcguuaugccguaaugccag

SEQ ID NO: 1990313 - RNA, 13 nt, Shigella flexneri 2a str. 301
ccggcuugaacca

SEQ ID NO: 1990314 - RNA, 18 nt, Shigella flexneri 2a str. 301
ccggcuucaaagcagaaa

SEQ ID NO: 1990315 - RNA, 23 nt, Shigella flexneri 2a str. 301
ccggcuuaaugcauggcagauaa

SEQ ID NO: 1990316 - RNA, 18 nt, Shigella flexneri 2a str. 301
ccggcgguaaaucgccgc

SEQ ID NO: 1990317 - RNA, 15 nt, Shigella flexneri 2a str. 301
ccggcguccaccugc

SEQ ID NO: 1990318 - RNA, 17 nt, Shigella flexneri 2a str. 301
ccgggcucccggcggua

SEQ ID NO: 1990319 - RNA, 21 nt, Shigella flexneri 2a str. 301
ccgggagggaaccuguucaac

SEQ ID NO: 1990320 - RNA, 14 nt, Shigella flexneri 2a str. 301
ccgggagaaggccu

SEQ ID NO: 1990321 - RNA, 22 nt, Shigella flexneri 2a str. 301
ccgggaucaccgaaccagggcg

SEQ ID NO: 1990322 - RNA, 20 nt, Shigella flexneri 2a str. 301
ccggcuuguucaucaccauu

SEQ ID NO: 1990323 - RNA, 16 nt, Shigella flexneri 2a str. 301
ccggguuuuuuauuaa

SEQ ID NO: 1990324 - RNA, 18 nt, Shigella flexneri 2a str. 301
ccggguuuaacccuguac

SEQ ID NO: 1990325 - RNA, 12 nt, Shigella flexneri 2a str. 301
ccgguaaauaau

SEQ ID NO: 1990326 - RNA, 18 nt, Shigella flexneri 2a str. 301
ccggggcgcgugcuccag

SEQ ID NO: 1990327 - RNA, 20 nt, Shigella flexneri 2a str. 301
ccgggguucgaauccccgcc

SEQ ID NO: 1990328 - RNA, 15 nt, Shigella flexneri 2a str. 301
ccgguagucaccgcc

SEQ ID NO: 1990329 - RNA, 13 nt, Shigella flexneri 2a str. 301
ccgguauccagcg

SEQ ID NO: 1990330 - RNA, 14 nt, Shigella flexneri 2a str. 301
ccgguaagcauuua

SEQ ID NO: 1990331 - RNA, 15 nt, Shigella flexneri 2a str. 301
ccggucaaaugaccg

SEQ ID NO: 1990332 - RNA, 22 nt, Shigella flexneri 2a str. 301
ccggucaagcgcagcgcccccg

SEQ ID NO: 1990333 - RNA, 17 nt, Shigella flexneri 2a str. 301
ccggucgcuucuagugc

SEQ ID NO: 1990334 - RNA, 14 nt, Shigella flexneri 2a str. 301
ccgguccuggcgau

SEQ ID NO: 1990335 - RNA, 12 nt, Shigella flexneri 2a str. 301
ccgucagcgagu

SEQ ID NO: 1990336 - RNA, 15 nt, Shigella flexneri 2a str. 301
ccgucagccgcccgc

SEQ ID NO: 1990337 - RNA, 19 nt, Shigella flexneri 2a str. 301
ccgucagcggcaauucuuu

SEQ ID NO: 1990338 - RNA, 16 nt, Shigella flexneri 2a str. 301
ccgucgagcagagaaa

SEQ ID NO: 1990339 - RNA, 22 nt, Shigella flexneri 2a str. 301
ccgucgagcagagaaacgccag

SEQ ID NO: 1990340 - RNA, 18 nt, Shigella flexneri 2a str. 301
ccgucgcgcccuccugca

SEQ ID NO: 1990341 - RNA, 14 nt, Shigella flexneri 2a str. 301
ccgucgucccuucc

SEQ ID NO: 1990342 - RNA, 17 nt, Shigella flexneri 2a str. 301
ccgucguagccaccauc

SEQ ID NO: 1990343 - RNA, 16 nt, Shigella flexneri 2a str. 301
ccgucgggucagcucc

SEQ ID NO: 1990344 - RNA, 14 nt, Shigella flexneri 2a str. 301
ccggugagcugcau

SEQ ID NO: 1990345 - RNA, 16 nt, Shigella flexneri 2a str. 301
ccggugaccaucagca

SEQ ID NO: 1990346 - RNA, 11 nt, Shigella flexneri 2a str. 301
ccggugcauuc

SEQ ID NO: 1990347 - RNA, 16 nt, Shigella flexneri 2a str. 301
ccgguuuugcaggaaa

SEQ ID NO: 1990348 - RNA, 12 nt, Shigella flexneri 2a str. 301
ccgguuuuucaa

SEQ ID NO: 1990349 - RNA, 18 nt, Shigella flexneri 2a str. 301
ccgguuuuacuuugccuu

SEQ ID NO: 1990350 - RNA, 21 nt, Shigella flexneri 2a str. 301
ccgguuuuacagaaucuggcc

SEQ ID NO: 1990351 - RNA, 21 nt, Shigella flexneri 2a str. 301
ccguaaccaccagcacugauu

SEQ ID NO: 1990352 - RNA, 19 nt, Shigella flexneri 2a str. 301
ccguaacgcccuucaggug

SEQ ID NO: 1990353 - RNA, 18 nt, Shigella flexneri 2a str. 301
ccguacgcaucaccagac

SEQ ID NO: 1990354 - RNA, 17 nt, Shigella flexneri 2a str. 301
ccguaagcaacgccaaa

SEQ ID NO: 1990355 - RNA, 23 nt, Shigella flexneri 2a str. 301
ccguacugaaugaucacuuguuc

SEQ ID NO: 1990356 - RNA, 21 nt, Shigella flexneri 2a str. 301
ccguacugacggcguucuuua

SEQ ID NO: 1990357 - RNA, 15 nt, Shigella flexneri 2a str. 301
ccguagcguucuuug

SEQ ID NO: 1990358 - RNA, 18 nt, Shigella flexneri 2a str. 301
ccguauaauaucuuuucu

SEQ ID NO: 1990359 - RNA, 14 nt, Shigella flexneri 2a str. 301
ccguaguuccacau

SEQ ID NO: 1990360 - RNA, 13 nt, Shigella flexneri 2a str. 301
ccguaguggccac

SEQ ID NO: 1990361 - RNA, 21 nt, Shigella flexneri 2a str. 301
ccgucagcaaaauacugaaca

SEQ ID NO: 1990362 - RNA, 14 nt, Shigella flexneri 2a str. 301
ccgucacuucuucg

SEQ ID NO: 1990363 - RNA, 19 nt, Shigella flexneri 2a str. 301
ccguaguccauacccagca

SEQ ID NO: 1990364 - RNA, 12 nt, Shigella flexneri 2a str. 301
ccguagugaaaa

SEQ ID NO: 1990365 - RNA, 13 nt, Shigella flexneri 2a str. 301
ccuaccaaaccug

SEQ ID NO: 1990366 - RNA, 18 nt, Shigella flexneri 2a str. 301
ccuacagguaagguaaug

SEQ ID NO: 1990367 - RNA, 14 nt, Shigella flexneri 2a str. 301
ccuaacauuuuacu

SEQ ID NO: 1990368 - RNA, 16 nt, Shigella flexneri 2a str. 301
ccuaacaucauccccg

SEQ ID NO: 1990369 - RNA, 13 nt, Shigella flexneri 2a str. 301
ccuaacaucaucc

SEQ ID NO: 1990370 - RNA, 15 nt, Shigella flexneri 2a str. 301
ccuaacacaugcaag

SEQ ID NO: 1990371 - RNA, 17 nt, Shigella flexneri 2a str. 301
ccuaacaaccaucccca

SEQ ID NO: 1990372 - RNA, 14 nt, Shigella flexneri 2a str. 301
ccguuuucaccuua

SEQ ID NO: 1990373 - RNA, 20 nt, Shigella flexneri 2a str. 301
ccguuuuccagccuuuuucu

SEQ ID NO: 1990374 - RNA, 12 nt, Shigella flexneri 2a str. 301
ccguuucuccac

SEQ ID NO: 1990375 - RNA, 19 nt, Shigella flexneri 2a str. 301
ccguuugcgucaguuuuug

SEQ ID NO: 1990376 - RNA, 16 nt, Shigella flexneri 2a str. 301
ccguuucgcagguucc

SEQ ID NO: 1990377 - RNA, 17 nt, Shigella flexneri 2a str. 301
ccguuuccucaagcgga

SEQ ID NO: 1990378 - RNA, 17 nt, Shigella flexneri 2a str. 301
ccguuucagccccuugc

SEQ ID NO: 1990379 - RNA, 16 nt, Shigella flexneri 2a str. 301
ccguuuaccccaguca

SEQ ID NO: 1990380 - RNA, 16 nt, Shigella flexneri 2a str. 301
ccguugcgcgucaacu

SEQ ID NO: 1990381 - RNA, 15 nt, Shigella flexneri 2a str. 301
ccguugcgccaacca

SEQ ID NO: 1990382 - RNA, 18 nt, Shigella flexneri 2a str. 301
ccguuggcagaccgccaa

SEQ ID NO: 1990383 - RNA, 21 nt, Shigella flexneri 2a str. 301
ccguuggcagaccgccaacca

SEQ ID NO: 1990384 - RNA, 18 nt, Shigella flexneri 2a str. 301
ccguugauuuuauuggca

SEQ ID NO: 1990385 - RNA, 19 nt, Shigella flexneri 2a str. 301
ccgugcaucuccugaaaca

SEQ ID NO: 1990386 - RNA, 24 nt, Shigella flexneri 2a str. 301
ccgugagcggaacggcaggaauac

SEQ ID NO: 1990387 - RNA, 14 nt, Shigella flexneri 2a str. 301
ccgugaauuacugc

SEQ ID NO: 1990388 - RNA, 17 nt, Shigella flexneri 2a str. 301
ccgugaagguugcgccu

SEQ ID NO: 1990389 - RNA, 20 nt, Shigella flexneri 2a str. 301
ccgugaaaacagcaaccucc

SEQ ID NO: 1990390 - RNA, 14 nt, Shigella flexneri 2a str. 301
ccguggauuuaaug

SEQ ID NO: 1990391 - RNA, 23 nt, Shigella flexneri 2a str. 301
ccguggugaguuguggcgcgucg

SEQ ID NO: 1990392 - RNA, 19 nt, Shigella flexneri 2a str. 301
ccgugguggcagccagcca

SEQ ID NO: 1990393 - RNA, 13 nt, Shigella flexneri 2a str. 301
ccgugcgcuuuuu

SEQ ID NO: 1990394 - RNA, 18 nt, Shigella flexneri 2a str. 301
ccgugcugacucagcggc

SEQ ID NO: 1990395 - RNA, 21 nt, Shigella flexneri 2a str. 301
ccgugcugacucagcggcugc

SEQ ID NO: 1990396 - RNA, 17 nt, Shigella flexneri 2a str. 301
ccgugcugacucagcgg

SEQ ID NO: 1990397 - RNA, 22 nt, Shigella flexneri 2a str. 301
ccguucauauggagcaaaagug

SEQ ID NO: 1990398 - RNA, 17 nt, Shigella flexneri 2a str. 301
ccguuccacccagcuca

SEQ ID NO: 1990399 - RNA, 16 nt, Shigella flexneri 2a str. 301
ccgugguucauaugau

SEQ ID NO: 1990400 - RNA, 23 nt, Shigella flexneri 2a str. 301
ccucccgcuguuuguucaagcgc

SEQ ID NO: 1990401 - RNA, 15 nt, Shigella flexneri 2a str. 301
ccuccaugaaaauag

SEQ ID NO: 1990402 - RNA, 18 nt, Shigella flexneri 2a str. 301
ccucccguuucccugucu

SEQ ID NO: 1990403 - RNA, 16 nt, Shigella flexneri 2a str. 301
ccucccguuucccugu

SEQ ID NO: 1990404 - RNA, 12 nt, Shigella flexneri 2a str. 301
ccuccgcaauau

SEQ ID NO: 1990405 - RNA, 11 nt, Shigella flexneri 2a str. 301
ccuccugcagc

SEQ ID NO: 1990406 - RNA, 13 nt, Shigella flexneri 2a str. 301
ccuccugcagcgu

SEQ ID NO: 1990407 - RNA, 21 nt, Shigella flexneri 2a str. 301
ccuccugucuucccugcugaa

SEQ ID NO: 1990408 - RNA, 14 nt, Shigella flexneri 2a str. 301
ccuccugucuuccc

SEQ ID NO: 1990409 - RNA, 15 nt, Shigella flexneri 2a str. 301
ccuccugucuucccu

SEQ ID NO: 1990410 - RNA, 17 nt, Shigella flexneri 2a str. 301
ccuccuguaccuucacg

SEQ ID NO: 1990411 - RNA, 11 nt, Shigella flexneri 2a str. 301
ccuccggcguu

SEQ ID NO: 1990412 - RNA, 12 nt, Shigella flexneri 2a str. 301
ccuccggcuggg

SEQ ID NO: 1990413 - RNA, 15 nt, Shigella flexneri 2a str. 301
ccuccaaaaaacaaa

SEQ ID NO: 1990414 - RNA, 17 nt, Shigella flexneri 2a str. 301
ccucauuccuccccgaa

SEQ ID NO: 1990415 - RNA, 14 nt, Shigella flexneri 2a str. 301
ccucauuucccugu

SEQ ID NO: 1990416 - RNA, 22 nt, Shigella flexneri 2a str. 301
ccuccagcuccucgaguccuuc

SEQ ID NO: 1990417 - RNA, 16 nt, Shigella flexneri 2a str. 301
ccuccagcuccgccag

SEQ ID NO: 1990418 - RNA, 14 nt, Shigella flexneri 2a str. 301
ccucaucaccacag

SEQ ID NO: 1990419 - RNA, 17 nt, Shigella flexneri 2a str. 301
ccuacgugcgcaauaac

SEQ ID NO: 1990420 - RNA, 17 nt, Shigella flexneri 2a str. 301
ccuacgcgcccgcgcag

SEQ ID NO: 1990421 - RNA, 22 nt, Shigella flexneri 2a str. 301
ccucaucgauauuaucuucauc

SEQ ID NO: 1990422 - RNA, 16 nt, Shigella flexneri 2a str. 301
ccucgaccaaaugaaa

SEQ ID NO: 1990423 - RNA, 14 nt, Shigella flexneri 2a str. 301
ccucgcuacgccag

SEQ ID NO: 1990424 - RNA, 18 nt, Shigella flexneri 2a str. 301
ccucguuuugccgccauc

SEQ ID NO: 1990425 - RNA, 14 nt, Shigella flexneri 2a str. 301
ccucguucuucccu

SEQ ID NO: 1990426 - RNA, 20 nt, Shigella flexneri 2a str. 301
ccucgucggcgguuuucauc

SEQ ID NO: 1990427 - RNA, 22 nt, Shigella flexneri 2a str. 301
ccucucccgaaugaccgccccu

SEQ ID NO: 1990428 - RNA, 18 nt, Shigella flexneri 2a str. 301
ccucguuucgcccugccu

SEQ ID NO: 1990429 - RNA, 15 nt, Shigella flexneri 2a str. 301
ccucucaugagcaga

SEQ ID NO: 1990430 - RNA, 16 nt, Shigella flexneri 2a str. 301
ccucuucggcagucac

SEQ ID NO: 1990431 - RNA, 11 nt, Shigella flexneri 2a str. 301
ccucuucuuuu

SEQ ID NO: 1990432 - RNA, 23 nt, Shigella flexneri 2a str. 301
ccugaaacgcggcguaaccgccc

SEQ ID NO: 1990433 - RNA, 13 nt, Shigella flexneri 2a str. 301
ccugaaaacgaaa

SEQ ID NO: 1990434 - RNA, 21 nt, Shigella flexneri 2a str. 301
ccucuuuuuauuuacucuccu

SEQ ID NO: 1990435 - RNA, 18 nt, Shigella flexneri 2a str. 301
ccugaaagcgugucaugu

SEQ ID NO: 1990436 - RNA, 13 nt, Shigella flexneri 2a str. 301
ccugaacaagcaa

SEQ ID NO: 1990437 - RNA, 13 nt, Shigella flexneri 2a str. 301
ccugaagaucaac

SEQ ID NO: 1990438 - RNA, 16 nt, Shigella flexneri 2a str. 301
ccugaagcguccgcuu

SEQ ID NO: 1990439 - RNA, 17 nt, Shigella flexneri 2a str. 301
ccugccugcagcugcuc

SEQ ID NO: 1990440 - RNA, 13 nt, Shigella flexneri 2a str. 301
ccugccugacgga

SEQ ID NO: 1990441 - RNA, 23 nt, Shigella flexneri 2a str. 301
ccugccugacggaaaucaugcaa

SEQ ID NO: 1990442 - RNA, 12 nt, Shigella flexneri 2a str. 301
ccugccugcagc

SEQ ID NO: 1990443 - RNA, 14 nt, Shigella flexneri 2a str. 301
ccugcgccagcggc

SEQ ID NO: 1990444 - RNA, 17 nt, Shigella flexneri 2a str. 301
ccugcgccugcaccauu

SEQ ID NO: 1990445 - RNA, 14 nt, Shigella flexneri 2a str. 301
ccugcgcaggaagc

SEQ ID NO: 1990446 - RNA, 13 nt, Shigella flexneri 2a str. 301
ccugcgcaggcau

SEQ ID NO: 1990447 - RNA, 15 nt, Shigella flexneri 2a str. 301
ccugcggcaacgcuc

SEQ ID NO: 1990448 - RNA, 19 nt, Shigella flexneri 2a str. 301
ccugcggcaccuaauaacu

SEQ ID NO: 1990449 - RNA, 17 nt, Shigella flexneri 2a str. 301
ccugcggcaccagcggu

SEQ ID NO: 1990450 - RNA, 17 nt, Shigella flexneri 2a str. 301
ccugcgcuuccugcaac

SEQ ID NO: 1990451 - RNA, 18 nt, Shigella flexneri 2a str. 301
ccugcgcggcaaugcgcc

SEQ ID NO: 1990452 - RNA, 18 nt, Shigella flexneri 2a str. 301
ccugcgcgcccgccgccu

SEQ ID NO: 1990453 - RNA, 16 nt, Shigella flexneri 2a str. 301
ccugcgcgcccgccgc

SEQ ID NO: 1990454 - RNA, 16 nt, Shigella flexneri 2a str. 301
ccugcggguucuuacc

SEQ ID NO: 1990455 - RNA, 14 nt, Shigella flexneri 2a str. 301
ccugcggugcagcc

SEQ ID NO: 1990456 - RNA, 23 nt, Shigella flexneri 2a str. 301
ccugcgggagcgcuuuuuuccug

SEQ ID NO: 1990457 - RNA, 20 nt, Shigella flexneri 2a str. 301
ccugcggcugcugaggcuga

SEQ ID NO: 1990458 - RNA, 22 nt, Shigella flexneri 2a str. 301
ccugcggcuggcacaauuaccu

SEQ ID NO: 1990459 - RNA, 17 nt, Shigella flexneri 2a str. 301
ccugcggcggcaucgcc

SEQ ID NO: 1990460 - RNA, 19 nt, Shigella flexneri 2a str. 301
ccugcggcugaccaccacc

SEQ ID NO: 1990461 - RNA, 11 nt, Shigella flexneri 2a str. 301
ccugcauaucg

SEQ ID NO: 1990462 - RNA, 18 nt, Shigella flexneri 2a str. 301
ccugcauacgacgugccg

SEQ ID NO: 1990463 - RNA, 22 nt, Shigella flexneri 2a str. 301
ccugccgcaggacgggcaauuc

SEQ ID NO: 1990464 - RNA, 18 nt, Shigella flexneri 2a str. 301
ccugaaugucuccauacu

SEQ ID NO: 1990465 - RNA, 22 nt, Shigella flexneri 2a str. 301
ccugcaacgguugauggcaguc

SEQ ID NO: 1990466 - RNA, 17 nt, Shigella flexneri 2a str. 301
ccugcaagguggucaga

SEQ ID NO: 1990467 - RNA, 15 nt, Shigella flexneri 2a str. 301
ccugaauaacaccag

SEQ ID NO: 1990468 - RNA, 22 nt, Shigella flexneri 2a str. 301
ccugaauaacaccagccagaau

SEQ ID NO: 1990469 - RNA, 12 nt, Shigella flexneri 2a str. 301
ccugaauaacac

SEQ ID NO: 1990470 - RNA, 13 nt, Shigella flexneri 2a str. 301
ccugaauaaacgc

SEQ ID NO: 1990471 - RNA, 16 nt, Shigella flexneri 2a str. 301
ccugcacgaccggguu

SEQ ID NO: 1990472 - RNA, 22 nt, Shigella flexneri 2a str. 301
ccugcacggagauauccagcgc

SEQ ID NO: 1990473 - RNA, 23 nt, Shigella flexneri 2a str. 301
ccugcacggagauauccagcgcc

SEQ ID NO: 1990474 - RNA, 19 nt, Shigella flexneri 2a str. 301
ccugcaccggugcauccac

SEQ ID NO: 1990475 - RNA, 21 nt, Shigella flexneri 2a str. 301
ccuguaucaggcuguguuuaa

SEQ ID NO: 1990476 - RNA, 21 nt, Shigella flexneri 2a str. 301
ccuguauuguuccacucuuuc

SEQ ID NO: 1990477 - RNA, 22 nt, Shigella flexneri 2a str. 301
ccuguauacgcauaucaacgcc

SEQ ID NO: 1990478 - RNA, 14 nt, Shigella flexneri 2a str. 301
ccuguccacaccca

SEQ ID NO: 1990479 - RNA, 17 nt, Shigella flexneri 2a str. 301
ccugucagacuuaagcc

SEQ ID NO: 1990480 - RNA, 13 nt, Shigella flexneri 2a str. 301
ccugugcgcccug

SEQ ID NO: 1990481 - RNA, 18 nt, Shigella flexneri 2a str. 301
ccugugcgcccuguucug

SEQ ID NO: 1990482 - RNA, 18 nt, Shigella flexneri 2a str. 301
ccuguggacgcagcucau

SEQ ID NO: 1990483 - RNA, 23 nt, Shigella flexneri 2a str. 301
ccugucgggugcuuuuuucaauu

SEQ ID NO: 1990484 - RNA, 18 nt, Shigella flexneri 2a str. 301
ccugucgcuuugacugcu

SEQ ID NO: 1990485 - RNA, 14 nt, Shigella flexneri 2a str. 301
ccugucgaggccaa

SEQ ID NO: 1990486 - RNA, 18 nt, Shigella flexneri 2a str. 301
ccugggcuucauccagca

SEQ ID NO: 1990487 - RNA, 15 nt, Shigella flexneri 2a str. 301
ccugguaccagcacc

SEQ ID NO: 1990488 - RNA, 20 nt, Shigella flexneri 2a str. 301
ccuguacgucgagaauaucg

SEQ ID NO: 1990489 - RNA, 16 nt, Shigella flexneri 2a str. 301
ccuguacggcagugaa

SEQ ID NO: 1990490 - RNA, 14 nt, Shigella flexneri 2a str. 301
ccuguaccagcccg

SEQ ID NO: 1990491 - RNA, 16 nt, Shigella flexneri 2a str. 301
ccuguaccacaaccug

SEQ ID NO: 1990492 - RNA, 15 nt, Shigella flexneri 2a str. 301
ccuguaaacgaaaac

SEQ ID NO: 1990493 - RNA, 20 nt, Shigella flexneri 2a str. 301
ccugguaucuuuacagcgcu

SEQ ID NO: 1990494 - RNA, 13 nt, Shigella flexneri 2a str. 301
ccuggcacagcag

SEQ ID NO: 1990495 - RNA, 19 nt, Shigella flexneri 2a str. 301
ccuggcaauagcgcacgcc

SEQ ID NO: 1990496 - RNA, 20 nt, Shigella flexneri 2a str. 301
ccuggauugagucagaaauc

SEQ ID NO: 1990497 - RNA, 22 nt, Shigella flexneri 2a str. 301
ccuggcaacccgggcucccggc

SEQ ID NO: 1990498 - RNA, 20 nt, Shigella flexneri 2a str. 301
ccuggcgggaauaaaagcca

SEQ ID NO: 1990499 - RNA, 15 nt, Shigella flexneri 2a str. 301
ccuggcgucuggccc

SEQ ID NO: 1990500 - RNA, 18 nt, Shigella flexneri 2a str. 301
ccuggcgguuaauaauga

SEQ ID NO: 1990501 - RNA, 15 nt, Shigella flexneri 2a str. 301
ccugggcgauuuccu

SEQ ID NO: 1990502 - RNA, 21 nt, Shigella flexneri 2a str. 301
ccuggagaguguuuuaucugu

SEQ ID NO: 1990503 - RNA, 20 nt, Shigella flexneri 2a str. 301
ccugcugcacgcccugauaa

SEQ ID NO: 1990504 - RNA, 22 nt, Shigella flexneri 2a str. 301
ccugcugauggcgggaugugua

SEQ ID NO: 1990505 - RNA, 14 nt, Shigella flexneri 2a str. 301
ccuggacuuuaaac

SEQ ID NO: 1990506 - RNA, 16 nt, Shigella flexneri 2a str. 301
ccugcucgucauccgc

SEQ ID NO: 1990507 - RNA, 18 nt, Shigella flexneri 2a str. 301
ccugcucgucauccgcca

SEQ ID NO: 1990508 - RNA, 19 nt, Shigella flexneri 2a str. 301
ccugcucgucauccgccag

SEQ ID NO: 1990509 - RNA, 12 nt, Shigella flexneri 2a str. 301
ccugcucugcca

SEQ ID NO: 1990510 - RNA, 23 nt, Shigella flexneri 2a str. 301
ccugcucuaaccacugagcuaaa

SEQ ID NO: 1990511 - RNA, 16 nt, Shigella flexneri 2a str. 301
ccugcucuuucagcac

SEQ ID NO: 1990512 - RNA, 14 nt, Shigella flexneri 2a str. 301
ccugcgugacuaaa

SEQ ID NO: 1990513 - RNA, 18 nt, Shigella flexneri 2a str. 301
ccugcguuuguccgccgg

SEQ ID NO: 1990514 - RNA, 23 nt, Shigella flexneri 2a str. 301
ccugcucaaacuucgucacagcg

SEQ ID NO: 1990515 - RNA, 11 nt, Shigella flexneri 2a str. 301
ccgccgcuucu

SEQ ID NO: 1990516 - RNA, 21 nt, Shigella flexneri 2a str. 301
ccgccgcacaauacauagaaa

SEQ ID NO: 1990517 - RNA, 17 nt, Shigella flexneri 2a str. 301
ccgcccagugccagcac

SEQ ID NO: 1990518 - RNA, 18 nt, Shigella flexneri 2a str. 301
ccgccauuaaacgcagua

SEQ ID NO: 1990519 - RNA, 16 nt, Shigella flexneri 2a str. 301
ccgccaucucuuccag

SEQ ID NO: 1990520 - RNA, 21 nt, Shigella flexneri 2a str. 301
ccgcaguuucugauacugcuc

SEQ ID NO: 1990521 - RNA, 18 nt, Shigella flexneri 2a str. 301
ccgcagugauuucaaccg

SEQ ID NO: 1990522 - RNA, 17 nt, Shigella flexneri 2a str. 301
ccgcccgaugaauagca

SEQ ID NO: 1990523 - RNA, 23 nt, Shigella flexneri 2a str. 301
ccgcccguuuucuccagcgccgc

SEQ ID NO: 1990524 - RNA, 11 nt, Shigella flexneri 2a str. 301
ccgcgccgcgg

SEQ ID NO: 1990525 - RNA, 15 nt, Shigella flexneri 2a str. 301
ccgcgccgcagccgg

SEQ ID NO: 1990526 - RNA, 13 nt, Shigella flexneri 2a str. 301
ccgcgccauaguu

SEQ ID NO: 1990527 - RNA, 20 nt, Shigella flexneri 2a str. 301
ccgcgcagcgguuugcgcau

SEQ ID NO: 1990528 - RNA, 18 nt, Shigella flexneri 2a str. 301
ccgcgcacgucagccucg

SEQ ID NO: 1990529 - RNA, 16 nt, Shigella flexneri 2a str. 301
ccgccuugauauaaau

SEQ ID NO: 1990530 - RNA, 19 nt, Shigella flexneri 2a str. 301
ccgccuuguuguaaugaca

SEQ ID NO: 1990531 - RNA, 16 nt, Shigella flexneri 2a str. 301
ccgcgcaauggcuggc

SEQ ID NO: 1990532 - RNA, 19 nt, Shigella flexneri 2a str. 301
ccgcgacgacgacaggcaa

SEQ ID NO: 1990533 - RNA, 20 nt, Shigella flexneri 2a str. 301
ccgccugaucauuuccgguu

SEQ ID NO: 1990534 - RNA, 21 nt, Shigella flexneri 2a str. 301
ccgccucgcggcagcagagaa

SEQ ID NO: 1990535 - RNA, 22 nt, Shigella flexneri 2a str. 301
ccgccguugccuuuaccgccac

SEQ ID NO: 1990536 - RNA, 19 nt, Shigella flexneri 2a str. 301
ccgccguuagcuucagccg

SEQ ID NO: 1990537 - RNA, 19 nt, Shigella flexneri 2a str. 301
ccgccguuaccuucggccc

SEQ ID NO: 1990538 - RNA, 19 nt, Shigella flexneri 2a str. 301
ccgccucacuauccgcccc

SEQ ID NO: 1990539 - RNA, 16 nt, Shigella flexneri 2a str. 301
ccgccuaauuacauaa

SEQ ID NO: 1990540 - RNA, 14 nt, Shigella flexneri 2a str. 301
ccgccguaacuggc

SEQ ID NO: 1990541 - RNA, 16 nt, Shigella flexneri 2a str. 301
ccgccgguugccccgc

SEQ ID NO: 1990542 - RNA, 18 nt, Shigella flexneri 2a str. 301
ccgccguauguucucugg

SEQ ID NO: 1990543 - RNA, 21 nt, Shigella flexneri 2a str. 301
ccgccgguagucaccgcccag

SEQ ID NO: 1990544 - RNA, 16 nt, Shigella flexneri 2a str. 301
ccgccggucaacgcgc

SEQ ID NO: 1990545 - RNA, 23 nt, Shigella flexneri 2a str. 301
ccgccgguggcguuuccagcagu

SEQ ID NO: 1990546 - RNA, 15 nt, Shigella flexneri 2a str. 301
ccgcucuuccaggca

SEQ ID NO: 1990547 - RNA, 23 nt, Shigella flexneri 2a str. 301
ccgcugaacugauugccacccug

SEQ ID NO: 1990548 - RNA, 18 nt, Shigella flexneri 2a str. 301
ccgcugcacguuuucaac

SEQ ID NO: 1990549 - RNA, 20 nt, Shigella flexneri 2a str. 301
ccgcucacgaugccgccgag

SEQ ID NO: 1990550 - RNA, 12 nt, Shigella flexneri 2a str. 301
ccgcucagcucc

SEQ ID NO: 1990551 - RNA, 17 nt, Shigella flexneri 2a str. 301
ccgcuuccagcgcaucu

SEQ ID NO: 1990552 - RNA, 14 nt, Shigella flexneri 2a str. 301
ccgcuucaccaauc

SEQ ID NO: 1990553 - RNA, 15 nt, Shigella flexneri 2a str. 301
ccgcuucaccaccgc

SEQ ID NO: 1990554 - RNA, 14 nt, Shigella flexneri 2a str. 301
ccgcuucacucccu

SEQ ID NO: 1990555 - RNA, 16 nt, Shigella flexneri 2a str. 301
ccgcuucauugaccuu

SEQ ID NO: 1990556 - RNA, 17 nt, Shigella flexneri 2a str. 301
ccgcuucaguugcgccu

SEQ ID NO: 1990557 - RNA, 22 nt, Shigella flexneri 2a str. 301
ccgcuggcccaucagaauaucg

SEQ ID NO: 1990558 - RNA, 20 nt, Shigella flexneri 2a str. 301
ccgcuggccauuucugccag

SEQ ID NO: 1990559 - RNA, 13 nt, Shigella flexneri 2a str. 301
ccgcuggacccgg

SEQ ID NO: 1990560 - RNA, 21 nt, Shigella flexneri 2a str. 301
ccgcuaucgaggcucugauug

SEQ ID NO: 1990561 - RNA, 19 nt, Shigella flexneri 2a str. 301
ccgcuaucggcaaggaaac

SEQ ID NO: 1990562 - RNA, 23 nt, Shigella flexneri 2a str. 301
ccgcguaaacgugcggcugugcg

SEQ ID NO: 1990563 - RNA, 15 nt, Shigella flexneri 2a str. 301
ccgcguacgccgcug

SEQ ID NO: 1990564 - RNA, 19 nt, Shigella flexneri 2a str. 301
ccggcauuaucacaucagc

SEQ ID NO: 1990565 - RNA, 19 nt, Shigella flexneri 2a str. 301
ccggcauucagugcaaaug

SEQ ID NO: 1990566 - RNA, 17 nt, Shigella flexneri 2a str. 301
ccggcauggcauuuuua

SEQ ID NO: 1990567 - RNA, 16 nt, Shigella flexneri 2a str. 301
ccggcagaagcaauca

SEQ ID NO: 1990568 - RNA, 11 nt, Shigella flexneri 2a str. 301
ccggcagagaa

SEQ ID NO: 1990569 - RNA, 14 nt, Shigella flexneri 2a str. 301
ccggcacuucaacu

SEQ ID NO: 1990570 - RNA, 13 nt, Shigella flexneri 2a str. 301
ccggcaagauucc

SEQ ID NO: 1990571 - RNA, 18 nt, Shigella flexneri 2a str. 301
ccggcaacgacugcgagc

SEQ ID NO: 1990572 - RNA, 13 nt, Shigella flexneri 2a str. 301
ccggcaauaaaac

SEQ ID NO: 1990573 - RNA, 22 nt, Shigella flexneri 2a str. 301
ccggauaaggcguucgcgccgc

SEQ ID NO: 1990574 - RNA, 11 nt, Shigella flexneri 2a str. 301
ccggcaccuuu

SEQ ID NO: 1990575 - RNA, 16 nt, Shigella flexneri 2a str. 301
ccggcaccugucagac

SEQ ID NO: 1990576 - RNA, 16 nt, Shigella flexneri 2a str. 301
ccggcaauaaaacagg

SEQ ID NO: 1990577 - RNA, 21 nt, Shigella flexneri 2a str. 301
ccggcaaucaccgccagcggc

SEQ ID NO: 1990578 - RNA, 14 nt, Shigella flexneri 2a str. 301
ccgcuuuugcgcgu

SEQ ID NO: 1990579 - RNA, 22 nt, Shigella flexneri 2a str. 301
ccggaaaagguguucacgccgc

SEQ ID NO: 1990580 - RNA, 14 nt, Shigella flexneri 2a str. 301
ccgcuuuggcgucu

SEQ ID NO: 1990581 - RNA, 22 nt, Shigella flexneri 2a str. 301
ccgcuuuguguaaguuuaaccu

SEQ ID NO: 1990582 - RNA, 14 nt, Shigella flexneri 2a str. 301
ccgcuuucccagug

SEQ ID NO: 1990583 - RNA, 15 nt, Shigella flexneri 2a str. 301
ccggaauagcuuuac

SEQ ID NO: 1990584 - RNA, 19 nt, Shigella flexneri 2a str. 301
ccggaaucagaauccggug

SEQ ID NO: 1990585 - RNA, 18 nt, Shigella flexneri 2a str. 301
ccggaacugccugcucgu

SEQ ID NO: 1990586 - RNA, 17 nt, Shigella flexneri 2a str. 301
ccggaagccaccacgcc

SEQ ID NO: 1990587 - RNA, 16 nt, Shigella flexneri 2a str. 301
ccggaacaucaccaag

SEQ ID NO: 1990588 - RNA, 21 nt, Shigella flexneri 2a str. 301
ccggaaccggauuuucaccau

SEQ ID NO: 1990589 - RNA, 22 nt, Shigella flexneri 2a str. 301
ccggaacgggagaaacccggcc

SEQ ID NO: 1990590 - RNA, 18 nt, Shigella flexneri 2a str. 301
ccggaacaggcagggcca

SEQ ID NO: 1990591 - RNA, 17 nt, Shigella flexneri 2a str. 301
ccggagacguauuaaau

SEQ ID NO: 1990592 - RNA, 15 nt, Shigella flexneri 2a str. 301
ccggacuccgcaccg

SEQ ID NO: 1990593 - RNA, 15 nt, Shigella flexneri 2a str. 301
ccggauaaacaaugu

SEQ ID NO: 1990594 - RNA, 14 nt, Shigella flexneri 2a str. 301
ccggauaaacaaug

SEQ ID NO: 1990595 - RNA, 23 nt, Shigella flexneri 2a str. 301
ccggagaguauuaucugcaauua

SEQ ID NO: 1990596 - RNA, 22 nt, Shigella flexneri 2a str. 301
ccggacacugcuuacaggcugg

SEQ ID NO: 1990597 - RNA, 21 nt, Shigella flexneri 2a str. 301
ccggaauuucuuucagcaguu

SEQ ID NO: 1990598 - RNA, 23 nt, Shigella flexneri 2a str. 301
ccggacacugcuuacaggcuggu

SEQ ID NO: 1990599 - RNA, 19 nt, Shigella flexneri 2a str. 301
ccggacguaaugauguaaa

SEQ ID NO: 1990600 - RNA, 15 nt, Shigella flexneri 2a str. 301
ccggacauugcgccc

SEQ ID NO: 1990601 - RNA, 23 nt, Shigella flexneri 2a str. 301
ccgaggggcugacgcaacugguc

SEQ ID NO: 1990602 - RNA, 20 nt, Shigella flexneri 2a str. 301
ccgaggcgcuggcagaaggc

SEQ ID NO: 1990603 - RNA, 15 nt, Shigella flexneri 2a str. 301
ccgagcgccaccauc

SEQ ID NO: 1990604 - RNA, 15 nt, Shigella flexneri 2a str. 301
ccgagccgguugccu

SEQ ID NO: 1990605 - RNA, 17 nt, Shigella flexneri 2a str. 301
ccgagcuuaugcaauag

SEQ ID NO: 1990606 - RNA, 16 nt, Shigella flexneri 2a str. 301
ccgaucaauuucacag

SEQ ID NO: 1990607 - RNA, 22 nt, Shigella flexneri 2a str. 301
ccgauaaaggucgacagcagcc

SEQ ID NO: 1990608 - RNA, 14 nt, Shigella flexneri 2a str. 301
ccgaucaucaucca

SEQ ID NO: 1990609 - RNA, 20 nt, Shigella flexneri 2a str. 301
ccgaucggcuggcauuuuua

SEQ ID NO: 1990610 - RNA, 19 nt, Shigella flexneri 2a str. 301
ccgagcaaaucgcggcagu

SEQ ID NO: 1990611 - RNA, 14 nt, Shigella flexneri 2a str. 301
ccgacguuugcgcc

SEQ ID NO: 1990612 - RNA, 16 nt, Shigella flexneri 2a str. 301
ccgagaagcagcaaca

SEQ ID NO: 1990613 - RNA, 15 nt, Shigella flexneri 2a str. 301
ccgagaauaauuuca

SEQ ID NO: 1990614 - RNA, 12 nt, Shigella flexneri 2a str. 301
ccgaccuucacg

SEQ ID NO: 1990615 - RNA, 21 nt, Shigella flexneri 2a str. 301
ccgcagccaucacugacugcg

SEQ ID NO: 1990616 - RNA, 14 nt, Shigella flexneri 2a str. 301
ccgcagccaucaac

SEQ ID NO: 1990617 - RNA, 13 nt, Shigella flexneri 2a str. 301
ccgcagccaucac

SEQ ID NO: 1990618 - RNA, 19 nt, Shigella flexneri 2a str. 301
ccgcagcauugcucaccgc

SEQ ID NO: 1990619 - RNA, 20 nt, Shigella flexneri 2a str. 301
ccgcagccgccagaaauggc

SEQ ID NO: 1990620 - RNA, 13 nt, Shigella flexneri 2a str. 301
ccgcagcuccagc

SEQ ID NO: 1990621 - RNA, 19 nt, Shigella flexneri 2a str. 301
ccgcagucauggcucuucc

SEQ ID NO: 1990622 - RNA, 13 nt, Shigella flexneri 2a str. 301
ccgcaccaggcag

SEQ ID NO: 1990623 - RNA, 22 nt, Shigella flexneri 2a str. 301
ccgcacucguaucaccccgccc

SEQ ID NO: 1990624 - RNA, 21 nt, Shigella flexneri 2a str. 301
ccgcacguuagaaacaaaaaa

SEQ ID NO: 1990625 - RNA, 17 nt, Shigella flexneri 2a str. 301
ccgcacucuacuucuuc

SEQ ID NO: 1990626 - RNA, 16 nt, Shigella flexneri 2a str. 301
ccgcacuucuuccuug

SEQ ID NO: 1990627 - RNA, 18 nt, Shigella flexneri 2a str. 301
ccgauuuugccuucauac

SEQ ID NO: 1990628 - RNA, 23 nt, Shigella flexneri 2a str. 301
ccgcaaccggccguaagaaaguc

SEQ ID NO: 1990629 - RNA, 20 nt, Shigella flexneri 2a str. 301
ccgcaacagugaaauacagu

SEQ ID NO: 1990630 - RNA, 22 nt, Shigella flexneri 2a str. 301
ccgcaacaaugccgauaaauac

SEQ ID NO: 1990631 - RNA, 16 nt, Shigella flexneri 2a str. 301
ccgcaagccaacaugu

SEQ ID NO: 1990632 - RNA, 14 nt, Shigella flexneri 2a str. 301
ccgcaacuaccagc

SEQ ID NO: 1990633 - RNA, 22 nt, Shigella flexneri 2a str. 301
ccgcaacgccuaucaccagaag

SEQ ID NO: 1990634 - RNA, 21 nt, Shigella flexneri 2a str. 301
ccgauuaaucuuccagaucac

SEQ ID NO: 1990635 - RNA, 18 nt, Shigella flexneri 2a str. 301
ccgauuaauugccgccag

SEQ ID NO: 1990636 - RNA, 22 nt, Shigella flexneri 2a str. 301
ccgaugaucaacagcaucaucg

SEQ ID NO: 1990637 - RNA, 21 nt, Shigella flexneri 2a str. 301
ccgaugaucaacagcaucauc

SEQ ID NO: 1990638 - RNA, 22 nt, Shigella flexneri 2a str. 301
cccugguggcauugguugcugg

SEQ ID NO: 1990639 - RNA, 19 nt, Shigella flexneri 2a str. 301
cccuggucaguuucagcca

SEQ ID NO: 1990640 - RNA, 17 nt, Shigella flexneri 2a str. 301
cccugguaaaaaaugau

SEQ ID NO: 1990641 - RNA, 23 nt, Shigella flexneri 2a str. 301
cccuggggagugaccuuaccacc

SEQ ID NO: 1990642 - RNA, 15 nt, Shigella flexneri 2a str. 301
cccugggcuucaucc

SEQ ID NO: 1990643 - RNA, 21 nt, Shigella flexneri 2a str. 301
cccugggcuucauccagcagu

SEQ ID NO: 1990644 - RNA, 14 nt, Shigella flexneri 2a str. 301
cccugggcaccgac

SEQ ID NO: 1990645 - RNA, 18 nt, Shigella flexneri 2a str. 301
cccugugcgcccuguucu

SEQ ID NO: 1990646 - RNA, 23 nt, Shigella flexneri 2a str. 301
cccuguuugguugccagccacac

SEQ ID NO: 1990647 - RNA, 22 nt, Shigella flexneri 2a str. 301
cccuguuugguugccagccaca

SEQ ID NO: 1990648 - RNA, 22 nt, Shigella flexneri 2a str. 301
cccuuacgcguucauacuuuuc

SEQ ID NO: 1990649 - RNA, 14 nt, Shigella flexneri 2a str. 301
cccuuacccuuacu

SEQ ID NO: 1990650 - RNA, 20 nt, Shigella flexneri 2a str. 301
cccuucacgacauaaacauu

SEQ ID NO: 1990651 - RNA, 23 nt, Shigella flexneri 2a str. 301
cccuuccuugcuaagcccucuca

SEQ ID NO: 1990652 - RNA, 18 nt, Shigella flexneri 2a str. 301
cccuucgguagcagcuuu

SEQ ID NO: 1990653 - RNA, 23 nt, Shigella flexneri 2a str. 301
cccuucccgggucgcgacugcca

SEQ ID NO: 1990654 - RNA, 20 nt, Shigella flexneri 2a str. 301
cccuucaucacgcagcguca

SEQ ID NO: 1990655 - RNA, 15 nt, Shigella flexneri 2a str. 301
cccuucauucaggug

SEQ ID NO: 1990656 - RNA, 16 nt, Shigella flexneri 2a str. 301
ccgaaccagugcucca

SEQ ID NO: 1990657 - RNA, 23 nt, Shigella flexneri 2a str. 301
ccgaacagcgccagacaaaccac

SEQ ID NO: 1990658 - RNA, 22 nt, Shigella flexneri 2a str. 301
ccgaacagcgccagacaaacca

SEQ ID NO: 1990659 - RNA, 17 nt, Shigella flexneri 2a str. 301
ccgaaggugcacuagac

SEQ ID NO: 1990660 - RNA, 21 nt, Shigella flexneri 2a str. 301
ccgaagcccaucaguacacca

SEQ ID NO: 1990661 - RNA, 22 nt, Shigella flexneri 2a str. 301
ccgaagagggggcgauagaaua

SEQ ID NO: 1990662 - RNA, 19 nt, Shigella flexneri 2a str. 301
ccgaagaguaaccaaacgu

SEQ ID NO: 1990663 - RNA, 15 nt, Shigella flexneri 2a str. 301
cccuuuuuucaggug

SEQ ID NO: 1990664 - RNA, 19 nt, Shigella flexneri 2a str. 301
ccgaacagcgccagacaaa

SEQ ID NO: 1990665 - RNA, 14 nt, Shigella flexneri 2a str. 301
ccgaacagaucacg

SEQ ID NO: 1990666 - RNA, 13 nt, Shigella flexneri 2a str. 301
cccuugcaggcga

SEQ ID NO: 1990667 - RNA, 14 nt, Shigella flexneri 2a str. 301
cccuucucaauccc

SEQ ID NO: 1990668 - RNA, 24 nt, Shigella flexneri 2a str. 301
cccuucucaaucccuuucucuuca

SEQ ID NO: 1990669 - RNA, 16 nt, Shigella flexneri 2a str. 301
cccuucguucucugca

SEQ ID NO: 1990670 - RNA, 10 nt, Shigella flexneri 2a str. 301
cccuucuucc

SEQ ID NO: 1990671 - RNA, 17 nt, Shigella flexneri 2a str. 301
cccugagacaguuauua

SEQ ID NO: 1990672 - RNA, 16 nt, Shigella flexneri 2a str. 301
cccugagcaucaauac

SEQ ID NO: 1990673 - RNA, 10 nt, Shigella flexneri 2a str. 301
cccugaguga

SEQ ID NO: 1990674 - RNA, 17 nt, Shigella flexneri 2a str. 301
cccugagcguuacccgc

SEQ ID NO: 1990675 - RNA, 14 nt, Shigella flexneri 2a str. 301
cccugacgaccacc

SEQ ID NO: 1990676 - RNA, 15 nt, Shigella flexneri 2a str. 301
cccugacgaccaccc

SEQ ID NO: 1990677 - RNA, 22 nt, Shigella flexneri 2a str. 301
cccugaauaacaccagccagaa

SEQ ID NO: 1990678 - RNA, 23 nt, Shigella flexneri 2a str. 301
cccugaaucaaucagagccaucc

SEQ ID NO: 1990679 - RNA, 16 nt, Shigella flexneri 2a str. 301
cccugaucggccauga

SEQ ID NO: 1990680 - RNA, 14 nt, Shigella flexneri 2a str. 301
cccugcaaacgggg

SEQ ID NO: 1990681 - RNA, 17 nt, Shigella flexneri 2a str. 301
cccugauaaaucaccug

SEQ ID NO: 1990682 - RNA, 19 nt, Shigella flexneri 2a str. 301
cccugcacuuaacaggauc

SEQ ID NO: 1990683 - RNA, 21 nt, Shigella flexneri 2a str. 301
cccugcacuuaacaggaucug

SEQ ID NO: 1990684 - RNA, 22 nt, Shigella flexneri 2a str. 301
cccugcacuuaacaggaucugg

SEQ ID NO: 1990685 - RNA, 18 nt, Shigella flexneri 2a str. 301
cccugcaauuauuaaccu

SEQ ID NO: 1990686 - RNA, 23 nt, Shigella flexneri 2a str. 301
cccugcacauuugugaacgccag

SEQ ID NO: 1990687 - RNA, 13 nt, Shigella flexneri 2a str. 301
ccccuuccugcug

SEQ ID NO: 1990688 - RNA, 12 nt, Shigella flexneri 2a str. 301
ccccuguugcaa

SEQ ID NO: 1990689 - RNA, 22 nt, Shigella flexneri 2a str. 301
cccucugaucaguuguuaguaa

SEQ ID NO: 1990690 - RNA, 14 nt, Shigella flexneri 2a str. 301
cccucuccccagaa

SEQ ID NO: 1990691 - RNA, 20 nt, Shigella flexneri 2a str. 301
cccugcgcuaaacaggaucu

SEQ ID NO: 1990692 - RNA, 18 nt, Shigella flexneri 2a str. 301
cccugcgcuggugaaaac

SEQ ID NO: 1990693 - RNA, 13 nt, Shigella flexneri 2a str. 301
cccugcggaaaaa

SEQ ID NO: 1990694 - RNA, 19 nt, Shigella flexneri 2a str. 301
cccugcgcggcgacuucca

SEQ ID NO: 1990695 - RNA, 18 nt, Shigella flexneri 2a str. 301
cccugcagucaccugccc

SEQ ID NO: 1990696 - RNA, 22 nt, Shigella flexneri 2a str. 301
cccugcagucaccugcccuccg

SEQ ID NO: 1990697 - RNA, 18 nt, Shigella flexneri 2a str. 301
cccugcccguugccagga

SEQ ID NO: 1990698 - RNA, 20 nt, Shigella flexneri 2a str. 301
cccuggaagaaaaacuggcg

SEQ ID NO: 1990699 - RNA, 20 nt, Shigella flexneri 2a str. 301
cccuggcaauagcgcacgcc

SEQ ID NO: 1990700 - RNA, 21 nt, Shigella flexneri 2a str. 301
cccuggcgaugcccccagcag

SEQ ID NO: 1990701 - RNA, 15 nt, Shigella flexneri 2a str. 301
cccugcggcugacca

SEQ ID NO: 1990702 - RNA, 18 nt, Shigella flexneri 2a str. 301
cccugcggcugaccacca

SEQ ID NO: 1990703 - RNA, 21 nt, Shigella flexneri 2a str. 301
cccugcucuuucagcaccgcg

SEQ ID NO: 1990704 - RNA, 14 nt, Shigella flexneri 2a str. 301
cccugcucuuucag

SEQ ID NO: 1990705 - RNA, 22 nt, Shigella flexneri 2a str. 301
cccugcucgucggcaaagcggg

SEQ ID NO: 1990706 - RNA, 13 nt, Shigella flexneri 2a str. 301
cggcgcaugccuc

SEQ ID NO: 1990707 - RNA, 18 nt, Shigella flexneri 2a str. 301
cggcgaucuuuuaauaau

SEQ ID NO: 1990708 - RNA, 14 nt, Shigella flexneri 2a str. 301
cggcgaucgugagc

SEQ ID NO: 1990709 - RNA, 20 nt, Shigella flexneri 2a str. 301
cggcgagauaaugcgauaac

SEQ ID NO: 1990710 - RNA, 17 nt, Shigella flexneri 2a str. 301
cggcgagcaacgcagcg

SEQ ID NO: 1990711 - RNA, 18 nt, Shigella flexneri 2a str. 301
cggcgagggcuauuucuu

SEQ ID NO: 1990712 - RNA, 13 nt, Shigella flexneri 2a str. 301
cggcgacccgcga

SEQ ID NO: 1990713 - RNA, 18 nt, Shigella flexneri 2a str. 301
cggcgaagauacccgcga

SEQ ID NO: 1990714 - RNA, 20 nt, Shigella flexneri 2a str. 301
cggcgaaacgguaauuauug

SEQ ID NO: 1990715 - RNA, 12 nt, Shigella flexneri 2a str. 301
cggcgaaagagc

SEQ ID NO: 1990716 - RNA, 14 nt, Shigella flexneri 2a str. 301
cggcgaaagcuggc

SEQ ID NO: 1990717 - RNA, 16 nt, Shigella flexneri 2a str. 301
cggcugaaaugaugcu

SEQ ID NO: 1990718 - RNA, 19 nt, Shigella flexneri 2a str. 301
cggcucggucagacccggg

SEQ ID NO: 1990719 - RNA, 20 nt, Shigella flexneri 2a str. 301
cggcucgccuuucggcugca

SEQ ID NO: 1990720 - RNA, 19 nt, Shigella flexneri 2a str. 301
cggcucgccuuucggcugc

SEQ ID NO: 1990721 - RNA, 18 nt, Shigella flexneri 2a str. 301
cggcucgcgaccucaagc

SEQ ID NO: 1990722 - RNA, 16 nt, Shigella flexneri 2a str. 301
cggcguugagaaacgc

SEQ ID NO: 1990723 - RNA, 15 nt, Shigella flexneri 2a str. 301
cggcgugacgaucac

SEQ ID NO: 1990724 - RNA, 13 nt, Shigella flexneri 2a str. 301
cggcgugaaugcc

SEQ ID NO: 1990725 - RNA, 19 nt, Shigella flexneri 2a str. 301
cggcgucuuguugaacagg

SEQ ID NO: 1990726 - RNA, 15 nt, Shigella flexneri 2a str. 301
cggcgucugaaucaa

SEQ ID NO: 1990727 - RNA, 14 nt, Shigella flexneri 2a str. 301
cggcggcaacguca

SEQ ID NO: 1990728 - RNA, 18 nt, Shigella flexneri 2a str. 301
cggcggguuaaccagcac

SEQ ID NO: 1990729 - RNA, 16 nt, Shigella flexneri 2a str. 301
cggcgguaaaaucauc

SEQ ID NO: 1990730 - RNA, 23 nt, Shigella flexneri 2a str. 301
cggcggugaccagcagcauuuca

SEQ ID NO: 1990731 - RNA, 16 nt, Shigella flexneri 2a str. 301
cggcggugaccagcag

SEQ ID NO: 1990732 - RNA, 21 nt, Shigella flexneri 2a str. 301
cggcguaucguaaaacgcgga

SEQ ID NO: 1990733 - RNA, 22 nt, Shigella flexneri 2a str. 301
cggcgucaacaccgggugcaga

SEQ ID NO: 1990734 - RNA, 15 nt, Shigella flexneri 2a str. 301
cggcguccuggaacu

SEQ ID NO: 1990735 - RNA, 18 nt, Shigella flexneri 2a str. 301
cggcugcugaggcugacc

SEQ ID NO: 1990736 - RNA, 20 nt, Shigella flexneri 2a str. 301
cggcugcugauguucgccag

SEQ ID NO: 1990737 - RNA, 18 nt, Shigella flexneri 2a str. 301
cggcugcuucggucagca

SEQ ID NO: 1990738 - RNA, 15 nt, Shigella flexneri 2a str. 301
cggcuggccacaaac

SEQ ID NO: 1990739 - RNA, 16 nt, Shigella flexneri 2a str. 301
cgggacagcauggggc

SEQ ID NO: 1990740 - RNA, 17 nt, Shigella flexneri 2a str. 301
cgggacaacaaacgcaa

SEQ ID NO: 1990741 - RNA, 15 nt, Shigella flexneri 2a str. 301
cgggaagauccaggu

SEQ ID NO: 1990742 - RNA, 20 nt, Shigella flexneri 2a str. 301
cgggaacagucgguauaaau

SEQ ID NO: 1990743 - RNA, 12 nt, Shigella flexneri 2a str. 301
cgggaacagaau

SEQ ID NO: 1990744 - RNA, 14 nt, Shigella flexneri 2a str. 301
cgggaaaucaaguu

SEQ ID NO: 1990745 - RNA, 18 nt, Shigella flexneri 2a str. 301
cgggagagauaagauaaa

SEQ ID NO: 1990746 - RNA, 14 nt, Shigella flexneri 2a str. 301
cgggagcaauuugu

SEQ ID NO: 1990747 - RNA, 18 nt, Shigella flexneri 2a str. 301
cgggagauuuucuccugc

SEQ ID NO: 1990748 - RNA, 23 nt, Shigella flexneri 2a str. 301
cgggacgccaguuacugcugacg

SEQ ID NO: 1990749 - RNA, 18 nt, Shigella flexneri 2a str. 301
cgggaucaccagaccaau

SEQ ID NO: 1990750 - RNA, 14 nt, Shigella flexneri 2a str. 301
cgggaucgaguuca

SEQ ID NO: 1990751 - RNA, 13 nt, Shigella flexneri 2a str. 301
cgggaucugaugg

SEQ ID NO: 1990752 - RNA, 20 nt, Shigella flexneri 2a str. 301
cgggaugaaaggcaagcacg

SEQ ID NO: 1990753 - RNA, 20 nt, Shigella flexneri 2a str. 301
cgggaugguguaaaugccgg

SEQ ID NO: 1990754 - RNA, 14 nt, Shigella flexneri 2a str. 301
cgggcaaucggcug

SEQ ID NO: 1990755 - RNA, 16 nt, Shigella flexneri 2a str. 301
cgggcagaggcaauau

SEQ ID NO: 1990756 - RNA, 19 nt, Shigella flexneri 2a str. 301
cgggcagcagaaccaggga

SEQ ID NO: 1990757 - RNA, 13 nt, Shigella flexneri 2a str. 301
cgggcaacugcug

SEQ ID NO: 1990758 - RNA, 18 nt, Shigella flexneri 2a str. 301
cgggcaaauccacugaau

SEQ ID NO: 1990759 - RNA, 17 nt, Shigella flexneri 2a str. 301
cgggauugccagaugcg

SEQ ID NO: 1990760 - RNA, 21 nt, Shigella flexneri 2a str. 301
cgggauguguaaguaaugaca

SEQ ID NO: 1990761 - RNA, 19 nt, Shigella flexneri 2a str. 301
cggguggugcguaccaggc

SEQ ID NO: 1990762 - RNA, 17 nt, Shigella flexneri 2a str. 301
cggguggcucucgccag

SEQ ID NO: 1990763 - RNA, 19 nt, Shigella flexneri 2a str. 301
cggguggcgauaauaaucu

SEQ ID NO: 1990764 - RNA, 17 nt, Shigella flexneri 2a str. 301
cggguuaaccagcacca

SEQ ID NO: 1990765 - RNA, 17 nt, Shigella flexneri 2a str. 301
cggguuuggccgggaag

SEQ ID NO: 1990766 - RNA, 22 nt, Shigella flexneri 2a str. 301
cggguuucccaugccauuucca

SEQ ID NO: 1990767 - RNA, 15 nt, Shigella flexneri 2a str. 301
cgguaaugacuccaa

SEQ ID NO: 1990768 - RNA, 13 nt, Shigella flexneri 2a str. 301
cgguaauggcaaa

SEQ ID NO: 1990769 - RNA, 16 nt, Shigella flexneri 2a str. 301
cgguaauggcaaagau

SEQ ID NO: 1990770 - RNA, 15 nt, Shigella flexneri 2a str. 301
cgguaacuuaucugu

SEQ ID NO: 1990771 - RNA, 20 nt, Shigella flexneri 2a str. 301
cgguaacguugcucaagggu

SEQ ID NO: 1990772 - RNA, 13 nt, Shigella flexneri 2a str. 301
cgguaacucugau

SEQ ID NO: 1990773 - RNA, 18 nt, Shigella flexneri 2a str. 301
cgguaacgccaguuuaau

SEQ ID NO: 1990774 - RNA, 14 nt, Shigella flexneri 2a str. 301
cgguaaaaucaucc

SEQ ID NO: 1990775 - RNA, 16 nt, Shigella flexneri 2a str. 301
cgguaaaaucauccug

SEQ ID NO: 1990776 - RNA, 18 nt, Shigella flexneri 2a str. 301
cgguaaaagcccauuauu

SEQ ID NO: 1990777 - RNA, 21 nt, Shigella flexneri 2a str. 301
cggguuuuucgcgcgggcaga

SEQ ID NO: 1990778 - RNA, 22 nt, Shigella flexneri 2a str. 301
cgguaaagaagagcggcaaacg

SEQ ID NO: 1990779 - RNA, 16 nt, Shigella flexneri 2a str. 301
cgguaaagcccucacc

SEQ ID NO: 1990780 - RNA, 16 nt, Shigella flexneri 2a str. 301
cgguaugacccagcgc

SEQ ID NO: 1990781 - RNA, 14 nt, Shigella flexneri 2a str. 301
cgguauuggugaaa

SEQ ID NO: 1990782 - RNA, 23 nt, Shigella flexneri 2a str. 301
cgguauugccuguauuccuggcc

SEQ ID NO: 1990783 - RNA, 15 nt, Shigella flexneri 2a str. 301
cggucaaaagcugca

SEQ ID NO: 1990784 - RNA, 14 nt, Shigella flexneri 2a str. 301
cggucaacgcgcgg

SEQ ID NO: 1990785 - RNA, 20 nt, Shigella flexneri 2a str. 301
cgguaucaccacccagcggu

SEQ ID NO: 1990786 - RNA, 16 nt, Shigella flexneri 2a str. 301
cgguaucaccacccag

SEQ ID NO: 1990787 - RNA, 17 nt, Shigella flexneri 2a str. 301
cgguaguggcaaccagc

SEQ ID NO: 1990788 - RNA, 16 nt, Shigella flexneri 2a str. 301
cgguaguuucucccca

SEQ ID NO: 1990789 - RNA, 15 nt, Shigella flexneri 2a str. 301
cgguagucaccgccc

SEQ ID NO: 1990790 - RNA, 20 nt, Shigella flexneri 2a str. 301
cgguagcagcuuucagcagc

SEQ ID NO: 1990791 - RNA, 23 nt, Shigella flexneri 2a str. 301
cgguagauuauuucgcugcggau

SEQ ID NO: 1990792 - RNA, 14 nt, Shigella flexneri 2a str. 301
cgguagccauuccc

SEQ ID NO: 1990793 - RNA, 12 nt, Shigella flexneri 2a str. 301
cgguacuucacc

SEQ ID NO: 1990794 - RNA, 15 nt, Shigella flexneri 2a str. 301
cgguacucgcgcagu

SEQ ID NO: 1990795 - RNA, 17 nt, Shigella flexneri 2a str. 301
cgguacagagcaauaaa

SEQ ID NO: 1990796 - RNA, 14 nt, Shigella flexneri 2a str. 301
cgguaauuucacaa

SEQ ID NO: 1990797 - RNA, 19 nt, Shigella flexneri 2a str. 301
cgggugcgacaggagccgc

SEQ ID NO: 1990798 - RNA, 14 nt, Shigella flexneri 2a str. 301
cgggugcauuuuca

SEQ ID NO: 1990799 - RNA, 23 nt, Shigella flexneri 2a str. 301
cgggugcaaucaacaccacugcc

SEQ ID NO: 1990800 - RNA, 19 nt, Shigella flexneri 2a str. 301
cgggugaucuucauagaua

SEQ ID NO: 1990801 - RNA, 15 nt, Shigella flexneri 2a str. 301
cgggucaggccagga

SEQ ID NO: 1990802 - RNA, 14 nt, Shigella flexneri 2a str. 301
cgggucagcggggu

SEQ ID NO: 1990803 - RNA, 21 nt, Shigella flexneri 2a str. 301
cgggcaugucgguuguacaaa

SEQ ID NO: 1990804 - RNA, 15 nt, Shigella flexneri 2a str. 301
cggggaacgcaaaau

SEQ ID NO: 1990805 - RNA, 16 nt, Shigella flexneri 2a str. 301
cggggacaggcggccc

SEQ ID NO: 1990806 - RNA, 17 nt, Shigella flexneri 2a str. 301
cggggaucacuggcaga

SEQ ID NO: 1990807 - RNA, 20 nt, Shigella flexneri 2a str. 301
cggggauuacuccccgcaca

SEQ ID NO: 1990808 - RNA, 22 nt, Shigella flexneri 2a str. 301
cggugaaaguaacugacaguag

SEQ ID NO: 1990809 - RNA, 19 nt, Shigella flexneri 2a str. 301
cggugaagcgcccugcaau

SEQ ID NO: 1990810 - RNA, 19 nt, Shigella flexneri 2a str. 301
cggucuggauuuggcugcc

SEQ ID NO: 1990811 - RNA, 16 nt, Shigella flexneri 2a str. 301
cggucugguguaucug

SEQ ID NO: 1990812 - RNA, 20 nt, Shigella flexneri 2a str. 301
cggucugguguaucugcugu

SEQ ID NO: 1990813 - RNA, 23 nt, Shigella flexneri 2a str. 301
cggucagcagcaccaccgcccgu

SEQ ID NO: 1990814 - RNA, 12 nt, Shigella flexneri 2a str. 301
cggugauaaacc

SEQ ID NO: 1990815 - RNA, 24 nt, Shigella flexneri 2a str. 301
cggugacacuuugcgccaucgcca

SEQ ID NO: 1990816 - RNA, 21 nt, Shigella flexneri 2a str. 301
cggugauauacgucacuucau

SEQ ID NO: 1990817 - RNA, 17 nt, Shigella flexneri 2a str. 301
cgguucagcgucggcgu

SEQ ID NO: 1990818 - RNA, 16 nt, Shigella flexneri 2a str. 301
cgguguucguuguauc

SEQ ID NO: 1990819 - RNA, 13 nt, Shigella flexneri 2a str. 301
cgguguggcaugg

SEQ ID NO: 1990820 - RNA, 15 nt, Shigella flexneri 2a str. 301
cgguguucacucauc

SEQ ID NO: 1990821 - RNA, 18 nt, Shigella flexneri 2a str. 301
cgguguucaagccaaaac

SEQ ID NO: 1990822 - RNA, 23 nt, Shigella flexneri 2a str. 301
cgguguaaccaucaaaacgcugg

SEQ ID NO: 1990823 - RNA, 19 nt, Shigella flexneri 2a str. 301
cggugguguaaccuucacc

SEQ ID NO: 1990824 - RNA, 18 nt, Shigella flexneri 2a str. 301
cgguggcguuuccagcag

SEQ ID NO: 1990825 - RNA, 17 nt, Shigella flexneri 2a str. 301
cggugcgguaagcugcg

SEQ ID NO: 1990826 - RNA, 23 nt, Shigella flexneri 2a str. 301
cggugcggcucucuuucuccagc

SEQ ID NO: 1990827 - RNA, 21 nt, Shigella flexneri 2a str. 301
cggugcucaucagcccggcaa

SEQ ID NO: 1990828 - RNA, 17 nt, Shigella flexneri 2a str. 301
cgguggccgucgagcag

SEQ ID NO: 1990829 - RNA, 21 nt, Shigella flexneri 2a str. 301
cggugcuggucuguuccccuc

SEQ ID NO: 1990830 - RNA, 15 nt, Shigella flexneri 2a str. 301
cgguugacugcugag

SEQ ID NO: 1990831 - RNA, 18 nt, Shigella flexneri 2a str. 301
cgguucguugauaauaaa

SEQ ID NO: 1990832 - RNA, 18 nt, Shigella flexneri 2a str. 301
cgguucgacggcuggaca

SEQ ID NO: 1990833 - RNA, 13 nt, Shigella flexneri 2a str. 301
cgguucgccauca

SEQ ID NO: 1990834 - RNA, 22 nt, Shigella flexneri 2a str. 301
cgguuccacaucuaccgccagc

SEQ ID NO: 1990835 - RNA, 17 nt, Shigella flexneri 2a str. 301
cguaaaaacccgcuucg

SEQ ID NO: 1990836 - RNA, 15 nt, Shigella flexneri 2a str. 301
cgguuuuuugcuccg

SEQ ID NO: 1990837 - RNA, 22 nt, Shigella flexneri 2a str. 301
cguaagcgcauccggcaccagc

SEQ ID NO: 1990838 - RNA, 17 nt, Shigella flexneri 2a str. 301
cguaagcaacgccaaau

SEQ ID NO: 1990839 - RNA, 11 nt, Shigella flexneri 2a str. 301
cguaaaugccu

SEQ ID NO: 1990840 - RNA, 18 nt, Shigella flexneri 2a str. 301
cguaaauucaauauauug

SEQ ID NO: 1990841 - RNA, 13 nt, Shigella flexneri 2a str. 301
cguaacaaaacuc

SEQ ID NO: 1990842 - RNA, 14 nt, Shigella flexneri 2a str. 301
cguaacauauuccc

SEQ ID NO: 1990843 - RNA, 16 nt, Shigella flexneri 2a str. 301
cguaaaagccuggacc

SEQ ID NO: 1990844 - RNA, 20 nt, Shigella flexneri 2a str. 301
cguaaaagccuggaccauau

SEQ ID NO: 1990845 - RNA, 16 nt, Shigella flexneri 2a str. 301
cguaaauaguccggaa

SEQ ID NO: 1990846 - RNA, 21 nt, Shigella flexneri 2a str. 301
cguaaauaguccggaagaugc

SEQ ID NO: 1990847 - RNA, 16 nt, Shigella flexneri 2a str. 301
cguacaaccaaaucug

SEQ ID NO: 1990848 - RNA, 12 nt, Shigella flexneri 2a str. 301
cguacaccaaca

SEQ ID NO: 1990849 - RNA, 15 nt, Shigella flexneri 2a str. 301
cguacaccaacauca

SEQ ID NO: 1990850 - RNA, 20 nt, Shigella flexneri 2a str. 301
cguacaccaacaucacgcaa

SEQ ID NO: 1990851 - RNA, 14 nt, Shigella flexneri 2a str. 301
cguaauuugccguu

SEQ ID NO: 1990852 - RNA, 19 nt, Shigella flexneri 2a str. 301
cguacaaaauuagaaaggg

SEQ ID NO: 1990853 - RNA, 19 nt, Shigella flexneri 2a str. 301
cguacaaaacgcaccacuu

SEQ ID NO: 1990854 - RNA, 22 nt, Shigella flexneri 2a str. 301
cguaaucaacauauuccccugg

SEQ ID NO: 1990855 - RNA, 18 nt, Shigella flexneri 2a str. 301
cguaaucuuuucauauua

SEQ ID NO: 1990856 - RNA, 23 nt, Shigella flexneri 2a str. 301
cguaaugaauguuuuccugcuuc

SEQ ID NO: 1990857 - RNA, 20 nt, Shigella flexneri 2a str. 301
cguaaugauguaaaaauacu

SEQ ID NO: 1990858 - RNA, 21 nt, Shigella flexneri 2a str. 301
cguacgggucgggcuguguuu

SEQ ID NO: 1990859 - RNA, 21 nt, Shigella flexneri 2a str. 301
cguacgggcaaagcgacgcgc

SEQ ID NO: 1990860 - RNA, 16 nt, Shigella flexneri 2a str. 301
cguacucaccgcucac

SEQ ID NO: 1990861 - RNA, 15 nt, Shigella flexneri 2a str. 301
cguacucaauuuuca

SEQ ID NO: 1990862 - RNA, 22 nt, Shigella flexneri 2a str. 301
cguaccggcaacgacugcgagc

SEQ ID NO: 1990863 - RNA, 23 nt, Shigella flexneri 2a str. 301
cguaccgguaaaccugguguucg

SEQ ID NO: 1990864 - RNA, 16 nt, Shigella flexneri 2a str. 301
cguaccacggcauuuc

SEQ ID NO: 1990865 - RNA, 22 nt, Shigella flexneri 2a str. 301
cguacagggugagggcaauaau

SEQ ID NO: 1990866 - RNA, 16 nt, Shigella flexneri 2a str. 301
cguacccgccugauag

SEQ ID NO: 1990867 - RNA, 13 nt, Shigella flexneri 2a str. 301
cguaccgcagcaa

SEQ ID NO: 1990868 - RNA, 18 nt, Shigella flexneri 2a str. 301
cguaccaugcgcaucauc

SEQ ID NO: 1990869 - RNA, 20 nt, Shigella flexneri 2a str. 301
cguaccauuaucaccaaacu

SEQ ID NO: 1990870 - RNA, 15 nt, Shigella flexneri 2a str. 301
cggaccgucaucuuc

SEQ ID NO: 1990871 - RNA, 15 nt, Shigella flexneri 2a str. 301
cggaccgucuuuuuu

SEQ ID NO: 1990872 - RNA, 14 nt, Shigella flexneri 2a str. 301
cggacccacacccc

SEQ ID NO: 1990873 - RNA, 14 nt, Shigella flexneri 2a str. 301
cggaccagcaaguc

SEQ ID NO: 1990874 - RNA, 17 nt, Shigella flexneri 2a str. 301
cggacgcccgccgacca

SEQ ID NO: 1990875 - RNA, 16 nt, Shigella flexneri 2a str. 301
cggacgaucccaacca

SEQ ID NO: 1990876 - RNA, 21 nt, Shigella flexneri 2a str. 301
cggacgcaccgcguauugcuc

SEQ ID NO: 1990877 - RNA, 21 nt, Shigella flexneri 2a str. 301
cggacauguuuuccagcacau

SEQ ID NO: 1990878 - RNA, 15 nt, Shigella flexneri 2a str. 301
cggacagaucugccu

SEQ ID NO: 1990879 - RNA, 18 nt, Shigella flexneri 2a str. 301
cggacaauaauaucuuuu

SEQ ID NO: 1990880 - RNA, 14 nt, Shigella flexneri 2a str. 301
cggaauuuuccuuc

SEQ ID NO: 1990881 - RNA, 20 nt, Shigella flexneri 2a str. 301
cggacaaaguuccugccgau

SEQ ID NO: 1990882 - RNA, 11 nt, Shigella flexneri 2a str. 301
cggaauuucaa

SEQ ID NO: 1990883 - RNA, 17 nt, Shigella flexneri 2a str. 301
cggacaauaauaucuuu

SEQ ID NO: 1990884 - RNA, 15 nt, Shigella flexneri 2a str. 301
cggaauggcaucuuc

SEQ ID NO: 1990885 - RNA, 15 nt, Shigella flexneri 2a str. 301
cggaaugucaucauc

SEQ ID NO: 1990886 - RNA, 16 nt, Shigella flexneri 2a str. 301
cggaaugucaucauca

SEQ ID NO: 1990887 - RNA, 20 nt, Shigella flexneri 2a str. 301
cggaaugauauuggucacca

SEQ ID NO: 1990888 - RNA, 21 nt, Shigella flexneri 2a str. 301
cggacggucgacgggcccaua

SEQ ID NO: 1990889 - RNA, 20 nt, Shigella flexneri 2a str. 301
cggacugaaaguacuucaca

SEQ ID NO: 1990890 - RNA, 15 nt, Shigella flexneri 2a str. 301
cggacugaacgcggc

SEQ ID NO: 1990891 - RNA, 15 nt, Shigella flexneri 2a str. 301
cggacuuuuuauuua

SEQ ID NO: 1990892 - RNA, 19 nt, Shigella flexneri 2a str. 301
cggacuuccagcggacgau

SEQ ID NO: 1990893 - RNA, 15 nt, Shigella flexneri 2a str. 301
cggagagaaaagcaa

SEQ ID NO: 1990894 - RNA, 22 nt, Shigella flexneri 2a str. 301
cggagacgguuauauuuacaaa

SEQ ID NO: 1990895 - RNA, 16 nt, Shigella flexneri 2a str. 301
cggagacaaacagggu

SEQ ID NO: 1990896 - RNA, 20 nt, Shigella flexneri 2a str. 301
cggagaguaaugccagucag

SEQ ID NO: 1990897 - RNA, 15 nt, Shigella flexneri 2a str. 301
cggagugaaaauucu

SEQ ID NO: 1990898 - RNA, 22 nt, Shigella flexneri 2a str. 301
cggagugaaaauucuccggcgu

SEQ ID NO: 1990899 - RNA, 16 nt, Shigella flexneri 2a str. 301
cggauaccaccagugc

SEQ ID NO: 1990900 - RNA, 16 nt, Shigella flexneri 2a str. 301
cggauaauucccaggc

SEQ ID NO: 1990901 - RNA, 16 nt, Shigella flexneri 2a str. 301
cggauaauuucacugc

SEQ ID NO: 1990902 - RNA, 23 nt, Shigella flexneri 2a str. 301
cggaguagucucucgccucaugg

SEQ ID NO: 1990903 - RNA, 13 nt, Shigella flexneri 2a str. 301
cggaagccaccac

SEQ ID NO: 1990904 - RNA, 19 nt, Shigella flexneri 2a str. 301
cggaagcgagguauuuucu

SEQ ID NO: 1990905 - RNA, 16 nt, Shigella flexneri 2a str. 301
cggaaguaccaauggc

SEQ ID NO: 1990906 - RNA, 15 nt, Shigella flexneri 2a str. 301
cggaauaucagaggc

SEQ ID NO: 1990907 - RNA, 15 nt, Shigella flexneri 2a str. 301
cggaauaucgcuggc

SEQ ID NO: 1990908 - RNA, 15 nt, Shigella flexneri 2a str. 301
cggaauaaucagaug

SEQ ID NO: 1990909 - RNA, 17 nt, Shigella flexneri 2a str. 301
cggaaguguguaucuuc

SEQ ID NO: 1990910 - RNA, 14 nt, Shigella flexneri 2a str. 301
cggaagagacuauu

SEQ ID NO: 1990911 - RNA, 17 nt, Shigella flexneri 2a str. 301
cggaagagacuauuucu

SEQ ID NO: 1990912 - RNA, 13 nt, Shigella flexneri 2a str. 301
cggaagagauggu

SEQ ID NO: 1990913 - RNA, 14 nt, Shigella flexneri 2a str. 301
cggaaccagccagg

SEQ ID NO: 1990914 - RNA, 18 nt, Shigella flexneri 2a str. 301
cgcuuucucaccaugacc

SEQ ID NO: 1990915 - RNA, 21 nt, Shigella flexneri 2a str. 301
cgcuuucgcuacuucaaacaa

SEQ ID NO: 1990916 - RNA, 15 nt, Shigella flexneri 2a str. 301
cgcuuugcaggcugg

SEQ ID NO: 1990917 - RNA, 15 nt, Shigella flexneri 2a str. 301
cgcuuugcaccagaa

SEQ ID NO: 1990918 - RNA, 14 nt, Shigella flexneri 2a str. 301
cgcuuuggaaggua

SEQ ID NO: 1990919 - RNA, 20 nt, Shigella flexneri 2a str. 301
cggaaauuaccgcaccacca

SEQ ID NO: 1990920 - RNA, 21 nt, Shigella flexneri 2a str. 301
cggaacaacagucccaggcag

SEQ ID NO: 1990921 - RNA, 14 nt, Shigella flexneri 2a str. 301
cgcuucaaccaccu

SEQ ID NO: 1990922 - RNA, 16 nt, Shigella flexneri 2a str. 301
cgcuucgcccaaaucc

SEQ ID NO: 1990923 - RNA, 19 nt, Shigella flexneri 2a str. 301
cgcuucccaacgcagcaac

SEQ ID NO: 1990924 - RNA, 18 nt, Shigella flexneri 2a str. 301
cgcuucaugcuuaaucau

SEQ ID NO: 1990925 - RNA, 22 nt, Shigella flexneri 2a str. 301
cgcuucaccgacaucuuucugc

SEQ ID NO: 1990926 - RNA, 16 nt, Shigella flexneri 2a str. 301
cgcuucagucgccagc

SEQ ID NO: 1990927 - RNA, 14 nt, Shigella flexneri 2a str. 301
cgcuucagugacuu

SEQ ID NO: 1990928 - RNA, 15 nt, Shigella flexneri 2a str. 301
cgcuugcucgcgcac

SEQ ID NO: 1990929 - RNA, 13 nt, Shigella flexneri 2a str. 301
cgcuugagcagga

SEQ ID NO: 1990930 - RNA, 19 nt, Shigella flexneri 2a str. 301
cgcuugagcaggagcagca

SEQ ID NO: 1990931 - RNA, 18 nt, Shigella flexneri 2a str. 301
cgcuugucacuucugccu

SEQ ID NO: 1990932 - RNA, 23 nt, Shigella flexneri 2a str. 301
cgcuugucaucgaugagaugacg

SEQ ID NO: 1990933 - RNA, 20 nt, Shigella flexneri 2a str. 301
cgcuuggcaagcccagcacc

SEQ ID NO: 1990934 - RNA, 21 nt, Shigella flexneri 2a str. 301
cgcuuggcaagcccagcaccc

SEQ ID NO: 1990935 - RNA, 21 nt, Shigella flexneri 2a str. 301
cgcuucgguuuucgcgccagc

SEQ ID NO: 1990936 - RNA, 19 nt, Shigella flexneri 2a str. 301
cgcuucugguuauauuucc

SEQ ID NO: 1990937 - RNA, 12 nt, Shigella flexneri 2a str. 301
cgcuucuucagc

SEQ ID NO: 1990938 - RNA, 16 nt, Shigella flexneri 2a str. 301
cgcuucugucgcuuca

SEQ ID NO: 1990939 - RNA, 14 nt, Shigella flexneri 2a str. 301
cgcuucuucagccu

SEQ ID NO: 1990940 - RNA, 11 nt, Shigella flexneri 2a str. 301
cgcuucugcuu

SEQ ID NO: 1990941 - RNA, 14 nt, Shigella flexneri 2a str. 301
cgcuucguuuucag

SEQ ID NO: 1990942 - RNA, 19 nt, Shigella flexneri 2a str. 301
cggcagcaggugcgccagc

SEQ ID NO: 1990943 - RNA, 16 nt, Shigella flexneri 2a str. 301
cggcagcaggaucucc

SEQ ID NO: 1990944 - RNA, 17 nt, Shigella flexneri 2a str. 301
cggcagccaccgccagc

SEQ ID NO: 1990945 - RNA, 16 nt, Shigella flexneri 2a str. 301
cggcagccaggcaauc

SEQ ID NO: 1990946 - RNA, 22 nt, Shigella flexneri 2a str. 301
cggcagacgcucgccauuuuuc

SEQ ID NO: 1990947 - RNA, 19 nt, Shigella flexneri 2a str. 301
cggcagcaaucgaccaggc

SEQ ID NO: 1990948 - RNA, 17 nt, Shigella flexneri 2a str. 301
cggcaauucucucugau

SEQ ID NO: 1990949 - RNA, 17 nt, Shigella flexneri 2a str. 301
cggcaauucucugcucc

SEQ ID NO: 1990950 - RNA, 18 nt, Shigella flexneri 2a str. 301
cggcaauuagcggcuggc

SEQ ID NO: 1990951 - RNA, 13 nt, Shigella flexneri 2a str. 301
cggcaauuuuuac

SEQ ID NO: 1990952 - RNA, 16 nt, Shigella flexneri 2a str. 301
cggcacagaaacgcca

SEQ ID NO: 1990953 - RNA, 16 nt, Shigella flexneri 2a str. 301
cggcaagaucagcauc

SEQ ID NO: 1990954 - RNA, 18 nt, Shigella flexneri 2a str. 301
cggcaagauacugcauaa

SEQ ID NO: 1990955 - RNA, 22 nt, Shigella flexneri 2a str. 301
cggcaaggguugagauuuauuu

SEQ ID NO: 1990956 - RNA, 16 nt, Shigella flexneri 2a str. 301
cggcaauaauccccgc

SEQ ID NO: 1990957 - RNA, 22 nt, Shigella flexneri 2a str. 301
cggcaauauagauaucaugcuc

SEQ ID NO: 1990958 - RNA, 21 nt, Shigella flexneri 2a str. 301
cggcaauacuuugcagaucgc

SEQ ID NO: 1990959 - RNA, 14 nt, Shigella flexneri 2a str. 301
cggcaaucacgccc

SEQ ID NO: 1990960 - RNA, 12 nt, Shigella flexneri 2a str. 301
cggcaaucgcca

SEQ ID NO: 1990961 - RNA, 17 nt, Shigella flexneri 2a str. 301
cggcaaucgcugcuaau

SEQ ID NO: 1990962 - RNA, 15 nt, Shigella flexneri 2a str. 301
cggcaaucuguuaug

SEQ ID NO: 1990963 - RNA, 19 nt, Shigella flexneri 2a str. 301
cggauccccugcgcggcga

SEQ ID NO: 1990964 - RNA, 23 nt, Shigella flexneri 2a str. 301
cggaucaugguagcgugauggcc

SEQ ID NO: 1990965 - RNA, 22 nt, Shigella flexneri 2a str. 301
cggcaacgacugcgagcaaaau

SEQ ID NO: 1990966 - RNA, 21 nt, Shigella flexneri 2a str. 301
cggauagauuuuuaaugcuuu

SEQ ID NO: 1990967 - RNA, 20 nt, Shigella flexneri 2a str. 301
cggaucaggcggcucaccug

SEQ ID NO: 1990968 - RNA, 16 nt, Shigella flexneri 2a str. 301
cggauaucgagaauca

SEQ ID NO: 1990969 - RNA, 13 nt, Shigella flexneri 2a str. 301
cggauaucaccac

SEQ ID NO: 1990970 - RNA, 18 nt, Shigella flexneri 2a str. 301
cggauaucuuucgccaug

SEQ ID NO: 1990971 - RNA, 16 nt, Shigella flexneri 2a str. 301
cggcauuaccggcaau

SEQ ID NO: 1990972 - RNA, 21 nt, Shigella flexneri 2a str. 301
cggcaugaacaaagcgcaccu

SEQ ID NO: 1990973 - RNA, 18 nt, Shigella flexneri 2a str. 301
cggcagcgucggaagcga

SEQ ID NO: 1990974 - RNA, 21 nt, Shigella flexneri 2a str. 301
cggcagcgugccaggcgcgcu

SEQ ID NO: 1990975 - RNA, 13 nt, Shigella flexneri 2a str. 301
cggcagcugucau

SEQ ID NO: 1990976 - RNA, 22 nt, Shigella flexneri 2a str. 301
cggcauuuuucggcgucagaac

SEQ ID NO: 1990977 - RNA, 18 nt, Shigella flexneri 2a str. 301
cggcauuuuuuucaccaa

SEQ ID NO: 1990978 - RNA, 18 nt, Shigella flexneri 2a str. 301
cggcauuuugcugaugca

SEQ ID NO: 1990979 - RNA, 19 nt, Shigella flexneri 2a str. 301
cggcauuuccauaccuaaa

SEQ ID NO: 1990980 - RNA, 23 nt, Shigella flexneri 2a str. 301
cggcauucagugcaaaugccaga

SEQ ID NO: 1990981 - RNA, 17 nt, Shigella flexneri 2a str. 301
cggcauucccagccccc

SEQ ID NO: 1990982 - RNA, 19 nt, Shigella flexneri 2a str. 301
cggccacagccagccaacg

SEQ ID NO: 1990983 - RNA, 14 nt, Shigella flexneri 2a str. 301
cggccagcgggcgu

SEQ ID NO: 1990984 - RNA, 14 nt, Shigella flexneri 2a str. 301
cggccauauccagc

SEQ ID NO: 1990985 - RNA, 23 nt, Shigella flexneri 2a str. 301
cgcguggcaauggcgacuucugc

SEQ ID NO: 1990986 - RNA, 18 nt, Shigella flexneri 2a str. 301
cgcgucuuaucuggccua

SEQ ID NO: 1990987 - RNA, 15 nt, Shigella flexneri 2a str. 301
cgcgucggcuugagu

SEQ ID NO: 1990988 - RNA, 24 nt, Shigella flexneri 2a str. 301
cgcguaugguuuuuccagccgagc

SEQ ID NO: 1990989 - RNA, 20 nt, Shigella flexneri 2a str. 301
cgcguagagaauccagugcu

SEQ ID NO: 1990990 - RNA, 19 nt, Shigella flexneri 2a str. 301
cgcguaauggcagcauuca

SEQ ID NO: 1990991 - RNA, 16 nt, Shigella flexneri 2a str. 301
cgcguaauggcagcau

SEQ ID NO: 1990992 - RNA, 15 nt, Shigella flexneri 2a str. 301
cgcguaauggcagca

SEQ ID NO: 1990993 - RNA, 20 nt, Shigella flexneri 2a str. 301
cgcguaaccgguaccugccg

SEQ ID NO: 1990994 - RNA, 16 nt, Shigella flexneri 2a str. 301
cgcguaacugaagcau

SEQ ID NO: 1990995 - RNA, 19 nt, Shigella flexneri 2a str. 301
cgcguaagcgauauuguuu

SEQ ID NO: 1990996 - RNA, 22 nt, Shigella flexneri 2a str. 301
cgcuauagacaccuugcaacuc

SEQ ID NO: 1990997 - RNA, 18 nt, Shigella flexneri 2a str. 301
cgcucaaucguaugauca

SEQ ID NO: 1990998 - RNA, 21 nt, Shigella flexneri 2a str. 301
cgcuauaucgcugauaucaaa

SEQ ID NO: 1990999 - RNA, 13 nt, Shigella flexneri 2a str. 301
cgcucauaaccaa

SEQ ID NO: 1991000 - RNA, 18 nt, Shigella flexneri 2a str. 301
cgcucauaauacaggcua

SEQ ID NO: 1991001 - RNA, 15 nt, Shigella flexneri 2a str. 301
cgcucaucaggccua

SEQ ID NO: 1991002 - RNA, 20 nt, Shigella flexneri 2a str. 301
cgcucaucgaagagacaaaa

SEQ ID NO: 1991003 - RNA, 15 nt, Shigella flexneri 2a str. 301
cgcucaccggaugcg

SEQ ID NO: 1991004 - RNA, 15 nt, Shigella flexneri 2a str. 301
cgcguuauccgcuuu

SEQ ID NO: 1991005 - RNA, 13 nt, Shigella flexneri 2a str. 301
cgcguucacugcc

SEQ ID NO: 1991006 - RNA, 14 nt, Shigella flexneri 2a str. 301
cgcguucacugccg

SEQ ID NO: 1991007 - RNA, 15 nt, Shigella flexneri 2a str. 301
cgcguuagccauaaa

SEQ ID NO: 1991008 - RNA, 15 nt, Shigella flexneri 2a str. 301
cgcguguuccagaga

SEQ ID NO: 1991009 - RNA, 19 nt, Shigella flexneri 2a str. 301
cgcguucgauggcgcgcca

SEQ ID NO: 1991010 - RNA, 21 nt, Shigella flexneri 2a str. 301
cgcuagccaacuuaccgccgg

SEQ ID NO: 1991011 - RNA, 14 nt, Shigella flexneri 2a str. 301
cgcuaccaccaaac

SEQ ID NO: 1991012 - RNA, 17 nt, Shigella flexneri 2a str. 301
cgcguuuaaucacacca

SEQ ID NO: 1991013 - RNA, 21 nt, Shigella flexneri 2a str. 301
cgcguuuaauggcggugccca

SEQ ID NO: 1991014 - RNA, 14 nt, Shigella flexneri 2a str. 301
cgcguuuacagagc

SEQ ID NO: 1991015 - RNA, 20 nt, Shigella flexneri 2a str. 301
cgcuaaggucaccaguucac

SEQ ID NO: 1991016 - RNA, 16 nt, Shigella flexneri 2a str. 301
cgcuaaucgcaccgac

SEQ ID NO: 1991017 - RNA, 17 nt, Shigella flexneri 2a str. 301
cgcuaagauaccccagc

SEQ ID NO: 1991018 - RNA, 21 nt, Shigella flexneri 2a str. 301
cgcuaaugcgacccaugcacc

SEQ ID NO: 1991019 - RNA, 21 nt, Shigella flexneri 2a str. 301
cgcugcacaauugccagcccu

SEQ ID NO: 1991020 - RNA, 19 nt, Shigella flexneri 2a str. 301
cgcugcaacguccugagca

SEQ ID NO: 1991021 - RNA, 19 nt, Shigella flexneri 2a str. 301
cgcugcauggcaacuuuaa

SEQ ID NO: 1991022 - RNA, 23 nt, Shigella flexneri 2a str. 301
cgcugcauugacaagcucaccuc

SEQ ID NO: 1991023 - RNA, 14 nt, Shigella flexneri 2a str. 301
cgcugcaucgccaa

SEQ ID NO: 1991024 - RNA, 14 nt, Shigella flexneri 2a str. 301
cgcugagagaagca

SEQ ID NO: 1991025 - RNA, 15 nt, Shigella flexneri 2a str. 301
cgcugagagaagcac

SEQ ID NO: 1991026 - RNA, 13 nt, Shigella flexneri 2a str. 301
cgcugagacgcgc

SEQ ID NO: 1991027 - RNA, 20 nt, Shigella flexneri 2a str. 301
cgcugacgcgucuuaucugg

SEQ ID NO: 1991028 - RNA, 14 nt, Shigella flexneri 2a str. 301
cgcugacggcagcg

SEQ ID NO: 1991029 - RNA, 15 nt, Shigella flexneri 2a str. 301
cgcugacucuacuga

SEQ ID NO: 1991030 - RNA, 12 nt, Shigella flexneri 2a str. 301
cgcugauucaag

SEQ ID NO: 1991031 - RNA, 20 nt, Shigella flexneri 2a str. 301
cgcugaugucagcacuucca

SEQ ID NO: 1991032 - RNA, 16 nt, Shigella flexneri 2a str. 301
cgcugauuugcuucaa

SEQ ID NO: 1991033 - RNA, 21 nt, Shigella flexneri 2a str. 301
cgcugauuuuuuuucaaccua

SEQ ID NO: 1991034 - RNA, 20 nt, Shigella flexneri 2a str. 301
cgcugauuucaccaucuuca

SEQ ID NO: 1991035 - RNA, 13 nt, Shigella flexneri 2a str. 301
cgcucgcgccgca

SEQ ID NO: 1991036 - RNA, 16 nt, Shigella flexneri 2a str. 301
cgcucgcgccgcaucc

SEQ ID NO: 1991037 - RNA, 15 nt, Shigella flexneri 2a str. 301
cgcucuuuaaaggcc

SEQ ID NO: 1991038 - RNA, 14 nt, Shigella flexneri 2a str. 301
cgcugaaagcugaa

SEQ ID NO: 1991039 - RNA, 21 nt, Shigella flexneri 2a str. 301
cgcugaaagcugaacaaagcc

SEQ ID NO: 1991040 - RNA, 19 nt, Shigella flexneri 2a str. 301
cgcucggcgcaaucgccag

SEQ ID NO: 1991041 - RNA, 22 nt, Shigella flexneri 2a str. 301
cgcucuuguucuuccggcacac

SEQ ID NO: 1991042 - RNA, 19 nt, Shigella flexneri 2a str. 301
cgcucgagagagaaaauaa

SEQ ID NO: 1991043 - RNA, 17 nt, Shigella flexneri 2a str. 301
cgcucgaagcgggcgcg

SEQ ID NO: 1991044 - RNA, 17 nt, Shigella flexneri 2a str. 301
cgcuccgcaccugagua

SEQ ID NO: 1991045 - RNA, 17 nt, Shigella flexneri 2a str. 301
cgcucaucugcugcguu

SEQ ID NO: 1991046 - RNA, 13 nt, Shigella flexneri 2a str. 301
cgcucccugccag

SEQ ID NO: 1991047 - RNA, 21 nt, Shigella flexneri 2a str. 301
cgcucccuggcccaucgccag

SEQ ID NO: 1991048 - RNA, 18 nt, Shigella flexneri 2a str. 301
cgcucccgcaggagcgcc

SEQ ID NO: 1991049 - RNA, 13 nt, Shigella flexneri 2a str. 301
cgcuccagugccu

SEQ ID NO: 1991050 - RNA, 13 nt, Shigella flexneri 2a str. 301
cgccagcaacaca

SEQ ID NO: 1991051 - RNA, 20 nt, Shigella flexneri 2a str. 301
cgccagcaagagcaaauaaa

SEQ ID NO: 1991052 - RNA, 16 nt, Shigella flexneri 2a str. 301
cgccagcacaucaucc

SEQ ID NO: 1991053 - RNA, 15 nt, Shigella flexneri 2a str. 301
cgcgccucaggcacu

SEQ ID NO: 1991054 - RNA, 20 nt, Shigella flexneri 2a str. 301
cgcgcgaauauggcggcggc

SEQ ID NO: 1991055 - RNA, 13 nt, Shigella flexneri 2a str. 301
cgcgccugccagg

SEQ ID NO: 1991056 - RNA, 12 nt, Shigella flexneri 2a str. 301
cgcgcgcagcac

SEQ ID NO: 1991057 - RNA, 12 nt, Shigella flexneri 2a str. 301
cgcgcgccgcca

SEQ ID NO: 1991058 - RNA, 13 nt, Shigella flexneri 2a str. 301
cgcgcgucacgau

SEQ ID NO: 1991059 - RNA, 18 nt, Shigella flexneri 2a str. 301
cgcgcggcgaaccagccg

SEQ ID NO: 1991060 - RNA, 18 nt, Shigella flexneri 2a str. 301
cgcgcucugccagcaaau

SEQ ID NO: 1991061 - RNA, 18 nt, Shigella flexneri 2a str. 301
cgcgcugagguccggcca

SEQ ID NO: 1991062 - RNA, 15 nt, Shigella flexneri 2a str. 301
cgcgcucaucagcgg

SEQ ID NO: 1991063 - RNA, 14 nt, Shigella flexneri 2a str. 301
cgcgcuauuuuccu

SEQ ID NO: 1991064 - RNA, 15 nt, Shigella flexneri 2a str. 301
cgcggaccaacaaaa

SEQ ID NO: 1991065 - RNA, 17 nt, Shigella flexneri 2a str. 301
cgcgcuucacaugccac

SEQ ID NO: 1991066 - RNA, 18 nt, Shigella flexneri 2a str. 301
cgcgcuucagucgccagc

SEQ ID NO: 1991067 - RNA, 16 nt, Shigella flexneri 2a str. 301
cgcgcuuaucgccagc

SEQ ID NO: 1991068 - RNA, 20 nt, Shigella flexneri 2a str. 301
cgcgcuuaucgccagcgcca

SEQ ID NO: 1991069 - RNA, 15 nt, Shigella flexneri 2a str. 301
cgcgcuuaucgccag

SEQ ID NO: 1991070 - RNA, 15 nt, Shigella flexneri 2a str. 301
cgcgcugucgggcag

SEQ ID NO: 1991071 - RNA, 22 nt, Shigella flexneri 2a str. 301
cgcggcacacagcacggcagca

SEQ ID NO: 1991072 - RNA, 13 nt, Shigella flexneri 2a str. 301
cgcggcaggcauc

SEQ ID NO: 1991073 - RNA, 16 nt, Shigella flexneri 2a str. 301
cgcggcccaccuggcu

SEQ ID NO: 1991074 - RNA, 15 nt, Shigella flexneri 2a str. 301
cgcggcgacuuccag

SEQ ID NO: 1991075 - RNA, 20 nt, Shigella flexneri 2a str. 301
cgcggcuuugucauaaccaa

SEQ ID NO: 1991076 - RNA, 12 nt, Shigella flexneri 2a str. 301
cguccagaugcg

SEQ ID NO: 1991077 - RNA, 21 nt, Shigella flexneri 2a str. 301
cguacucugccacuacccgca

SEQ ID NO: 1991078 - RNA, 12 nt, Shigella flexneri 2a str. 301
cguacuuccuua

SEQ ID NO: 1991079 - RNA, 16 nt, Shigella flexneri 2a str. 301
cguacuggcaaucgcc

SEQ ID NO: 1991080 - RNA, 15 nt, Shigella flexneri 2a str. 301
cguccagcagcaaug

SEQ ID NO: 1991081 - RNA, 22 nt, Shigella flexneri 2a str. 301
cguccaguuugccuucacaggc

SEQ ID NO: 1991082 - RNA, 19 nt, Shigella flexneri 2a str. 301
cguccauuucagcgcagac

SEQ ID NO: 1991083 - RNA, 17 nt, Shigella flexneri 2a str. 301
cgucccacgaccgcagc

SEQ ID NO: 1991084 - RNA, 20 nt, Shigella flexneri 2a str. 301
cgucccaucggcaaucauuc

SEQ ID NO: 1991085 - RNA, 19 nt, Shigella flexneri 2a str. 301
cguccgauuaaaaacccug

SEQ ID NO: 1991086 - RNA, 20 nt, Shigella flexneri 2a str. 301
cguccuggcaacggacgacc

SEQ ID NO: 1991087 - RNA, 15 nt, Shigella flexneri 2a str. 301
cguccucuucccaga

SEQ ID NO: 1991088 - RNA, 21 nt, Shigella flexneri 2a str. 301
cgucggcaucgggcagcaucg

SEQ ID NO: 1991089 - RNA, 15 nt, Shigella flexneri 2a str. 301
cgucggauauaaaaa

SEQ ID NO: 1991090 - RNA, 17 nt, Shigella flexneri 2a str. 301
cgucgcgcacgcccauc

SEQ ID NO: 1991091 - RNA, 13 nt, Shigella flexneri 2a str. 301
cgucgccuucaac

SEQ ID NO: 1991092 - RNA, 23 nt, Shigella flexneri 2a str. 301
cgucgcgguugcugucggcggcg

SEQ ID NO: 1991093 - RNA, 19 nt, Shigella flexneri 2a str. 301
cgucgauaucgaugacgcg

SEQ ID NO: 1991094 - RNA, 18 nt, Shigella flexneri 2a str. 301
cgucgccaguaccagcag

SEQ ID NO: 1991095 - RNA, 14 nt, Shigella flexneri 2a str. 301
cgucgccagcgccu

SEQ ID NO: 1991096 - RNA, 16 nt, Shigella flexneri 2a str. 301
cgucgcaucaggcauu

SEQ ID NO: 1991097 - RNA, 13 nt, Shigella flexneri 2a str. 301
cgucgcacccggc

SEQ ID NO: 1991098 - RNA, 14 nt, Shigella flexneri 2a str. 301
cgucgauugcucaa

SEQ ID NO: 1991099 - RNA, 15 nt, Shigella flexneri 2a str. 301
cgugccauuaauguc

SEQ ID NO: 1991100 - RNA, 19 nt, Shigella flexneri 2a str. 301
cgugcccaacugccugaug

SEQ ID NO: 1991101 - RNA, 23 nt, Shigella flexneri 2a str. 301
cgugccaggguggcucaaucgcc

SEQ ID NO: 1991102 - RNA, 18 nt, Shigella flexneri 2a str. 301
cgugccaggaccauucac

SEQ ID NO: 1991103 - RNA, 13 nt, Shigella flexneri 2a str. 301
cgugccagauguu

SEQ ID NO: 1991104 - RNA, 11 nt, Shigella flexneri 2a str. 301
cgugcccugcg

SEQ ID NO: 1991105 - RNA, 13 nt, Shigella flexneri 2a str. 301
cgugccgcauuuc

SEQ ID NO: 1991106 - RNA, 20 nt, Shigella flexneri 2a str. 301
cgugcauagcagcacaccac

SEQ ID NO: 1991107 - RNA, 19 nt, Shigella flexneri 2a str. 301
cgugcauagcagcacacca

SEQ ID NO: 1991108 - RNA, 16 nt, Shigella flexneri 2a str. 301
cgugcaucauggaagc

SEQ ID NO: 1991109 - RNA, 15 nt, Shigella flexneri 2a str. 301
cgugcaggcauucag

SEQ ID NO: 1991110 - RNA, 16 nt, Shigella flexneri 2a str. 301
cgugcaaauucaauau

SEQ ID NO: 1991111 - RNA, 21 nt, Shigella flexneri 2a str. 301
cgugcaaauauacauaaaguc

SEQ ID NO: 1991112 - RNA, 17 nt, Shigella flexneri 2a str. 301
cgugcaaaaucaaacag

SEQ ID NO: 1991113 - RNA, 16 nt, Shigella flexneri 2a str. 301
cgugcacugaaauuuu

SEQ ID NO: 1991114 - RNA, 16 nt, Shigella flexneri 2a str. 301
cgugagaacaccaccu

SEQ ID NO: 1991115 - RNA, 17 nt, Shigella flexneri 2a str. 301
cgugaccgccagaacac

SEQ ID NO: 1991116 - RNA, 15 nt, Shigella flexneri 2a str. 301
cgugacgaucaccac

SEQ ID NO: 1991117 - RNA, 16 nt, Shigella flexneri 2a str. 301
cgugaacgugcaaaau

SEQ ID NO: 1991118 - RNA, 22 nt, Shigella flexneri 2a str. 301
cgugaacuucgccauuuucugc

SEQ ID NO: 1991119 - RNA, 17 nt, Shigella flexneri 2a str. 301
cgugaauauggaacgga

SEQ ID NO: 1991120 - RNA, 18 nt, Shigella flexneri 2a str. 301
cgugaagcuggcagaagu

SEQ ID NO: 1991121 - RNA, 17 nt, Shigella flexneri 2a str. 301
cgugaaguaaaaggucu

SEQ ID NO: 1991122 - RNA, 12 nt, Shigella flexneri 2a str. 301
cgugaauuacug

SEQ ID NO: 1991123 - RNA, 20 nt, Shigella flexneri 2a str. 301
cgugaaugccuuauccggca

SEQ ID NO: 1991124 - RNA, 16 nt, Shigella flexneri 2a str. 301
cgugacacgcagucuc

SEQ ID NO: 1991125 - RNA, 19 nt, Shigella flexneri 2a str. 301
cgugagcguauuggugaau

SEQ ID NO: 1991126 - RNA, 20 nt, Shigella flexneri 2a str. 301
cgugaguuuuuguccccuca

SEQ ID NO: 1991127 - RNA, 17 nt, Shigella flexneri 2a str. 301
cgugauaaacauccacc

SEQ ID NO: 1991128 - RNA, 23 nt, Shigella flexneri 2a str. 301
cgugaucgucuucaaccgcagug

SEQ ID NO: 1991129 - RNA, 20 nt, Shigella flexneri 2a str. 301
cgugaucgaacaucugcgug

SEQ ID NO: 1991130 - RNA, 19 nt, Shigella flexneri 2a str. 301
cgugauucacguucgugaa

SEQ ID NO: 1991131 - RNA, 14 nt, Shigella flexneri 2a str. 301
cgugauugguuuca

SEQ ID NO: 1991132 - RNA, 15 nt, Shigella flexneri 2a str. 301
cgucuccaucaauac

SEQ ID NO: 1991133 - RNA, 20 nt, Shigella flexneri 2a str. 301
cgucucccgaugccagcaca

SEQ ID NO: 1991134 - RNA, 12 nt, Shigella flexneri 2a str. 301
cgucuccaucaa

SEQ ID NO: 1991135 - RNA, 17 nt, Shigella flexneri 2a str. 301
cgucuacaggcgcgacc

SEQ ID NO: 1991136 - RNA, 19 nt, Shigella flexneri 2a str. 301
cgucucagcaccgucuggc

SEQ ID NO: 1991137 - RNA, 20 nt, Shigella flexneri 2a str. 301
cgucguuacugucgcgcagc

SEQ ID NO: 1991138 - RNA, 22 nt, Shigella flexneri 2a str. 301
cgucggcuuucagcgcgacgcu

SEQ ID NO: 1991139 - RNA, 17 nt, Shigella flexneri 2a str. 301
cgucggcgucagcgcca

SEQ ID NO: 1991140 - RNA, 14 nt, Shigella flexneri 2a str. 301
cgugaaacucagcc

SEQ ID NO: 1991141 - RNA, 15 nt, Shigella flexneri 2a str. 301
cgugaaaaaucaaua

SEQ ID NO: 1991142 - RNA, 12 nt, Shigella flexneri 2a str. 301
cgucuuaucugg

SEQ ID NO: 1991143 - RNA, 20 nt, Shigella flexneri 2a str. 301
cgucuuaucuggccuacaga

SEQ ID NO: 1991144 - RNA, 16 nt, Shigella flexneri 2a str. 301
cgucuucugcagucac

SEQ ID NO: 1991145 - RNA, 13 nt, Shigella flexneri 2a str. 301
cgucuucguccca

SEQ ID NO: 1991146 - RNA, 18 nt, Shigella flexneri 2a str. 301
cgucuucugguugcgaaa

SEQ ID NO: 1991147 - RNA, 21 nt, Shigella flexneri 2a str. 301
cgucuucugguuuuucugaaa

SEQ ID NO: 1991148 - RNA, 19 nt, Shigella flexneri 2a str. 301
cgucuguuuuaucucccug

SEQ ID NO: 1991149 - RNA, 18 nt, Shigella flexneri 2a str. 301
cgucugggcaaaaucauc

SEQ ID NO: 1991150 - RNA, 19 nt, Shigella flexneri 2a str. 301
cgucugggcaaaaucauca

SEQ ID NO: 1991151 - RNA, 15 nt, Shigella flexneri 2a str. 301
cgucugauguaauca

SEQ ID NO: 1991152 - RNA, 15 nt, Shigella flexneri 2a str. 301
cgucugacggccuuc

SEQ ID NO: 1991153 - RNA, 12 nt, Shigella flexneri 2a str. 301
cgucugaaaacu

SEQ ID NO: 1991154 - RNA, 18 nt, Shigella flexneri 2a str. 301
cuaaccgcuuuuccagca

SEQ ID NO: 1991155 - RNA, 15 nt, Shigella flexneri 2a str. 301
cuaaccgcuuuucca

SEQ ID NO: 1991156 - RNA, 13 nt, Shigella flexneri 2a str. 301
cuaacgaaagaac

SEQ ID NO: 1991157 - RNA, 20 nt, Shigella flexneri 2a str. 301
cuaacgauaccguguuauuc

SEQ ID NO: 1991158 - RNA, 15 nt, Shigella flexneri 2a str. 301
cuaacccucuccccg

SEQ ID NO: 1991159 - RNA, 16 nt, Shigella flexneri 2a str. 301
cuaacccgcgacuggc

SEQ ID NO: 1991160 - RNA, 22 nt, Shigella flexneri 2a str. 301
cuaaccgaauucaaauccuuca

SEQ ID NO: 1991161 - RNA, 14 nt, Shigella flexneri 2a str. 301
cuaacuucuuuuuc

SEQ ID NO: 1991162 - RNA, 18 nt, Shigella flexneri 2a str. 301
cuaacgcgucuuaucugg

SEQ ID NO: 1991163 - RNA, 16 nt, Shigella flexneri 2a str. 301
cuaacgcgucuuaucu

SEQ ID NO: 1991164 - RNA, 21 nt, Shigella flexneri 2a str. 301
cuaacgcgucuuaucuggccu

SEQ ID NO: 1991165 - RNA, 20 nt, Shigella flexneri 2a str. 301
cuaagaauguccauuauuuc

SEQ ID NO: 1991166 - RNA, 20 nt, Shigella flexneri 2a str. 301
cuaagccauuuaacucaccg

SEQ ID NO: 1991167 - RNA, 15 nt, Shigella flexneri 2a str. 301
cuaagccauuuaacu

SEQ ID NO: 1991168 - RNA, 15 nt, Shigella flexneri 2a str. 301
cuaaagcaacuccau

SEQ ID NO: 1991169 - RNA, 18 nt, Shigella flexneri 2a str. 301
cuaaagcacccagcaauc

SEQ ID NO: 1991170 - RNA, 19 nt, Shigella flexneri 2a str. 301
cuaaaucuggugcuuuuuc

SEQ ID NO: 1991171 - RNA, 22 nt, Shigella flexneri 2a str. 301
cuaaaucuggugcuuuuucaac

SEQ ID NO: 1991172 - RNA, 15 nt, Shigella flexneri 2a str. 301
cuaaaugcugcagcc

SEQ ID NO: 1991173 - RNA, 14 nt, Shigella flexneri 2a str. 301
cuaaauguucaaua

SEQ ID NO: 1991174 - RNA, 14 nt, Shigella flexneri 2a str. 301
cuaacagaucaucc

SEQ ID NO: 1991175 - RNA, 14 nt, Shigella flexneri 2a str. 301
cuaacagcaauccc

SEQ ID NO: 1991176 - RNA, 12 nt, Shigella flexneri 2a str. 301
cuaacagcagca

SEQ ID NO: 1991177 - RNA, 13 nt, Shigella flexneri 2a str. 301
cuaacaggcuuuu

SEQ ID NO: 1991178 - RNA, 20 nt, Shigella flexneri 2a str. 301
cuaacacugcguacagcgcg

SEQ ID NO: 1991179 - RNA, 15 nt, Shigella flexneri 2a str. 301
cuaacagaacaauaa

SEQ ID NO: 1991180 - RNA, 19 nt, Shigella flexneri 2a str. 301
cuaacaaucucaaccgcuu

SEQ ID NO: 1991181 - RNA, 20 nt, Shigella flexneri 2a str. 301
cuaaaaacagcaucaauaau

SEQ ID NO: 1991182 - RNA, 15 nt, Shigella flexneri 2a str. 301
cuaaaaauugcagac

SEQ ID NO: 1991183 - RNA, 18 nt, Shigella flexneri 2a str. 301
cuaaaaauugcagacccg

SEQ ID NO: 1991184 - RNA, 16 nt, Shigella flexneri 2a str. 301
cuaaaagcacgccaga

SEQ ID NO: 1991185 - RNA, 22 nt, Shigella flexneri 2a str. 301
cuaaaagcacgccagacaucac

SEQ ID NO: 1991186 - RNA, 24 nt, Shigella flexneri 2a str. 301
cuaaaagcauagccccagcgcaga

SEQ ID NO: 1991187 - RNA, 23 nt, Shigella flexneri 2a str. 301
cuaaaccagguauccaguuucug

SEQ ID NO: 1991188 - RNA, 23 nt, Shigella flexneri 2a str. 301
cuaaaccaucaggaugacaaacu

SEQ ID NO: 1991189 - RNA, 19 nt, Shigella flexneri 2a str. 301
cuaaacccgaccacuucca

SEQ ID NO: 1991190 - RNA, 21 nt, Shigella flexneri 2a str. 301
cguuucgcagguuccgcauac

SEQ ID NO: 1991191 - RNA, 19 nt, Shigella flexneri 2a str. 301
cguuuguaacccaccaugc

SEQ ID NO: 1991192 - RNA, 15 nt, Shigella flexneri 2a str. 301
cguuuuuuguacucu

SEQ ID NO: 1991193 - RNA, 13 nt, Shigella flexneri 2a str. 301
cguuuuuuguccg

SEQ ID NO: 1991194 - RNA, 22 nt, Shigella flexneri 2a str. 301
cguuuuaaugcgauccugagcc

SEQ ID NO: 1991195 - RNA, 22 nt, Shigella flexneri 2a str. 301
cguugcuugaugcacugggaga

SEQ ID NO: 1991196 - RNA, 21 nt, Shigella flexneri 2a str. 301
cguugcuuuuugcgcauccag

SEQ ID NO: 1991197 - RNA, 15 nt, Shigella flexneri 2a str. 301
cguugaaaaaucaaa

SEQ ID NO: 1991198 - RNA, 14 nt, Shigella flexneri 2a str. 301
cguugaaagauaau

SEQ ID NO: 1991199 - RNA, 13 nt, Shigella flexneri 2a str. 301
cguuggccugaua

SEQ ID NO: 1991200 - RNA, 16 nt, Shigella flexneri 2a str. 301
cguucugaucuuucuu

SEQ ID NO: 1991201 - RNA, 13 nt, Shigella flexneri 2a str. 301
cguucuucccucc

SEQ ID NO: 1991202 - RNA, 19 nt, Shigella flexneri 2a str. 301
cguucuucagacuccugaa

SEQ ID NO: 1991203 - RNA, 14 nt, Shigella flexneri 2a str. 301
cguucggcgagcag

SEQ ID NO: 1991204 - RNA, 17 nt, Shigella flexneri 2a str. 301
cguuuccauucgcugcu

SEQ ID NO: 1991205 - RNA, 20 nt, Shigella flexneri 2a str. 301
cguuuacccaaacuuaacac

SEQ ID NO: 1991206 - RNA, 19 nt, Shigella flexneri 2a str. 301
cguuuaaucacaccauuga

SEQ ID NO: 1991207 - RNA, 16 nt, Shigella flexneri 2a str. 301
cguuacgccccaacac

SEQ ID NO: 1991208 - RNA, 21 nt, Shigella flexneri 2a str. 301
cguuacgccccgguuucucuu

SEQ ID NO: 1991209 - RNA, 17 nt, Shigella flexneri 2a str. 301
cguuacguucuccugaa

SEQ ID NO: 1991210 - RNA, 17 nt, Shigella flexneri 2a str. 301
cguuacguacuuccuua

SEQ ID NO: 1991211 - RNA, 19 nt, Shigella flexneri 2a str. 301
cguuacguaccacgcacag

SEQ ID NO: 1991212 - RNA, 12 nt, Shigella flexneri 2a str. 301
cguuacguacuu

SEQ ID NO: 1991213 - RNA, 20 nt, Shigella flexneri 2a str. 301
cguuagccagcgcaccagcg

SEQ ID NO: 1991214 - RNA, 18 nt, Shigella flexneri 2a str. 301
cguuagccagcgcaccag

SEQ ID NO: 1991215 - RNA, 15 nt, Shigella flexneri 2a str. 301
cguucaaccacuuca

SEQ ID NO: 1991216 - RNA, 20 nt, Shigella flexneri 2a str. 301
cguuauucaggcccgccagc

SEQ ID NO: 1991217 - RNA, 19 nt, Shigella flexneri 2a str. 301
cguucacgcagcucacgca

SEQ ID NO: 1991218 - RNA, 20 nt, Shigella flexneri 2a str. 301
cguucaauaccgucugcgcc

SEQ ID NO: 1991219 - RNA, 13 nt, Shigella flexneri 2a str. 301
cguuccaccgcuc

SEQ ID NO: 1991220 - RNA, 15 nt, Shigella flexneri 2a str. 301
cguucgcccauucca

SEQ ID NO: 1991221 - RNA, 13 nt, Shigella flexneri 2a str. 301
cguucccagcgga

SEQ ID NO: 1991222 - RNA, 13 nt, Shigella flexneri 2a str. 301
cguucccauucac

SEQ ID NO: 1991223 - RNA, 22 nt, Shigella flexneri 2a str. 301
cguuccccuguugugccagacc

SEQ ID NO: 1991224 - RNA, 15 nt, Shigella flexneri 2a str. 301
cguguuaauuaccua

SEQ ID NO: 1991225 - RNA, 17 nt, Shigella flexneri 2a str. 301
cguguugaggaagcgca

SEQ ID NO: 1991226 - RNA, 22 nt, Shigella flexneri 2a str. 301
cguguuuaugaaaguuuaacua

SEQ ID NO: 1991227 - RNA, 16 nt, Shigella flexneri 2a str. 301
cguguuucucaaauga

SEQ ID NO: 1991228 - RNA, 17 nt, Shigella flexneri 2a str. 301
cguuaaauccagauccu

SEQ ID NO: 1991229 - RNA, 13 nt, Shigella flexneri 2a str. 301
cguuaaagaaagu

SEQ ID NO: 1991230 - RNA, 18 nt, Shigella flexneri 2a str. 301
cguuaaaacuaaaaacag

SEQ ID NO: 1991231 - RNA, 15 nt, Shigella flexneri 2a str. 301
cguuaaccacuucag

SEQ ID NO: 1991232 - RNA, 14 nt, Shigella flexneri 2a str. 301
cguuaacugcugau

SEQ ID NO: 1991233 - RNA, 20 nt, Shigella flexneri 2a str. 301
cguuaagaaaacggaagcuc

SEQ ID NO: 1991234 - RNA, 15 nt, Shigella flexneri 2a str. 301
cgugucuuuuacuga

SEQ ID NO: 1991235 - RNA, 18 nt, Shigella flexneri 2a str. 301
cgugucuuaucaggccua

SEQ ID NO: 1991236 - RNA, 15 nt, Shigella flexneri 2a str. 301
cgugguuuaugcaau

SEQ ID NO: 1991237 - RNA, 19 nt, Shigella flexneri 2a str. 301
cgugguucauaugauucau

SEQ ID NO: 1991238 - RNA, 20 nt, Shigella flexneri 2a str. 301
cgugcguuccacccacggcg

SEQ ID NO: 1991239 - RNA, 18 nt, Shigella flexneri 2a str. 301
cgugcgguuucagcucac

SEQ ID NO: 1991240 - RNA, 16 nt, Shigella flexneri 2a str. 301
cgugcucgcuuuccau

SEQ ID NO: 1991241 - RNA, 20 nt, Shigella flexneri 2a str. 301
cgugcucaccacgcagcagc

SEQ ID NO: 1991242 - RNA, 22 nt, Shigella flexneri 2a str. 301
cgugcucaccacgcagcagcca

SEQ ID NO: 1991243 - RNA, 16 nt, Shigella flexneri 2a str. 301
cgugcgggcacaggcg

SEQ ID NO: 1991244 - RNA, 19 nt, Shigella flexneri 2a str. 301
cgugcgggcgaaagcagaa

SEQ ID NO: 1991245 - RNA, 18 nt, Shigella flexneri 2a str. 301
cguggaugcgauguuccc

SEQ ID NO: 1991246 - RNA, 18 nt, Shigella flexneri 2a str. 301
cguggauuuaaugccaau

SEQ ID NO: 1991247 - RNA, 20 nt, Shigella flexneri 2a str. 301
cguggauuuaaugccaaucu

SEQ ID NO: 1991248 - RNA, 19 nt, Shigella flexneri 2a str. 301
cguggcaucgggcacagcg

SEQ ID NO: 1991249 - RNA, 15 nt, Shigella flexneri 2a str. 301
cgugcuguacagcag

SEQ ID NO: 1991250 - RNA, 16 nt, Shigella flexneri 2a str. 301
cgugcugccagcgauu

SEQ ID NO: 1991251 - RNA, 14 nt, Shigella flexneri 2a str. 301
cguggucauggcau

SEQ ID NO: 1991252 - RNA, 14 nt, Shigella flexneri 2a str. 301
cgugggcaggaaaa

SEQ ID NO: 1991253 - RNA, 15 nt, Shigella flexneri 2a str. 301
cguggcugacggccc

SEQ ID NO: 1991254 - RNA, 15 nt, Shigella flexneri 2a str. 301
cguggcgcagugccu

SEQ ID NO: 1991255 - RNA, 20 nt, Shigella flexneri 2a str. 301
cguggcgauaaucagcgcca

SEQ ID NO: 1991256 - RNA, 14 nt, Shigella flexneri 2a str. 301
cguggccuccaaaa

SEQ ID NO: 1991257 - RNA, 23 nt, Shigella flexneri 2a str. 301
cguggccaugagccaguucuucu

SEQ ID NO: 1991258 - RNA, 18 nt, Shigella flexneri 2a str. 301
cuccaucucgccauccuu

SEQ ID NO: 1991259 - RNA, 22 nt, Shigella flexneri 2a str. 301
cuccaugagaagcugaaaucau

SEQ ID NO: 1991260 - RNA, 19 nt, Shigella flexneri 2a str. 301
cuccauccagcaacaacag

SEQ ID NO: 1991261 - RNA, 22 nt, Shigella flexneri 2a str. 301
cuccauccgggaucacaucaua

SEQ ID NO: 1991262 - RNA, 21 nt, Shigella flexneri 2a str. 301
cuccauacaucuucaucaucc

SEQ ID NO: 1991263 - RNA, 13 nt, Shigella flexneri 2a str. 301
cuccagguccucc

SEQ ID NO: 1991264 - RNA, 22 nt, Shigella flexneri 2a str. 301
cuccagguccuccuguaccuuc

SEQ ID NO: 1991265 - RNA, 15 nt, Shigella flexneri 2a str. 301
cuccagugcauccag

SEQ ID NO: 1991266 - RNA, 15 nt, Shigella flexneri 2a str. 301
cuccagucgcgugug

SEQ ID NO: 1991267 - RNA, 19 nt, Shigella flexneri 2a str. 301
cuccaguuuguucagcugc

SEQ ID NO: 1991268 - RNA, 13 nt, Shigella flexneri 2a str. 301
cuccagccagagc

SEQ ID NO: 1991269 - RNA, 22 nt, Shigella flexneri 2a str. 301
cuccagcgcgucugcgcccagc

SEQ ID NO: 1991270 - RNA, 13 nt, Shigella flexneri 2a str. 301
cuccagcgccgcc

SEQ ID NO: 1991271 - RNA, 11 nt, Shigella flexneri 2a str. 301
cuccagcgccg

SEQ ID NO: 1991272 - RNA, 13 nt, Shigella flexneri 2a str. 301
cuccagcgccgca

SEQ ID NO: 1991273 - RNA, 16 nt, Shigella flexneri 2a str. 301
cuccagcgccgccaga

SEQ ID NO: 1991274 - RNA, 22 nt, Shigella flexneri 2a str. 301
cuccaggagcguauucagcaau

SEQ ID NO: 1991275 - RNA, 13 nt, Shigella flexneri 2a str. 301
cuccagcuauaac

SEQ ID NO: 1991276 - RNA, 20 nt, Shigella flexneri 2a str. 301
cuccaccucauuaagaugca

SEQ ID NO: 1991277 - RNA, 11 nt, Shigella flexneri 2a str. 301
cuccaccugag

SEQ ID NO: 1991278 - RNA, 14 nt, Shigella flexneri 2a str. 301
cucauuugcagaaa

SEQ ID NO: 1991279 - RNA, 13 nt, Shigella flexneri 2a str. 301
cuccacuuuuaca

SEQ ID NO: 1991280 - RNA, 22 nt, Shigella flexneri 2a str. 301
cuccacuuuuacaugcgcgaca

SEQ ID NO: 1991281 - RNA, 13 nt, Shigella flexneri 2a str. 301
cuccacugcucac

SEQ ID NO: 1991282 - RNA, 14 nt, Shigella flexneri 2a str. 301
cuccacugaagacg

SEQ ID NO: 1991283 - RNA, 12 nt, Shigella flexneri 2a str. 301
cuccacgcugca

SEQ ID NO: 1991284 - RNA, 23 nt, Shigella flexneri 2a str. 301
cucauuuuucagcguuccccaga

SEQ ID NO: 1991285 - RNA, 20 nt, Shigella flexneri 2a str. 301
cuccacgcugcaucgccaau

SEQ ID NO: 1991286 - RNA, 21 nt, Shigella flexneri 2a str. 301
cuccacgcuuaacaacccguu

SEQ ID NO: 1991287 - RNA, 16 nt, Shigella flexneri 2a str. 301
cuccacgauguucuga

SEQ ID NO: 1991288 - RNA, 18 nt, Shigella flexneri 2a str. 301
cuccacgauguucugagc

SEQ ID NO: 1991289 - RNA, 22 nt, Shigella flexneri 2a str. 301
cuccacgauguucugagcgaag

SEQ ID NO: 1991290 - RNA, 23 nt, Shigella flexneri 2a str. 301
cuccagauuaccagcgacaucac

SEQ ID NO: 1991291 - RNA, 20 nt, Shigella flexneri 2a str. 301
cuccagauuacuuaacuuau

SEQ ID NO: 1991292 - RNA, 22 nt, Shigella flexneri 2a str. 301
cuccagauuacuuaacuuauau

SEQ ID NO: 1991293 - RNA, 17 nt, Shigella flexneri 2a str. 301
cuccagcaauaacauua

SEQ ID NO: 1991294 - RNA, 20 nt, Shigella flexneri 2a str. 301
cuccuauuguugauaaggaa

SEQ ID NO: 1991295 - RNA, 18 nt, Shigella flexneri 2a str. 301
cuccucgcgaaucuccac

SEQ ID NO: 1991296 - RNA, 22 nt, Shigella flexneri 2a str. 301
cuccugacgaucauauuguucc

SEQ ID NO: 1991297 - RNA, 20 nt, Shigella flexneri 2a str. 301
cuccuauuaucggcaccauu

SEQ ID NO: 1991298 - RNA, 24 nt, Shigella flexneri 2a str. 301
cuccggcgcguugaugccgugcag

SEQ ID NO: 1991299 - RNA, 17 nt, Shigella flexneri 2a str. 301
cuccggcgcauccauga

SEQ ID NO: 1991300 - RNA, 23 nt, Shigella flexneri 2a str. 301
cuccggccuuuuuuaucucuuac

SEQ ID NO: 1991301 - RNA, 14 nt, Shigella flexneri 2a str. 301
cuccggcugggcgu

SEQ ID NO: 1991302 - RNA, 17 nt, Shigella flexneri 2a str. 301
cuccggcggcacagcca

SEQ ID NO: 1991303 - RNA, 21 nt, Shigella flexneri 2a str. 301
cuccgggaaaacgcuggcagc

SEQ ID NO: 1991304 - RNA, 16 nt, Shigella flexneri 2a str. 301
cuccgggcgcaccagu

SEQ ID NO: 1991305 - RNA, 18 nt, Shigella flexneri 2a str. 301
cuccggcagccaggcaau

SEQ ID NO: 1991306 - RNA, 20 nt, Shigella flexneri 2a str. 301
cuccgccggaaucaacggca

SEQ ID NO: 1991307 - RNA, 16 nt, Shigella flexneri 2a str. 301
cuccgccgcaucuucc

SEQ ID NO: 1991308 - RNA, 21 nt, Shigella flexneri 2a str. 301
cuccgccagcguagucggcag

SEQ ID NO: 1991309 - RNA, 23 nt, Shigella flexneri 2a str. 301
cuccgccccggcaauaaaacagg

SEQ ID NO: 1991310 - RNA, 14 nt, Shigella flexneri 2a str. 301
cuccccagaaucca

SEQ ID NO: 1991311 - RNA, 19 nt, Shigella flexneri 2a str. 301
cuccauugcccgcccgaca

SEQ ID NO: 1991312 - RNA, 15 nt, Shigella flexneri 2a str. 301
cuccauuaccuggau

SEQ ID NO: 1991313 - RNA, 15 nt, Shigella flexneri 2a str. 301
cuccauugaauuuua

SEQ ID NO: 1991314 - RNA, 18 nt, Shigella flexneri 2a str. 301
cuccauguccagcuugau

SEQ ID NO: 1991315 - RNA, 24 nt, Shigella flexneri 2a str. 301
cuccauuuuuuugcauuacugcua

SEQ ID NO: 1991316 - RNA, 12 nt, Shigella flexneri 2a str. 301
cucccuucgcug

SEQ ID NO: 1991317 - RNA, 16 nt, Shigella flexneri 2a str. 301
cucccuuuggccgcuc

SEQ ID NO: 1991318 - RNA, 16 nt, Shigella flexneri 2a str. 301
cuccccccaacaugac

SEQ ID NO: 1991319 - RNA, 21 nt, Shigella flexneri 2a str. 301
cucccgauaaccuucuucauu

SEQ ID NO: 1991320 - RNA, 19 nt, Shigella flexneri 2a str. 301
cucccgaaugaccgccccu

SEQ ID NO: 1991321 - RNA, 17 nt, Shigella flexneri 2a str. 301
cucccgcaggagcgccg

SEQ ID NO: 1991322 - RNA, 14 nt, Shigella flexneri 2a str. 301
cucggcgcggaugc

SEQ ID NO: 1991323 - RNA, 23 nt, Shigella flexneri 2a str. 301
cucggcugacgauaccaggugug

SEQ ID NO: 1991324 - RNA, 21 nt, Shigella flexneri 2a str. 301
cucgggaaggcccuuccccuu

SEQ ID NO: 1991325 - RNA, 17 nt, Shigella flexneri 2a str. 301
cucgcuguggcagcguu

SEQ ID NO: 1991326 - RNA, 19 nt, Shigella flexneri 2a str. 301
cucgcuuaagccaucauca

SEQ ID NO: 1991327 - RNA, 20 nt, Shigella flexneri 2a str. 301
cucggaaugccggaaucaga

SEQ ID NO: 1991328 - RNA, 22 nt, Shigella flexneri 2a str. 301
cucggugucguuacgccgcaga

SEQ ID NO: 1991329 - RNA, 18 nt, Shigella flexneri 2a str. 301
cucgguugauucgcucug

SEQ ID NO: 1991330 - RNA, 13 nt, Shigella flexneri 2a str. 301
cucuacagcgccc

SEQ ID NO: 1991331 - RNA, 13 nt, Shigella flexneri 2a str. 301
cucuacaccaacg

SEQ ID NO: 1991332 - RNA, 17 nt, Shigella flexneri 2a str. 301
cucuacaauauccucaa

SEQ ID NO: 1991333 - RNA, 14 nt, Shigella flexneri 2a str. 301
cucgugccaccagu

SEQ ID NO: 1991334 - RNA, 14 nt, Shigella flexneri 2a str. 301
cucguuuauuaugc

SEQ ID NO: 1991335 - RNA, 16 nt, Shigella flexneri 2a str. 301
cucguuggucaucacu

SEQ ID NO: 1991336 - RNA, 14 nt, Shigella flexneri 2a str. 301
cucuaaaaucauca

SEQ ID NO: 1991337 - RNA, 17 nt, Shigella flexneri 2a str. 301
cucgacaccaaacagac

SEQ ID NO: 1991338 - RNA, 21 nt, Shigella flexneri 2a str. 301
cuccugccaccacugcaauga

SEQ ID NO: 1991339 - RNA, 15 nt, Shigella flexneri 2a str. 301
cuccugauaacacag

SEQ ID NO: 1991340 - RNA, 16 nt, Shigella flexneri 2a str. 301
cuccugauaacacaga

SEQ ID NO: 1991341 - RNA, 15 nt, Shigella flexneri 2a str. 301
cucgagaaauuuuua

SEQ ID NO: 1991342 - RNA, 23 nt, Shigella flexneri 2a str. 301
cucgacuuuagucgcuugcagga

SEQ ID NO: 1991343 - RNA, 18 nt, Shigella flexneri 2a str. 301
cucgaccaaaugaaacag

SEQ ID NO: 1991344 - RNA, 21 nt, Shigella flexneri 2a str. 301
cucgccagaccgcagaagccg

SEQ ID NO: 1991345 - RNA, 18 nt, Shigella flexneri 2a str. 301
cucgccagagagcggagc

SEQ ID NO: 1991346 - RNA, 18 nt, Shigella flexneri 2a str. 301
cucgaguccuuccagguc

SEQ ID NO: 1991347 - RNA, 13 nt, Shigella flexneri 2a str. 301
cucgaguccuucc

SEQ ID NO: 1991348 - RNA, 14 nt, Shigella flexneri 2a str. 301
cucgaguccuucca

SEQ ID NO: 1991349 - RNA, 17 nt, Shigella flexneri 2a str. 301
cucgauaaaaccuuccu

SEQ ID NO: 1991350 - RNA, 22 nt, Shigella flexneri 2a str. 301
cucgauaacacgguaaugacuc

SEQ ID NO: 1991351 - RNA, 24 nt, Shigella flexneri 2a str. 301
cucgauacgacacgccuccuggcu

SEQ ID NO: 1991352 - RNA, 19 nt, Shigella flexneri 2a str. 301
cucgauaaggcgcugaagg

SEQ ID NO: 1991353 - RNA, 16 nt, Shigella flexneri 2a str. 301
cucgcucgagagagaa

SEQ ID NO: 1991354 - RNA, 19 nt, Shigella flexneri 2a str. 301
cucgcucgagagagaaaau

SEQ ID NO: 1991355 - RNA, 20 nt, Shigella flexneri 2a str. 301
cucgcucuuguucuuccggc

SEQ ID NO: 1991356 - RNA, 13 nt, Shigella flexneri 2a str. 301
cucgcugccagca

SEQ ID NO: 1991357 - RNA, 21 nt, Shigella flexneri 2a str. 301
cucgcguucgauggcgcgcca

SEQ ID NO: 1991358 - RNA, 18 nt, Shigella flexneri 2a str. 301
cucgcguucuguugccgc

SEQ ID NO: 1991359 - RNA, 19 nt, Shigella flexneri 2a str. 301
cucgcuccauuccaucgcc

SEQ ID NO: 1991360 - RNA, 17 nt, Shigella flexneri 2a str. 301
cucgcccagaucaccaa

SEQ ID NO: 1991361 - RNA, 13 nt, Shigella flexneri 2a str. 301
cucgccagccacc

SEQ ID NO: 1991362 - RNA, 23 nt, Shigella flexneri 2a str. 301
cucgcgcuucauauagaucuuua

SEQ ID NO: 1991363 - RNA, 22 nt, Shigella flexneri 2a str. 301
cucaaagucgagaugaaacucg

SEQ ID NO: 1991364 - RNA, 16 nt, Shigella flexneri 2a str. 301
cucaaaguaaucaagc

SEQ ID NO: 1991365 - RNA, 16 nt, Shigella flexneri 2a str. 301
cucaaaggccgacagc

SEQ ID NO: 1991366 - RNA, 19 nt, Shigella flexneri 2a str. 301
cucaaaccauuucugcgag

SEQ ID NO: 1991367 - RNA, 23 nt, Shigella flexneri 2a str. 301
cuauuuuuuugauaaucuucuuc

SEQ ID NO: 1991368 - RNA, 19 nt, Shigella flexneri 2a str. 301
cuauuucgucgcuaacggu

SEQ ID NO: 1991369 - RNA, 13 nt, Shigella flexneri 2a str. 301
cuauuguuuuaau

SEQ ID NO: 1991370 - RNA, 17 nt, Shigella flexneri 2a str. 301
cucaaccgcuucuuucu

SEQ ID NO: 1991371 - RNA, 18 nt, Shigella flexneri 2a str. 301
cucaaccgcuucuuucuc

SEQ ID NO: 1991372 - RNA, 13 nt, Shigella flexneri 2a str. 301
cucaaccgcuucu

SEQ ID NO: 1991373 - RNA, 13 nt, Shigella flexneri 2a str. 301
cucaaccagauuc

SEQ ID NO: 1991374 - RNA, 15 nt, Shigella flexneri 2a str. 301
cucaaucaucucaca

SEQ ID NO: 1991375 - RNA, 22 nt, Shigella flexneri 2a str. 301
cucaaucucuuuuuccaccgca

SEQ ID NO: 1991376 - RNA, 13 nt, Shigella flexneri 2a str. 301
cucaaucuucacg

SEQ ID NO: 1991377 - RNA, 17 nt, Shigella flexneri 2a str. 301
cucaaucucuuuuucca

SEQ ID NO: 1991378 - RNA, 14 nt, Shigella flexneri 2a str. 301
cucaaucgccacca

SEQ ID NO: 1991379 - RNA, 20 nt, Shigella flexneri 2a str. 301
cucaauuaccacaaguaaaa

SEQ ID NO: 1991380 - RNA, 19 nt, Shigella flexneri 2a str. 301
cucaaugucugucauauua

SEQ ID NO: 1991381 - RNA, 13 nt, Shigella flexneri 2a str. 301
cucaauuaacauu

SEQ ID NO: 1991382 - RNA, 19 nt, Shigella flexneri 2a str. 301
cucaaugguguuuuccacc

SEQ ID NO: 1991383 - RNA, 14 nt, Shigella flexneri 2a str. 301
cucaaugucuguca

SEQ ID NO: 1991384 - RNA, 16 nt, Shigella flexneri 2a str. 301
cucaaugaaauccauu

SEQ ID NO: 1991385 - RNA, 13 nt, Shigella flexneri 2a str. 301
cucaaugcgcuga

SEQ ID NO: 1991386 - RNA, 23 nt, Shigella flexneri 2a str. 301
cucaaugcggcggcgcaccggcc

SEQ ID NO: 1991387 - RNA, 17 nt, Shigella flexneri 2a str. 301
cucaccagccgcgacau

SEQ ID NO: 1991388 - RNA, 21 nt, Shigella flexneri 2a str. 301
cucaccacgcagcagccaagc

SEQ ID NO: 1991389 - RNA, 22 nt, Shigella flexneri 2a str. 301
cucaccaaaugcggucaauugc

SEQ ID NO: 1991390 - RNA, 15 nt, Shigella flexneri 2a str. 301
cucacaugaguugcu

SEQ ID NO: 1991391 - RNA, 20 nt, Shigella flexneri 2a str. 301
cucacaugaguugcuggacg

SEQ ID NO: 1991392 - RNA, 13 nt, Shigella flexneri 2a str. 301
cucagcuucagau

SEQ ID NO: 1991393 - RNA, 19 nt, Shigella flexneri 2a str. 301
cucaggacguuuucagcca

SEQ ID NO: 1991394 - RNA, 19 nt, Shigella flexneri 2a str. 301
cucagccaaauccagcgca

SEQ ID NO: 1991395 - RNA, 21 nt, Shigella flexneri 2a str. 301
cucagcaaauagauaaaauau

SEQ ID NO: 1991396 - RNA, 15 nt, Shigella flexneri 2a str. 301
cucagcaacuuccug

SEQ ID NO: 1991397 - RNA, 18 nt, Shigella flexneri 2a str. 301
cucagauaaaugcaaacg

SEQ ID NO: 1991398 - RNA, 12 nt, Shigella flexneri 2a str. 301
cucacuuuuccg

SEQ ID NO: 1991399 - RNA, 14 nt, Shigella flexneri 2a str. 301
cucacuuuuccgcc

SEQ ID NO: 1991400 - RNA, 16 nt, Shigella flexneri 2a str. 301
cucagaagacgcucca

SEQ ID NO: 1991401 - RNA, 17 nt, Shigella flexneri 2a str. 301
cucagaagacgcuccag

SEQ ID NO: 1991402 - RNA, 14 nt, Shigella flexneri 2a str. 301
cucagaaaggggga

SEQ ID NO: 1991403 - RNA, 15 nt, Shigella flexneri 2a str. 301
cucagaaucacgcca

SEQ ID NO: 1991404 - RNA, 17 nt, Shigella flexneri 2a str. 301
cucagaaucacgccaac

SEQ ID NO: 1991405 - RNA, 16 nt, Shigella flexneri 2a str. 301
cucacuguucacuuuu

SEQ ID NO: 1991406 - RNA, 15 nt, Shigella flexneri 2a str. 301
cucaccuuccacgcg

SEQ ID NO: 1991407 - RNA, 19 nt, Shigella flexneri 2a str. 301
cucaccuauguggaaacag

SEQ ID NO: 1991408 - RNA, 16 nt, Shigella flexneri 2a str. 301
cucaccggauaauucc

SEQ ID NO: 1991409 - RNA, 17 nt, Shigella flexneri 2a str. 301
cucaugggucugcggau

SEQ ID NO: 1991410 - RNA, 15 nt, Shigella flexneri 2a str. 301
cucauuacagcgacu

SEQ ID NO: 1991411 - RNA, 14 nt, Shigella flexneri 2a str. 301
cucaucgccgccaa

SEQ ID NO: 1991412 - RNA, 15 nt, Shigella flexneri 2a str. 301
cucaucagcccggca

SEQ ID NO: 1991413 - RNA, 20 nt, Shigella flexneri 2a str. 301
cucaucaacguuuuuuugcu

SEQ ID NO: 1991414 - RNA, 23 nt, Shigella flexneri 2a str. 301
cucaucaauaccugguccuucau

SEQ ID NO: 1991415 - RNA, 14 nt, Shigella flexneri 2a str. 301
cucaguacaggccg

SEQ ID NO: 1991416 - RNA, 13 nt, Shigella flexneri 2a str. 301
cucagguucaacc

SEQ ID NO: 1991417 - RNA, 17 nt, Shigella flexneri 2a str. 301
cucaguaaaguuaccuu

SEQ ID NO: 1991418 - RNA, 20 nt, Shigella flexneri 2a str. 301
cucaggugucuggcagcgug

SEQ ID NO: 1991419 - RNA, 19 nt, Shigella flexneri 2a str. 301
cuacgucucaauucaucuu

SEQ ID NO: 1991420 - RNA, 22 nt, Shigella flexneri 2a str. 301
cuacguaggacagcguugccag

SEQ ID NO: 1991421 - RNA, 23 nt, Shigella flexneri 2a str. 301
cuacguaggacagcguugccagc

SEQ ID NO: 1991422 - RNA, 16 nt, Shigella flexneri 2a str. 301
cuacggaguaaccugc

SEQ ID NO: 1991423 - RNA, 21 nt, Shigella flexneri 2a str. 301
cuacgcucucuucaaacgcuu

SEQ ID NO: 1991424 - RNA, 16 nt, Shigella flexneri 2a str. 301
cuacgacgggauucga

SEQ ID NO: 1991425 - RNA, 22 nt, Shigella flexneri 2a str. 301
cuaccuuaacgguaucuuucca

SEQ ID NO: 1991426 - RNA, 20 nt, Shigella flexneri 2a str. 301
cuaccgugcuguacagcagu

SEQ ID NO: 1991427 - RNA, 19 nt, Shigella flexneri 2a str. 301
cuaccgucuguaaccagau

SEQ ID NO: 1991428 - RNA, 17 nt, Shigella flexneri 2a str. 301
cuaccuaaggaauccag

SEQ ID NO: 1991429 - RNA, 16 nt, Shigella flexneri 2a str. 301
cuagaaaucauucaau

SEQ ID NO: 1991430 - RNA, 16 nt, Shigella flexneri 2a str. 301
cuagccucccugccuc

SEQ ID NO: 1991431 - RNA, 20 nt, Shigella flexneri 2a str. 301
cuauccugguuauuucacuu

SEQ ID NO: 1991432 - RNA, 14 nt, Shigella flexneri 2a str. 301
cuauauacaaucac

SEQ ID NO: 1991433 - RNA, 18 nt, Shigella flexneri 2a str. 301
cuaucgaaaguuuaccag

SEQ ID NO: 1991434 - RNA, 18 nt, Shigella flexneri 2a str. 301
cuauggaacgcucaagcc

SEQ ID NO: 1991435 - RNA, 18 nt, Shigella flexneri 2a str. 301
cuaugaacacgaucucac

SEQ ID NO: 1991436 - RNA, 16 nt, Shigella flexneri 2a str. 301
cuaugaagaacuggaa

SEQ ID NO: 1991437 - RNA, 11 nt, Shigella flexneri 2a str. 301
cuaugagcaga

SEQ ID NO: 1991438 - RNA, 15 nt, Shigella flexneri 2a str. 301
cuaucuguuugccag

SEQ ID NO: 1991439 - RNA, 21 nt, Shigella flexneri 2a str. 301
cuaucuuucagaccuuuuacu

SEQ ID NO: 1991440 - RNA, 18 nt, Shigella flexneri 2a str. 301
cuauaaggccccuuccuc

SEQ ID NO: 1991441 - RNA, 14 nt, Shigella flexneri 2a str. 301
cuauaccccacccc

SEQ ID NO: 1991442 - RNA, 13 nt, Shigella flexneri 2a str. 301
cuauacagcagcc

SEQ ID NO: 1991443 - RNA, 15 nt, Shigella flexneri 2a str. 301
cuauacuuuugccga

SEQ ID NO: 1991444 - RNA, 22 nt, Shigella flexneri 2a str. 301
cuauacuuuugccgaauucaua

SEQ ID NO: 1991445 - RNA, 14 nt, Shigella flexneri 2a str. 301
cuauaacaaaacug

SEQ ID NO: 1991446 - RNA, 13 nt, Shigella flexneri 2a str. 301
cuagccugcuccc

SEQ ID NO: 1991447 - RNA, 13 nt, Shigella flexneri 2a str. 301
cuaggcauagaaa

SEQ ID NO: 1991448 - RNA, 15 nt, Shigella flexneri 2a str. 301
cuaggcgaacauucc

SEQ ID NO: 1991449 - RNA, 14 nt, Shigella flexneri 2a str. 301
cugauacugcuccg

SEQ ID NO: 1991450 - RNA, 23 nt, Shigella flexneri 2a str. 301
cugauacuccaugaguaacaguc

SEQ ID NO: 1991451 - RNA, 24 nt, Shigella flexneri 2a str. 301
cugauaauggcguauuucacagua

SEQ ID NO: 1991452 - RNA, 15 nt, Shigella flexneri 2a str. 301
cugauaauccacgcg

SEQ ID NO: 1991453 - RNA, 22 nt, Shigella flexneri 2a str. 301
cugauaauaaauaacagugccg

SEQ ID NO: 1991454 - RNA, 16 nt, Shigella flexneri 2a str. 301
cugauaaguuucggag

SEQ ID NO: 1991455 - RNA, 18 nt, Shigella flexneri 2a str. 301
cugauacagccaaaucau

SEQ ID NO: 1991456 - RNA, 16 nt, Shigella flexneri 2a str. 301
cugauaauuuuuucac

SEQ ID NO: 1991457 - RNA, 17 nt, Shigella flexneri 2a str. 301
cugauaaaccuucaucg

SEQ ID NO: 1991458 - RNA, 14 nt, Shigella flexneri 2a str. 301
cugauaaacaagcg

SEQ ID NO: 1991459 - RNA, 22 nt, Shigella flexneri 2a str. 301
cugauaaacaagcguacaaaau

SEQ ID NO: 1991460 - RNA, 18 nt, Shigella flexneri 2a str. 301
cugauaagacgcgccagc

SEQ ID NO: 1991461 - RNA, 14 nt, Shigella flexneri 2a str. 301
cugauaacuucacu

SEQ ID NO: 1991462 - RNA, 17 nt, Shigella flexneri 2a str. 301
cugauaacgcggcagca

SEQ ID NO: 1991463 - RNA, 14 nt, Shigella flexneri 2a str. 301
cugauccaucgucu

SEQ ID NO: 1991464 - RNA, 18 nt, Shigella flexneri 2a str. 301
cugaucaaucacuucucc

SEQ ID NO: 1991465 - RNA, 15 nt, Shigella flexneri 2a str. 301
cugaucccaguuuuc

SEQ ID NO: 1991466 - RNA, 17 nt, Shigella flexneri 2a str. 301
cugauccccgcaagucc

SEQ ID NO: 1991467 - RNA, 22 nt, Shigella flexneri 2a str. 301
cugaucccgauggucagcuuca

SEQ ID NO: 1991468 - RNA, 13 nt, Shigella flexneri 2a str. 301
cugauccgcuucg

SEQ ID NO: 1991469 - RNA, 18 nt, Shigella flexneri 2a str. 301
cugaucgacaaaaucccg

SEQ ID NO: 1991470 - RNA, 14 nt, Shigella flexneri 2a str. 301
cugauccugacaag

SEQ ID NO: 1991471 - RNA, 17 nt, Shigella flexneri 2a str. 301
cugaucgccauauuucu

SEQ ID NO: 1991472 - RNA, 21 nt, Shigella flexneri 2a str. 301
cugaucgauaaauucguuuuc

SEQ ID NO: 1991473 - RNA, 14 nt, Shigella flexneri 2a str. 301
cugauauucauauc

SEQ ID NO: 1991474 - RNA, 16 nt, Shigella flexneri 2a str. 301
cugauaucucaccaga

SEQ ID NO: 1991475 - RNA, 16 nt, Shigella flexneri 2a str. 301
cugauagugcugccau

SEQ ID NO: 1991476 - RNA, 15 nt, Shigella flexneri 2a str. 301
cugauauacccuuca

SEQ ID NO: 1991477 - RNA, 15 nt, Shigella flexneri 2a str. 301
cugauauugcccgug

SEQ ID NO: 1991478 - RNA, 17 nt, Shigella flexneri 2a str. 301
cucuauggcaccuguug

SEQ ID NO: 1991479 - RNA, 22 nt, Shigella flexneri 2a str. 301
cucuaucuguuugccagucugg

SEQ ID NO: 1991480 - RNA, 22 nt, Shigella flexneri 2a str. 301
cugagcgugccccugaauaauc

SEQ ID NO: 1991481 - RNA, 22 nt, Shigella flexneri 2a str. 301
cugagcuucuucaaaaaaguca

SEQ ID NO: 1991482 - RNA, 22 nt, Shigella flexneri 2a str. 301
cugagcuugauccuacacauac

SEQ ID NO: 1991483 - RNA, 13 nt, Shigella flexneri 2a str. 301
cugagcuucuuca

SEQ ID NO: 1991484 - RNA, 23 nt, Shigella flexneri 2a str. 301
cugaggccggaugucgcugcuag

SEQ ID NO: 1991485 - RNA, 13 nt, Shigella flexneri 2a str. 301
cugaggcugucau

SEQ ID NO: 1991486 - RNA, 17 nt, Shigella flexneri 2a str. 301
cugaggcugaugacaaa

SEQ ID NO: 1991487 - RNA, 17 nt, Shigella flexneri 2a str. 301
cugagggauccccagaa

SEQ ID NO: 1991488 - RNA, 15 nt, Shigella flexneri 2a str. 301
cugaguaauaacuuc

SEQ ID NO: 1991489 - RNA, 22 nt, Shigella flexneri 2a str. 301
cugaguaauaacuuccugagug

SEQ ID NO: 1991490 - RNA, 23 nt, Shigella flexneri 2a str. 301
cugagguuuauaacggugcugca

SEQ ID NO: 1991491 - RNA, 21 nt, Shigella flexneri 2a str. 301
cugaguaauuaauacgccaga

SEQ ID NO: 1991492 - RNA, 15 nt, Shigella flexneri 2a str. 301
cugagugaaucagaa

SEQ ID NO: 1991493 - RNA, 16 nt, Shigella flexneri 2a str. 301
cugagugaaucagaag

SEQ ID NO: 1991494 - RNA, 22 nt, Shigella flexneri 2a str. 301
cugagucgggugcagcgacagg

SEQ ID NO: 1991495 - RNA, 12 nt, Shigella flexneri 2a str. 301
cugauaaaaaac

SEQ ID NO: 1991496 - RNA, 14 nt, Shigella flexneri 2a str. 301
cugauaaaaaaccc

SEQ ID NO: 1991497 - RNA, 23 nt, Shigella flexneri 2a str. 301
cugauaaaaaacccgcuuuuuga

SEQ ID NO: 1991498 - RNA, 16 nt, Shigella flexneri 2a str. 301
cugaguuucagaccaa

SEQ ID NO: 1991499 - RNA, 18 nt, Shigella flexneri 2a str. 301
cugaguuuaacggacacu

SEQ ID NO: 1991500 - RNA, 15 nt, Shigella flexneri 2a str. 301
cugcagguauugcuu

SEQ ID NO: 1991501 - RNA, 16 nt, Shigella flexneri 2a str. 301
cugcagucaccugccc

SEQ ID NO: 1991502 - RNA, 14 nt, Shigella flexneri 2a str. 301
cugcagugaaauua

SEQ ID NO: 1991503 - RNA, 17 nt, Shigella flexneri 2a str. 301
cugcagugcaaugacuc

SEQ ID NO: 1991504 - RNA, 21 nt, Shigella flexneri 2a str. 301
cugcagugcacgaaccagaga

SEQ ID NO: 1991505 - RNA, 18 nt, Shigella flexneri 2a str. 301
cugcagauuaugccugau

SEQ ID NO: 1991506 - RNA, 15 nt, Shigella flexneri 2a str. 301
cugcagauauucaug

SEQ ID NO: 1991507 - RNA, 14 nt, Shigella flexneri 2a str. 301
cugcagggcuuuca

SEQ ID NO: 1991508 - RNA, 20 nt, Shigella flexneri 2a str. 301
cugcacguuuucaaccguuu

SEQ ID NO: 1991509 - RNA, 19 nt, Shigella flexneri 2a str. 301
cugcacguuggcgcauaac

SEQ ID NO: 1991510 - RNA, 15 nt, Shigella flexneri 2a str. 301
cugcacuggcuucca

SEQ ID NO: 1991511 - RNA, 21 nt, Shigella flexneri 2a str. 301
cugcaauaaaauaucuuccac

SEQ ID NO: 1991512 - RNA, 15 nt, Shigella flexneri 2a str. 301
cugcaauaccgccgu

SEQ ID NO: 1991513 - RNA, 23 nt, Shigella flexneri 2a str. 301
cugcaauugcggcaggucaucgu

SEQ ID NO: 1991514 - RNA, 19 nt, Shigella flexneri 2a str. 301
cugcaaugcugcgaucagu

SEQ ID NO: 1991515 - RNA, 20 nt, Shigella flexneri 2a str. 301
cugcacaaguuguuuacagu

SEQ ID NO: 1991516 - RNA, 23 nt, Shigella flexneri 2a str. 301
cugcacggagauauccagcgccg

SEQ ID NO: 1991517 - RNA, 18 nt, Shigella flexneri 2a str. 301
cugcacgcuaguuuccug

SEQ ID NO: 1991518 - RNA, 22 nt, Shigella flexneri 2a str. 301
cugauuuaaccaacaauaaaau

SEQ ID NO: 1991519 - RNA, 15 nt, Shigella flexneri 2a str. 301
cugauuuauagauuu

SEQ ID NO: 1991520 - RNA, 13 nt, Shigella flexneri 2a str. 301
cugauuucaccau

SEQ ID NO: 1991521 - RNA, 21 nt, Shigella flexneri 2a str. 301
cugcaaagcauuuuuucacau

SEQ ID NO: 1991522 - RNA, 20 nt, Shigella flexneri 2a str. 301
cugcaaagcugaugguugaa

SEQ ID NO: 1991523 - RNA, 14 nt, Shigella flexneri 2a str. 301
cugcaaggcucuau

SEQ ID NO: 1991524 - RNA, 14 nt, Shigella flexneri 2a str. 301
cugcaacuucucuu

SEQ ID NO: 1991525 - RNA, 16 nt, Shigella flexneri 2a str. 301
cugcaacuucucuuuc

SEQ ID NO: 1991526 - RNA, 15 nt, Shigella flexneri 2a str. 301
cugcaacgucuuccc

SEQ ID NO: 1991527 - RNA, 14 nt, Shigella flexneri 2a str. 301
cugcaaauauuaau

SEQ ID NO: 1991528 - RNA, 16 nt, Shigella flexneri 2a str. 301
cugcaaauauuaauaa

SEQ ID NO: 1991529 - RNA, 17 nt, Shigella flexneri 2a str. 301
cugcaaauauuaauaau

SEQ ID NO: 1991530 - RNA, 13 nt, Shigella flexneri 2a str. 301
cugcaaauaaaua

SEQ ID NO: 1991531 - RNA, 20 nt, Shigella flexneri 2a str. 301
cugauuaccuuccugccaga

SEQ ID NO: 1991532 - RNA, 14 nt, Shigella flexneri 2a str. 301
cugauuacuuccuu

SEQ ID NO: 1991533 - RNA, 20 nt, Shigella flexneri 2a str. 301
cugauuauccgcaucacucc

SEQ ID NO: 1991534 - RNA, 23 nt, Shigella flexneri 2a str. 301
cugauugauucaggguaugaaug

SEQ ID NO: 1991535 - RNA, 13 nt, Shigella flexneri 2a str. 301
cugauugcauaau

SEQ ID NO: 1991536 - RNA, 15 nt, Shigella flexneri 2a str. 301
cugauguucgccaga

SEQ ID NO: 1991537 - RNA, 23 nt, Shigella flexneri 2a str. 301
cugauguuguuucucuuucuuca

SEQ ID NO: 1991538 - RNA, 14 nt, Shigella flexneri 2a str. 301
cugauuacccuucg

SEQ ID NO: 1991539 - RNA, 20 nt, Shigella flexneri 2a str. 301
cugauuaauuuucgcccguu

SEQ ID NO: 1991540 - RNA, 14 nt, Shigella flexneri 2a str. 301
cugaucuuucuuca

SEQ ID NO: 1991541 - RNA, 22 nt, Shigella flexneri 2a str. 301
cugaugugauccaucaggucau

SEQ ID NO: 1991542 - RNA, 14 nt, Shigella flexneri 2a str. 301
cugaugugaugccc

SEQ ID NO: 1991543 - RNA, 12 nt, Shigella flexneri 2a str. 301
cugaucggcaag

SEQ ID NO: 1991544 - RNA, 16 nt, Shigella flexneri 2a str. 301
cugaucggcaagugcc

SEQ ID NO: 1991545 - RNA, 23 nt, Shigella flexneri 2a str. 301
cugaucgcuguggaacaucaccc

SEQ ID NO: 1991546 - RNA, 15 nt, Shigella flexneri 2a str. 301
cugccgaucaacugc

SEQ ID NO: 1991547 - RNA, 15 nt, Shigella flexneri 2a str. 301
cugccgaccaucugu

SEQ ID NO: 1991548 - RNA, 14 nt, Shigella flexneri 2a str. 301
cugccgacaaaugc

SEQ ID NO: 1991549 - RNA, 16 nt, Shigella flexneri 2a str. 301
cugccgcugcgcguga

SEQ ID NO: 1991550 - RNA, 20 nt, Shigella flexneri 2a str. 301
cugccggaggaguaucugcu

SEQ ID NO: 1991551 - RNA, 21 nt, Shigella flexneri 2a str. 301
cugccggaggaguaucugcug

SEQ ID NO: 1991552 - RNA, 16 nt, Shigella flexneri 2a str. 301
cugccggagcgccacc

SEQ ID NO: 1991553 - RNA, 20 nt, Shigella flexneri 2a str. 301
cugccggagcgccaccaccc

SEQ ID NO: 1991554 - RNA, 17 nt, Shigella flexneri 2a str. 301
cugccggaccaucuucc

SEQ ID NO: 1991555 - RNA, 14 nt, Shigella flexneri 2a str. 301
cugccguuaacccg

SEQ ID NO: 1991556 - RNA, 21 nt, Shigella flexneri 2a str. 301
cugccguccccaucaggaaac

SEQ ID NO: 1991557 - RNA, 21 nt, Shigella flexneri 2a str. 301
cugccguacaggcagcuuaga

SEQ ID NO: 1991558 - RNA, 17 nt, Shigella flexneri 2a str. 301
cugccguacaggcagcu

SEQ ID NO: 1991559 - RNA, 19 nt, Shigella flexneri 2a str. 301
cugccguacaggcagcuua

SEQ ID NO: 1991560 - RNA, 15 nt, Shigella flexneri 2a str. 301
cugccgucaauuuua

SEQ ID NO: 1991561 - RNA, 14 nt, Shigella flexneri 2a str. 301
cugccuccaugaaa

SEQ ID NO: 1991562 - RNA, 16 nt, Shigella flexneri 2a str. 301
cugccguacaggcagc

SEQ ID NO: 1991563 - RNA, 17 nt, Shigella flexneri 2a str. 301
cugccgguacuucacca

SEQ ID NO: 1991564 - RNA, 19 nt, Shigella flexneri 2a str. 301
cugccgggguaaagcgcgg

SEQ ID NO: 1991565 - RNA, 15 nt, Shigella flexneri 2a str. 301
cugccagaaccgcuu

SEQ ID NO: 1991566 - RNA, 14 nt, Shigella flexneri 2a str. 301
cugccacuucugcu

SEQ ID NO: 1991567 - RNA, 21 nt, Shigella flexneri 2a str. 301
cugccagaaaucggccuucca

SEQ ID NO: 1991568 - RNA, 19 nt, Shigella flexneri 2a str. 301
cugccagaaaucggccuuc

SEQ ID NO: 1991569 - RNA, 14 nt, Shigella flexneri 2a str. 301
cugccagaaggauu

SEQ ID NO: 1991570 - RNA, 15 nt, Shigella flexneri 2a str. 301
cugccagaccugcga

SEQ ID NO: 1991571 - RNA, 22 nt, Shigella flexneri 2a str. 301
cugccagaggagccaucaccau

SEQ ID NO: 1991572 - RNA, 21 nt, Shigella flexneri 2a str. 301
cugcauaaacgccgucaucac

SEQ ID NO: 1991573 - RNA, 22 nt, Shigella flexneri 2a str. 301
cugcauaaacgccgucaucaca

SEQ ID NO: 1991574 - RNA, 18 nt, Shigella flexneri 2a str. 301
cugcauaaucgcaacgcc

SEQ ID NO: 1991575 - RNA, 15 nt, Shigella flexneri 2a str. 301
cugccagugcugcuu

SEQ ID NO: 1991576 - RNA, 23 nt, Shigella flexneri 2a str. 301
cugccauaaacgguuucagcagc

SEQ ID NO: 1991577 - RNA, 23 nt, Shigella flexneri 2a str. 301
cugccaggucgugccagaaaguc

SEQ ID NO: 1991578 - RNA, 20 nt, Shigella flexneri 2a str. 301
cugccaggucgugccagaaa

SEQ ID NO: 1991579 - RNA, 13 nt, Shigella flexneri 2a str. 301
cugccagaucauc

SEQ ID NO: 1991580 - RNA, 12 nt, Shigella flexneri 2a str. 301
cugccagcucuc

SEQ ID NO: 1991581 - RNA, 23 nt, Shigella flexneri 2a str. 301
cugccagcugcucauagcggcug

SEQ ID NO: 1991582 - RNA, 22 nt, Shigella flexneri 2a str. 301
cugccaucauggcauccuguuu

SEQ ID NO: 1991583 - RNA, 15 nt, Shigella flexneri 2a str. 301
cugcccacuccagcu

SEQ ID NO: 1991584 - RNA, 19 nt, Shigella flexneri 2a str. 301
cugcgcgugaagcacguaa

SEQ ID NO: 1991585 - RNA, 21 nt, Shigella flexneri 2a str. 301
cugcgcgucuuaucaggccug

SEQ ID NO: 1991586 - RNA, 15 nt, Shigella flexneri 2a str. 301
cugcgcgccgccgcu

SEQ ID NO: 1991587 - RNA, 21 nt, Shigella flexneri 2a str. 301
cugcgcgaccucuucugccug

SEQ ID NO: 1991588 - RNA, 22 nt, Shigella flexneri 2a str. 301
cugcgccuuuuuucgccgcagc

SEQ ID NO: 1991589 - RNA, 18 nt, Shigella flexneri 2a str. 301
cugcgcgagguuaaaaag

SEQ ID NO: 1991590 - RNA, 17 nt, Shigella flexneri 2a str. 301
cugcgcagauuagccgg

SEQ ID NO: 1991591 - RNA, 21 nt, Shigella flexneri 2a str. 301
cugccucgggauccaugcacg

SEQ ID NO: 1991592 - RNA, 14 nt, Shigella flexneri 2a str. 301
cugccucgcugaag

SEQ ID NO: 1991593 - RNA, 15 nt, Shigella flexneri 2a str. 301
cugccucgcugaagc

SEQ ID NO: 1991594 - RNA, 13 nt, Shigella flexneri 2a str. 301
cugccucgcagag

SEQ ID NO: 1991595 - RNA, 17 nt, Shigella flexneri 2a str. 301
cugccugauccugggcu

SEQ ID NO: 1991596 - RNA, 10 nt, Shigella flexneri 2a str. 301
cugccugaug

SEQ ID NO: 1991597 - RNA, 14 nt, Shigella flexneri 2a str. 301
cugcgcccgcagcg

SEQ ID NO: 1991598 - RNA, 18 nt, Shigella flexneri 2a str. 301
cugcgccccacaccacca

SEQ ID NO: 1991599 - RNA, 15 nt, Shigella flexneri 2a str. 301
cugcgccaaacagau

SEQ ID NO: 1991600 - RNA, 15 nt, Shigella flexneri 2a str. 301
cugcgcauuucccag

SEQ ID NO: 1991601 - RNA, 14 nt, Shigella flexneri 2a str. 301
cugcgcaucuuccc

SEQ ID NO: 1991602 - RNA, 15 nt, Shigella flexneri 2a str. 301
cugcgcauaacugcc

SEQ ID NO: 1991603 - RNA, 13 nt, Shigella flexneri 2a str. 301
cugcgggagcgcu

SEQ ID NO: 1991604 - RNA, 19 nt, Shigella flexneri 2a str. 301
cugcgggaacauaugcaca

SEQ ID NO: 1991605 - RNA, 18 nt, Shigella flexneri 2a str. 301
cugcggcuuccagagcag

SEQ ID NO: 1991606 - RNA, 14 nt, Shigella flexneri 2a str. 301
cugcgcuuccugca

SEQ ID NO: 1991607 - RNA, 16 nt, Shigella flexneri 2a str. 301
cugcgcuuccugcaac

SEQ ID NO: 1991608 - RNA, 21 nt, Shigella flexneri 2a str. 301
cugcggguuagucugcauuuu

SEQ ID NO: 1991609 - RNA, 14 nt, Shigella flexneri 2a str. 301
cugcgguaauccgg

SEQ ID NO: 1991610 - RNA, 14 nt, Shigella flexneri 2a str. 301
cugcggguuggcuu

SEQ ID NO: 1991611 - RNA, 17 nt, Shigella flexneri 2a str. 301
cugcgggaguugcucca

SEQ ID NO: 1991612 - RNA, 17 nt, Shigella flexneri 2a str. 301
cugcggguuagucugca

SEQ ID NO: 1991613 - RNA, 15 nt, Shigella flexneri 2a str. 301
cugcguuucuggcuu

SEQ ID NO: 1991614 - RNA, 22 nt, Shigella flexneri 2a str. 301
cugcguuagaaaacgccugcuc

SEQ ID NO: 1991615 - RNA, 14 nt, Shigella flexneri 2a str. 301
cugcguucagcagu

SEQ ID NO: 1991616 - RNA, 15 nt, Shigella flexneri 2a str. 301
cugcuaauauuuucg

SEQ ID NO: 1991617 - RNA, 21 nt, Shigella flexneri 2a str. 301
cugcguuuucgagaaggcgcu

SEQ ID NO: 1991618 - RNA, 20 nt, Shigella flexneri 2a str. 301
cugcguggucauuaugaccg

SEQ ID NO: 1991619 - RNA, 19 nt, Shigella flexneri 2a str. 301
cugcguuccggcaugauuc

SEQ ID NO: 1991620 - RNA, 20 nt, Shigella flexneri 2a str. 301
cugcguuccggcaugauuca

SEQ ID NO: 1991621 - RNA, 20 nt, Shigella flexneri 2a str. 301
cugcgguuucaacgacccag

SEQ ID NO: 1991622 - RNA, 15 nt, Shigella flexneri 2a str. 301
cugcgguucagcuuu

SEQ ID NO: 1991623 - RNA, 21 nt, Shigella flexneri 2a str. 301
cugcguaauguuuagagacgc

SEQ ID NO: 1991624 - RNA, 17 nt, Shigella flexneri 2a str. 301
cugcgugacuaaaaccc

SEQ ID NO: 1991625 - RNA, 19 nt, Shigella flexneri 2a str. 301
cugguagcgggugaagaga

SEQ ID NO: 1991626 - RNA, 20 nt, Shigella flexneri 2a str. 301
cugguagacguucaguuccg

SEQ ID NO: 1991627 - RNA, 18 nt, Shigella flexneri 2a str. 301
cugguauuuccaguccag

SEQ ID NO: 1991628 - RNA, 21 nt, Shigella flexneri 2a str. 301
cugguaguuguacaacugcuu

SEQ ID NO: 1991629 - RNA, 20 nt, Shigella flexneri 2a str. 301
cuggucaguuucagccagga

SEQ ID NO: 1991630 - RNA, 20 nt, Shigella flexneri 2a str. 301
cuggucauaggccgcugaug

SEQ ID NO: 1991631 - RNA, 21 nt, Shigella flexneri 2a str. 301
cuggucaugaaccugccgccu

SEQ ID NO: 1991632 - RNA, 16 nt, Shigella flexneri 2a str. 301
cuggucacucucgacc

SEQ ID NO: 1991633 - RNA, 14 nt, Shigella flexneri 2a str. 301
cuggucgcgaugcu

SEQ ID NO: 1991634 - RNA, 12 nt, Shigella flexneri 2a str. 301
cuggucugcugg

SEQ ID NO: 1991635 - RNA, 14 nt, Shigella flexneri 2a str. 301
cuggucuccuuuac

SEQ ID NO: 1991636 - RNA, 21 nt, Shigella flexneri 2a str. 301
cuggugccaagcuccagcauc

SEQ ID NO: 1991637 - RNA, 20 nt, Shigella flexneri 2a str. 301
cuggugauugccggaauggu

SEQ ID NO: 1991638 - RNA, 12 nt, Shigella flexneri 2a str. 301
cuggugaccugg

SEQ ID NO: 1991639 - RNA, 14 nt, Shigella flexneri 2a str. 301
cuggcguacccauc

SEQ ID NO: 1991640 - RNA, 23 nt, Shigella flexneri 2a str. 301
cuggcguaccaaucagacucaua

SEQ ID NO: 1991641 - RNA, 16 nt, Shigella flexneri 2a str. 301
cuggcguacccaucaa

SEQ ID NO: 1991642 - RNA, 23 nt, Shigella flexneri 2a str. 301
cuggcgucacgccgaccagaccg

SEQ ID NO: 1991643 - RNA, 21 nt, Shigella flexneri 2a str. 301
cuggcgucacgccgaccagac

SEQ ID NO: 1991644 - RNA, 17 nt, Shigella flexneri 2a str. 301
cuggcgucaaagcugcu

SEQ ID NO: 1991645 - RNA, 15 nt, Shigella flexneri 2a str. 301
cuggcgucaaagcug

SEQ ID NO: 1991646 - RNA, 17 nt, Shigella flexneri 2a str. 301
cuggcguacagagggca

SEQ ID NO: 1991647 - RNA, 16 nt, Shigella flexneri 2a str. 301
cuggcguacagagggc

SEQ ID NO: 1991648 - RNA, 23 nt, Shigella flexneri 2a str. 301
cugggcgauuuccuucagcagca

SEQ ID NO: 1991649 - RNA, 18 nt, Shigella flexneri 2a str. 301
cugggcgauuuucuacuu

SEQ ID NO: 1991650 - RNA, 23 nt, Shigella flexneri 2a str. 301
cugggcuucauccagcagugacu

SEQ ID NO: 1991651 - RNA, 14 nt, Shigella flexneri 2a str. 301
cugggccugcauau

SEQ ID NO: 1991652 - RNA, 15 nt, Shigella flexneri 2a str. 301
cugguaccagcaccg

SEQ ID NO: 1991653 - RNA, 16 nt, Shigella flexneri 2a str. 301
cugguaaucaccaccc

SEQ ID NO: 1991654 - RNA, 24 nt, Shigella flexneri 2a str. 301
cugggucugcagauauucaugcag

SEQ ID NO: 1991655 - RNA, 13 nt, Shigella flexneri 2a str. 301
cuggggccgucau

SEQ ID NO: 1991656 - RNA, 16 nt, Shigella flexneri 2a str. 301
cuggggauagaaacag

SEQ ID NO: 1991657 - RNA, 15 nt, Shigella flexneri 2a str. 301
cuguaccacaaccug

SEQ ID NO: 1991658 - RNA, 14 nt, Shigella flexneri 2a str. 301
cuguaccagcccgc

SEQ ID NO: 1991659 - RNA, 14 nt, Shigella flexneri 2a str. 301
cuguaccaccagaa

SEQ ID NO: 1991660 - RNA, 15 nt, Shigella flexneri 2a str. 301
cuguacggcagugaa

SEQ ID NO: 1991661 - RNA, 21 nt, Shigella flexneri 2a str. 301
cuguaccuucacgcgcuccag

SEQ ID NO: 1991662 - RNA, 23 nt, Shigella flexneri 2a str. 301
cuguaccuucacgcgcuccagga

SEQ ID NO: 1991663 - RNA, 19 nt, Shigella flexneri 2a str. 301
cuguaccuucagcggcagc

SEQ ID NO: 1991664 - RNA, 16 nt, Shigella flexneri 2a str. 301
cuguaguacaaauuuu

SEQ ID NO: 1991665 - RNA, 18 nt, Shigella flexneri 2a str. 301
cuguaguacaaauuuuag

SEQ ID NO: 1991666 - RNA, 22 nt, Shigella flexneri 2a str. 301
cuguaaugucaucucuggcacg

SEQ ID NO: 1991667 - RNA, 21 nt, Shigella flexneri 2a str. 301
cuguaacaaggugaaucaagc

SEQ ID NO: 1991668 - RNA, 15 nt, Shigella flexneri 2a str. 301
cugguuuugaacagc

SEQ ID NO: 1991669 - RNA, 15 nt, Shigella flexneri 2a str. 301
cugguuuuucgauuu

SEQ ID NO: 1991670 - RNA, 19 nt, Shigella flexneri 2a str. 301
cugguuuuucugaaaacug

SEQ ID NO: 1991671 - RNA, 14 nt, Shigella flexneri 2a str. 301
cuggugcgagaucg

SEQ ID NO: 1991672 - RNA, 17 nt, Shigella flexneri 2a str. 301
cuguaaaaggcgccauu

SEQ ID NO: 1991673 - RNA, 19 nt, Shigella flexneri 2a str. 301
cuguaaaaggcgccauuuu

SEQ ID NO: 1991674 - RNA, 13 nt, Shigella flexneri 2a str. 301
cugucaguucacc

SEQ ID NO: 1991675 - RNA, 15 nt, Shigella flexneri 2a str. 301
cugucaguucaccau

SEQ ID NO: 1991676 - RNA, 15 nt, Shigella flexneri 2a str. 301
cugucaguuggcugu

SEQ ID NO: 1991677 - RNA, 17 nt, Shigella flexneri 2a str. 301
cugucagguaacaagcc

SEQ ID NO: 1991678 - RNA, 16 nt, Shigella flexneri 2a str. 301
cuguauucuucagcga

SEQ ID NO: 1991679 - RNA, 21 nt, Shigella flexneri 2a str. 301
cuguauuagcaucgcgauggc

SEQ ID NO: 1991680 - RNA, 14 nt, Shigella flexneri 2a str. 301
cuguauuacagagg

SEQ ID NO: 1991681 - RNA, 15 nt, Shigella flexneri 2a str. 301
cuguauguuccccuc

SEQ ID NO: 1991682 - RNA, 20 nt, Shigella flexneri 2a str. 301
cugucaauaaacgccugcuu

SEQ ID NO: 1991683 - RNA, 17 nt, Shigella flexneri 2a str. 301
cugucacaccuuauuua

SEQ ID NO: 1991684 - RNA, 11 nt, Shigella flexneri 2a str. 301
cugucaacugc

SEQ ID NO: 1991685 - RNA, 20 nt, Shigella flexneri 2a str. 301
cugucggguaagcgccacaa

SEQ ID NO: 1991686 - RNA, 20 nt, Shigella flexneri 2a str. 301
cugucgguuuguacucuucc

SEQ ID NO: 1991687 - RNA, 15 nt, Shigella flexneri 2a str. 301
cugucguaacugcgc

SEQ ID NO: 1991688 - RNA, 17 nt, Shigella flexneri 2a str. 301
cugucggguaagcgcca

SEQ ID NO: 1991689 - RNA, 20 nt, Shigella flexneri 2a str. 301
cugucggcaaaucaauagug

SEQ ID NO: 1991690 - RNA, 23 nt, Shigella flexneri 2a str. 301
cugucggcaagauacugcauaau

SEQ ID NO: 1991691 - RNA, 15 nt, Shigella flexneri 2a str. 301
cugucgcgcagcacu

SEQ ID NO: 1991692 - RNA, 17 nt, Shigella flexneri 2a str. 301
cugucggacgcugucac

SEQ ID NO: 1991693 - RNA, 14 nt, Shigella flexneri 2a str. 301
cugucgcaaauccg

SEQ ID NO: 1991694 - RNA, 15 nt, Shigella flexneri 2a str. 301
cugucgcaaauccgc

SEQ ID NO: 1991695 - RNA, 18 nt, Shigella flexneri 2a str. 301
cugucgcagcgugcucuc

SEQ ID NO: 1991696 - RNA, 17 nt, Shigella flexneri 2a str. 301
cuguccgauuuguucuc

SEQ ID NO: 1991697 - RNA, 16 nt, Shigella flexneri 2a str. 301
cuguccgauuuguucu

SEQ ID NO: 1991698 - RNA, 16 nt, Shigella flexneri 2a str. 301
cugcuugccagauacg

SEQ ID NO: 1991699 - RNA, 16 nt, Shigella flexneri 2a str. 301
cugcuugcccagcaaa

SEQ ID NO: 1991700 - RNA, 16 nt, Shigella flexneri 2a str. 301
cugcuuuaucagauca

SEQ ID NO: 1991701 - RNA, 21 nt, Shigella flexneri 2a str. 301
cugcuuuaucagaucacgcau

SEQ ID NO: 1991702 - RNA, 15 nt, Shigella flexneri 2a str. 301
cugcuuuacgccagg

SEQ ID NO: 1991703 - RNA, 18 nt, Shigella flexneri 2a str. 301
cugcuuuacgccagguug

SEQ ID NO: 1991704 - RNA, 17 nt, Shigella flexneri 2a str. 301
cugcuuguuccacuuca

SEQ ID NO: 1991705 - RNA, 16 nt, Shigella flexneri 2a str. 301
cugcuuguuccacuuc

SEQ ID NO: 1991706 - RNA, 20 nt, Shigella flexneri 2a str. 301
cugcuugucguaacgauaac

SEQ ID NO: 1991707 - RNA, 20 nt, Shigella flexneri 2a str. 301
cuggaaaaagugccccagcu

SEQ ID NO: 1991708 - RNA, 12 nt, Shigella flexneri 2a str. 301
cugcuuugccca

SEQ ID NO: 1991709 - RNA, 13 nt, Shigella flexneri 2a str. 301
cuggaaagagaaa

SEQ ID NO: 1991710 - RNA, 17 nt, Shigella flexneri 2a str. 301
cuggaaagagaaaaccc

SEQ ID NO: 1991711 - RNA, 21 nt, Shigella flexneri 2a str. 301
cuggaaaaucuacguuaaaaa

SEQ ID NO: 1991712 - RNA, 12 nt, Shigella flexneri 2a str. 301
cugcucaaugga

SEQ ID NO: 1991713 - RNA, 21 nt, Shigella flexneri 2a str. 301
cugcucaacugccaguucccc

SEQ ID NO: 1991714 - RNA, 19 nt, Shigella flexneri 2a str. 301
cugcuaugcaagauguuaa

SEQ ID NO: 1991715 - RNA, 19 nt, Shigella flexneri 2a str. 301
cugcuauucaccagcaaau

SEQ ID NO: 1991716 - RNA, 21 nt, Shigella flexneri 2a str. 301
cugcucaguugcaucgucugu

SEQ ID NO: 1991717 - RNA, 16 nt, Shigella flexneri 2a str. 301
cugcucagcuccucuu

SEQ ID NO: 1991718 - RNA, 17 nt, Shigella flexneri 2a str. 301
cugcucagcuccucuuu

SEQ ID NO: 1991719 - RNA, 15 nt, Shigella flexneri 2a str. 301
cugcucagcuccucu

SEQ ID NO: 1991720 - RNA, 12 nt, Shigella flexneri 2a str. 301
cugcucaauguc

SEQ ID NO: 1991721 - RNA, 14 nt, Shigella flexneri 2a str. 301
cugcucaucuggcg

SEQ ID NO: 1991722 - RNA, 14 nt, Shigella flexneri 2a str. 301
cugcuucugccugg

SEQ ID NO: 1991723 - RNA, 21 nt, Shigella flexneri 2a str. 301
cugcuugaacgcaccgccacc

SEQ ID NO: 1991724 - RNA, 18 nt, Shigella flexneri 2a str. 301
cugcuugaacgcaccgcc

SEQ ID NO: 1991725 - RNA, 15 nt, Shigella flexneri 2a str. 301
cuggagcaggaacuu

SEQ ID NO: 1991726 - RNA, 18 nt, Shigella flexneri 2a str. 301
cuggagcacugcgcccgc

SEQ ID NO: 1991727 - RNA, 16 nt, Shigella flexneri 2a str. 301
cuggagcacccgcgcu

SEQ ID NO: 1991728 - RNA, 21 nt, Shigella flexneri 2a str. 301
cuggacucccagaacaacccg

SEQ ID NO: 1991729 - RNA, 20 nt, Shigella flexneri 2a str. 301
cuggacguugcguugcagca

SEQ ID NO: 1991730 - RNA, 23 nt, Shigella flexneri 2a str. 301
cuggacguugcguugcagcagga

SEQ ID NO: 1991731 - RNA, 22 nt, Shigella flexneri 2a str. 301
cuggagauauuuuuauggcagg

SEQ ID NO: 1991732 - RNA, 15 nt, Shigella flexneri 2a str. 301
cuggagaagauauug

SEQ ID NO: 1991733 - RNA, 15 nt, Shigella flexneri 2a str. 301
cuggacaacuucuga

SEQ ID NO: 1991734 - RNA, 16 nt, Shigella flexneri 2a str. 301
cuggaccauauuagcc

SEQ ID NO: 1991735 - RNA, 22 nt, Shigella flexneri 2a str. 301
cuggacagcucguuaaucagaa

SEQ ID NO: 1991736 - RNA, 15 nt, Shigella flexneri 2a str. 301
cuggaccagcggguu

SEQ ID NO: 1991737 - RNA, 14 nt, Shigella flexneri 2a str. 301
cuggaaaucaaaaa

SEQ ID NO: 1991738 - RNA, 13 nt, Shigella flexneri 2a str. 301
cuggaacgcuucu

SEQ ID NO: 1991739 - RNA, 17 nt, Shigella flexneri 2a str. 301
cuggaaccacagcgccg

SEQ ID NO: 1991740 - RNA, 18 nt, Shigella flexneri 2a str. 301
cuggaacuggcugccagc

SEQ ID NO: 1991741 - RNA, 14 nt, Shigella flexneri 2a str. 301
cuggaacuggcugu

SEQ ID NO: 1991742 - RNA, 21 nt, Shigella flexneri 2a str. 301
cuggaagaguuuguugagaug

SEQ ID NO: 1991743 - RNA, 23 nt, Shigella flexneri 2a str. 301
cuggaagcuggauuaacgcuggg

SEQ ID NO: 1991744 - RNA, 14 nt, Shigella flexneri 2a str. 301
cuggaaggugaaau

SEQ ID NO: 1991745 - RNA, 23 nt, Shigella flexneri 2a str. 301
cuggaagaguuuguugagauggu

SEQ ID NO: 1991746 - RNA, 19 nt, Shigella flexneri 2a str. 301
cuggaauuaagaauguuaa

SEQ ID NO: 1991747 - RNA, 22 nt, Shigella flexneri 2a str. 301
cuggaauuccuuucccuauuuu

SEQ ID NO: 1991748 - RNA, 16 nt, Shigella flexneri 2a str. 301
cuggaauggaaacagc

SEQ ID NO: 1991749 - RNA, 12 nt, Shigella flexneri 2a str. 301
cuggcaaugacc

SEQ ID NO: 1991750 - RNA, 17 nt, Shigella flexneri 2a str. 301
cuggcaaugacgggcuu

SEQ ID NO: 1991751 - RNA, 17 nt, Shigella flexneri 2a str. 301
cuggcaaucgccagcgg

SEQ ID NO: 1991752 - RNA, 17 nt, Shigella flexneri 2a str. 301
cuggcaccgcagaucag

SEQ ID NO: 1991753 - RNA, 16 nt, Shigella flexneri 2a str. 301
cuggcacaugcauaaa

SEQ ID NO: 1991754 - RNA, 15 nt, Shigella flexneri 2a str. 301
cuggauaaugaaguc

SEQ ID NO: 1991755 - RNA, 22 nt, Shigella flexneri 2a str. 301
cuggauaaggcguucacgccgc

SEQ ID NO: 1991756 - RNA, 16 nt, Shigella flexneri 2a str. 301
cuggaguggugaaaca

SEQ ID NO: 1991757 - RNA, 18 nt, Shigella flexneri 2a str. 301
cuggccauuucugccagu

SEQ ID NO: 1991758 - RNA, 16 nt, Shigella flexneri 2a str. 301
cuggccauuucugcca

SEQ ID NO: 1991759 - RNA, 17 nt, Shigella flexneri 2a str. 301
cuggcauguugauacac

SEQ ID NO: 1991760 - RNA, 15 nt, Shigella flexneri 2a str. 301
cuggcaucugccccc

SEQ ID NO: 1991761 - RNA, 23 nt, Shigella flexneri 2a str. 301
cuggcauccccgcccuuccagcu

SEQ ID NO: 1991762 - RNA, 19 nt, Shigella flexneri 2a str. 301
cuggcaguggaauauaauu

SEQ ID NO: 1991763 - RNA, 16 nt, Shigella flexneri 2a str. 301
cuggcauaaacaaagc

SEQ ID NO: 1991764 - RNA, 18 nt, Shigella flexneri 2a str. 301
cuggcgcguuaucgacaa

SEQ ID NO: 1991765 - RNA, 15 nt, Shigella flexneri 2a str. 301
cuggcgcuaucaaua

SEQ ID NO: 1991766 - RNA, 11 nt, Shigella flexneri 2a str. 301
cuggcgcgcuc

SEQ ID NO: 1991767 - RNA, 21 nt, Shigella flexneri 2a str. 301
cuggcggagcucccaggcucc

SEQ ID NO: 1991768 - RNA, 18 nt, Shigella flexneri 2a str. 301
cuggcggcaaucgccaga

SEQ ID NO: 1991769 - RNA, 14 nt, Shigella flexneri 2a str. 301
cuggcggcaauaac

SEQ ID NO: 1991770 - RNA, 14 nt, Shigella flexneri 2a str. 301
cuggccgugcagac

SEQ ID NO: 1991771 - RNA, 15 nt, Shigella flexneri 2a str. 301
cuggccgugcagacc

SEQ ID NO: 1991772 - RNA, 18 nt, Shigella flexneri 2a str. 301
cuggcccggaauggugcu

SEQ ID NO: 1991773 - RNA, 21 nt, Shigella flexneri 2a str. 301
cuggccuauuaugacuccagc

SEQ ID NO: 1991774 - RNA, 14 nt, Shigella flexneri 2a str. 301
cuggccuggcuggu

SEQ ID NO: 1991775 - RNA, 15 nt, Shigella flexneri 2a str. 301
cuggcgcgacgcagg

SEQ ID NO: 1991776 - RNA, 22 nt, Shigella flexneri 2a str. 301
cuggcgcgaacagcacaucagc

SEQ ID NO: 1991777 - RNA, 21 nt, Shigella flexneri 2a str. 301
cuggcgcgaauagcuucuuca

SEQ ID NO: 1991778 - RNA, 20 nt, Shigella flexneri 2a str. 301
cuucugucgggcaucacuau

SEQ ID NO: 1991779 - RNA, 19 nt, Shigella flexneri 2a str. 301
cuucugguuauauuucccc

SEQ ID NO: 1991780 - RNA, 18 nt, Shigella flexneri 2a str. 301
cuucugguuucaguaauc

SEQ ID NO: 1991781 - RNA, 20 nt, Shigella flexneri 2a str. 301
cuucuggcguacgcauucuc

SEQ ID NO: 1991782 - RNA, 14 nt, Shigella flexneri 2a str. 301
cuucuggcuacuga

SEQ ID NO: 1991783 - RNA, 17 nt, Shigella flexneri 2a str. 301
cuucuggcuacugaugg

SEQ ID NO: 1991784 - RNA, 19 nt, Shigella flexneri 2a str. 301
cuucuggugauaggcguug

SEQ ID NO: 1991785 - RNA, 15 nt, Shigella flexneri 2a str. 301
cuucuucaguuuuuc

SEQ ID NO: 1991786 - RNA, 23 nt, Shigella flexneri 2a str. 301
cuucuuaaugcccaucucuucuu

SEQ ID NO: 1991787 - RNA, 16 nt, Shigella flexneri 2a str. 301
cuucuucuggcugcca

SEQ ID NO: 1991788 - RNA, 12 nt, Shigella flexneri 2a str. 301
cuucuucugucg

SEQ ID NO: 1991789 - RNA, 21 nt, Shigella flexneri 2a str. 301
cuucuucugucgggcaucacu

SEQ ID NO: 1991790 - RNA, 13 nt, Shigella flexneri 2a str. 301
cuucuucuuucag

SEQ ID NO: 1991791 - RNA, 18 nt, Shigella flexneri 2a str. 301
cuucuugcagcuuaauca

SEQ ID NO: 1991792 - RNA, 13 nt, Shigella flexneri 2a str. 301
cuucuuguaauuc

SEQ ID NO: 1991793 - RNA, 17 nt, Shigella flexneri 2a str. 301
cuucugccacuucuucg

SEQ ID NO: 1991794 - RNA, 15 nt, Shigella flexneri 2a str. 301
cuucucuucuuccgc

SEQ ID NO: 1991795 - RNA, 21 nt, Shigella flexneri 2a str. 301
cuucucuugcuggauuucccu

SEQ ID NO: 1991796 - RNA, 14 nt, Shigella flexneri 2a str. 301
cuucucuuccccgg

SEQ ID NO: 1991797 - RNA, 22 nt, Shigella flexneri 2a str. 301
cuucugcuuuggcugccgccag

SEQ ID NO: 1991798 - RNA, 20 nt, Shigella flexneri 2a str. 301
cuucugcuuucauucgguuu

SEQ ID NO: 1991799 - RNA, 22 nt, Shigella flexneri 2a str. 301
cuucugcuuugcccacgcuuuu

SEQ ID NO: 1991800 - RNA, 20 nt, Shigella flexneri 2a str. 301
cuucugcuuuggcugccgcc

SEQ ID NO: 1991801 - RNA, 16 nt, Shigella flexneri 2a str. 301
cuucugccagcugcug

SEQ ID NO: 1991802 - RNA, 16 nt, Shigella flexneri 2a str. 301
cuucugccuguccacc

SEQ ID NO: 1991803 - RNA, 20 nt, Shigella flexneri 2a str. 301
cuucgcguaacugaagcauu

SEQ ID NO: 1991804 - RNA, 19 nt, Shigella flexneri 2a str. 301
cuucucccagccgcccugc

SEQ ID NO: 1991805 - RNA, 22 nt, Shigella flexneri 2a str. 301
cuucucgcucgagagagaaaau

SEQ ID NO: 1991806 - RNA, 17 nt, Shigella flexneri 2a str. 301
cuucucgcucuuguucu

SEQ ID NO: 1991807 - RNA, 21 nt, Shigella flexneri 2a str. 301
cuucucgccagccucccagcc

SEQ ID NO: 1991808 - RNA, 23 nt, Shigella flexneri 2a str. 301
cuucucgauaaaccauccugcuc

SEQ ID NO: 1991809 - RNA, 14 nt, Shigella flexneri 2a str. 301
cuucucgauaaacc

SEQ ID NO: 1991810 - RNA, 22 nt, Shigella flexneri 2a str. 301
cuugauaaagaucgaucauuuu

SEQ ID NO: 1991811 - RNA, 17 nt, Shigella flexneri 2a str. 301
cuugcacucgcagaagc

SEQ ID NO: 1991812 - RNA, 23 nt, Shigella flexneri 2a str. 301
cuugauugggguugcagaaacaa

SEQ ID NO: 1991813 - RNA, 14 nt, Shigella flexneri 2a str. 301
cuugaugcacuggg

SEQ ID NO: 1991814 - RNA, 12 nt, Shigella flexneri 2a str. 301
cuugaaaccaga

SEQ ID NO: 1991815 - RNA, 20 nt, Shigella flexneri 2a str. 301
cuugaaaauuauaucuuauu

SEQ ID NO: 1991816 - RNA, 20 nt, Shigella flexneri 2a str. 301
cuucuuuuuuauggcuggca

SEQ ID NO: 1991817 - RNA, 14 nt, Shigella flexneri 2a str. 301
cuucuuuaugaauc

SEQ ID NO: 1991818 - RNA, 18 nt, Shigella flexneri 2a str. 301
cuugagcaggagcagcag

SEQ ID NO: 1991819 - RNA, 22 nt, Shigella flexneri 2a str. 301
cuugccggacaugcugccucca

SEQ ID NO: 1991820 - RNA, 18 nt, Shigella flexneri 2a str. 301
cuugcagucggcuuucuc

SEQ ID NO: 1991821 - RNA, 15 nt, Shigella flexneri 2a str. 301
cuugcagcgucuuau

SEQ ID NO: 1991822 - RNA, 19 nt, Shigella flexneri 2a str. 301
cuugcgccgcuuucucugc

SEQ ID NO: 1991823 - RNA, 15 nt, Shigella flexneri 2a str. 301
cuugcgcgcaaucag

SEQ ID NO: 1991824 - RNA, 20 nt, Shigella flexneri 2a str. 301
cuugcugauacuccucauug

SEQ ID NO: 1991825 - RNA, 17 nt, Shigella flexneri 2a str. 301
cuugcugauaacgugca

SEQ ID NO: 1991826 - RNA, 19 nt, Shigella flexneri 2a str. 301
cuugcugauaacgugcagc

SEQ ID NO: 1991827 - RNA, 20 nt, Shigella flexneri 2a str. 301
cuugcuuuccagcuucaaau

SEQ ID NO: 1991828 - RNA, 16 nt, Shigella flexneri 2a str. 301
cuugcugaugcacgca

SEQ ID NO: 1991829 - RNA, 14 nt, Shigella flexneri 2a str. 301
cuugcucaaugagu

SEQ ID NO: 1991830 - RNA, 14 nt, Shigella flexneri 2a str. 301
cuugcuccacguuc

SEQ ID NO: 1991831 - RNA, 19 nt, Shigella flexneri 2a str. 301
cuugcguacaccaacauca

SEQ ID NO: 1991832 - RNA, 22 nt, Shigella flexneri 2a str. 301
cuugcuaaccaacaaugcaaaa

SEQ ID NO: 1991833 - RNA, 23 nt, Shigella flexneri 2a str. 301
cuugcggaagcaaccggugucau

SEQ ID NO: 1991834 - RNA, 14 nt, Shigella flexneri 2a str. 301
cuugcggaaacugu

SEQ ID NO: 1991835 - RNA, 19 nt, Shigella flexneri 2a str. 301
cuugcggaagcgucaaggu

SEQ ID NO: 1991836 - RNA, 22 nt, Shigella flexneri 2a str. 301
cuuuaaccuuugcgguuaaaaa

SEQ ID NO: 1991837 - RNA, 17 nt, Shigella flexneri 2a str. 301
cuuuaaauugcguaaag

SEQ ID NO: 1991838 - RNA, 21 nt, Shigella flexneri 2a str. 301
cuuuaaacacgcgaccaaagg

SEQ ID NO: 1991839 - RNA, 13 nt, Shigella flexneri 2a str. 301
cuuuaaaggccag

SEQ ID NO: 1991840 - RNA, 17 nt, Shigella flexneri 2a str. 301
cuuuaaauaccuuacac

SEQ ID NO: 1991841 - RNA, 21 nt, Shigella flexneri 2a str. 301
cuuuaaauaccuuacacucaa

SEQ ID NO: 1991842 - RNA, 17 nt, Shigella flexneri 2a str. 301
cuuuaaaaaaagcauuu

SEQ ID NO: 1991843 - RNA, 13 nt, Shigella flexneri 2a str. 301
cuuguuuuuuucg

SEQ ID NO: 1991844 - RNA, 16 nt, Shigella flexneri 2a str. 301
cuuuaaaaaaagcauu

SEQ ID NO: 1991845 - RNA, 14 nt, Shigella flexneri 2a str. 301
cuuguuuaaggaaa

SEQ ID NO: 1991846 - RNA, 23 nt, Shigella flexneri 2a str. 301
cuuguuguaaugacaacaucuuu

SEQ ID NO: 1991847 - RNA, 16 nt, Shigella flexneri 2a str. 301
cuuguucgaagacauc

SEQ ID NO: 1991848 - RNA, 15 nt, Shigella flexneri 2a str. 301
cuuguucaucaccau

SEQ ID NO: 1991849 - RNA, 16 nt, Shigella flexneri 2a str. 301
cuuguuccacuucauc

SEQ ID NO: 1991850 - RNA, 18 nt, Shigella flexneri 2a str. 301
cuuguucucgcgcuucau

SEQ ID NO: 1991851 - RNA, 13 nt, Shigella flexneri 2a str. 301
cuuguugaacagg

SEQ ID NO: 1991852 - RNA, 15 nt, Shigella flexneri 2a str. 301
cuuguugcaacaaaa

SEQ ID NO: 1991853 - RNA, 15 nt, Shigella flexneri 2a str. 301
cuuguggugaaacua

SEQ ID NO: 1991854 - RNA, 12 nt, Shigella flexneri 2a str. 301
cuuguuaugaga

SEQ ID NO: 1991855 - RNA, 19 nt, Shigella flexneri 2a str. 301
cuuguuauuguguagccag

SEQ ID NO: 1991856 - RNA, 13 nt, Shigella flexneri 2a str. 301
cuugucuuuauua

SEQ ID NO: 1991857 - RNA, 15 nt, Shigella flexneri 2a str. 301
cuugugcucaauuga

SEQ ID NO: 1991858 - RNA, 13 nt, Shigella flexneri 2a str. 301
cuugugccggaug

SEQ ID NO: 1991859 - RNA, 22 nt, Shigella flexneri 2a str. 301
cuugucaugcagcuccaccgau

SEQ ID NO: 1991860 - RNA, 19 nt, Shigella flexneri 2a str. 301
cuuguacggcuccgcccca

SEQ ID NO: 1991861 - RNA, 18 nt, Shigella flexneri 2a str. 301
cuuguacucuacaaccag

SEQ ID NO: 1991862 - RNA, 16 nt, Shigella flexneri 2a str. 301
cuuguacggcuccgcc

SEQ ID NO: 1991863 - RNA, 21 nt, Shigella flexneri 2a str. 301
cuugucauacaccguuuuaca

SEQ ID NO: 1991864 - RNA, 16 nt, Shigella flexneri 2a str. 301
cuuguacccuuaacuc

SEQ ID NO: 1991865 - RNA, 16 nt, Shigella flexneri 2a str. 301
cuuucaccucuucauu

SEQ ID NO: 1991866 - RNA, 17 nt, Shigella flexneri 2a str. 301
cuuucaccucuucauua

SEQ ID NO: 1991867 - RNA, 20 nt, Shigella flexneri 2a str. 301
cuuucacgccgggaaauuuu

SEQ ID NO: 1991868 - RNA, 17 nt, Shigella flexneri 2a str. 301
cuuucacgcccaguccg

SEQ ID NO: 1991869 - RNA, 18 nt, Shigella flexneri 2a str. 301
cuuucacucauuaagacu

SEQ ID NO: 1991870 - RNA, 15 nt, Shigella flexneri 2a str. 301
cuuucacuauuucuu

SEQ ID NO: 1991871 - RNA, 21 nt, Shigella flexneri 2a str. 301
cuuucacuauuucuuuguaga

SEQ ID NO: 1991872 - RNA, 22 nt, Shigella flexneri 2a str. 301
cuuucaguggcuuaucuuccug

SEQ ID NO: 1991873 - RNA, 20 nt, Shigella flexneri 2a str. 301
cuuucacggccacucugccu

SEQ ID NO: 1991874 - RNA, 16 nt, Shigella flexneri 2a str. 301
cuuucaccgccugauc

SEQ ID NO: 1991875 - RNA, 22 nt, Shigella flexneri 2a str. 301
cuuucacccggaucaauuaauc

SEQ ID NO: 1991876 - RNA, 17 nt, Shigella flexneri 2a str. 301
cuuuaugugcuucuacc

SEQ ID NO: 1991877 - RNA, 21 nt, Shigella flexneri 2a str. 301
cuuuaaugccacauuagauaa

SEQ ID NO: 1991878 - RNA, 23 nt, Shigella flexneri 2a str. 301
cuuuaaugccacauuagauaaaa

SEQ ID NO: 1991879 - RNA, 20 nt, Shigella flexneri 2a str. 301
cuuuaccaccgucaaaaaaa

SEQ ID NO: 1991880 - RNA, 17 nt, Shigella flexneri 2a str. 301
cuuuacccagcggaugu

SEQ ID NO: 1991881 - RNA, 17 nt, Shigella flexneri 2a str. 301
cuuuaccgcgaccacca

SEQ ID NO: 1991882 - RNA, 18 nt, Shigella flexneri 2a str. 301
cuuuaccgcgaccaccac

SEQ ID NO: 1991883 - RNA, 16 nt, Shigella flexneri 2a str. 301
cuuuaauaugccacgc

SEQ ID NO: 1991884 - RNA, 17 nt, Shigella flexneri 2a str. 301
cuuuaaugcaucagcca

SEQ ID NO: 1991885 - RNA, 20 nt, Shigella flexneri 2a str. 301
cuuuauagugugcaaucacu

SEQ ID NO: 1991886 - RNA, 19 nt, Shigella flexneri 2a str. 301
cuuuauagggugccauuuu

SEQ ID NO: 1991887 - RNA, 11 nt, Shigella flexneri 2a str. 301
cuuuaccuuca

SEQ ID NO: 1991888 - RNA, 14 nt, Shigella flexneri 2a str. 301
cuuuaccuucaucc

SEQ ID NO: 1991889 - RNA, 16 nt, Shigella flexneri 2a str. 301
cuuuacgaagaaagca

SEQ ID NO: 1991890 - RNA, 19 nt, Shigella flexneri 2a str. 301
cuuucucccgaaaaaccug

SEQ ID NO: 1991891 - RNA, 14 nt, Shigella flexneri 2a str. 301
cuuucucuucaucu

SEQ ID NO: 1991892 - RNA, 23 nt, Shigella flexneri 2a str. 301
cuuucucaauuaacgguaauaau

SEQ ID NO: 1991893 - RNA, 15 nt, Shigella flexneri 2a str. 301
cuuucgcuucaacca

SEQ ID NO: 1991894 - RNA, 17 nt, Shigella flexneri 2a str. 301
cuuucgcuuuaucgccu

SEQ ID NO: 1991895 - RNA, 17 nt, Shigella flexneri 2a str. 301
cuuucgcuuaacgccca

SEQ ID NO: 1991896 - RNA, 20 nt, Shigella flexneri 2a str. 301
cuuuccuuaacuccucgccu

SEQ ID NO: 1991897 - RNA, 22 nt, Shigella flexneri 2a str. 301
cuuucgaauguggcagcaacug

SEQ ID NO: 1991898 - RNA, 21 nt, Shigella flexneri 2a str. 301
cuuucgagaagcaagcauuau

SEQ ID NO: 1991899 - RNA, 23 nt, Shigella flexneri 2a str. 301
cuuucgacggcaucagaaacaca

SEQ ID NO: 1991900 - RNA, 21 nt, Shigella flexneri 2a str. 301
cuuucgagcaauuuuccuuga

SEQ ID NO: 1991901 - RNA, 20 nt, Shigella flexneri 2a str. 301
cuuucgcuaaggucaccagu

SEQ ID NO: 1991902 - RNA, 14 nt, Shigella flexneri 2a str. 301
cuuucgcggcagga

SEQ ID NO: 1991903 - RNA, 22 nt, Shigella flexneri 2a str. 301
cuuucgcagauucggcaugaua

SEQ ID NO: 1991904 - RNA, 18 nt, Shigella flexneri 2a str. 301
cuuucgcauuagcagccc

SEQ ID NO: 1991905 - RNA, 13 nt, Shigella flexneri 2a str. 301
cuuucgcaaauau

SEQ ID NO: 1991906 - RNA, 17 nt, Shigella flexneri 2a str. 301
cuuucccggcaaucacc

SEQ ID NO: 1991907 - RNA, 16 nt, Shigella flexneri 2a str. 301
cuuucccggcaaucac

SEQ ID NO: 1991908 - RNA, 13 nt, Shigella flexneri 2a str. 301
cuuucccuucucg

SEQ ID NO: 1991909 - RNA, 18 nt, Shigella flexneri 2a str. 301
cuuucccuucacucugcu

SEQ ID NO: 1991910 - RNA, 13 nt, Shigella flexneri 2a str. 301
cuuuccugcugcg

SEQ ID NO: 1991911 - RNA, 22 nt, Shigella flexneri 2a str. 301
cuuuccuggucggcaaacugcu

SEQ ID NO: 1991912 - RNA, 13 nt, Shigella flexneri 2a str. 301
cuuuccuccuguc

SEQ ID NO: 1991913 - RNA, 15 nt, Shigella flexneri 2a str. 301
cuuuccucacuccuu

SEQ ID NO: 1991914 - RNA, 16 nt, Shigella flexneri 2a str. 301
cuuuccggcagaagca

SEQ ID NO: 1991915 - RNA, 19 nt, Shigella flexneri 2a str. 301
cuuuccaugccaucugcca

SEQ ID NO: 1991916 - RNA, 14 nt, Shigella flexneri 2a str. 301
cuuuccaggcauca

SEQ ID NO: 1991917 - RNA, 13 nt, Shigella flexneri 2a str. 301
cuuuccaggcauc

SEQ ID NO: 1991918 - RNA, 18 nt, Shigella flexneri 2a str. 301
cuuuccagucuucuugcu

SEQ ID NO: 1991919 - RNA, 21 nt, Shigella flexneri 2a str. 301
cuuucaucgcgacguucagau

SEQ ID NO: 1991920 - RNA, 19 nt, Shigella flexneri 2a str. 301
cuucauucagacaggcgaa

SEQ ID NO: 1991921 - RNA, 19 nt, Shigella flexneri 2a str. 301
cuucauuaccuuuuuuccc

SEQ ID NO: 1991922 - RNA, 20 nt, Shigella flexneri 2a str. 301
cuucauucgcgccagauggc

SEQ ID NO: 1991923 - RNA, 20 nt, Shigella flexneri 2a str. 301
cuucauugaacgggugauuu

SEQ ID NO: 1991924 - RNA, 15 nt, Shigella flexneri 2a str. 301
cuucauugacgccaa

SEQ ID NO: 1991925 - RNA, 15 nt, Shigella flexneri 2a str. 301
cuucauugcucucuu

SEQ ID NO: 1991926 - RNA, 13 nt, Shigella flexneri 2a str. 301
cuucauugcucuc

SEQ ID NO: 1991927 - RNA, 14 nt, Shigella flexneri 2a str. 301
cuuccauacagcuc

SEQ ID NO: 1991928 - RNA, 14 nt, Shigella flexneri 2a str. 301
cuuccaguuccggc

SEQ ID NO: 1991929 - RNA, 18 nt, Shigella flexneri 2a str. 301
cuuccagucgccugcuuu

SEQ ID NO: 1991930 - RNA, 20 nt, Shigella flexneri 2a str. 301
cuuccaguacgcgcaacccc

SEQ ID NO: 1991931 - RNA, 14 nt, Shigella flexneri 2a str. 301
cuuccgccagcggc

SEQ ID NO: 1991932 - RNA, 20 nt, Shigella flexneri 2a str. 301
cuuccgcuaguguacccuuc

SEQ ID NO: 1991933 - RNA, 18 nt, Shigella flexneri 2a str. 301
cuuccgcaauacagccag

SEQ ID NO: 1991934 - RNA, 20 nt, Shigella flexneri 2a str. 301
cuuccaucguccgugaagaa

SEQ ID NO: 1991935 - RNA, 17 nt, Shigella flexneri 2a str. 301
cuuccauugagaaagcc

SEQ ID NO: 1991936 - RNA, 22 nt, Shigella flexneri 2a str. 301
cuuccauugagaaagcccuggc

SEQ ID NO: 1991937 - RNA, 21 nt, Shigella flexneri 2a str. 301
cuucccugcugaauccccuuc

SEQ ID NO: 1991938 - RNA, 13 nt, Shigella flexneri 2a str. 301
cuucccagcgcag

SEQ ID NO: 1991939 - RNA, 22 nt, Shigella flexneri 2a str. 301
cuucccaauugcacauauuuuu

SEQ ID NO: 1991940 - RNA, 22 nt, Shigella flexneri 2a str. 301
cuucccaaagaucuccucacca

SEQ ID NO: 1991941 - RNA, 15 nt, Shigella flexneri 2a str. 301
cuucccacgucagac

SEQ ID NO: 1991942 - RNA, 23 nt, Shigella flexneri 2a str. 301
cuuccugcaacgagugcaucugg

SEQ ID NO: 1991943 - RNA, 12 nt, Shigella flexneri 2a str. 301
cuuccugaguga

SEQ ID NO: 1991944 - RNA, 20 nt, Shigella flexneri 2a str. 301
cuuccugcaacgagugcauc

SEQ ID NO: 1991945 - RNA, 12 nt, Shigella flexneri 2a str. 301
cuuccugcagcu

SEQ ID NO: 1991946 - RNA, 16 nt, Shigella flexneri 2a str. 301
cuucgaucuugccgcu

SEQ ID NO: 1991947 - RNA, 19 nt, Shigella flexneri 2a str. 301
cuucgcaaaaaaccauccc

SEQ ID NO: 1991948 - RNA, 14 nt, Shigella flexneri 2a str. 301
cuucgauggcuggg

SEQ ID NO: 1991949 - RNA, 18 nt, Shigella flexneri 2a str. 301
cuucgauggcugggguac

SEQ ID NO: 1991950 - RNA, 12 nt, Shigella flexneri 2a str. 301
cuuccucgccag

SEQ ID NO: 1991951 - RNA, 15 nt, Shigella flexneri 2a str. 301
cuuccucgucccaaa

SEQ ID NO: 1991952 - RNA, 18 nt, Shigella flexneri 2a str. 301
cuuccugaacucgccagc

SEQ ID NO: 1991953 - RNA, 18 nt, Shigella flexneri 2a str. 301
cuuccggcaacaaugcca

SEQ ID NO: 1991954 - RNA, 19 nt, Shigella flexneri 2a str. 301
cuuccggacguucagccau

SEQ ID NO: 1991955 - RNA, 20 nt, Shigella flexneri 2a str. 301
cuuccgggauuucccggcac

SEQ ID NO: 1991956 - RNA, 16 nt, Shigella flexneri 2a str. 301
cuucgcggaauuucag

SEQ ID NO: 1991957 - RNA, 14 nt, Shigella flexneri 2a str. 301
cuucgcgcaccaac

SEQ ID NO: 1991958 - RNA, 13 nt, Shigella flexneri 2a str. 301
cuucgccgccgcu

SEQ ID NO: 1991959 - RNA, 18 nt, Shigella flexneri 2a str. 301
cuucgccugccugcagcu

SEQ ID NO: 1991960 - RNA, 15 nt, Shigella flexneri 2a str. 301
cuucgccuuacucac

SEQ ID NO: 1991961 - RNA, 18 nt, Shigella flexneri 2a str. 301
cuucgccgaugaaguaca

SEQ ID NO: 1991962 - RNA, 22 nt, Shigella flexneri 2a str. 301
cuucgccgaugaaguacagccc

SEQ ID NO: 1991963 - RNA, 14 nt, Shigella flexneri 2a str. 301
cuucgccaaaucgc

SEQ ID NO: 1991964 - RNA, 14 nt, Shigella flexneri 2a str. 301
cuucaggcccugcu

SEQ ID NO: 1991965 - RNA, 20 nt, Shigella flexneri 2a str. 301
cuucaggcccugcuguuuuu

SEQ ID NO: 1991966 - RNA, 23 nt, Shigella flexneri 2a str. 301
cuucaggaucaaccgcuacauac

SEQ ID NO: 1991967 - RNA, 21 nt, Shigella flexneri 2a str. 301
cuucaggauguacgucauccg

SEQ ID NO: 1991968 - RNA, 14 nt, Shigella flexneri 2a str. 301
cuucagcucccgcu

SEQ ID NO: 1991969 - RNA, 14 nt, Shigella flexneri 2a str. 301
cuucaguugccugg

SEQ ID NO: 1991970 - RNA, 19 nt, Shigella flexneri 2a str. 301
cuucaguugccugggugca

SEQ ID NO: 1991971 - RNA, 14 nt, Shigella flexneri 2a str. 301
cuucagucgccagc

SEQ ID NO: 1991972 - RNA, 23 nt, Shigella flexneri 2a str. 301
cuucagucaggcgauuguuuaga

SEQ ID NO: 1991973 - RNA, 20 nt, Shigella flexneri 2a str. 301
cuucaggugcccaacauacu

SEQ ID NO: 1991974 - RNA, 22 nt, Shigella flexneri 2a str. 301
cuucauggggaugcugaaaaga

SEQ ID NO: 1991975 - RNA, 19 nt, Shigella flexneri 2a str. 301
cuucaugcagcauggucag

SEQ ID NO: 1991976 - RNA, 20 nt, Shigella flexneri 2a str. 301
cuucaugcagcauggucagg

SEQ ID NO: 1991977 - RNA, 17 nt, Shigella flexneri 2a str. 301
cuucaucgauacugcuc

SEQ ID NO: 1991978 - RNA, 22 nt, Shigella flexneri 2a str. 301
cuucauccgccccggcuucaaa

SEQ ID NO: 1991979 - RNA, 14 nt, Shigella flexneri 2a str. 301
cuucaucccugaaa

SEQ ID NO: 1991980 - RNA, 22 nt, Shigella flexneri 2a str. 301
cuucaucauaacccuuuccuuc

SEQ ID NO: 1991981 - RNA, 15 nt, Shigella flexneri 2a str. 301
cuucauccagcagug

SEQ ID NO: 1991982 - RNA, 19 nt, Shigella flexneri 2a str. 301
cuucaucaucgcagauuuc

SEQ ID NO: 1991983 - RNA, 14 nt, Shigella flexneri 2a str. 301
cuucaucauccucu

SEQ ID NO: 1991984 - RNA, 22 nt, Shigella flexneri 2a str. 301
cuucaucauccuuugggcauuu

SEQ ID NO: 1991985 - RNA, 12 nt, Shigella flexneri 2a str. 301
cuucauaggcuu

SEQ ID NO: 1991986 - RNA, 16 nt, Shigella flexneri 2a str. 301
cuucauagugcgcggu

SEQ ID NO: 1991987 - RNA, 19 nt, Shigella flexneri 2a str. 301
cuucauaaagauaauguaa

SEQ ID NO: 1991988 - RNA, 22 nt, Shigella flexneri 2a str. 301
cuucauaacuuugaucgcguuu

SEQ ID NO: 1991989 - RNA, 21 nt, Shigella flexneri 2a str. 301
cuucagcaacuuguucacgcc

SEQ ID NO: 1991990 - RNA, 23 nt, Shigella flexneri 2a str. 301
cuucagcaacuuguucacgccau

SEQ ID NO: 1991991 - RNA, 23 nt, Shigella flexneri 2a str. 301
cuucagccaguuuuucagcgcca

SEQ ID NO: 1991992 - RNA, 22 nt, Shigella flexneri 2a str. 301
cuucagccgcaaaccuggcaac

SEQ ID NO: 1991993 - RNA, 16 nt, Shigella flexneri 2a str. 301
cuucagccccuccaca

SEQ ID NO: 1991994 - RNA, 22 nt, Shigella flexneri 2a str. 301
cuucaccagcagcgucaacacu

SEQ ID NO: 1991995 - RNA, 20 nt, Shigella flexneri 2a str. 301
cuucacggcuuugucauuaa

SEQ ID NO: 1991996 - RNA, 14 nt, Shigella flexneri 2a str. 301
cuucagcaacaaaa

SEQ ID NO: 1991997 - RNA, 18 nt, Shigella flexneri 2a str. 301
cuucagcaacaaaauggc

SEQ ID NO: 1991998 - RNA, 19 nt, Shigella flexneri 2a str. 301
cuucagcaacaaaauggca

SEQ ID NO: 1991999 - RNA, 11 nt, Shigella flexneri 2a str. 301
cuuaucuggcc

SEQ ID NO: 1992000 - RNA, 16 nt, Shigella flexneri 2a str. 301
cuuauuaacuucccac

SEQ ID NO: 1992001 - RNA, 19 nt, Shigella flexneri 2a str. 301
cuuauuaugaaugauaaaa

SEQ ID NO: 1992002 - RNA, 16 nt, Shigella flexneri 2a str. 301
cuucacaaaggcuugc

SEQ ID NO: 1992003 - RNA, 13 nt, Shigella flexneri 2a str. 301
cuucaccagcagc

SEQ ID NO: 1992004 - RNA, 18 nt, Shigella flexneri 2a str. 301
cuucacagaaggccagga

SEQ ID NO: 1992005 - RNA, 22 nt, Shigella flexneri 2a str. 301
cuucacacacuuuuauuaacuc

SEQ ID NO: 1992006 - RNA, 12 nt, Shigella flexneri 2a str. 301
cuucacacugau

SEQ ID NO: 1992007 - RNA, 12 nt, Shigella flexneri 2a str. 301
cuucacaggccg

SEQ ID NO: 1992008 - RNA, 22 nt, Shigella flexneri 2a str. 301
cuuacucauaaauacuccauaa

SEQ ID NO: 1992009 - RNA, 14 nt, Shigella flexneri 2a str. 301
cuuauagacuaaau

SEQ ID NO: 1992010 - RNA, 22 nt, Shigella flexneri 2a str. 301
cuuauauauuaaucaucauuaa

SEQ ID NO: 1992011 - RNA, 22 nt, Shigella flexneri 2a str. 301
cuuauccggccuccauaagagu

SEQ ID NO: 1992012 - RNA, 14 nt, Shigella flexneri 2a str. 301
cuuauccgaugguu

SEQ ID NO: 1992013 - RNA, 19 nt, Shigella flexneri 2a str. 301
cuuauccggccuacaaaau

SEQ ID NO: 1992014 - RNA, 22 nt, Shigella flexneri 2a str. 301
cuuauccgacauuucugcugcc

SEQ ID NO: 1992015 - RNA, 17 nt, Shigella flexneri 2a str. 301
cuuauccgaccuacaaa

SEQ ID NO: 1992016 - RNA, 19 nt, Shigella flexneri 2a str. 301
cuuauccggcuuaccgcuc

SEQ ID NO: 1992017 - RNA, 17 nt, Shigella flexneri 2a str. 301
cuuaucgcccugcucca

SEQ ID NO: 1992018 - RNA, 18 nt, Shigella flexneri 2a str. 301
cuuaucgcccugcuccag

SEQ ID NO: 1992019 - RNA, 20 nt, Shigella flexneri 2a str. 301
cuuaucgcccugcuccagca

SEQ ID NO: 1992020 - RNA, 19 nt, Shigella flexneri 2a str. 301
cuuaucaggccuacaaguc

SEQ ID NO: 1992021 - RNA, 21 nt, Shigella flexneri 2a str. 301
cuuaucaggccuacaacuccg

SEQ ID NO: 1992022 - RNA, 18 nt, Shigella flexneri 2a str. 301
cuuaucaggccuacaaaa

SEQ ID NO: 1992023 - RNA, 13 nt, Shigella flexneri 2a str. 301
cuuauccagcaga

SEQ ID NO: 1992024 - RNA, 17 nt, Shigella flexneri 2a str. 301
cuuauccagccuacaaa

SEQ ID NO: 1992025 - RNA, 17 nt, Shigella flexneri 2a str. 301
cuuaauauuaacuuaau

SEQ ID NO: 1992026 - RNA, 13 nt, Shigella flexneri 2a str. 301
cuuaaucaccagc

SEQ ID NO: 1992027 - RNA, 20 nt, Shigella flexneri 2a str. 301
cuuaaucagaauuuuucgcu

SEQ ID NO: 1992028 - RNA, 18 nt, Shigella flexneri 2a str. 301
cuuaaucaucaaugccag

SEQ ID NO: 1992029 - RNA, 16 nt, Shigella flexneri 2a str. 301
cuuaaucaucaaugcc

SEQ ID NO: 1992030 - RNA, 23 nt, Shigella flexneri 2a str. 301
cuuaaucaucgcguacucaccgc

SEQ ID NO: 1992031 - RNA, 17 nt, Shigella flexneri 2a str. 301
cuuaauugcgcaacuga

SEQ ID NO: 1992032 - RNA, 21 nt, Shigella flexneri 2a str. 301
cuuaaaggggugaaaaaaacu

SEQ ID NO: 1992033 - RNA, 17 nt, Shigella flexneri 2a str. 301
cuuaaagucuuuguauu

SEQ ID NO: 1992034 - RNA, 17 nt, Shigella flexneri 2a str. 301
cuuaaaggggugaaaaa

SEQ ID NO: 1992035 - RNA, 15 nt, Shigella flexneri 2a str. 301
cuuacgcaacugcca

SEQ ID NO: 1992036 - RNA, 16 nt, Shigella flexneri 2a str. 301
cuuacgccugccagcu

SEQ ID NO: 1992037 - RNA, 17 nt, Shigella flexneri 2a str. 301
cuuaccuuuacguccac

SEQ ID NO: 1992038 - RNA, 13 nt, Shigella flexneri 2a str. 301
cuuacggauaauu

SEQ ID NO: 1992039 - RNA, 18 nt, Shigella flexneri 2a str. 301
cuuaccguccucuuccca

SEQ ID NO: 1992040 - RNA, 17 nt, Shigella flexneri 2a str. 301
cuuacacucaaauaucu

SEQ ID NO: 1992041 - RNA, 24 nt, Shigella flexneri 2a str. 301
cuuacagaaaugguaaagaaggca

SEQ ID NO: 1992042 - RNA, 19 nt, Shigella flexneri 2a str. 301
cuguugugccagaccaaac

SEQ ID NO: 1992043 - RNA, 19 nt, Shigella flexneri 2a str. 301
cuguugucuuuccagacuc

SEQ ID NO: 1992044 - RNA, 16 nt, Shigella flexneri 2a str. 301
cuguuuagccgcuucu

SEQ ID NO: 1992045 - RNA, 18 nt, Shigella flexneri 2a str. 301
cuguuuacgcagcucacu

SEQ ID NO: 1992046 - RNA, 18 nt, Shigella flexneri 2a str. 301
cuguugguaacuuacuga

SEQ ID NO: 1992047 - RNA, 20 nt, Shigella flexneri 2a str. 301
cuguugcccaugcuucugca

SEQ ID NO: 1992048 - RNA, 15 nt, Shigella flexneri 2a str. 301
cuguugcugaagaaa

SEQ ID NO: 1992049 - RNA, 17 nt, Shigella flexneri 2a str. 301
cuguugccugcacucag

SEQ ID NO: 1992050 - RNA, 18 nt, Shigella flexneri 2a str. 301
cuguugccugcacucagg

SEQ ID NO: 1992051 - RNA, 16 nt, Shigella flexneri 2a str. 301
cugucucucagcacac

SEQ ID NO: 1992052 - RNA, 21 nt, Shigella flexneri 2a str. 301
cugucucauuguguacauccu

SEQ ID NO: 1992053 - RNA, 16 nt, Shigella flexneri 2a str. 301
cugucugcuucugccu

SEQ ID NO: 1992054 - RNA, 12 nt, Shigella flexneri 2a str. 301
cugucuaccagc

SEQ ID NO: 1992055 - RNA, 21 nt, Shigella flexneri 2a str. 301
cuguugacguccagcccuucu

SEQ ID NO: 1992056 - RNA, 20 nt, Shigella flexneri 2a str. 301
cuguucugccguccagccgg

SEQ ID NO: 1992057 - RNA, 19 nt, Shigella flexneri 2a str. 301
cuguucgguuuugcccaca

SEQ ID NO: 1992058 - RNA, 16 nt, Shigella flexneri 2a str. 301
cuguuuucagcaccag

SEQ ID NO: 1992059 - RNA, 16 nt, Shigella flexneri 2a str. 301
cuguuuugucaucuuc

SEQ ID NO: 1992060 - RNA, 22 nt, Shigella flexneri 2a str. 301
cuguuugucgaucaucaggccc

SEQ ID NO: 1992061 - RNA, 19 nt, Shigella flexneri 2a str. 301
cuguuugcaggugaccagc

SEQ ID NO: 1992062 - RNA, 20 nt, Shigella flexneri 2a str. 301
cuguuucaucucuucacgcu

SEQ ID NO: 1992063 - RNA, 19 nt, Shigella flexneri 2a str. 301
cuguuuaucuucccagcgc

SEQ ID NO: 1992064 - RNA, 16 nt, Shigella flexneri 2a str. 301
cuguuuaucuucccag

SEQ ID NO: 1992065 - RNA, 23 nt, Shigella flexneri 2a str. 301
cuguuuagccgcuucugcagcuu

SEQ ID NO: 1992066 - RNA, 19 nt, Shigella flexneri 2a str. 301
cuguuuagccgcuucugca

SEQ ID NO: 1992067 - RNA, 15 nt, Shigella flexneri 2a str. 301
cuguuuuuuauacuu

SEQ ID NO: 1992068 - RNA, 16 nt, Shigella flexneri 2a str. 301
cuuaaaaaccagagaa

SEQ ID NO: 1992069 - RNA, 15 nt, Shigella flexneri 2a str. 301
cuuaaaaaauuuauu

SEQ ID NO: 1992070 - RNA, 13 nt, Shigella flexneri 2a str. 301
cuuaaaacaauau

SEQ ID NO: 1992071 - RNA, 17 nt, Shigella flexneri 2a str. 301
cuuaaaaucccgccagc

SEQ ID NO: 1992072 - RNA, 22 nt, Shigella flexneri 2a str. 301
cuuaaacaguacgagagaagag

SEQ ID NO: 1992073 - RNA, 19 nt, Shigella flexneri 2a str. 301
gaauaguuuccgcuucugc

SEQ ID NO: 1992074 - RNA, 14 nt, Shigella flexneri 2a str. 301
gaauauaagucagg

SEQ ID NO: 1992075 - RNA, 19 nt, Shigella flexneri 2a str. 301
gaauauaacgcagcgucag

SEQ ID NO: 1992076 - RNA, 21 nt, Shigella flexneri 2a str. 301
gaauagaaccuaagaaccaga

SEQ ID NO: 1992077 - RNA, 15 nt, Shigella flexneri 2a str. 301
gaauagcggaaaucu

SEQ ID NO: 1992078 - RNA, 20 nt, Shigella flexneri 2a str. 301
gaauauugccgaagaccaga

SEQ ID NO: 1992079 - RNA, 16 nt, Shigella flexneri 2a str. 301
gaauauguuuuugcag

SEQ ID NO: 1992080 - RNA, 16 nt, Shigella flexneri 2a str. 301
gaauauucaccgguuc

SEQ ID NO: 1992081 - RNA, 17 nt, Shigella flexneri 2a str. 301
gaauauggcggcggcuu

SEQ ID NO: 1992082 - RNA, 17 nt, Shigella flexneri 2a str. 301
gaauaugcgccacacca

SEQ ID NO: 1992083 - RNA, 20 nt, Shigella flexneri 2a str. 301
gaauaugguuagagaacaac

SEQ ID NO: 1992084 - RNA, 18 nt, Shigella flexneri 2a str. 301
gaauaugucgcgccaggc

SEQ ID NO: 1992085 - RNA, 23 nt, Shigella flexneri 2a str. 301
gaauaugaacaugaaaaaacugg

SEQ ID NO: 1992086 - RNA, 23 nt, Shigella flexneri 2a str. 301
gaauaugagucguaaacaacugg

SEQ ID NO: 1992087 - RNA, 17 nt, Shigella flexneri 2a str. 301
gaauaugaacaugaaaa

SEQ ID NO: 1992088 - RNA, 20 nt, Shigella flexneri 2a str. 301
gaauauauccgaaaaaggau

SEQ ID NO: 1992089 - RNA, 20 nt, Shigella flexneri 2a str. 301
gaauauauaauuaaaaauag

SEQ ID NO: 1992090 - RNA, 19 nt, Shigella flexneri 2a str. 301
gaauauauaauuaaaaaua

SEQ ID NO: 1992091 - RNA, 17 nt, Shigella flexneri 2a str. 301
gaauauauaauuaaaaa

SEQ ID NO: 1992092 - RNA, 16 nt, Shigella flexneri 2a str. 301
gaauaucaauacauca

SEQ ID NO: 1992093 - RNA, 21 nt, Shigella flexneri 2a str. 301
gaauaucauugccgguuggcg

SEQ ID NO: 1992094 - RNA, 12 nt, Shigella flexneri 2a str. 301
gaauaauuucau

SEQ ID NO: 1992095 - RNA, 17 nt, Shigella flexneri 2a str. 301
gaauaaugcaaaaaggc

SEQ ID NO: 1992096 - RNA, 20 nt, Shigella flexneri 2a str. 301
gaauaccccauggagaaaau

SEQ ID NO: 1992097 - RNA, 21 nt, Shigella flexneri 2a str. 301
gaauaccccauggagaaaaug

SEQ ID NO: 1992098 - RNA, 17 nt, Shigella flexneri 2a str. 301
gaauaccuugcugcucc

SEQ ID NO: 1992099 - RNA, 23 nt, Shigella flexneri 2a str. 301
gaauacgcucacgcgcugccucu

SEQ ID NO: 1992100 - RNA, 13 nt, Shigella flexneri 2a str. 301
gaauaaccgguuc

SEQ ID NO: 1992101 - RNA, 23 nt, Shigella flexneri 2a str. 301
gaauaacacccauaaaaaaaccc

SEQ ID NO: 1992102 - RNA, 15 nt, Shigella flexneri 2a str. 301
gaauaacaccagcca

SEQ ID NO: 1992103 - RNA, 17 nt, Shigella flexneri 2a str. 301
gaauaacaccagccaga

SEQ ID NO: 1992104 - RNA, 16 nt, Shigella flexneri 2a str. 301
gaauaaauuggcuggg

SEQ ID NO: 1992105 - RNA, 15 nt, Shigella flexneri 2a str. 301
gaauaauccgcccgg

SEQ ID NO: 1992106 - RNA, 17 nt, Shigella flexneri 2a str. 301
gaauaauccccauauca

SEQ ID NO: 1992107 - RNA, 22 nt, Shigella flexneri 2a str. 301
gaauaauccccauaucaggcac

SEQ ID NO: 1992108 - RNA, 17 nt, Shigella flexneri 2a str. 301
gaauaaucguaaucagc

SEQ ID NO: 1992109 - RNA, 19 nt, Shigella flexneri 2a str. 301
gaauaaucaccuuuaaccu

SEQ ID NO: 1992110 - RNA, 13 nt, Shigella flexneri 2a str. 301
gaauaaucagaug

SEQ ID NO: 1992111 - RNA, 13 nt, Shigella flexneri 2a str. 301
gaauaaucagcaa

SEQ ID NO: 1992112 - RNA, 21 nt, Shigella flexneri 2a str. 301
gaauaagacuggcaaaugaca

SEQ ID NO: 1992113 - RNA, 15 nt, Shigella flexneri 2a str. 301
gaauaagcugcguga

SEQ ID NO: 1992114 - RNA, 22 nt, Shigella flexneri 2a str. 301
gaagggcuggccaauuggcugg

SEQ ID NO: 1992115 - RNA, 18 nt, Shigella flexneri 2a str. 301
gaaggcuucguaaguggc

SEQ ID NO: 1992116 - RNA, 16 nt, Shigella flexneri 2a str. 301
gaaggcuuauaaggaa

SEQ ID NO: 1992117 - RNA, 16 nt, Shigella flexneri 2a str. 301
gaaggcgcauugcugg

SEQ ID NO: 1992118 - RNA, 19 nt, Shigella flexneri 2a str. 301
gaagguugccauaucuucc

SEQ ID NO: 1992119 - RNA, 17 nt, Shigella flexneri 2a str. 301
gaaguauuggugagucc

SEQ ID NO: 1992120 - RNA, 19 nt, Shigella flexneri 2a str. 301
gaaguagccaguaccaccc

SEQ ID NO: 1992121 - RNA, 17 nt, Shigella flexneri 2a str. 301
gaaguaccaauggcaau

SEQ ID NO: 1992122 - RNA, 20 nt, Shigella flexneri 2a str. 301
gaagugauccgccgcgcggu

SEQ ID NO: 1992123 - RNA, 16 nt, Shigella flexneri 2a str. 301
gaaguggacgaacagu

SEQ ID NO: 1992124 - RNA, 15 nt, Shigella flexneri 2a str. 301
gaaguggcguucagc

SEQ ID NO: 1992125 - RNA, 23 nt, Shigella flexneri 2a str. 301
gaagugguucauguugcgguggu

SEQ ID NO: 1992126 - RNA, 14 nt, Shigella flexneri 2a str. 301
gaagucgaucauau

SEQ ID NO: 1992127 - RNA, 18 nt, Shigella flexneri 2a str. 301
gaagucguucagaucuuu

SEQ ID NO: 1992128 - RNA, 23 nt, Shigella flexneri 2a str. 301
gaaguccacgcgguagcgggcag

SEQ ID NO: 1992129 - RNA, 22 nt, Shigella flexneri 2a str. 301
gaaguccacgcgguagcgggca

SEQ ID NO: 1992130 - RNA, 20 nt, Shigella flexneri 2a str. 301
gaagucccacggugcagcug

SEQ ID NO: 1992131 - RNA, 17 nt, Shigella flexneri 2a str. 301
gaagucgaacuucucuu

SEQ ID NO: 1992132 - RNA, 12 nt, Shigella flexneri 2a str. 301
gaauaaaagcca

SEQ ID NO: 1992133 - RNA, 20 nt, Shigella flexneri 2a str. 301
gaauaaaacagaaaccgagg

SEQ ID NO: 1992134 - RNA, 16 nt, Shigella flexneri 2a str. 301
gaauaaaacaggcagc

SEQ ID NO: 1992135 - RNA, 12 nt, Shigella flexneri 2a str. 301
gaauaaaacaga

SEQ ID NO: 1992136 - RNA, 16 nt, Shigella flexneri 2a str. 301
gaaguuuaauucuuug

SEQ ID NO: 1992137 - RNA, 15 nt, Shigella flexneri 2a str. 301
gaaguuccagggcag

SEQ ID NO: 1992138 - RNA, 21 nt, Shigella flexneri 2a str. 301
gaagugugguuugucauuggc

SEQ ID NO: 1992139 - RNA, 17 nt, Shigella flexneri 2a str. 301
gaaguuaauuucgacgg

SEQ ID NO: 1992140 - RNA, 16 nt, Shigella flexneri 2a str. 301
gaaucgccacaacuuc

SEQ ID NO: 1992141 - RNA, 21 nt, Shigella flexneri 2a str. 301
gaauccgcaccaacuccacuu

SEQ ID NO: 1992142 - RNA, 14 nt, Shigella flexneri 2a str. 301
gaauccccacugca

SEQ ID NO: 1992143 - RNA, 14 nt, Shigella flexneri 2a str. 301
gaaucagcccagcc

SEQ ID NO: 1992144 - RNA, 23 nt, Shigella flexneri 2a str. 301
gaaucaggcaggucuuucaccug

SEQ ID NO: 1992145 - RNA, 19 nt, Shigella flexneri 2a str. 301
gaaucaguaggugcaagca

SEQ ID NO: 1992146 - RNA, 21 nt, Shigella flexneri 2a str. 301
gaaucauaaauacaaggccaa

SEQ ID NO: 1992147 - RNA, 22 nt, Shigella flexneri 2a str. 301
gaaucaguuguucagaaugccc

SEQ ID NO: 1992148 - RNA, 23 nt, Shigella flexneri 2a str. 301
gaaucaugccgaucgucugggca

SEQ ID NO: 1992149 - RNA, 16 nt, Shigella flexneri 2a str. 301
gaaucauaacugccgu

SEQ ID NO: 1992150 - RNA, 19 nt, Shigella flexneri 2a str. 301
gaaucaucguucauauauu

SEQ ID NO: 1992151 - RNA, 13 nt, Shigella flexneri 2a str. 301
gaaucauaggcuu

SEQ ID NO: 1992152 - RNA, 22 nt, Shigella flexneri 2a str. 301
gaaucaccgccacgcccuccug

SEQ ID NO: 1992153 - RNA, 16 nt, Shigella flexneri 2a str. 301
gaaucaccgccacgcc

SEQ ID NO: 1992154 - RNA, 22 nt, Shigella flexneri 2a str. 301
gaaucagaauccggugccuuac

SEQ ID NO: 1992155 - RNA, 16 nt, Shigella flexneri 2a str. 301
gaaucacuucaucgcc

SEQ ID NO: 1992156 - RNA, 16 nt, Shigella flexneri 2a str. 301
gaaucaaucagagcca

SEQ ID NO: 1992157 - RNA, 19 nt, Shigella flexneri 2a str. 301
gaaucaaauaaaaauaccc

SEQ ID NO: 1992158 - RNA, 14 nt, Shigella flexneri 2a str. 301
gaaucaaaaucauc

SEQ ID NO: 1992159 - RNA, 19 nt, Shigella flexneri 2a str. 301
gaaucaaaaucaucaucuu

SEQ ID NO: 1992160 - RNA, 21 nt, Shigella flexneri 2a str. 301
gaaucaaaaucaucaucuuua

SEQ ID NO: 1992161 - RNA, 13 nt, Shigella flexneri 2a str. 301
gaaucggcggcgg

SEQ ID NO: 1992162 - RNA, 13 nt, Shigella flexneri 2a str. 301
gaaucgccagcau

SEQ ID NO: 1992163 - RNA, 14 nt, Shigella flexneri 2a str. 301
gaaucucuuuuguu

SEQ ID NO: 1992164 - RNA, 14 nt, Shigella flexneri 2a str. 301
gaaucuccagaucu

SEQ ID NO: 1992165 - RNA, 22 nt, Shigella flexneri 2a str. 301
gaaugacaucaucgccccgcuc

SEQ ID NO: 1992166 - RNA, 22 nt, Shigella flexneri 2a str. 301
gaaugaucagcgguuuugccag

SEQ ID NO: 1992167 - RNA, 16 nt, Shigella flexneri 2a str. 301
gaaugacgacguacca

SEQ ID NO: 1992168 - RNA, 18 nt, Shigella flexneri 2a str. 301
gaaugaggaucagccgcu

SEQ ID NO: 1992169 - RNA, 15 nt, Shigella flexneri 2a str. 301
gaaugagcaucuacu

SEQ ID NO: 1992170 - RNA, 15 nt, Shigella flexneri 2a str. 301
gaaugaggcagcaag

SEQ ID NO: 1992171 - RNA, 13 nt, Shigella flexneri 2a str. 301
gaauggucgggcu

SEQ ID NO: 1992172 - RNA, 18 nt, Shigella flexneri 2a str. 301
gaauggcgcacucaaaac

SEQ ID NO: 1992173 - RNA, 15 nt, Shigella flexneri 2a str. 301
gaaugucguuuccau

SEQ ID NO: 1992174 - RNA, 21 nt, Shigella flexneri 2a str. 301
gaaugucugucugacaaccgc

SEQ ID NO: 1992175 - RNA, 15 nt, Shigella flexneri 2a str. 301
gaauguggcaaugag

SEQ ID NO: 1992176 - RNA, 12 nt, Shigella flexneri 2a str. 301
gaauuaaaauau

SEQ ID NO: 1992177 - RNA, 16 nt, Shigella flexneri 2a str. 301
gaaugcgaaaauccuc

SEQ ID NO: 1992178 - RNA, 16 nt, Shigella flexneri 2a str. 301
gaaugccggaaucaga

SEQ ID NO: 1992179 - RNA, 18 nt, Shigella flexneri 2a str. 301
gaaugccggaaucagaau

SEQ ID NO: 1992180 - RNA, 21 nt, Shigella flexneri 2a str. 301
gaaugccggaaucagaauccg

SEQ ID NO: 1992181 - RNA, 14 nt, Shigella flexneri 2a str. 301
gaaugcagcuccac

SEQ ID NO: 1992182 - RNA, 19 nt, Shigella flexneri 2a str. 301
gaaugccccuuuaaauacc

SEQ ID NO: 1992183 - RNA, 19 nt, Shigella flexneri 2a str. 301
gaaugcagucacgccagua

SEQ ID NO: 1992184 - RNA, 20 nt, Shigella flexneri 2a str. 301
gaauggcaucugauaagccc

SEQ ID NO: 1992185 - RNA, 20 nt, Shigella flexneri 2a str. 301
gaauggaaacagcaccaucc

SEQ ID NO: 1992186 - RNA, 14 nt, Shigella flexneri 2a str. 301
gaaugcggcaggca

SEQ ID NO: 1992187 - RNA, 15 nt, Shigella flexneri 2a str. 301
gaaugcgauggcaaa

SEQ ID NO: 1992188 - RNA, 17 nt, Shigella flexneri 2a str. 301
gaaugcgauggcaaaag

SEQ ID NO: 1992189 - RNA, 19 nt, Shigella flexneri 2a str. 301
gaaugcucgcuggcaggcc

SEQ ID NO: 1992190 - RNA, 17 nt, Shigella flexneri 2a str. 301
gaauucuaucaugcaaa

SEQ ID NO: 1992191 - RNA, 16 nt, Shigella flexneri 2a str. 301
gaauucuaucaugcaa

SEQ ID NO: 1992192 - RNA, 17 nt, Shigella flexneri 2a str. 301
gaauucgacuuucucug

SEQ ID NO: 1992193 - RNA, 21 nt, Shigella flexneri 2a str. 301
gaauucgcugaauaccgauuc

SEQ ID NO: 1992194 - RNA, 19 nt, Shigella flexneri 2a str. 301
gaauugauuuucgaaaaaa

SEQ ID NO: 1992195 - RNA, 21 nt, Shigella flexneri 2a str. 301
gaauugauuuucgaaaaaaaa

SEQ ID NO: 1992196 - RNA, 14 nt, Shigella flexneri 2a str. 301
gaauugagaugacg

SEQ ID NO: 1992197 - RNA, 21 nt, Shigella flexneri 2a str. 301
gaauuguuuggacgaauuagc

SEQ ID NO: 1992198 - RNA, 22 nt, Shigella flexneri 2a str. 301
gaauuguucugcgccaaacaga

SEQ ID NO: 1992199 - RNA, 20 nt, Shigella flexneri 2a str. 301
gaauugcugcgcccgcagcg

SEQ ID NO: 1992200 - RNA, 15 nt, Shigella flexneri 2a str. 301
gaauuucagaaaacg

SEQ ID NO: 1992201 - RNA, 17 nt, Shigella flexneri 2a str. 301
gaauucaaauccuucag

SEQ ID NO: 1992202 - RNA, 18 nt, Shigella flexneri 2a str. 301
gaauucacucuauaccgc

SEQ ID NO: 1992203 - RNA, 14 nt, Shigella flexneri 2a str. 301
gaauuaaugccucu

SEQ ID NO: 1992204 - RNA, 16 nt, Shigella flexneri 2a str. 301
gaauuacacagccaca

SEQ ID NO: 1992205 - RNA, 21 nt, Shigella flexneri 2a str. 301
gaauuaugcagccuucauuca

SEQ ID NO: 1992206 - RNA, 13 nt, Shigella flexneri 2a str. 301
gaauuaugcagcc

SEQ ID NO: 1992207 - RNA, 18 nt, Shigella flexneri 2a str. 301
gaauuauaauuccuucac

SEQ ID NO: 1992208 - RNA, 15 nt, Shigella flexneri 2a str. 301
gaaccgccccacccc

SEQ ID NO: 1992209 - RNA, 21 nt, Shigella flexneri 2a str. 301
gaaccgccccggguuuccugg

SEQ ID NO: 1992210 - RNA, 17 nt, Shigella flexneri 2a str. 301
gaaccgcauacgcagca

SEQ ID NO: 1992211 - RNA, 14 nt, Shigella flexneri 2a str. 301
gaaccggaaaucca

SEQ ID NO: 1992212 - RNA, 19 nt, Shigella flexneri 2a str. 301
gaaccgcugucacccggca

SEQ ID NO: 1992213 - RNA, 23 nt, Shigella flexneri 2a str. 301
gaaccgcuguugucugaaugaua

SEQ ID NO: 1992214 - RNA, 15 nt, Shigella flexneri 2a str. 301
gaaccgccuggcgcu

SEQ ID NO: 1992215 - RNA, 22 nt, Shigella flexneri 2a str. 301
gaacccaaccgugaggccaccg

SEQ ID NO: 1992216 - RNA, 23 nt, Shigella flexneri 2a str. 301
gaaccaugcaauuaccgccacca

SEQ ID NO: 1992217 - RNA, 11 nt, Shigella flexneri 2a str. 301
gaaccaucggc

SEQ ID NO: 1992218 - RNA, 13 nt, Shigella flexneri 2a str. 301
gaacccagcaggu

SEQ ID NO: 1992219 - RNA, 21 nt, Shigella flexneri 2a str. 301
gaaccaccgaugcacagcacg

SEQ ID NO: 1992220 - RNA, 17 nt, Shigella flexneri 2a str. 301
gaaccacaaugaagaaa

SEQ ID NO: 1992221 - RNA, 13 nt, Shigella flexneri 2a str. 301
gaaccacagcgcc

SEQ ID NO: 1992222 - RNA, 21 nt, Shigella flexneri 2a str. 301
gaaccacggaaaggcaguuca

SEQ ID NO: 1992223 - RNA, 17 nt, Shigella flexneri 2a str. 301
gaaccagagaaucugcg

SEQ ID NO: 1992224 - RNA, 16 nt, Shigella flexneri 2a str. 301
gaaccagagaaucugc

SEQ ID NO: 1992225 - RNA, 16 nt, Shigella flexneri 2a str. 301
gaaccauaaaaucaca

SEQ ID NO: 1992226 - RNA, 21 nt, Shigella flexneri 2a str. 301
gaaccagggaaaaaagccccg

SEQ ID NO: 1992227 - RNA, 20 nt, Shigella flexneri 2a str. 301
gaacgcacuauacaaccaga

SEQ ID NO: 1992228 - RNA, 19 nt, Shigella flexneri 2a str. 301
gaacgcaaucaaauaccac

SEQ ID NO: 1992229 - RNA, 16 nt, Shigella flexneri 2a str. 301
gaacgccuucgccauc

SEQ ID NO: 1992230 - RNA, 16 nt, Shigella flexneri 2a str. 301
gaacgccuuauccggc

SEQ ID NO: 1992231 - RNA, 17 nt, Shigella flexneri 2a str. 301
gaacgccuuauccggcc

SEQ ID NO: 1992232 - RNA, 16 nt, Shigella flexneri 2a str. 301
gaacgccuuaucuggc

SEQ ID NO: 1992233 - RNA, 17 nt, Shigella flexneri 2a str. 301
gaacgcgcacaggcgcu

SEQ ID NO: 1992234 - RNA, 16 nt, Shigella flexneri 2a str. 301
gaacgccauaaaaguc

SEQ ID NO: 1992235 - RNA, 17 nt, Shigella flexneri 2a str. 301
gaaccucgcggcugccc

SEQ ID NO: 1992236 - RNA, 15 nt, Shigella flexneri 2a str. 301
gaaccguaaaagccu

SEQ ID NO: 1992237 - RNA, 20 nt, Shigella flexneri 2a str. 301
gaacgagaaaaugacgauga

SEQ ID NO: 1992238 - RNA, 22 nt, Shigella flexneri 2a str. 301
gaacgagaaaagccaaccugcg

SEQ ID NO: 1992239 - RNA, 13 nt, Shigella flexneri 2a str. 301
gaacgagaaaagc

SEQ ID NO: 1992240 - RNA, 20 nt, Shigella flexneri 2a str. 301
gaacgacaaauucaggaaac

SEQ ID NO: 1992241 - RNA, 16 nt, Shigella flexneri 2a str. 301
gaaccuguucaacaau

SEQ ID NO: 1992242 - RNA, 17 nt, Shigella flexneri 2a str. 301
gaaccugugacagcagc

SEQ ID NO: 1992243 - RNA, 22 nt, Shigella flexneri 2a str. 301
gaacguuacaaucugcgcugga

SEQ ID NO: 1992244 - RNA, 17 nt, Shigella flexneri 2a str. 301
gaacgugcaaaaucaaa

SEQ ID NO: 1992245 - RNA, 21 nt, Shigella flexneri 2a str. 301
gaacgucgucgugaagcagag

SEQ ID NO: 1992246 - RNA, 19 nt, Shigella flexneri 2a str. 301
gaacuaccgugcuguacag

SEQ ID NO: 1992247 - RNA, 22 nt, Shigella flexneri 2a str. 301
gaacuacggcaaaagaauauca

SEQ ID NO: 1992248 - RNA, 18 nt, Shigella flexneri 2a str. 301
gaacucaacgccuucuuc

SEQ ID NO: 1992249 - RNA, 18 nt, Shigella flexneri 2a str. 301
gaacgggagaaacccggc

SEQ ID NO: 1992250 - RNA, 21 nt, Shigella flexneri 2a str. 301
gaacgguaagaacaagcaaac

SEQ ID NO: 1992251 - RNA, 21 nt, Shigella flexneri 2a str. 301
gaacggcgcgguuuccaccuu

SEQ ID NO: 1992252 - RNA, 19 nt, Shigella flexneri 2a str. 301
gaacgcuuuugcaucggca

SEQ ID NO: 1992253 - RNA, 21 nt, Shigella flexneri 2a str. 301
gaacggauagagcgcggcgca

SEQ ID NO: 1992254 - RNA, 19 nt, Shigella flexneri 2a str. 301
gaacggauagagcgcggcg

SEQ ID NO: 1992255 - RNA, 15 nt, Shigella flexneri 2a str. 301
gaacgcggcccaggc

SEQ ID NO: 1992256 - RNA, 20 nt, Shigella flexneri 2a str. 301
gaacgcggcccaggcggcgu

SEQ ID NO: 1992257 - RNA, 17 nt, Shigella flexneri 2a str. 301
gaacgcguucacugccg

SEQ ID NO: 1992258 - RNA, 19 nt, Shigella flexneri 2a str. 301
gaacugcgguaauccgggu

SEQ ID NO: 1992259 - RNA, 18 nt, Shigella flexneri 2a str. 301
gaacugggccugcauauc

SEQ ID NO: 1992260 - RNA, 11 nt, Shigella flexneri 2a str. 301
gaacuggcugu

SEQ ID NO: 1992261 - RNA, 14 nt, Shigella flexneri 2a str. 301
gaacuggcaggaaa

SEQ ID NO: 1992262 - RNA, 19 nt, Shigella flexneri 2a str. 301
gaacuggcaacaauggcau

SEQ ID NO: 1992263 - RNA, 15 nt, Shigella flexneri 2a str. 301
gaacuggcugccagc

SEQ ID NO: 1992264 - RNA, 22 nt, Shigella flexneri 2a str. 301
gaacuucgccauuuucugccgc

SEQ ID NO: 1992265 - RNA, 12 nt, Shigella flexneri 2a str. 301
gaacuucgccac

SEQ ID NO: 1992266 - RNA, 16 nt, Shigella flexneri 2a str. 301
gaacuucgcagccgug

SEQ ID NO: 1992267 - RNA, 19 nt, Shigella flexneri 2a str. 301
gaacuucauaugcgccaga

SEQ ID NO: 1992268 - RNA, 12 nt, Shigella flexneri 2a str. 301
gaacuggucugc

SEQ ID NO: 1992269 - RNA, 17 nt, Shigella flexneri 2a str. 301
gaacugacugaaugcca

SEQ ID NO: 1992270 - RNA, 11 nt, Shigella flexneri 2a str. 301
gaacugacagc

SEQ ID NO: 1992271 - RNA, 13 nt, Shigella flexneri 2a str. 301
gaacugaaaggcg

SEQ ID NO: 1992272 - RNA, 17 nt, Shigella flexneri 2a str. 301
gaacucuucuuccggca

SEQ ID NO: 1992273 - RNA, 20 nt, Shigella flexneri 2a str. 301
gaacucgaggauaaauuuuc

SEQ ID NO: 1992274 - RNA, 17 nt, Shigella flexneri 2a str. 301
gaacucgauaacacggu

SEQ ID NO: 1992275 - RNA, 15 nt, Shigella flexneri 2a str. 301
gaacucgaggauaaa

SEQ ID NO: 1992276 - RNA, 15 nt, Shigella flexneri 2a str. 301
gaacuccugaaagcg

SEQ ID NO: 1992277 - RNA, 17 nt, Shigella flexneri 2a str. 301
gaacucgacgcccugga

SEQ ID NO: 1992278 - RNA, 20 nt, Shigella flexneri 2a str. 301
gaacucaggcugccagauca

SEQ ID NO: 1992279 - RNA, 18 nt, Shigella flexneri 2a str. 301
gaacucacagggcugcug

SEQ ID NO: 1992280 - RNA, 17 nt, Shigella flexneri 2a str. 301
gaagcguaaaucccagc

SEQ ID NO: 1992281 - RNA, 19 nt, Shigella flexneri 2a str. 301
gaagcguucuucugcuucu

SEQ ID NO: 1992282 - RNA, 16 nt, Shigella flexneri 2a str. 301
gaagcuggucagcauc

SEQ ID NO: 1992283 - RNA, 17 nt, Shigella flexneri 2a str. 301
gaagcuggcagaaguug

SEQ ID NO: 1992284 - RNA, 18 nt, Shigella flexneri 2a str. 301
gaagcuggauuaacgcug

SEQ ID NO: 1992285 - RNA, 19 nt, Shigella flexneri 2a str. 301
gaagcugacgacgaagaaa

SEQ ID NO: 1992286 - RNA, 13 nt, Shigella flexneri 2a str. 301
gaaggauuacuca

SEQ ID NO: 1992287 - RNA, 19 nt, Shigella flexneri 2a str. 301
gaaggaagacgcagcaugc

SEQ ID NO: 1992288 - RNA, 14 nt, Shigella flexneri 2a str. 301
gaaggaaaauacag

SEQ ID NO: 1992289 - RNA, 15 nt, Shigella flexneri 2a str. 301
gaaggaauuuuacag

SEQ ID NO: 1992290 - RNA, 14 nt, Shigella flexneri 2a str. 301
gaagcgcauggcgu

SEQ ID NO: 1992291 - RNA, 13 nt, Shigella flexneri 2a str. 301
gaagcgcgugcua

SEQ ID NO: 1992292 - RNA, 17 nt, Shigella flexneri 2a str. 301
gaagcggcacugcucuu

SEQ ID NO: 1992293 - RNA, 13 nt, Shigella flexneri 2a str. 301
gaagcggaaauca

SEQ ID NO: 1992294 - RNA, 20 nt, Shigella flexneri 2a str. 301
gaagcgcaacgcaucaggca

SEQ ID NO: 1992295 - RNA, 20 nt, Shigella flexneri 2a str. 301
gaagcgauggugguggggga

SEQ ID NO: 1992296 - RNA, 15 nt, Shigella flexneri 2a str. 301
gaagcgaacaucgag

SEQ ID NO: 1992297 - RNA, 11 nt, Shigella flexneri 2a str. 301
gaagccuccau

SEQ ID NO: 1992298 - RNA, 21 nt, Shigella flexneri 2a str. 301
gaagccuaccgggaugcugau

SEQ ID NO: 1992299 - RNA, 16 nt, Shigella flexneri 2a str. 301
gaagccgaucgugcua

SEQ ID NO: 1992300 - RNA, 22 nt, Shigella flexneri 2a str. 301
gaagcccaguaccgccagugca

SEQ ID NO: 1992301 - RNA, 18 nt, Shigella flexneri 2a str. 301
gaagccauuaaacaccag

SEQ ID NO: 1992302 - RNA, 18 nt, Shigella flexneri 2a str. 301
gaagccaccacgccaaga

SEQ ID NO: 1992303 - RNA, 19 nt, Shigella flexneri 2a str. 301
gaagcauugcgccugcagg

SEQ ID NO: 1992304 - RNA, 13 nt, Shigella flexneri 2a str. 301
gaagcaguuuugc

SEQ ID NO: 1992305 - RNA, 13 nt, Shigella flexneri 2a str. 301
gaagcaagcauua

SEQ ID NO: 1992306 - RNA, 20 nt, Shigella flexneri 2a str. 301
gaagcaauccauaccagcac

SEQ ID NO: 1992307 - RNA, 12 nt, Shigella flexneri 2a str. 301
gaagcagagcag

SEQ ID NO: 1992308 - RNA, 14 nt, Shigella flexneri 2a str. 301
gaagcagucaacac

SEQ ID NO: 1992309 - RNA, 15 nt, Shigella flexneri 2a str. 301
gaagcaaaccaggcc

SEQ ID NO: 1992310 - RNA, 23 nt, Shigella flexneri 2a str. 301
gaagauguuucuggucugcugga

SEQ ID NO: 1992311 - RNA, 14 nt, Shigella flexneri 2a str. 301
gaagaguaaaaaaa

SEQ ID NO: 1992312 - RNA, 17 nt, Shigella flexneri 2a str. 301
gaagaguaaaaaaaccg

SEQ ID NO: 1992313 - RNA, 13 nt, Shigella flexneri 2a str. 301
gaagaggaacaaa

SEQ ID NO: 1992314 - RNA, 13 nt, Shigella flexneri 2a str. 301
gaagagacaaaaa

SEQ ID NO: 1992315 - RNA, 20 nt, Shigella flexneri 2a str. 301
gaagagacaaaaaaggugcu

SEQ ID NO: 1992316 - RNA, 14 nt, Shigella flexneri 2a str. 301
gaagaugaaaaacg

SEQ ID NO: 1992317 - RNA, 18 nt, Shigella flexneri 2a str. 301
gaagaugaauugagacgu

SEQ ID NO: 1992318 - RNA, 19 nt, Shigella flexneri 2a str. 301
gaagaugccaacuggcaua

SEQ ID NO: 1992319 - RNA, 18 nt, Shigella flexneri 2a str. 301
gaagaucguggagaacaa

SEQ ID NO: 1992320 - RNA, 19 nt, Shigella flexneri 2a str. 301
gaagaucguggagaacaau

SEQ ID NO: 1992321 - RNA, 20 nt, Shigella flexneri 2a str. 301
gaagaguuucgggauggcgu

SEQ ID NO: 1992322 - RNA, 13 nt, Shigella flexneri 2a str. 301
gaagacaaccaaa

SEQ ID NO: 1992323 - RNA, 14 nt, Shigella flexneri 2a str. 301
gaagaauuugcccu

SEQ ID NO: 1992324 - RNA, 14 nt, Shigella flexneri 2a str. 301
gaagacacauugcg

SEQ ID NO: 1992325 - RNA, 21 nt, Shigella flexneri 2a str. 301
gaagacaucgcagggaucauc

SEQ ID NO: 1992326 - RNA, 24 nt, Shigella flexneri 2a str. 301
gaagaaggcuucguaaguggcguu

SEQ ID NO: 1992327 - RNA, 19 nt, Shigella flexneri 2a str. 301
gaagaccugccagaacaac

SEQ ID NO: 1992328 - RNA, 12 nt, Shigella flexneri 2a str. 301
gaagaaaucagu

SEQ ID NO: 1992329 - RNA, 20 nt, Shigella flexneri 2a str. 301
gaagaaaucccccagcauca

SEQ ID NO: 1992330 - RNA, 22 nt, Shigella flexneri 2a str. 301
gaagaagcguuccauugggcug

SEQ ID NO: 1992331 - RNA, 21 nt, Shigella flexneri 2a str. 301
gaacuugacgaucugcuacag

SEQ ID NO: 1992332 - RNA, 23 nt, Shigella flexneri 2a str. 301
gaacuugacgaucugcuacaggc

SEQ ID NO: 1992333 - RNA, 15 nt, Shigella flexneri 2a str. 301
gaagaaaaacuggcg

SEQ ID NO: 1992334 - RNA, 19 nt, Shigella flexneri 2a str. 301
gaacuuuuugauagccacu

SEQ ID NO: 1992335 - RNA, 14 nt, Shigella flexneri 2a str. 301
gaaaucgaucauca

SEQ ID NO: 1992336 - RNA, 24 nt, Shigella flexneri 2a str. 301
gaaaucgacgcugcugcguacuga

SEQ ID NO: 1992337 - RNA, 21 nt, Shigella flexneri 2a str. 301
gaaaucguuugcauccagcuc

SEQ ID NO: 1992338 - RNA, 14 nt, Shigella flexneri 2a str. 301
gaaaucuccagaua

SEQ ID NO: 1992339 - RNA, 13 nt, Shigella flexneri 2a str. 301
gaaaucugacucu

SEQ ID NO: 1992340 - RNA, 18 nt, Shigella flexneri 2a str. 301
gaaaucugacucuuguaa

SEQ ID NO: 1992341 - RNA, 17 nt, Shigella flexneri 2a str. 301
gaaaucugauauaccgc

SEQ ID NO: 1992342 - RNA, 12 nt, Shigella flexneri 2a str. 301
gaaaucaccacc

SEQ ID NO: 1992343 - RNA, 21 nt, Shigella flexneri 2a str. 301
gaaaucagaaggguuggugaa

SEQ ID NO: 1992344 - RNA, 19 nt, Shigella flexneri 2a str. 301
gaaaucagcuuuggugaaa

SEQ ID NO: 1992345 - RNA, 19 nt, Shigella flexneri 2a str. 301
gaaauggcccaaaaggcag

SEQ ID NO: 1992346 - RNA, 15 nt, Shigella flexneri 2a str. 301
gaaaugccaguaacu

SEQ ID NO: 1992347 - RNA, 18 nt, Shigella flexneri 2a str. 301
gaaaugccaguaacucau

SEQ ID NO: 1992348 - RNA, 21 nt, Shigella flexneri 2a str. 301
gaaauggcccaaaaggcagcg

SEQ ID NO: 1992349 - RNA, 15 nt, Shigella flexneri 2a str. 301
gaaaugaaaaaauag

SEQ ID NO: 1992350 - RNA, 17 nt, Shigella flexneri 2a str. 301
gaaaugaaaaaauagaa

SEQ ID NO: 1992351 - RNA, 18 nt, Shigella flexneri 2a str. 301
gaaaugccaaauauuucu

SEQ ID NO: 1992352 - RNA, 16 nt, Shigella flexneri 2a str. 301
gaaaugauggucuggu

SEQ ID NO: 1992353 - RNA, 19 nt, Shigella flexneri 2a str. 301
gaaauuaacgucaccaucc

SEQ ID NO: 1992354 - RNA, 16 nt, Shigella flexneri 2a str. 301
gaaauuaacgucacca

SEQ ID NO: 1992355 - RNA, 13 nt, Shigella flexneri 2a str. 301
gaaauuaccgcaa

SEQ ID NO: 1992356 - RNA, 18 nt, Shigella flexneri 2a str. 301
gaaauuaccgcaccacca

SEQ ID NO: 1992357 - RNA, 15 nt, Shigella flexneri 2a str. 301
gaaauuacaggcagu

SEQ ID NO: 1992358 - RNA, 12 nt, Shigella flexneri 2a str. 301
gaaauuauuucu

SEQ ID NO: 1992359 - RNA, 20 nt, Shigella flexneri 2a str. 301
gaaauuacgauguguggcau

SEQ ID NO: 1992360 - RNA, 19 nt, Shigella flexneri 2a str. 301
gaaauguuugcaauaaaga

SEQ ID NO: 1992361 - RNA, 22 nt, Shigella flexneri 2a str. 301
gaaauuaaacugucgucgcuuu

SEQ ID NO: 1992362 - RNA, 18 nt, Shigella flexneri 2a str. 301
gaaauugaaaaaccagac

SEQ ID NO: 1992363 - RNA, 16 nt, Shigella flexneri 2a str. 301
gaacaacaagaagcgu

SEQ ID NO: 1992364 - RNA, 16 nt, Shigella flexneri 2a str. 301
gaacaaauaaauagau

SEQ ID NO: 1992365 - RNA, 19 nt, Shigella flexneri 2a str. 301
gaacaaaauguuuaugccu

SEQ ID NO: 1992366 - RNA, 12 nt, Shigella flexneri 2a str. 301
gaacaaaacagc

SEQ ID NO: 1992367 - RNA, 13 nt, Shigella flexneri 2a str. 301
gaacaaaaaagag

SEQ ID NO: 1992368 - RNA, 22 nt, Shigella flexneri 2a str. 301
gaaauuuugcaacguccugcaa

SEQ ID NO: 1992369 - RNA, 20 nt, Shigella flexneri 2a str. 301
gaaauuuugcugauauuuau

SEQ ID NO: 1992370 - RNA, 23 nt, Shigella flexneri 2a str. 301
gaaauugccacgccaauguguuu

SEQ ID NO: 1992371 - RNA, 13 nt, Shigella flexneri 2a str. 301
gaacagaccagca

SEQ ID NO: 1992372 - RNA, 14 nt, Shigella flexneri 2a str. 301
gaacagaccaguaa

SEQ ID NO: 1992373 - RNA, 14 nt, Shigella flexneri 2a str. 301
gaacagaccacauu

SEQ ID NO: 1992374 - RNA, 15 nt, Shigella flexneri 2a str. 301
gaacagaagaaagca

SEQ ID NO: 1992375 - RNA, 20 nt, Shigella flexneri 2a str. 301
gaacacgcucccagcagaga

SEQ ID NO: 1992376 - RNA, 16 nt, Shigella flexneri 2a str. 301
gaacagcgccagacaa

SEQ ID NO: 1992377 - RNA, 17 nt, Shigella flexneri 2a str. 301
gaacagcgccagacaaa

SEQ ID NO: 1992378 - RNA, 15 nt, Shigella flexneri 2a str. 301
gaacagcaguuguuu

SEQ ID NO: 1992379 - RNA, 13 nt, Shigella flexneri 2a str. 301
gaacagcagcagg

SEQ ID NO: 1992380 - RNA, 15 nt, Shigella flexneri 2a str. 301
gaacagcagcagguc

SEQ ID NO: 1992381 - RNA, 17 nt, Shigella flexneri 2a str. 301
gaacagcagcaggucac

SEQ ID NO: 1992382 - RNA, 18 nt, Shigella flexneri 2a str. 301
gaacagcacaucagccag

SEQ ID NO: 1992383 - RNA, 22 nt, Shigella flexneri 2a str. 301
gaacaccaccugccagagcuga

SEQ ID NO: 1992384 - RNA, 12 nt, Shigella flexneri 2a str. 301
gaacaccagcag

SEQ ID NO: 1992385 - RNA, 15 nt, Shigella flexneri 2a str. 301
gaacaauuaacccgc

SEQ ID NO: 1992386 - RNA, 13 nt, Shigella flexneri 2a str. 301
gaacacagugguu

SEQ ID NO: 1992387 - RNA, 19 nt, Shigella flexneri 2a str. 301
gaacaccgacauugccagc

SEQ ID NO: 1992388 - RNA, 16 nt, Shigella flexneri 2a str. 301
gaacaaucacccccac

SEQ ID NO: 1992389 - RNA, 22 nt, Shigella flexneri 2a str. 301
gaacaauuggauagugaguaca

SEQ ID NO: 1992390 - RNA, 13 nt, Shigella flexneri 2a str. 301
gaacaagcaagag

SEQ ID NO: 1992391 - RNA, 21 nt, Shigella flexneri 2a str. 301
gaacaacgcgcgucugauauu

SEQ ID NO: 1992392 - RNA, 15 nt, Shigella flexneri 2a str. 301
gaacauuuaccgcaa

SEQ ID NO: 1992393 - RNA, 18 nt, Shigella flexneri 2a str. 301
gaaccaaacagcgccaga

SEQ ID NO: 1992394 - RNA, 17 nt, Shigella flexneri 2a str. 301
gaaccaaagaaaucagu

SEQ ID NO: 1992395 - RNA, 19 nt, Shigella flexneri 2a str. 301
gaacauuauuuuugcgaca

SEQ ID NO: 1992396 - RNA, 20 nt, Shigella flexneri 2a str. 301
gaacaucccgguaauaaugc

SEQ ID NO: 1992397 - RNA, 15 nt, Shigella flexneri 2a str. 301
gaacauacacaagcc

SEQ ID NO: 1992398 - RNA, 22 nt, Shigella flexneri 2a str. 301
gaacaguucagcagcacuacac

SEQ ID NO: 1992399 - RNA, 20 nt, Shigella flexneri 2a str. 301
gaacagcgccagacaaacca

SEQ ID NO: 1992400 - RNA, 18 nt, Shigella flexneri 2a str. 301
gaacagcuuuuuccugcg

SEQ ID NO: 1992401 - RNA, 17 nt, Shigella flexneri 2a str. 301
gaaauaaacuuuugggc

SEQ ID NO: 1992402 - RNA, 13 nt, Shigella flexneri 2a str. 301
gaaauaaaaauaa

SEQ ID NO: 1992403 - RNA, 14 nt, Shigella flexneri 2a str. 301
gaaauaaaaauaag

SEQ ID NO: 1992404 - RNA, 19 nt, Shigella flexneri 2a str. 301
gaaauaaaaauaagaaaga

SEQ ID NO: 1992405 - RNA, 22 nt, Shigella flexneri 2a str. 301
gaaauaacugcuauucaccagc

SEQ ID NO: 1992406 - RNA, 20 nt, Shigella flexneri 2a str. 301
gaaaguguaaagcaggugcc

SEQ ID NO: 1992407 - RNA, 17 nt, Shigella flexneri 2a str. 301
gaaaguguaaagcaggu

SEQ ID NO: 1992408 - RNA, 16 nt, Shigella flexneri 2a str. 301
gaaagugguguucuuu

SEQ ID NO: 1992409 - RNA, 18 nt, Shigella flexneri 2a str. 301
gaaagugacagcccggca

SEQ ID NO: 1992410 - RNA, 16 nt, Shigella flexneri 2a str. 301
gaaagugacagcccgg

SEQ ID NO: 1992411 - RNA, 18 nt, Shigella flexneri 2a str. 301
gaaauagagaaaguaaac

SEQ ID NO: 1992412 - RNA, 18 nt, Shigella flexneri 2a str. 301
gaaauagaacaguuacgc

SEQ ID NO: 1992413 - RNA, 18 nt, Shigella flexneri 2a str. 301
gaaauacagguccccgcu

SEQ ID NO: 1992414 - RNA, 18 nt, Shigella flexneri 2a str. 301
gaaauaccccgccagcag

SEQ ID NO: 1992415 - RNA, 20 nt, Shigella flexneri 2a str. 301
gaaaguaaucuauauuucug

SEQ ID NO: 1992416 - RNA, 17 nt, Shigella flexneri 2a str. 301
gaaaguaauuacacccu

SEQ ID NO: 1992417 - RNA, 15 nt, Shigella flexneri 2a str. 301
gaaaguaaaccacca

SEQ ID NO: 1992418 - RNA, 13 nt, Shigella flexneri 2a str. 301
gaaaguaaauuua

SEQ ID NO: 1992419 - RNA, 15 nt, Shigella flexneri 2a str. 301
gaaaguaacaccauc

SEQ ID NO: 1992420 - RNA, 15 nt, Shigella flexneri 2a str. 301
gaaagggcaaauaau

SEQ ID NO: 1992421 - RNA, 12 nt, Shigella flexneri 2a str. 301
gaaaggcgcggu

SEQ ID NO: 1992422 - RNA, 17 nt, Shigella flexneri 2a str. 301
gaaaggaucacaauaau

SEQ ID NO: 1992423 - RNA, 20 nt, Shigella flexneri 2a str. 301
gaaagccccaccagcaaaua

SEQ ID NO: 1992424 - RNA, 15 nt, Shigella flexneri 2a str. 301
gaaagcccaucaucc

SEQ ID NO: 1992425 - RNA, 15 nt, Shigella flexneri 2a str. 301
gaaagcgaugcugau

SEQ ID NO: 1992426 - RNA, 23 nt, Shigella flexneri 2a str. 301
gaaagcguuuaugcgcauugcca

SEQ ID NO: 1992427 - RNA, 20 nt, Shigella flexneri 2a str. 301
gaaagcguauccaucacuaa

SEQ ID NO: 1992428 - RNA, 19 nt, Shigella flexneri 2a str. 301
gaaagcgccagcaagagca

SEQ ID NO: 1992429 - RNA, 21 nt, Shigella flexneri 2a str. 301
gaaagcgccaucaaugugcug

SEQ ID NO: 1992430 - RNA, 14 nt, Shigella flexneri 2a str. 301
gaaagcgccagcaa

SEQ ID NO: 1992431 - RNA, 17 nt, Shigella flexneri 2a str. 301
gaaagcgccucaagcuc

SEQ ID NO: 1992432 - RNA, 21 nt, Shigella flexneri 2a str. 301
gaaagauggcgcgcagaaaga

SEQ ID NO: 1992433 - RNA, 22 nt, Shigella flexneri 2a str. 301
gaaagcagauaacccagcagcc

SEQ ID NO: 1992434 - RNA, 18 nt, Shigella flexneri 2a str. 301
gaaacucgcugccagcac

SEQ ID NO: 1992435 - RNA, 19 nt, Shigella flexneri 2a str. 301
gaaacucucaaaacaacac

SEQ ID NO: 1992436 - RNA, 14 nt, Shigella flexneri 2a str. 301
gaaacugauaauuu

SEQ ID NO: 1992437 - RNA, 18 nt, Shigella flexneri 2a str. 301
gaaacugacuguuucacc

SEQ ID NO: 1992438 - RNA, 18 nt, Shigella flexneri 2a str. 301
gaaacucgcguaaaucca

SEQ ID NO: 1992439 - RNA, 21 nt, Shigella flexneri 2a str. 301
gaaacucgcguaaauccagcg

SEQ ID NO: 1992440 - RNA, 16 nt, Shigella flexneri 2a str. 301
gaaacucgcugccagc

SEQ ID NO: 1992441 - RNA, 23 nt, Shigella flexneri 2a str. 301
gaaacucacgcagggugugcucc

SEQ ID NO: 1992442 - RNA, 22 nt, Shigella flexneri 2a str. 301
gaaacgguaauuauugaugaag

SEQ ID NO: 1992443 - RNA, 21 nt, Shigella flexneri 2a str. 301
gaaagagcgucuggaagaagu

SEQ ID NO: 1992444 - RNA, 22 nt, Shigella flexneri 2a str. 301
gaaagaagcuuuccacgcaggc

SEQ ID NO: 1992445 - RNA, 21 nt, Shigella flexneri 2a str. 301
gaaagaagcccacgagcaaaa

SEQ ID NO: 1992446 - RNA, 22 nt, Shigella flexneri 2a str. 301
gaaagaagcccacgagcaaaac

SEQ ID NO: 1992447 - RNA, 12 nt, Shigella flexneri 2a str. 301
gaaacuuauuca

SEQ ID NO: 1992448 - RNA, 23 nt, Shigella flexneri 2a str. 301
gaaaccgacuuacuuauuucugu

SEQ ID NO: 1992449 - RNA, 19 nt, Shigella flexneri 2a str. 301
gaaacccggccacagcgcc

SEQ ID NO: 1992450 - RNA, 20 nt, Shigella flexneri 2a str. 301
gaaaccgucuucccgcagcc

SEQ ID NO: 1992451 - RNA, 16 nt, Shigella flexneri 2a str. 301
gaaaccgugaaaaugg

SEQ ID NO: 1992452 - RNA, 19 nt, Shigella flexneri 2a str. 301
gaaaccgcgcagcgggcau

SEQ ID NO: 1992453 - RNA, 16 nt, Shigella flexneri 2a str. 301
gaaacgauuaauuaca

SEQ ID NO: 1992454 - RNA, 22 nt, Shigella flexneri 2a str. 301
gaaacgccaccauuuuacgucc

SEQ ID NO: 1992455 - RNA, 19 nt, Shigella flexneri 2a str. 301
gaaacgccaucucuuuaug

SEQ ID NO: 1992456 - RNA, 14 nt, Shigella flexneri 2a str. 301
gaaaccuggauauu

SEQ ID NO: 1992457 - RNA, 14 nt, Shigella flexneri 2a str. 301
gaaaccuugcauag

SEQ ID NO: 1992458 - RNA, 19 nt, Shigella flexneri 2a str. 301
gaaaccuuuaacgaagccg

SEQ ID NO: 1992459 - RNA, 20 nt, Shigella flexneri 2a str. 301
gaaaccaacuccagcggcgc

SEQ ID NO: 1992460 - RNA, 19 nt, Shigella flexneri 2a str. 301
gaaaccacggugauucccg

SEQ ID NO: 1992461 - RNA, 13 nt, Shigella flexneri 2a str. 301
gaaacccaacgca

SEQ ID NO: 1992462 - RNA, 16 nt, Shigella flexneri 2a str. 301
gaaaccacugcaacag

SEQ ID NO: 1992463 - RNA, 19 nt, Shigella flexneri 2a str. 301
gaaacagcaccauccgccc

SEQ ID NO: 1992464 - RNA, 16 nt, Shigella flexneri 2a str. 301
gaaacagaaaauuacg

SEQ ID NO: 1992465 - RNA, 19 nt, Shigella flexneri 2a str. 301
gaaacagugauuucuucau

SEQ ID NO: 1992466 - RNA, 18 nt, Shigella flexneri 2a str. 301
gaaacauacaggcuaacc

SEQ ID NO: 1992467 - RNA, 23 nt, Shigella flexneri 2a str. 301
gaaacagguggcguuugccaccu

SEQ ID NO: 1992468 - RNA, 16 nt, Shigella flexneri 2a str. 301
cuuuuuuacaucauca

SEQ ID NO: 1992469 - RNA, 17 nt, Shigella flexneri 2a str. 301
cuuuuuuaagauccagu

SEQ ID NO: 1992470 - RNA, 18 nt, Shigella flexneri 2a str. 301
cuuuuuuaagauccaguu

SEQ ID NO: 1992471 - RNA, 14 nt, Shigella flexneri 2a str. 301
cuuuuuuaaacauu

SEQ ID NO: 1992472 - RNA, 17 nt, Shigella flexneri 2a str. 301
cuuuuuguaauuuuuuu

SEQ ID NO: 1992473 - RNA, 20 nt, Shigella flexneri 2a str. 301
cuuuuuugagcagcauuacc

SEQ ID NO: 1992474 - RNA, 20 nt, Shigella flexneri 2a str. 301
cuuuuuuagguacaaagcca

SEQ ID NO: 1992475 - RNA, 14 nt, Shigella flexneri 2a str. 301
cuuuuuuauggaau

SEQ ID NO: 1992476 - RNA, 16 nt, Shigella flexneri 2a str. 301
gaaaaaccagacagca

SEQ ID NO: 1992477 - RNA, 12 nt, Shigella flexneri 2a str. 301
gaaaaacacaaa

SEQ ID NO: 1992478 - RNA, 18 nt, Shigella flexneri 2a str. 301
gaaaaaagcgcucccgca

SEQ ID NO: 1992479 - RNA, 13 nt, Shigella flexneri 2a str. 301
gaaaaaagaaaga

SEQ ID NO: 1992480 - RNA, 12 nt, Shigella flexneri 2a str. 301
gaaaacagcgca

SEQ ID NO: 1992481 - RNA, 17 nt, Shigella flexneri 2a str. 301
gaaaacagcgcaccaga

SEQ ID NO: 1992482 - RNA, 18 nt, Shigella flexneri 2a str. 301
gaaaacagcgcaccagaa

SEQ ID NO: 1992483 - RNA, 20 nt, Shigella flexneri 2a str. 301
gaaaacaauuacgccgagcg

SEQ ID NO: 1992484 - RNA, 23 nt, Shigella flexneri 2a str. 301
gaaaacgccggagugaaaauucu

SEQ ID NO: 1992485 - RNA, 22 nt, Shigella flexneri 2a str. 301
gaaaaccgguacagaaucugaa

SEQ ID NO: 1992486 - RNA, 14 nt, Shigella flexneri 2a str. 301
gaaaacgaauugca

SEQ ID NO: 1992487 - RNA, 15 nt, Shigella flexneri 2a str. 301
gaaaacgaaagcgcc

SEQ ID NO: 1992488 - RNA, 22 nt, Shigella flexneri 2a str. 301
gaaaaccggacugaaaguacuu

SEQ ID NO: 1992489 - RNA, 20 nt, Shigella flexneri 2a str. 301
gaaaacccucgaccaucucc

SEQ ID NO: 1992490 - RNA, 12 nt, Shigella flexneri 2a str. 301
gaaaaacugccc

SEQ ID NO: 1992491 - RNA, 18 nt, Shigella flexneri 2a str. 301
gaaaaacgggucgccaga

SEQ ID NO: 1992492 - RNA, 15 nt, Shigella flexneri 2a str. 301
gaaaaagagcaucag

SEQ ID NO: 1992493 - RNA, 17 nt, Shigella flexneri 2a str. 301
gaaaaagagcaucagca

SEQ ID NO: 1992494 - RNA, 19 nt, Shigella flexneri 2a str. 301
gaaaaagagcaucagcagu

SEQ ID NO: 1992495 - RNA, 21 nt, Shigella flexneri 2a str. 301
gaaaaagagcaucagcagugc

SEQ ID NO: 1992496 - RNA, 22 nt, Shigella flexneri 2a str. 301
gaaaaaucaauauuuucaaucu

SEQ ID NO: 1992497 - RNA, 18 nt, Shigella flexneri 2a str. 301
gaaaaauaacgacgaagc

SEQ ID NO: 1992498 - RNA, 14 nt, Shigella flexneri 2a str. 301
gaaacaaacgcaaa

SEQ ID NO: 1992499 - RNA, 16 nt, Shigella flexneri 2a str. 301
gaaacaaauacaugau

SEQ ID NO: 1992500 - RNA, 20 nt, Shigella flexneri 2a str. 301
gaaacaacguggaacaaaua

SEQ ID NO: 1992501 - RNA, 12 nt, Shigella flexneri 2a str. 301
gaaacaccagaa

SEQ ID NO: 1992502 - RNA, 16 nt, Shigella flexneri 2a str. 301
gaaacacacuuuccag

SEQ ID NO: 1992503 - RNA, 13 nt, Shigella flexneri 2a str. 301
gaaaauuauaucu

SEQ ID NO: 1992504 - RNA, 22 nt, Shigella flexneri 2a str. 301
gaaaauuaacgggcaggucacu

SEQ ID NO: 1992505 - RNA, 20 nt, Shigella flexneri 2a str. 301
gaaaauugguagaccagagc

SEQ ID NO: 1992506 - RNA, 17 nt, Shigella flexneri 2a str. 301
gaaaaucucauaucccc

SEQ ID NO: 1992507 - RNA, 20 nt, Shigella flexneri 2a str. 301
gaaaaucugaauuguuuuuc

SEQ ID NO: 1992508 - RNA, 14 nt, Shigella flexneri 2a str. 301
gaaaaucugcggga

SEQ ID NO: 1992509 - RNA, 14 nt, Shigella flexneri 2a str. 301
gaaaaucuucucuc

SEQ ID NO: 1992510 - RNA, 23 nt, Shigella flexneri 2a str. 301
gaaaaugcccauggcaagaauaa

SEQ ID NO: 1992511 - RNA, 17 nt, Shigella flexneri 2a str. 301
gaaaaugccucagagcu

SEQ ID NO: 1992512 - RNA, 19 nt, Shigella flexneri 2a str. 301
gaaaauggcggaggauuuc

SEQ ID NO: 1992513 - RNA, 23 nt, Shigella flexneri 2a str. 301
gaaaauggcggaggauuucauuu

SEQ ID NO: 1992514 - RNA, 21 nt, Shigella flexneri 2a str. 301
gaaaaucucaauguauucccg

SEQ ID NO: 1992515 - RNA, 16 nt, Shigella flexneri 2a str. 301
gaaaaucgacaauaug

SEQ ID NO: 1992516 - RNA, 13 nt, Shigella flexneri 2a str. 301
gaaaaucaccauu

SEQ ID NO: 1992517 - RNA, 12 nt, Shigella flexneri 2a str. 301
gaaaauaucggu

SEQ ID NO: 1992518 - RNA, 16 nt, Shigella flexneri 2a str. 301
gaaaagguagaauaag

SEQ ID NO: 1992519 - RNA, 17 nt, Shigella flexneri 2a str. 301
gaaaagguagaauaagg

SEQ ID NO: 1992520 - RNA, 18 nt, Shigella flexneri 2a str. 301
gaaaauaauccgcuguaa

SEQ ID NO: 1992521 - RNA, 13 nt, Shigella flexneri 2a str. 301
gaaaauacagcaa

SEQ ID NO: 1992522 - RNA, 19 nt, Shigella flexneri 2a str. 301
gaaaauaaauguguuuuua

SEQ ID NO: 1992523 - RNA, 19 nt, Shigella flexneri 2a str. 301
gaaaacguuucaaccugca

SEQ ID NO: 1992524 - RNA, 11 nt, Shigella flexneri 2a str. 301
gaaaacgcugu

SEQ ID NO: 1992525 - RNA, 18 nt, Shigella flexneri 2a str. 301
gaaaagccggaauguacu

SEQ ID NO: 1992526 - RNA, 20 nt, Shigella flexneri 2a str. 301
gaaaagcaaaagauggaaaa

SEQ ID NO: 1992527 - RNA, 16 nt, Shigella flexneri 2a str. 301
gaaaagcuucuuccuc

SEQ ID NO: 1992528 - RNA, 19 nt, Shigella flexneri 2a str. 301
gaaaagcgagaguuacagc

SEQ ID NO: 1992529 - RNA, 17 nt, Shigella flexneri 2a str. 301
cuuuuucgaucacuuuu

SEQ ID NO: 1992530 - RNA, 21 nt, Shigella flexneri 2a str. 301
cuuuuucaugcuauuccuuga

SEQ ID NO: 1992531 - RNA, 18 nt, Shigella flexneri 2a str. 301
cuuuuucucccuuaaaaa

SEQ ID NO: 1992532 - RNA, 20 nt, Shigella flexneri 2a str. 301
cuuuuucucccuuaaaaaau

SEQ ID NO: 1992533 - RNA, 13 nt, Shigella flexneri 2a str. 301
cuuuuugcauaau

SEQ ID NO: 1992534 - RNA, 17 nt, Shigella flexneri 2a str. 301
cuuuuuaccuucauuug

SEQ ID NO: 1992535 - RNA, 17 nt, Shigella flexneri 2a str. 301
cuuuuuacccaugguca

SEQ ID NO: 1992536 - RNA, 22 nt, Shigella flexneri 2a str. 301
cuuuuuaaacgaauaguuucag

SEQ ID NO: 1992537 - RNA, 23 nt, Shigella flexneri 2a str. 301
cuuuuuauugaagauguugccac

SEQ ID NO: 1992538 - RNA, 19 nt, Shigella flexneri 2a str. 301
cuuuuucaagcucaaaaua

SEQ ID NO: 1992539 - RNA, 21 nt, Shigella flexneri 2a str. 301
cuuuuuaguaucuauucauca

SEQ ID NO: 1992540 - RNA, 21 nt, Shigella flexneri 2a str. 301
cuuuucuggucaguuggcugg

SEQ ID NO: 1992541 - RNA, 22 nt, Shigella flexneri 2a str. 301
cuuuucucauuacagcgacuuc

SEQ ID NO: 1992542 - RNA, 23 nt, Shigella flexneri 2a str. 301
cuuuucgccaccggcaaucugcu

SEQ ID NO: 1992543 - RNA, 21 nt, Shigella flexneri 2a str. 301
cuuuucguuuugguccugguc

SEQ ID NO: 1992544 - RNA, 21 nt, Shigella flexneri 2a str. 301
cuuuucuaccaccaaaaccac

SEQ ID NO: 1992545 - RNA, 22 nt, Shigella flexneri 2a str. 301
cuuuuggcaaagguucaagcag

SEQ ID NO: 1992546 - RNA, 16 nt, Shigella flexneri 2a str. 301
cuuuuggggugcaguu

SEQ ID NO: 1992547 - RNA, 22 nt, Shigella flexneri 2a str. 301
cuuuugggcguaagaugacauu

SEQ ID NO: 1992548 - RNA, 18 nt, Shigella flexneri 2a str. 301
cuuuuggugcuuuugcug

SEQ ID NO: 1992549 - RNA, 19 nt, Shigella flexneri 2a str. 301
cuuuugaacuuuaagcuga

SEQ ID NO: 1992550 - RNA, 21 nt, Shigella flexneri 2a str. 301
cuuuugcgccacuaacgcauu

SEQ ID NO: 1992551 - RNA, 17 nt, Shigella flexneri 2a str. 301
cuuuugccagaauagcg

SEQ ID NO: 1992552 - RNA, 23 nt, Shigella flexneri 2a str. 301
cuuucuuuuuguugcgcugaaac

SEQ ID NO: 1992553 - RNA, 16 nt, Shigella flexneri 2a str. 301
cuuucugagcaucaca

SEQ ID NO: 1992554 - RNA, 19 nt, Shigella flexneri 2a str. 301
cuuuguuaaacagugccca

SEQ ID NO: 1992555 - RNA, 21 nt, Shigella flexneri 2a str. 301
cuuuguuacccccauccacgc

SEQ ID NO: 1992556 - RNA, 13 nt, Shigella flexneri 2a str. 301
cuuugucuucaau

SEQ ID NO: 1992557 - RNA, 19 nt, Shigella flexneri 2a str. 301
cuuuguuacccccauccac

SEQ ID NO: 1992558 - RNA, 15 nt, Shigella flexneri 2a str. 301
cuuuuccagcauaau

SEQ ID NO: 1992559 - RNA, 17 nt, Shigella flexneri 2a str. 301
cuuuuccagcauaaugu

SEQ ID NO: 1992560 - RNA, 13 nt, Shigella flexneri 2a str. 301
cuuuucauuaucg

SEQ ID NO: 1992561 - RNA, 16 nt, Shigella flexneri 2a str. 301
cuuuuccgccucauca

SEQ ID NO: 1992562 - RNA, 14 nt, Shigella flexneri 2a str. 301
cuuuucccuccacu

SEQ ID NO: 1992563 - RNA, 22 nt, Shigella flexneri 2a str. 301
cuuuucaguuggcugacaaagu

SEQ ID NO: 1992564 - RNA, 22 nt, Shigella flexneri 2a str. 301
cuuuucaccaugggcaauccac

SEQ ID NO: 1992565 - RNA, 17 nt, Shigella flexneri 2a str. 301
cuuuuacagcgccagaa

SEQ ID NO: 1992566 - RNA, 23 nt, Shigella flexneri 2a str. 301
cuuuuaccagcgccugcgcggca

SEQ ID NO: 1992567 - RNA, 20 nt, Shigella flexneri 2a str. 301
cuuuuauuauuacuuauccc

SEQ ID NO: 1992568 - RNA, 14 nt, Shigella flexneri 2a str. 301
cuuuuacucucugg

SEQ ID NO: 1992569 - RNA, 20 nt, Shigella flexneri 2a str. 301
aaaaaacuggaaaaauaauu

SEQ ID NO: 1992570 - RNA, 16 nt, Shigella flexneri 2a str. 301
aaaaaacgaucauuau

SEQ ID NO: 1992571 - RNA, 11 nt, Shigella flexneri 2a str. 301
aaaaaagaaga

SEQ ID NO: 1992572 - RNA, 13 nt, Shigella flexneri 2a str. 301
aaaaaagaauuca

SEQ ID NO: 1992573 - RNA, 13 nt, Shigella flexneri 2a str. 301
aaaaaaagcauuu

SEQ ID NO: 1992574 - RNA, 17 nt, Shigella flexneri 2a str. 301
aaaaaaccagaaaggga

SEQ ID NO: 1992575 - RNA, 11 nt, Shigella flexneri 2a str. 301
aaaaaagagcg

SEQ ID NO: 1992576 - RNA, 15 nt, Shigella flexneri 2a str. 301
aaaaaauuaacaaaa

SEQ ID NO: 1992577 - RNA, 17 nt, Shigella flexneri 2a str. 301
aaaaaauuaacaaaaca

SEQ ID NO: 1992578 - RNA, 10 nt, Shigella flexneri 2a str. 301
aaaaaauuua

SEQ ID NO: 1992579 - RNA, 21 nt, Shigella flexneri 2a str. 301
aaaaaugugaagaggaacaaa

SEQ ID NO: 1992580 - RNA, 21 nt, Shigella flexneri 2a str. 301
aaaaaugcccgauaagcaaaa

SEQ ID NO: 1992581 - RNA, 18 nt, Shigella flexneri 2a str. 301
aaaaaucuaaccuacuuu

SEQ ID NO: 1992582 - RNA, 15 nt, Shigella flexneri 2a str. 301
aaaaaucaaaaaacu

SEQ ID NO: 1992583 - RNA, 14 nt, Shigella flexneri 2a str. 301
aaaaaucaauauau

SEQ ID NO: 1992584 - RNA, 17 nt, Shigella flexneri 2a str. 301
aaaaagugcuuucugaa

SEQ ID NO: 1992585 - RNA, 20 nt, Shigella flexneri 2a str. 301
aaaacauacccaguuucaug

SEQ ID NO: 1992586 - RNA, 22 nt, Shigella flexneri 2a str. 301
aaaaccacacuucuucagccag

SEQ ID NO: 1992587 - RNA, 21 nt, Shigella flexneri 2a str. 301
aaaaccagaaagggaagaaca

SEQ ID NO: 1992588 - RNA, 20 nt, Shigella flexneri 2a str. 301
aaaacaggucgccagucccu

SEQ ID NO: 1992589 - RNA, 16 nt, Shigella flexneri 2a str. 301
aaaacaggcagcugcc

SEQ ID NO: 1992590 - RNA, 19 nt, Shigella flexneri 2a str. 301
aaaacagggcuuacugaaa

SEQ ID NO: 1992591 - RNA, 22 nt, Shigella flexneri 2a str. 301
aaaacaacggaacgaaaaaaau

SEQ ID NO: 1992592 - RNA, 20 nt, Shigella flexneri 2a str. 301
aaaacaacggaacgaaaaaa

SEQ ID NO: 1992593 - RNA, 14 nt, Shigella flexneri 2a str. 301
aaaacaacacaaac

SEQ ID NO: 1992594 - RNA, 22 nt, Shigella flexneri 2a str. 301
aaaacagcgcaccagaaacaau

SEQ ID NO: 1992595 - RNA, 22 nt, Shigella flexneri 2a str. 301
aaaacagcgcagcucuggcaua

SEQ ID NO: 1992596 - RNA, 20 nt, Shigella flexneri 2a str. 301
aaaacagcgcccaacacuuc

SEQ ID NO: 1992597 - RNA, 23 nt, Shigella flexneri 2a str. 301
aaaacagcgaguucaggcgcugc

SEQ ID NO: 1992598 - RNA, 14 nt, Shigella flexneri 2a str. 301
aaaacagccagcgc

SEQ ID NO: 1992599 - RNA, 23 nt, Shigella flexneri 2a str. 301
aaaaccgccauucauacccugaa

SEQ ID NO: 1992600 - RNA, 19 nt, Shigella flexneri 2a str. 301
aaaaccucuuccagcagau

SEQ ID NO: 1992601 - RNA, 13 nt, Shigella flexneri 2a str. 301
aaaaccucuucca

SEQ ID NO: 1992602 - RNA, 20 nt, Shigella flexneri 2a str. 301
aaaaccucucuggaagaggc

SEQ ID NO: 1992603 - RNA, 17 nt, Shigella flexneri 2a str. 301
aaaaccucucuggaaga

SEQ ID NO: 1992604 - RNA, 19 nt, Shigella flexneri 2a str. 301
aaaaccuccgccucuuuca

SEQ ID NO: 1992605 - RNA, 21 nt, Shigella flexneri 2a str. 301
aaaaccugaccuagcaaacua

SEQ ID NO: 1992606 - RNA, 15 nt, Shigella flexneri 2a str. 301
aaaaccugacaacaa

SEQ ID NO: 1992607 - RNA, 14 nt, Shigella flexneri 2a str. 301
aaaaccaguaauga

SEQ ID NO: 1992608 - RNA, 15 nt, Shigella flexneri 2a str. 301
aaaaccccaaaaaga

SEQ ID NO: 1992609 - RNA, 18 nt, Shigella flexneri 2a str. 301
aaaaccgagaagcagcaa

SEQ ID NO: 1992610 - RNA, 13 nt, Shigella flexneri 2a str. 301
aaaaacuaauuca

SEQ ID NO: 1992611 - RNA, 22 nt, Shigella flexneri 2a str. 301
aaaaacuccgccgcaucuuccc

SEQ ID NO: 1992612 - RNA, 22 nt, Shigella flexneri 2a str. 301
aaaaacugccgcacuuugagca

SEQ ID NO: 1992613 - RNA, 22 nt, Shigella flexneri 2a str. 301
aaaaacgccagcaacacauagu

SEQ ID NO: 1992614 - RNA, 23 nt, Shigella flexneri 2a str. 301
aaaaaccuguauacgcauaucaa

SEQ ID NO: 1992615 - RNA, 22 nt, Shigella flexneri 2a str. 301
aaaaaccuccggcguuucagau

SEQ ID NO: 1992616 - RNA, 17 nt, Shigella flexneri 2a str. 301
aaaaacccuuccagcac

SEQ ID NO: 1992617 - RNA, 13 nt, Shigella flexneri 2a str. 301
aaaaacccuucuu

SEQ ID NO: 1992618 - RNA, 13 nt, Shigella flexneri 2a str. 301
aaaaaccugaccu

SEQ ID NO: 1992619 - RNA, 17 nt, Shigella flexneri 2a str. 301
aaaaacggaaagcagau

SEQ ID NO: 1992620 - RNA, 23 nt, Shigella flexneri 2a str. 301
aaaaacaccccauugccccaugu

SEQ ID NO: 1992621 - RNA, 12 nt, Shigella flexneri 2a str. 301
aaaaacccgccc

SEQ ID NO: 1992622 - RNA, 17 nt, Shigella flexneri 2a str. 301
aaaaaguaguuccagca

SEQ ID NO: 1992623 - RNA, 22 nt, Shigella flexneri 2a str. 301
aaaaaguagggcugauaaacaa

SEQ ID NO: 1992624 - RNA, 23 nt, Shigella flexneri 2a str. 301
aaaaagguccuguaaugagaaua

SEQ ID NO: 1992625 - RNA, 20 nt, Shigella flexneri 2a str. 301
aaaaaggcugacaaaucaga

SEQ ID NO: 1992626 - RNA, 14 nt, Shigella flexneri 2a str. 301
aaaaacuuuuguau

SEQ ID NO: 1992627 - RNA, 13 nt, Shigella flexneri 2a str. 301
aaaaagaaggaaa

SEQ ID NO: 1992628 - RNA, 15 nt, Shigella flexneri 2a str. 301
aaaaagaaggaaaau

SEQ ID NO: 1992629 - RNA, 12 nt, Shigella flexneri 2a str. 301
aaaaagaaaguu

SEQ ID NO: 1992630 - RNA, 13 nt, Shigella flexneri 2a str. 301
aaaaagaaagaag

SEQ ID NO: 1992631 - RNA, 19 nt, Shigella flexneri 2a str. 301
aaaaagccaaucacaaaaa

SEQ ID NO: 1992632 - RNA, 17 nt, Shigella flexneri 2a str. 301
aaaaagccaaucacaaa

SEQ ID NO: 1992633 - RNA, 16 nt, Shigella flexneri 2a str. 301
aaaaagccaaucacaa

SEQ ID NO: 1992634 - RNA, 15 nt, Shigella flexneri 2a str. 301
aaaaagcauuuaaua

SEQ ID NO: 1992635 - RNA, 21 nt, Shigella flexneri 2a str. 301
aaaaagagcagcugauugaaa

SEQ ID NO: 1992636 - RNA, 15 nt, Shigella flexneri 2a str. 301
aaaaucaugcaauaa

SEQ ID NO: 1992637 - RNA, 14 nt, Shigella flexneri 2a str. 301
aaaaucuuaaagau

SEQ ID NO: 1992638 - RNA, 20 nt, Shigella flexneri 2a str. 301
aaaaucucgacuucuucauu

SEQ ID NO: 1992639 - RNA, 14 nt, Shigella flexneri 2a str. 301
aaaaucuucguuau

SEQ ID NO: 1992640 - RNA, 12 nt, Shigella flexneri 2a str. 301
aaaauaccaaua

SEQ ID NO: 1992641 - RNA, 13 nt, Shigella flexneri 2a str. 301
aaaauaucacucg

SEQ ID NO: 1992642 - RNA, 17 nt, Shigella flexneri 2a str. 301
aaaauacaauucucagc

SEQ ID NO: 1992643 - RNA, 12 nt, Shigella flexneri 2a str. 301
aaaauacacuuu

SEQ ID NO: 1992644 - RNA, 22 nt, Shigella flexneri 2a str. 301
aaaauaucguaggccugcucaa

SEQ ID NO: 1992645 - RNA, 20 nt, Shigella flexneri 2a str. 301
aaaauaucguaggccugcuc

SEQ ID NO: 1992646 - RNA, 15 nt, Shigella flexneri 2a str. 301
aaaauucuccagcgc

SEQ ID NO: 1992647 - RNA, 22 nt, Shigella flexneri 2a str. 301
aaaauucuuacguaauuuauaa

SEQ ID NO: 1992648 - RNA, 20 nt, Shigella flexneri 2a str. 301
aaaaugugcccggacagucc

SEQ ID NO: 1992649 - RNA, 12 nt, Shigella flexneri 2a str. 301
aaaauguugcgc

SEQ ID NO: 1992650 - RNA, 12 nt, Shigella flexneri 2a str. 301
aaaauuaacaaa

SEQ ID NO: 1992651 - RNA, 15 nt, Shigella flexneri 2a str. 301
aaaauuaacaaaaca

SEQ ID NO: 1992652 - RNA, 13 nt, Shigella flexneri 2a str. 301
aaaauggucagcc

SEQ ID NO: 1992653 - RNA, 19 nt, Shigella flexneri 2a str. 301
aaaauggucagccagcggc

SEQ ID NO: 1992654 - RNA, 17 nt, Shigella flexneri 2a str. 301
aaaaugguggagauaaa

SEQ ID NO: 1992655 - RNA, 16 nt, Shigella flexneri 2a str. 301
aaaauggccagccagc

SEQ ID NO: 1992656 - RNA, 20 nt, Shigella flexneri 2a str. 301
aaaaugagugccaaaaaaau

SEQ ID NO: 1992657 - RNA, 18 nt, Shigella flexneri 2a str. 301
aaaaugagcaccgaacag

SEQ ID NO: 1992658 - RNA, 18 nt, Shigella flexneri 2a str. 301
aaaagguaggccugauaa

SEQ ID NO: 1992659 - RNA, 15 nt, Shigella flexneri 2a str. 301
aaaaguccaggcugc

SEQ ID NO: 1992660 - RNA, 16 nt, Shigella flexneri 2a str. 301
aaaagucccuucccag

SEQ ID NO: 1992661 - RNA, 12 nt, Shigella flexneri 2a str. 301
aaaaggcagcgg

SEQ ID NO: 1992662 - RNA, 17 nt, Shigella flexneri 2a str. 301
aaaauaaaucaaaguca

SEQ ID NO: 1992663 - RNA, 21 nt, Shigella flexneri 2a str. 301
aaaauaaauguguuuuuauuu

SEQ ID NO: 1992664 - RNA, 13 nt, Shigella flexneri 2a str. 301
aaaaguuuuagca

SEQ ID NO: 1992665 - RNA, 20 nt, Shigella flexneri 2a str. 301
aaaaguuuuaucggagaaca

SEQ ID NO: 1992666 - RNA, 24 nt, Shigella flexneri 2a str. 301
aaaaguuuuaucggagaacaggaa

SEQ ID NO: 1992667 - RNA, 18 nt, Shigella flexneri 2a str. 301
aaaacgcgacugcaaaaa

SEQ ID NO: 1992668 - RNA, 18 nt, Shigella flexneri 2a str. 301
aaaacgcuuacgcuucau

SEQ ID NO: 1992669 - RNA, 22 nt, Shigella flexneri 2a str. 301
aaaagcgggcgacgcugcgccg

SEQ ID NO: 1992670 - RNA, 22 nt, Shigella flexneri 2a str. 301
aaaagcgcgauggcaguacgcu

SEQ ID NO: 1992671 - RNA, 22 nt, Shigella flexneri 2a str. 301
aaaagcggcuaaccacgccgcu

SEQ ID NO: 1992672 - RNA, 19 nt, Shigella flexneri 2a str. 301
aaaacgcagucuucccagc

SEQ ID NO: 1992673 - RNA, 20 nt, Shigella flexneri 2a str. 301
aaaacgccggagugaaaauu

SEQ ID NO: 1992674 - RNA, 18 nt, Shigella flexneri 2a str. 301
aaaagcucccuaaaauau

SEQ ID NO: 1992675 - RNA, 12 nt, Shigella flexneri 2a str. 301
aaaaagaaagaa

SEQ ID NO: 1992676 - RNA, 12 nt, Shigella flexneri 2a str. 301
aaaaagaaaaaa

SEQ ID NO: 1992677 - RNA, 11 nt, Shigella flexneri 2a str. 301
aaaaagaagac

SEQ ID NO: 1992678 - RNA, 14 nt, Shigella flexneri 2a str. 301
aaacacuugcggca

SEQ ID NO: 1992679 - RNA, 12 nt, Shigella flexneri 2a str. 301
aaacagccaacu

SEQ ID NO: 1992680 - RNA, 14 nt, Shigella flexneri 2a str. 301
aaacagccauaacc

SEQ ID NO: 1992681 - RNA, 18 nt, Shigella flexneri 2a str. 301
aaacagcgacaccagcca

SEQ ID NO: 1992682 - RNA, 22 nt, Shigella flexneri 2a str. 301
aaacagcgaguuaacaccagaa

SEQ ID NO: 1992683 - RNA, 19 nt, Shigella flexneri 2a str. 301
aaacagcgcaccagaaaca

SEQ ID NO: 1992684 - RNA, 23 nt, Shigella flexneri 2a str. 301
aaacagcguauuaauuccgguga

SEQ ID NO: 1992685 - RNA, 22 nt, Shigella flexneri 2a str. 301
aaacagcgcaccagaaacaaua

SEQ ID NO: 1992686 - RNA, 13 nt, Shigella flexneri 2a str. 301
aaacagcgccaga

SEQ ID NO: 1992687 - RNA, 22 nt, Shigella flexneri 2a str. 301
aaacagcccaaucaucgcggca

SEQ ID NO: 1992688 - RNA, 12 nt, Shigella flexneri 2a str. 301
aaacaggaucug

SEQ ID NO: 1992689 - RNA, 13 nt, Shigella flexneri 2a str. 301
aaacagcugcugg

SEQ ID NO: 1992690 - RNA, 15 nt, Shigella flexneri 2a str. 301
aaacaguucugcagc

SEQ ID NO: 1992691 - RNA, 12 nt, Shigella flexneri 2a str. 301
aaacaucaaacc

SEQ ID NO: 1992692 - RNA, 12 nt, Shigella flexneri 2a str. 301
aaacaucaaaaa

SEQ ID NO: 1992693 - RNA, 19 nt, Shigella flexneri 2a str. 301
aaacaucaccaaugaaagc

SEQ ID NO: 1992694 - RNA, 21 nt, Shigella flexneri 2a str. 301
aaacaucaccaaugaaagccc

SEQ ID NO: 1992695 - RNA, 21 nt, Shigella flexneri 2a str. 301
aaacaguacgagagaagagac

SEQ ID NO: 1992696 - RNA, 20 nt, Shigella flexneri 2a str. 301
aaacagggcuggaagaguuu

SEQ ID NO: 1992697 - RNA, 21 nt, Shigella flexneri 2a str. 301
aaacaggcgacgcguccgguu

SEQ ID NO: 1992698 - RNA, 18 nt, Shigella flexneri 2a str. 301
aaacaggggcuggaagau

SEQ ID NO: 1992699 - RNA, 16 nt, Shigella flexneri 2a str. 301
aaacagguaaagacca

SEQ ID NO: 1992700 - RNA, 18 nt, Shigella flexneri 2a str. 301
aaacagugauuacuaaau

SEQ ID NO: 1992701 - RNA, 16 nt, Shigella flexneri 2a str. 301
aaacagucuggagcaa

SEQ ID NO: 1992702 - RNA, 21 nt, Shigella flexneri 2a str. 301
aaacaguggugcuuugcugug

SEQ ID NO: 1992703 - RNA, 17 nt, Shigella flexneri 2a str. 301
aaacacgcgaccaaagg

SEQ ID NO: 1992704 - RNA, 12 nt, Shigella flexneri 2a str. 301
aaacaccagcaa

SEQ ID NO: 1992705 - RNA, 21 nt, Shigella flexneri 2a str. 301
aaacacaucaaugaugaacgc

SEQ ID NO: 1992706 - RNA, 18 nt, Shigella flexneri 2a str. 301
aaacacaaaguaaacaau

SEQ ID NO: 1992707 - RNA, 17 nt, Shigella flexneri 2a str. 301
aaacaauuuucauugaa

SEQ ID NO: 1992708 - RNA, 15 nt, Shigella flexneri 2a str. 301
aaaauuggcuucguu

SEQ ID NO: 1992709 - RNA, 13 nt, Shigella flexneri 2a str. 301
aaacaauacgauc

SEQ ID NO: 1992710 - RNA, 22 nt, Shigella flexneri 2a str. 301
aaacaaguucuucgaagcacuc

SEQ ID NO: 1992711 - RNA, 21 nt, Shigella flexneri 2a str. 301
aaacauuucacguucacguaa

SEQ ID NO: 1992712 - RNA, 15 nt, Shigella flexneri 2a str. 301
aaacauugcugccag

SEQ ID NO: 1992713 - RNA, 22 nt, Shigella flexneri 2a str. 301
aaacaucggcuuauucauauca

SEQ ID NO: 1992714 - RNA, 23 nt, Shigella flexneri 2a str. 301
aaacaucggcuuauucauaucaa

SEQ ID NO: 1992715 - RNA, 23 nt, Shigella flexneri 2a str. 301
aaacaucgcugauuucaccaucu

SEQ ID NO: 1992716 - RNA, 16 nt, Shigella flexneri 2a str. 301
aaacaucauaauaauu

SEQ ID NO: 1992717 - RNA, 21 nt, Shigella flexneri 2a str. 301
aaacaucagcuauucuuauaa

SEQ ID NO: 1992718 - RNA, 20 nt, Shigella flexneri 2a str. 301
aaacaugccaacaaaaucuu

SEQ ID NO: 1992719 - RNA, 14 nt, Shigella flexneri 2a str. 301
aaacaugccaacaa

SEQ ID NO: 1992720 - RNA, 16 nt, Shigella flexneri 2a str. 301
aaacaugcaaaccauc

SEQ ID NO: 1992721 - RNA, 17 nt, Shigella flexneri 2a str. 301
aaaccaccacuccccuc

SEQ ID NO: 1992722 - RNA, 18 nt, Shigella flexneri 2a str. 301
aaaccacccaccagcgcc

SEQ ID NO: 1992723 - RNA, 19 nt, Shigella flexneri 2a str. 301
aaaccacagaccggacuga

SEQ ID NO: 1992724 - RNA, 14 nt, Shigella flexneri 2a str. 301
aaaccacugacaca

SEQ ID NO: 1992725 - RNA, 16 nt, Shigella flexneri 2a str. 301
aaaccacuccugacga

SEQ ID NO: 1992726 - RNA, 21 nt, Shigella flexneri 2a str. 301
aaaccacgcaauaaacaugau

SEQ ID NO: 1992727 - RNA, 21 nt, Shigella flexneri 2a str. 301
aaaccacuuaauuauuaacaa

SEQ ID NO: 1992728 - RNA, 22 nt, Shigella flexneri 2a str. 301
aaaccacuuaauuauuaacaaa

SEQ ID NO: 1992729 - RNA, 20 nt, Shigella flexneri 2a str. 301
aaaccacuuaauuauuaaca

SEQ ID NO: 1992730 - RNA, 15 nt, Shigella flexneri 2a str. 301
aaaccagaaagggaa

SEQ ID NO: 1992731 - RNA, 17 nt, Shigella flexneri 2a str. 301
aaaccacuuaauuauua

SEQ ID NO: 1992732 - RNA, 15 nt, Shigella flexneri 2a str. 301
aaaccacuuaauuau

SEQ ID NO: 1992733 - RNA, 19 nt, Shigella flexneri 2a str. 301
aaaccacugauaagcugag

SEQ ID NO: 1992734 - RNA, 17 nt, Shigella flexneri 2a str. 301
aaaccacugcaacagcu

SEQ ID NO: 1992735 - RNA, 20 nt, Shigella flexneri 2a str. 301
aaaccaaagcgguugaacug

SEQ ID NO: 1992736 - RNA, 15 nt, Shigella flexneri 2a str. 301
aaaccgccuucugcg

SEQ ID NO: 1992737 - RNA, 23 nt, Shigella flexneri 2a str. 301
aaaccgccuucugcgccgccucu

SEQ ID NO: 1992738 - RNA, 19 nt, Shigella flexneri 2a str. 301
aaaccgcucgugggcaucg

SEQ ID NO: 1992739 - RNA, 13 nt, Shigella flexneri 2a str. 301
aaacccugcgcac

SEQ ID NO: 1992740 - RNA, 14 nt, Shigella flexneri 2a str. 301
aaaccgacuuaaaa

SEQ ID NO: 1992741 - RNA, 20 nt, Shigella flexneri 2a str. 301
aaaccgacuuacuuauuucu

SEQ ID NO: 1992742 - RNA, 17 nt, Shigella flexneri 2a str. 301
aaaccagacagcacauu

SEQ ID NO: 1992743 - RNA, 20 nt, Shigella flexneri 2a str. 301
aaaccagacagcacauuuca

SEQ ID NO: 1992744 - RNA, 15 nt, Shigella flexneri 2a str. 301
aaaccagagaauauu

SEQ ID NO: 1992745 - RNA, 24 nt, Shigella flexneri 2a str. 301
aaaccagcaaccaacgccagcagc

SEQ ID NO: 1992746 - RNA, 19 nt, Shigella flexneri 2a str. 301
aaaccagcccugguuuauc

SEQ ID NO: 1992747 - RNA, 19 nt, Shigella flexneri 2a str. 301
aaaccagcgcauggcggua

SEQ ID NO: 1992748 - RNA, 12 nt, Shigella flexneri 2a str. 301
aaaccagcgcau

SEQ ID NO: 1992749 - RNA, 22 nt, Shigella flexneri 2a str. 301
aaaccaggccaauagugcggca

SEQ ID NO: 1992750 - RNA, 14 nt, Shigella flexneri 2a str. 301
aaaccaguaaugau

SEQ ID NO: 1992751 - RNA, 16 nt, Shigella flexneri 2a str. 301
aaaccaucaauccacu

SEQ ID NO: 1992752 - RNA, 18 nt, Shigella flexneri 2a str. 301
aaaccaucaggaugacaa

SEQ ID NO: 1992753 - RNA, 20 nt, Shigella flexneri 2a str. 301
aaaccccaaaaagauuaaaa

SEQ ID NO: 1992754 - RNA, 16 nt, Shigella flexneri 2a str. 301
aaacccaccagcugau

SEQ ID NO: 1992755 - RNA, 18 nt, Shigella flexneri 2a str. 301
aaacccgauuuuuaaauu

SEQ ID NO: 1992756 - RNA, 11 nt, Shigella flexneri 2a str. 301
aaacccgcuca

SEQ ID NO: 1992757 - RNA, 21 nt, Shigella flexneri 2a str. 301
aacaacagcgauuauggauca

SEQ ID NO: 1992758 - RNA, 19 nt, Shigella flexneri 2a str. 301
aacaacaguuuuaucucca

SEQ ID NO: 1992759 - RNA, 14 nt, Shigella flexneri 2a str. 301
aacaacaagaagcg

SEQ ID NO: 1992760 - RNA, 20 nt, Shigella flexneri 2a str. 301
aacaacacauucaauaacac

SEQ ID NO: 1992761 - RNA, 13 nt, Shigella flexneri 2a str. 301
aacaaauucacgc

SEQ ID NO: 1992762 - RNA, 19 nt, Shigella flexneri 2a str. 301
aacaaaugcgcuuuauuca

SEQ ID NO: 1992763 - RNA, 19 nt, Shigella flexneri 2a str. 301
aacaacgcgcggaacugau

SEQ ID NO: 1992764 - RNA, 17 nt, Shigella flexneri 2a str. 301
aacaacugaaaaaaaau

SEQ ID NO: 1992765 - RNA, 22 nt, Shigella flexneri 2a str. 301
aacaagacgucgcgaauggccu

SEQ ID NO: 1992766 - RNA, 21 nt, Shigella flexneri 2a str. 301
aacaagaagcguuuaugacgc

SEQ ID NO: 1992767 - RNA, 15 nt, Shigella flexneri 2a str. 301
aacaagcaaacccga

SEQ ID NO: 1992768 - RNA, 16 nt, Shigella flexneri 2a str. 301
aacaagcguacaaaau

SEQ ID NO: 1992769 - RNA, 21 nt, Shigella flexneri 2a str. 301
aacaaacagcgcgccagccac

SEQ ID NO: 1992770 - RNA, 12 nt, Shigella flexneri 2a str. 301
aacaaacaguac

SEQ ID NO: 1992771 - RNA, 16 nt, Shigella flexneri 2a str. 301
aacaaaaucuucuaac

SEQ ID NO: 1992772 - RNA, 19 nt, Shigella flexneri 2a str. 301
aacaaacgcaaaauugccu

SEQ ID NO: 1992773 - RNA, 15 nt, Shigella flexneri 2a str. 301
aacaaacgcaaacac

SEQ ID NO: 1992774 - RNA, 19 nt, Shigella flexneri 2a str. 301
aacaaacgauuuaucgauu

SEQ ID NO: 1992775 - RNA, 14 nt, Shigella flexneri 2a str. 301
aacaaacgcaaaau

SEQ ID NO: 1992776 - RNA, 18 nt, Shigella flexneri 2a str. 301
aacaaagcgcacuuuguc

SEQ ID NO: 1992777 - RNA, 14 nt, Shigella flexneri 2a str. 301
aacaaagcgcaccu

SEQ ID NO: 1992778 - RNA, 18 nt, Shigella flexneri 2a str. 301
aacaaagaacgccauaaa

SEQ ID NO: 1992779 - RNA, 15 nt, Shigella flexneri 2a str. 301
aacaaagaaauguuc

SEQ ID NO: 1992780 - RNA, 17 nt, Shigella flexneri 2a str. 301
aacaaaaaaaccgccuc

SEQ ID NO: 1992781 - RNA, 11 nt, Shigella flexneri 2a str. 301
aaauuuuuccg

SEQ ID NO: 1992782 - RNA, 18 nt, Shigella flexneri 2a str. 301
aaauuuuuccguuuucca

SEQ ID NO: 1992783 - RNA, 13 nt, Shigella flexneri 2a str. 301
aacaaaaaagagu

SEQ ID NO: 1992784 - RNA, 21 nt, Shigella flexneri 2a str. 301
aaauuuucagcgugcccacgu

SEQ ID NO: 1992785 - RNA, 20 nt, Shigella flexneri 2a str. 301
aaauugacuacaccauuaac

SEQ ID NO: 1992786 - RNA, 13 nt, Shigella flexneri 2a str. 301
aaauugaagaguu

SEQ ID NO: 1992787 - RNA, 15 nt, Shigella flexneri 2a str. 301
aaauucauuugaaua

SEQ ID NO: 1992788 - RNA, 18 nt, Shigella flexneri 2a str. 301
aaauugcaccauccauuu

SEQ ID NO: 1992789 - RNA, 23 nt, Shigella flexneri 2a str. 301
aaauugccccagacacaguucuu

SEQ ID NO: 1992790 - RNA, 20 nt, Shigella flexneri 2a str. 301
aaauugcagaguacagccuu

SEQ ID NO: 1992791 - RNA, 15 nt, Shigella flexneri 2a str. 301
aaauugcaggaaaua

SEQ ID NO: 1992792 - RNA, 17 nt, Shigella flexneri 2a str. 301
aaauugcguaaagccug

SEQ ID NO: 1992793 - RNA, 19 nt, Shigella flexneri 2a str. 301
aaauugucuccaccaauga

SEQ ID NO: 1992794 - RNA, 16 nt, Shigella flexneri 2a str. 301
aaauugguagaccaga

SEQ ID NO: 1992795 - RNA, 16 nt, Shigella flexneri 2a str. 301
aaauugguacagcaua

SEQ ID NO: 1992796 - RNA, 16 nt, Shigella flexneri 2a str. 301
aaauugcugguuuugu

SEQ ID NO: 1992797 - RNA, 18 nt, Shigella flexneri 2a str. 301
aaauuucuucccuuucug

SEQ ID NO: 1992798 - RNA, 21 nt, Shigella flexneri 2a str. 301
aaauuucugccauuuugcuuu

SEQ ID NO: 1992799 - RNA, 20 nt, Shigella flexneri 2a str. 301
aaauuuggcuccucugacug

SEQ ID NO: 1992800 - RNA, 23 nt, Shigella flexneri 2a str. 301
aaauuugcucaucgauaucgacc

SEQ ID NO: 1992801 - RNA, 12 nt, Shigella flexneri 2a str. 301
aaauuucuccuu

SEQ ID NO: 1992802 - RNA, 17 nt, Shigella flexneri 2a str. 301
aaauuucacugcuuaau

SEQ ID NO: 1992803 - RNA, 13 nt, Shigella flexneri 2a str. 301
aaauuuaauaaua

SEQ ID NO: 1992804 - RNA, 15 nt, Shigella flexneri 2a str. 301
aaauuuaauaauaag

SEQ ID NO: 1992805 - RNA, 21 nt, Shigella flexneri 2a str. 301
aaauuuaccugauccuuugga

SEQ ID NO: 1992806 - RNA, 19 nt, Shigella flexneri 2a str. 301
aaauuuaucgcauauccuc

SEQ ID NO: 1992807 - RNA, 22 nt, Shigella flexneri 2a str. 301
aaauuguuuaaucaacugccca

SEQ ID NO: 1992808 - RNA, 21 nt, Shigella flexneri 2a str. 301
aaauugugauaaaaaucggca

SEQ ID NO: 1992809 - RNA, 14 nt, Shigella flexneri 2a str. 301
aaauccgaacuauu

SEQ ID NO: 1992810 - RNA, 20 nt, Shigella flexneri 2a str. 301
aaauccgccaauagcuggca

SEQ ID NO: 1992811 - RNA, 22 nt, Shigella flexneri 2a str. 301
aaauccugucuggcgaauaaua

SEQ ID NO: 1992812 - RNA, 18 nt, Shigella flexneri 2a str. 301
aaaucgauaaaacuuccc

SEQ ID NO: 1992813 - RNA, 18 nt, Shigella flexneri 2a str. 301
aaauauuaagaaaggcag

SEQ ID NO: 1992814 - RNA, 16 nt, Shigella flexneri 2a str. 301
aaauauuaauaauaca

SEQ ID NO: 1992815 - RNA, 14 nt, Shigella flexneri 2a str. 301
aaauauuaauaaua

SEQ ID NO: 1992816 - RNA, 20 nt, Shigella flexneri 2a str. 301
aaauauggugaaaguaaaaa

SEQ ID NO: 1992817 - RNA, 21 nt, Shigella flexneri 2a str. 301
aaauaugggugcaaugagaau

SEQ ID NO: 1992818 - RNA, 14 nt, Shigella flexneri 2a str. 301
aaaucccgccagcg

SEQ ID NO: 1992819 - RNA, 14 nt, Shigella flexneri 2a str. 301
aaaucccagugccu

SEQ ID NO: 1992820 - RNA, 22 nt, Shigella flexneri 2a str. 301
aaaugacucgccgcuguggaua

SEQ ID NO: 1992821 - RNA, 21 nt, Shigella flexneri 2a str. 301
aaaugacaaacuuagauugca

SEQ ID NO: 1992822 - RNA, 14 nt, Shigella flexneri 2a str. 301
aaaucuuucauuuc

SEQ ID NO: 1992823 - RNA, 16 nt, Shigella flexneri 2a str. 301
aaaucugcccguuaac

SEQ ID NO: 1992824 - RNA, 19 nt, Shigella flexneri 2a str. 301
aaaucugcccguuaaccau

SEQ ID NO: 1992825 - RNA, 20 nt, Shigella flexneri 2a str. 301
aaaucugcccguuaaccaua

SEQ ID NO: 1992826 - RNA, 18 nt, Shigella flexneri 2a str. 301
aaaucugauuaauauuga

SEQ ID NO: 1992827 - RNA, 18 nt, Shigella flexneri 2a str. 301
aaaucugcgccuacggca

SEQ ID NO: 1992828 - RNA, 11 nt, Shigella flexneri 2a str. 301
aaaucuuuaua

SEQ ID NO: 1992829 - RNA, 15 nt, Shigella flexneri 2a str. 301
aaaucugaaaucauc

SEQ ID NO: 1992830 - RNA, 17 nt, Shigella flexneri 2a str. 301
aaaucgugaaaaaucaa

SEQ ID NO: 1992831 - RNA, 17 nt, Shigella flexneri 2a str. 301
aaaucgucgagggauuu

SEQ ID NO: 1992832 - RNA, 14 nt, Shigella flexneri 2a str. 301
aaaucggugggcug

SEQ ID NO: 1992833 - RNA, 14 nt, Shigella flexneri 2a str. 301
aaaugauagccagg

SEQ ID NO: 1992834 - RNA, 19 nt, Shigella flexneri 2a str. 301
aaaugagugccaaaaaaau

SEQ ID NO: 1992835 - RNA, 21 nt, Shigella flexneri 2a str. 301
aaaugcaugcucagucacuuc

SEQ ID NO: 1992836 - RNA, 23 nt, Shigella flexneri 2a str. 301
aaaugcaucagugacaaauuccg

SEQ ID NO: 1992837 - RNA, 19 nt, Shigella flexneri 2a str. 301
aaaugccagauaagacacu

SEQ ID NO: 1992838 - RNA, 18 nt, Shigella flexneri 2a str. 301
aaauggcacaauggagcu

SEQ ID NO: 1992839 - RNA, 12 nt, Shigella flexneri 2a str. 301
aaauggcaaagc

SEQ ID NO: 1992840 - RNA, 11 nt, Shigella flexneri 2a str. 301
aaauggccccg

SEQ ID NO: 1992841 - RNA, 19 nt, Shigella flexneri 2a str. 301
aaauggcuggcuauacaca

SEQ ID NO: 1992842 - RNA, 16 nt, Shigella flexneri 2a str. 301
aaauggcugaccagaa

SEQ ID NO: 1992843 - RNA, 23 nt, Shigella flexneri 2a str. 301
aaauggcgcuucguguuuaagaa

SEQ ID NO: 1992844 - RNA, 15 nt, Shigella flexneri 2a str. 301
aaaugggagcuggga

SEQ ID NO: 1992845 - RNA, 12 nt, Shigella flexneri 2a str. 301
aaaugucacugc

SEQ ID NO: 1992846 - RNA, 20 nt, Shigella flexneri 2a str. 301
aaaugugcaaucacaguuaa

SEQ ID NO: 1992847 - RNA, 22 nt, Shigella flexneri 2a str. 301
aaaugugaagaggaacaaauuu

SEQ ID NO: 1992848 - RNA, 16 nt, Shigella flexneri 2a str. 301
aaauggugugcauggu

SEQ ID NO: 1992849 - RNA, 15 nt, Shigella flexneri 2a str. 301
aaauuauuucuuuua

SEQ ID NO: 1992850 - RNA, 21 nt, Shigella flexneri 2a str. 301
aaauuauuucuuuuacauuau

SEQ ID NO: 1992851 - RNA, 14 nt, Shigella flexneri 2a str. 301
aaauuauuuuaaau

SEQ ID NO: 1992852 - RNA, 16 nt, Shigella flexneri 2a str. 301
aaauuaggucaaagaa

SEQ ID NO: 1992853 - RNA, 20 nt, Shigella flexneri 2a str. 301
aaauuacugccuugaugaaa

SEQ ID NO: 1992854 - RNA, 20 nt, Shigella flexneri 2a str. 301
aaaguauauaaaaaacaaua

SEQ ID NO: 1992855 - RNA, 18 nt, Shigella flexneri 2a str. 301
aaaguauauaaaaaacaa

SEQ ID NO: 1992856 - RNA, 17 nt, Shigella flexneri 2a str. 301
aaagugaauacagaaca

SEQ ID NO: 1992857 - RNA, 16 nt, Shigella flexneri 2a str. 301
aaagugaauacagaac

SEQ ID NO: 1992858 - RNA, 21 nt, Shigella flexneri 2a str. 301
aaagucuuuguauuuauuuuc

SEQ ID NO: 1992859 - RNA, 16 nt, Shigella flexneri 2a str. 301
aaagugagcuuuguuc

SEQ ID NO: 1992860 - RNA, 15 nt, Shigella flexneri 2a str. 301
aaagugaguuuugca

SEQ ID NO: 1992861 - RNA, 21 nt, Shigella flexneri 2a str. 301
aaagugacacaaucaaauccu

SEQ ID NO: 1992862 - RNA, 15 nt, Shigella flexneri 2a str. 301
aaagugaugguggug

SEQ ID NO: 1992863 - RNA, 17 nt, Shigella flexneri 2a str. 301
aaagugguguucuuugu

SEQ ID NO: 1992864 - RNA, 21 nt, Shigella flexneri 2a str. 301
aaagugguguugaagaaacau

SEQ ID NO: 1992865 - RNA, 20 nt, Shigella flexneri 2a str. 301
aaaguggcggggaucacucc

SEQ ID NO: 1992866 - RNA, 20 nt, Shigella flexneri 2a str. 301
aaaguggaaaaauaacaaau

SEQ ID NO: 1992867 - RNA, 17 nt, Shigella flexneri 2a str. 301
aaaguggaaaaauaaca

SEQ ID NO: 1992868 - RNA, 23 nt, Shigella flexneri 2a str. 301
aaagugccgccagcuucgcuucc

SEQ ID NO: 1992869 - RNA, 14 nt, Shigella flexneri 2a str. 301
aaauaaaaaacauu

SEQ ID NO: 1992870 - RNA, 21 nt, Shigella flexneri 2a str. 301
aaauaaaaaaaguauuuuuaa

SEQ ID NO: 1992871 - RNA, 12 nt, Shigella flexneri 2a str. 301
aaauaaaaauaa

SEQ ID NO: 1992872 - RNA, 13 nt, Shigella flexneri 2a str. 301
aaauaaaaauaag

SEQ ID NO: 1992873 - RNA, 11 nt, Shigella flexneri 2a str. 301
aaauaaaaauu

SEQ ID NO: 1992874 - RNA, 17 nt, Shigella flexneri 2a str. 301
aaaguuaccuucgaaga

SEQ ID NO: 1992875 - RNA, 18 nt, Shigella flexneri 2a str. 301
aaaguugcucucaaagac

SEQ ID NO: 1992876 - RNA, 21 nt, Shigella flexneri 2a str. 301
aaauaauuuucguaguauaga

SEQ ID NO: 1992877 - RNA, 13 nt, Shigella flexneri 2a str. 301
aaauaaugcagcg

SEQ ID NO: 1992878 - RNA, 22 nt, Shigella flexneri 2a str. 301
aaauaaaucaaagucagaucaa

SEQ ID NO: 1992879 - RNA, 15 nt, Shigella flexneri 2a str. 301
aaauaaauauauaaa

SEQ ID NO: 1992880 - RNA, 18 nt, Shigella flexneri 2a str. 301
aaauacagcaauggaaaa

SEQ ID NO: 1992881 - RNA, 18 nt, Shigella flexneri 2a str. 301
aaauacaccuauacuuuu

SEQ ID NO: 1992882 - RNA, 12 nt, Shigella flexneri 2a str. 301
aaauacagauuc

SEQ ID NO: 1992883 - RNA, 14 nt, Shigella flexneri 2a str. 301
aaauacccaaaaaa

SEQ ID NO: 1992884 - RNA, 15 nt, Shigella flexneri 2a str. 301
aaauacccaaaaaau

SEQ ID NO: 1992885 - RNA, 20 nt, Shigella flexneri 2a str. 301
aaauaccggacacacuucau

SEQ ID NO: 1992886 - RNA, 15 nt, Shigella flexneri 2a str. 301
aaauagaaagugacu

SEQ ID NO: 1992887 - RNA, 13 nt, Shigella flexneri 2a str. 301
aaauaucuuauag

SEQ ID NO: 1992888 - RNA, 16 nt, Shigella flexneri 2a str. 301
aaauauggcgcaccga

SEQ ID NO: 1992889 - RNA, 11 nt, Shigella flexneri 2a str. 301
aaauaucugua

SEQ ID NO: 1992890 - RNA, 21 nt, Shigella flexneri 2a str. 301
aaauaucuauauacaaucaca

SEQ ID NO: 1992891 - RNA, 18 nt, Shigella flexneri 2a str. 301
aaauaucucggcaaucau

SEQ ID NO: 1992892 - RNA, 21 nt, Shigella flexneri 2a str. 301
aaauauccguagugaaaaagc

SEQ ID NO: 1992893 - RNA, 17 nt, Shigella flexneri 2a str. 301
aaauaucgcccauauga

SEQ ID NO: 1992894 - RNA, 23 nt, Shigella flexneri 2a str. 301
aaauaucaaagacaaauuuugaa

SEQ ID NO: 1992895 - RNA, 11 nt, Shigella flexneri 2a str. 301
aaauauauccu

SEQ ID NO: 1992896 - RNA, 22 nt, Shigella flexneri 2a str. 301
aaauauauuccccggucagcag

SEQ ID NO: 1992897 - RNA, 16 nt, Shigella flexneri 2a str. 301
aaauauaaaacaacgg

SEQ ID NO: 1992898 - RNA, 13 nt, Shigella flexneri 2a str. 301
aaauauaaaacaa

SEQ ID NO: 1992899 - RNA, 15 nt, Shigella flexneri 2a str. 301
aaauagcaaaguaau

SEQ ID NO: 1992900 - RNA, 14 nt, Shigella flexneri 2a str. 301
aaauagcaaaguaa

SEQ ID NO: 1992901 - RNA, 16 nt, Shigella flexneri 2a str. 301
aaauagacacaagaaa

SEQ ID NO: 1992902 - RNA, 19 nt, Shigella flexneri 2a str. 301
aaauagacacaagaaauau

SEQ ID NO: 1992903 - RNA, 23 nt, Shigella flexneri 2a str. 301
aaauagagaaaguaaaccaccag

SEQ ID NO: 1992904 - RNA, 13 nt, Shigella flexneri 2a str. 301
aaagacaucaaac

SEQ ID NO: 1992905 - RNA, 21 nt, Shigella flexneri 2a str. 301
aaagaccacaguaacgccugg

SEQ ID NO: 1992906 - RNA, 18 nt, Shigella flexneri 2a str. 301
aaagaccaggaaacccaa

SEQ ID NO: 1992907 - RNA, 15 nt, Shigella flexneri 2a str. 301
aaagaucgccacugc

SEQ ID NO: 1992908 - RNA, 16 nt, Shigella flexneri 2a str. 301
aaagaguaaaguuagu

SEQ ID NO: 1992909 - RNA, 14 nt, Shigella flexneri 2a str. 301
aaagcaauuccagc

SEQ ID NO: 1992910 - RNA, 16 nt, Shigella flexneri 2a str. 301
aaagcaauuccagcgc

SEQ ID NO: 1992911 - RNA, 12 nt, Shigella flexneri 2a str. 301
aaagcaacucca

SEQ ID NO: 1992912 - RNA, 11 nt, Shigella flexneri 2a str. 301
aaagcaacucc

SEQ ID NO: 1992913 - RNA, 13 nt, Shigella flexneri 2a str. 301
aaagcaaauuuug

SEQ ID NO: 1992914 - RNA, 20 nt, Shigella flexneri 2a str. 301
aaagauucaucgcccuuuuu

SEQ ID NO: 1992915 - RNA, 21 nt, Shigella flexneri 2a str. 301
aaagauggcgcgcagaaagag

SEQ ID NO: 1992916 - RNA, 23 nt, Shigella flexneri 2a str. 301
aaagauggcgcgcagaaagaggc

SEQ ID NO: 1992917 - RNA, 13 nt, Shigella flexneri 2a str. 301
aaagauuaaaaaa

SEQ ID NO: 1992918 - RNA, 18 nt, Shigella flexneri 2a str. 301
aaagauggauugcugaaa

SEQ ID NO: 1992919 - RNA, 22 nt, Shigella flexneri 2a str. 301
aaagaugccauuggcauaaaua

SEQ ID NO: 1992920 - RNA, 17 nt, Shigella flexneri 2a str. 301
aaagauuaaaaaaacac

SEQ ID NO: 1992921 - RNA, 20 nt, Shigella flexneri 2a str. 301
aaagauuaaaaaaacaccac

SEQ ID NO: 1992922 - RNA, 15 nt, Shigella flexneri 2a str. 301
aaagauguugucauu

SEQ ID NO: 1992923 - RNA, 19 nt, Shigella flexneri 2a str. 301
aaagauguugucauuacaa

SEQ ID NO: 1992924 - RNA, 23 nt, Shigella flexneri 2a str. 301
aaagauuauugcuugaucaggaa

SEQ ID NO: 1992925 - RNA, 16 nt, Shigella flexneri 2a str. 301
aaaccuccgcaaugcg

SEQ ID NO: 1992926 - RNA, 23 nt, Shigella flexneri 2a str. 301
aaaccucguccuguugaaaaacc

SEQ ID NO: 1992927 - RNA, 14 nt, Shigella flexneri 2a str. 301
aaaccucuuccagc

SEQ ID NO: 1992928 - RNA, 18 nt, Shigella flexneri 2a str. 301
aaaccucuuccagcagau

SEQ ID NO: 1992929 - RNA, 19 nt, Shigella flexneri 2a str. 301
aaaccucacgcauccucua

SEQ ID NO: 1992930 - RNA, 19 nt, Shigella flexneri 2a str. 301
aaaccguguuuaugaaagu

SEQ ID NO: 1992931 - RNA, 14 nt, Shigella flexneri 2a str. 301
aaaccguauccauc

SEQ ID NO: 1992932 - RNA, 23 nt, Shigella flexneri 2a str. 301
aaaccguucuuuucgagcagguc

SEQ ID NO: 1992933 - RNA, 16 nt, Shigella flexneri 2a str. 301
aaagaaaaucugaauu

SEQ ID NO: 1992934 - RNA, 13 nt, Shigella flexneri 2a str. 301
aaagaaagaagcc

SEQ ID NO: 1992935 - RNA, 11 nt, Shigella flexneri 2a str. 301
aaagaaaaucu

SEQ ID NO: 1992936 - RNA, 18 nt, Shigella flexneri 2a str. 301
aaagaagcggugaaaaaa

SEQ ID NO: 1992937 - RNA, 13 nt, Shigella flexneri 2a str. 301
aaagaaugacacu

SEQ ID NO: 1992938 - RNA, 19 nt, Shigella flexneri 2a str. 301
aaaggucauugcgacgaga

SEQ ID NO: 1992939 - RNA, 17 nt, Shigella flexneri 2a str. 301
aaagguccuguaaugag

SEQ ID NO: 1992940 - RNA, 13 nt, Shigella flexneri 2a str. 301
aaaguaacaccau

SEQ ID NO: 1992941 - RNA, 20 nt, Shigella flexneri 2a str. 301
aaaguaaaccagagagaagc

SEQ ID NO: 1992942 - RNA, 15 nt, Shigella flexneri 2a str. 301
aaaguaaaccaccag

SEQ ID NO: 1992943 - RNA, 18 nt, Shigella flexneri 2a str. 301
aaaguaagaauugauaaa

SEQ ID NO: 1992944 - RNA, 21 nt, Shigella flexneri 2a str. 301
aaaguaagaauugauaaaaaa

SEQ ID NO: 1992945 - RNA, 10 nt, Shigella flexneri 2a str. 301
aaaguaaauu

SEQ ID NO: 1992946 - RNA, 18 nt, Shigella flexneri 2a str. 301
aaaggcggcagaacagaa

SEQ ID NO: 1992947 - RNA, 19 nt, Shigella flexneri 2a str. 301
aaaggcggcagaacagaac

SEQ ID NO: 1992948 - RNA, 19 nt, Shigella flexneri 2a str. 301
aaaggcgcgguuucugcuu

SEQ ID NO: 1992949 - RNA, 14 nt, Shigella flexneri 2a str. 301
aaaggcgaugcugu

SEQ ID NO: 1992950 - RNA, 16 nt, Shigella flexneri 2a str. 301
aaaggcugacaaauca

SEQ ID NO: 1992951 - RNA, 15 nt, Shigella flexneri 2a str. 301
aaagggucagggaga

SEQ ID NO: 1992952 - RNA, 17 nt, Shigella flexneri 2a str. 301
aaaggggugaaaaaaac

SEQ ID NO: 1992953 - RNA, 16 nt, Shigella flexneri 2a str. 301
aaagcugauuucuggc

SEQ ID NO: 1992954 - RNA, 19 nt, Shigella flexneri 2a str. 301
aaagcugcaaggugaaagc

SEQ ID NO: 1992955 - RNA, 23 nt, Shigella flexneri 2a str. 301
aaagcugccgucaauuuuaagca

SEQ ID NO: 1992956 - RNA, 13 nt, Shigella flexneri 2a str. 301
aaaggauguuuau

SEQ ID NO: 1992957 - RNA, 23 nt, Shigella flexneri 2a str. 301
aaaggcgacuaauacaccaucau

SEQ ID NO: 1992958 - RNA, 13 nt, Shigella flexneri 2a str. 301
aaagccuuucacu

SEQ ID NO: 1992959 - RNA, 16 nt, Shigella flexneri 2a str. 301
aaagccuuucacuucg

SEQ ID NO: 1992960 - RNA, 13 nt, Shigella flexneri 2a str. 301
aaagcgaagcgaa

SEQ ID NO: 1992961 - RNA, 13 nt, Shigella flexneri 2a str. 301
aaagcgaagcggc

SEQ ID NO: 1992962 - RNA, 23 nt, Shigella flexneri 2a str. 301
aaagccucucgcgaggagaggcc

SEQ ID NO: 1992963 - RNA, 21 nt, Shigella flexneri 2a str. 301
aaagccucucgcgaggagagg

SEQ ID NO: 1992964 - RNA, 22 nt, Shigella flexneri 2a str. 301
aaagccuguaacgccuuuucca

SEQ ID NO: 1992965 - RNA, 14 nt, Shigella flexneri 2a str. 301
aaagccugcuggca

SEQ ID NO: 1992966 - RNA, 22 nt, Shigella flexneri 2a str. 301
aaagcaggcuggaguuacccag

SEQ ID NO: 1992967 - RNA, 20 nt, Shigella flexneri 2a str. 301
aaagcaggucccauccugau

SEQ ID NO: 1992968 - RNA, 17 nt, Shigella flexneri 2a str. 301
aaagcagguuuuacgca

SEQ ID NO: 1992969 - RNA, 23 nt, Shigella flexneri 2a str. 301
aaagcaguaaggucaucaaucau

SEQ ID NO: 1992970 - RNA, 14 nt, Shigella flexneri 2a str. 301
aaagcaggccagau

SEQ ID NO: 1992971 - RNA, 19 nt, Shigella flexneri 2a str. 301
aaagcaggccagauagcca

SEQ ID NO: 1992972 - RNA, 14 nt, Shigella flexneri 2a str. 301
aaagcaccacuccu

SEQ ID NO: 1992973 - RNA, 18 nt, Shigella flexneri 2a str. 301
aaagcauagccccagcgc

SEQ ID NO: 1992974 - RNA, 14 nt, Shigella flexneri 2a str. 301
aaagcucccuaaaa

SEQ ID NO: 1992975 - RNA, 13 nt, Shigella flexneri 2a str. 301
aaagcucccuaaa

SEQ ID NO: 1992976 - RNA, 14 nt, Shigella flexneri 2a str. 301
aaagcguauuaugc

SEQ ID NO: 1992977 - RNA, 23 nt, Shigella flexneri 2a str. 301
aaagcgucaaguugacucucauc

SEQ ID NO: 1992978 - RNA, 16 nt, Shigella flexneri 2a str. 301
aaagcgcgucaccacc

SEQ ID NO: 1992979 - RNA, 20 nt, Shigella flexneri 2a str. 301
aaagcguacccgccugauag

SEQ ID NO: 1992980 - RNA, 16 nt, Shigella flexneri 2a str. 301
aaagcguauccaucac

SEQ ID NO: 1992981 - RNA, 12 nt, Shigella flexneri 2a str. 301
aaagcggccaga

SEQ ID NO: 1992982 - RNA, 18 nt, Shigella flexneri 2a str. 301
aaagcgagcgagcaauau

SEQ ID NO: 1992983 - RNA, 14 nt, Shigella flexneri 2a str. 301
aaagcgccaaaucu

SEQ ID NO: 1992984 - RNA, 14 nt, Shigella flexneri 2a str. 301
aaagcgcgcaguuu

SEQ ID NO: 1992985 - RNA, 16 nt, Shigella flexneri 2a str. 301
aacaggaguagcucug

SEQ ID NO: 1992986 - RNA, 19 nt, Shigella flexneri 2a str. 301
aacaggcagggccaccagc

SEQ ID NO: 1992987 - RNA, 16 nt, Shigella flexneri 2a str. 301
aacaggcccaacuguu

SEQ ID NO: 1992988 - RNA, 19 nt, Shigella flexneri 2a str. 301
aacaggcccaggcggccug

SEQ ID NO: 1992989 - RNA, 22 nt, Shigella flexneri 2a str. 301
aacaggcagggccaccagcgug

SEQ ID NO: 1992990 - RNA, 23 nt, Shigella flexneri 2a str. 301
aacaggcgcagaacuucacucuc

SEQ ID NO: 1992991 - RNA, 19 nt, Shigella flexneri 2a str. 301
aacagggcaauuaaaaauu

SEQ ID NO: 1992992 - RNA, 14 nt, Shigella flexneri 2a str. 301
aacaggggcuggaa

SEQ ID NO: 1992993 - RNA, 21 nt, Shigella flexneri 2a str. 301
aacaguagacaauuuuucaua

SEQ ID NO: 1992994 - RNA, 20 nt, Shigella flexneri 2a str. 301
aacaguaucugaaucaaaau

SEQ ID NO: 1992995 - RNA, 18 nt, Shigella flexneri 2a str. 301
aacaguacacagacgaag

SEQ ID NO: 1992996 - RNA, 11 nt, Shigella flexneri 2a str. 301
aacaguacauu

SEQ ID NO: 1992997 - RNA, 19 nt, Shigella flexneri 2a str. 301
aacaguaaacucgacuuuc

SEQ ID NO: 1992998 - RNA, 20 nt, Shigella flexneri 2a str. 301
aacaguaagcacucugacgg

SEQ ID NO: 1992999 - RNA, 19 nt, Shigella flexneri 2a str. 301
aacaguaauaaugcccauc

SEQ ID NO: 1993000 - RNA, 17 nt, Shigella flexneri 2a str. 301
aacagguugcccagcgc

SEQ ID NO: 1993001 - RNA, 22 nt, Shigella flexneri 2a str. 301
aacaggaauaaaucuaaaagau

SEQ ID NO: 1993002 - RNA, 16 nt, Shigella flexneri 2a str. 301
aacagcucgacaccaa

SEQ ID NO: 1993003 - RNA, 21 nt, Shigella flexneri 2a str. 301
aacagcucaacgcguggauca

SEQ ID NO: 1993004 - RNA, 15 nt, Shigella flexneri 2a str. 301
aacaaggcaggauua

SEQ ID NO: 1993005 - RNA, 19 nt, Shigella flexneri 2a str. 301
aacagcgcgccagccacca

SEQ ID NO: 1993006 - RNA, 23 nt, Shigella flexneri 2a str. 301
aacagcgccuguuuaccgcucac

SEQ ID NO: 1993007 - RNA, 20 nt, Shigella flexneri 2a str. 301
aacaucggcuuauucauauc

SEQ ID NO: 1993008 - RNA, 18 nt, Shigella flexneri 2a str. 301
aacaucacaccugcucag

SEQ ID NO: 1993009 - RNA, 12 nt, Shigella flexneri 2a str. 301
aacaucacaugc

SEQ ID NO: 1993010 - RNA, 17 nt, Shigella flexneri 2a str. 301
aacauauccuucacaca

SEQ ID NO: 1993011 - RNA, 14 nt, Shigella flexneri 2a str. 301
aacaucaaauuaca

SEQ ID NO: 1993012 - RNA, 22 nt, Shigella flexneri 2a str. 301
aacauagguacagcaccaaaag

SEQ ID NO: 1993013 - RNA, 13 nt, Shigella flexneri 2a str. 301
aacaguuucgcca

SEQ ID NO: 1993014 - RNA, 17 nt, Shigella flexneri 2a str. 301
aacaguucuggaagaga

SEQ ID NO: 1993015 - RNA, 16 nt, Shigella flexneri 2a str. 301
aacaguucugcagcgu

SEQ ID NO: 1993016 - RNA, 12 nt, Shigella flexneri 2a str. 301
aacaguuucugc

SEQ ID NO: 1993017 - RNA, 13 nt, Shigella flexneri 2a str. 301
aacaguuucugca

SEQ ID NO: 1993018 - RNA, 23 nt, Shigella flexneri 2a str. 301
aacaguuuucaagacgccgucca

SEQ ID NO: 1993019 - RNA, 12 nt, Shigella flexneri 2a str. 301
aacaguuuucag

SEQ ID NO: 1993020 - RNA, 15 nt, Shigella flexneri 2a str. 301
aacauaaccugaaag

SEQ ID NO: 1993021 - RNA, 21 nt, Shigella flexneri 2a str. 301
aacagugcugauccccggaau

SEQ ID NO: 1993022 - RNA, 20 nt, Shigella flexneri 2a str. 301
aacagugccaugccaaucag

SEQ ID NO: 1993023 - RNA, 22 nt, Shigella flexneri 2a str. 301
aacagugaccaucuuccagcau

SEQ ID NO: 1993024 - RNA, 18 nt, Shigella flexneri 2a str. 301
aacagucuggagcaaaaa

SEQ ID NO: 1993025 - RNA, 14 nt, Shigella flexneri 2a str. 301
aacaguucagcagc

SEQ ID NO: 1993026 - RNA, 23 nt, Shigella flexneri 2a str. 301
aacaguuccgcaaagcccaucac

SEQ ID NO: 1993027 - RNA, 16 nt, Shigella flexneri 2a str. 301
aaccaaaaauuuccac

SEQ ID NO: 1993028 - RNA, 14 nt, Shigella flexneri 2a str. 301
aaccaaaagcuggg

SEQ ID NO: 1993029 - RNA, 14 nt, Shigella flexneri 2a str. 301
aaccaaacagucac

SEQ ID NO: 1993030 - RNA, 20 nt, Shigella flexneri 2a str. 301
aaccaaacguggucgccagc

SEQ ID NO: 1993031 - RNA, 16 nt, Shigella flexneri 2a str. 301
aaccaaagcgguugaa

SEQ ID NO: 1993032 - RNA, 21 nt, Shigella flexneri 2a str. 301
aaccaccuccacgcccagcgc

SEQ ID NO: 1993033 - RNA, 15 nt, Shigella flexneri 2a str. 301
aaccagaaagggaag

SEQ ID NO: 1993034 - RNA, 19 nt, Shigella flexneri 2a str. 301
aaccagaaagggaagaaca

SEQ ID NO: 1993035 - RNA, 20 nt, Shigella flexneri 2a str. 301
aaccaccgucgucccuuccg

SEQ ID NO: 1993036 - RNA, 13 nt, Shigella flexneri 2a str. 301
aaccacaucaauc

SEQ ID NO: 1993037 - RNA, 13 nt, Shigella flexneri 2a str. 301
aacauggaaacca

SEQ ID NO: 1993038 - RNA, 14 nt, Shigella flexneri 2a str. 301
aacauggaaaccau

SEQ ID NO: 1993039 - RNA, 17 nt, Shigella flexneri 2a str. 301
aacaugcaaaccaucac

SEQ ID NO: 1993040 - RNA, 23 nt, Shigella flexneri 2a str. 301
aacaugcagcccagcaucagacu

SEQ ID NO: 1993041 - RNA, 18 nt, Shigella flexneri 2a str. 301
aacaugccaacaaaaucu

SEQ ID NO: 1993042 - RNA, 17 nt, Shigella flexneri 2a str. 301
aacaugcggugauuuug

SEQ ID NO: 1993043 - RNA, 13 nt, Shigella flexneri 2a str. 301
aaccauaaucuca

SEQ ID NO: 1993044 - RNA, 13 nt, Shigella flexneri 2a str. 301
aaccauaaaauca

SEQ ID NO: 1993045 - RNA, 15 nt, Shigella flexneri 2a str. 301
aaccauaaaaucaca

SEQ ID NO: 1993046 - RNA, 23 nt, Shigella flexneri 2a str. 301
aaccaguuacgugcugcgcagac

SEQ ID NO: 1993047 - RNA, 14 nt, Shigella flexneri 2a str. 301
aaccagugacauac

SEQ ID NO: 1993048 - RNA, 17 nt, Shigella flexneri 2a str. 301
aaccccggcaaaugucg

SEQ ID NO: 1993049 - RNA, 21 nt, Shigella flexneri 2a str. 301
aaccagcuuaugccuguccuc

SEQ ID NO: 1993050 - RNA, 18 nt, Shigella flexneri 2a str. 301
aaccaggcgagaucggca

SEQ ID NO: 1993051 - RNA, 15 nt, Shigella flexneri 2a str. 301
aaccaguaaugaucg

SEQ ID NO: 1993052 - RNA, 14 nt, Shigella flexneri 2a str. 301
aaccagacugugaa

SEQ ID NO: 1993053 - RNA, 17 nt, Shigella flexneri 2a str. 301
aaccagagacagaccaa

SEQ ID NO: 1993054 - RNA, 14 nt, Shigella flexneri 2a str. 301
aaccagcaggcugg

SEQ ID NO: 1993055 - RNA, 20 nt, Shigella flexneri 2a str. 301
aacgaaagcagggcggcagg

SEQ ID NO: 1993056 - RNA, 21 nt, Shigella flexneri 2a str. 301
aacgaaagucccgauaaccgc

SEQ ID NO: 1993057 - RNA, 20 nt, Shigella flexneri 2a str. 301
aacgaaaguuaauccacagc

SEQ ID NO: 1993058 - RNA, 21 nt, Shigella flexneri 2a str. 301
aacgaaccauaaaaucacagg

SEQ ID NO: 1993059 - RNA, 20 nt, Shigella flexneri 2a str. 301
aaccuuugcgguuaaaaaua

SEQ ID NO: 1993060 - RNA, 19 nt, Shigella flexneri 2a str. 301
aaccuugcacucgcagaag

SEQ ID NO: 1993061 - RNA, 21 nt, Shigella flexneri 2a str. 301
aaccuuguuucugagcaugaa

SEQ ID NO: 1993062 - RNA, 16 nt, Shigella flexneri 2a str. 301
aaccuuuaaucaggcu

SEQ ID NO: 1993063 - RNA, 20 nt, Shigella flexneri 2a str. 301
aaccuucccgucuacaaaaa

SEQ ID NO: 1993064 - RNA, 18 nt, Shigella flexneri 2a str. 301
aaccuucuucauuaugaa

SEQ ID NO: 1993065 - RNA, 22 nt, Shigella flexneri 2a str. 301
aaccuucuucauuaugaauagc

SEQ ID NO: 1993066 - RNA, 19 nt, Shigella flexneri 2a str. 301
aaccuguugaaauuauugc

SEQ ID NO: 1993067 - RNA, 17 nt, Shigella flexneri 2a str. 301
aaccuguggugcaggcg

SEQ ID NO: 1993068 - RNA, 17 nt, Shigella flexneri 2a str. 301
aaccugguggugcugga

SEQ ID NO: 1993069 - RNA, 20 nt, Shigella flexneri 2a str. 301
aaccugguguucggcauucu

SEQ ID NO: 1993070 - RNA, 18 nt, Shigella flexneri 2a str. 301
aaccuggauauugcggaa

SEQ ID NO: 1993071 - RNA, 18 nt, Shigella flexneri 2a str. 301
aaccugcggguuggcuuu

SEQ ID NO: 1993072 - RNA, 17 nt, Shigella flexneri 2a str. 301
aaccugacucgguucaa

SEQ ID NO: 1993073 - RNA, 18 nt, Shigella flexneri 2a str. 301
aaccugaauauuaguacu

SEQ ID NO: 1993074 - RNA, 23 nt, Shigella flexneri 2a str. 301
aaccucucugcuagcuggcucga

SEQ ID NO: 1993075 - RNA, 19 nt, Shigella flexneri 2a str. 301
aaccugcacgaaaccacug

SEQ ID NO: 1993076 - RNA, 16 nt, Shigella flexneri 2a str. 301
aaccugcacgaaacca

SEQ ID NO: 1993077 - RNA, 21 nt, Shigella flexneri 2a str. 301
aaccugccgcgucgggcauca

SEQ ID NO: 1993078 - RNA, 17 nt, Shigella flexneri 2a str. 301
aaccugauuacgcaccg

SEQ ID NO: 1993079 - RNA, 22 nt, Shigella flexneri 2a str. 301
aaccucacagaggucuuuucuc

SEQ ID NO: 1993080 - RNA, 21 nt, Shigella flexneri 2a str. 301
aaccucacagaggucuuuucu

SEQ ID NO: 1993081 - RNA, 18 nt, Shigella flexneri 2a str. 301
aaccuccucggcaaaaca

SEQ ID NO: 1993082 - RNA, 14 nt, Shigella flexneri 2a str. 301
aaccucgcccgcag

SEQ ID NO: 1993083 - RNA, 21 nt, Shigella flexneri 2a str. 301
aaccucagaguuaaccugaaa

SEQ ID NO: 1993084 - RNA, 14 nt, Shigella flexneri 2a str. 301
aaccuacuuuuuaa

SEQ ID NO: 1993085 - RNA, 16 nt, Shigella flexneri 2a str. 301
aaccuaacgcugucgg

SEQ ID NO: 1993086 - RNA, 23 nt, Shigella flexneri 2a str. 301
aaccguaaacagauaggcaucag

SEQ ID NO: 1993087 - RNA, 14 nt, Shigella flexneri 2a str. 301
aaccguacagcaug

SEQ ID NO: 1993088 - RNA, 17 nt, Shigella flexneri 2a str. 301
aaccgggucgauaaaca

SEQ ID NO: 1993089 - RNA, 13 nt, Shigella flexneri 2a str. 301
aacccgccagacc

SEQ ID NO: 1993090 - RNA, 19 nt, Shigella flexneri 2a str. 301
aacccgccagaccagcuac

SEQ ID NO: 1993091 - RNA, 23 nt, Shigella flexneri 2a str. 301
aacccgccaguuugucuggcaau

SEQ ID NO: 1993092 - RNA, 19 nt, Shigella flexneri 2a str. 301
aacccgcagccgccagaaa

SEQ ID NO: 1993093 - RNA, 18 nt, Shigella flexneri 2a str. 301
aacccgcccagugccgag

SEQ ID NO: 1993094 - RNA, 14 nt, Shigella flexneri 2a str. 301
aaccgugggaaaca

SEQ ID NO: 1993095 - RNA, 19 nt, Shigella flexneri 2a str. 301
aaccgugcgggcaucaucu

SEQ ID NO: 1993096 - RNA, 16 nt, Shigella flexneri 2a str. 301
aaccguuuacgucauu

SEQ ID NO: 1993097 - RNA, 20 nt, Shigella flexneri 2a str. 301
aaccguuugauugaaaaaua

SEQ ID NO: 1993098 - RNA, 22 nt, Shigella flexneri 2a str. 301
aaccguaguggccacagauaau

SEQ ID NO: 1993099 - RNA, 13 nt, Shigella flexneri 2a str. 301
aaccgucgccggg

SEQ ID NO: 1993100 - RNA, 23 nt, Shigella flexneri 2a str. 301
aacgcauuuaucuucaaggcaga

SEQ ID NO: 1993101 - RNA, 18 nt, Shigella flexneri 2a str. 301
aacgcacgucugauguaa

SEQ ID NO: 1993102 - RNA, 15 nt, Shigella flexneri 2a str. 301
aacgcagucuuccca

SEQ ID NO: 1993103 - RNA, 17 nt, Shigella flexneri 2a str. 301
aacgcagucuucccagc

SEQ ID NO: 1993104 - RNA, 18 nt, Shigella flexneri 2a str. 301
aacgcauaccccaucagc

SEQ ID NO: 1993105 - RNA, 15 nt, Shigella flexneri 2a str. 301
aacgagcgcaaugaa

SEQ ID NO: 1993106 - RNA, 17 nt, Shigella flexneri 2a str. 301
aacgagccaauaaaaau

SEQ ID NO: 1993107 - RNA, 16 nt, Shigella flexneri 2a str. 301
aacgagccaauaaaaa

SEQ ID NO: 1993108 - RNA, 14 nt, Shigella flexneri 2a str. 301
aacgacggcguggu

SEQ ID NO: 1993109 - RNA, 21 nt, Shigella flexneri 2a str. 301
aacgaccaucagcugccaggg

SEQ ID NO: 1993110 - RNA, 15 nt, Shigella flexneri 2a str. 301
aacgaccagaaaugc

SEQ ID NO: 1993111 - RNA, 13 nt, Shigella flexneri 2a str. 301
aacgaccaucagc

SEQ ID NO: 1993112 - RNA, 22 nt, Shigella flexneri 2a str. 301
aacgacaccguuaaauaacugg

SEQ ID NO: 1993113 - RNA, 22 nt, Shigella flexneri 2a str. 301
aacgacacugcucgcagaaaua

SEQ ID NO: 1993114 - RNA, 19 nt, Shigella flexneri 2a str. 301
aacgacaccguuaaauaac

SEQ ID NO: 1993115 - RNA, 21 nt, Shigella flexneri 2a str. 301
aacgacaccguuaaauaacug

SEQ ID NO: 1993116 - RNA, 18 nt, Shigella flexneri 2a str. 301
aacgacaaaaauaccacc

SEQ ID NO: 1993117 - RNA, 14 nt, Shigella flexneri 2a str. 301
aacgaaucugcaaa

SEQ ID NO: 1993118 - RNA, 15 nt, Shigella flexneri 2a str. 301
aacgaauaguuucag

SEQ ID NO: 1993119 - RNA, 17 nt, Shigella flexneri 2a str. 301
aacgaaguaauaaucaa

SEQ ID NO: 1993120 - RNA, 14 nt, Shigella flexneri 2a str. 301
aacgcgcggcuuau

SEQ ID NO: 1993121 - RNA, 15 nt, Shigella flexneri 2a str. 301
aacgcgcauccggca

SEQ ID NO: 1993122 - RNA, 21 nt, Shigella flexneri 2a str. 301
aacgcgaggaugcguuuuccg

SEQ ID NO: 1993123 - RNA, 23 nt, Shigella flexneri 2a str. 301
aacgcgccaagauagaaccacgc

SEQ ID NO: 1993124 - RNA, 14 nt, Shigella flexneri 2a str. 301
aacgcgucucaugg

SEQ ID NO: 1993125 - RNA, 19 nt, Shigella flexneri 2a str. 301
aacgcgucuuaucuggccu

SEQ ID NO: 1993126 - RNA, 15 nt, Shigella flexneri 2a str. 301
aacgcggcccaggcg

SEQ ID NO: 1993127 - RNA, 17 nt, Shigella flexneri 2a str. 301
aacgcgggcuucuucuu

SEQ ID NO: 1993128 - RNA, 16 nt, Shigella flexneri 2a str. 301
aacgcgaccgccgcca

SEQ ID NO: 1993129 - RNA, 20 nt, Shigella flexneri 2a str. 301
aacgcgaaggccagaaccac

SEQ ID NO: 1993130 - RNA, 16 nt, Shigella flexneri 2a str. 301
aacgccuuauccggcu

SEQ ID NO: 1993131 - RNA, 21 nt, Shigella flexneri 2a str. 301
aacgccuuccgucagcaaagu

SEQ ID NO: 1993132 - RNA, 16 nt, Shigella flexneri 2a str. 301
aacgccuuauccggcc

SEQ ID NO: 1993133 - RNA, 13 nt, Shigella flexneri 2a str. 301
aacgccaaauucu

SEQ ID NO: 1993134 - RNA, 18 nt, Shigella flexneri 2a str. 301
aacgccaccccacaccag

SEQ ID NO: 1993135 - RNA, 22 nt, Shigella flexneri 2a str. 301
aacgccaauucauuccuugaaa

SEQ ID NO: 1993136 - RNA, 17 nt, Shigella flexneri 2a str. 301
aacggcagaagcugcag

SEQ ID NO: 1993137 - RNA, 22 nt, Shigella flexneri 2a str. 301
aacggcagaguuguucugcgac

SEQ ID NO: 1993138 - RNA, 22 nt, Shigella flexneri 2a str. 301
aacggcgagguacgcccagcgc

SEQ ID NO: 1993139 - RNA, 16 nt, Shigella flexneri 2a str. 301
aacggcgagccagcgc

SEQ ID NO: 1993140 - RNA, 18 nt, Shigella flexneri 2a str. 301
aacggcgcaccagaauac

SEQ ID NO: 1993141 - RNA, 21 nt, Shigella flexneri 2a str. 301
aacggcgaugcuuugaccucc

SEQ ID NO: 1993142 - RNA, 20 nt, Shigella flexneri 2a str. 301
aacgcucggcaacaccucag

SEQ ID NO: 1993143 - RNA, 17 nt, Shigella flexneri 2a str. 301
aacgcucugagcugcuc

SEQ ID NO: 1993144 - RNA, 17 nt, Shigella flexneri 2a str. 301
aacggaugcagcaucau

SEQ ID NO: 1993145 - RNA, 13 nt, Shigella flexneri 2a str. 301
aacggagcaaaaa

SEQ ID NO: 1993146 - RNA, 13 nt, Shigella flexneri 2a str. 301
aacuucaucagca

SEQ ID NO: 1993147 - RNA, 15 nt, Shigella flexneri 2a str. 301
aacuuccugagugaa

SEQ ID NO: 1993148 - RNA, 13 nt, Shigella flexneri 2a str. 301
aacuuccugcugg

SEQ ID NO: 1993149 - RNA, 16 nt, Shigella flexneri 2a str. 301
aacuucgcguuguaua

SEQ ID NO: 1993150 - RNA, 16 nt, Shigella flexneri 2a str. 301
aacuucgguuaccaca

SEQ ID NO: 1993151 - RNA, 14 nt, Shigella flexneri 2a str. 301
aacuucgucacagc

SEQ ID NO: 1993152 - RNA, 21 nt, Shigella flexneri 2a str. 301
aacuucguuagguucucucag

SEQ ID NO: 1993153 - RNA, 16 nt, Shigella flexneri 2a str. 301
aacugugguccuggcu

SEQ ID NO: 1993154 - RNA, 22 nt, Shigella flexneri 2a str. 301
aacuguugaccauuugugcaua

SEQ ID NO: 1993155 - RNA, 24 nt, Shigella flexneri 2a str. 301
aacuucacuuccccgagcucaaua

SEQ ID NO: 1993156 - RNA, 23 nt, Shigella flexneri 2a str. 301
aacuguuucgcgguaaacugcau

SEQ ID NO: 1993157 - RNA, 17 nt, Shigella flexneri 2a str. 301
aacugccaguaaagcag

SEQ ID NO: 1993158 - RNA, 15 nt, Shigella flexneri 2a str. 301
aacugauccugacaa

SEQ ID NO: 1993159 - RNA, 22 nt, Shigella flexneri 2a str. 301
aacugauaaaccuucaucguuu

SEQ ID NO: 1993160 - RNA, 20 nt, Shigella flexneri 2a str. 301
aacugccucgggauccaugc

SEQ ID NO: 1993161 - RNA, 16 nt, Shigella flexneri 2a str. 301
aacugcgccagaccca

SEQ ID NO: 1993162 - RNA, 22 nt, Shigella flexneri 2a str. 301
aacugccaugaccgcuccgcca

SEQ ID NO: 1993163 - RNA, 20 nt, Shigella flexneri 2a str. 301
aacugccgcgccugaaucug

SEQ ID NO: 1993164 - RNA, 15 nt, Shigella flexneri 2a str. 301
aacugccggaaggcg

SEQ ID NO: 1993165 - RNA, 22 nt, Shigella flexneri 2a str. 301
aacugccggaaggcgauuaaac

SEQ ID NO: 1993166 - RNA, 13 nt, Shigella flexneri 2a str. 301
aacuguacaggcu

SEQ ID NO: 1993167 - RNA, 23 nt, Shigella flexneri 2a str. 301
aacuguacaggcuccuguagcug

SEQ ID NO: 1993168 - RNA, 13 nt, Shigella flexneri 2a str. 301
aacugucuaaugg

SEQ ID NO: 1993169 - RNA, 16 nt, Shigella flexneri 2a str. 301
aacugugccgccgcca

SEQ ID NO: 1993170 - RNA, 18 nt, Shigella flexneri 2a str. 301
aacuucucuucuuccgcu

SEQ ID NO: 1993171 - RNA, 21 nt, Shigella flexneri 2a str. 301
aacuuguugucuucucaacac

SEQ ID NO: 1993172 - RNA, 14 nt, Shigella flexneri 2a str. 301
aacuuucaucagca

SEQ ID NO: 1993173 - RNA, 15 nt, Shigella flexneri 2a str. 301
aagaaaccgaaguug

SEQ ID NO: 1993174 - RNA, 19 nt, Shigella flexneri 2a str. 301
aagaaaccgaaguuguagc

SEQ ID NO: 1993175 - RNA, 14 nt, Shigella flexneri 2a str. 301
aagaaacauccguu

SEQ ID NO: 1993176 - RNA, 21 nt, Shigella flexneri 2a str. 301
aagaaacaccagaaugcccca

SEQ ID NO: 1993177 - RNA, 22 nt, Shigella flexneri 2a str. 301
aagaaaauggccagccagcaga

SEQ ID NO: 1993178 - RNA, 17 nt, Shigella flexneri 2a str. 301
aacuuuucaacaaauuc

SEQ ID NO: 1993179 - RNA, 14 nt, Shigella flexneri 2a str. 301
aacuuuucaacaaa

SEQ ID NO: 1993180 - RNA, 21 nt, Shigella flexneri 2a str. 301
aacuuuguuagcgaauaaagu

SEQ ID NO: 1993181 - RNA, 19 nt, Shigella flexneri 2a str. 301
aacucacgauuguuaauca

SEQ ID NO: 1993182 - RNA, 14 nt, Shigella flexneri 2a str. 301
aacucaccgaugau

SEQ ID NO: 1993183 - RNA, 13 nt, Shigella flexneri 2a str. 301
aacucaccaucaa

SEQ ID NO: 1993184 - RNA, 20 nt, Shigella flexneri 2a str. 301
aacucagcauuauuuuuaaa

SEQ ID NO: 1993185 - RNA, 19 nt, Shigella flexneri 2a str. 301
aacucaggcuggcaagcug

SEQ ID NO: 1993186 - RNA, 12 nt, Shigella flexneri 2a str. 301
aacuccacuuca

SEQ ID NO: 1993187 - RNA, 14 nt, Shigella flexneri 2a str. 301
aacuccaccagcac

SEQ ID NO: 1993188 - RNA, 18 nt, Shigella flexneri 2a str. 301
aacucauugccaguccua

SEQ ID NO: 1993189 - RNA, 20 nt, Shigella flexneri 2a str. 301
aacucauugccaguccuaaa

SEQ ID NO: 1993190 - RNA, 20 nt, Shigella flexneri 2a str. 301
aacucauacaccagcggcac

SEQ ID NO: 1993191 - RNA, 18 nt, Shigella flexneri 2a str. 301
aacucauacaccagcggc

SEQ ID NO: 1993192 - RNA, 19 nt, Shigella flexneri 2a str. 301
aacucauacaccagcggca

SEQ ID NO: 1993193 - RNA, 14 nt, Shigella flexneri 2a str. 301
aacucauacugagc

SEQ ID NO: 1993194 - RNA, 20 nt, Shigella flexneri 2a str. 301
aacuauauucucaaaauaca

SEQ ID NO: 1993195 - RNA, 15 nt, Shigella flexneri 2a str. 301
aacuaucccagccua

SEQ ID NO: 1993196 - RNA, 19 nt, Shigella flexneri 2a str. 301
aacucaaucgccucgccga

SEQ ID NO: 1993197 - RNA, 13 nt, Shigella flexneri 2a str. 301
aacucaaucgccu

SEQ ID NO: 1993198 - RNA, 19 nt, Shigella flexneri 2a str. 301
aacgggcggcguugaccac

SEQ ID NO: 1993199 - RNA, 21 nt, Shigella flexneri 2a str. 301
aacggcgguuucgcaaaccaa

SEQ ID NO: 1993200 - RNA, 12 nt, Shigella flexneri 2a str. 301
aacggcggauga

SEQ ID NO: 1993201 - RNA, 21 nt, Shigella flexneri 2a str. 301
aacggcgcgguuuccaccuuc

SEQ ID NO: 1993202 - RNA, 18 nt, Shigella flexneri 2a str. 301
aacugacuuccacuuccu

SEQ ID NO: 1993203 - RNA, 17 nt, Shigella flexneri 2a str. 301
aacugacggcaugacca

SEQ ID NO: 1993204 - RNA, 16 nt, Shigella flexneri 2a str. 301
aacugacagagaacau

SEQ ID NO: 1993205 - RNA, 15 nt, Shigella flexneri 2a str. 301
aacugacgaaucaaa

SEQ ID NO: 1993206 - RNA, 22 nt, Shigella flexneri 2a str. 301
aacucuaaucccuuagcuaauu

SEQ ID NO: 1993207 - RNA, 14 nt, Shigella flexneri 2a str. 301
aacucucuauucca

SEQ ID NO: 1993208 - RNA, 19 nt, Shigella flexneri 2a str. 301
aacucucaaaacaacacaa

SEQ ID NO: 1993209 - RNA, 22 nt, Shigella flexneri 2a str. 301
aacucgcuuaagccaucaucaa

SEQ ID NO: 1993210 - RNA, 19 nt, Shigella flexneri 2a str. 301
aacucgaggauaaauuuuc

SEQ ID NO: 1993211 - RNA, 16 nt, Shigella flexneri 2a str. 301
aacucgccagccacca

SEQ ID NO: 1993212 - RNA, 16 nt, Shigella flexneri 2a str. 301
aacucgcuuaagccau

SEQ ID NO: 1993213 - RNA, 24 nt, Shigella flexneri 2a str. 301
aacuccgcguggugagugugcugu

SEQ ID NO: 1993214 - RNA, 21 nt, Shigella flexneri 2a str. 301
aacuccugaaagcgaaccaua

SEQ ID NO: 1993215 - RNA, 16 nt, Shigella flexneri 2a str. 301
aacucgaccagcagcu

SEQ ID NO: 1993216 - RNA, 15 nt, Shigella flexneri 2a str. 301
aacuccaucuuuaac

SEQ ID NO: 1993217 - RNA, 16 nt, Shigella flexneri 2a str. 301
aacuccccgagaaaua

SEQ ID NO: 1993218 - RNA, 15 nt, Shigella flexneri 2a str. 301
aagagaacucuuuuu

SEQ ID NO: 1993219 - RNA, 23 nt, Shigella flexneri 2a str. 301
aagacuuuuuucaugggugccag

SEQ ID NO: 1993220 - RNA, 17 nt, Shigella flexneri 2a str. 301
aagacguuuugugagaa

SEQ ID NO: 1993221 - RNA, 23 nt, Shigella flexneri 2a str. 301
aagacguugauucacuuucugaa

SEQ ID NO: 1993222 - RNA, 18 nt, Shigella flexneri 2a str. 301
aagacguuaaaaaaggug

SEQ ID NO: 1993223 - RNA, 22 nt, Shigella flexneri 2a str. 301
aagacucuuacucuuucaauuu

SEQ ID NO: 1993224 - RNA, 14 nt, Shigella flexneri 2a str. 301
aagacgcgucaagc

SEQ ID NO: 1993225 - RNA, 14 nt, Shigella flexneri 2a str. 301
aagacgcgccagcg

SEQ ID NO: 1993226 - RNA, 16 nt, Shigella flexneri 2a str. 301
aagaccauugaugcuc

SEQ ID NO: 1993227 - RNA, 22 nt, Shigella flexneri 2a str. 301
aagacacugacgcgucuuaucu

SEQ ID NO: 1993228 - RNA, 18 nt, Shigella flexneri 2a str. 301
aagacaucaauaaacaau

SEQ ID NO: 1993229 - RNA, 18 nt, Shigella flexneri 2a str. 301
aagacauccagcccggcg

SEQ ID NO: 1993230 - RNA, 21 nt, Shigella flexneri 2a str. 301
aagacaucgcccgauucacau

SEQ ID NO: 1993231 - RNA, 20 nt, Shigella flexneri 2a str. 301
aagacacuaacgcgucuuau

SEQ ID NO: 1993232 - RNA, 22 nt, Shigella flexneri 2a str. 301
aagacacuaacgcgucuuaucu

SEQ ID NO: 1993233 - RNA, 11 nt, Shigella flexneri 2a str. 301
aagacacacua

SEQ ID NO: 1993234 - RNA, 17 nt, Shigella flexneri 2a str. 301
aagaaauccacaaauuc

SEQ ID NO: 1993235 - RNA, 19 nt, Shigella flexneri 2a str. 301
aagaaacgccgaaaccgcg

SEQ ID NO: 1993236 - RNA, 16 nt, Shigella flexneri 2a str. 301
aagaaugcgaaaacga

SEQ ID NO: 1993237 - RNA, 16 nt, Shigella flexneri 2a str. 301
aagaaugacacuuuca

SEQ ID NO: 1993238 - RNA, 22 nt, Shigella flexneri 2a str. 301
aagaaugacacuuucagcgcag

SEQ ID NO: 1993239 - RNA, 14 nt, Shigella flexneri 2a str. 301
aagauauguugugg

SEQ ID NO: 1993240 - RNA, 21 nt, Shigella flexneri 2a str. 301
aagauauuggggguaauuccc

SEQ ID NO: 1993241 - RNA, 22 nt, Shigella flexneri 2a str. 301
aagauauuguuuuccguugugc

SEQ ID NO: 1993242 - RNA, 18 nt, Shigella flexneri 2a str. 301
aagauauuucaccagcgc

SEQ ID NO: 1993243 - RNA, 19 nt, Shigella flexneri 2a str. 301
aagauauuucaccagcgca

SEQ ID NO: 1993244 - RNA, 15 nt, Shigella flexneri 2a str. 301
aagauauugccgauu

SEQ ID NO: 1993245 - RNA, 19 nt, Shigella flexneri 2a str. 301
aagauagcgucauuucuac

SEQ ID NO: 1993246 - RNA, 16 nt, Shigella flexneri 2a str. 301
aagauagcgucauuuc

SEQ ID NO: 1993247 - RNA, 18 nt, Shigella flexneri 2a str. 301
aagauacggauucuuaac

SEQ ID NO: 1993248 - RNA, 13 nt, Shigella flexneri 2a str. 301
aagaguuccaacg

SEQ ID NO: 1993249 - RNA, 15 nt, Shigella flexneri 2a str. 301
aagauaauccaggac

SEQ ID NO: 1993250 - RNA, 18 nt, Shigella flexneri 2a str. 301
aagagcuggggcugagcg

SEQ ID NO: 1993251 - RNA, 19 nt, Shigella flexneri 2a str. 301
aagagcgauccguucagau

SEQ ID NO: 1993252 - RNA, 17 nt, Shigella flexneri 2a str. 301
aagagcgaucggcagcu

SEQ ID NO: 1993253 - RNA, 15 nt, Shigella flexneri 2a str. 301
aagagcgacaauccc

SEQ ID NO: 1993254 - RNA, 21 nt, Shigella flexneri 2a str. 301
aagagccgauaaacaccguuu

SEQ ID NO: 1993255 - RNA, 18 nt, Shigella flexneri 2a str. 301
aagagcgggacaacaaac

SEQ ID NO: 1993256 - RNA, 17 nt, Shigella flexneri 2a str. 301
aagagcgucuggaagaa

SEQ ID NO: 1993257 - RNA, 13 nt, Shigella flexneri 2a str. 301
aagaggcgcagau

SEQ ID NO: 1993258 - RNA, 13 nt, Shigella flexneri 2a str. 301
aagaggaacaaau

SEQ ID NO: 1993259 - RNA, 21 nt, Shigella flexneri 2a str. 301
aagaguaaauugcaaaccuca

SEQ ID NO: 1993260 - RNA, 20 nt, Shigella flexneri 2a str. 301
aagagaucgaacagcagcag

SEQ ID NO: 1993261 - RNA, 16 nt, Shigella flexneri 2a str. 301
aagagcaaauaaaaca

SEQ ID NO: 1993262 - RNA, 13 nt, Shigella flexneri 2a str. 301
aagagcaaauaaa

SEQ ID NO: 1993263 - RNA, 18 nt, Shigella flexneri 2a str. 301
aagagaggcgugccaggu

SEQ ID NO: 1993264 - RNA, 23 nt, Shigella flexneri 2a str. 301
aagagacagccgaaaagguagaa

SEQ ID NO: 1993265 - RNA, 17 nt, Shigella flexneri 2a str. 301
aagagacaaaaaaggug

SEQ ID NO: 1993266 - RNA, 18 nt, Shigella flexneri 2a str. 301
aauaaaucgugaaacaau

SEQ ID NO: 1993267 - RNA, 16 nt, Shigella flexneri 2a str. 301
aauaaaucuaaaagau

SEQ ID NO: 1993268 - RNA, 12 nt, Shigella flexneri 2a str. 301
aauaaaugccac

SEQ ID NO: 1993269 - RNA, 20 nt, Shigella flexneri 2a str. 301
aauaaauaugggugcaauga

SEQ ID NO: 1993270 - RNA, 21 nt, Shigella flexneri 2a str. 301
aaguuuaaccgccuaauuaca

SEQ ID NO: 1993271 - RNA, 22 nt, Shigella flexneri 2a str. 301
aauaaaucaaagucagaucaau

SEQ ID NO: 1993272 - RNA, 11 nt, Shigella flexneri 2a str. 301
aaguuuaaccu

SEQ ID NO: 1993273 - RNA, 14 nt, Shigella flexneri 2a str. 301
aauaagacaauuga

SEQ ID NO: 1993274 - RNA, 13 nt, Shigella flexneri 2a str. 301
aauaaccauauau

SEQ ID NO: 1993275 - RNA, 14 nt, Shigella flexneri 2a str. 301
aauaaccaucagcu

SEQ ID NO: 1993276 - RNA, 19 nt, Shigella flexneri 2a str. 301
aauaaccauggcagaagca

SEQ ID NO: 1993277 - RNA, 20 nt, Shigella flexneri 2a str. 301
aauaaccaacggcgagccag

SEQ ID NO: 1993278 - RNA, 18 nt, Shigella flexneri 2a str. 301
aauaaccacaacggcaau

SEQ ID NO: 1993279 - RNA, 19 nt, Shigella flexneri 2a str. 301
aauaacugcuauucaccag

SEQ ID NO: 1993280 - RNA, 15 nt, Shigella flexneri 2a str. 301
aauaacugcuauuca

SEQ ID NO: 1993281 - RNA, 16 nt, Shigella flexneri 2a str. 301
aauaacccgcuguaaa

SEQ ID NO: 1993282 - RNA, 20 nt, Shigella flexneri 2a str. 301
aauaacccgcuguaaaugcu

SEQ ID NO: 1993283 - RNA, 11 nt, Shigella flexneri 2a str. 301
aauaacccuga

SEQ ID NO: 1993284 - RNA, 17 nt, Shigella flexneri 2a str. 301
aauaaggcuuucgugaa

SEQ ID NO: 1993285 - RNA, 13 nt, Shigella flexneri 2a str. 301
aauaagguuaauu

SEQ ID NO: 1993286 - RNA, 13 nt, Shigella flexneri 2a str. 301
aauaagcuuuuuc

SEQ ID NO: 1993287 - RNA, 22 nt, Shigella flexneri 2a str. 301
aauaagccccuuucgaaaucau

SEQ ID NO: 1993288 - RNA, 13 nt, Shigella flexneri 2a str. 301
aaaaauaacaaau

SEQ ID NO: 1993289 - RNA, 12 nt, Shigella flexneri 2a str. 301
aaaaauaaaugc

SEQ ID NO: 1993290 - RNA, 22 nt, Shigella flexneri 2a str. 301
aaaaaguugcagcgucaucaac

SEQ ID NO: 1993291 - RNA, 14 nt, Shigella flexneri 2a str. 301
aauaauuucauuua

SEQ ID NO: 1993292 - RNA, 15 nt, Shigella flexneri 2a str. 301
aauaauuuuaaauau

SEQ ID NO: 1993293 - RNA, 20 nt, Shigella flexneri 2a str. 301
aauaaugcgacaacagaaau

SEQ ID NO: 1993294 - RNA, 21 nt, Shigella flexneri 2a str. 301
aauaaugcgacaacagaaaua

SEQ ID NO: 1993295 - RNA, 15 nt, Shigella flexneri 2a str. 301
aauaauggccuuuuc

SEQ ID NO: 1993296 - RNA, 14 nt, Shigella flexneri 2a str. 301
aauaauggugaauu

SEQ ID NO: 1993297 - RNA, 13 nt, Shigella flexneri 2a str. 301
aauaaugcaaaaa

SEQ ID NO: 1993298 - RNA, 23 nt, Shigella flexneri 2a str. 301
aauaaugaucaguggaagacguu

SEQ ID NO: 1993299 - RNA, 13 nt, Shigella flexneri 2a str. 301
aauaaugcagauc

SEQ ID NO: 1993300 - RNA, 12 nt, Shigella flexneri 2a str. 301
aauaaugcagau

SEQ ID NO: 1993301 - RNA, 21 nt, Shigella flexneri 2a str. 301
aauaauacagcccagacaaau

SEQ ID NO: 1993302 - RNA, 13 nt, Shigella flexneri 2a str. 301
aauaauacacaca

SEQ ID NO: 1993303 - RNA, 16 nt, Shigella flexneri 2a str. 301
aauaauacacacauca

SEQ ID NO: 1993304 - RNA, 22 nt, Shigella flexneri 2a str. 301
aauaauacucagugaacaauua

SEQ ID NO: 1993305 - RNA, 17 nt, Shigella flexneri 2a str. 301
aauaccagccuucuuca

SEQ ID NO: 1993306 - RNA, 12 nt, Shigella flexneri 2a str. 301
aauaccagccuu

SEQ ID NO: 1993307 - RNA, 12 nt, Shigella flexneri 2a str. 301
aauacacccuga

SEQ ID NO: 1993308 - RNA, 17 nt, Shigella flexneri 2a str. 301
aauacaccaucauggaa

SEQ ID NO: 1993309 - RNA, 18 nt, Shigella flexneri 2a str. 301
aauacaccuauacuuuug

SEQ ID NO: 1993310 - RNA, 21 nt, Shigella flexneri 2a str. 301
aauacacuaacagaacaauaa

SEQ ID NO: 1993311 - RNA, 17 nt, Shigella flexneri 2a str. 301
aauacacuaacagaaca

SEQ ID NO: 1993312 - RNA, 12 nt, Shigella flexneri 2a str. 301
aaaaaugcccga

SEQ ID NO: 1993313 - RNA, 18 nt, Shigella flexneri 2a str. 301
aaaaaugcccgauaagca

SEQ ID NO: 1993314 - RNA, 14 nt, Shigella flexneri 2a str. 301
aauaccaucaccaa

SEQ ID NO: 1993315 - RNA, 17 nt, Shigella flexneri 2a str. 301
aauaccauggcucacca

SEQ ID NO: 1993316 - RNA, 19 nt, Shigella flexneri 2a str. 301
aauaccaucggcagcgcca

SEQ ID NO: 1993317 - RNA, 18 nt, Shigella flexneri 2a str. 301
aauaccaucggcagcgcc

SEQ ID NO: 1993318 - RNA, 13 nt, Shigella flexneri 2a str. 301
aaaaauggcuggc

SEQ ID NO: 1993319 - RNA, 12 nt, Shigella flexneri 2a str. 301
aaaaauggcugg

SEQ ID NO: 1993320 - RNA, 22 nt, Shigella flexneri 2a str. 301
aaaaauggccagacauuauaaa

SEQ ID NO: 1993321 - RNA, 22 nt, Shigella flexneri 2a str. 301
aauaccauggcucaccagcagc

SEQ ID NO: 1993322 - RNA, 15 nt, Shigella flexneri 2a str. 301
aauacccaaaaaaua

SEQ ID NO: 1993323 - RNA, 22 nt, Shigella flexneri 2a str. 301
aauacccaaaaaauagcaaagu

SEQ ID NO: 1993324 - RNA, 22 nt, Shigella flexneri 2a str. 301
aauaccguucauuaacgcccca

SEQ ID NO: 1993325 - RNA, 19 nt, Shigella flexneri 2a str. 301
aauagcggacacuaccauu

SEQ ID NO: 1993326 - RNA, 20 nt, Shigella flexneri 2a str. 301
aauagcggaaaucuccagau

SEQ ID NO: 1993327 - RNA, 22 nt, Shigella flexneri 2a str. 301
aauagccgccauacggaaaauc

SEQ ID NO: 1993328 - RNA, 21 nt, Shigella flexneri 2a str. 301
aauagcgugauuguggcaauc

SEQ ID NO: 1993329 - RNA, 19 nt, Shigella flexneri 2a str. 301
aauagcuaacgaaagaaca

SEQ ID NO: 1993330 - RNA, 23 nt, Shigella flexneri 2a str. 301
aauagcgccugcugcuguugcgu

SEQ ID NO: 1993331 - RNA, 17 nt, Shigella flexneri 2a str. 301
aauagcaacugauuuau

SEQ ID NO: 1993332 - RNA, 22 nt, Shigella flexneri 2a str. 301
aauagcaacugauuuauagauu

SEQ ID NO: 1993333 - RNA, 14 nt, Shigella flexneri 2a str. 301
aauagcaauauuuu

SEQ ID NO: 1993334 - RNA, 17 nt, Shigella flexneri 2a str. 301
aauagacacaagaaaua

SEQ ID NO: 1993335 - RNA, 14 nt, Shigella flexneri 2a str. 301
aauaccuucuuccu

SEQ ID NO: 1993336 - RNA, 18 nt, Shigella flexneri 2a str. 301
aauaccugaccguuaauu

SEQ ID NO: 1993337 - RNA, 15 nt, Shigella flexneri 2a str. 301
aauaccuuacacuca

SEQ ID NO: 1993338 - RNA, 15 nt, Shigella flexneri 2a str. 301
aauagcuucuucaac

SEQ ID NO: 1993339 - RNA, 22 nt, Shigella flexneri 2a str. 301
aauaggaaucauuguuauauca

SEQ ID NO: 1993340 - RNA, 14 nt, Shigella flexneri 2a str. 301
aauagugccgcacu

SEQ ID NO: 1993341 - RNA, 17 nt, Shigella flexneri 2a str. 301
aauaguccggaagaugc

SEQ ID NO: 1993342 - RNA, 22 nt, Shigella flexneri 2a str. 301
aauaguuauagccguaacugua

SEQ ID NO: 1993343 - RNA, 22 nt, Shigella flexneri 2a str. 301
aauagugcuuuuuacuaagagu

SEQ ID NO: 1993344 - RNA, 23 nt, Shigella flexneri 2a str. 301
aauauaaaacaacggaacgaaaa

SEQ ID NO: 1993345 - RNA, 15 nt, Shigella flexneri 2a str. 301
aauaguuucacgcug

SEQ ID NO: 1993346 - RNA, 22 nt, Shigella flexneri 2a str. 301
aauauauuccccggucagcagc

SEQ ID NO: 1993347 - RNA, 15 nt, Shigella flexneri 2a str. 301
aauaucaaauaaaaa

SEQ ID NO: 1993348 - RNA, 17 nt, Shigella flexneri 2a str. 301
aauauauaaaaaaacaa

SEQ ID NO: 1993349 - RNA, 13 nt, Shigella flexneri 2a str. 301
aauauauaaagau

SEQ ID NO: 1993350 - RNA, 14 nt, Shigella flexneri 2a str. 301
aauauauaauuaaa

SEQ ID NO: 1993351 - RNA, 21 nt, Shigella flexneri 2a str. 301
aauauaucagccugaaugcuu

SEQ ID NO: 1993352 - RNA, 23 nt, Shigella flexneri 2a str. 301
aauauauccccccaugaaauaaa

SEQ ID NO: 1993353 - RNA, 20 nt, Shigella flexneri 2a str. 301
aauauauccgaaaaaggaua

SEQ ID NO: 1993354 - RNA, 11 nt, Shigella flexneri 2a str. 301
aauauauccua

SEQ ID NO: 1993355 - RNA, 21 nt, Shigella flexneri 2a str. 301
aauauacagccuuaacaagau

SEQ ID NO: 1993356 - RNA, 15 nt, Shigella flexneri 2a str. 301
aauaucuuuucaggu

SEQ ID NO: 1993357 - RNA, 22 nt, Shigella flexneri 2a str. 301
aauaucuuucugccaccaguaa

SEQ ID NO: 1993358 - RNA, 11 nt, Shigella flexneri 2a str. 301
aauaucuuccu

SEQ ID NO: 1993359 - RNA, 16 nt, Shigella flexneri 2a str. 301
aauaucuuucauauuc

SEQ ID NO: 1993360 - RNA, 19 nt, Shigella flexneri 2a str. 301
aauaucugccggaagacac

SEQ ID NO: 1993361 - RNA, 21 nt, Shigella flexneri 2a str. 301
aauaucugccggaagacacau

SEQ ID NO: 1993362 - RNA, 17 nt, Shigella flexneri 2a str. 301
aauaucuguauaaccug

SEQ ID NO: 1993363 - RNA, 22 nt, Shigella flexneri 2a str. 301
aauaucguugauuguugcgcga

SEQ ID NO: 1993364 - RNA, 13 nt, Shigella flexneri 2a str. 301
aauaucguugauu

SEQ ID NO: 1993365 - RNA, 22 nt, Shigella flexneri 2a str. 301
aauaucuauauacaaucacacu

SEQ ID NO: 1993366 - RNA, 12 nt, Shigella flexneri 2a str. 301
aauaucuccucu

SEQ ID NO: 1993367 - RNA, 13 nt, Shigella flexneri 2a str. 301
aauaucuccucug

SEQ ID NO: 1993368 - RNA, 19 nt, Shigella flexneri 2a str. 301
aauaucgcggcacagaaac

SEQ ID NO: 1993369 - RNA, 18 nt, Shigella flexneri 2a str. 301
aauaucgcggcacagaaa

SEQ ID NO: 1993370 - RNA, 16 nt, Shigella flexneri 2a str. 301
aauaucgacauucaau

SEQ ID NO: 1993371 - RNA, 15 nt, Shigella flexneri 2a str. 301
aauaucgauaucgua

SEQ ID NO: 1993372 - RNA, 13 nt, Shigella flexneri 2a str. 301
aauaucaucauuu

SEQ ID NO: 1993373 - RNA, 21 nt, Shigella flexneri 2a str. 301
aauaucacucggggcuuuucu

SEQ ID NO: 1993374 - RNA, 13 nt, Shigella flexneri 2a str. 301
aauaucaaucuuc

SEQ ID NO: 1993375 - RNA, 15 nt, Shigella flexneri 2a str. 301
aauauccaacagguu

SEQ ID NO: 1993376 - RNA, 21 nt, Shigella flexneri 2a str. 301
aauauccguagugaaaaagcu

SEQ ID NO: 1993377 - RNA, 13 nt, Shigella flexneri 2a str. 301
aaguacauuaaaa

SEQ ID NO: 1993378 - RNA, 20 nt, Shigella flexneri 2a str. 301
aaguaccaucguccagcagc

SEQ ID NO: 1993379 - RNA, 20 nt, Shigella flexneri 2a str. 301
aaguacacauaaacagguaa

SEQ ID NO: 1993380 - RNA, 22 nt, Shigella flexneri 2a str. 301
aaguacacauaaacagguaaag

SEQ ID NO: 1993381 - RNA, 13 nt, Shigella flexneri 2a str. 301
aaguagaaauuau

SEQ ID NO: 1993382 - RNA, 20 nt, Shigella flexneri 2a str. 301
aaguagagcgaaacgaaagu

SEQ ID NO: 1993383 - RNA, 21 nt, Shigella flexneri 2a str. 301
aaguacucuuugaacagccag

SEQ ID NO: 1993384 - RNA, 18 nt, Shigella flexneri 2a str. 301
aaguacgauacagaagca

SEQ ID NO: 1993385 - RNA, 15 nt, Shigella flexneri 2a str. 301
aaguacgauacagaa

SEQ ID NO: 1993386 - RNA, 14 nt, Shigella flexneri 2a str. 301
aagggcuaacgugc

SEQ ID NO: 1993387 - RNA, 15 nt, Shigella flexneri 2a str. 301
aagggacaaaccaca

SEQ ID NO: 1993388 - RNA, 15 nt, Shigella flexneri 2a str. 301
aagggccuuaaguau

SEQ ID NO: 1993389 - RNA, 16 nt, Shigella flexneri 2a str. 301
aaguaaaccaccaguc

SEQ ID NO: 1993390 - RNA, 18 nt, Shigella flexneri 2a str. 301
aaguaaaggcacaagggu

SEQ ID NO: 1993391 - RNA, 18 nt, Shigella flexneri 2a str. 301
aaguaaaaaagaaggaaa

SEQ ID NO: 1993392 - RNA, 20 nt, Shigella flexneri 2a str. 301
aaguauugcgcaaauguuug

SEQ ID NO: 1993393 - RNA, 13 nt, Shigella flexneri 2a str. 301
aagucaaacuggu

SEQ ID NO: 1993394 - RNA, 17 nt, Shigella flexneri 2a str. 301
aaguagccuucaucaga

SEQ ID NO: 1993395 - RNA, 23 nt, Shigella flexneri 2a str. 301
aaguaguguagcacuugcagcuc

SEQ ID NO: 1993396 - RNA, 19 nt, Shigella flexneri 2a str. 301
aaguagugauuuuaauaaa

SEQ ID NO: 1993397 - RNA, 17 nt, Shigella flexneri 2a str. 301
aaguaguuccagcauga

SEQ ID NO: 1993398 - RNA, 18 nt, Shigella flexneri 2a str. 301
aaguauggaaaucaccca

SEQ ID NO: 1993399 - RNA, 16 nt, Shigella flexneri 2a str. 301
aaguaugcaauaacaa

SEQ ID NO: 1993400 - RNA, 17 nt, Shigella flexneri 2a str. 301
aaguauauaaaaaacaa

SEQ ID NO: 1993401 - RNA, 19 nt, Shigella flexneri 2a str. 301
aaguauccacacagacaau

SEQ ID NO: 1993402 - RNA, 22 nt, Shigella flexneri 2a str. 301
aaguccgaggaaggcacguaca

SEQ ID NO: 1993403 - RNA, 16 nt, Shigella flexneri 2a str. 301
aaguccauacugucuc

SEQ ID NO: 1993404 - RNA, 18 nt, Shigella flexneri 2a str. 301
aaguccguugaaaaugcu

SEQ ID NO: 1993405 - RNA, 17 nt, Shigella flexneri 2a str. 301
aaguccgguaauggaga

SEQ ID NO: 1993406 - RNA, 12 nt, Shigella flexneri 2a str. 301
aagucgaaccuu

SEQ ID NO: 1993407 - RNA, 14 nt, Shigella flexneri 2a str. 301
aagucauuccuuca

SEQ ID NO: 1993408 - RNA, 16 nt, Shigella flexneri 2a str. 301
aaguccaaaagguccu

SEQ ID NO: 1993409 - RNA, 20 nt, Shigella flexneri 2a str. 301
aaguccaaaagguccuucag

SEQ ID NO: 1993410 - RNA, 17 nt, Shigella flexneri 2a str. 301
aagucaggguauuaacc

SEQ ID NO: 1993411 - RNA, 17 nt, Shigella flexneri 2a str. 301
aagucucaauuaguaau

SEQ ID NO: 1993412 - RNA, 14 nt, Shigella flexneri 2a str. 301
aagucggucacagu

SEQ ID NO: 1993413 - RNA, 16 nt, Shigella flexneri 2a str. 301
aagucggucacagucu

SEQ ID NO: 1993414 - RNA, 14 nt, Shigella flexneri 2a str. 301
aagugaagaugaau

SEQ ID NO: 1993415 - RNA, 17 nt, Shigella flexneri 2a str. 301
aagugaauacagaacag

SEQ ID NO: 1993416 - RNA, 21 nt, Shigella flexneri 2a str. 301
aagucuuuuuucaacuuuauc

SEQ ID NO: 1993417 - RNA, 13 nt, Shigella flexneri 2a str. 301
aagucuuuguauu

SEQ ID NO: 1993418 - RNA, 16 nt, Shigella flexneri 2a str. 301
aagucuuuguauuuau

SEQ ID NO: 1993419 - RNA, 19 nt, Shigella flexneri 2a str. 301
aagucuuuuuucaacuuua

SEQ ID NO: 1993420 - RNA, 15 nt, Shigella flexneri 2a str. 301
aagucucagaaagua

SEQ ID NO: 1993421 - RNA, 16 nt, Shigella flexneri 2a str. 301
aagucucagaaaguaa

SEQ ID NO: 1993422 - RNA, 12 nt, Shigella flexneri 2a str. 301
aaguuacaaaaa

SEQ ID NO: 1993423 - RNA, 20 nt, Shigella flexneri 2a str. 301
aaguucaggguuaaaucuca

SEQ ID NO: 1993424 - RNA, 15 nt, Shigella flexneri 2a str. 301
aaggcagaaacaaac

SEQ ID NO: 1993425 - RNA, 20 nt, Shigella flexneri 2a str. 301
aaggcagccuuucucagaga

SEQ ID NO: 1993426 - RNA, 12 nt, Shigella flexneri 2a str. 301
aaggcagccuuu

SEQ ID NO: 1993427 - RNA, 19 nt, Shigella flexneri 2a str. 301
aaggcaccaauauugacug

SEQ ID NO: 1993428 - RNA, 13 nt, Shigella flexneri 2a str. 301
aaggccagaacca

SEQ ID NO: 1993429 - RNA, 22 nt, Shigella flexneri 2a str. 301
aaggccaacgaaaaauggggga

SEQ ID NO: 1993430 - RNA, 15 nt, Shigella flexneri 2a str. 301
aaggccagccaggca

SEQ ID NO: 1993431 - RNA, 12 nt, Shigella flexneri 2a str. 301
aaggcaguucag

SEQ ID NO: 1993432 - RNA, 12 nt, Shigella flexneri 2a str. 301
aaggcuucaacg

SEQ ID NO: 1993433 - RNA, 16 nt, Shigella flexneri 2a str. 301
aaggcugacaaaucag

SEQ ID NO: 1993434 - RNA, 15 nt, Shigella flexneri 2a str. 301
aaggcccuuccccuu

SEQ ID NO: 1993435 - RNA, 16 nt, Shigella flexneri 2a str. 301
aaggccgacagcaggc

SEQ ID NO: 1993436 - RNA, 23 nt, Shigella flexneri 2a str. 301
aaggccgacagcaggcucagaag

SEQ ID NO: 1993437 - RNA, 21 nt, Shigella flexneri 2a str. 301
aaggccggagaagaugcguca

SEQ ID NO: 1993438 - RNA, 20 nt, Shigella flexneri 2a str. 301
aaggccguuuucaacaccgc

SEQ ID NO: 1993439 - RNA, 23 nt, Shigella flexneri 2a str. 301
aaggaagccugacagggaaggga

SEQ ID NO: 1993440 - RNA, 20 nt, Shigella flexneri 2a str. 301
aaggacagugggauuaaaaa

SEQ ID NO: 1993441 - RNA, 13 nt, Shigella flexneri 2a str. 301
aaggauaugugaa

SEQ ID NO: 1993442 - RNA, 22 nt, Shigella flexneri 2a str. 301
aagcuggcgauauuauccccug

SEQ ID NO: 1993443 - RNA, 13 nt, Shigella flexneri 2a str. 301
aagcuggaagggu

SEQ ID NO: 1993444 - RNA, 18 nt, Shigella flexneri 2a str. 301
aagcuggcagaaguuguc

SEQ ID NO: 1993445 - RNA, 16 nt, Shigella flexneri 2a str. 301
aagcuggcagaaguug

SEQ ID NO: 1993446 - RNA, 13 nt, Shigella flexneri 2a str. 301
aagcuggcaaagu

SEQ ID NO: 1993447 - RNA, 14 nt, Shigella flexneri 2a str. 301
aagcuccaccaguu

SEQ ID NO: 1993448 - RNA, 21 nt, Shigella flexneri 2a str. 301
aaggaaauccugccgcaguuu

SEQ ID NO: 1993449 - RNA, 13 nt, Shigella flexneri 2a str. 301
aaggaacaagggu

SEQ ID NO: 1993450 - RNA, 15 nt, Shigella flexneri 2a str. 301
aagcggcguuuucag

SEQ ID NO: 1993451 - RNA, 15 nt, Shigella flexneri 2a str. 301
aagcgggugucccag

SEQ ID NO: 1993452 - RNA, 14 nt, Shigella flexneri 2a str. 301
aagcggugaaaaaa

SEQ ID NO: 1993453 - RNA, 21 nt, Shigella flexneri 2a str. 301
aagcggcguugcucuucuccg

SEQ ID NO: 1993454 - RNA, 15 nt, Shigella flexneri 2a str. 301
aagcggcgcucugcc

SEQ ID NO: 1993455 - RNA, 19 nt, Shigella flexneri 2a str. 301
aagcgcccgucacugaauc

SEQ ID NO: 1993456 - RNA, 23 nt, Shigella flexneri 2a str. 301
aagcgccagauaugaucgaaaau

SEQ ID NO: 1993457 - RNA, 15 nt, Shigella flexneri 2a str. 301
aagcgccucaagcuc

SEQ ID NO: 1993458 - RNA, 19 nt, Shigella flexneri 2a str. 301
aagcgccgccucagccaga

SEQ ID NO: 1993459 - RNA, 19 nt, Shigella flexneri 2a str. 301
aagcgccggacauugcguu

SEQ ID NO: 1993460 - RNA, 16 nt, Shigella flexneri 2a str. 301
aagcgccaaaucugcc

SEQ ID NO: 1993461 - RNA, 18 nt, Shigella flexneri 2a str. 301
aagcgcauccggcaccag

SEQ ID NO: 1993462 - RNA, 20 nt, Shigella flexneri 2a str. 301
aagcgcacuuuacuggucug

SEQ ID NO: 1993463 - RNA, 18 nt, Shigella flexneri 2a str. 301
aagcgcacuuugccagaa

SEQ ID NO: 1993464 - RNA, 15 nt, Shigella flexneri 2a str. 301
aagcgcagcgccccc

SEQ ID NO: 1993465 - RNA, 20 nt, Shigella flexneri 2a str. 301
aagcgaugguggugggggaa

SEQ ID NO: 1993466 - RNA, 17 nt, Shigella flexneri 2a str. 301
aagcgcacaauggcggu

SEQ ID NO: 1993467 - RNA, 14 nt, Shigella flexneri 2a str. 301
aagccggugaacgu

SEQ ID NO: 1993468 - RNA, 17 nt, Shigella flexneri 2a str. 301
aagccuaagaagucauu

SEQ ID NO: 1993469 - RNA, 22 nt, Shigella flexneri 2a str. 301
aagccguuagucaucaucagga

SEQ ID NO: 1993470 - RNA, 14 nt, Shigella flexneri 2a str. 301
aagccgugaaucac

SEQ ID NO: 1993471 - RNA, 17 nt, Shigella flexneri 2a str. 301
aagauccguaaugccug

SEQ ID NO: 1993472 - RNA, 18 nt, Shigella flexneri 2a str. 301
aagaucgacggcuuuuag

SEQ ID NO: 1993473 - RNA, 18 nt, Shigella flexneri 2a str. 301
aagcgacuuugccuggcg

SEQ ID NO: 1993474 - RNA, 15 nt, Shigella flexneri 2a str. 301
aagcgauaaccuuca

SEQ ID NO: 1993475 - RNA, 19 nt, Shigella flexneri 2a str. 301
aagcgagaguuacagcucu

SEQ ID NO: 1993476 - RNA, 19 nt, Shigella flexneri 2a str. 301
aagccuuuaccgcgcucga

SEQ ID NO: 1993477 - RNA, 13 nt, Shigella flexneri 2a str. 301
aagccuuucagga

SEQ ID NO: 1993478 - RNA, 16 nt, Shigella flexneri 2a str. 301
aagccuuuuaccgccu

SEQ ID NO: 1993479 - RNA, 18 nt, Shigella flexneri 2a str. 301
aagccuuccgcaaacagg

SEQ ID NO: 1993480 - RNA, 17 nt, Shigella flexneri 2a str. 301
aagccuucgccuuucag

SEQ ID NO: 1993481 - RNA, 23 nt, Shigella flexneri 2a str. 301
aagccugcccgugggcaggccug

SEQ ID NO: 1993482 - RNA, 15 nt, Shigella flexneri 2a str. 301
aagccugauaagcgu

SEQ ID NO: 1993483 - RNA, 21 nt, Shigella flexneri 2a str. 301
aauuuuuucacuguucugaua

SEQ ID NO: 1993484 - RNA, 17 nt, Shigella flexneri 2a str. 301
aauuuuuguuguuuaaa

SEQ ID NO: 1993485 - RNA, 16 nt, Shigella flexneri 2a str. 301
acaacggguuuggccg

SEQ ID NO: 1993486 - RNA, 18 nt, Shigella flexneri 2a str. 301
acaacguaucuugcguca

SEQ ID NO: 1993487 - RNA, 17 nt, Shigella flexneri 2a str. 301
acaacgcuuucaacaac

SEQ ID NO: 1993488 - RNA, 13 nt, Shigella flexneri 2a str. 301
acaacggaacgaa

SEQ ID NO: 1993489 - RNA, 17 nt, Shigella flexneri 2a str. 301
acaacggaacgaaaaaa

SEQ ID NO: 1993490 - RNA, 19 nt, Shigella flexneri 2a str. 301
acaacggaacgaaaaaaau

SEQ ID NO: 1993491 - RNA, 16 nt, Shigella flexneri 2a str. 301
acaacugaaaaaaaau

SEQ ID NO: 1993492 - RNA, 18 nt, Shigella flexneri 2a str. 301
acaacugaaaaaaaauua

SEQ ID NO: 1993493 - RNA, 15 nt, Shigella flexneri 2a str. 301
acaacugcauuuuca

SEQ ID NO: 1993494 - RNA, 21 nt, Shigella flexneri 2a str. 301
acaacucaucacuguaggcca

SEQ ID NO: 1993495 - RNA, 12 nt, Shigella flexneri 2a str. 301
acaacucaucac

SEQ ID NO: 1993496 - RNA, 15 nt, Shigella flexneri 2a str. 301
acaacgugugcuuug

SEQ ID NO: 1993497 - RNA, 17 nt, Shigella flexneri 2a str. 301
acaacgucgccaguccu

SEQ ID NO: 1993498 - RNA, 16 nt, Shigella flexneri 2a str. 301
acaacgucgccagucc

SEQ ID NO: 1993499 - RNA, 23 nt, Shigella flexneri 2a str. 301
acaacugcgaccguacaaccaaa

SEQ ID NO: 1993500 - RNA, 21 nt, Shigella flexneri 2a str. 301
acaacuucaacguugaauuuc

SEQ ID NO: 1993501 - RNA, 16 nt, Shigella flexneri 2a str. 301
acaacuuucaucagca

SEQ ID NO: 1993502 - RNA, 22 nt, Shigella flexneri 2a str. 301
acaagcauuaaggcaagaaaau

SEQ ID NO: 1993503 - RNA, 20 nt, Shigella flexneri 2a str. 301
acaagcccgcugccgcagau

SEQ ID NO: 1993504 - RNA, 17 nt, Shigella flexneri 2a str. 301
acaagaaucaugccaaa

SEQ ID NO: 1993505 - RNA, 23 nt, Shigella flexneri 2a str. 301
acaagaaugccugccagcuugcg

SEQ ID NO: 1993506 - RNA, 17 nt, Shigella flexneri 2a str. 301
acaagauacggaacugc

SEQ ID NO: 1993507 - RNA, 14 nt, Shigella flexneri 2a str. 301
acaagaucgcccug

SEQ ID NO: 1993508 - RNA, 17 nt, Shigella flexneri 2a str. 301
acaagaucgcccugagg

SEQ ID NO: 1993509 - RNA, 17 nt, Shigella flexneri 2a str. 301
acaauaauaucuuuuuu

SEQ ID NO: 1993510 - RNA, 17 nt, Shigella flexneri 2a str. 301
acaauaaucaccacaca

SEQ ID NO: 1993511 - RNA, 21 nt, Shigella flexneri 2a str. 301
acaauaaucaacgcgaaaaug

SEQ ID NO: 1993512 - RNA, 20 nt, Shigella flexneri 2a str. 301
acaaguccguugaaaaugcu

SEQ ID NO: 1993513 - RNA, 16 nt, Shigella flexneri 2a str. 301
acaaguauaucaaaca

SEQ ID NO: 1993514 - RNA, 16 nt, Shigella flexneri 2a str. 301
acaauaaacuggcugu

SEQ ID NO: 1993515 - RNA, 17 nt, Shigella flexneri 2a str. 301
acaagucuuuuuugguu

SEQ ID NO: 1993516 - RNA, 20 nt, Shigella flexneri 2a str. 301
acaauggucaacauucccug

SEQ ID NO: 1993517 - RNA, 21 nt, Shigella flexneri 2a str. 301
acaauggcauuuaucuucugg

SEQ ID NO: 1993518 - RNA, 21 nt, Shigella flexneri 2a str. 301
acaauggagcuaaacagcgcu

SEQ ID NO: 1993519 - RNA, 13 nt, Shigella flexneri 2a str. 301
acaaucugauaau

SEQ ID NO: 1993520 - RNA, 14 nt, Shigella flexneri 2a str. 301
acaaucucacccgc

SEQ ID NO: 1993521 - RNA, 12 nt, Shigella flexneri 2a str. 301
acaauaucaaau

SEQ ID NO: 1993522 - RNA, 14 nt, Shigella flexneri 2a str. 301
acaauauccagcgc

SEQ ID NO: 1993523 - RNA, 19 nt, Shigella flexneri 2a str. 301
acaauaucggcaccagcgc

SEQ ID NO: 1993524 - RNA, 22 nt, Shigella flexneri 2a str. 301
acaauuacugagagaaaaaaaa

SEQ ID NO: 1993525 - RNA, 16 nt, Shigella flexneri 2a str. 301
acacaauaccuucugc

SEQ ID NO: 1993526 - RNA, 19 nt, Shigella flexneri 2a str. 301
acacaauauugcggauaaa

SEQ ID NO: 1993527 - RNA, 14 nt, Shigella flexneri 2a str. 301
acacacauuuaucc

SEQ ID NO: 1993528 - RNA, 22 nt, Shigella flexneri 2a str. 301
acaauuucagaauagacaaaaa

SEQ ID NO: 1993529 - RNA, 23 nt, Shigella flexneri 2a str. 301
acaauuucgcacguauaaacauc

SEQ ID NO: 1993530 - RNA, 13 nt, Shigella flexneri 2a str. 301
acacacuuuccag

SEQ ID NO: 1993531 - RNA, 19 nt, Shigella flexneri 2a str. 301
acacacuuuuauuaacuca

SEQ ID NO: 1993532 - RNA, 15 nt, Shigella flexneri 2a str. 301
acacacuaucccaac

SEQ ID NO: 1993533 - RNA, 14 nt, Shigella flexneri 2a str. 301
acacagcacuauga

SEQ ID NO: 1993534 - RNA, 21 nt, Shigella flexneri 2a str. 301
acacagugaaucucuuaucau

SEQ ID NO: 1993535 - RNA, 19 nt, Shigella flexneri 2a str. 301
acacaguucuucaaaaaua

SEQ ID NO: 1993536 - RNA, 16 nt, Shigella flexneri 2a str. 301
acacagguaacuuaaa

SEQ ID NO: 1993537 - RNA, 19 nt, Shigella flexneri 2a str. 301
acacagcgacguaaaaaac

SEQ ID NO: 1993538 - RNA, 15 nt, Shigella flexneri 2a str. 301
acacaggcagcaauc

SEQ ID NO: 1993539 - RNA, 14 nt, Shigella flexneri 2a str. 301
acaccagagccugc

SEQ ID NO: 1993540 - RNA, 14 nt, Shigella flexneri 2a str. 301
acaccacugcgcau

SEQ ID NO: 1993541 - RNA, 17 nt, Shigella flexneri 2a str. 301
acaccacugcgcauaau

SEQ ID NO: 1993542 - RNA, 15 nt, Shigella flexneri 2a str. 301
acacauauauuaauu

SEQ ID NO: 1993543 - RNA, 19 nt, Shigella flexneri 2a str. 301
acacauaacgccaauucau

SEQ ID NO: 1993544 - RNA, 20 nt, Shigella flexneri 2a str. 301
acacauaaacagguaaagac

SEQ ID NO: 1993545 - RNA, 18 nt, Shigella flexneri 2a str. 301
acaccagcaguaaaccac

SEQ ID NO: 1993546 - RNA, 22 nt, Shigella flexneri 2a str. 301
acaccagcaguaaaccacccac

SEQ ID NO: 1993547 - RNA, 15 nt, Shigella flexneri 2a str. 301
acaccagcacaucau

SEQ ID NO: 1993548 - RNA, 17 nt, Shigella flexneri 2a str. 301
acaccagcacaucauca

SEQ ID NO: 1993549 - RNA, 15 nt, Shigella flexneri 2a str. 301
acaccaucuuccuca

SEQ ID NO: 1993550 - RNA, 21 nt, Shigella flexneri 2a str. 301
acaccauaaaacaaauccgcu

SEQ ID NO: 1993551 - RNA, 22 nt, Shigella flexneri 2a str. 301
acaccauaucuaugguuuuuuc

SEQ ID NO: 1993552 - RNA, 14 nt, Shigella flexneri 2a str. 301
acagcggaguaauc

SEQ ID NO: 1993553 - RNA, 17 nt, Shigella flexneri 2a str. 301
acagccgacaaugccac

SEQ ID NO: 1993554 - RNA, 15 nt, Shigella flexneri 2a str. 301
acagcgcgcugacau

SEQ ID NO: 1993555 - RNA, 22 nt, Shigella flexneri 2a str. 301
acagcgcgcgccgccaaucacg

SEQ ID NO: 1993556 - RNA, 15 nt, Shigella flexneri 2a str. 301
acagcgcgccagcca

SEQ ID NO: 1993557 - RNA, 18 nt, Shigella flexneri 2a str. 301
acagccccgaaaaagagc

SEQ ID NO: 1993558 - RNA, 14 nt, Shigella flexneri 2a str. 301
acaggauauauuuc

SEQ ID NO: 1993559 - RNA, 21 nt, Shigella flexneri 2a str. 301
acaggauauauuucaucaacu

SEQ ID NO: 1993560 - RNA, 19 nt, Shigella flexneri 2a str. 301
acaggacaucuugaauaug

SEQ ID NO: 1993561 - RNA, 18 nt, Shigella flexneri 2a str. 301
acagcuggaguagauaau

SEQ ID NO: 1993562 - RNA, 11 nt, Shigella flexneri 2a str. 301
acagcugggcg

SEQ ID NO: 1993563 - RNA, 15 nt, Shigella flexneri 2a str. 301
acagcuuagacagcg

SEQ ID NO: 1993564 - RNA, 19 nt, Shigella flexneri 2a str. 301
acagcuuaaucaccagcgc

SEQ ID NO: 1993565 - RNA, 23 nt, Shigella flexneri 2a str. 301
acagcggugauuuccgccgccag

SEQ ID NO: 1993566 - RNA, 18 nt, Shigella flexneri 2a str. 301
acagcucuugcuccacaa

SEQ ID NO: 1993567 - RNA, 22 nt, Shigella flexneri 2a str. 301
acagcucgguauggccuuucug

SEQ ID NO: 1993568 - RNA, 15 nt, Shigella flexneri 2a str. 301
acagcguguuaaugc

SEQ ID NO: 1993569 - RNA, 23 nt, Shigella flexneri 2a str. 301
acagagaaucgggaaauaacauc

SEQ ID NO: 1993570 - RNA, 20 nt, Shigella flexneri 2a str. 301
acagagaacaucaauccaaa

SEQ ID NO: 1993571 - RNA, 16 nt, Shigella flexneri 2a str. 301
acagagacgcacugcu

SEQ ID NO: 1993572 - RNA, 21 nt, Shigella flexneri 2a str. 301
acagagauuacuuuauuuaua

SEQ ID NO: 1993573 - RNA, 22 nt, Shigella flexneri 2a str. 301
acagagcaauaaaagaugguca

SEQ ID NO: 1993574 - RNA, 20 nt, Shigella flexneri 2a str. 301
acagaggguuuuuuaucuuc

SEQ ID NO: 1993575 - RNA, 16 nt, Shigella flexneri 2a str. 301
acagaggucuuuucuc

SEQ ID NO: 1993576 - RNA, 16 nt, Shigella flexneri 2a str. 301
acagagcgagggagaa

SEQ ID NO: 1993577 - RNA, 22 nt, Shigella flexneri 2a str. 301
acagaugcaggauuucuucacc

SEQ ID NO: 1993578 - RNA, 20 nt, Shigella flexneri 2a str. 301
acagauaggcaucagcaauu

SEQ ID NO: 1993579 - RNA, 20 nt, Shigella flexneri 2a str. 301
acagcacgaugaaucuguua

SEQ ID NO: 1993580 - RNA, 21 nt, Shigella flexneri 2a str. 301
acagcagaacucgaacccguc

SEQ ID NO: 1993581 - RNA, 14 nt, Shigella flexneri 2a str. 301
acagcagagcaugg

SEQ ID NO: 1993582 - RNA, 19 nt, Shigella flexneri 2a str. 301
acagcaguuguuuaauggc

SEQ ID NO: 1993583 - RNA, 21 nt, Shigella flexneri 2a str. 301
acagcauaccuucacagaagg

SEQ ID NO: 1993584 - RNA, 20 nt, Shigella flexneri 2a str. 301
acagcaucguccgccagccu

SEQ ID NO: 1993585 - RNA, 18 nt, Shigella flexneri 2a str. 301
acagauuuugccagcaug

SEQ ID NO: 1993586 - RNA, 14 nt, Shigella flexneri 2a str. 301
acagauuuugccag

SEQ ID NO: 1993587 - RNA, 12 nt, Shigella flexneri 2a str. 301
acagcaaaacac

SEQ ID NO: 1993588 - RNA, 14 nt, Shigella flexneri 2a str. 301
acagauucaggcgc

SEQ ID NO: 1993589 - RNA, 20 nt, Shigella flexneri 2a str. 301
acagauucgcuugucacuuc

SEQ ID NO: 1993590 - RNA, 12 nt, Shigella flexneri 2a str. 301
acagauucaggc

SEQ ID NO: 1993591 - RNA, 17 nt, Shigella flexneri 2a str. 301
acacuggcaaaaucaaa

SEQ ID NO: 1993592 - RNA, 13 nt, Shigella flexneri 2a str. 301
acacugcuuacag

SEQ ID NO: 1993593 - RNA, 22 nt, Shigella flexneri 2a str. 301
acacuggcauccccgcccuucc

SEQ ID NO: 1993594 - RNA, 18 nt, Shigella flexneri 2a str. 301
acacuguuaccgcugcug

SEQ ID NO: 1993595 - RNA, 18 nt, Shigella flexneri 2a str. 301
acacugaugacaggcuac

SEQ ID NO: 1993596 - RNA, 14 nt, Shigella flexneri 2a str. 301
acacugaugacagg

SEQ ID NO: 1993597 - RNA, 21 nt, Shigella flexneri 2a str. 301
acacugaaccgaaauggcugc

SEQ ID NO: 1993598 - RNA, 17 nt, Shigella flexneri 2a str. 301
acacugaauaaaaaugu

SEQ ID NO: 1993599 - RNA, 20 nt, Shigella flexneri 2a str. 301
acacugaauaaaaaugugca

SEQ ID NO: 1993600 - RNA, 20 nt, Shigella flexneri 2a str. 301
acacugacgcgucuuaucug

SEQ ID NO: 1993601 - RNA, 17 nt, Shigella flexneri 2a str. 301
acacucggcgcggaugc

SEQ ID NO: 1993602 - RNA, 20 nt, Shigella flexneri 2a str. 301
acacucuuccagucgccugc

SEQ ID NO: 1993603 - RNA, 14 nt, Shigella flexneri 2a str. 301
acacuauuuccuug

SEQ ID NO: 1993604 - RNA, 17 nt, Shigella flexneri 2a str. 301
acacuccagucccaguu

SEQ ID NO: 1993605 - RNA, 17 nt, Shigella flexneri 2a str. 301
acacccggagacaaaca

SEQ ID NO: 1993606 - RNA, 16 nt, Shigella flexneri 2a str. 301
acacuaccggaaccca

SEQ ID NO: 1993607 - RNA, 15 nt, Shigella flexneri 2a str. 301
acacguuaacaaugu

SEQ ID NO: 1993608 - RNA, 14 nt, Shigella flexneri 2a str. 301
acacuaacagaaca

SEQ ID NO: 1993609 - RNA, 20 nt, Shigella flexneri 2a str. 301
acacuaaccguuucuaauau

SEQ ID NO: 1993610 - RNA, 23 nt, Shigella flexneri 2a str. 301
acacuaaccguuucuaauauuag

SEQ ID NO: 1993611 - RNA, 18 nt, Shigella flexneri 2a str. 301
acacuaacgcgucuuauc

SEQ ID NO: 1993612 - RNA, 20 nt, Shigella flexneri 2a str. 301
acacuaacgcgucuuaucug

SEQ ID NO: 1993613 - RNA, 18 nt, Shigella flexneri 2a str. 301
acagaccgcgcaguacca

SEQ ID NO: 1993614 - RNA, 11 nt, Shigella flexneri 2a str. 301
acagacccagg

SEQ ID NO: 1993615 - RNA, 24 nt, Shigella flexneri 2a str. 301
acagaccaaaacgugcagcugccu

SEQ ID NO: 1993616 - RNA, 20 nt, Shigella flexneri 2a str. 301
acagacagccucaagcaccc

SEQ ID NO: 1993617 - RNA, 13 nt, Shigella flexneri 2a str. 301
acagacaguaaua

SEQ ID NO: 1993618 - RNA, 19 nt, Shigella flexneri 2a str. 301
acagacucaaaccaauggc

SEQ ID NO: 1993619 - RNA, 19 nt, Shigella flexneri 2a str. 301
acagaccuuucgaacccaa

SEQ ID NO: 1993620 - RNA, 20 nt, Shigella flexneri 2a str. 301
acagaccuuucgaacccaac

SEQ ID NO: 1993621 - RNA, 11 nt, Shigella flexneri 2a str. 301
acagacgacga

SEQ ID NO: 1993622 - RNA, 19 nt, Shigella flexneri 2a str. 301
acagacgagggaaaauaaa

SEQ ID NO: 1993623 - RNA, 19 nt, Shigella flexneri 2a str. 301
acagaagaaagcaaugaaa

SEQ ID NO: 1993624 - RNA, 17 nt, Shigella flexneri 2a str. 301
acagaagugaagcaugg

SEQ ID NO: 1993625 - RNA, 18 nt, Shigella flexneri 2a str. 301
acagaauauaagucaggg

SEQ ID NO: 1993626 - RNA, 21 nt, Shigella flexneri 2a str. 301
acagaauucccccauugaaac

SEQ ID NO: 1993627 - RNA, 17 nt, Shigella flexneri 2a str. 301
acagaaucugaaggaug

SEQ ID NO: 1993628 - RNA, 15 nt, Shigella flexneri 2a str. 301
acagaauggcaucug

SEQ ID NO: 1993629 - RNA, 19 nt, Shigella flexneri 2a str. 301
acagaaugcgggcgaaaac

SEQ ID NO: 1993630 - RNA, 12 nt, Shigella flexneri 2a str. 301
acagacaaacag

SEQ ID NO: 1993631 - RNA, 20 nt, Shigella flexneri 2a str. 301
acacuucacacacuuuuauu

SEQ ID NO: 1993632 - RNA, 15 nt, Shigella flexneri 2a str. 301
acacuucuucugucg

SEQ ID NO: 1993633 - RNA, 14 nt, Shigella flexneri 2a str. 301
acagaaaacucacg

SEQ ID NO: 1993634 - RNA, 18 nt, Shigella flexneri 2a str. 301
acacuuuuauuaacucag

SEQ ID NO: 1993635 - RNA, 15 nt, Shigella flexneri 2a str. 301
acagaaauucagcgu

SEQ ID NO: 1993636 - RNA, 20 nt, Shigella flexneri 2a str. 301
acagaaaugguaaagaaggc

SEQ ID NO: 1993637 - RNA, 16 nt, Shigella flexneri 2a str. 301
acagaaaugaaaaaau

SEQ ID NO: 1993638 - RNA, 19 nt, Shigella flexneri 2a str. 301
acagaaaugaaaaaauaga

SEQ ID NO: 1993639 - RNA, 14 nt, Shigella flexneri 2a str. 301
acauccaucugcuu

SEQ ID NO: 1993640 - RNA, 23 nt, Shigella flexneri 2a str. 301
acauccaugcacugcaacgccuu

SEQ ID NO: 1993641 - RNA, 14 nt, Shigella flexneri 2a str. 301
acauccaccgccac

SEQ ID NO: 1993642 - RNA, 14 nt, Shigella flexneri 2a str. 301
acaucauacggguc

SEQ ID NO: 1993643 - RNA, 22 nt, Shigella flexneri 2a str. 301
acaucagauaaucgccauccug

SEQ ID NO: 1993644 - RNA, 19 nt, Shigella flexneri 2a str. 301
acauauuuuuguugaaaua

SEQ ID NO: 1993645 - RNA, 19 nt, Shigella flexneri 2a str. 301
acaucaaauuacagcaccu

SEQ ID NO: 1993646 - RNA, 20 nt, Shigella flexneri 2a str. 301
acaucacuccauccagcaac

SEQ ID NO: 1993647 - RNA, 12 nt, Shigella flexneri 2a str. 301
acauauucacca

SEQ ID NO: 1993648 - RNA, 22 nt, Shigella flexneri 2a str. 301
acauauucgauacauucagaau

SEQ ID NO: 1993649 - RNA, 14 nt, Shigella flexneri 2a str. 301
acauauugcagcuu

SEQ ID NO: 1993650 - RNA, 20 nt, Shigella flexneri 2a str. 301
acauauaaccggcaacagaa

SEQ ID NO: 1993651 - RNA, 20 nt, Shigella flexneri 2a str. 301
acauauaucgaaaaaucgac

SEQ ID NO: 1993652 - RNA, 22 nt, Shigella flexneri 2a str. 301
acauauauuacaacguauuaua

SEQ ID NO: 1993653 - RNA, 14 nt, Shigella flexneri 2a str. 301
acauauaucgaaaa

SEQ ID NO: 1993654 - RNA, 16 nt, Shigella flexneri 2a str. 301
acauauccuucacaca

SEQ ID NO: 1993655 - RNA, 18 nt, Shigella flexneri 2a str. 301
acauaguagccagccaga

SEQ ID NO: 1993656 - RNA, 13 nt, Shigella flexneri 2a str. 301
acauagucaucau

SEQ ID NO: 1993657 - RNA, 18 nt, Shigella flexneri 2a str. 301
acauagguacagcaccaa

SEQ ID NO: 1993658 - RNA, 14 nt, Shigella flexneri 2a str. 301
acauagccaucccu

SEQ ID NO: 1993659 - RNA, 20 nt, Shigella flexneri 2a str. 301
acauagcguguugauuauaa

SEQ ID NO: 1993660 - RNA, 21 nt, Shigella flexneri 2a str. 301
acauacuuaaauaaugcuucu

SEQ ID NO: 1993661 - RNA, 19 nt, Shigella flexneri 2a str. 301
acaggcaaccgauagcugg

SEQ ID NO: 1993662 - RNA, 13 nt, Shigella flexneri 2a str. 301
acaggaugggcau

SEQ ID NO: 1993663 - RNA, 20 nt, Shigella flexneri 2a str. 301
acaggcaagcauaugacgaa

SEQ ID NO: 1993664 - RNA, 14 nt, Shigella flexneri 2a str. 301
acaggcagcuuaga

SEQ ID NO: 1993665 - RNA, 16 nt, Shigella flexneri 2a str. 301
acaggcagcuuagaaa

SEQ ID NO: 1993666 - RNA, 13 nt, Shigella flexneri 2a str. 301
acaggcagcugcc

SEQ ID NO: 1993667 - RNA, 15 nt, Shigella flexneri 2a str. 301
acauaccuaaaagca

SEQ ID NO: 1993668 - RNA, 17 nt, Shigella flexneri 2a str. 301
acauacagaucgugcau

SEQ ID NO: 1993669 - RNA, 12 nt, Shigella flexneri 2a str. 301
acauugcugcug

SEQ ID NO: 1993670 - RNA, 13 nt, Shigella flexneri 2a str. 301
acauugcugcuga

SEQ ID NO: 1993671 - RNA, 14 nt, Shigella flexneri 2a str. 301
acauugguaaucag

SEQ ID NO: 1993672 - RNA, 17 nt, Shigella flexneri 2a str. 301
acauugcaucugauaac

SEQ ID NO: 1993673 - RNA, 20 nt, Shigella flexneri 2a str. 301
acauugccguaauggucugc

SEQ ID NO: 1993674 - RNA, 21 nt, Shigella flexneri 2a str. 301
acauugccguaagcaacgcca

SEQ ID NO: 1993675 - RNA, 16 nt, Shigella flexneri 2a str. 301
acauugcaucugauaa

SEQ ID NO: 1993676 - RNA, 12 nt, Shigella flexneri 2a str. 301
acauucccauca

SEQ ID NO: 1993677 - RNA, 14 nt, Shigella flexneri 2a str. 301
acauuccacuuuca

SEQ ID NO: 1993678 - RNA, 20 nt, Shigella flexneri 2a str. 301
acauucgagaagcccauacc

SEQ ID NO: 1993679 - RNA, 23 nt, Shigella flexneri 2a str. 301
acauuccaggcccgcguggauaa

SEQ ID NO: 1993680 - RNA, 20 nt, Shigella flexneri 2a str. 301
acauuauuuuugcgacaguu

SEQ ID NO: 1993681 - RNA, 12 nt, Shigella flexneri 2a str. 301
acauucaaugau

SEQ ID NO: 1993682 - RNA, 19 nt, Shigella flexneri 2a str. 301
acauguucggcgguuuuuu

SEQ ID NO: 1993683 - RNA, 18 nt, Shigella flexneri 2a str. 301
acauguuuuccagcacau

SEQ ID NO: 1993684 - RNA, 21 nt, Shigella flexneri 2a str. 301
acauuaucgcgucuaaauuuu

SEQ ID NO: 1993685 - RNA, 14 nt, Shigella flexneri 2a str. 301
acauuaaauugaua

SEQ ID NO: 1993686 - RNA, 14 nt, Shigella flexneri 2a str. 301
acaugccacuggcc

SEQ ID NO: 1993687 - RNA, 22 nt, Shigella flexneri 2a str. 301
acaugcaguugauuacacaaau

SEQ ID NO: 1993688 - RNA, 21 nt, Shigella flexneri 2a str. 301
acaugauguggugcaaggaaa

SEQ ID NO: 1993689 - RNA, 22 nt, Shigella flexneri 2a str. 301
acaugauguggugcaaggaaau

SEQ ID NO: 1993690 - RNA, 15 nt, Shigella flexneri 2a str. 301
acaugauguggaucg

SEQ ID NO: 1993691 - RNA, 14 nt, Shigella flexneri 2a str. 301
acaugauaugccug

SEQ ID NO: 1993692 - RNA, 16 nt, Shigella flexneri 2a str. 301
acaugaguugcuggac

SEQ ID NO: 1993693 - RNA, 14 nt, Shigella flexneri 2a str. 301
acaugaguugcugg

SEQ ID NO: 1993694 - RNA, 17 nt, Shigella flexneri 2a str. 301
acaugaugaucuuauga

SEQ ID NO: 1993695 - RNA, 23 nt, Shigella flexneri 2a str. 301
acaugaugaucuuaugauguaaa

SEQ ID NO: 1993696 - RNA, 17 nt, Shigella flexneri 2a str. 301
acaugaugauggcuauc

SEQ ID NO: 1993697 - RNA, 22 nt, Shigella flexneri 2a str. 301
acauggcaaccgggucgauaaa

SEQ ID NO: 1993698 - RNA, 16 nt, Shigella flexneri 2a str. 301
acauguugaaucuucg

SEQ ID NO: 1993699 - RNA, 13 nt, Shigella flexneri 2a str. 301
acauguugcugac

SEQ ID NO: 1993700 - RNA, 21 nt, Shigella flexneri 2a str. 301
acauguucaaaaaaaucacau

SEQ ID NO: 1993701 - RNA, 14 nt, Shigella flexneri 2a str. 301
acaucuucaucauc

SEQ ID NO: 1993702 - RNA, 14 nt, Shigella flexneri 2a str. 301
acaucgccagaaau

SEQ ID NO: 1993703 - RNA, 13 nt, Shigella flexneri 2a str. 301
acaucgcauucga

SEQ ID NO: 1993704 - RNA, 20 nt, Shigella flexneri 2a str. 301
acaucgcauucgacauugaa

SEQ ID NO: 1993705 - RNA, 18 nt, Shigella flexneri 2a str. 301
acaugaaaauaaccauau

SEQ ID NO: 1993706 - RNA, 15 nt, Shigella flexneri 2a str. 301
acaucuuugcggcua

SEQ ID NO: 1993707 - RNA, 17 nt, Shigella flexneri 2a str. 301
acaucgauaagguuaug

SEQ ID NO: 1993708 - RNA, 14 nt, Shigella flexneri 2a str. 301
acaucgcaauccuu

SEQ ID NO: 1993709 - RNA, 23 nt, Shigella flexneri 2a str. 301
acaucccagcagagaucuuucac

SEQ ID NO: 1993710 - RNA, 19 nt, Shigella flexneri 2a str. 301
acaucccgcgaacgagaau

SEQ ID NO: 1993711 - RNA, 18 nt, Shigella flexneri 2a str. 301
acauccgaggacagcauc

SEQ ID NO: 1993712 - RNA, 24 nt, Shigella flexneri 2a str. 301
accaacggacgagucgcuucaugc

SEQ ID NO: 1993713 - RNA, 19 nt, Shigella flexneri 2a str. 301
accaacggcgagccagcgc

SEQ ID NO: 1993714 - RNA, 23 nt, Shigella flexneri 2a str. 301
accaacggucgugcgagauaacc

SEQ ID NO: 1993715 - RNA, 13 nt, Shigella flexneri 2a str. 301
accaacgaggaga

SEQ ID NO: 1993716 - RNA, 23 nt, Shigella flexneri 2a str. 301
accaacgcaccggcuuguugccc

SEQ ID NO: 1993717 - RNA, 17 nt, Shigella flexneri 2a str. 301
accaauaacuacggcuc

SEQ ID NO: 1993718 - RNA, 16 nt, Shigella flexneri 2a str. 301
accaagucucaagagu

SEQ ID NO: 1993719 - RNA, 14 nt, Shigella flexneri 2a str. 301
accaagcgauuaug

SEQ ID NO: 1993720 - RNA, 17 nt, Shigella flexneri 2a str. 301
accaaucggcagaacgg

SEQ ID NO: 1993721 - RNA, 17 nt, Shigella flexneri 2a str. 301
accaaucucccagccgg

SEQ ID NO: 1993722 - RNA, 18 nt, Shigella flexneri 2a str. 301
accaaucgcgggcaacgu

SEQ ID NO: 1993723 - RNA, 20 nt, Shigella flexneri 2a str. 301
accaaucgcggcgauaucca

SEQ ID NO: 1993724 - RNA, 16 nt, Shigella flexneri 2a str. 301
accaauaucaaauaaa

SEQ ID NO: 1993725 - RNA, 23 nt, Shigella flexneri 2a str. 301
accaaucgcaauaccggcaaaga

SEQ ID NO: 1993726 - RNA, 21 nt, Shigella flexneri 2a str. 301
accaaugaaagccccaccagc

SEQ ID NO: 1993727 - RNA, 16 nt, Shigella flexneri 2a str. 301
accaaugccgcggcgc

SEQ ID NO: 1993728 - RNA, 14 nt, Shigella flexneri 2a str. 301
accaaugccgcggc

SEQ ID NO: 1993729 - RNA, 18 nt, Shigella flexneri 2a str. 301
accaauaccaaugaccag

SEQ ID NO: 1993730 - RNA, 14 nt, Shigella flexneri 2a str. 301
accaauaccaauga

SEQ ID NO: 1993731 - RNA, 22 nt, Shigella flexneri 2a str. 301
accaauaccgcccaccaccagc

SEQ ID NO: 1993732 - RNA, 23 nt, Shigella flexneri 2a str. 301
accaauagcccaugcaucggcca

SEQ ID NO: 1993733 - RNA, 12 nt, Shigella flexneri 2a str. 301
accaauaauccc

SEQ ID NO: 1993734 - RNA, 15 nt, Shigella flexneri 2a str. 301
accaaucaccgccac

SEQ ID NO: 1993735 - RNA, 20 nt, Shigella flexneri 2a str. 301
accaauauaauuccauucac

SEQ ID NO: 1993736 - RNA, 16 nt, Shigella flexneri 2a str. 301
accaaugucgaaagcc

SEQ ID NO: 1993737 - RNA, 13 nt, Shigella flexneri 2a str. 301
accaauggcuuuu

SEQ ID NO: 1993738 - RNA, 16 nt, Shigella flexneri 2a str. 301
accacacccgcaagac

SEQ ID NO: 1993739 - RNA, 20 nt, Shigella flexneri 2a str. 301
accacacccgcaagacgaac

SEQ ID NO: 1993740 - RNA, 15 nt, Shigella flexneri 2a str. 301
accacaauugaccag

SEQ ID NO: 1993741 - RNA, 12 nt, Shigella flexneri 2a str. 301
accacaaaagcg

SEQ ID NO: 1993742 - RNA, 16 nt, Shigella flexneri 2a str. 301
accaccaaugucgaaa

SEQ ID NO: 1993743 - RNA, 13 nt, Shigella flexneri 2a str. 301
accaccaccgcag

SEQ ID NO: 1993744 - RNA, 15 nt, Shigella flexneri 2a str. 301
accacaucgcaaaau

SEQ ID NO: 1993745 - RNA, 21 nt, Shigella flexneri 2a str. 301
accacaccggaccagacgauc

SEQ ID NO: 1993746 - RNA, 19 nt, Shigella flexneri 2a str. 301
accacaccggaccagacga

SEQ ID NO: 1993747 - RNA, 15 nt, Shigella flexneri 2a str. 301
accacacgaauucca

SEQ ID NO: 1993748 - RNA, 14 nt, Shigella flexneri 2a str. 301
accacacuucuuca

SEQ ID NO: 1993749 - RNA, 21 nt, Shigella flexneri 2a str. 301
accacagaccggacugacucc

SEQ ID NO: 1993750 - RNA, 20 nt, Shigella flexneri 2a str. 301
accacaggccggagccagcc

SEQ ID NO: 1993751 - RNA, 16 nt, Shigella flexneri 2a str. 301
accacaguaacgccug

SEQ ID NO: 1993752 - RNA, 18 nt, Shigella flexneri 2a str. 301
accacagugacccgcagc

SEQ ID NO: 1993753 - RNA, 16 nt, Shigella flexneri 2a str. 301
accacggccuuccucg

SEQ ID NO: 1993754 - RNA, 21 nt, Shigella flexneri 2a str. 301
accacguaccacggcauuucc

SEQ ID NO: 1993755 - RNA, 14 nt, Shigella flexneri 2a str. 301
accacguugacaaa

SEQ ID NO: 1993756 - RNA, 16 nt, Shigella flexneri 2a str. 301
accacguucauuucau

SEQ ID NO: 1993757 - RNA, 15 nt, Shigella flexneri 2a str. 301
accacguccagagug

SEQ ID NO: 1993758 - RNA, 18 nt, Shigella flexneri 2a str. 301
accacgcuccaucauguc

SEQ ID NO: 1993759 - RNA, 15 nt, Shigella flexneri 2a str. 301
accacggcagcaacu

SEQ ID NO: 1993760 - RNA, 17 nt, Shigella flexneri 2a str. 301
accacggccacagccag

SEQ ID NO: 1993761 - RNA, 13 nt, Shigella flexneri 2a str. 301
accacgcgggcca

SEQ ID NO: 1993762 - RNA, 18 nt, Shigella flexneri 2a str. 301
accacgccugccgccagc

SEQ ID NO: 1993763 - RNA, 14 nt, Shigella flexneri 2a str. 301
accacgauauguuc

SEQ ID NO: 1993764 - RNA, 14 nt, Shigella flexneri 2a str. 301
accacgcagcagcc

SEQ ID NO: 1993765 - RNA, 13 nt, Shigella flexneri 2a str. 301
accacuucaugcc

SEQ ID NO: 1993766 - RNA, 14 nt, Shigella flexneri 2a str. 301
accacuucacccgc

SEQ ID NO: 1993767 - RNA, 15 nt, Shigella flexneri 2a str. 301
accacuuaauuauua

SEQ ID NO: 1993768 - RNA, 13 nt, Shigella flexneri 2a str. 301
accacuucacccg

SEQ ID NO: 1993769 - RNA, 16 nt, Shigella flexneri 2a str. 301
accacugcgcauaauc

SEQ ID NO: 1993770 - RNA, 19 nt, Shigella flexneri 2a str. 301
accacuugcagaccaaggu

SEQ ID NO: 1993771 - RNA, 20 nt, Shigella flexneri 2a str. 301
accacuuccacguuccccag

SEQ ID NO: 1993772 - RNA, 14 nt, Shigella flexneri 2a str. 301
accacuuccugcuc

SEQ ID NO: 1993773 - RNA, 20 nt, Shigella flexneri 2a str. 301
accacguuuuucaauucacg

SEQ ID NO: 1993774 - RNA, 13 nt, Shigella flexneri 2a str. 301
accacguuuuuca

SEQ ID NO: 1993775 - RNA, 18 nt, Shigella flexneri 2a str. 301
accacucugaccugacaa

SEQ ID NO: 1993776 - RNA, 22 nt, Shigella flexneri 2a str. 301
accacugacacaggcagcaauc

SEQ ID NO: 1993777 - RNA, 22 nt, Shigella flexneri 2a str. 301
accacugcgacgcggcgguucu

SEQ ID NO: 1993778 - RNA, 19 nt, Shigella flexneri 2a str. 301
accacugccagauucucca

SEQ ID NO: 1993779 - RNA, 17 nt, Shigella flexneri 2a str. 301
accaccgcaaucgccag

SEQ ID NO: 1993780 - RNA, 19 nt, Shigella flexneri 2a str. 301
accaccgauauugccaccu

SEQ ID NO: 1993781 - RNA, 21 nt, Shigella flexneri 2a str. 301
accaccgaugaucaacagcau

SEQ ID NO: 1993782 - RNA, 21 nt, Shigella flexneri 2a str. 301
accaccgaugcacagcacgcu

SEQ ID NO: 1993783 - RNA, 15 nt, Shigella flexneri 2a str. 301
accacccguaaucac

SEQ ID NO: 1993784 - RNA, 15 nt, Shigella flexneri 2a str. 301
accacccgcagugau

SEQ ID NO: 1993785 - RNA, 15 nt, Shigella flexneri 2a str. 301
accaccagcagcugc

SEQ ID NO: 1993786 - RNA, 20 nt, Shigella flexneri 2a str. 301
accaccagacgcaacagaaa

SEQ ID NO: 1993787 - RNA, 13 nt, Shigella flexneri 2a str. 301
accaccagcacac

SEQ ID NO: 1993788 - RNA, 15 nt, Shigella flexneri 2a str. 301
accaccagcaauaau

SEQ ID NO: 1993789 - RNA, 16 nt, Shigella flexneri 2a str. 301
accaccagcaauaaua

SEQ ID NO: 1993790 - RNA, 18 nt, Shigella flexneri 2a str. 301
accaccagcggaauauca

SEQ ID NO: 1993791 - RNA, 19 nt, Shigella flexneri 2a str. 301
accaccaguaaauugucgc

SEQ ID NO: 1993792 - RNA, 14 nt, Shigella flexneri 2a str. 301
accacccaccagcg

SEQ ID NO: 1993793 - RNA, 19 nt, Shigella flexneri 2a str. 301
accaccauauucgccaccg

SEQ ID NO: 1993794 - RNA, 14 nt, Shigella flexneri 2a str. 301
accacgaaaacagc

SEQ ID NO: 1993795 - RNA, 19 nt, Shigella flexneri 2a str. 301
accaccugauugcugcugc

SEQ ID NO: 1993796 - RNA, 17 nt, Shigella flexneri 2a str. 301
accacgaagcaauggcg

SEQ ID NO: 1993797 - RNA, 17 nt, Shigella flexneri 2a str. 301
accaccggacgcacacg

SEQ ID NO: 1993798 - RNA, 23 nt, Shigella flexneri 2a str. 301
accaccggauguagcaacggagg

SEQ ID NO: 1993799 - RNA, 15 nt, Shigella flexneri 2a str. 301
accaccuccacgccc

SEQ ID NO: 1993800 - RNA, 12 nt, Shigella flexneri 2a str. 301
accaccuccacg

SEQ ID NO: 1993801 - RNA, 16 nt, Shigella flexneri 2a str. 301
accaccguuuucccgc

SEQ ID NO: 1993802 - RNA, 19 nt, Shigella flexneri 2a str. 301
aauuucacaccaucaacaa

SEQ ID NO: 1993803 - RNA, 12 nt, Shigella flexneri 2a str. 301
aauuucacacca

SEQ ID NO: 1993804 - RNA, 17 nt, Shigella flexneri 2a str. 301
aauuucacguucaccca

SEQ ID NO: 1993805 - RNA, 13 nt, Shigella flexneri 2a str. 301
aauuucacuugcu

SEQ ID NO: 1993806 - RNA, 17 nt, Shigella flexneri 2a str. 301
aauuucagcguccugcc

SEQ ID NO: 1993807 - RNA, 18 nt, Shigella flexneri 2a str. 301
aauuucagcgccugauac

SEQ ID NO: 1993808 - RNA, 20 nt, Shigella flexneri 2a str. 301
aauuucagcaagacaauguu

SEQ ID NO: 1993809 - RNA, 17 nt, Shigella flexneri 2a str. 301
aauuucaucgccgguaa

SEQ ID NO: 1993810 - RNA, 18 nt, Shigella flexneri 2a str. 301
aauuucaucgcuacacca

SEQ ID NO: 1993811 - RNA, 21 nt, Shigella flexneri 2a str. 301
aauuucaucgcuacaccaauc

SEQ ID NO: 1993812 - RNA, 14 nt, Shigella flexneri 2a str. 301
aauuucauuuugau

SEQ ID NO: 1993813 - RNA, 13 nt, Shigella flexneri 2a str. 301
aauuuccauugcu

SEQ ID NO: 1993814 - RNA, 17 nt, Shigella flexneri 2a str. 301
aauuuccagaaagugag

SEQ ID NO: 1993815 - RNA, 21 nt, Shigella flexneri 2a str. 301
aauuucugugcagccaaaaau

SEQ ID NO: 1993816 - RNA, 22 nt, Shigella flexneri 2a str. 301
aauuucugugcagccaaaaaug

SEQ ID NO: 1993817 - RNA, 18 nt, Shigella flexneri 2a str. 301
aauuucuucccuuucugc

SEQ ID NO: 1993818 - RNA, 19 nt, Shigella flexneri 2a str. 301
aauuucuucugguuucagu

SEQ ID NO: 1993819 - RNA, 18 nt, Shigella flexneri 2a str. 301
aauuucuuaccacugccg

SEQ ID NO: 1993820 - RNA, 18 nt, Shigella flexneri 2a str. 301
aauuucuccuucacucua

SEQ ID NO: 1993821 - RNA, 18 nt, Shigella flexneri 2a str. 301
aauuuccgccaccugauc

SEQ ID NO: 1993822 - RNA, 19 nt, Shigella flexneri 2a str. 301
aauuuacguuuuaaaccua

SEQ ID NO: 1993823 - RNA, 13 nt, Shigella flexneri 2a str. 301
aauuuacccgguu

SEQ ID NO: 1993824 - RNA, 13 nt, Shigella flexneri 2a str. 301
aauuuaacaccau

SEQ ID NO: 1993825 - RNA, 16 nt, Shigella flexneri 2a str. 301
aauugcguaaagccug

SEQ ID NO: 1993826 - RNA, 22 nt, Shigella flexneri 2a str. 301
aauugcguaaagccugcuggca

SEQ ID NO: 1993827 - RNA, 17 nt, Shigella flexneri 2a str. 301
aauugcucccugaauaa

SEQ ID NO: 1993828 - RNA, 22 nt, Shigella flexneri 2a str. 301
aauugcucaguacaggccgcac

SEQ ID NO: 1993829 - RNA, 22 nt, Shigella flexneri 2a str. 301
aauuuagcgccacgggcaauaa

SEQ ID NO: 1993830 - RNA, 18 nt, Shigella flexneri 2a str. 301
aauuuaucgcauauccuc

SEQ ID NO: 1993831 - RNA, 15 nt, Shigella flexneri 2a str. 301
aauuuauguuuccuu

SEQ ID NO: 1993832 - RNA, 11 nt, Shigella flexneri 2a str. 301
aauuuauguuu

SEQ ID NO: 1993833 - RNA, 18 nt, Shigella flexneri 2a str. 301
aauuuuauguuucgcauc

SEQ ID NO: 1993834 - RNA, 17 nt, Shigella flexneri 2a str. 301
aauuuuaggaugcugca

SEQ ID NO: 1993835 - RNA, 15 nt, Shigella flexneri 2a str. 301
aauuuuaggaugcug

SEQ ID NO: 1993836 - RNA, 20 nt, Shigella flexneri 2a str. 301
aauuuuccuugaaaaagagg

SEQ ID NO: 1993837 - RNA, 19 nt, Shigella flexneri 2a str. 301
aauuuuccuugaaaaagag

SEQ ID NO: 1993838 - RNA, 13 nt, Shigella flexneri 2a str. 301
aauuuucaucagu

SEQ ID NO: 1993839 - RNA, 14 nt, Shigella flexneri 2a str. 301
aauuuuuauuauuu

SEQ ID NO: 1993840 - RNA, 14 nt, Shigella flexneri 2a str. 301
aauuuugugcagca

SEQ ID NO: 1993841 - RNA, 13 nt, Shigella flexneri 2a str. 301
aauuuucucuuuc

SEQ ID NO: 1993842 - RNA, 22 nt, Shigella flexneri 2a str. 301
aauuugccguuaaucccagacu

SEQ ID NO: 1993843 - RNA, 20 nt, Shigella flexneri 2a str. 301
aauuugcgcucaauaaucaa

SEQ ID NO: 1993844 - RNA, 14 nt, Shigella flexneri 2a str. 301
aauuugaucaaaua

SEQ ID NO: 1993845 - RNA, 14 nt, Shigella flexneri 2a str. 301
aauuugaggaagcu

SEQ ID NO: 1993846 - RNA, 13 nt, Shigella flexneri 2a str. 301
aauuugaggaagc

SEQ ID NO: 1993847 - RNA, 12 nt, Shigella flexneri 2a str. 301
aauuuuaaauau

SEQ ID NO: 1993848 - RNA, 22 nt, Shigella flexneri 2a str. 301
aauuuuaaauaucaucaaaauu

SEQ ID NO: 1993849 - RNA, 17 nt, Shigella flexneri 2a str. 301
aauuuguuggcgaaaau

SEQ ID NO: 1993850 - RNA, 12 nt, Shigella flexneri 2a str. 301
aauuuguaacug

SEQ ID NO: 1993851 - RNA, 17 nt, Shigella flexneri 2a str. 301
aauuuguccaccaauag

SEQ ID NO: 1993852 - RNA, 14 nt, Shigella flexneri 2a str. 301
aauuaguaaugaua

SEQ ID NO: 1993853 - RNA, 12 nt, Shigella flexneri 2a str. 301
aauuaugcagcc

SEQ ID NO: 1993854 - RNA, 18 nt, Shigella flexneri 2a str. 301
aauuaugccgaucaucau

SEQ ID NO: 1993855 - RNA, 21 nt, Shigella flexneri 2a str. 301
aauuacucccgugccagagca

SEQ ID NO: 1993856 - RNA, 18 nt, Shigella flexneri 2a str. 301
aauuacugagagaaaaaa

SEQ ID NO: 1993857 - RNA, 21 nt, Shigella flexneri 2a str. 301
aauuacugagagaaaaaaaag

SEQ ID NO: 1993858 - RNA, 22 nt, Shigella flexneri 2a str. 301
aauuacugagagaaaaaaaagc

SEQ ID NO: 1993859 - RNA, 23 nt, Shigella flexneri 2a str. 301
aauuacugagagaaaaaaaagca

SEQ ID NO: 1993860 - RNA, 24 nt, Shigella flexneri 2a str. 301
aauuacugagagaaaaaaaagcau

SEQ ID NO: 1993861 - RNA, 13 nt, Shigella flexneri 2a str. 301
aauuacugagcaa

SEQ ID NO: 1993862 - RNA, 15 nt, Shigella flexneri 2a str. 301
aauuacugcuuaaau

SEQ ID NO: 1993863 - RNA, 18 nt, Shigella flexneri 2a str. 301
aauuacugggaugugaaa

SEQ ID NO: 1993864 - RNA, 19 nt, Shigella flexneri 2a str. 301
aauuacugggaugugaaaa

SEQ ID NO: 1993865 - RNA, 21 nt, Shigella flexneri 2a str. 301
aauuacugccuugaugaaaaa

SEQ ID NO: 1993866 - RNA, 22 nt, Shigella flexneri 2a str. 301
aauuacugccuugaugaaaaaa

SEQ ID NO: 1993867 - RNA, 18 nt, Shigella flexneri 2a str. 301
aauuacugccuugaugaa

SEQ ID NO: 1993868 - RNA, 18 nt, Shigella flexneri 2a str. 301
aauuagcacgauuuugua

SEQ ID NO: 1993869 - RNA, 17 nt, Shigella flexneri 2a str. 301
aauuagcaauauuuuua

SEQ ID NO: 1993870 - RNA, 15 nt, Shigella flexneri 2a str. 301
aauggugagauggcc

SEQ ID NO: 1993871 - RNA, 13 nt, Shigella flexneri 2a str. 301
aaugguagccgcc

SEQ ID NO: 1993872 - RNA, 19 nt, Shigella flexneri 2a str. 301
aauuacacagcgacguaaa

SEQ ID NO: 1993873 - RNA, 17 nt, Shigella flexneri 2a str. 301
aauuacacccuuaauca

SEQ ID NO: 1993874 - RNA, 21 nt, Shigella flexneri 2a str. 301
aauuacccuuuauuuucuggg

SEQ ID NO: 1993875 - RNA, 22 nt, Shigella flexneri 2a str. 301
aauuacccuuuauuuucuggga

SEQ ID NO: 1993876 - RNA, 17 nt, Shigella flexneri 2a str. 301
aauuaccagccagacac

SEQ ID NO: 1993877 - RNA, 21 nt, Shigella flexneri 2a str. 301
aauuacgcaggcaauccauaa

SEQ ID NO: 1993878 - RNA, 20 nt, Shigella flexneri 2a str. 301
aauuaccugucgccagagcg

SEQ ID NO: 1993879 - RNA, 22 nt, Shigella flexneri 2a str. 301
aauuaccgcaccaccagcagcu

SEQ ID NO: 1993880 - RNA, 19 nt, Shigella flexneri 2a str. 301
aauuaccgcaccaccagca

SEQ ID NO: 1993881 - RNA, 21 nt, Shigella flexneri 2a str. 301
aauuaauccuuucgaaaaacc

SEQ ID NO: 1993882 - RNA, 23 nt, Shigella flexneri 2a str. 301
aauugcgagccuguaccacaacc

SEQ ID NO: 1993883 - RNA, 12 nt, Shigella flexneri 2a str. 301
aauugcagauac

SEQ ID NO: 1993884 - RNA, 21 nt, Shigella flexneri 2a str. 301
aauugauuuucgaaaaaaaag

SEQ ID NO: 1993885 - RNA, 23 nt, Shigella flexneri 2a str. 301
aauugauuuucgaaaaaaaagaa

SEQ ID NO: 1993886 - RNA, 13 nt, Shigella flexneri 2a str. 301
aaaacaaaaaccg

SEQ ID NO: 1993887 - RNA, 14 nt, Shigella flexneri 2a str. 301
aauugacaguuuau

SEQ ID NO: 1993888 - RNA, 16 nt, Shigella flexneri 2a str. 301
aauugaagguuuaaua

SEQ ID NO: 1993889 - RNA, 15 nt, Shigella flexneri 2a str. 301
aauugaagguuuaau

SEQ ID NO: 1993890 - RNA, 15 nt, Shigella flexneri 2a str. 301
aauucuguaauccuc

SEQ ID NO: 1993891 - RNA, 14 nt, Shigella flexneri 2a str. 301
aauucuacagaaau

SEQ ID NO: 1993892 - RNA, 12 nt, Shigella flexneri 2a str. 301
aauucuacagaa

SEQ ID NO: 1993893 - RNA, 13 nt, Shigella flexneri 2a str. 301
aauucuaaaacgg

SEQ ID NO: 1993894 - RNA, 23 nt, Shigella flexneri 2a str. 301
aauucggauggcgauacucugcc

SEQ ID NO: 1993895 - RNA, 23 nt, Shigella flexneri 2a str. 301
aauucgcgucggcgucagcgcca

SEQ ID NO: 1993896 - RNA, 20 nt, Shigella flexneri 2a str. 301
aauucguaaguacauuaaaa

SEQ ID NO: 1993897 - RNA, 16 nt, Shigella flexneri 2a str. 301
aauucaagacaucaau

SEQ ID NO: 1993898 - RNA, 18 nt, Shigella flexneri 2a str. 301
aauucaacgcguuuuuuc

SEQ ID NO: 1993899 - RNA, 23 nt, Shigella flexneri 2a str. 301
aauucaaacaguucuggaagaga

SEQ ID NO: 1993900 - RNA, 14 nt, Shigella flexneri 2a str. 301
aauuccgaacaaaa

SEQ ID NO: 1993901 - RNA, 16 nt, Shigella flexneri 2a str. 301
aauuccuaugcaacaa

SEQ ID NO: 1993902 - RNA, 21 nt, Shigella flexneri 2a str. 301
aauuccggcuugguguggaua

SEQ ID NO: 1993903 - RNA, 22 nt, Shigella flexneri 2a str. 301
aauuccggcuuguucaucacca

SEQ ID NO: 1993904 - RNA, 23 nt, Shigella flexneri 2a str. 301
aauuccggcuuguucaucaccau

SEQ ID NO: 1993905 - RNA, 18 nt, Shigella flexneri 2a str. 301
aaugaacgccaccccaca

SEQ ID NO: 1993906 - RNA, 14 nt, Shigella flexneri 2a str. 301
aaugaaauccauug

SEQ ID NO: 1993907 - RNA, 13 nt, Shigella flexneri 2a str. 301
aaugaacaccaaa

SEQ ID NO: 1993908 - RNA, 12 nt, Shigella flexneri 2a str. 301
aaugaauggacu

SEQ ID NO: 1993909 - RNA, 14 nt, Shigella flexneri 2a str. 301
aaucuuuaaaaaaa

SEQ ID NO: 1993910 - RNA, 21 nt, Shigella flexneri 2a str. 301
aaucuuuagcauaaaaacucg

SEQ ID NO: 1993911 - RNA, 14 nt, Shigella flexneri 2a str. 301
aaucucuacaccaa

SEQ ID NO: 1993912 - RNA, 22 nt, Shigella flexneri 2a str. 301
aaugaaacgcaaauacugacug

SEQ ID NO: 1993913 - RNA, 11 nt, Shigella flexneri 2a str. 301
aaugaaaaacc

SEQ ID NO: 1993914 - RNA, 14 nt, Shigella flexneri 2a str. 301
aaugaaaaaauaga

SEQ ID NO: 1993915 - RNA, 20 nt, Shigella flexneri 2a str. 301
aaugagauauuuaaaugauu

SEQ ID NO: 1993916 - RNA, 19 nt, Shigella flexneri 2a str. 301
aaugagaaagccgacugca

SEQ ID NO: 1993917 - RNA, 15 nt, Shigella flexneri 2a str. 301
aaugaggcagcaagg

SEQ ID NO: 1993918 - RNA, 18 nt, Shigella flexneri 2a str. 301
aaugaggcagcaaggaaa

SEQ ID NO: 1993919 - RNA, 23 nt, Shigella flexneri 2a str. 301
aaugaggcagcaaggaaaaccag

SEQ ID NO: 1993920 - RNA, 20 nt, Shigella flexneri 2a str. 301
aaugaguacugaugaauaaa

SEQ ID NO: 1993921 - RNA, 17 nt, Shigella flexneri 2a str. 301
aaugagugccaaaaaaa

SEQ ID NO: 1993922 - RNA, 18 nt, Shigella flexneri 2a str. 301
aaugaguggugaaaaaaa

SEQ ID NO: 1993923 - RNA, 15 nt, Shigella flexneri 2a str. 301
aaugauagccaggcg

SEQ ID NO: 1993924 - RNA, 18 nt, Shigella flexneri 2a str. 301
aaugacguuaauaaaauu

SEQ ID NO: 1993925 - RNA, 17 nt, Shigella flexneri 2a str. 301
aaugacguuaauaaaau

SEQ ID NO: 1993926 - RNA, 14 nt, Shigella flexneri 2a str. 301
aaugacgaucgguu

SEQ ID NO: 1993927 - RNA, 17 nt, Shigella flexneri 2a str. 301
aaugacagccagcaagu

SEQ ID NO: 1993928 - RNA, 18 nt, Shigella flexneri 2a str. 301
aaugacagccagcaaguc

SEQ ID NO: 1993929 - RNA, 22 nt, Shigella flexneri 2a str. 301
aaugaucggauaucuccuauug

SEQ ID NO: 1993930 - RNA, 19 nt, Shigella flexneri 2a str. 301
aaugaucagcgguuuugcc

SEQ ID NO: 1993931 - RNA, 15 nt, Shigella flexneri 2a str. 301
aaugauauuuucugc

SEQ ID NO: 1993932 - RNA, 21 nt, Shigella flexneri 2a str. 301
aaugaugcggcgcuuucagca

SEQ ID NO: 1993933 - RNA, 12 nt, Shigella flexneri 2a str. 301
aaugauggcuga

SEQ ID NO: 1993934 - RNA, 16 nt, Shigella flexneri 2a str. 301
aaugauguaaaaauac

SEQ ID NO: 1993935 - RNA, 17 nt, Shigella flexneri 2a str. 301
aaugauguaaaaauacu

SEQ ID NO: 1993936 - RNA, 13 nt, Shigella flexneri 2a str. 301
aaugcccacgccg

SEQ ID NO: 1993937 - RNA, 16 nt, Shigella flexneri 2a str. 301
aaugcccagaaaccag

SEQ ID NO: 1993938 - RNA, 17 nt, Shigella flexneri 2a str. 301
aaugccccuuuaaauac

SEQ ID NO: 1993939 - RNA, 21 nt, Shigella flexneri 2a str. 301
aaugccccuuuaaauaccuua

SEQ ID NO: 1993940 - RNA, 18 nt, Shigella flexneri 2a str. 301
aaugccggaaucagaauc

SEQ ID NO: 1993941 - RNA, 15 nt, Shigella flexneri 2a str. 301
aaugccgcaaaacuu

SEQ ID NO: 1993942 - RNA, 22 nt, Shigella flexneri 2a str. 301
aaugcaggggcguccagaugcg

SEQ ID NO: 1993943 - RNA, 19 nt, Shigella flexneri 2a str. 301
aaugcaggggcguccagau

SEQ ID NO: 1993944 - RNA, 17 nt, Shigella flexneri 2a str. 301
aaugcauuaucagagau

SEQ ID NO: 1993945 - RNA, 15 nt, Shigella flexneri 2a str. 301
aaugcuggaucacuu

SEQ ID NO: 1993946 - RNA, 17 nt, Shigella flexneri 2a str. 301
aauggcaggcucagacu

SEQ ID NO: 1993947 - RNA, 11 nt, Shigella flexneri 2a str. 301
aauggcaaaga

SEQ ID NO: 1993948 - RNA, 22 nt, Shigella flexneri 2a str. 301
aauggcguuagucaugaaauau

SEQ ID NO: 1993949 - RNA, 21 nt, Shigella flexneri 2a str. 301
aauggcgcuuuauagggugcc

SEQ ID NO: 1993950 - RNA, 14 nt, Shigella flexneri 2a str. 301
aauggcuggcuaua

SEQ ID NO: 1993951 - RNA, 19 nt, Shigella flexneri 2a str. 301
aaugcucuccguaggccag

SEQ ID NO: 1993952 - RNA, 16 nt, Shigella flexneri 2a str. 301
aaugcugacaaaaccg

SEQ ID NO: 1993953 - RNA, 20 nt, Shigella flexneri 2a str. 301
aaugcucugcacguuuugcu

SEQ ID NO: 1993954 - RNA, 16 nt, Shigella flexneri 2a str. 301
aaugcucucuucgcca

SEQ ID NO: 1993955 - RNA, 14 nt, Shigella flexneri 2a str. 301
aaugcucaauuccc

SEQ ID NO: 1993956 - RNA, 22 nt, Shigella flexneri 2a str. 301
aaugcuacgcgcaauauccugc

SEQ ID NO: 1993957 - RNA, 15 nt, Shigella flexneri 2a str. 301
aaugcguuccagcau

SEQ ID NO: 1993958 - RNA, 18 nt, Shigella flexneri 2a str. 301
aaugccucucaaaccccg

SEQ ID NO: 1993959 - RNA, 21 nt, Shigella flexneri 2a str. 301
aaugccugcacuuugugucag

SEQ ID NO: 1993960 - RNA, 18 nt, Shigella flexneri 2a str. 301
aaugcgggcgaaaacauc

SEQ ID NO: 1993961 - RNA, 16 nt, Shigella flexneri 2a str. 301
aaugccgucaccagca

SEQ ID NO: 1993962 - RNA, 20 nt, Shigella flexneri 2a str. 301
aauccagcucuuuuccagcc

SEQ ID NO: 1993963 - RNA, 16 nt, Shigella flexneri 2a str. 301
aauccacgcgcgaaau

SEQ ID NO: 1993964 - RNA, 20 nt, Shigella flexneri 2a str. 301
aauccaguguaaaacagcac

SEQ ID NO: 1993965 - RNA, 16 nt, Shigella flexneri 2a str. 301
aauccauaccagcaca

SEQ ID NO: 1993966 - RNA, 15 nt, Shigella flexneri 2a str. 301
aauccaguacaugaa

SEQ ID NO: 1993967 - RNA, 22 nt, Shigella flexneri 2a str. 301
aauccaggcccgcauuaaaagu

SEQ ID NO: 1993968 - RNA, 17 nt, Shigella flexneri 2a str. 301
aauccaguaagcugugc

SEQ ID NO: 1993969 - RNA, 13 nt, Shigella flexneri 2a str. 301
aaucauucccauu

SEQ ID NO: 1993970 - RNA, 17 nt, Shigella flexneri 2a str. 301
aaucauuacaguuucgg

SEQ ID NO: 1993971 - RNA, 18 nt, Shigella flexneri 2a str. 301
aaucauuacaguuucgga

SEQ ID NO: 1993972 - RNA, 17 nt, Shigella flexneri 2a str. 301
aaucauucccauuuauu

SEQ ID NO: 1993973 - RNA, 14 nt, Shigella flexneri 2a str. 301
aauccaacaacaca

SEQ ID NO: 1993974 - RNA, 15 nt, Shigella flexneri 2a str. 301
aauccaacaacacau

SEQ ID NO: 1993975 - RNA, 19 nt, Shigella flexneri 2a str. 301
aaucaucugauaucucacc

SEQ ID NO: 1993976 - RNA, 21 nt, Shigella flexneri 2a str. 301
aaucaucgcggcacacagcac

SEQ ID NO: 1993977 - RNA, 16 nt, Shigella flexneri 2a str. 301
aaucaucgcguacuca

SEQ ID NO: 1993978 - RNA, 18 nt, Shigella flexneri 2a str. 301
aaucaucgcgugacagcc

SEQ ID NO: 1993979 - RNA, 13 nt, Shigella flexneri 2a str. 301
aaucaucgccuua

SEQ ID NO: 1993980 - RNA, 20 nt, Shigella flexneri 2a str. 301
aaucaucgccuuaugcugcu

SEQ ID NO: 1993981 - RNA, 20 nt, Shigella flexneri 2a str. 301
aaucaucgcggcacacagca

SEQ ID NO: 1993982 - RNA, 19 nt, Shigella flexneri 2a str. 301
aaucauccaccuuaaaaca

SEQ ID NO: 1993983 - RNA, 21 nt, Shigella flexneri 2a str. 301
aaucauccaccuuaaaacaau

SEQ ID NO: 1993984 - RNA, 15 nt, Shigella flexneri 2a str. 301
aaucaucauuuuuuc

SEQ ID NO: 1993985 - RNA, 19 nt, Shigella flexneri 2a str. 301
aaucauccuaccgccaggu

SEQ ID NO: 1993986 - RNA, 19 nt, Shigella flexneri 2a str. 301
aaucaucccacaugaauuc

SEQ ID NO: 1993987 - RNA, 15 nt, Shigella flexneri 2a str. 301
aaucaucacgccaau

SEQ ID NO: 1993988 - RNA, 15 nt, Shigella flexneri 2a str. 301
aaucaucaguaccag

SEQ ID NO: 1993989 - RNA, 13 nt, Shigella flexneri 2a str. 301
aaucaucaucagu

SEQ ID NO: 1993990 - RNA, 21 nt, Shigella flexneri 2a str. 301
aaucaucaucuuuauauauug

SEQ ID NO: 1993991 - RNA, 13 nt, Shigella flexneri 2a str. 301
aaucaucauuaau

SEQ ID NO: 1993992 - RNA, 19 nt, Shigella flexneri 2a str. 301
aaucaucauuaauaucuuu

SEQ ID NO: 1993993 - RNA, 15 nt, Shigella flexneri 2a str. 301
aaucauauucaccac

SEQ ID NO: 1993994 - RNA, 19 nt, Shigella flexneri 2a str. 301
aauaugaacaugaaaaaac

SEQ ID NO: 1993995 - RNA, 20 nt, Shigella flexneri 2a str. 301
aaucagcaucucauccauca

SEQ ID NO: 1993996 - RNA, 15 nt, Shigella flexneri 2a str. 301
aauaugauaaaccuc

SEQ ID NO: 1993997 - RNA, 15 nt, Shigella flexneri 2a str. 301
aaucagcgccagcgc

SEQ ID NO: 1993998 - RNA, 12 nt, Shigella flexneri 2a str. 301
aaucagcggcag

SEQ ID NO: 1993999 - RNA, 22 nt, Shigella flexneri 2a str. 301
aaucagcguaacgauggcaauu

SEQ ID NO: 1994000 - RNA, 17 nt, Shigella flexneri 2a str. 301
aaucagcguaugcagcc

SEQ ID NO: 1994001 - RNA, 14 nt, Shigella flexneri 2a str. 301
aaucaggccgaggc

SEQ ID NO: 1994002 - RNA, 17 nt, Shigella flexneri 2a str. 301
aaucaggcaggucuuuc

SEQ ID NO: 1994003 - RNA, 19 nt, Shigella flexneri 2a str. 301
aaucagcuuuuccauauca

SEQ ID NO: 1994004 - RNA, 22 nt, Shigella flexneri 2a str. 301
aaucagugguguagggcaggcg

SEQ ID NO: 1994005 - RNA, 16 nt, Shigella flexneri 2a str. 301
aaucaguucaaauuca

SEQ ID NO: 1994006 - RNA, 19 nt, Shigella flexneri 2a str. 301
aaucauaauaaagaugcca

SEQ ID NO: 1994007 - RNA, 22 nt, Shigella flexneri 2a str. 301
aaaaaugugcccggacaguccc

SEQ ID NO: 1994008 - RNA, 15 nt, Shigella flexneri 2a str. 301
aaaaauuaacaaaac

SEQ ID NO: 1994009 - RNA, 14 nt, Shigella flexneri 2a str. 301
aaucuauucauuua

SEQ ID NO: 1994010 - RNA, 15 nt, Shigella flexneri 2a str. 301
aaucuauucauuuau

SEQ ID NO: 1994011 - RNA, 13 nt, Shigella flexneri 2a str. 301
aaucuauugcaac

SEQ ID NO: 1994012 - RNA, 23 nt, Shigella flexneri 2a str. 301
aaucguucugugccgucugcccc

SEQ ID NO: 1994013 - RNA, 17 nt, Shigella flexneri 2a str. 301
aaucguacucaccagac

SEQ ID NO: 1994014 - RNA, 20 nt, Shigella flexneri 2a str. 301
aaucggugcaaaugccagau

SEQ ID NO: 1994015 - RNA, 17 nt, Shigella flexneri 2a str. 301
aaucgggcagcacauag

SEQ ID NO: 1994016 - RNA, 24 nt, Shigella flexneri 2a str. 301
aaucgcuuuuucugcaucaaccaa

SEQ ID NO: 1994017 - RNA, 16 nt, Shigella flexneri 2a str. 301
aaucggaaacaaauac

SEQ ID NO: 1994018 - RNA, 13 nt, Shigella flexneri 2a str. 301
aaucgcuuucgga

SEQ ID NO: 1994019 - RNA, 14 nt, Shigella flexneri 2a str. 301
aaucgcuucauuua

SEQ ID NO: 1994020 - RNA, 13 nt, Shigella flexneri 2a str. 301
aaucgcugcggca

SEQ ID NO: 1994021 - RNA, 16 nt, Shigella flexneri 2a str. 301
aaucgcuacugauaau

SEQ ID NO: 1994022 - RNA, 16 nt, Shigella flexneri 2a str. 301
aaucccgcgcaacaaa

SEQ ID NO: 1994023 - RNA, 14 nt, Shigella flexneri 2a str. 301
aaucccggcaccaa

SEQ ID NO: 1994024 - RNA, 19 nt, Shigella flexneri 2a str. 301
aauccccuucucaaucccu

SEQ ID NO: 1994025 - RNA, 20 nt, Shigella flexneri 2a str. 301
aaucccauccgcgcugaugc

SEQ ID NO: 1994026 - RNA, 22 nt, Shigella flexneri 2a str. 301
aauccauaccagcacauaacuc

SEQ ID NO: 1994027 - RNA, 17 nt, Shigella flexneri 2a str. 301
aauccauaccagcacau

SEQ ID NO: 1994028 - RNA, 13 nt, Shigella flexneri 2a str. 301
aauccccacugca

SEQ ID NO: 1994029 - RNA, 20 nt, Shigella flexneri 2a str. 301
aauccugccgcaguuucuga

SEQ ID NO: 1994030 - RNA, 19 nt, Shigella flexneri 2a str. 301
aauccugcgcacaagccca

SEQ ID NO: 1994031 - RNA, 13 nt, Shigella flexneri 2a str. 301
aaucgaaaucaac

SEQ ID NO: 1994032 - RNA, 17 nt, Shigella flexneri 2a str. 301
aaucgaaaucaacaugu

SEQ ID NO: 1994033 - RNA, 22 nt, Shigella flexneri 2a str. 301
aaucgaaaaugcuccuuuuggc

SEQ ID NO: 1994034 - RNA, 17 nt, Shigella flexneri 2a str. 301
aaucgccaguaguaacc

SEQ ID NO: 1994035 - RNA, 19 nt, Shigella flexneri 2a str. 301
aaucgcccagcgcguaaau

SEQ ID NO: 1994036 - RNA, 20 nt, Shigella flexneri 2a str. 301
aaucgcccgcuguuuauguu

SEQ ID NO: 1994037 - RNA, 15 nt, Shigella flexneri 2a str. 301
aaucgccagcggcag

SEQ ID NO: 1994038 - RNA, 18 nt, Shigella flexneri 2a str. 301
aaucgcgaaauaacugcu

SEQ ID NO: 1994039 - RNA, 17 nt, Shigella flexneri 2a str. 301
aaucgccguauaauauc

SEQ ID NO: 1994040 - RNA, 22 nt, Shigella flexneri 2a str. 301
acugagccaaacgcccagcuaa

SEQ ID NO: 1994041 - RNA, 14 nt, Shigella flexneri 2a str. 301
acugagauggcuuc

SEQ ID NO: 1994042 - RNA, 14 nt, Shigella flexneri 2a str. 301
acugaggcaauaau

SEQ ID NO: 1994043 - RNA, 21 nt, Shigella flexneri 2a str. 301
acugagucagcccaacaaagc

SEQ ID NO: 1994044 - RNA, 16 nt, Shigella flexneri 2a str. 301
acugaaacgucaccca

SEQ ID NO: 1994045 - RNA, 18 nt, Shigella flexneri 2a str. 301
acucuuuuuccugcugca

SEQ ID NO: 1994046 - RNA, 12 nt, Shigella flexneri 2a str. 301
acucuuuuuccu

SEQ ID NO: 1994047 - RNA, 13 nt, Shigella flexneri 2a str. 301
acucuuuuuuccg

SEQ ID NO: 1994048 - RNA, 23 nt, Shigella flexneri 2a str. 301
acucuuucucggaguaacuauaa

SEQ ID NO: 1994049 - RNA, 20 nt, Shigella flexneri 2a str. 301
acucuuugaugaaacaugau

SEQ ID NO: 1994050 - RNA, 23 nt, Shigella flexneri 2a str. 301
acucuuuggcaaccguggugagu

SEQ ID NO: 1994051 - RNA, 17 nt, Shigella flexneri 2a str. 301
acucuuucaauuuguag

SEQ ID NO: 1994052 - RNA, 13 nt, Shigella flexneri 2a str. 301
acucuuuauuuca

SEQ ID NO: 1994053 - RNA, 22 nt, Shigella flexneri 2a str. 301
acucuuuauuucauuuuuuaau

SEQ ID NO: 1994054 - RNA, 17 nt, Shigella flexneri 2a str. 301
acugcaaaccaugacgc

SEQ ID NO: 1994055 - RNA, 15 nt, Shigella flexneri 2a str. 301
acugcaaaaagcagg

SEQ ID NO: 1994056 - RNA, 21 nt, Shigella flexneri 2a str. 301
acugauugccacccugcggcu

SEQ ID NO: 1994057 - RNA, 18 nt, Shigella flexneri 2a str. 301
acugcaacugcgcggcaa

SEQ ID NO: 1994058 - RNA, 23 nt, Shigella flexneri 2a str. 301
acugcauaaugccgguggugacc

SEQ ID NO: 1994059 - RNA, 16 nt, Shigella flexneri 2a str. 301
acugcaaaucaccaca

SEQ ID NO: 1994060 - RNA, 19 nt, Shigella flexneri 2a str. 301
acugcaacagcuguugaaa

SEQ ID NO: 1994061 - RNA, 16 nt, Shigella flexneri 2a str. 301
acugaucgucaucaaa

SEQ ID NO: 1994062 - RNA, 14 nt, Shigella flexneri 2a str. 301
acugauccugacaa

SEQ ID NO: 1994063 - RNA, 23 nt, Shigella flexneri 2a str. 301
acugauaauuuucgguaaugacu

SEQ ID NO: 1994064 - RNA, 16 nt, Shigella flexneri 2a str. 301
acugauaguguuuuau

SEQ ID NO: 1994065 - RNA, 18 nt, Shigella flexneri 2a str. 301
acugauaagcugagcaca

SEQ ID NO: 1994066 - RNA, 14 nt, Shigella flexneri 2a str. 301
acugaggccgccac

SEQ ID NO: 1994067 - RNA, 16 nt, Shigella flexneri 2a str. 301
acugcaucuuccgugg

SEQ ID NO: 1994068 - RNA, 22 nt, Shigella flexneri 2a str. 301
acugccacacaggccauuuccc

SEQ ID NO: 1994069 - RNA, 23 nt, Shigella flexneri 2a str. 301
acugccaccagcagcguuuugua

SEQ ID NO: 1994070 - RNA, 13 nt, Shigella flexneri 2a str. 301
acugccaccaucc

SEQ ID NO: 1994071 - RNA, 14 nt, Shigella flexneri 2a str. 301
acugccuuaaucaa

SEQ ID NO: 1994072 - RNA, 15 nt, Shigella flexneri 2a str. 301
acugcgcuaccagga

SEQ ID NO: 1994073 - RNA, 14 nt, Shigella flexneri 2a str. 301
acugcggucuaaau

SEQ ID NO: 1994074 - RNA, 16 nt, Shigella flexneri 2a str. 301
acugcgccgcucagua

SEQ ID NO: 1994075 - RNA, 19 nt, Shigella flexneri 2a str. 301
acugcgccucaacauacaa

SEQ ID NO: 1994076 - RNA, 20 nt, Shigella flexneri 2a str. 301
acugcgccucgccgcugccu

SEQ ID NO: 1994077 - RNA, 21 nt, Shigella flexneri 2a str. 301
acugcgcgauuaucauuuuac

SEQ ID NO: 1994078 - RNA, 19 nt, Shigella flexneri 2a str. 301
acugcgcgccgccgcugaa

SEQ ID NO: 1994079 - RNA, 17 nt, Shigella flexneri 2a str. 301
acugcgaugggagcagc

SEQ ID NO: 1994080 - RNA, 16 nt, Shigella flexneri 2a str. 301
acugcgaccgaucacc

SEQ ID NO: 1994081 - RNA, 14 nt, Shigella flexneri 2a str. 301
acugcgagcaaaau

SEQ ID NO: 1994082 - RNA, 21 nt, Shigella flexneri 2a str. 301
acuggaaaaauaauuuuaaau

SEQ ID NO: 1994083 - RNA, 17 nt, Shigella flexneri 2a str. 301
acugcuuuuuaaucucc

SEQ ID NO: 1994084 - RNA, 13 nt, Shigella flexneri 2a str. 301
acuggaaaucaaa

SEQ ID NO: 1994085 - RNA, 13 nt, Shigella flexneri 2a str. 301
acuggauagauau

SEQ ID NO: 1994086 - RNA, 14 nt, Shigella flexneri 2a str. 301
acuggaugaaaaaa

SEQ ID NO: 1994087 - RNA, 17 nt, Shigella flexneri 2a str. 301
acugcugaaugaggcuu

SEQ ID NO: 1994088 - RNA, 22 nt, Shigella flexneri 2a str. 301
acugcggucuaaaucuuccgcc

SEQ ID NO: 1994089 - RNA, 21 nt, Shigella flexneri 2a str. 301
acugcugauguuguuucucuu

SEQ ID NO: 1994090 - RNA, 18 nt, Shigella flexneri 2a str. 301
acugcugauguuguuucu

SEQ ID NO: 1994091 - RNA, 17 nt, Shigella flexneri 2a str. 301
acugcugcucaaucugc

SEQ ID NO: 1994092 - RNA, 14 nt, Shigella flexneri 2a str. 301
acuccccgcacaac

SEQ ID NO: 1994093 - RNA, 17 nt, Shigella flexneri 2a str. 301
acuccccgcacaacggc

SEQ ID NO: 1994094 - RNA, 21 nt, Shigella flexneri 2a str. 301
acuccguugaaauugcugguu

SEQ ID NO: 1994095 - RNA, 20 nt, Shigella flexneri 2a str. 301
acuccggcuugaaccagcca

SEQ ID NO: 1994096 - RNA, 21 nt, Shigella flexneri 2a str. 301
acuccggcuugaaccagccaa

SEQ ID NO: 1994097 - RNA, 14 nt, Shigella flexneri 2a str. 301
acucccgcgccgca

SEQ ID NO: 1994098 - RNA, 19 nt, Shigella flexneri 2a str. 301
acucgaggauaaauuuucu

SEQ ID NO: 1994099 - RNA, 13 nt, Shigella flexneri 2a str. 301
acucgagcagcug

SEQ ID NO: 1994100 - RNA, 22 nt, Shigella flexneri 2a str. 301
acucgacgcccuggaagaaaaa

SEQ ID NO: 1994101 - RNA, 20 nt, Shigella flexneri 2a str. 301
acucgcuuugcccagaggau

SEQ ID NO: 1994102 - RNA, 15 nt, Shigella flexneri 2a str. 301
acucgcugccagcac

SEQ ID NO: 1994103 - RNA, 20 nt, Shigella flexneri 2a str. 301
acucucaucuuugaaaucac

SEQ ID NO: 1994104 - RNA, 14 nt, Shigella flexneri 2a str. 301
acucucauuuuuca

SEQ ID NO: 1994105 - RNA, 18 nt, Shigella flexneri 2a str. 301
acucuacaaccagcuuau

SEQ ID NO: 1994106 - RNA, 20 nt, Shigella flexneri 2a str. 301
acucucgacccgacagaugc

SEQ ID NO: 1994107 - RNA, 13 nt, Shigella flexneri 2a str. 301
acucucugaagua

SEQ ID NO: 1994108 - RNA, 21 nt, Shigella flexneri 2a str. 301
acucucgggaaggcccuuucc

SEQ ID NO: 1994109 - RNA, 19 nt, Shigella flexneri 2a str. 301
acucugaccugacaaccgg

SEQ ID NO: 1994110 - RNA, 23 nt, Shigella flexneri 2a str. 301
acucugaccugccgcagauauug

SEQ ID NO: 1994111 - RNA, 15 nt, Shigella flexneri 2a str. 301
acucugaaaacgcug

SEQ ID NO: 1994112 - RNA, 18 nt, Shigella flexneri 2a str. 301
acucuuauuuaaauccua

SEQ ID NO: 1994113 - RNA, 21 nt, Shigella flexneri 2a str. 301
acucuuaagguucacuuaauc

SEQ ID NO: 1994114 - RNA, 18 nt, Shigella flexneri 2a str. 301
acucugcugccacauucc

SEQ ID NO: 1994115 - RNA, 17 nt, Shigella flexneri 2a str. 301
acucuucguucuucuuc

SEQ ID NO: 1994116 - RNA, 20 nt, Shigella flexneri 2a str. 301
acuucgcuaaaucuggugcu

SEQ ID NO: 1994117 - RNA, 18 nt, Shigella flexneri 2a str. 301
acuucgauguccgcucca

SEQ ID NO: 1994118 - RNA, 19 nt, Shigella flexneri 2a str. 301
acuucgcuuacgccugcca

SEQ ID NO: 1994119 - RNA, 21 nt, Shigella flexneri 2a str. 301
acuuccgucccagccuugcca

SEQ ID NO: 1994120 - RNA, 17 nt, Shigella flexneri 2a str. 301
acuucgaguacauccac

SEQ ID NO: 1994121 - RNA, 13 nt, Shigella flexneri 2a str. 301
acuuccccucugc

SEQ ID NO: 1994122 - RNA, 18 nt, Shigella flexneri 2a str. 301
acuuccgaacaguacugg

SEQ ID NO: 1994123 - RNA, 21 nt, Shigella flexneri 2a str. 301
acuucccucccguuucccugu

SEQ ID NO: 1994124 - RNA, 13 nt, Shigella flexneri 2a str. 301
acuuccgcccauc

SEQ ID NO: 1994125 - RNA, 14 nt, Shigella flexneri 2a str. 301
acuuccgcccaucg

SEQ ID NO: 1994126 - RNA, 18 nt, Shigella flexneri 2a str. 301
acuuccgcgucaaucugc

SEQ ID NO: 1994127 - RNA, 20 nt, Shigella flexneri 2a str. 301
acuuccgcgucaaucugccc

SEQ ID NO: 1994128 - RNA, 23 nt, Shigella flexneri 2a str. 301
acuuccagcguagugaaggcaaa

SEQ ID NO: 1994129 - RNA, 14 nt, Shigella flexneri 2a str. 301
acuuccacgcagau

SEQ ID NO: 1994130 - RNA, 22 nt, Shigella flexneri 2a str. 301
acuucauccggauacagcccca

SEQ ID NO: 1994131 - RNA, 23 nt, Shigella flexneri 2a str. 301
acuucaucgcccacguuuacugc

SEQ ID NO: 1994132 - RNA, 13 nt, Shigella flexneri 2a str. 301
acuucaucagcaa

SEQ ID NO: 1994133 - RNA, 22 nt, Shigella flexneri 2a str. 301
acuucaucauaacccuuuccuu

SEQ ID NO: 1994134 - RNA, 22 nt, Shigella flexneri 2a str. 301
acuucaucacuaccuucuuccc

SEQ ID NO: 1994135 - RNA, 18 nt, Shigella flexneri 2a str. 301
acuuccaccacuuccugc

SEQ ID NO: 1994136 - RNA, 19 nt, Shigella flexneri 2a str. 301
acuucaugaguuccacugg

SEQ ID NO: 1994137 - RNA, 22 nt, Shigella flexneri 2a str. 301
acuucuuagucccaaacagcag

SEQ ID NO: 1994138 - RNA, 16 nt, Shigella flexneri 2a str. 301
acuucuguuacuccag

SEQ ID NO: 1994139 - RNA, 23 nt, Shigella flexneri 2a str. 301
acuucucuucuuccgcuucaauc

SEQ ID NO: 1994140 - RNA, 12 nt, Shigella flexneri 2a str. 301
acuucucuuucg

SEQ ID NO: 1994141 - RNA, 23 nt, Shigella flexneri 2a str. 301
acuucugcucgcgguuaaguucc

SEQ ID NO: 1994142 - RNA, 20 nt, Shigella flexneri 2a str. 301
acuucucgguuugcggcagg

SEQ ID NO: 1994143 - RNA, 15 nt, Shigella flexneri 2a str. 301
acuucgguuaccaca

SEQ ID NO: 1994144 - RNA, 17 nt, Shigella flexneri 2a str. 301
acuugaacgcgagaaaa

SEQ ID NO: 1994145 - RNA, 13 nt, Shigella flexneri 2a str. 301
acuugagcccugg

SEQ ID NO: 1994146 - RNA, 18 nt, Shigella flexneri 2a str. 301
acuucuucuucgcugcag

SEQ ID NO: 1994147 - RNA, 11 nt, Shigella flexneri 2a str. 301
acuucuucagc

SEQ ID NO: 1994148 - RNA, 16 nt, Shigella flexneri 2a str. 301
acuucacacacuuuua

SEQ ID NO: 1994149 - RNA, 12 nt, Shigella flexneri 2a str. 301
acuucacacacu

SEQ ID NO: 1994150 - RNA, 16 nt, Shigella flexneri 2a str. 301
acuucacaucaccaua

SEQ ID NO: 1994151 - RNA, 15 nt, Shigella flexneri 2a str. 301
acuucacaucaccau

SEQ ID NO: 1994152 - RNA, 22 nt, Shigella flexneri 2a str. 301
acuucacaaucagcgcgauaaa

SEQ ID NO: 1994153 - RNA, 14 nt, Shigella flexneri 2a str. 301
acuucaaccacauu

SEQ ID NO: 1994154 - RNA, 16 nt, Shigella flexneri 2a str. 301
acuucagacggucagc

SEQ ID NO: 1994155 - RNA, 13 nt, Shigella flexneri 2a str. 301
acuucacuucuuc

SEQ ID NO: 1994156 - RNA, 15 nt, Shigella flexneri 2a str. 301
acuucacggcugcua

SEQ ID NO: 1994157 - RNA, 15 nt, Shigella flexneri 2a str. 301
acuucagcaacaaaa

SEQ ID NO: 1994158 - RNA, 18 nt, Shigella flexneri 2a str. 301
acuuaugcaaaauuuuuu

SEQ ID NO: 1994159 - RNA, 19 nt, Shigella flexneri 2a str. 301
acuuacugaugcacacacg

SEQ ID NO: 1994160 - RNA, 14 nt, Shigella flexneri 2a str. 301
acuuacuucagcaa

SEQ ID NO: 1994161 - RNA, 13 nt, Shigella flexneri 2a str. 301
acuuaucggaaca

SEQ ID NO: 1994162 - RNA, 22 nt, Shigella flexneri 2a str. 301
acuuaucuggauuuaacgauaa

SEQ ID NO: 1994163 - RNA, 19 nt, Shigella flexneri 2a str. 301
acuuaucuuuuacaagcaa

SEQ ID NO: 1994164 - RNA, 20 nt, Shigella flexneri 2a str. 301
acugucuccacuauaaaaaa

SEQ ID NO: 1994165 - RNA, 14 nt, Shigella flexneri 2a str. 301
acugucuucaccau

SEQ ID NO: 1994166 - RNA, 21 nt, Shigella flexneri 2a str. 301
acugugcacccgcuucaguga

SEQ ID NO: 1994167 - RNA, 23 nt, Shigella flexneri 2a str. 301
acugugcacccgcuucagugacu

SEQ ID NO: 1994168 - RNA, 13 nt, Shigella flexneri 2a str. 301
acuguuccagcac

SEQ ID NO: 1994169 - RNA, 18 nt, Shigella flexneri 2a str. 301
acuguucugauaguuaaa

SEQ ID NO: 1994170 - RNA, 16 nt, Shigella flexneri 2a str. 301
acuguugauccaggag

SEQ ID NO: 1994171 - RNA, 12 nt, Shigella flexneri 2a str. 301
acuggcaaugac

SEQ ID NO: 1994172 - RNA, 13 nt, Shigella flexneri 2a str. 301
acuggcaauccag

SEQ ID NO: 1994173 - RNA, 23 nt, Shigella flexneri 2a str. 301
acuggcaauagcggacacuacca

SEQ ID NO: 1994174 - RNA, 17 nt, Shigella flexneri 2a str. 301
acuggcagagaaagaaa

SEQ ID NO: 1994175 - RNA, 17 nt, Shigella flexneri 2a str. 301
acuggcagcaccgggcc

SEQ ID NO: 1994176 - RNA, 17 nt, Shigella flexneri 2a str. 301
acuggcaacaauggcau

SEQ ID NO: 1994177 - RNA, 17 nt, Shigella flexneri 2a str. 301
acuggcaaccagaagag

SEQ ID NO: 1994178 - RNA, 23 nt, Shigella flexneri 2a str. 301
acugucguuaaauccagauccug

SEQ ID NO: 1994179 - RNA, 18 nt, Shigella flexneri 2a str. 301
acugucugcuucugccug

SEQ ID NO: 1994180 - RNA, 22 nt, Shigella flexneri 2a str. 301
acugucugcuucugccugggcc

SEQ ID NO: 1994181 - RNA, 18 nt, Shigella flexneri 2a str. 301
acugucgucgcuuucacu

SEQ ID NO: 1994182 - RNA, 21 nt, Shigella flexneri 2a str. 301
acugucguuaaauccagaucc

SEQ ID NO: 1994183 - RNA, 15 nt, Shigella flexneri 2a str. 301
acuuaaauaaugcuu

SEQ ID NO: 1994184 - RNA, 15 nt, Shigella flexneri 2a str. 301
acuuaacccauuaca

SEQ ID NO: 1994185 - RNA, 14 nt, Shigella flexneri 2a str. 301
acuuaccuucacga

SEQ ID NO: 1994186 - RNA, 19 nt, Shigella flexneri 2a str. 301
acuuacgaaaaaagggcau

SEQ ID NO: 1994187 - RNA, 12 nt, Shigella flexneri 2a str. 301
acuuacacauca

SEQ ID NO: 1994188 - RNA, 21 nt, Shigella flexneri 2a str. 301
acuuacaucugucugauaaaa

SEQ ID NO: 1994189 - RNA, 16 nt, Shigella flexneri 2a str. 301
acuuaauuauuaacaa

SEQ ID NO: 1994190 - RNA, 13 nt, Shigella flexneri 2a str. 301
acuaacagaacaa

SEQ ID NO: 1994191 - RNA, 16 nt, Shigella flexneri 2a str. 301
acuaacagaacaauaa

SEQ ID NO: 1994192 - RNA, 17 nt, Shigella flexneri 2a str. 301
acuaaggcgaacauaag

SEQ ID NO: 1994193 - RNA, 19 nt, Shigella flexneri 2a str. 301
acuaacuuuacucuuuuuu

SEQ ID NO: 1994194 - RNA, 20 nt, Shigella flexneri 2a str. 301
acuaacuuuacucuuuuuug

SEQ ID NO: 1994195 - RNA, 22 nt, Shigella flexneri 2a str. 301
acuaacuucugaucuacagccu

SEQ ID NO: 1994196 - RNA, 22 nt, Shigella flexneri 2a str. 301
acuaagaauguccauuauuuca

SEQ ID NO: 1994197 - RNA, 19 nt, Shigella flexneri 2a str. 301
acuacaaauccaacaccag

SEQ ID NO: 1994198 - RNA, 16 nt, Shigella flexneri 2a str. 301
acuacaaauccaacac

SEQ ID NO: 1994199 - RNA, 20 nt, Shigella flexneri 2a str. 301
acuacaaugucgggauuuuc

SEQ ID NO: 1994200 - RNA, 23 nt, Shigella flexneri 2a str. 301
acuaauccguaaaguuaccugug

SEQ ID NO: 1994201 - RNA, 22 nt, Shigella flexneri 2a str. 301
acuaaucugacaacaccaauuu

SEQ ID NO: 1994202 - RNA, 15 nt, Shigella flexneri 2a str. 301
acuaauacaccauca

SEQ ID NO: 1994203 - RNA, 17 nt, Shigella flexneri 2a str. 301
acuacaggacaucuuga

SEQ ID NO: 1994204 - RNA, 15 nt, Shigella flexneri 2a str. 301
acuaccauccgaguu

SEQ ID NO: 1994205 - RNA, 23 nt, Shigella flexneri 2a str. 301
acuacccgcauuuucuucauucg

SEQ ID NO: 1994206 - RNA, 14 nt, Shigella flexneri 2a str. 301
acuaccggaaccca

SEQ ID NO: 1994207 - RNA, 16 nt, Shigella flexneri 2a str. 301
acuaccgcccgaugaa

SEQ ID NO: 1994208 - RNA, 19 nt, Shigella flexneri 2a str. 301
acuagacgaugaaaaagaa

SEQ ID NO: 1994209 - RNA, 18 nt, Shigella flexneri 2a str. 301
acuagaugugcaguuccu

SEQ ID NO: 1994210 - RNA, 19 nt, Shigella flexneri 2a str. 301
acuagcucaauaaaagaaa

SEQ ID NO: 1994211 - RNA, 19 nt, Shigella flexneri 2a str. 301
acuauauucucaaaauaca

SEQ ID NO: 1994212 - RNA, 19 nt, Shigella flexneri 2a str. 301
acuauacuccugauggucu

SEQ ID NO: 1994213 - RNA, 13 nt, Shigella flexneri 2a str. 301
acuauuuccuugg

SEQ ID NO: 1994214 - RNA, 22 nt, Shigella flexneri 2a str. 301
acguaguugcccuuuucaccau

SEQ ID NO: 1994215 - RNA, 24 nt, Shigella flexneri 2a str. 301
acguagugaaaucgccaacaaucu

SEQ ID NO: 1994216 - RNA, 15 nt, Shigella flexneri 2a str. 301
acguaggccugauaa

SEQ ID NO: 1994217 - RNA, 16 nt, Shigella flexneri 2a str. 301
acguaggcgaucccgg

SEQ ID NO: 1994218 - RNA, 20 nt, Shigella flexneri 2a str. 301
acguagcguaaggauuauuu

SEQ ID NO: 1994219 - RNA, 15 nt, Shigella flexneri 2a str. 301
acgucuuaauguaau

SEQ ID NO: 1994220 - RNA, 17 nt, Shigella flexneri 2a str. 301
acgugacagcauaccuu

SEQ ID NO: 1994221 - RNA, 15 nt, Shigella flexneri 2a str. 301
acgugaccaguacca

SEQ ID NO: 1994222 - RNA, 19 nt, Shigella flexneri 2a str. 301
acguucucuuucaggccgc

SEQ ID NO: 1994223 - RNA, 19 nt, Shigella flexneri 2a str. 301
acguucugcguaauguuua

SEQ ID NO: 1994224 - RNA, 16 nt, Shigella flexneri 2a str. 301
acguucacccaucacu

SEQ ID NO: 1994225 - RNA, 13 nt, Shigella flexneri 2a str. 301
acguucagcgcaa

SEQ ID NO: 1994226 - RNA, 22 nt, Shigella flexneri 2a str. 301
acguugagagguaaaaccugac

SEQ ID NO: 1994227 - RNA, 18 nt, Shigella flexneri 2a str. 301
acguugaacugacuguuu

SEQ ID NO: 1994228 - RNA, 17 nt, Shigella flexneri 2a str. 301
acguucuuccuguggau

SEQ ID NO: 1994229 - RNA, 16 nt, Shigella flexneri 2a str. 301
acguucuuacauuccg

SEQ ID NO: 1994230 - RNA, 21 nt, Shigella flexneri 2a str. 301
acguucuucgcugacaguacc

SEQ ID NO: 1994231 - RNA, 20 nt, Shigella flexneri 2a str. 301
acguuaucgcgccaucaaau

SEQ ID NO: 1994232 - RNA, 16 nt, Shigella flexneri 2a str. 301
acguuagaaacaaaaa

SEQ ID NO: 1994233 - RNA, 20 nt, Shigella flexneri 2a str. 301
acguuaguguggccaguucc

SEQ ID NO: 1994234 - RNA, 22 nt, Shigella flexneri 2a str. 301
acgugcguaccauuaucaccaa

SEQ ID NO: 1994235 - RNA, 20 nt, Shigella flexneri 2a str. 301
acgugcggccguuccauuca

SEQ ID NO: 1994236 - RNA, 19 nt, Shigella flexneri 2a str. 301
acguuucaaccugcacauc

SEQ ID NO: 1994237 - RNA, 18 nt, Shigella flexneri 2a str. 301
acguuucaaacaggcugc

SEQ ID NO: 1994238 - RNA, 22 nt, Shigella flexneri 2a str. 301
acguuguuccuuccagcuggcu

SEQ ID NO: 1994239 - RNA, 13 nt, Shigella flexneri 2a str. 301
acguuucccggaa

SEQ ID NO: 1994240 - RNA, 18 nt, Shigella flexneri 2a str. 301
acguugccggauauaccc

SEQ ID NO: 1994241 - RNA, 17 nt, Shigella flexneri 2a str. 301
acguuggcgcauaacuc

SEQ ID NO: 1994242 - RNA, 17 nt, Shigella flexneri 2a str. 301
acguuggcggugccauc

SEQ ID NO: 1994243 - RNA, 16 nt, Shigella flexneri 2a str. 301
acguugucaguucuuu

SEQ ID NO: 1994244 - RNA, 14 nt, Shigella flexneri 2a str. 301
acguugucauacgg

SEQ ID NO: 1994245 - RNA, 15 nt, Shigella flexneri 2a str. 301
acguuuugcugaugc

SEQ ID NO: 1994246 - RNA, 14 nt, Shigella flexneri 2a str. 301
acguuuuucgaaaa

SEQ ID NO: 1994247 - RNA, 16 nt, Shigella flexneri 2a str. 301
acgccaucaucggcaa

SEQ ID NO: 1994248 - RNA, 17 nt, Shigella flexneri 2a str. 301
acgccaucgccagcagc

SEQ ID NO: 1994249 - RNA, 18 nt, Shigella flexneri 2a str. 301
acgccauacggcuaugaa

SEQ ID NO: 1994250 - RNA, 23 nt, Shigella flexneri 2a str. 301
acgccauacggcuaugaaagaaa

SEQ ID NO: 1994251 - RNA, 21 nt, Shigella flexneri 2a str. 301
acgcucaauauuugcaccuaa

SEQ ID NO: 1994252 - RNA, 17 nt, Shigella flexneri 2a str. 301
acgcuacuuuuuucacc

SEQ ID NO: 1994253 - RNA, 18 nt, Shigella flexneri 2a str. 301
acgcucaggcuacuuuuc

SEQ ID NO: 1994254 - RNA, 15 nt, Shigella flexneri 2a str. 301
acgcucaggguuuuc

SEQ ID NO: 1994255 - RNA, 23 nt, Shigella flexneri 2a str. 301
acgcucuucaauggucagccaca

SEQ ID NO: 1994256 - RNA, 16 nt, Shigella flexneri 2a str. 301
acgcucuccugcggaa

SEQ ID NO: 1994257 - RNA, 22 nt, Shigella flexneri 2a str. 301
acgcucuccugcggaaugcugu

SEQ ID NO: 1994258 - RNA, 22 nt, Shigella flexneri 2a str. 301
acgcugaaaagcgucucuuuuc

SEQ ID NO: 1994259 - RNA, 18 nt, Shigella flexneri 2a str. 301
acgcugaugucagcacuu

SEQ ID NO: 1994260 - RNA, 15 nt, Shigella flexneri 2a str. 301
acgcugcacaauuua

SEQ ID NO: 1994261 - RNA, 22 nt, Shigella flexneri 2a str. 301
acgcugcauggcaacuuuaaua

SEQ ID NO: 1994262 - RNA, 22 nt, Shigella flexneri 2a str. 301
acgcugcaucgccaaucugcug

SEQ ID NO: 1994263 - RNA, 20 nt, Shigella flexneri 2a str. 301
acgcugaauacgcaccgcuc

SEQ ID NO: 1994264 - RNA, 22 nt, Shigella flexneri 2a str. 301
acgcugaauaauccccauauca

SEQ ID NO: 1994265 - RNA, 23 nt, Shigella flexneri 2a str. 301
acgcugaauacgcaccgcuccau

SEQ ID NO: 1994266 - RNA, 15 nt, Shigella flexneri 2a str. 301
acgcugacgcgucuu

SEQ ID NO: 1994267 - RNA, 13 nt, Shigella flexneri 2a str. 301
acgcugucggcac

SEQ ID NO: 1994268 - RNA, 13 nt, Shigella flexneri 2a str. 301
acgcugucggcaa

SEQ ID NO: 1994269 - RNA, 18 nt, Shigella flexneri 2a str. 301
acgcugucuuuugaucaa

SEQ ID NO: 1994270 - RNA, 21 nt, Shigella flexneri 2a str. 301
acgcuguucaucccgaccaau

SEQ ID NO: 1994271 - RNA, 21 nt, Shigella flexneri 2a str. 301
acgcuguuccggcggcagggu

SEQ ID NO: 1994272 - RNA, 22 nt, Shigella flexneri 2a str. 301
acgcuuaaccccgggcuggauu

SEQ ID NO: 1994273 - RNA, 23 nt, Shigella flexneri 2a str. 301
acgcuucugucgcuucacgcagg

SEQ ID NO: 1994274 - RNA, 19 nt, Shigella flexneri 2a str. 301
acgcuucaaucugauauuu

SEQ ID NO: 1994275 - RNA, 20 nt, Shigella flexneri 2a str. 301
acgcuucaaucugauauuua

SEQ ID NO: 1994276 - RNA, 15 nt, Shigella flexneri 2a str. 301
acggauaugauuuaa

SEQ ID NO: 1994277 - RNA, 21 nt, Shigella flexneri 2a str. 301
acggauagcagaaaacucacg

SEQ ID NO: 1994278 - RNA, 20 nt, Shigella flexneri 2a str. 301
acggaucaggcggcucaccu

SEQ ID NO: 1994279 - RNA, 13 nt, Shigella flexneri 2a str. 301
acggaugcgaaug

SEQ ID NO: 1994280 - RNA, 16 nt, Shigella flexneri 2a str. 301
acggaugacacgcagg

SEQ ID NO: 1994281 - RNA, 22 nt, Shigella flexneri 2a str. 301
acggauguuucuucaacaccac

SEQ ID NO: 1994282 - RNA, 15 nt, Shigella flexneri 2a str. 301
acggauucagugagc

SEQ ID NO: 1994283 - RNA, 11 nt, Shigella flexneri 2a str. 301
acggacaugaa

SEQ ID NO: 1994284 - RNA, 15 nt, Shigella flexneri 2a str. 301
acggacacuccuucc

SEQ ID NO: 1994285 - RNA, 15 nt, Shigella flexneri 2a str. 301
acggacgcgcggcga

SEQ ID NO: 1994286 - RNA, 15 nt, Shigella flexneri 2a str. 301
acggacuuccagcgg

SEQ ID NO: 1994287 - RNA, 22 nt, Shigella flexneri 2a str. 301
acggagcaggcguuaaaacagg

SEQ ID NO: 1994288 - RNA, 18 nt, Shigella flexneri 2a str. 301
acggagcugccaggccgc

SEQ ID NO: 1994289 - RNA, 17 nt, Shigella flexneri 2a str. 301
acggaguugaccagcuc

SEQ ID NO: 1994290 - RNA, 14 nt, Shigella flexneri 2a str. 301
acggaaagcagcau

SEQ ID NO: 1994291 - RNA, 19 nt, Shigella flexneri 2a str. 301
acgcuuuuucccugguaaa

SEQ ID NO: 1994292 - RNA, 22 nt, Shigella flexneri 2a str. 301
acgcuuuuucccugguaaaaaa

SEQ ID NO: 1994293 - RNA, 19 nt, Shigella flexneri 2a str. 301
acggaagacguucaguuca

SEQ ID NO: 1994294 - RNA, 16 nt, Shigella flexneri 2a str. 301
acggaagcgaaacugc

SEQ ID NO: 1994295 - RNA, 14 nt, Shigella flexneri 2a str. 301
acggaauaaaccca

SEQ ID NO: 1994296 - RNA, 16 nt, Shigella flexneri 2a str. 301
acggaaugauauuggu

SEQ ID NO: 1994297 - RNA, 14 nt, Shigella flexneri 2a str. 301
acgcuugagcagga

SEQ ID NO: 1994298 - RNA, 16 nt, Shigella flexneri 2a str. 301
acgcuugagcaggagc

SEQ ID NO: 1994299 - RNA, 20 nt, Shigella flexneri 2a str. 301
acgcuugauucuguucagua

SEQ ID NO: 1994300 - RNA, 15 nt, Shigella flexneri 2a str. 301
acgcuugauuucucg

SEQ ID NO: 1994301 - RNA, 14 nt, Shigella flexneri 2a str. 301
acgcuugcugauaa

SEQ ID NO: 1994302 - RNA, 12 nt, Shigella flexneri 2a str. 301
acgcuugucauc

SEQ ID NO: 1994303 - RNA, 16 nt, Shigella flexneri 2a str. 301
acgcuuugcaggcugg

SEQ ID NO: 1994304 - RNA, 14 nt, Shigella flexneri 2a str. 301
acgcuuuucagugc

SEQ ID NO: 1994305 - RNA, 22 nt, Shigella flexneri 2a str. 301
acgcuuucaacaaccuugcguu

SEQ ID NO: 1994306 - RNA, 14 nt, Shigella flexneri 2a str. 301
acgcuuucacccgg

SEQ ID NO: 1994307 - RNA, 13 nt, Shigella flexneri 2a str. 301
acgcuuucuuugg

SEQ ID NO: 1994308 - RNA, 14 nt, Shigella flexneri 2a str. 301
acguaaaaaacacu

SEQ ID NO: 1994309 - RNA, 14 nt, Shigella flexneri 2a str. 301
acgguuucagcagc

SEQ ID NO: 1994310 - RNA, 13 nt, Shigella flexneri 2a str. 301
acgguuucagugg

SEQ ID NO: 1994311 - RNA, 15 nt, Shigella flexneri 2a str. 301
acguaaacgcagcau

SEQ ID NO: 1994312 - RNA, 14 nt, Shigella flexneri 2a str. 301
acguaaagaagaug

SEQ ID NO: 1994313 - RNA, 16 nt, Shigella flexneri 2a str. 301
acguaacaaaacucag

SEQ ID NO: 1994314 - RNA, 14 nt, Shigella flexneri 2a str. 301
acguaacagagcau

SEQ ID NO: 1994315 - RNA, 16 nt, Shigella flexneri 2a str. 301
acguacgcaauccucu

SEQ ID NO: 1994316 - RNA, 22 nt, Shigella flexneri 2a str. 301
acguaauuuauaaucuuuaaaa

SEQ ID NO: 1994317 - RNA, 19 nt, Shigella flexneri 2a str. 301
acguacaaaacgcaccacu

SEQ ID NO: 1994318 - RNA, 17 nt, Shigella flexneri 2a str. 301
acguaaguacugauuga

SEQ ID NO: 1994319 - RNA, 24 nt, Shigella flexneri 2a str. 301
acguaaguuagaggcacauagcca

SEQ ID NO: 1994320 - RNA, 12 nt, Shigella flexneri 2a str. 301
acgguaauacaa

SEQ ID NO: 1994321 - RNA, 15 nt, Shigella flexneri 2a str. 301
acggguuuuccccuu

SEQ ID NO: 1994322 - RNA, 17 nt, Shigella flexneri 2a str. 301
acgggcugauuucaccc

SEQ ID NO: 1994323 - RNA, 17 nt, Shigella flexneri 2a str. 301
acggugauaaucauccc

SEQ ID NO: 1994324 - RNA, 15 nt, Shigella flexneri 2a str. 301
acggugaugcuccac

SEQ ID NO: 1994325 - RNA, 20 nt, Shigella flexneri 2a str. 301
acggugccauugaccagcug

SEQ ID NO: 1994326 - RNA, 22 nt, Shigella flexneri 2a str. 301
acggugccauugaccagcugcc

SEQ ID NO: 1994327 - RNA, 22 nt, Shigella flexneri 2a str. 301
acgguuuaaaccugauuuugcc

SEQ ID NO: 1994328 - RNA, 22 nt, Shigella flexneri 2a str. 301
acgggcgcgagguaacaucccu

SEQ ID NO: 1994329 - RNA, 20 nt, Shigella flexneri 2a str. 301
acgggaagggguucuccuua

SEQ ID NO: 1994330 - RNA, 15 nt, Shigella flexneri 2a str. 301
acggcuuugcgcaug

SEQ ID NO: 1994331 - RNA, 21 nt, Shigella flexneri 2a str. 301
acggcuuuggcaaaccgccag

SEQ ID NO: 1994332 - RNA, 12 nt, Shigella flexneri 2a str. 301
acggcuggaaca

SEQ ID NO: 1994333 - RNA, 19 nt, Shigella flexneri 2a str. 301
acggcugggaaaucaccac

SEQ ID NO: 1994334 - RNA, 19 nt, Shigella flexneri 2a str. 301
acggcugucauccagcagc

SEQ ID NO: 1994335 - RNA, 21 nt, Shigella flexneri 2a str. 301
acggcuguuggaaucacucau

SEQ ID NO: 1994336 - RNA, 20 nt, Shigella flexneri 2a str. 301
acggcuucgccuccuguucu

SEQ ID NO: 1994337 - RNA, 18 nt, Shigella flexneri 2a str. 301
acggcugcuucggucagc

SEQ ID NO: 1994338 - RNA, 16 nt, Shigella flexneri 2a str. 301
acggcugcuaauauuu

SEQ ID NO: 1994339 - RNA, 15 nt, Shigella flexneri 2a str. 301
acggcugggaaauca

SEQ ID NO: 1994340 - RNA, 14 nt, Shigella flexneri 2a str. 301
acggcucagcucug

SEQ ID NO: 1994341 - RNA, 22 nt, Shigella flexneri 2a str. 301
acggcaauucccagaauguuaa

SEQ ID NO: 1994342 - RNA, 23 nt, Shigella flexneri 2a str. 301
acggcgcagcuucacaaaggcuu

SEQ ID NO: 1994343 - RNA, 13 nt, Shigella flexneri 2a str. 301
acggcaauaccug

SEQ ID NO: 1994344 - RNA, 18 nt, Shigella flexneri 2a str. 301
acggcaacacgccuggcu

SEQ ID NO: 1994345 - RNA, 15 nt, Shigella flexneri 2a str. 301
acggcgcaugccuca

SEQ ID NO: 1994346 - RNA, 22 nt, Shigella flexneri 2a str. 301
acggcgcgacuuuaaucaccug

SEQ ID NO: 1994347 - RNA, 17 nt, Shigella flexneri 2a str. 301
acggcguuuccagcucg

SEQ ID NO: 1994348 - RNA, 22 nt, Shigella flexneri 2a str. 301
acggcuaaaaaaagccgccauc

SEQ ID NO: 1994349 - RNA, 14 nt, Shigella flexneri 2a str. 301
acggcuaaagccgu

SEQ ID NO: 1994350 - RNA, 23 nt, Shigella flexneri 2a str. 301
acggcgcuuuuuuugugccugaa

SEQ ID NO: 1994351 - RNA, 15 nt, Shigella flexneri 2a str. 301
acggcggagucauuc

SEQ ID NO: 1994352 - RNA, 14 nt, Shigella flexneri 2a str. 301
acggcgugccgucg

SEQ ID NO: 1994353 - RNA, 19 nt, Shigella flexneri 2a str. 301
acggcgugcugaugcacga

SEQ ID NO: 1994354 - RNA, 17 nt, Shigella flexneri 2a str. 301
acggcguggcaucaaua

SEQ ID NO: 1994355 - RNA, 23 nt, Shigella flexneri 2a str. 301
accucgccccgugaugaacugcg

SEQ ID NO: 1994356 - RNA, 19 nt, Shigella flexneri 2a str. 301
accucgccccgugaugaac

SEQ ID NO: 1994357 - RNA, 17 nt, Shigella flexneri 2a str. 301
accucgcccauuuuuca

SEQ ID NO: 1994358 - RNA, 13 nt, Shigella flexneri 2a str. 301
accucguccuguu

SEQ ID NO: 1994359 - RNA, 23 nt, Shigella flexneri 2a str. 301
accucguccuguugaaaaaccag

SEQ ID NO: 1994360 - RNA, 14 nt, Shigella flexneri 2a str. 301
accugacauuaagu

SEQ ID NO: 1994361 - RNA, 13 nt, Shigella flexneri 2a str. 301
accugaccgcgag

SEQ ID NO: 1994362 - RNA, 13 nt, Shigella flexneri 2a str. 301
accugacaacaaa

SEQ ID NO: 1994363 - RNA, 18 nt, Shigella flexneri 2a str. 301
accugacuguuccagcac

SEQ ID NO: 1994364 - RNA, 19 nt, Shigella flexneri 2a str. 301
accugacuguuccagcacg

SEQ ID NO: 1994365 - RNA, 13 nt, Shigella flexneri 2a str. 301
accugacugugac

SEQ ID NO: 1994366 - RNA, 13 nt, Shigella flexneri 2a str. 301
accugaauauuag

SEQ ID NO: 1994367 - RNA, 18 nt, Shigella flexneri 2a str. 301
accugaaagccgaugccc

SEQ ID NO: 1994368 - RNA, 19 nt, Shigella flexneri 2a str. 301
accugaaagccgaugcccc

SEQ ID NO: 1994369 - RNA, 15 nt, Shigella flexneri 2a str. 301
accugaaaaaacaaa

SEQ ID NO: 1994370 - RNA, 11 nt, Shigella flexneri 2a str. 301
accucuuccag

SEQ ID NO: 1994371 - RNA, 17 nt, Shigella flexneri 2a str. 301
accucugcugcugcguu

SEQ ID NO: 1994372 - RNA, 15 nt, Shigella flexneri 2a str. 301
accuagcacuguaaa

SEQ ID NO: 1994373 - RNA, 21 nt, Shigella flexneri 2a str. 301
accuagcaaacuaucugugua

SEQ ID NO: 1994374 - RNA, 20 nt, Shigella flexneri 2a str. 301
accgguucggacauguuuuc

SEQ ID NO: 1994375 - RNA, 22 nt, Shigella flexneri 2a str. 301
accgguucggacauguuuucca

SEQ ID NO: 1994376 - RNA, 17 nt, Shigella flexneri 2a str. 301
accggggacaggcgggc

SEQ ID NO: 1994377 - RNA, 15 nt, Shigella flexneri 2a str. 301
accucgagaucauca

SEQ ID NO: 1994378 - RNA, 15 nt, Shigella flexneri 2a str. 301
accuccguuuuucug

SEQ ID NO: 1994379 - RNA, 13 nt, Shigella flexneri 2a str. 301
accucacugaaaa

SEQ ID NO: 1994380 - RNA, 12 nt, Shigella flexneri 2a str. 301
accucagcgaac

SEQ ID NO: 1994381 - RNA, 20 nt, Shigella flexneri 2a str. 301
accucagcgaacaggaccuu

SEQ ID NO: 1994382 - RNA, 14 nt, Shigella flexneri 2a str. 301
acgaaaaaucaaua

SEQ ID NO: 1994383 - RNA, 16 nt, Shigella flexneri 2a str. 301
accuuucagaacggca

SEQ ID NO: 1994384 - RNA, 18 nt, Shigella flexneri 2a str. 301
acgaaccauaaaaucaca

SEQ ID NO: 1994385 - RNA, 19 nt, Shigella flexneri 2a str. 301
acgaaccguccccucgccc

SEQ ID NO: 1994386 - RNA, 18 nt, Shigella flexneri 2a str. 301
accuuuaaucaggcuggu

SEQ ID NO: 1994387 - RNA, 15 nt, Shigella flexneri 2a str. 301
accuuguuucugagc

SEQ ID NO: 1994388 - RNA, 16 nt, Shigella flexneri 2a str. 301
accuugcggaaacugu

SEQ ID NO: 1994389 - RNA, 21 nt, Shigella flexneri 2a str. 301
accuugcgccucaacccauuu

SEQ ID NO: 1994390 - RNA, 23 nt, Shigella flexneri 2a str. 301
accuucgccucccguuuauuuac

SEQ ID NO: 1994391 - RNA, 13 nt, Shigella flexneri 2a str. 301
accuucgcggcac

SEQ ID NO: 1994392 - RNA, 16 nt, Shigella flexneri 2a str. 301
accuucgcggcacugg

SEQ ID NO: 1994393 - RNA, 23 nt, Shigella flexneri 2a str. 301
accuucgcgguaaugacuccaac

SEQ ID NO: 1994394 - RNA, 15 nt, Shigella flexneri 2a str. 301
accuucgaagaucag

SEQ ID NO: 1994395 - RNA, 14 nt, Shigella flexneri 2a str. 301
accuuccucaauua

SEQ ID NO: 1994396 - RNA, 15 nt, Shigella flexneri 2a str. 301
accuugcauagcuuc

SEQ ID NO: 1994397 - RNA, 21 nt, Shigella flexneri 2a str. 301
accuugcacucgcagaagcag

SEQ ID NO: 1994398 - RNA, 14 nt, Shigella flexneri 2a str. 301
accuuaucaaucuc

SEQ ID NO: 1994399 - RNA, 18 nt, Shigella flexneri 2a str. 301
accuucccgucuacaaaa

SEQ ID NO: 1994400 - RNA, 22 nt, Shigella flexneri 2a str. 301
accuuccggcguaccuuugccu

SEQ ID NO: 1994401 - RNA, 15 nt, Shigella flexneri 2a str. 301
accuuacggucagua

SEQ ID NO: 1994402 - RNA, 23 nt, Shigella flexneri 2a str. 301
accuuacuuccgguuacgccacc

SEQ ID NO: 1994403 - RNA, 19 nt, Shigella flexneri 2a str. 301
accuuacacucaaauaucu

SEQ ID NO: 1994404 - RNA, 13 nt, Shigella flexneri 2a str. 301
accuuaaaacaau

SEQ ID NO: 1994405 - RNA, 14 nt, Shigella flexneri 2a str. 301
accuguugaaauua

SEQ ID NO: 1994406 - RNA, 20 nt, Shigella flexneri 2a str. 301
accuguucgucccgauucag

SEQ ID NO: 1994407 - RNA, 17 nt, Shigella flexneri 2a str. 301
accuggugcagcggcuc

SEQ ID NO: 1994408 - RNA, 18 nt, Shigella flexneri 2a str. 301
accuguuccaguggcuga

SEQ ID NO: 1994409 - RNA, 20 nt, Shigella flexneri 2a str. 301
accugauccagcucuucuuc

SEQ ID NO: 1994410 - RNA, 13 nt, Shigella flexneri 2a str. 301
accugauccaucg

SEQ ID NO: 1994411 - RNA, 15 nt, Shigella flexneri 2a str. 301
accugauccagcucu

SEQ ID NO: 1994412 - RNA, 15 nt, Shigella flexneri 2a str. 301
accugaucagcaauc

SEQ ID NO: 1994413 - RNA, 14 nt, Shigella flexneri 2a str. 301
acgcaaacgugggg

SEQ ID NO: 1994414 - RNA, 15 nt, Shigella flexneri 2a str. 301
acgcaaacuucgguu

SEQ ID NO: 1994415 - RNA, 13 nt, Shigella flexneri 2a str. 301
acgauuaauuaca

SEQ ID NO: 1994416 - RNA, 16 nt, Shigella flexneri 2a str. 301
acgauucggcaaucac

SEQ ID NO: 1994417 - RNA, 18 nt, Shigella flexneri 2a str. 301
acgauucggcaaucacca

SEQ ID NO: 1994418 - RNA, 17 nt, Shigella flexneri 2a str. 301
acgaugaaagaaaaaac

SEQ ID NO: 1994419 - RNA, 20 nt, Shigella flexneri 2a str. 301
acgaugaaagaaaaaacgau

SEQ ID NO: 1994420 - RNA, 15 nt, Shigella flexneri 2a str. 301
acgaucgcuuucaac

SEQ ID NO: 1994421 - RNA, 19 nt, Shigella flexneri 2a str. 301
acgaucgauaaccaucuuc

SEQ ID NO: 1994422 - RNA, 23 nt, Shigella flexneri 2a str. 301
acgaucccaaccauuucaucuuc

SEQ ID NO: 1994423 - RNA, 13 nt, Shigella flexneri 2a str. 301
acgaugguuuuug

SEQ ID NO: 1994424 - RNA, 18 nt, Shigella flexneri 2a str. 301
acgauggcaauuuucacu

SEQ ID NO: 1994425 - RNA, 17 nt, Shigella flexneri 2a str. 301
acgauggccaaccaugu

SEQ ID NO: 1994426 - RNA, 19 nt, Shigella flexneri 2a str. 301
acgaugcuaaaaacaucau

SEQ ID NO: 1994427 - RNA, 13 nt, Shigella flexneri 2a str. 301
acgaaguacucaa

SEQ ID NO: 1994428 - RNA, 14 nt, Shigella flexneri 2a str. 301
acgaauaaaacaga

SEQ ID NO: 1994429 - RNA, 19 nt, Shigella flexneri 2a str. 301
acgagaauuucucgugcca

SEQ ID NO: 1994430 - RNA, 14 nt, Shigella flexneri 2a str. 301
acgacuuuuuccau

SEQ ID NO: 1994431 - RNA, 13 nt, Shigella flexneri 2a str. 301
acgagaaaagcca

SEQ ID NO: 1994432 - RNA, 13 nt, Shigella flexneri 2a str. 301
acgaagauuuuac

SEQ ID NO: 1994433 - RNA, 20 nt, Shigella flexneri 2a str. 301
acgagauagcgaaguagaca

SEQ ID NO: 1994434 - RNA, 23 nt, Shigella flexneri 2a str. 301
acgagacgguuaaaaacagccag

SEQ ID NO: 1994435 - RNA, 15 nt, Shigella flexneri 2a str. 301
acgaggggagaccuc

SEQ ID NO: 1994436 - RNA, 18 nt, Shigella flexneri 2a str. 301
acgagucaacgcuucagc

SEQ ID NO: 1994437 - RNA, 13 nt, Shigella flexneri 2a str. 301
acgaucagugccg

SEQ ID NO: 1994438 - RNA, 14 nt, Shigella flexneri 2a str. 301
acgcagacacugcu

SEQ ID NO: 1994439 - RNA, 13 nt, Shigella flexneri 2a str. 301
acgcagaccaaag

SEQ ID NO: 1994440 - RNA, 12 nt, Shigella flexneri 2a str. 301
acgcagaacuga

SEQ ID NO: 1994441 - RNA, 16 nt, Shigella flexneri 2a str. 301
acgcagaaccagaagc

SEQ ID NO: 1994442 - RNA, 16 nt, Shigella flexneri 2a str. 301
acgcacuucuuccggg

SEQ ID NO: 1994443 - RNA, 23 nt, Shigella flexneri 2a str. 301
acgcacuggcgagcgccagcaug

SEQ ID NO: 1994444 - RNA, 14 nt, Shigella flexneri 2a str. 301
acgcacugcuugaa

SEQ ID NO: 1994445 - RNA, 18 nt, Shigella flexneri 2a str. 301
acgcaggcggcuggcauc

SEQ ID NO: 1994446 - RNA, 19 nt, Shigella flexneri 2a str. 301
acgcaggaugcaauuguug

SEQ ID NO: 1994447 - RNA, 14 nt, Shigella flexneri 2a str. 301
acgcagcugaccuu

SEQ ID NO: 1994448 - RNA, 22 nt, Shigella flexneri 2a str. 301
acgcaacaugucagcaaucacc

SEQ ID NO: 1994449 - RNA, 18 nt, Shigella flexneri 2a str. 301
acgcaacugguccagccc

SEQ ID NO: 1994450 - RNA, 15 nt, Shigella flexneri 2a str. 301
acgcaacuuccccuc

SEQ ID NO: 1994451 - RNA, 18 nt, Shigella flexneri 2a str. 301
acgcaaucgaguuugccg

SEQ ID NO: 1994452 - RNA, 16 nt, Shigella flexneri 2a str. 301
acgcaaugccagugga

SEQ ID NO: 1994453 - RNA, 16 nt, Shigella flexneri 2a str. 301
acgcaauaauggacaa

SEQ ID NO: 1994454 - RNA, 13 nt, Shigella flexneri 2a str. 301
acgcaauaccugg

SEQ ID NO: 1994455 - RNA, 18 nt, Shigella flexneri 2a str. 301
acgcaagcggcauccagg

SEQ ID NO: 1994456 - RNA, 16 nt, Shigella flexneri 2a str. 301
acgcaauaaacaugau

SEQ ID NO: 1994457 - RNA, 16 nt, Shigella flexneri 2a str. 301
acgcacagaacaaaau

SEQ ID NO: 1994458 - RNA, 15 nt, Shigella flexneri 2a str. 301
acgcaccaugcacgg

SEQ ID NO: 1994459 - RNA, 15 nt, Shigella flexneri 2a str. 301
acgcacgccugcauc

SEQ ID NO: 1994460 - RNA, 23 nt, Shigella flexneri 2a str. 301
acgcagugguuaacaaucacaau

SEQ ID NO: 1994461 - RNA, 15 nt, Shigella flexneri 2a str. 301
acgcagucuucccag

SEQ ID NO: 1994462 - RNA, 16 nt, Shigella flexneri 2a str. 301
acgcagugguuaacaa

SEQ ID NO: 1994463 - RNA, 20 nt, Shigella flexneri 2a str. 301
acgcagugguuaacaaucac

SEQ ID NO: 1994464 - RNA, 22 nt, Shigella flexneri 2a str. 301
acgcauaaugcgccccgcaacg

SEQ ID NO: 1994465 - RNA, 17 nt, Shigella flexneri 2a str. 301
acgcaucggcuaaacca

SEQ ID NO: 1994466 - RNA, 17 nt, Shigella flexneri 2a str. 301
acgcauccaccagauaa

SEQ ID NO: 1994467 - RNA, 18 nt, Shigella flexneri 2a str. 301
acgcaucggcuaaaccau

SEQ ID NO: 1994468 - RNA, 18 nt, Shigella flexneri 2a str. 301
acgcauugcucacuuccu

SEQ ID NO: 1994469 - RNA, 13 nt, Shigella flexneri 2a str. 301
acgcauugcauuu

SEQ ID NO: 1994470 - RNA, 15 nt, Shigella flexneri 2a str. 301
acgcauucagcaaau

SEQ ID NO: 1994471 - RNA, 12 nt, Shigella flexneri 2a str. 301
acgcaugcacau

SEQ ID NO: 1994472 - RNA, 14 nt, Shigella flexneri 2a str. 301
acgccagacugcgc

SEQ ID NO: 1994473 - RNA, 20 nt, Shigella flexneri 2a str. 301
acgccagacugcgcuaccag

SEQ ID NO: 1994474 - RNA, 15 nt, Shigella flexneri 2a str. 301
acgccagauacauca

SEQ ID NO: 1994475 - RNA, 22 nt, Shigella flexneri 2a str. 301
acgccagucacggugcagcucg

SEQ ID NO: 1994476 - RNA, 21 nt, Shigella flexneri 2a str. 301
acgccagucgcacacaacaga

SEQ ID NO: 1994477 - RNA, 16 nt, Shigella flexneri 2a str. 301
acgccacgacucaaau

SEQ ID NO: 1994478 - RNA, 16 nt, Shigella flexneri 2a str. 301
acgccacgcucacuca

SEQ ID NO: 1994479 - RNA, 14 nt, Shigella flexneri 2a str. 301
acgccacugcggcu

SEQ ID NO: 1994480 - RNA, 17 nt, Shigella flexneri 2a str. 301
acgccaagaaacaccag

SEQ ID NO: 1994481 - RNA, 18 nt, Shigella flexneri 2a str. 301
acgccaauaccgcccaga

SEQ ID NO: 1994482 - RNA, 19 nt, Shigella flexneri 2a str. 301
accgcccagugcagugccu

SEQ ID NO: 1994483 - RNA, 18 nt, Shigella flexneri 2a str. 301
accgcccagaccugcguu

SEQ ID NO: 1994484 - RNA, 12 nt, Shigella flexneri 2a str. 301
accgccccugca

SEQ ID NO: 1994485 - RNA, 14 nt, Shigella flexneri 2a str. 301
accgccccugcacu

SEQ ID NO: 1994486 - RNA, 14 nt, Shigella flexneri 2a str. 301
accgccccugcgcu

SEQ ID NO: 1994487 - RNA, 16 nt, Shigella flexneri 2a str. 301
accgcccugcggcuga

SEQ ID NO: 1994488 - RNA, 15 nt, Shigella flexneri 2a str. 301
accgccgaggaacau

SEQ ID NO: 1994489 - RNA, 15 nt, Shigella flexneri 2a str. 301
accgccagcaggaac

SEQ ID NO: 1994490 - RNA, 15 nt, Shigella flexneri 2a str. 301
accgccaucauggau

SEQ ID NO: 1994491 - RNA, 14 nt, Shigella flexneri 2a str. 301
accgcccaccacca

SEQ ID NO: 1994492 - RNA, 15 nt, Shigella flexneri 2a str. 301
accgccagugcagcg

SEQ ID NO: 1994493 - RNA, 16 nt, Shigella flexneri 2a str. 301
accgcagccgccacaa

SEQ ID NO: 1994494 - RNA, 13 nt, Shigella flexneri 2a str. 301
accgcaggcuuuu

SEQ ID NO: 1994495 - RNA, 16 nt, Shigella flexneri 2a str. 301
accgccaaagauaaaa

SEQ ID NO: 1994496 - RNA, 18 nt, Shigella flexneri 2a str. 301
accgccaccaccgaugau

SEQ ID NO: 1994497 - RNA, 19 nt, Shigella flexneri 2a str. 301
accgcauccgcuugcguau

SEQ ID NO: 1994498 - RNA, 13 nt, Shigella flexneri 2a str. 301
accgcaucggcau

SEQ ID NO: 1994499 - RNA, 21 nt, Shigella flexneri 2a str. 301
accgcaucacgacagcaccac

SEQ ID NO: 1994500 - RNA, 16 nt, Shigella flexneri 2a str. 301
accgcaccaccagcag

SEQ ID NO: 1994501 - RNA, 22 nt, Shigella flexneri 2a str. 301
accgcaaucgaucuguuuauca

SEQ ID NO: 1994502 - RNA, 14 nt, Shigella flexneri 2a str. 301
accgcaccaccagc

SEQ ID NO: 1994503 - RNA, 20 nt, Shigella flexneri 2a str. 301
accgcaaaugauuagugcca

SEQ ID NO: 1994504 - RNA, 15 nt, Shigella flexneri 2a str. 301
accgcaacucauuua

SEQ ID NO: 1994505 - RNA, 17 nt, Shigella flexneri 2a str. 301
accgcaagccaaauaca

SEQ ID NO: 1994506 - RNA, 12 nt, Shigella flexneri 2a str. 301
accgauccggca

SEQ ID NO: 1994507 - RNA, 15 nt, Shigella flexneri 2a str. 301
accgauauugccacc

SEQ ID NO: 1994508 - RNA, 21 nt, Shigella flexneri 2a str. 301
accgauauucgccgcgacaca

SEQ ID NO: 1994509 - RNA, 23 nt, Shigella flexneri 2a str. 301
acccucucccgaaugaccgcccc

SEQ ID NO: 1994510 - RNA, 23 nt, Shigella flexneri 2a str. 301
acccucgaccaucuccuuacugc

SEQ ID NO: 1994511 - RNA, 21 nt, Shigella flexneri 2a str. 301
acccucgaccaaaugaaacag

SEQ ID NO: 1994512 - RNA, 15 nt, Shigella flexneri 2a str. 301
accgagaaaaucauc

SEQ ID NO: 1994513 - RNA, 12 nt, Shigella flexneri 2a str. 301
accgagaaaauc

SEQ ID NO: 1994514 - RNA, 16 nt, Shigella flexneri 2a str. 301
acccugacccagaccg

SEQ ID NO: 1994515 - RNA, 22 nt, Shigella flexneri 2a str. 301
accgagauaaugguuuccagca

SEQ ID NO: 1994516 - RNA, 15 nt, Shigella flexneri 2a str. 301
accgagaagcagcaa

SEQ ID NO: 1994517 - RNA, 17 nt, Shigella flexneri 2a str. 301
acccuaaauccgccauc

SEQ ID NO: 1994518 - RNA, 22 nt, Shigella flexneri 2a str. 301
acccguugguuugauagcaaua

SEQ ID NO: 1994519 - RNA, 18 nt, Shigella flexneri 2a str. 301
acccguugguuugauagc

SEQ ID NO: 1994520 - RNA, 16 nt, Shigella flexneri 2a str. 301
accggcaaacuucguc

SEQ ID NO: 1994521 - RNA, 17 nt, Shigella flexneri 2a str. 301
accggauuuuuuuuccg

SEQ ID NO: 1994522 - RNA, 16 nt, Shigella flexneri 2a str. 301
accggcaauaauuaac

SEQ ID NO: 1994523 - RNA, 23 nt, Shigella flexneri 2a str. 301
accgcugcuuaauuacugccuua

SEQ ID NO: 1994524 - RNA, 21 nt, Shigella flexneri 2a str. 301
accgcugcuuaauuacugccu

SEQ ID NO: 1994525 - RNA, 15 nt, Shigella flexneri 2a str. 301
accggagucugugcu

SEQ ID NO: 1994526 - RNA, 18 nt, Shigella flexneri 2a str. 301
accggcguaacggccacg

SEQ ID NO: 1994527 - RNA, 15 nt, Shigella flexneri 2a str. 301
accgggcgaauuuac

SEQ ID NO: 1994528 - RNA, 15 nt, Shigella flexneri 2a str. 301
accgcugacuuucaa

SEQ ID NO: 1994529 - RNA, 23 nt, Shigella flexneri 2a str. 301
accgcugacuuucaaacgccaca

SEQ ID NO: 1994530 - RNA, 17 nt, Shigella flexneri 2a str. 301
accgcgcucagccagcc

SEQ ID NO: 1994531 - RNA, 13 nt, Shigella flexneri 2a str. 301
accgcgaaauaau

SEQ ID NO: 1994532 - RNA, 23 nt, Shigella flexneri 2a str. 301
accgcgaggccuaacaccaucag

SEQ ID NO: 1994533 - RNA, 20 nt, Shigella flexneri 2a str. 301
accgccuccaccugaggggc

SEQ ID NO: 1994534 - RNA, 13 nt, Shigella flexneri 2a str. 301
accaucaccucuu

SEQ ID NO: 1994535 - RNA, 11 nt, Shigella flexneri 2a str. 301
accaucaaucc

SEQ ID NO: 1994536 - RNA, 18 nt, Shigella flexneri 2a str. 301
accaucaacaaacgccag

SEQ ID NO: 1994537 - RNA, 21 nt, Shigella flexneri 2a str. 301
accaucaaguagcagguaauc

SEQ ID NO: 1994538 - RNA, 19 nt, Shigella flexneri 2a str. 301
accauacagcagcaacgau

SEQ ID NO: 1994539 - RNA, 15 nt, Shigella flexneri 2a str. 301
accauacagcagcaa

SEQ ID NO: 1994540 - RNA, 14 nt, Shigella flexneri 2a str. 301
accagaaacaauaa

SEQ ID NO: 1994541 - RNA, 16 nt, Shigella flexneri 2a str. 301
accagaaacaauaagu

SEQ ID NO: 1994542 - RNA, 12 nt, Shigella flexneri 2a str. 301
accagaagagaa

SEQ ID NO: 1994543 - RNA, 14 nt, Shigella flexneri 2a str. 301
accaugcaccaacc

SEQ ID NO: 1994544 - RNA, 22 nt, Shigella flexneri 2a str. 301
accaugccggugaugccgccag

SEQ ID NO: 1994545 - RNA, 13 nt, Shigella flexneri 2a str. 301
accaucagcagca

SEQ ID NO: 1994546 - RNA, 15 nt, Shigella flexneri 2a str. 301
accaucaccucuuca

SEQ ID NO: 1994547 - RNA, 19 nt, Shigella flexneri 2a str. 301
accaucaggaugacaaacu

SEQ ID NO: 1994548 - RNA, 18 nt, Shigella flexneri 2a str. 301
accaucaggaugacaaac

SEQ ID NO: 1994549 - RNA, 16 nt, Shigella flexneri 2a str. 301
accaucauaccgauca

SEQ ID NO: 1994550 - RNA, 13 nt, Shigella flexneri 2a str. 301
accauccaggaga

SEQ ID NO: 1994551 - RNA, 14 nt, Shigella flexneri 2a str. 301
accaucccgccgau

SEQ ID NO: 1994552 - RNA, 11 nt, Shigella flexneri 2a str. 301
accauccauac

SEQ ID NO: 1994553 - RNA, 16 nt, Shigella flexneri 2a str. 301
accaucccaccaccag

SEQ ID NO: 1994554 - RNA, 20 nt, Shigella flexneri 2a str. 301
accauugcugccgccaguuc

SEQ ID NO: 1994555 - RNA, 21 nt, Shigella flexneri 2a str. 301
accauugcugccgccaguucu

SEQ ID NO: 1994556 - RNA, 22 nt, Shigella flexneri 2a str. 301
accauugaggauugcgccuuua

SEQ ID NO: 1994557 - RNA, 15 nt, Shigella flexneri 2a str. 301
accauugauaaucca

SEQ ID NO: 1994558 - RNA, 18 nt, Shigella flexneri 2a str. 301
accauuggucuuugugcc

SEQ ID NO: 1994559 - RNA, 15 nt, Shigella flexneri 2a str. 301
accauuuaaaucaau

SEQ ID NO: 1994560 - RNA, 14 nt, Shigella flexneri 2a str. 301
accauuauuaaauu

SEQ ID NO: 1994561 - RNA, 14 nt, Shigella flexneri 2a str. 301
accauuaucaccaa

SEQ ID NO: 1994562 - RNA, 19 nt, Shigella flexneri 2a str. 301
accauuaaucgauaaacca

SEQ ID NO: 1994563 - RNA, 21 nt, Shigella flexneri 2a str. 301
accauuaaucgauaaaccagc

SEQ ID NO: 1994564 - RNA, 21 nt, Shigella flexneri 2a str. 301
accauuacuguauacgggcuu

SEQ ID NO: 1994565 - RNA, 14 nt, Shigella flexneri 2a str. 301
acccaaccggcaau

SEQ ID NO: 1994566 - RNA, 16 nt, Shigella flexneri 2a str. 301
accauuugugcuggca

SEQ ID NO: 1994567 - RNA, 23 nt, Shigella flexneri 2a str. 301
accauuugugcuggcaaaucagu

SEQ ID NO: 1994568 - RNA, 17 nt, Shigella flexneri 2a str. 301
accauuuugcuguucau

SEQ ID NO: 1994569 - RNA, 22 nt, Shigella flexneri 2a str. 301
acccaacgccacucucgccccu

SEQ ID NO: 1994570 - RNA, 14 nt, Shigella flexneri 2a str. 301
acccaaucccccac

SEQ ID NO: 1994571 - RNA, 20 nt, Shigella flexneri 2a str. 301
acccaaucccccacuuuuaa

SEQ ID NO: 1994572 - RNA, 12 nt, Shigella flexneri 2a str. 301
acccacaccccc

SEQ ID NO: 1994573 - RNA, 17 nt, Shigella flexneri 2a str. 301
acccacaucagcggcac

SEQ ID NO: 1994574 - RNA, 14 nt, Shigella flexneri 2a str. 301
acccacacuucaau

SEQ ID NO: 1994575 - RNA, 23 nt, Shigella flexneri 2a str. 301
accccagguuuucaacgugucuu

SEQ ID NO: 1994576 - RNA, 15 nt, Shigella flexneri 2a str. 301
accccagcucuucuc

SEQ ID NO: 1994577 - RNA, 16 nt, Shigella flexneri 2a str. 301
accccaggcugugcgc

SEQ ID NO: 1994578 - RNA, 17 nt, Shigella flexneri 2a str. 301
acccccaccccggcccu

SEQ ID NO: 1994579 - RNA, 14 nt, Shigella flexneri 2a str. 301
accccgauggcuug

SEQ ID NO: 1994580 - RNA, 16 nt, Shigella flexneri 2a str. 301
accccgccagcagaau

SEQ ID NO: 1994581 - RNA, 21 nt, Shigella flexneri 2a str. 301
accccucuauccagcucaucc

SEQ ID NO: 1994582 - RNA, 13 nt, Shigella flexneri 2a str. 301
acccaugaagaau

SEQ ID NO: 1994583 - RNA, 15 nt, Shigella flexneri 2a str. 301
acccauccagcagag

SEQ ID NO: 1994584 - RNA, 21 nt, Shigella flexneri 2a str. 301
accccacgcucucgcagcuca

SEQ ID NO: 1994585 - RNA, 11 nt, Shigella flexneri 2a str. 301
accccagcaga

SEQ ID NO: 1994586 - RNA, 22 nt, Shigella flexneri 2a str. 301
accccagcgcaagggccgcagc

SEQ ID NO: 1994587 - RNA, 14 nt, Shigella flexneri 2a str. 301
accccaccagcaug

SEQ ID NO: 1994588 - RNA, 15 nt, Shigella flexneri 2a str. 301
accccacagccccga

SEQ ID NO: 1994589 - RNA, 19 nt, Shigella flexneri 2a str. 301
acccauauuuaaucaguuc

SEQ ID NO: 1994590 - RNA, 19 nt, Shigella flexneri 2a str. 301
acccaucaagcgaaaaugc

SEQ ID NO: 1994591 - RNA, 22 nt, Shigella flexneri 2a str. 301
acccaccgggcagacgugacca

SEQ ID NO: 1994592 - RNA, 16 nt, Shigella flexneri 2a str. 301
accccugcggccgguu

SEQ ID NO: 1994593 - RNA, 13 nt, Shigella flexneri 2a str. 301
acccgccugauag

SEQ ID NO: 1994594 - RNA, 15 nt, Shigella flexneri 2a str. 301
acccgcgaccaccag

SEQ ID NO: 1994595 - RNA, 15 nt, Shigella flexneri 2a str. 301
acccgcgaucgccug

SEQ ID NO: 1994596 - RNA, 20 nt, Shigella flexneri 2a str. 301
acccgcucgccauaucuucu

SEQ ID NO: 1994597 - RNA, 18 nt, Shigella flexneri 2a str. 301
acccggaggaaagcaccu

SEQ ID NO: 1994598 - RNA, 15 nt, Shigella flexneri 2a str. 301
acccggcaucaacca

SEQ ID NO: 1994599 - RNA, 18 nt, Shigella flexneri 2a str. 301
acccggccacagcgccag

SEQ ID NO: 1994600 - RNA, 19 nt, Shigella flexneri 2a str. 301
acccgcugcugacuuugac

SEQ ID NO: 1994601 - RNA, 16 nt, Shigella flexneri 2a str. 301
acccggccugcucccg

SEQ ID NO: 1994602 - RNA, 21 nt, Shigella flexneri 2a str. 301
acccggccuguuuauccauca

SEQ ID NO: 1994603 - RNA, 22 nt, Shigella flexneri 2a str. 301
agaaagcaauauugauggaaag

SEQ ID NO: 1994604 - RNA, 16 nt, Shigella flexneri 2a str. 301
agaaagcaaugaaauu

SEQ ID NO: 1994605 - RNA, 18 nt, Shigella flexneri 2a str. 301
agaaagccggaugaucau

SEQ ID NO: 1994606 - RNA, 17 nt, Shigella flexneri 2a str. 301
agaaagaggcggauaaa

SEQ ID NO: 1994607 - RNA, 23 nt, Shigella flexneri 2a str. 301
agaaagagcgucuggaagaagua

SEQ ID NO: 1994608 - RNA, 11 nt, Shigella flexneri 2a str. 301
agaaagaagcc

SEQ ID NO: 1994609 - RNA, 22 nt, Shigella flexneri 2a str. 301
agaaaccgaugacgcauacgug

SEQ ID NO: 1994610 - RNA, 16 nt, Shigella flexneri 2a str. 301
agaaagcgccagcaag

SEQ ID NO: 1994611 - RNA, 22 nt, Shigella flexneri 2a str. 301
agaaagcggaucaguuccagca

SEQ ID NO: 1994612 - RNA, 17 nt, Shigella flexneri 2a str. 301
agaaaggcagagugcaa

SEQ ID NO: 1994613 - RNA, 17 nt, Shigella flexneri 2a str. 301
agaaaggcguuguccuu

SEQ ID NO: 1994614 - RNA, 22 nt, Shigella flexneri 2a str. 301
agaaaguaacaauagcgaacag

SEQ ID NO: 1994615 - RNA, 16 nt, Shigella flexneri 2a str. 301
agaaaguaaucuauau

SEQ ID NO: 1994616 - RNA, 14 nt, Shigella flexneri 2a str. 301
agaaagggaagaac

SEQ ID NO: 1994617 - RNA, 15 nt, Shigella flexneri 2a str. 301
agaaagggaagaaca

SEQ ID NO: 1994618 - RNA, 11 nt, Shigella flexneri 2a str. 301
agaaaggggga

SEQ ID NO: 1994619 - RNA, 19 nt, Shigella flexneri 2a str. 301
agaaaguugccagauaaau

SEQ ID NO: 1994620 - RNA, 14 nt, Shigella flexneri 2a str. 301
agaaaguuuuucaa

SEQ ID NO: 1994621 - RNA, 17 nt, Shigella flexneri 2a str. 301
agaaaguacggccacug

SEQ ID NO: 1994622 - RNA, 22 nt, Shigella flexneri 2a str. 301
agaaauaaucgcaauuacccag

SEQ ID NO: 1994623 - RNA, 23 nt, Shigella flexneri 2a str. 301
agaaauaccacccgucgggcaga

SEQ ID NO: 1994624 - RNA, 15 nt, Shigella flexneri 2a str. 301
agaaaguuuuucaac

SEQ ID NO: 1994625 - RNA, 13 nt, Shigella flexneri 2a str. 301
agaaaaagagcau

SEQ ID NO: 1994626 - RNA, 15 nt, Shigella flexneri 2a str. 301
acuuuuuaacuuuaa

SEQ ID NO: 1994627 - RNA, 21 nt, Shigella flexneri 2a str. 301
agaaacagucuggagcaaaaa

SEQ ID NO: 1994628 - RNA, 12 nt, Shigella flexneri 2a str. 301
agaaacagccau

SEQ ID NO: 1994629 - RNA, 23 nt, Shigella flexneri 2a str. 301
agaaaagcgagaguuacagcucu

SEQ ID NO: 1994630 - RNA, 20 nt, Shigella flexneri 2a str. 301
agaaaacgguugauauacca

SEQ ID NO: 1994631 - RNA, 15 nt, Shigella flexneri 2a str. 301
agaaaacguuucaac

SEQ ID NO: 1994632 - RNA, 16 nt, Shigella flexneri 2a str. 301
agaaaagccaaccugc

SEQ ID NO: 1994633 - RNA, 12 nt, Shigella flexneri 2a str. 301
agaaaagcaaaa

SEQ ID NO: 1994634 - RNA, 16 nt, Shigella flexneri 2a str. 301
agaagcggaaaucacg

SEQ ID NO: 1994635 - RNA, 20 nt, Shigella flexneri 2a str. 301
agaagcggaaaucacgcauc

SEQ ID NO: 1994636 - RNA, 16 nt, Shigella flexneri 2a str. 301
agaagcguaaauccca

SEQ ID NO: 1994637 - RNA, 15 nt, Shigella flexneri 2a str. 301
agaagcggaaaucac

SEQ ID NO: 1994638 - RNA, 15 nt, Shigella flexneri 2a str. 301
agaagcgcgugcuaa

SEQ ID NO: 1994639 - RNA, 19 nt, Shigella flexneri 2a str. 301
agaagcagcaacacaauca

SEQ ID NO: 1994640 - RNA, 13 nt, Shigella flexneri 2a str. 301
agaagcagcaaca

SEQ ID NO: 1994641 - RNA, 19 nt, Shigella flexneri 2a str. 301
agaagcacguucaucccac

SEQ ID NO: 1994642 - RNA, 22 nt, Shigella flexneri 2a str. 301
agaagcaccguugcccggagca

SEQ ID NO: 1994643 - RNA, 20 nt, Shigella flexneri 2a str. 301
agaagauuuuuugccagcac

SEQ ID NO: 1994644 - RNA, 20 nt, Shigella flexneri 2a str. 301
agaagaucguggagaacaau

SEQ ID NO: 1994645 - RNA, 23 nt, Shigella flexneri 2a str. 301
agaaggaaaauacagcaauggaa

SEQ ID NO: 1994646 - RNA, 14 nt, Shigella flexneri 2a str. 301
agaagcuuuccauc

SEQ ID NO: 1994647 - RNA, 23 nt, Shigella flexneri 2a str. 301
agaaggauugaucaauucuaaau

SEQ ID NO: 1994648 - RNA, 12 nt, Shigella flexneri 2a str. 301
agaagcuggcga

SEQ ID NO: 1994649 - RNA, 20 nt, Shigella flexneri 2a str. 301
agaagcugacgacgaagaaa

SEQ ID NO: 1994650 - RNA, 16 nt, Shigella flexneri 2a str. 301
agaaccguaaacagau

SEQ ID NO: 1994651 - RNA, 17 nt, Shigella flexneri 2a str. 301
agaacuguagacaaaau

SEQ ID NO: 1994652 - RNA, 19 nt, Shigella flexneri 2a str. 301
agaacuguagacaaaaugu

SEQ ID NO: 1994653 - RNA, 14 nt, Shigella flexneri 2a str. 301
agaacugcgccaga

SEQ ID NO: 1994654 - RNA, 15 nt, Shigella flexneri 2a str. 301
agaacugcgccagac

SEQ ID NO: 1994655 - RNA, 16 nt, Shigella flexneri 2a str. 301
agaacuccagcccgga

SEQ ID NO: 1994656 - RNA, 18 nt, Shigella flexneri 2a str. 301
agaacuccugaaagcgaa

SEQ ID NO: 1994657 - RNA, 20 nt, Shigella flexneri 2a str. 301
agaacucgaacccgucagag

SEQ ID NO: 1994658 - RNA, 20 nt, Shigella flexneri 2a str. 301
agaacugauaacgcauuuca

SEQ ID NO: 1994659 - RNA, 17 nt, Shigella flexneri 2a str. 301
agaacaaggcuuuaaua

SEQ ID NO: 1994660 - RNA, 17 nt, Shigella flexneri 2a str. 301
agaacaccaccugccag

SEQ ID NO: 1994661 - RNA, 18 nt, Shigella flexneri 2a str. 301
agaacacuucuucugucg

SEQ ID NO: 1994662 - RNA, 15 nt, Shigella flexneri 2a str. 301
agaacauaaacagcg

SEQ ID NO: 1994663 - RNA, 19 nt, Shigella flexneri 2a str. 301
agaacaguucagcagcacu

SEQ ID NO: 1994664 - RNA, 14 nt, Shigella flexneri 2a str. 301
agaacaguuuucag

SEQ ID NO: 1994665 - RNA, 13 nt, Shigella flexneri 2a str. 301
aaaacaauauguc

SEQ ID NO: 1994666 - RNA, 23 nt, Shigella flexneri 2a str. 301
aaaacacaacgcuuucaacaacc

SEQ ID NO: 1994667 - RNA, 18 nt, Shigella flexneri 2a str. 301
aaaacaccacaaaacgga

SEQ ID NO: 1994668 - RNA, 15 nt, Shigella flexneri 2a str. 301
agacagacagccuca

SEQ ID NO: 1994669 - RNA, 16 nt, Shigella flexneri 2a str. 301
agacagccuaccagac

SEQ ID NO: 1994670 - RNA, 17 nt, Shigella flexneri 2a str. 301
agacagcgucacaucag

SEQ ID NO: 1994671 - RNA, 17 nt, Shigella flexneri 2a str. 301
agacaccgcccaacaga

SEQ ID NO: 1994672 - RNA, 21 nt, Shigella flexneri 2a str. 301
agacacgccgccagaccaaua

SEQ ID NO: 1994673 - RNA, 18 nt, Shigella flexneri 2a str. 301
agacaccuugcaacuccg

SEQ ID NO: 1994674 - RNA, 17 nt, Shigella flexneri 2a str. 301
agacaccccuucauuca

SEQ ID NO: 1994675 - RNA, 11 nt, Shigella flexneri 2a str. 301
agacaccagaa

SEQ ID NO: 1994676 - RNA, 19 nt, Shigella flexneri 2a str. 301
agacacccaccauaagccc

SEQ ID NO: 1994677 - RNA, 20 nt, Shigella flexneri 2a str. 301
agacaauuuuucauaaucau

SEQ ID NO: 1994678 - RNA, 21 nt, Shigella flexneri 2a str. 301
agacaauugauggaaaauugu

SEQ ID NO: 1994679 - RNA, 14 nt, Shigella flexneri 2a str. 301
agacaaucgccagu

SEQ ID NO: 1994680 - RNA, 17 nt, Shigella flexneri 2a str. 301
agacaauauaacugcgg

SEQ ID NO: 1994681 - RNA, 13 nt, Shigella flexneri 2a str. 301
agacaacuucccu

SEQ ID NO: 1994682 - RNA, 14 nt, Shigella flexneri 2a str. 301
agacaacuucccug

SEQ ID NO: 1994683 - RNA, 21 nt, Shigella flexneri 2a str. 301
agacaacaugagaacaguuca

SEQ ID NO: 1994684 - RNA, 15 nt, Shigella flexneri 2a str. 301
agacaaccaaaauca

SEQ ID NO: 1994685 - RNA, 14 nt, Shigella flexneri 2a str. 301
agacaacccacaca

SEQ ID NO: 1994686 - RNA, 16 nt, Shigella flexneri 2a str. 301
agacaacccacacauu

SEQ ID NO: 1994687 - RNA, 20 nt, Shigella flexneri 2a str. 301
agaauuuuucgcuaaaaaau

SEQ ID NO: 1994688 - RNA, 17 nt, Shigella flexneri 2a str. 301
agacaaaauccugccag

SEQ ID NO: 1994689 - RNA, 13 nt, Shigella flexneri 2a str. 301
agacaaaauguuc

SEQ ID NO: 1994690 - RNA, 13 nt, Shigella flexneri 2a str. 301
agacaaacagggu

SEQ ID NO: 1994691 - RNA, 13 nt, Shigella flexneri 2a str. 301
agaauuuuucacu

SEQ ID NO: 1994692 - RNA, 22 nt, Shigella flexneri 2a str. 301
agaauguuaacgccaauuaaug

SEQ ID NO: 1994693 - RNA, 21 nt, Shigella flexneri 2a str. 301
agaauugcagauaccacauca

SEQ ID NO: 1994694 - RNA, 15 nt, Shigella flexneri 2a str. 301
agaauugauaaaaaa

SEQ ID NO: 1994695 - RNA, 17 nt, Shigella flexneri 2a str. 301
agaauugauaaaaaaaa

SEQ ID NO: 1994696 - RNA, 19 nt, Shigella flexneri 2a str. 301
agaauguccauuauuucaa

SEQ ID NO: 1994697 - RNA, 14 nt, Shigella flexneri 2a str. 301
agaaugauggcuga

SEQ ID NO: 1994698 - RNA, 17 nt, Shigella flexneri 2a str. 301
agaaugauggcugacgg

SEQ ID NO: 1994699 - RNA, 23 nt, Shigella flexneri 2a str. 301
agaaguaaucuacugcaccgcag

SEQ ID NO: 1994700 - RNA, 22 nt, Shigella flexneri 2a str. 301
agaaguaaacgccgagcuggaa

SEQ ID NO: 1994701 - RNA, 14 nt, Shigella flexneri 2a str. 301
agaagggcuggcca

SEQ ID NO: 1994702 - RNA, 19 nt, Shigella flexneri 2a str. 301
agaauccccacugcauggc

SEQ ID NO: 1994703 - RNA, 17 nt, Shigella flexneri 2a str. 301
agaccggcaaccagcac

SEQ ID NO: 1994704 - RNA, 13 nt, Shigella flexneri 2a str. 301
agaccggcaacca

SEQ ID NO: 1994705 - RNA, 13 nt, Shigella flexneri 2a str. 301
agaccgcaucacg

SEQ ID NO: 1994706 - RNA, 15 nt, Shigella flexneri 2a str. 301
agaccgcagaagccg

SEQ ID NO: 1994707 - RNA, 20 nt, Shigella flexneri 2a str. 301
agaccaguuuuuucaccagc

SEQ ID NO: 1994708 - RNA, 19 nt, Shigella flexneri 2a str. 301
aaaacagccagcagcgaau

SEQ ID NO: 1994709 - RNA, 18 nt, Shigella flexneri 2a str. 301
agaccggcaaccagcacc

SEQ ID NO: 1994710 - RNA, 14 nt, Shigella flexneri 2a str. 301
agacgccagccaca

SEQ ID NO: 1994711 - RNA, 20 nt, Shigella flexneri 2a str. 301
agacgguuaaaaacagccag

SEQ ID NO: 1994712 - RNA, 22 nt, Shigella flexneri 2a str. 301
agacgguuuaucucaucuucca

SEQ ID NO: 1994713 - RNA, 12 nt, Shigella flexneri 2a str. 301
agacgguuuuuc

SEQ ID NO: 1994714 - RNA, 23 nt, Shigella flexneri 2a str. 301
aaaacauagguacagcaccaaaa

SEQ ID NO: 1994715 - RNA, 20 nt, Shigella flexneri 2a str. 301
agacgcacccucaaaauuuc

SEQ ID NO: 1994716 - RNA, 14 nt, Shigella flexneri 2a str. 301
agacgcaacagaaa

SEQ ID NO: 1994717 - RNA, 17 nt, Shigella flexneri 2a str. 301
agacgcacccucaaaau

SEQ ID NO: 1994718 - RNA, 20 nt, Shigella flexneri 2a str. 301
aaaacaggcagcugccagac

SEQ ID NO: 1994719 - RNA, 12 nt, Shigella flexneri 2a str. 301
aaaacagggcuu

SEQ ID NO: 1994720 - RNA, 20 nt, Shigella flexneri 2a str. 301
aaaacagggcuuacugaaaa

SEQ ID NO: 1994721 - RNA, 21 nt, Shigella flexneri 2a str. 301
aaaacagggcuuacugaaaau

SEQ ID NO: 1994722 - RNA, 12 nt, Shigella flexneri 2a str. 301
aaaacagccccu

SEQ ID NO: 1994723 - RNA, 14 nt, Shigella flexneri 2a str. 301
aaaacaguaccaga

SEQ ID NO: 1994724 - RNA, 20 nt, Shigella flexneri 2a str. 301
aaaacaguaccagaccaaca

SEQ ID NO: 1994725 - RNA, 16 nt, Shigella flexneri 2a str. 301
aaaacagugauuacua

SEQ ID NO: 1994726 - RNA, 22 nt, Shigella flexneri 2a str. 301
agacaucgcccgauucacauaa

SEQ ID NO: 1994727 - RNA, 14 nt, Shigella flexneri 2a str. 301
agacaucuguuauc

SEQ ID NO: 1994728 - RNA, 18 nt, Shigella flexneri 2a str. 301
agacauguggauuaaauu

SEQ ID NO: 1994729 - RNA, 19 nt, Shigella flexneri 2a str. 301
agacauucgcgcacggugc

SEQ ID NO: 1994730 - RNA, 19 nt, Shigella flexneri 2a str. 301
agacauuccuuuacuuaga

SEQ ID NO: 1994731 - RNA, 15 nt, Shigella flexneri 2a str. 301
agacauagcacauaa

SEQ ID NO: 1994732 - RNA, 11 nt, Shigella flexneri 2a str. 301
agaccagcacc

SEQ ID NO: 1994733 - RNA, 12 nt, Shigella flexneri 2a str. 301
agaccagcaaaa

SEQ ID NO: 1994734 - RNA, 16 nt, Shigella flexneri 2a str. 301
agaccacuuuccucau

SEQ ID NO: 1994735 - RNA, 19 nt, Shigella flexneri 2a str. 301
agaccaguaaagugcgcuu

SEQ ID NO: 1994736 - RNA, 20 nt, Shigella flexneri 2a str. 301
agaccaguaaagugcgcuuu

SEQ ID NO: 1994737 - RNA, 22 nt, Shigella flexneri 2a str. 301
agaccaaaacgugcagcugccu

SEQ ID NO: 1994738 - RNA, 14 nt, Shigella flexneri 2a str. 301
agaccaaacagcau

SEQ ID NO: 1994739 - RNA, 21 nt, Shigella flexneri 2a str. 301
agaccaaaacgugcagcugcc

SEQ ID NO: 1994740 - RNA, 22 nt, Shigella flexneri 2a str. 301
agaccaaacugcuccuguauga

SEQ ID NO: 1994741 - RNA, 22 nt, Shigella flexneri 2a str. 301
agaccaauccagccggcaaagu

SEQ ID NO: 1994742 - RNA, 18 nt, Shigella flexneri 2a str. 301
agaccaauggcuuuugcc

SEQ ID NO: 1994743 - RNA, 16 nt, Shigella flexneri 2a str. 301
agaccaauccgccagc

SEQ ID NO: 1994744 - RNA, 18 nt, Shigella flexneri 2a str. 301
agaccaauccgccagcca

SEQ ID NO: 1994745 - RNA, 21 nt, Shigella flexneri 2a str. 301
agagcuggcgaacgugcagga

SEQ ID NO: 1994746 - RNA, 20 nt, Shigella flexneri 2a str. 301
agagcuggaaguuacucaaa

SEQ ID NO: 1994747 - RNA, 17 nt, Shigella flexneri 2a str. 301
agagcugaagcauggug

SEQ ID NO: 1994748 - RNA, 14 nt, Shigella flexneri 2a str. 301
agagcgagggagaa

SEQ ID NO: 1994749 - RNA, 19 nt, Shigella flexneri 2a str. 301
agagcaucaugaauauaua

SEQ ID NO: 1994750 - RNA, 15 nt, Shigella flexneri 2a str. 301
agagcaucagcagug

SEQ ID NO: 1994751 - RNA, 22 nt, Shigella flexneri 2a str. 301
agagccugccaauggcaggcuc

SEQ ID NO: 1994752 - RNA, 13 nt, Shigella flexneri 2a str. 301
agagcacaucacu

SEQ ID NO: 1994753 - RNA, 19 nt, Shigella flexneri 2a str. 301
agagaucgaacagcagcag

SEQ ID NO: 1994754 - RNA, 20 nt, Shigella flexneri 2a str. 301
agagaucuugagaaauuaac

SEQ ID NO: 1994755 - RNA, 15 nt, Shigella flexneri 2a str. 301
agacguucuuccugu

SEQ ID NO: 1994756 - RNA, 22 nt, Shigella flexneri 2a str. 301
agacgucccgccgcuaucccau

SEQ ID NO: 1994757 - RNA, 18 nt, Shigella flexneri 2a str. 301
agacguuaacuacaauca

SEQ ID NO: 1994758 - RNA, 18 nt, Shigella flexneri 2a str. 301
agacguccggcgcugcaa

SEQ ID NO: 1994759 - RNA, 21 nt, Shigella flexneri 2a str. 301
agacguucuuccuguggaucg

SEQ ID NO: 1994760 - RNA, 16 nt, Shigella flexneri 2a str. 301
agagaucauacagaug

SEQ ID NO: 1994761 - RNA, 20 nt, Shigella flexneri 2a str. 301
agagggcgauaaaucuccac

SEQ ID NO: 1994762 - RNA, 20 nt, Shigella flexneri 2a str. 301
agagggccggggugggggug

SEQ ID NO: 1994763 - RNA, 20 nt, Shigella flexneri 2a str. 301
agagguaaaaccugacaaca

SEQ ID NO: 1994764 - RNA, 21 nt, Shigella flexneri 2a str. 301
agaggguuagggugaggggaa

SEQ ID NO: 1994765 - RNA, 23 nt, Shigella flexneri 2a str. 301
agaggugggggauccaguccccc

SEQ ID NO: 1994766 - RNA, 14 nt, Shigella flexneri 2a str. 301
agaggucuuuucuc

SEQ ID NO: 1994767 - RNA, 17 nt, Shigella flexneri 2a str. 301
agagguuauaaauaaaa

SEQ ID NO: 1994768 - RNA, 19 nt, Shigella flexneri 2a str. 301
agagguuauaaauaaaaau

SEQ ID NO: 1994769 - RNA, 22 nt, Shigella flexneri 2a str. 301
agagcuuuguugcgcugaagua

SEQ ID NO: 1994770 - RNA, 17 nt, Shigella flexneri 2a str. 301
agagcuuucauuucaau

SEQ ID NO: 1994771 - RNA, 15 nt, Shigella flexneri 2a str. 301
agaggaaucgcuguu

SEQ ID NO: 1994772 - RNA, 22 nt, Shigella flexneri 2a str. 301
agaggcacauagccaccuuaua

SEQ ID NO: 1994773 - RNA, 16 nt, Shigella flexneri 2a str. 301
agaggcgcagaugaag

SEQ ID NO: 1994774 - RNA, 15 nt, Shigella flexneri 2a str. 301
agaucacgcaucacc

SEQ ID NO: 1994775 - RNA, 15 nt, Shigella flexneri 2a str. 301
agaucaccugcugga

SEQ ID NO: 1994776 - RNA, 23 nt, Shigella flexneri 2a str. 301
agauauuggggguaauucccugc

SEQ ID NO: 1994777 - RNA, 15 nt, Shigella flexneri 2a str. 301
agauauuuaaaugau

SEQ ID NO: 1994778 - RNA, 15 nt, Shigella flexneri 2a str. 301
agauauucuccagcu

SEQ ID NO: 1994779 - RNA, 17 nt, Shigella flexneri 2a str. 301
agauauucgcucgccac

SEQ ID NO: 1994780 - RNA, 23 nt, Shigella flexneri 2a str. 301
agauauucgcucgccacuucugc

SEQ ID NO: 1994781 - RNA, 12 nt, Shigella flexneri 2a str. 301
agauaugccagu

SEQ ID NO: 1994782 - RNA, 21 nt, Shigella flexneri 2a str. 301
agauaucccgccagcaccagc

SEQ ID NO: 1994783 - RNA, 23 nt, Shigella flexneri 2a str. 301
agauaucccgccagcaccagcaa

SEQ ID NO: 1994784 - RNA, 17 nt, Shigella flexneri 2a str. 301
agauagcaacagcagcc

SEQ ID NO: 1994785 - RNA, 20 nt, Shigella flexneri 2a str. 301
agauagcacgacguuucuuu

SEQ ID NO: 1994786 - RNA, 20 nt, Shigella flexneri 2a str. 301
agauccagcaccuuuugcug

SEQ ID NO: 1994787 - RNA, 22 nt, Shigella flexneri 2a str. 301
agauccaaaccgacugccugca

SEQ ID NO: 1994788 - RNA, 15 nt, Shigella flexneri 2a str. 301
agauccugaaauucc

SEQ ID NO: 1994789 - RNA, 13 nt, Shigella flexneri 2a str. 301
agauccugaaauu

SEQ ID NO: 1994790 - RNA, 15 nt, Shigella flexneri 2a str. 301
agauccaggaacaga

SEQ ID NO: 1994791 - RNA, 23 nt, Shigella flexneri 2a str. 301
agauccugauccugcaacagcac

SEQ ID NO: 1994792 - RNA, 11 nt, Shigella flexneri 2a str. 301
agauacugcau

SEQ ID NO: 1994793 - RNA, 16 nt, Shigella flexneri 2a str. 301
agauacugaugaacgc

SEQ ID NO: 1994794 - RNA, 17 nt, Shigella flexneri 2a str. 301
agauacggauucuuaac

SEQ ID NO: 1994795 - RNA, 20 nt, Shigella flexneri 2a str. 301
agauagaggucauuaggcca

SEQ ID NO: 1994796 - RNA, 18 nt, Shigella flexneri 2a str. 301
agauaccuaacauuuuac

SEQ ID NO: 1994797 - RNA, 16 nt, Shigella flexneri 2a str. 301
agauaauaauguguuc

SEQ ID NO: 1994798 - RNA, 22 nt, Shigella flexneri 2a str. 301
agauacgaccguuccauucaaa

SEQ ID NO: 1994799 - RNA, 19 nt, Shigella flexneri 2a str. 301
agauacgacugauaucugc

SEQ ID NO: 1994800 - RNA, 12 nt, Shigella flexneri 2a str. 301
agauaagcaagg

SEQ ID NO: 1994801 - RNA, 22 nt, Shigella flexneri 2a str. 301
agauaagcagcguguugcggag

SEQ ID NO: 1994802 - RNA, 15 nt, Shigella flexneri 2a str. 301
agauaaggcguucac

SEQ ID NO: 1994803 - RNA, 18 nt, Shigella flexneri 2a str. 301
agauaaggcguucacgcc

SEQ ID NO: 1994804 - RNA, 22 nt, Shigella flexneri 2a str. 301
agauaaggugccaauccuucuu

SEQ ID NO: 1994805 - RNA, 19 nt, Shigella flexneri 2a str. 301
agaguaggcuggaucagac

SEQ ID NO: 1994806 - RNA, 14 nt, Shigella flexneri 2a str. 301
agaguaguaauugc

SEQ ID NO: 1994807 - RNA, 23 nt, Shigella flexneri 2a str. 301
agaguugagcaguccccacauca

SEQ ID NO: 1994808 - RNA, 15 nt, Shigella flexneri 2a str. 301
agauaaaaugcgaaa

SEQ ID NO: 1994809 - RNA, 16 nt, Shigella flexneri 2a str. 301
agauaaaauuaacgac

SEQ ID NO: 1994810 - RNA, 17 nt, Shigella flexneri 2a str. 301
agauaaacgaccacucu

SEQ ID NO: 1994811 - RNA, 21 nt, Shigella flexneri 2a str. 301
agauaaacgaccacucuuucg

SEQ ID NO: 1994812 - RNA, 17 nt, Shigella flexneri 2a str. 301
agauaagauaaauuccu

SEQ ID NO: 1994813 - RNA, 18 nt, Shigella flexneri 2a str. 301
aaaaccgccucaggcaac

SEQ ID NO: 1994814 - RNA, 20 nt, Shigella flexneri 2a str. 301
aaaaccgcgaugaccaaaaa

SEQ ID NO: 1994815 - RNA, 22 nt, Shigella flexneri 2a str. 301
agaugauaaccccgcaauuuca

SEQ ID NO: 1994816 - RNA, 15 nt, Shigella flexneri 2a str. 301
aaaaccgacuuaaaa

SEQ ID NO: 1994817 - RNA, 14 nt, Shigella flexneri 2a str. 301
aaaaccgaggggcu

SEQ ID NO: 1994818 - RNA, 22 nt, Shigella flexneri 2a str. 301
agauccuguuggccaacccgcg

SEQ ID NO: 1994819 - RNA, 15 nt, Shigella flexneri 2a str. 301
aaaacccguacugcc

SEQ ID NO: 1994820 - RNA, 23 nt, Shigella flexneri 2a str. 301
aaaacccguacugccgaacagaa

SEQ ID NO: 1994821 - RNA, 14 nt, Shigella flexneri 2a str. 301
agauggcggcuggc

SEQ ID NO: 1994822 - RNA, 16 nt, Shigella flexneri 2a str. 301
agauggcgcgcagaaa

SEQ ID NO: 1994823 - RNA, 17 nt, Shigella flexneri 2a str. 301
agaugucggggccagaa

SEQ ID NO: 1994824 - RNA, 21 nt, Shigella flexneri 2a str. 301
agaugucggggccagaacaaa

SEQ ID NO: 1994825 - RNA, 23 nt, Shigella flexneri 2a str. 301
agaugucggggccagaacaaacu

SEQ ID NO: 1994826 - RNA, 16 nt, Shigella flexneri 2a str. 301
agaugcaggaguagaa

SEQ ID NO: 1994827 - RNA, 22 nt, Shigella flexneri 2a str. 301
agaugccauuggcauaaauaau

SEQ ID NO: 1994828 - RNA, 15 nt, Shigella flexneri 2a str. 301
agaugccaaucaguu

SEQ ID NO: 1994829 - RNA, 16 nt, Shigella flexneri 2a str. 301
agauggauugcugaaa

SEQ ID NO: 1994830 - RNA, 20 nt, Shigella flexneri 2a str. 301
agauggauugcugaaauaca

SEQ ID NO: 1994831 - RNA, 13 nt, Shigella flexneri 2a str. 301
agauuacaauucu

SEQ ID NO: 1994832 - RNA, 18 nt, Shigella flexneri 2a str. 301
agauuagccguuaaguuu

SEQ ID NO: 1994833 - RNA, 16 nt, Shigella flexneri 2a str. 301
agaugugcgguggcuu

SEQ ID NO: 1994834 - RNA, 20 nt, Shigella flexneri 2a str. 301
agaugugagcgauacccauu

SEQ ID NO: 1994835 - RNA, 20 nt, Shigella flexneri 2a str. 301
agauuaagagaaccagcugc

SEQ ID NO: 1994836 - RNA, 18 nt, Shigella flexneri 2a str. 301
agauuaaucagcagauau

SEQ ID NO: 1994837 - RNA, 19 nt, Shigella flexneri 2a str. 301
agauguucuaucuuucaga

SEQ ID NO: 1994838 - RNA, 22 nt, Shigella flexneri 2a str. 301
agauucagcagcguggugcuga

SEQ ID NO: 1994839 - RNA, 18 nt, Shigella flexneri 2a str. 301
agauucagcgucgucagc

SEQ ID NO: 1994840 - RNA, 19 nt, Shigella flexneri 2a str. 301
agauugcagacaaagugag

SEQ ID NO: 1994841 - RNA, 18 nt, Shigella flexneri 2a str. 301
agauugcaccacaucggu

SEQ ID NO: 1994842 - RNA, 18 nt, Shigella flexneri 2a str. 301
agauugcgaauauguacu

SEQ ID NO: 1994843 - RNA, 19 nt, Shigella flexneri 2a str. 301
agauugcaaauucucuauu

SEQ ID NO: 1994844 - RNA, 16 nt, Shigella flexneri 2a str. 301
agauugaauuagcaag

SEQ ID NO: 1994845 - RNA, 23 nt, Shigella flexneri 2a str. 301
agauucgcggguaagcgcggagg

SEQ ID NO: 1994846 - RNA, 19 nt, Shigella flexneri 2a str. 301
agauucguauuuaaaaccc

SEQ ID NO: 1994847 - RNA, 12 nt, Shigella flexneri 2a str. 301
agauuucaccaa

SEQ ID NO: 1994848 - RNA, 15 nt, Shigella flexneri 2a str. 301
agauuuauaaaagaa

SEQ ID NO: 1994849 - RNA, 20 nt, Shigella flexneri 2a str. 301
agauuuaauaacaacgauau

SEQ ID NO: 1994850 - RNA, 18 nt, Shigella flexneri 2a str. 301
agauuuaacggcagcaag

SEQ ID NO: 1994851 - RNA, 20 nt, Shigella flexneri 2a str. 301
agauuuacuauuauuuuuca

SEQ ID NO: 1994852 - RNA, 21 nt, Shigella flexneri 2a str. 301
agauuggcuucauugauuaac

SEQ ID NO: 1994853 - RNA, 15 nt, Shigella flexneri 2a str. 301
agauuguugacaaag

SEQ ID NO: 1994854 - RNA, 18 nt, Shigella flexneri 2a str. 301
agauugucggcagccagu

SEQ ID NO: 1994855 - RNA, 13 nt, Shigella flexneri 2a str. 301
agauuuugccagc

SEQ ID NO: 1994856 - RNA, 14 nt, Shigella flexneri 2a str. 301
agauuuuuccccac

SEQ ID NO: 1994857 - RNA, 14 nt, Shigella flexneri 2a str. 301
agauuuuuauccag

SEQ ID NO: 1994858 - RNA, 22 nt, Shigella flexneri 2a str. 301
agcaaaucaaauaauuacuucg

SEQ ID NO: 1994859 - RNA, 20 nt, Shigella flexneri 2a str. 301
agcaaauccaucauaugcgc

SEQ ID NO: 1994860 - RNA, 16 nt, Shigella flexneri 2a str. 301
agcaaauccaucauau

SEQ ID NO: 1994861 - RNA, 20 nt, Shigella flexneri 2a str. 301
agcaaaucgcggcaguggcu

SEQ ID NO: 1994862 - RNA, 22 nt, Shigella flexneri 2a str. 301
agcaaauaaaacaucaccaaug

SEQ ID NO: 1994863 - RNA, 12 nt, Shigella flexneri 2a str. 301
agcaaaggugcc

SEQ ID NO: 1994864 - RNA, 18 nt, Shigella flexneri 2a str. 301
agcaaaguaauaaugauc

SEQ ID NO: 1994865 - RNA, 13 nt, Shigella flexneri 2a str. 301
agcaacaggccag

SEQ ID NO: 1994866 - RNA, 19 nt, Shigella flexneri 2a str. 301
agcaacagaguugccacua

SEQ ID NO: 1994867 - RNA, 22 nt, Shigella flexneri 2a str. 301
agcaacacgccagcguuauccc

SEQ ID NO: 1994868 - RNA, 19 nt, Shigella flexneri 2a str. 301
agcaacaagccaguccaga

SEQ ID NO: 1994869 - RNA, 23 nt, Shigella flexneri 2a str. 301
agcaaauugaggaucugcgccug

SEQ ID NO: 1994870 - RNA, 21 nt, Shigella flexneri 2a str. 301
agcaaauuaucccccagcacu

SEQ ID NO: 1994871 - RNA, 17 nt, Shigella flexneri 2a str. 301
agcaaaugaauuacacg

SEQ ID NO: 1994872 - RNA, 12 nt, Shigella flexneri 2a str. 301
agcaaauuuuua

SEQ ID NO: 1994873 - RNA, 19 nt, Shigella flexneri 2a str. 301
agcaacaaaauggcaaagc

SEQ ID NO: 1994874 - RNA, 22 nt, Shigella flexneri 2a str. 301
agcaacaaaauggcaaagcgau

SEQ ID NO: 1994875 - RNA, 14 nt, Shigella flexneri 2a str. 301
agcaacaaauaacc

SEQ ID NO: 1994876 - RNA, 12 nt, Shigella flexneri 2a str. 301
agcaacaacagc

SEQ ID NO: 1994877 - RNA, 13 nt, Shigella flexneri 2a str. 301
agcaaacaggugc

SEQ ID NO: 1994878 - RNA, 21 nt, Shigella flexneri 2a str. 301
agcaaaaucguaagcaggaga

SEQ ID NO: 1994879 - RNA, 14 nt, Shigella flexneri 2a str. 301
agcaaacgaaagca

SEQ ID NO: 1994880 - RNA, 21 nt, Shigella flexneri 2a str. 301
agcaaagcggucuucugugau

SEQ ID NO: 1994881 - RNA, 14 nt, Shigella flexneri 2a str. 301
agcaaaaucaccau

SEQ ID NO: 1994882 - RNA, 19 nt, Shigella flexneri 2a str. 301
agcaaaauagcuguuuauu

SEQ ID NO: 1994883 - RNA, 22 nt, Shigella flexneri 2a str. 301
agcaaaagugguguugaagaaa

SEQ ID NO: 1994884 - RNA, 12 nt, Shigella flexneri 2a str. 301
agcaaaaucacc

SEQ ID NO: 1994885 - RNA, 24 nt, Shigella flexneri 2a str. 301
agcccgaugauaaauccaucgggc

SEQ ID NO: 1994886 - RNA, 17 nt, Shigella flexneri 2a str. 301
agcccgauggcaucacc

SEQ ID NO: 1994887 - RNA, 19 nt, Shigella flexneri 2a str. 301
agcccgccaucgcccaucc

SEQ ID NO: 1994888 - RNA, 18 nt, Shigella flexneri 2a str. 301
agcccgugcauaggcggc

SEQ ID NO: 1994889 - RNA, 22 nt, Shigella flexneri 2a str. 301
agcccgccuuugaucucaaacg

SEQ ID NO: 1994890 - RNA, 11 nt, Shigella flexneri 2a str. 301
agcccuucuuu

SEQ ID NO: 1994891 - RNA, 18 nt, Shigella flexneri 2a str. 301
agcccuugcuucgccagu

SEQ ID NO: 1994892 - RNA, 12 nt, Shigella flexneri 2a str. 301
agcccuuucuuu

SEQ ID NO: 1994893 - RNA, 12 nt, Shigella flexneri 2a str. 301
agcccugccgga

SEQ ID NO: 1994894 - RNA, 18 nt, Shigella flexneri 2a str. 301
agcccuggcucugcacua

SEQ ID NO: 1994895 - RNA, 14 nt, Shigella flexneri 2a str. 301
agccgcagccauca

SEQ ID NO: 1994896 - RNA, 17 nt, Shigella flexneri 2a str. 301
agccgcagccaucagcg

SEQ ID NO: 1994897 - RNA, 13 nt, Shigella flexneri 2a str. 301
agccgcacgcugg

SEQ ID NO: 1994898 - RNA, 23 nt, Shigella flexneri 2a str. 301
agccgcagaggggaaguugcguc

SEQ ID NO: 1994899 - RNA, 16 nt, Shigella flexneri 2a str. 301
agccgaguagaucaac

SEQ ID NO: 1994900 - RNA, 13 nt, Shigella flexneri 2a str. 301
agcccagccccca

SEQ ID NO: 1994901 - RNA, 17 nt, Shigella flexneri 2a str. 301
agcccacgccgcccaga

SEQ ID NO: 1994902 - RNA, 19 nt, Shigella flexneri 2a str. 301
agcccacgccgcccagaga

SEQ ID NO: 1994903 - RNA, 22 nt, Shigella flexneri 2a str. 301
agcccaugaaucagcaaggaaa

SEQ ID NO: 1994904 - RNA, 19 nt, Shigella flexneri 2a str. 301
agcccaguucagcggcuga

SEQ ID NO: 1994905 - RNA, 23 nt, Shigella flexneri 2a str. 301
agcccauaccacagcaaaacacc

SEQ ID NO: 1994906 - RNA, 23 nt, Shigella flexneri 2a str. 301
agcccaucaguacaccaccuaac

SEQ ID NO: 1994907 - RNA, 22 nt, Shigella flexneri 2a str. 301
agcccaucaccgcgaggccuaa

SEQ ID NO: 1994908 - RNA, 20 nt, Shigella flexneri 2a str. 301
agccccagcgucagcaucau

SEQ ID NO: 1994909 - RNA, 12 nt, Shigella flexneri 2a str. 301
agccccagcacu

SEQ ID NO: 1994910 - RNA, 16 nt, Shigella flexneri 2a str. 301
agccccaccagcaaau

SEQ ID NO: 1994911 - RNA, 21 nt, Shigella flexneri 2a str. 301
agccccgcuuuuuucagcgcc

SEQ ID NO: 1994912 - RNA, 23 nt, Shigella flexneri 2a str. 301
agcccgaaucaguaaugauucgg

SEQ ID NO: 1994913 - RNA, 13 nt, Shigella flexneri 2a str. 301
agccaccucaacg

SEQ ID NO: 1994914 - RNA, 20 nt, Shigella flexneri 2a str. 301
agccaccuggcugcguuuuc

SEQ ID NO: 1994915 - RNA, 18 nt, Shigella flexneri 2a str. 301
agccagaaaguacggcca

SEQ ID NO: 1994916 - RNA, 19 nt, Shigella flexneri 2a str. 301
agccagaccacccguaauc

SEQ ID NO: 1994917 - RNA, 19 nt, Shigella flexneri 2a str. 301
agccacgccgaaccauguc

SEQ ID NO: 1994918 - RNA, 18 nt, Shigella flexneri 2a str. 301
agccagcgcgccuucauu

SEQ ID NO: 1994919 - RNA, 15 nt, Shigella flexneri 2a str. 301
agccagcucgcgcca

SEQ ID NO: 1994920 - RNA, 15 nt, Shigella flexneri 2a str. 301
agccagacagcauca

SEQ ID NO: 1994921 - RNA, 13 nt, Shigella flexneri 2a str. 301
agccagacgccag

SEQ ID NO: 1994922 - RNA, 12 nt, Shigella flexneri 2a str. 301
agcaugcuggcu

SEQ ID NO: 1994923 - RNA, 13 nt, Shigella flexneri 2a str. 301
agcaugcauaaca

SEQ ID NO: 1994924 - RNA, 24 nt, Shigella flexneri 2a str. 301
agcaugauauucacagggaauagc

SEQ ID NO: 1994925 - RNA, 15 nt, Shigella flexneri 2a str. 301
agcaugaucagcgca

SEQ ID NO: 1994926 - RNA, 14 nt, Shigella flexneri 2a str. 301
agcaugcacccuca

SEQ ID NO: 1994927 - RNA, 18 nt, Shigella flexneri 2a str. 301
agcaugacuaccggggac

SEQ ID NO: 1994928 - RNA, 12 nt, Shigella flexneri 2a str. 301
agccaagcaugu

SEQ ID NO: 1994929 - RNA, 15 nt, Shigella flexneri 2a str. 301
agccaacggcucaac

SEQ ID NO: 1994930 - RNA, 20 nt, Shigella flexneri 2a str. 301
agccaacagcagccacacca

SEQ ID NO: 1994931 - RNA, 20 nt, Shigella flexneri 2a str. 301
agcccaaagcagaguugcug

SEQ ID NO: 1994932 - RNA, 18 nt, Shigella flexneri 2a str. 301
agcccaaagcagaguugc

SEQ ID NO: 1994933 - RNA, 14 nt, Shigella flexneri 2a str. 301
agcccaaccaaagc

SEQ ID NO: 1994934 - RNA, 13 nt, Shigella flexneri 2a str. 301
agcccaauaauca

SEQ ID NO: 1994935 - RNA, 23 nt, Shigella flexneri 2a str. 301
agccaugcggcaucuucuccacg

SEQ ID NO: 1994936 - RNA, 19 nt, Shigella flexneri 2a str. 301
agccaugcggcaucuucuc

SEQ ID NO: 1994937 - RNA, 15 nt, Shigella flexneri 2a str. 301
agccaugcccgugcu

SEQ ID NO: 1994938 - RNA, 20 nt, Shigella flexneri 2a str. 301
agccaugcccgugcugacag

SEQ ID NO: 1994939 - RNA, 21 nt, Shigella flexneri 2a str. 301
agccauuaaacaccaguaccu

SEQ ID NO: 1994940 - RNA, 17 nt, Shigella flexneri 2a str. 301
agccauuaaacaccagu

SEQ ID NO: 1994941 - RNA, 17 nt, Shigella flexneri 2a str. 301
agccauguuuaacuccu

SEQ ID NO: 1994942 - RNA, 20 nt, Shigella flexneri 2a str. 301
agccauguuuaacuccuucu

SEQ ID NO: 1994943 - RNA, 12 nt, Shigella flexneri 2a str. 301
agccauucccuc

SEQ ID NO: 1994944 - RNA, 18 nt, Shigella flexneri 2a str. 301
agccauucccucuacauu

SEQ ID NO: 1994945 - RNA, 14 nt, Shigella flexneri 2a str. 301
agccauucccccuu

SEQ ID NO: 1994946 - RNA, 22 nt, Shigella flexneri 2a str. 301
agccauaaucacucuuccccgc

SEQ ID NO: 1994947 - RNA, 15 nt, Shigella flexneri 2a str. 301
agccaucaaucccau

SEQ ID NO: 1994948 - RNA, 16 nt, Shigella flexneri 2a str. 301
agccaucccagacacc

SEQ ID NO: 1994949 - RNA, 22 nt, Shigella flexneri 2a str. 301
agccaggagccaacacuuucac

SEQ ID NO: 1994950 - RNA, 17 nt, Shigella flexneri 2a str. 301
agccaggacgcagucca

SEQ ID NO: 1994951 - RNA, 16 nt, Shigella flexneri 2a str. 301
agccaguuuuucuuuu

SEQ ID NO: 1994952 - RNA, 17 nt, Shigella flexneri 2a str. 301
agccaguuuuucuuuuu

SEQ ID NO: 1994953 - RNA, 20 nt, Shigella flexneri 2a str. 301
agccaguuuuucuuuuucaa

SEQ ID NO: 1994954 - RNA, 13 nt, Shigella flexneri 2a str. 301
agccauaaagaaa

SEQ ID NO: 1994955 - RNA, 22 nt, Shigella flexneri 2a str. 301
agccauaaagaaaucaccugcc

SEQ ID NO: 1994956 - RNA, 21 nt, Shigella flexneri 2a str. 301
agccauaaccccaccagcaug

SEQ ID NO: 1994957 - RNA, 22 nt, Shigella flexneri 2a str. 301
agccauaaccccaccagcauga

SEQ ID NO: 1994958 - RNA, 22 nt, Shigella flexneri 2a str. 301
agcaacgagacgguuaaaaaca

SEQ ID NO: 1994959 - RNA, 17 nt, Shigella flexneri 2a str. 301
agcaaccgguaaagaag

SEQ ID NO: 1994960 - RNA, 13 nt, Shigella flexneri 2a str. 301
agcaaccuuuugc

SEQ ID NO: 1994961 - RNA, 15 nt, Shigella flexneri 2a str. 301
agcaaccaacgccag

SEQ ID NO: 1994962 - RNA, 18 nt, Shigella flexneri 2a str. 301
agcaaccaacgccagcag

SEQ ID NO: 1994963 - RNA, 21 nt, Shigella flexneri 2a str. 301
agcaacaggccaguucgaaau

SEQ ID NO: 1994964 - RNA, 20 nt, Shigella flexneri 2a str. 301
agcaacauaaccugaaagcc

SEQ ID NO: 1994965 - RNA, 12 nt, Shigella flexneri 2a str. 301
agcaacaucaaa

SEQ ID NO: 1994966 - RNA, 16 nt, Shigella flexneri 2a str. 301
agcaaccaaugccacc

SEQ ID NO: 1994967 - RNA, 16 nt, Shigella flexneri 2a str. 301
agcacgucaucugcac

SEQ ID NO: 1994968 - RNA, 19 nt, Shigella flexneri 2a str. 301
agcacguuaaucaaaucaa

SEQ ID NO: 1994969 - RNA, 18 nt, Shigella flexneri 2a str. 301
agcacgucuuccauugcc

SEQ ID NO: 1994970 - RNA, 15 nt, Shigella flexneri 2a str. 301
agcacuaugacugcc

SEQ ID NO: 1994971 - RNA, 21 nt, Shigella flexneri 2a str. 301
agcacuauccgacaucccgcc

SEQ ID NO: 1994972 - RNA, 18 nt, Shigella flexneri 2a str. 301
agcagauacggcgcaucu

SEQ ID NO: 1994973 - RNA, 13 nt, Shigella flexneri 2a str. 301
agcagagagacaa

SEQ ID NO: 1994974 - RNA, 18 nt, Shigella flexneri 2a str. 301
agcagaaccagggaaaaa

SEQ ID NO: 1994975 - RNA, 14 nt, Shigella flexneri 2a str. 301
agcagagaucuuuc

SEQ ID NO: 1994976 - RNA, 18 nt, Shigella flexneri 2a str. 301
agcagauguagcucaccu

SEQ ID NO: 1994977 - RNA, 19 nt, Shigella flexneri 2a str. 301
agcagauaucccgccagca

SEQ ID NO: 1994978 - RNA, 16 nt, Shigella flexneri 2a str. 301
agcagauaucccgcca

SEQ ID NO: 1994979 - RNA, 22 nt, Shigella flexneri 2a str. 301
agcagauauugccccacaccgc

SEQ ID NO: 1994980 - RNA, 21 nt, Shigella flexneri 2a str. 301
agcacugauuuuuuccaacag

SEQ ID NO: 1994981 - RNA, 14 nt, Shigella flexneri 2a str. 301
agcacuugcagcuc

SEQ ID NO: 1994982 - RNA, 17 nt, Shigella flexneri 2a str. 301
agcacuugcaggaacag

SEQ ID NO: 1994983 - RNA, 20 nt, Shigella flexneri 2a str. 301
agcacuugcaggaacagugc

SEQ ID NO: 1994984 - RNA, 19 nt, Shigella flexneri 2a str. 301
agcacuuuucgcacugcag

SEQ ID NO: 1994985 - RNA, 18 nt, Shigella flexneri 2a str. 301
agcacuuucgccugcggc

SEQ ID NO: 1994986 - RNA, 13 nt, Shigella flexneri 2a str. 301
agcagaaagcgac

SEQ ID NO: 1994987 - RNA, 15 nt, Shigella flexneri 2a str. 301
agcagaaaaagaagc

SEQ ID NO: 1994988 - RNA, 16 nt, Shigella flexneri 2a str. 301
agcagaaaaagaagcc

SEQ ID NO: 1994989 - RNA, 13 nt, Shigella flexneri 2a str. 301
agcagaaaagcca

SEQ ID NO: 1994990 - RNA, 21 nt, Shigella flexneri 2a str. 301
agcacuuuucgcacugcaggc

SEQ ID NO: 1994991 - RNA, 17 nt, Shigella flexneri 2a str. 301
agcagccacaccaauca

SEQ ID NO: 1994992 - RNA, 13 nt, Shigella flexneri 2a str. 301
agcagccaccacu

SEQ ID NO: 1994993 - RNA, 16 nt, Shigella flexneri 2a str. 301
agcagcagucaggcgc

SEQ ID NO: 1994994 - RNA, 15 nt, Shigella flexneri 2a str. 301
agcagcauacccacc

SEQ ID NO: 1994995 - RNA, 18 nt, Shigella flexneri 2a str. 301
agcagcaccaccgcccgu

SEQ ID NO: 1994996 - RNA, 21 nt, Shigella flexneri 2a str. 301
agcagcaaugcaggcaccugc

SEQ ID NO: 1994997 - RNA, 14 nt, Shigella flexneri 2a str. 301
agcagcacaccaca

SEQ ID NO: 1994998 - RNA, 20 nt, Shigella flexneri 2a str. 301
agcagcagcgccaacgguga

SEQ ID NO: 1994999 - RNA, 21 nt, Shigella flexneri 2a str. 301
agcagcagcgguugagagaag

SEQ ID NO: 1995000 - RNA, 13 nt, Shigella flexneri 2a str. 301
agcaggcuggcua

SEQ ID NO: 1995001 - RNA, 20 nt, Shigella flexneri 2a str. 301
agcaggcguuaaaacagguc

SEQ ID NO: 1995002 - RNA, 18 nt, Shigella flexneri 2a str. 301
agcaggcguuaaaacagg

SEQ ID NO: 1995003 - RNA, 19 nt, Shigella flexneri 2a str. 301
agcaguaaggucaucaauc

SEQ ID NO: 1995004 - RNA, 19 nt, Shigella flexneri 2a str. 301
agcaguaaaccacccacca

SEQ ID NO: 1995005 - RNA, 20 nt, Shigella flexneri 2a str. 301
agcaguaauugcagcagcug

SEQ ID NO: 1995006 - RNA, 13 nt, Shigella flexneri 2a str. 301
agcaguacagccg

SEQ ID NO: 1995007 - RNA, 23 nt, Shigella flexneri 2a str. 301
agcaguacgccgagaauaaaaca

SEQ ID NO: 1995008 - RNA, 22 nt, Shigella flexneri 2a str. 301
agcaggccggguuuucucccuc

SEQ ID NO: 1995009 - RNA, 21 nt, Shigella flexneri 2a str. 301
agcaggauguuccggcaaagu

SEQ ID NO: 1995010 - RNA, 17 nt, Shigella flexneri 2a str. 301
agcaggcauccugaucg

SEQ ID NO: 1995011 - RNA, 17 nt, Shigella flexneri 2a str. 301
agcagcuacuggugccu

SEQ ID NO: 1995012 - RNA, 23 nt, Shigella flexneri 2a str. 301
agcagcguaccucuaucuugauu

SEQ ID NO: 1995013 - RNA, 22 nt, Shigella flexneri 2a str. 301
agcagcguaacggcucacgccc

SEQ ID NO: 1995014 - RNA, 21 nt, Shigella flexneri 2a str. 301
agcaggaauguuguccagggc

SEQ ID NO: 1995015 - RNA, 13 nt, Shigella flexneri 2a str. 301
agcaggagcagca

SEQ ID NO: 1995016 - RNA, 16 nt, Shigella flexneri 2a str. 301
agcagcggcagaucaa

SEQ ID NO: 1995017 - RNA, 15 nt, Shigella flexneri 2a str. 301
agcagcggagaaaug

SEQ ID NO: 1995018 - RNA, 13 nt, Shigella flexneri 2a str. 301
agcaugaaaugaa

SEQ ID NO: 1995019 - RNA, 16 nt, Shigella flexneri 2a str. 301
agcaucgucaucagcu

SEQ ID NO: 1995020 - RNA, 21 nt, Shigella flexneri 2a str. 301
agcaucguuguuacaacauca

SEQ ID NO: 1995021 - RNA, 14 nt, Shigella flexneri 2a str. 301
agcaucgucaucag

SEQ ID NO: 1995022 - RNA, 18 nt, Shigella flexneri 2a str. 301
agcaucggugaggaucac

SEQ ID NO: 1995023 - RNA, 21 nt, Shigella flexneri 2a str. 301
agcaucggugaggaucaccag

SEQ ID NO: 1995024 - RNA, 22 nt, Shigella flexneri 2a str. 301
agcaucggcagcgccagcgaag

SEQ ID NO: 1995025 - RNA, 16 nt, Shigella flexneri 2a str. 301
agcaucagcgccacca

SEQ ID NO: 1995026 - RNA, 19 nt, Shigella flexneri 2a str. 301
agcaucagcccaaagcaga

SEQ ID NO: 1995027 - RNA, 15 nt, Shigella flexneri 2a str. 301
agcaucagacugaaa

SEQ ID NO: 1995028 - RNA, 18 nt, Shigella flexneri 2a str. 301
agcaucagcagugccagu

SEQ ID NO: 1995029 - RNA, 19 nt, Shigella flexneri 2a str. 301
agcaucgcauccggcacuu

SEQ ID NO: 1995030 - RNA, 23 nt, Shigella flexneri 2a str. 301
agcaucauauggaagaaacgcuu

SEQ ID NO: 1995031 - RNA, 18 nt, Shigella flexneri 2a str. 301
agcauagccccagcgcag

SEQ ID NO: 1995032 - RNA, 20 nt, Shigella flexneri 2a str. 301
agcaucaaugaccugacuuc

SEQ ID NO: 1995033 - RNA, 20 nt, Shigella flexneri 2a str. 301
agcauaccgccgaggaacau

SEQ ID NO: 1995034 - RNA, 18 nt, Shigella flexneri 2a str. 301
agcauacgcugccagcca

SEQ ID NO: 1995035 - RNA, 20 nt, Shigella flexneri 2a str. 301
agcauaccggacgacggcau

SEQ ID NO: 1995036 - RNA, 15 nt, Shigella flexneri 2a str. 301
agcauaccgccgagg

SEQ ID NO: 1995037 - RNA, 18 nt, Shigella flexneri 2a str. 301
agcaguguuuccggcauu

SEQ ID NO: 1995038 - RNA, 21 nt, Shigella flexneri 2a str. 301
agcaguagcgucgccagcagu

SEQ ID NO: 1995039 - RNA, 22 nt, Shigella flexneri 2a str. 301
agcagugaauacccagaaucuc

SEQ ID NO: 1995040 - RNA, 15 nt, Shigella flexneri 2a str. 301
agccuuuuucagccg

SEQ ID NO: 1995041 - RNA, 19 nt, Shigella flexneri 2a str. 301
agccuguuccagacgcugc

SEQ ID NO: 1995042 - RNA, 12 nt, Shigella flexneri 2a str. 301
agccuuucucag

SEQ ID NO: 1995043 - RNA, 23 nt, Shigella flexneri 2a str. 301
agcgaaagucaggauagauagau

SEQ ID NO: 1995044 - RNA, 17 nt, Shigella flexneri 2a str. 301
agcgaaaguaacaccau

SEQ ID NO: 1995045 - RNA, 13 nt, Shigella flexneri 2a str. 301
agcgaaacagcug

SEQ ID NO: 1995046 - RNA, 15 nt, Shigella flexneri 2a str. 301
agcgaauccagcaug

SEQ ID NO: 1995047 - RNA, 15 nt, Shigella flexneri 2a str. 301
agccuguaccacaac

SEQ ID NO: 1995048 - RNA, 20 nt, Shigella flexneri 2a str. 301
agccuguaccacaaccugca

SEQ ID NO: 1995049 - RNA, 16 nt, Shigella flexneri 2a str. 301
agccuggcuaagccac

SEQ ID NO: 1995050 - RNA, 18 nt, Shigella flexneri 2a str. 301
agccuguccacacccaga

SEQ ID NO: 1995051 - RNA, 23 nt, Shigella flexneri 2a str. 301
agccugugcggugacguugucau

SEQ ID NO: 1995052 - RNA, 14 nt, Shigella flexneri 2a str. 301
agccuuaacaagau

SEQ ID NO: 1995053 - RNA, 19 nt, Shigella flexneri 2a str. 301
agccugcagugaaauuaaa

SEQ ID NO: 1995054 - RNA, 19 nt, Shigella flexneri 2a str. 301
agccugccagaggagccau

SEQ ID NO: 1995055 - RNA, 12 nt, Shigella flexneri 2a str. 301
agccugccagag

SEQ ID NO: 1995056 - RNA, 19 nt, Shigella flexneri 2a str. 301
agccugccagcaugcauaa

SEQ ID NO: 1995057 - RNA, 12 nt, Shigella flexneri 2a str. 301
agccugcucccu

SEQ ID NO: 1995058 - RNA, 14 nt, Shigella flexneri 2a str. 301
agccugcgcuucuu

SEQ ID NO: 1995059 - RNA, 18 nt, Shigella flexneri 2a str. 301
agccugcuucaaacgcug

SEQ ID NO: 1995060 - RNA, 21 nt, Shigella flexneri 2a str. 301
agcgagcuggcgcugauaaau

SEQ ID NO: 1995061 - RNA, 18 nt, Shigella flexneri 2a str. 301
agcgacuuugccuggcgg

SEQ ID NO: 1995062 - RNA, 16 nt, Shigella flexneri 2a str. 301
agcgacugcgccgugu

SEQ ID NO: 1995063 - RNA, 13 nt, Shigella flexneri 2a str. 301
agcgacguaaaaa

SEQ ID NO: 1995064 - RNA, 18 nt, Shigella flexneri 2a str. 301
agcgaaugaggcagcaag

SEQ ID NO: 1995065 - RNA, 16 nt, Shigella flexneri 2a str. 301
agcgaauccagcaugc

SEQ ID NO: 1995066 - RNA, 23 nt, Shigella flexneri 2a str. 301
agcgaauccagcaugcucaccac

SEQ ID NO: 1995067 - RNA, 16 nt, Shigella flexneri 2a str. 301
agcgagggagaaaacc

SEQ ID NO: 1995068 - RNA, 21 nt, Shigella flexneri 2a str. 301
agcgagggagaaaacccggcc

SEQ ID NO: 1995069 - RNA, 21 nt, Shigella flexneri 2a str. 301
agcgagguauuuucugaaacg

SEQ ID NO: 1995070 - RNA, 12 nt, Shigella flexneri 2a str. 301
agcgaguuuuuc

SEQ ID NO: 1995071 - RNA, 19 nt, Shigella flexneri 2a str. 301
agcgaguuuuucaguccac

SEQ ID NO: 1995072 - RNA, 14 nt, Shigella flexneri 2a str. 301
agcgaguugaucac

SEQ ID NO: 1995073 - RNA, 15 nt, Shigella flexneri 2a str. 301
agcgauaauuuaugc

SEQ ID NO: 1995074 - RNA, 16 nt, Shigella flexneri 2a str. 301
agcgauacaucaucac

SEQ ID NO: 1995075 - RNA, 19 nt, Shigella flexneri 2a str. 301
agcgauacaucaucacugc

SEQ ID NO: 1995076 - RNA, 21 nt, Shigella flexneri 2a str. 301
agcgauacaucaucacugcca

SEQ ID NO: 1995077 - RNA, 14 nt, Shigella flexneri 2a str. 301
agcgauuaucgcca

SEQ ID NO: 1995078 - RNA, 16 nt, Shigella flexneri 2a str. 301
agcgauuaugaaacaa

SEQ ID NO: 1995079 - RNA, 11 nt, Shigella flexneri 2a str. 301
agcgaugcugc

SEQ ID NO: 1995080 - RNA, 15 nt, Shigella flexneri 2a str. 301
agcgauggugguggg

SEQ ID NO: 1995081 - RNA, 21 nt, Shigella flexneri 2a str. 301
agcgaugguggugggggaagg

SEQ ID NO: 1995082 - RNA, 22 nt, Shigella flexneri 2a str. 301
agcgaucauuagcccaauaauc

SEQ ID NO: 1995083 - RNA, 20 nt, Shigella flexneri 2a str. 301
agcgcaaaauaccagcaauu

SEQ ID NO: 1995084 - RNA, 17 nt, Shigella flexneri 2a str. 301
agcgauuuugccagccg

SEQ ID NO: 1995085 - RNA, 17 nt, Shigella flexneri 2a str. 301
agcgcaaaggccagcaa

SEQ ID NO: 1995086 - RNA, 18 nt, Shigella flexneri 2a str. 301
agcgcaagggccgcagcu

SEQ ID NO: 1995087 - RNA, 14 nt, Shigella flexneri 2a str. 301
agcgcaccaauuca

SEQ ID NO: 1995088 - RNA, 12 nt, Shigella flexneri 2a str. 301
agcgcaccagaa

SEQ ID NO: 1995089 - RNA, 17 nt, Shigella flexneri 2a str. 301
agcgcaccagaaacaau

SEQ ID NO: 1995090 - RNA, 11 nt, Shigella flexneri 2a str. 301
agcgcacaugc

SEQ ID NO: 1995091 - RNA, 14 nt, Shigella flexneri 2a str. 301
agcgcaaucaccac

SEQ ID NO: 1995092 - RNA, 22 nt, Shigella flexneri 2a str. 301
agcgcauccgacuuaucacugc

SEQ ID NO: 1995093 - RNA, 19 nt, Shigella flexneri 2a str. 301
agcgcaucaggcaaucucu

SEQ ID NO: 1995094 - RNA, 21 nt, Shigella flexneri 2a str. 301
agcgcaucaggcaaucuuguu

SEQ ID NO: 1995095 - RNA, 17 nt, Shigella flexneri 2a str. 301
agcgccagccagauggg

SEQ ID NO: 1995096 - RNA, 22 nt, Shigella flexneri 2a str. 301
agcgccagcaagagcaaauaaa

SEQ ID NO: 1995097 - RNA, 23 nt, Shigella flexneri 2a str. 301
agcgccagauaugaucgaaaaug

SEQ ID NO: 1995098 - RNA, 17 nt, Shigella flexneri 2a str. 301
agcgccagacaaaccac

SEQ ID NO: 1995099 - RNA, 21 nt, Shigella flexneri 2a str. 301
agcgccagaaguugcucaagc

SEQ ID NO: 1995100 - RNA, 17 nt, Shigella flexneri 2a str. 301
agcgccacgggcaauaa

SEQ ID NO: 1995101 - RNA, 21 nt, Shigella flexneri 2a str. 301
agcgccacgcuguucgcaacc

SEQ ID NO: 1995102 - RNA, 22 nt, Shigella flexneri 2a str. 301
agcgcaugaucguucaccuaaa

SEQ ID NO: 1995103 - RNA, 16 nt, Shigella flexneri 2a str. 301
agcgcccugcaauguc

SEQ ID NO: 1995104 - RNA, 23 nt, Shigella flexneri 2a str. 301
agcgcccugcaaugucaucagca

SEQ ID NO: 1995105 - RNA, 23 nt, Shigella flexneri 2a str. 301
agcgccaucccuaccgcccgcgc

SEQ ID NO: 1995106 - RNA, 20 nt, Shigella flexneri 2a str. 301
agcgccaguuuuuguuucug

SEQ ID NO: 1995107 - RNA, 15 nt, Shigella flexneri 2a str. 301
agcgccagccauuca

SEQ ID NO: 1995108 - RNA, 20 nt, Shigella flexneri 2a str. 301
agcgcgcgccgccaaucacg

SEQ ID NO: 1995109 - RNA, 21 nt, Shigella flexneri 2a str. 301
agcgcgccgccaauaaucagc

SEQ ID NO: 1995110 - RNA, 15 nt, Shigella flexneri 2a str. 301
agcgcggcgcaggca

SEQ ID NO: 1995111 - RNA, 19 nt, Shigella flexneri 2a str. 301
agcgccuucuacagcuuca

SEQ ID NO: 1995112 - RNA, 15 nt, Shigella flexneri 2a str. 301
agcgccuuauccugc

SEQ ID NO: 1995113 - RNA, 18 nt, Shigella flexneri 2a str. 301
agcgccucuuccauaauc

SEQ ID NO: 1995114 - RNA, 21 nt, Shigella flexneri 2a str. 301
agcgccugcgcggcaaugcgc

SEQ ID NO: 1995115 - RNA, 20 nt, Shigella flexneri 2a str. 301
agcgccgccagaaucaccuc

SEQ ID NO: 1995116 - RNA, 14 nt, Shigella flexneri 2a str. 301
agcgccgccacugc

SEQ ID NO: 1995117 - RNA, 19 nt, Shigella flexneri 2a str. 301
agcgccgccacugccacca

SEQ ID NO: 1995118 - RNA, 18 nt, Shigella flexneri 2a str. 301
agcgccgacagcagcccu

SEQ ID NO: 1995119 - RNA, 19 nt, Shigella flexneri 2a str. 301
agcgccgacagcagcccuu

SEQ ID NO: 1995120 - RNA, 22 nt, Shigella flexneri 2a str. 301
agcgccgaguaaaaaaacauca

SEQ ID NO: 1995121 - RNA, 21 nt, Shigella flexneri 2a str. 301
agcgugauuguggcaaucaua

SEQ ID NO: 1995122 - RNA, 15 nt, Shigella flexneri 2a str. 301
agcgugcaaauauac

SEQ ID NO: 1995123 - RNA, 16 nt, Shigella flexneri 2a str. 301
agcgugcauagcagca

SEQ ID NO: 1995124 - RNA, 16 nt, Shigella flexneri 2a str. 301
agcgugccaggcgcgc

SEQ ID NO: 1995125 - RNA, 14 nt, Shigella flexneri 2a str. 301
agcgugcucucaaa

SEQ ID NO: 1995126 - RNA, 18 nt, Shigella flexneri 2a str. 301
agcguggauuggguacaa

SEQ ID NO: 1995127 - RNA, 20 nt, Shigella flexneri 2a str. 301
agcguggugauaccagacca

SEQ ID NO: 1995128 - RNA, 14 nt, Shigella flexneri 2a str. 301
agcguuaaaacuuu

SEQ ID NO: 1995129 - RNA, 15 nt, Shigella flexneri 2a str. 301
agcguuaaucaucaa

SEQ ID NO: 1995130 - RNA, 21 nt, Shigella flexneri 2a str. 301
agcguuaaugauaucccugcu

SEQ ID NO: 1995131 - RNA, 22 nt, Shigella flexneri 2a str. 301
agcguguaaaaagauaaacggc

SEQ ID NO: 1995132 - RNA, 19 nt, Shigella flexneri 2a str. 301
agcguguaaaaagauaaac

SEQ ID NO: 1995133 - RNA, 20 nt, Shigella flexneri 2a str. 301
agcguguuaaugcccaucag

SEQ ID NO: 1995134 - RNA, 23 nt, Shigella flexneri 2a str. 301
agcguucagugaucgccugcaug

SEQ ID NO: 1995135 - RNA, 19 nt, Shigella flexneri 2a str. 301
agcguuccacgugcggccg

SEQ ID NO: 1995136 - RNA, 17 nt, Shigella flexneri 2a str. 301
agcguuccauugggcug

SEQ ID NO: 1995137 - RNA, 16 nt, Shigella flexneri 2a str. 301
agcguuacuucaccuu

SEQ ID NO: 1995138 - RNA, 16 nt, Shigella flexneri 2a str. 301
agcguccagcccuccg

SEQ ID NO: 1995139 - RNA, 15 nt, Shigella flexneri 2a str. 301
agcgucccaguaacg

SEQ ID NO: 1995140 - RNA, 20 nt, Shigella flexneri 2a str. 301
agcguaaaggcggcagaaca

SEQ ID NO: 1995141 - RNA, 14 nt, Shigella flexneri 2a str. 301
agcgguuuugccag

SEQ ID NO: 1995142 - RNA, 16 nt, Shigella flexneri 2a str. 301
agcgguuuugccagcg

SEQ ID NO: 1995143 - RNA, 22 nt, Shigella flexneri 2a str. 301
agcgguuguucaagcaucgcaa

SEQ ID NO: 1995144 - RNA, 12 nt, Shigella flexneri 2a str. 301
agcgugagggaa

SEQ ID NO: 1995145 - RNA, 15 nt, Shigella flexneri 2a str. 301
agcgugacuggcagg

SEQ ID NO: 1995146 - RNA, 16 nt, Shigella flexneri 2a str. 301
agcgugaaacgcguuu

SEQ ID NO: 1995147 - RNA, 19 nt, Shigella flexneri 2a str. 301
agcgucccaguaacguccc

SEQ ID NO: 1995148 - RNA, 16 nt, Shigella flexneri 2a str. 301
agcgucaguagauuuc

SEQ ID NO: 1995149 - RNA, 19 nt, Shigella flexneri 2a str. 301
agcgucgcaucaggcauga

SEQ ID NO: 1995150 - RNA, 13 nt, Shigella flexneri 2a str. 301
agcgcguucuguu

SEQ ID NO: 1995151 - RNA, 21 nt, Shigella flexneri 2a str. 301
agcgcuaauacgaugcaaccg

SEQ ID NO: 1995152 - RNA, 22 nt, Shigella flexneri 2a str. 301
agcggccccauuuauuucucac

SEQ ID NO: 1995153 - RNA, 18 nt, Shigella flexneri 2a str. 301
agcggggaacaucaggca

SEQ ID NO: 1995154 - RNA, 17 nt, Shigella flexneri 2a str. 301
agcgggcguugaagcgu

SEQ ID NO: 1995155 - RNA, 16 nt, Shigella flexneri 2a str. 301
agcgggccggagggca

SEQ ID NO: 1995156 - RNA, 13 nt, Shigella flexneri 2a str. 301
agcggcugcgcag

SEQ ID NO: 1995157 - RNA, 15 nt, Shigella flexneri 2a str. 301
agcggcugaauaucc

SEQ ID NO: 1995158 - RNA, 22 nt, Shigella flexneri 2a str. 301
agcucaucaagcuguucuuccc

SEQ ID NO: 1995159 - RNA, 23 nt, Shigella flexneri 2a str. 301
agcucaguugguuagagcacauc

SEQ ID NO: 1995160 - RNA, 18 nt, Shigella flexneri 2a str. 301
agcucaucguuacgccca

SEQ ID NO: 1995161 - RNA, 22 nt, Shigella flexneri 2a str. 301
agcucacaaauacgcuuuuucc

SEQ ID NO: 1995162 - RNA, 16 nt, Shigella flexneri 2a str. 301
agcucaauacaaccca

SEQ ID NO: 1995163 - RNA, 19 nt, Shigella flexneri 2a str. 301
agcucacggccggucauuu

SEQ ID NO: 1995164 - RNA, 19 nt, Shigella flexneri 2a str. 301
agcucagcuggauagagua

SEQ ID NO: 1995165 - RNA, 15 nt, Shigella flexneri 2a str. 301
agcucagugaccgaa

SEQ ID NO: 1995166 - RNA, 19 nt, Shigella flexneri 2a str. 301
agcucaguuaacggcauaa

SEQ ID NO: 1995167 - RNA, 19 nt, Shigella flexneri 2a str. 301
agcuauaaaccugcuggcg

SEQ ID NO: 1995168 - RNA, 15 nt, Shigella flexneri 2a str. 301
agcucaauaaaagaa

SEQ ID NO: 1995169 - RNA, 19 nt, Shigella flexneri 2a str. 301
agcucaauaaaagaaauca

SEQ ID NO: 1995170 - RNA, 21 nt, Shigella flexneri 2a str. 301
agcuauguuugaaccagauau

SEQ ID NO: 1995171 - RNA, 13 nt, Shigella flexneri 2a str. 301
agcguuucaagug

SEQ ID NO: 1995172 - RNA, 15 nt, Shigella flexneri 2a str. 301
agcguuugcggcugu

SEQ ID NO: 1995173 - RNA, 15 nt, Shigella flexneri 2a str. 301
agcguuguaacaauc

SEQ ID NO: 1995174 - RNA, 17 nt, Shigella flexneri 2a str. 301
agcguucgccaaaccca

SEQ ID NO: 1995175 - RNA, 15 nt, Shigella flexneri 2a str. 301
agcuaacgaaagaac

SEQ ID NO: 1995176 - RNA, 18 nt, Shigella flexneri 2a str. 301
agcuaacucuaaucccuu

SEQ ID NO: 1995177 - RNA, 13 nt, Shigella flexneri 2a str. 301
agcuaaaucacac

SEQ ID NO: 1995178 - RNA, 13 nt, Shigella flexneri 2a str. 301
agcguuuucucaa

SEQ ID NO: 1995179 - RNA, 14 nt, Shigella flexneri 2a str. 301
agcuaaucaucauc

SEQ ID NO: 1995180 - RNA, 23 nt, Shigella flexneri 2a str. 301
agcuaauuuuuguuguuuaaaug

SEQ ID NO: 1995181 - RNA, 20 nt, Shigella flexneri 2a str. 301
agcuaauccccuccagcgag

SEQ ID NO: 1995182 - RNA, 16 nt, Shigella flexneri 2a str. 301
agcuaccggauuuuuu

SEQ ID NO: 1995183 - RNA, 20 nt, Shigella flexneri 2a str. 301
agguuucacguaccagaugc

SEQ ID NO: 1995184 - RNA, 22 nt, Shigella flexneri 2a str. 301
agguuucauagcgucccaguaa

SEQ ID NO: 1995185 - RNA, 14 nt, Shigella flexneri 2a str. 301
agguuuaaacagag

SEQ ID NO: 1995186 - RNA, 16 nt, Shigella flexneri 2a str. 301
agguuuaccagcagcc

SEQ ID NO: 1995187 - RNA, 19 nt, Shigella flexneri 2a str. 301
agguuuaccagcagcccug

SEQ ID NO: 1995188 - RNA, 19 nt, Shigella flexneri 2a str. 301
agguuucuuuuuaaagaga

SEQ ID NO: 1995189 - RNA, 18 nt, Shigella flexneri 2a str. 301
aguaaacgccgagcugga

SEQ ID NO: 1995190 - RNA, 19 nt, Shigella flexneri 2a str. 301
aguaaaaggucugaaagau

SEQ ID NO: 1995191 - RNA, 22 nt, Shigella flexneri 2a str. 301
aguaaaacggauaugauuuaaa

SEQ ID NO: 1995192 - RNA, 16 nt, Shigella flexneri 2a str. 301
agguuggaucaacagg

SEQ ID NO: 1995193 - RNA, 17 nt, Shigella flexneri 2a str. 301
agguugcugcgccccac

SEQ ID NO: 1995194 - RNA, 20 nt, Shigella flexneri 2a str. 301
agguuguagauuuugcagau

SEQ ID NO: 1995195 - RNA, 17 nt, Shigella flexneri 2a str. 301
agguuguagauuuugca

SEQ ID NO: 1995196 - RNA, 17 nt, Shigella flexneri 2a str. 301
agguuguuaaccaccag

SEQ ID NO: 1995197 - RNA, 17 nt, Shigella flexneri 2a str. 301
aggugcuuuaacgaaag

SEQ ID NO: 1995198 - RNA, 15 nt, Shigella flexneri 2a str. 301
agguugacgcugcaa

SEQ ID NO: 1995199 - RNA, 17 nt, Shigella flexneri 2a str. 301
agguggccgagaggcug

SEQ ID NO: 1995200 - RNA, 19 nt, Shigella flexneri 2a str. 301
aguaaagcgcgucaccacc

SEQ ID NO: 1995201 - RNA, 18 nt, Shigella flexneri 2a str. 301
aguaacagguuuugauua

SEQ ID NO: 1995202 - RNA, 21 nt, Shigella flexneri 2a str. 301
aguaacagauuguggugccga

SEQ ID NO: 1995203 - RNA, 14 nt, Shigella flexneri 2a str. 301
aguaauaaugccca

SEQ ID NO: 1995204 - RNA, 11 nt, Shigella flexneri 2a str. 301
aguaauaacuu

SEQ ID NO: 1995205 - RNA, 14 nt, Shigella flexneri 2a str. 301
aguaauaacuuccu

SEQ ID NO: 1995206 - RNA, 15 nt, Shigella flexneri 2a str. 301
aguaaggguuuuuuu

SEQ ID NO: 1995207 - RNA, 23 nt, Shigella flexneri 2a str. 301
aguaaggcugcgagguuauccgc

SEQ ID NO: 1995208 - RNA, 19 nt, Shigella flexneri 2a str. 301
aguaaccacggcagcaacu

SEQ ID NO: 1995209 - RNA, 19 nt, Shigella flexneri 2a str. 301
aguaccacgguacgccaga

SEQ ID NO: 1995210 - RNA, 21 nt, Shigella flexneri 2a str. 301
aguaccacgguacgccagagu

SEQ ID NO: 1995211 - RNA, 13 nt, Shigella flexneri 2a str. 301
aguaccagcagcg

SEQ ID NO: 1995212 - RNA, 16 nt, Shigella flexneri 2a str. 301
aguacauuguuuucca

SEQ ID NO: 1995213 - RNA, 16 nt, Shigella flexneri 2a str. 301
aguaauugcagcagcu

SEQ ID NO: 1995214 - RNA, 21 nt, Shigella flexneri 2a str. 301
aguaaucuacugcaccgcagg

SEQ ID NO: 1995215 - RNA, 17 nt, Shigella flexneri 2a str. 301
aguaauugcuuuuacca

SEQ ID NO: 1995216 - RNA, 18 nt, Shigella flexneri 2a str. 301
aguaaucgggcaacugcu

SEQ ID NO: 1995217 - RNA, 21 nt, Shigella flexneri 2a str. 301
aguaauccuuucucaauuaac

SEQ ID NO: 1995218 - RNA, 17 nt, Shigella flexneri 2a str. 301
aguaaucgccagcaaaa

SEQ ID NO: 1995219 - RNA, 14 nt, Shigella flexneri 2a str. 301
aguaauccuuucuc

SEQ ID NO: 1995220 - RNA, 22 nt, Shigella flexneri 2a str. 301
aguaauauucaacgucacuggg

SEQ ID NO: 1995221 - RNA, 14 nt, Shigella flexneri 2a str. 301
aguaaucaggcuau

SEQ ID NO: 1995222 - RNA, 12 nt, Shigella flexneri 2a str. 301
aguaauaaugcc

SEQ ID NO: 1995223 - RNA, 13 nt, Shigella flexneri 2a str. 301
aguaaucacgaau

SEQ ID NO: 1995224 - RNA, 18 nt, Shigella flexneri 2a str. 301
aguaauauccccagccua

SEQ ID NO: 1995225 - RNA, 13 nt, Shigella flexneri 2a str. 301
aguauuuccagcu

SEQ ID NO: 1995226 - RNA, 22 nt, Shigella flexneri 2a str. 301
aguauugucuccgcugagacgc

SEQ ID NO: 1995227 - RNA, 21 nt, Shigella flexneri 2a str. 301
aguaugauacguuuauuacca

SEQ ID NO: 1995228 - RNA, 17 nt, Shigella flexneri 2a str. 301
aguaugcaauaacaaua

SEQ ID NO: 1995229 - RNA, 19 nt, Shigella flexneri 2a str. 301
aguaugcaauaacaauacu

SEQ ID NO: 1995230 - RNA, 20 nt, Shigella flexneri 2a str. 301
aguaugcaauaacaauacuu

SEQ ID NO: 1995231 - RNA, 16 nt, Shigella flexneri 2a str. 301
aguauuaagccaguuc

SEQ ID NO: 1995232 - RNA, 12 nt, Shigella flexneri 2a str. 301
aguaucaccauc

SEQ ID NO: 1995233 - RNA, 22 nt, Shigella flexneri 2a str. 301
aguauccacacagacaauaaac

SEQ ID NO: 1995234 - RNA, 22 nt, Shigella flexneri 2a str. 301
aguauccaugcgcauuaagcca

SEQ ID NO: 1995235 - RNA, 21 nt, Shigella flexneri 2a str. 301
aguaucgcucaauauccugac

SEQ ID NO: 1995236 - RNA, 22 nt, Shigella flexneri 2a str. 301
aguaugacaacuuucaucagca

SEQ ID NO: 1995237 - RNA, 16 nt, Shigella flexneri 2a str. 301
aguaugacuuuaugcu

SEQ ID NO: 1995238 - RNA, 15 nt, Shigella flexneri 2a str. 301
aguaucugaaucaaa

SEQ ID NO: 1995239 - RNA, 19 nt, Shigella flexneri 2a str. 301
aguaucugaaucaaaauca

SEQ ID NO: 1995240 - RNA, 17 nt, Shigella flexneri 2a str. 301
aguauauaaaaaacaau

SEQ ID NO: 1995241 - RNA, 12 nt, Shigella flexneri 2a str. 301
aguaucaauuau

SEQ ID NO: 1995242 - RNA, 17 nt, Shigella flexneri 2a str. 301
aguagaucuugauuuac

SEQ ID NO: 1995243 - RNA, 13 nt, Shigella flexneri 2a str. 301
aguagaucaacac

SEQ ID NO: 1995244 - RNA, 21 nt, Shigella flexneri 2a str. 301
aguagagugguuuuucaacau

SEQ ID NO: 1995245 - RNA, 18 nt, Shigella flexneri 2a str. 301
aguacccaugugauuuaa

SEQ ID NO: 1995246 - RNA, 19 nt, Shigella flexneri 2a str. 301
aguacccaugugauuuaaa

SEQ ID NO: 1995247 - RNA, 18 nt, Shigella flexneri 2a str. 301
aguaccaucguccagcag

SEQ ID NO: 1995248 - RNA, 20 nt, Shigella flexneri 2a str. 301
aguaccagcgcacucgcaga

SEQ ID NO: 1995249 - RNA, 20 nt, Shigella flexneri 2a str. 301
aguaccaucguccagcagca

SEQ ID NO: 1995250 - RNA, 23 nt, Shigella flexneri 2a str. 301
aguaccaucguccagcagcaaug

SEQ ID NO: 1995251 - RNA, 17 nt, Shigella flexneri 2a str. 301
aguagcgcaaucaccac

SEQ ID NO: 1995252 - RNA, 22 nt, Shigella flexneri 2a str. 301
aguagccucgccgagcaguugc

SEQ ID NO: 1995253 - RNA, 19 nt, Shigella flexneri 2a str. 301
aguagcgucgccagcaguu

SEQ ID NO: 1995254 - RNA, 14 nt, Shigella flexneri 2a str. 301
aguagccagacaau

SEQ ID NO: 1995255 - RNA, 16 nt, Shigella flexneri 2a str. 301
aguaguucauccccuc

SEQ ID NO: 1995256 - RNA, 15 nt, Shigella flexneri 2a str. 301
aguaguuccagcaug

SEQ ID NO: 1995257 - RNA, 13 nt, Shigella flexneri 2a str. 301
aggcggcagaaca

SEQ ID NO: 1995258 - RNA, 22 nt, Shigella flexneri 2a str. 301
aggcuuuaaacgauuccacuuu

SEQ ID NO: 1995259 - RNA, 19 nt, Shigella flexneri 2a str. 301
aggcuuuccugauaaucca

SEQ ID NO: 1995260 - RNA, 18 nt, Shigella flexneri 2a str. 301
aggcuuuuuugguaauga

SEQ ID NO: 1995261 - RNA, 16 nt, Shigella flexneri 2a str. 301
agggaaacggagcaaa

SEQ ID NO: 1995262 - RNA, 16 nt, Shigella flexneri 2a str. 301
agggaaacaacaccgu

SEQ ID NO: 1995263 - RNA, 19 nt, Shigella flexneri 2a str. 301
agggaaauaaucgggaaua

SEQ ID NO: 1995264 - RNA, 15 nt, Shigella flexneri 2a str. 301
agggaauccagcaau

SEQ ID NO: 1995265 - RNA, 19 nt, Shigella flexneri 2a str. 301
agggaggggugcaugaaaa

SEQ ID NO: 1995266 - RNA, 23 nt, Shigella flexneri 2a str. 301
agggaguaugcggucaaaagcug

SEQ ID NO: 1995267 - RNA, 22 nt, Shigella flexneri 2a str. 301
agggagucuugcuggaugccag

SEQ ID NO: 1995268 - RNA, 18 nt, Shigella flexneri 2a str. 301
agggaggauuucuccccc

SEQ ID NO: 1995269 - RNA, 22 nt, Shigella flexneri 2a str. 301
agggagagggccgggguggggg

SEQ ID NO: 1995270 - RNA, 15 nt, Shigella flexneri 2a str. 301
agggcugauaaacaa

SEQ ID NO: 1995271 - RNA, 22 nt, Shigella flexneri 2a str. 301
agggcuggcaaauucaggagca

SEQ ID NO: 1995272 - RNA, 21 nt, Shigella flexneri 2a str. 301
agggcuguuuaucgugaauuc

SEQ ID NO: 1995273 - RNA, 14 nt, Shigella flexneri 2a str. 301
agggcuuccaccug

SEQ ID NO: 1995274 - RNA, 22 nt, Shigella flexneri 2a str. 301
aggggcggguuuuuuuauaucu

SEQ ID NO: 1995275 - RNA, 14 nt, Shigella flexneri 2a str. 301
aggguaagggagga

SEQ ID NO: 1995276 - RNA, 17 nt, Shigella flexneri 2a str. 301
aggguaaacaacaugcu

SEQ ID NO: 1995277 - RNA, 20 nt, Shigella flexneri 2a str. 301
agggcaagcgccuaaaucca

SEQ ID NO: 1995278 - RNA, 21 nt, Shigella flexneri 2a str. 301
agggcaagcgccuaaauccac

SEQ ID NO: 1995279 - RNA, 21 nt, Shigella flexneri 2a str. 301
agggcaaccugcuuuaaaagc

SEQ ID NO: 1995280 - RNA, 13 nt, Shigella flexneri 2a str. 301
aggucgugccaga

SEQ ID NO: 1995281 - RNA, 14 nt, Shigella flexneri 2a str. 301
aggucggcuuugaa

SEQ ID NO: 1995282 - RNA, 22 nt, Shigella flexneri 2a str. 301
aggucgguccgucaagaucggc

SEQ ID NO: 1995283 - RNA, 13 nt, Shigella flexneri 2a str. 301
aggucgcacugcu

SEQ ID NO: 1995284 - RNA, 16 nt, Shigella flexneri 2a str. 301
agguccccgagcacau

SEQ ID NO: 1995285 - RNA, 16 nt, Shigella flexneri 2a str. 301
aggucaucacauccca

SEQ ID NO: 1995286 - RNA, 17 nt, Shigella flexneri 2a str. 301
aggucaucacaucccag

SEQ ID NO: 1995287 - RNA, 20 nt, Shigella flexneri 2a str. 301
aggucaucauugcagucaua

SEQ ID NO: 1995288 - RNA, 21 nt, Shigella flexneri 2a str. 301
aggucauugcgacgagaaaau

SEQ ID NO: 1995289 - RNA, 17 nt, Shigella flexneri 2a str. 301
agguaucuguaccccug

SEQ ID NO: 1995290 - RNA, 15 nt, Shigella flexneri 2a str. 301
agguaucgcacugau

SEQ ID NO: 1995291 - RNA, 18 nt, Shigella flexneri 2a str. 301
agguaucgcgaaaaaaaa

SEQ ID NO: 1995292 - RNA, 21 nt, Shigella flexneri 2a str. 301
agguaucgcgaaaaaaaagau

SEQ ID NO: 1995293 - RNA, 12 nt, Shigella flexneri 2a str. 301
agguacaaagcc

SEQ ID NO: 1995294 - RNA, 22 nt, Shigella flexneri 2a str. 301
agguaaugaauggacuccaccg

SEQ ID NO: 1995295 - RNA, 19 nt, Shigella flexneri 2a str. 301
agguacaaccgcaaagguu

SEQ ID NO: 1995296 - RNA, 14 nt, Shigella flexneri 2a str. 301
agguacaaagccaa

SEQ ID NO: 1995297 - RNA, 23 nt, Shigella flexneri 2a str. 301
agguacaaccgcaaagguugcug

SEQ ID NO: 1995298 - RNA, 15 nt, Shigella flexneri 2a str. 301
agguacgcuccagca

SEQ ID NO: 1995299 - RNA, 12 nt, Shigella flexneri 2a str. 301
agggugccggga

SEQ ID NO: 1995300 - RNA, 14 nt, Shigella flexneri 2a str. 301
agggugagggagga

SEQ ID NO: 1995301 - RNA, 20 nt, Shigella flexneri 2a str. 301
aggguaguguccauaaaaca

SEQ ID NO: 1995302 - RNA, 18 nt, Shigella flexneri 2a str. 301
agguaagauguucuaucu

SEQ ID NO: 1995303 - RNA, 19 nt, Shigella flexneri 2a str. 301
agguaagaguuucaacauc

SEQ ID NO: 1995304 - RNA, 15 nt, Shigella flexneri 2a str. 301
agguaagagugaauu

SEQ ID NO: 1995305 - RNA, 22 nt, Shigella flexneri 2a str. 301
agguaacgucgguuucaucaca

SEQ ID NO: 1995306 - RNA, 23 nt, Shigella flexneri 2a str. 301
agguaacgucgguuucaucacau

SEQ ID NO: 1995307 - RNA, 16 nt, Shigella flexneri 2a str. 301
aggccgacagcaggcu

SEQ ID NO: 1995308 - RNA, 16 nt, Shigella flexneri 2a str. 301
aggccgaggcacagca

SEQ ID NO: 1995309 - RNA, 15 nt, Shigella flexneri 2a str. 301
aggccguggaucaca

SEQ ID NO: 1995310 - RNA, 15 nt, Shigella flexneri 2a str. 301
aggccguauccggca

SEQ ID NO: 1995311 - RNA, 19 nt, Shigella flexneri 2a str. 301
aggcgaacaugcgcuggug

SEQ ID NO: 1995312 - RNA, 16 nt, Shigella flexneri 2a str. 301
aggccugggcgaugau

SEQ ID NO: 1995313 - RNA, 12 nt, Shigella flexneri 2a str. 301
aggccuucgccu

SEQ ID NO: 1995314 - RNA, 19 nt, Shigella flexneri 2a str. 301
aggccuaacaccaucagug

SEQ ID NO: 1995315 - RNA, 19 nt, Shigella flexneri 2a str. 301
aggccuacaaaaucuauug

SEQ ID NO: 1995316 - RNA, 14 nt, Shigella flexneri 2a str. 301
aggccuacaacucc

SEQ ID NO: 1995317 - RNA, 18 nt, Shigella flexneri 2a str. 301
aggcgagaucggcaggca

SEQ ID NO: 1995318 - RNA, 19 nt, Shigella flexneri 2a str. 301
aggcgacuaauacaccauc

SEQ ID NO: 1995319 - RNA, 20 nt, Shigella flexneri 2a str. 301
aggcgacuaauacaccauca

SEQ ID NO: 1995320 - RNA, 13 nt, Shigella flexneri 2a str. 301
aggcgagaaucaa

SEQ ID NO: 1995321 - RNA, 21 nt, Shigella flexneri 2a str. 301
aggcgaccguuuucaccaguu

SEQ ID NO: 1995322 - RNA, 21 nt, Shigella flexneri 2a str. 301
aggcgcauaagcguaaaaccu

SEQ ID NO: 1995323 - RNA, 15 nt, Shigella flexneri 2a str. 301
aggcgcacgccgaca

SEQ ID NO: 1995324 - RNA, 20 nt, Shigella flexneri 2a str. 301
aggcgcagauacagccucuu

SEQ ID NO: 1995325 - RNA, 13 nt, Shigella flexneri 2a str. 301
aggcgcaauggcg

SEQ ID NO: 1995326 - RNA, 13 nt, Shigella flexneri 2a str. 301
aggcgcgcgguga

SEQ ID NO: 1995327 - RNA, 23 nt, Shigella flexneri 2a str. 301
aggcgcuaaaagcauagccccag

SEQ ID NO: 1995328 - RNA, 23 nt, Shigella flexneri 2a str. 301
aggcgcucgcgccgcauccgaca

SEQ ID NO: 1995329 - RNA, 14 nt, Shigella flexneri 2a str. 301
aggcgccauuuuca

SEQ ID NO: 1995330 - RNA, 17 nt, Shigella flexneri 2a str. 301
aggcgccauuuucauau

SEQ ID NO: 1995331 - RNA, 23 nt, Shigella flexneri 2a str. 301
aggccauuuuuucgauaaucaaa

SEQ ID NO: 1995332 - RNA, 17 nt, Shigella flexneri 2a str. 301
aggccaaucagcaauaa

SEQ ID NO: 1995333 - RNA, 15 nt, Shigella flexneri 2a str. 301
aggccagauaagacg

SEQ ID NO: 1995334 - RNA, 18 nt, Shigella flexneri 2a str. 301
aggccaaagccgccgagc

SEQ ID NO: 1995335 - RNA, 17 nt, Shigella flexneri 2a str. 301
aggccaaauccuuccag

SEQ ID NO: 1995336 - RNA, 12 nt, Shigella flexneri 2a str. 301
aggccaaagccg

SEQ ID NO: 1995337 - RNA, 19 nt, Shigella flexneri 2a str. 301
aggccaaaaaacagccccu

SEQ ID NO: 1995338 - RNA, 23 nt, Shigella flexneri 2a str. 301
aggcauuuacgccgcauccggca

SEQ ID NO: 1995339 - RNA, 13 nt, Shigella flexneri 2a str. 301
aggcauuggcaaa

SEQ ID NO: 1995340 - RNA, 17 nt, Shigella flexneri 2a str. 301
aggcauuggcaaauuua

SEQ ID NO: 1995341 - RNA, 15 nt, Shigella flexneri 2a str. 301
aggcagaagcgcgug

SEQ ID NO: 1995342 - RNA, 18 nt, Shigella flexneri 2a str. 301
aggcagaagcgcgugcua

SEQ ID NO: 1995343 - RNA, 18 nt, Shigella flexneri 2a str. 301
aggcauuaaauccugaaa

SEQ ID NO: 1995344 - RNA, 16 nt, Shigella flexneri 2a str. 301
aggcaucuucuucauu

SEQ ID NO: 1995345 - RNA, 16 nt, Shigella flexneri 2a str. 301
aggcaucugcgcauaa

SEQ ID NO: 1995346 - RNA, 15 nt, Shigella flexneri 2a str. 301
aggcaugaugcgcca

SEQ ID NO: 1995347 - RNA, 13 nt, Shigella flexneri 2a str. 301
aggcaugaucagc

SEQ ID NO: 1995348 - RNA, 15 nt, Shigella flexneri 2a str. 301
aggcaucgugcacca

SEQ ID NO: 1995349 - RNA, 22 nt, Shigella flexneri 2a str. 301
aggcaucggugcacuccgccac

SEQ ID NO: 1995350 - RNA, 19 nt, Shigella flexneri 2a str. 301
aggagcuccagguccuccu

SEQ ID NO: 1995351 - RNA, 17 nt, Shigella flexneri 2a str. 301
aggauugaucaauucua

SEQ ID NO: 1995352 - RNA, 12 nt, Shigella flexneri 2a str. 301
aggauuucuccc

SEQ ID NO: 1995353 - RNA, 17 nt, Shigella flexneri 2a str. 301
aggcaccagccccugga

SEQ ID NO: 1995354 - RNA, 12 nt, Shigella flexneri 2a str. 301
aggcacagaaaa

SEQ ID NO: 1995355 - RNA, 13 nt, Shigella flexneri 2a str. 301
aggcaagccacaa

SEQ ID NO: 1995356 - RNA, 21 nt, Shigella flexneri 2a str. 301
aggcaagccgcuaacagcagc

SEQ ID NO: 1995357 - RNA, 22 nt, Shigella flexneri 2a str. 301
aggcaagccgcuaacagcagca

SEQ ID NO: 1995358 - RNA, 20 nt, Shigella flexneri 2a str. 301
aggcaagccgcuaacagcag

SEQ ID NO: 1995359 - RNA, 22 nt, Shigella flexneri 2a str. 301
aggcacaaguuuuuaggcauga

SEQ ID NO: 1995360 - RNA, 18 nt, Shigella flexneri 2a str. 301
aggcaacaugaaacagaa

SEQ ID NO: 1995361 - RNA, 19 nt, Shigella flexneri 2a str. 301
aggcaacgaccagaaaugc

SEQ ID NO: 1995362 - RNA, 15 nt, Shigella flexneri 2a str. 301
agcugccgccaggcu

SEQ ID NO: 1995363 - RNA, 18 nt, Shigella flexneri 2a str. 301
agcugccgacgccaguuc

SEQ ID NO: 1995364 - RNA, 17 nt, Shigella flexneri 2a str. 301
agcugccguccccauca

SEQ ID NO: 1995365 - RNA, 16 nt, Shigella flexneri 2a str. 301
agcugcucccagcgca

SEQ ID NO: 1995366 - RNA, 15 nt, Shigella flexneri 2a str. 301
agcuccaccaguucg

SEQ ID NO: 1995367 - RNA, 18 nt, Shigella flexneri 2a str. 301
agcuccaccgauuuugag

SEQ ID NO: 1995368 - RNA, 19 nt, Shigella flexneri 2a str. 301
agcuccaccgauuuugaga

SEQ ID NO: 1995369 - RNA, 22 nt, Shigella flexneri 2a str. 301
agcuccacaagaaugccugcca

SEQ ID NO: 1995370 - RNA, 22 nt, Shigella flexneri 2a str. 301
agcucccacaguuucagcccca

SEQ ID NO: 1995371 - RNA, 13 nt, Shigella flexneri 2a str. 301
agcucccaggcuc

SEQ ID NO: 1995372 - RNA, 23 nt, Shigella flexneri 2a str. 301
agcugcuuuuccggucagcaauc

SEQ ID NO: 1995373 - RNA, 18 nt, Shigella flexneri 2a str. 301
agcugguguaacugcgcc

SEQ ID NO: 1995374 - RNA, 14 nt, Shigella flexneri 2a str. 301
agcuggucugaauc

SEQ ID NO: 1995375 - RNA, 16 nt, Shigella flexneri 2a str. 301
agcuggucugaaucaa

SEQ ID NO: 1995376 - RNA, 19 nt, Shigella flexneri 2a str. 301
agcuggucugaaucaacac

SEQ ID NO: 1995377 - RNA, 23 nt, Shigella flexneri 2a str. 301
agcugucaucgggugcaguggcu

SEQ ID NO: 1995378 - RNA, 22 nt, Shigella flexneri 2a str. 301
agcugucccaagugauuuuuaa

SEQ ID NO: 1995379 - RNA, 15 nt, Shigella flexneri 2a str. 301
agcuucgcuucccaa

SEQ ID NO: 1995380 - RNA, 15 nt, Shigella flexneri 2a str. 301
agcuuacguaaccca

SEQ ID NO: 1995381 - RNA, 23 nt, Shigella flexneri 2a str. 301
agcuuauccauaauuuugguugc

SEQ ID NO: 1995382 - RNA, 16 nt, Shigella flexneri 2a str. 301
agcuugaucaauaacg

SEQ ID NO: 1995383 - RNA, 21 nt, Shigella flexneri 2a str. 301
aggacagagacgcacugcuug

SEQ ID NO: 1995384 - RNA, 19 nt, Shigella flexneri 2a str. 301
aggaauuuuacagcccugg

SEQ ID NO: 1995385 - RNA, 14 nt, Shigella flexneri 2a str. 301
aggacaaaaauuca

SEQ ID NO: 1995386 - RNA, 16 nt, Shigella flexneri 2a str. 301
aggaaggucauccaaa

SEQ ID NO: 1995387 - RNA, 21 nt, Shigella flexneri 2a str. 301
aggaagggauugugcaggcgc

SEQ ID NO: 1995388 - RNA, 20 nt, Shigella flexneri 2a str. 301
aggaagcuuucgcaguagau

SEQ ID NO: 1995389 - RNA, 21 nt, Shigella flexneri 2a str. 301
aggaagcuuucgcaguagauc

SEQ ID NO: 1995390 - RNA, 22 nt, Shigella flexneri 2a str. 301
aggacaucccggcagagaaaau

SEQ ID NO: 1995391 - RNA, 19 nt, Shigella flexneri 2a str. 301
aggacaucccggcagagaa

SEQ ID NO: 1995392 - RNA, 19 nt, Shigella flexneri 2a str. 301
aggacagugggauuaaaaa

SEQ ID NO: 1995393 - RNA, 22 nt, Shigella flexneri 2a str. 301
aggacuucaucacgaugcaaau

SEQ ID NO: 1995394 - RNA, 18 nt, Shigella flexneri 2a str. 301
aggacuuauucauuucgu

SEQ ID NO: 1995395 - RNA, 13 nt, Shigella flexneri 2a str. 301
aggagacgcgcaa

SEQ ID NO: 1995396 - RNA, 18 nt, Shigella flexneri 2a str. 301
aggagaguaugcgcguca

SEQ ID NO: 1995397 - RNA, 21 nt, Shigella flexneri 2a str. 301
aggaacagaagaaagcaauga

SEQ ID NO: 1995398 - RNA, 16 nt, Shigella flexneri 2a str. 301
aggaacagaagaaagc

SEQ ID NO: 1995399 - RNA, 13 nt, Shigella flexneri 2a str. 301
aggaacaauccaa

SEQ ID NO: 1995400 - RNA, 13 nt, Shigella flexneri 2a str. 301
aggaaauaauaua

SEQ ID NO: 1995401 - RNA, 15 nt, Shigella flexneri 2a str. 301
aggaaauaauauagu

SEQ ID NO: 1995402 - RNA, 14 nt, Shigella flexneri 2a str. 301
aggaaauaaauaau

SEQ ID NO: 1995403 - RNA, 15 nt, Shigella flexneri 2a str. 301
agcuuuggugaaaaa

SEQ ID NO: 1995404 - RNA, 22 nt, Shigella flexneri 2a str. 301
agcuuuuccauaucaagcauga

SEQ ID NO: 1995405 - RNA, 22 nt, Shigella flexneri 2a str. 301
agcuuuucgcccuggacaacau

SEQ ID NO: 1995406 - RNA, 17 nt, Shigella flexneri 2a str. 301
agcuuugugcuucaguu

SEQ ID NO: 1995407 - RNA, 15 nt, Shigella flexneri 2a str. 301
aggaagauuacgcug

SEQ ID NO: 1995408 - RNA, 12 nt, Shigella flexneri 2a str. 301
aggaagacgcag

SEQ ID NO: 1995409 - RNA, 20 nt, Shigella flexneri 2a str. 301
aggaagccggaauuuuccuu

SEQ ID NO: 1995410 - RNA, 15 nt, Shigella flexneri 2a str. 301
aggaagcagcuugcu

SEQ ID NO: 1995411 - RNA, 23 nt, Shigella flexneri 2a str. 301
aggaacgcgccaagauagaacca

SEQ ID NO: 1995412 - RNA, 18 nt, Shigella flexneri 2a str. 301
aggaaccuccauguccag

SEQ ID NO: 1995413 - RNA, 21 nt, Shigella flexneri 2a str. 301
aggaacaucccuugugcacug

SEQ ID NO: 1995414 - RNA, 23 nt, Shigella flexneri 2a str. 301
auaacagaaugcgggcgaaaaca

SEQ ID NO: 1995415 - RNA, 10 nt, Shigella flexneri 2a str. 301
auaacagaau

SEQ ID NO: 1995416 - RNA, 18 nt, Shigella flexneri 2a str. 301
auaacacgguaaugacuc

SEQ ID NO: 1995417 - RNA, 15 nt, Shigella flexneri 2a str. 301
auaacagcccgccaa

SEQ ID NO: 1995418 - RNA, 18 nt, Shigella flexneri 2a str. 301
auaacagcccgccaacca

SEQ ID NO: 1995419 - RNA, 14 nt, Shigella flexneri 2a str. 301
auaacaccagccag

SEQ ID NO: 1995420 - RNA, 19 nt, Shigella flexneri 2a str. 301
auaacaccagccagaauua

SEQ ID NO: 1995421 - RNA, 22 nt, Shigella flexneri 2a str. 301
auaacaccgauuuuguaaaaga

SEQ ID NO: 1995422 - RNA, 16 nt, Shigella flexneri 2a str. 301
auaacaccgauuuugu

SEQ ID NO: 1995423 - RNA, 23 nt, Shigella flexneri 2a str. 301
auaacaccgauuuuguaaaagaa

SEQ ID NO: 1995424 - RNA, 16 nt, Shigella flexneri 2a str. 301
auaaauccaacaacac

SEQ ID NO: 1995425 - RNA, 17 nt, Shigella flexneri 2a str. 301
auaaauccaacaacaca

SEQ ID NO: 1995426 - RNA, 17 nt, Shigella flexneri 2a str. 301
auaaaucgugaaacaau

SEQ ID NO: 1995427 - RNA, 14 nt, Shigella flexneri 2a str. 301
auaaaucuccauuu

SEQ ID NO: 1995428 - RNA, 22 nt, Shigella flexneri 2a str. 301
auaacggaggacuuauggcugg

SEQ ID NO: 1995429 - RNA, 15 nt, Shigella flexneri 2a str. 301
auaacggugcaaccc

SEQ ID NO: 1995430 - RNA, 13 nt, Shigella flexneri 2a str. 301
auaacgcuggcag

SEQ ID NO: 1995431 - RNA, 21 nt, Shigella flexneri 2a str. 301
auaacgcuccuacaccgaaca

SEQ ID NO: 1995432 - RNA, 17 nt, Shigella flexneri 2a str. 301
auaaccugugcaccaga

SEQ ID NO: 1995433 - RNA, 17 nt, Shigella flexneri 2a str. 301
auaaccugcaaaauagu

SEQ ID NO: 1995434 - RNA, 14 nt, Shigella flexneri 2a str. 301
auaacugcuauuca

SEQ ID NO: 1995435 - RNA, 12 nt, Shigella flexneri 2a str. 301
auaacugcuauu

SEQ ID NO: 1995436 - RNA, 15 nt, Shigella flexneri 2a str. 301
auaacuggucaucaa

SEQ ID NO: 1995437 - RNA, 20 nt, Shigella flexneri 2a str. 301
auaacuucacuaaucaauuu

SEQ ID NO: 1995438 - RNA, 21 nt, Shigella flexneri 2a str. 301
auaacucucuuuugcuugaca

SEQ ID NO: 1995439 - RNA, 15 nt, Shigella flexneri 2a str. 301
auaacguuauauccc

SEQ ID NO: 1995440 - RNA, 19 nt, Shigella flexneri 2a str. 301
auaacucgcacguucaguu

SEQ ID NO: 1995441 - RNA, 21 nt, Shigella flexneri 2a str. 301
auaaccagcguuuccagcacc

SEQ ID NO: 1995442 - RNA, 23 nt, Shigella flexneri 2a str. 301
auaaccacguucauuucauacag

SEQ ID NO: 1995443 - RNA, 15 nt, Shigella flexneri 2a str. 301
auaacccaguacaac

SEQ ID NO: 1995444 - RNA, 14 nt, Shigella flexneri 2a str. 301
auaacccccuccuu

SEQ ID NO: 1995445 - RNA, 18 nt, Shigella flexneri 2a str. 301
auaaccauuccacgggca

SEQ ID NO: 1995446 - RNA, 20 nt, Shigella flexneri 2a str. 301
auaacccgcuguaaaugcug

SEQ ID NO: 1995447 - RNA, 21 nt, Shigella flexneri 2a str. 301
auaacccgcuguaaaugcugc

SEQ ID NO: 1995448 - RNA, 16 nt, Shigella flexneri 2a str. 301
auaaccgcaaaaccaa

SEQ ID NO: 1995449 - RNA, 23 nt, Shigella flexneri 2a str. 301
auaaccgcugcaaaaaauugcgu

SEQ ID NO: 1995450 - RNA, 21 nt, Shigella flexneri 2a str. 301
auaaccggcaagcaaauacuu

SEQ ID NO: 1995451 - RNA, 20 nt, Shigella flexneri 2a str. 301
auaaccgguauuacuccaga

SEQ ID NO: 1995452 - RNA, 22 nt, Shigella flexneri 2a str. 301
auaaccguacgcaucaccagac

SEQ ID NO: 1995453 - RNA, 12 nt, Shigella flexneri 2a str. 301
auaaccuauugu

SEQ ID NO: 1995454 - RNA, 19 nt, Shigella flexneri 2a str. 301
auaaccgucagcgcaugau

SEQ ID NO: 1995455 - RNA, 17 nt, Shigella flexneri 2a str. 301
auaaccucuuucuuugc

SEQ ID NO: 1995456 - RNA, 16 nt, Shigella flexneri 2a str. 301
auaaccugaaagccga

SEQ ID NO: 1995457 - RNA, 18 nt, Shigella flexneri 2a str. 301
auaaccugaauauuagua

SEQ ID NO: 1995458 - RNA, 22 nt, Shigella flexneri 2a str. 301
auaaaccugccuuacauaucaa

SEQ ID NO: 1995459 - RNA, 15 nt, Shigella flexneri 2a str. 301
auaaagcagagcagg

SEQ ID NO: 1995460 - RNA, 15 nt, Shigella flexneri 2a str. 301
auaaagcgguuuuca

SEQ ID NO: 1995461 - RNA, 21 nt, Shigella flexneri 2a str. 301
auaaagcccccuguuugucua

SEQ ID NO: 1995462 - RNA, 17 nt, Shigella flexneri 2a str. 301
auaaaggucgacagcag

SEQ ID NO: 1995463 - RNA, 18 nt, Shigella flexneri 2a str. 301
auaaaggucgacagcagc

SEQ ID NO: 1995464 - RNA, 14 nt, Shigella flexneri 2a str. 301
auaaaguagaaauu

SEQ ID NO: 1995465 - RNA, 21 nt, Shigella flexneri 2a str. 301
auaaauauuaauacaacaaca

SEQ ID NO: 1995466 - RNA, 15 nt, Shigella flexneri 2a str. 301
auaaauauuaauaca

SEQ ID NO: 1995467 - RNA, 20 nt, Shigella flexneri 2a str. 301
auaaauauggugaaaguaaa

SEQ ID NO: 1995468 - RNA, 17 nt, Shigella flexneri 2a str. 301
auaaagucgauuugcaa

SEQ ID NO: 1995469 - RNA, 16 nt, Shigella flexneri 2a str. 301
auaaaguagaaauuau

SEQ ID NO: 1995470 - RNA, 19 nt, Shigella flexneri 2a str. 301
auaaacaagcguacaaaau

SEQ ID NO: 1995471 - RNA, 10 nt, Shigella flexneri 2a str. 301
auaaacaaag

SEQ ID NO: 1995472 - RNA, 16 nt, Shigella flexneri 2a str. 301
auaaacaccagcaaua

SEQ ID NO: 1995473 - RNA, 20 nt, Shigella flexneri 2a str. 301
auaaacaaugagauauuuaa

SEQ ID NO: 1995474 - RNA, 15 nt, Shigella flexneri 2a str. 301
auaaacaaugagaua

SEQ ID NO: 1995475 - RNA, 17 nt, Shigella flexneri 2a str. 301
auaaaauucauucaauu

SEQ ID NO: 1995476 - RNA, 18 nt, Shigella flexneri 2a str. 301
auaaaauucuccagcgcc

SEQ ID NO: 1995477 - RNA, 14 nt, Shigella flexneri 2a str. 301
auaaaauuauccag

SEQ ID NO: 1995478 - RNA, 17 nt, Shigella flexneri 2a str. 301
auaaaaugaguuuuuuu

SEQ ID NO: 1995479 - RNA, 17 nt, Shigella flexneri 2a str. 301
auaaaaugauuucgcaa

SEQ ID NO: 1995480 - RNA, 19 nt, Shigella flexneri 2a str. 301
auaaaauggccguaauaga

SEQ ID NO: 1995481 - RNA, 15 nt, Shigella flexneri 2a str. 301
aguuuucauauaccg

SEQ ID NO: 1995482 - RNA, 18 nt, Shigella flexneri 2a str. 301
aguuuucacccuuucguu

SEQ ID NO: 1995483 - RNA, 22 nt, Shigella flexneri 2a str. 301
aguuuuauacucagucaggcuu

SEQ ID NO: 1995484 - RNA, 14 nt, Shigella flexneri 2a str. 301
auaaaaucccauaa

SEQ ID NO: 1995485 - RNA, 23 nt, Shigella flexneri 2a str. 301
auaauacagcccagacaaaugaa

SEQ ID NO: 1995486 - RNA, 21 nt, Shigella flexneri 2a str. 301
auaauacacuaacagaacaau

SEQ ID NO: 1995487 - RNA, 20 nt, Shigella flexneri 2a str. 301
auaauacaggcuacucccag

SEQ ID NO: 1995488 - RNA, 12 nt, Shigella flexneri 2a str. 301
auaauacacaca

SEQ ID NO: 1995489 - RNA, 14 nt, Shigella flexneri 2a str. 301
auaaguguaaaauu

SEQ ID NO: 1995490 - RNA, 12 nt, Shigella flexneri 2a str. 301
auaagucucaga

SEQ ID NO: 1995491 - RNA, 22 nt, Shigella flexneri 2a str. 301
auaagaacugacuuccacuucc

SEQ ID NO: 1995492 - RNA, 16 nt, Shigella flexneri 2a str. 301
auaagaagcuuuucuc

SEQ ID NO: 1995493 - RNA, 18 nt, Shigella flexneri 2a str. 301
auaaugacggagaguacu

SEQ ID NO: 1995494 - RNA, 20 nt, Shigella flexneri 2a str. 301
auaaugagcaccgcaccuaa

SEQ ID NO: 1995495 - RNA, 18 nt, Shigella flexneri 2a str. 301
auaaugaucaguggaaga

SEQ ID NO: 1995496 - RNA, 22 nt, Shigella flexneri 2a str. 301
auaaugaugucucuguuuugaa

SEQ ID NO: 1995497 - RNA, 16 nt, Shigella flexneri 2a str. 301
auaaucuuuaaaaaaa

SEQ ID NO: 1995498 - RNA, 22 nt, Shigella flexneri 2a str. 301
auaaucgaucgcguaauaaaau

SEQ ID NO: 1995499 - RNA, 21 nt, Shigella flexneri 2a str. 301
auaaucgaucgcguaauaaaa

SEQ ID NO: 1995500 - RNA, 21 nt, Shigella flexneri 2a str. 301
auaaucacgcuuuacaauauc

SEQ ID NO: 1995501 - RNA, 17 nt, Shigella flexneri 2a str. 301
auaaucaggaauauggu

SEQ ID NO: 1995502 - RNA, 13 nt, Shigella flexneri 2a str. 301
auaaucaucccac

SEQ ID NO: 1995503 - RNA, 20 nt, Shigella flexneri 2a str. 301
auaaucacaauggucaacau

SEQ ID NO: 1995504 - RNA, 14 nt, Shigella flexneri 2a str. 301
auaaucaccacaca

SEQ ID NO: 1995505 - RNA, 14 nt, Shigella flexneri 2a str. 301
auaaucacauaauc

SEQ ID NO: 1995506 - RNA, 22 nt, Shigella flexneri 2a str. 301
auaauugaccagaucuucauca

SEQ ID NO: 1995507 - RNA, 20 nt, Shigella flexneri 2a str. 301
auaauuuucgguaaugacuc

SEQ ID NO: 1995508 - RNA, 16 nt, Shigella flexneri 2a str. 301
auacaaaauuuaacac

SEQ ID NO: 1995509 - RNA, 14 nt, Shigella flexneri 2a str. 301
auaauuuuuucuuc

SEQ ID NO: 1995510 - RNA, 22 nt, Shigella flexneri 2a str. 301
auaauuucuucguucgcugcau

SEQ ID NO: 1995511 - RNA, 13 nt, Shigella flexneri 2a str. 301
auaauuuuaaaua

SEQ ID NO: 1995512 - RNA, 14 nt, Shigella flexneri 2a str. 301
auaauuugugacga

SEQ ID NO: 1995513 - RNA, 21 nt, Shigella flexneri 2a str. 301
auaauuucugcacaucuaacc

SEQ ID NO: 1995514 - RNA, 17 nt, Shigella flexneri 2a str. 301
auacacuaacagaacaa

SEQ ID NO: 1995515 - RNA, 17 nt, Shigella flexneri 2a str. 301
auacacuauaaaauaac

SEQ ID NO: 1995516 - RNA, 17 nt, Shigella flexneri 2a str. 301
auacacgccgugggcau

SEQ ID NO: 1995517 - RNA, 20 nt, Shigella flexneri 2a str. 301
auacacuucacacacuuuua

SEQ ID NO: 1995518 - RNA, 22 nt, Shigella flexneri 2a str. 301
auacaccguuuuacaacgcugu

SEQ ID NO: 1995519 - RNA, 16 nt, Shigella flexneri 2a str. 301
auacaccaucauggaa

SEQ ID NO: 1995520 - RNA, 15 nt, Shigella flexneri 2a str. 301
auacagccaaaucau

SEQ ID NO: 1995521 - RNA, 23 nt, Shigella flexneri 2a str. 301
auacagcaauggaaaaaguuuua

SEQ ID NO: 1995522 - RNA, 17 nt, Shigella flexneri 2a str. 301
auacagcaauggaaaaa

SEQ ID NO: 1995523 - RNA, 20 nt, Shigella flexneri 2a str. 301
auacagcccagacaaaugaa

SEQ ID NO: 1995524 - RNA, 15 nt, Shigella flexneri 2a str. 301
auacagcccagacaa

SEQ ID NO: 1995525 - RNA, 22 nt, Shigella flexneri 2a str. 301
auacagcgcggaccccacgcuc

SEQ ID NO: 1995526 - RNA, 17 nt, Shigella flexneri 2a str. 301
auacagcggacagccau

SEQ ID NO: 1995527 - RNA, 12 nt, Shigella flexneri 2a str. 301
auacagccgaag

SEQ ID NO: 1995528 - RNA, 20 nt, Shigella flexneri 2a str. 301
auacagccgacaaugccaca

SEQ ID NO: 1995529 - RNA, 20 nt, Shigella flexneri 2a str. 301
auacaacugccgcgccugaa

SEQ ID NO: 1995530 - RNA, 12 nt, Shigella flexneri 2a str. 301
auacaacccacc

SEQ ID NO: 1995531 - RNA, 15 nt, Shigella flexneri 2a str. 301
auacaacgccaugaa

SEQ ID NO: 1995532 - RNA, 18 nt, Shigella flexneri 2a str. 301
auacaaccagauaaccau

SEQ ID NO: 1995533 - RNA, 20 nt, Shigella flexneri 2a str. 301
agucugaccucuucuaccac

SEQ ID NO: 1995534 - RNA, 23 nt, Shigella flexneri 2a str. 301
agucucucuccguuaucacagca

SEQ ID NO: 1995535 - RNA, 13 nt, Shigella flexneri 2a str. 301
agucugcauuuuc

SEQ ID NO: 1995536 - RNA, 14 nt, Shigella flexneri 2a str. 301
agucugcauuuucu

SEQ ID NO: 1995537 - RNA, 12 nt, Shigella flexneri 2a str. 301
agucugcauuuu

SEQ ID NO: 1995538 - RNA, 18 nt, Shigella flexneri 2a str. 301
agucugcugaccaccugu

SEQ ID NO: 1995539 - RNA, 18 nt, Shigella flexneri 2a str. 301
agucuggacaaagagcuu

SEQ ID NO: 1995540 - RNA, 17 nt, Shigella flexneri 2a str. 301
agucuuuuuucaacuuu

SEQ ID NO: 1995541 - RNA, 21 nt, Shigella flexneri 2a str. 301
agucuuuguauuuauuuucag

SEQ ID NO: 1995542 - RNA, 18 nt, Shigella flexneri 2a str. 301
agugaaaaccggacugaa

SEQ ID NO: 1995543 - RNA, 14 nt, Shigella flexneri 2a str. 301
agucuccauuuuuu

SEQ ID NO: 1995544 - RNA, 14 nt, Shigella flexneri 2a str. 301
agucggugccaugg

SEQ ID NO: 1995545 - RNA, 12 nt, Shigella flexneri 2a str. 301
agucguaaacaa

SEQ ID NO: 1995546 - RNA, 22 nt, Shigella flexneri 2a str. 301
agucgguauaaauagcggcugu

SEQ ID NO: 1995547 - RNA, 13 nt, Shigella flexneri 2a str. 301
agucggucacagu

SEQ ID NO: 1995548 - RNA, 16 nt, Shigella flexneri 2a str. 301
agucggcagaugaaaa

SEQ ID NO: 1995549 - RNA, 20 nt, Shigella flexneri 2a str. 301
agucgggucgccguaagcaa

SEQ ID NO: 1995550 - RNA, 21 nt, Shigella flexneri 2a str. 301
aguccugaccgucaccccauu

SEQ ID NO: 1995551 - RNA, 15 nt, Shigella flexneri 2a str. 301
aguccugagucagaa

SEQ ID NO: 1995552 - RNA, 16 nt, Shigella flexneri 2a str. 301
aguccugagucagaaa

SEQ ID NO: 1995553 - RNA, 20 nt, Shigella flexneri 2a str. 301
aguccugaccgucaccccau

SEQ ID NO: 1995554 - RNA, 21 nt, Shigella flexneri 2a str. 301
aguccguugaaaaugcugguu

SEQ ID NO: 1995555 - RNA, 21 nt, Shigella flexneri 2a str. 301
aguccguuauggcgugagcug

SEQ ID NO: 1995556 - RNA, 21 nt, Shigella flexneri 2a str. 301
agucgcgcucaucagcggcga

SEQ ID NO: 1995557 - RNA, 21 nt, Shigella flexneri 2a str. 301
agucaaaaugcccgaucuagg

SEQ ID NO: 1995558 - RNA, 19 nt, Shigella flexneri 2a str. 301
agucaacaagcaaauguua

SEQ ID NO: 1995559 - RNA, 17 nt, Shigella flexneri 2a str. 301
aguccggcuuuucgaca

SEQ ID NO: 1995560 - RNA, 18 nt, Shigella flexneri 2a str. 301
agugaauauuuaaccuga

SEQ ID NO: 1995561 - RNA, 15 nt, Shigella flexneri 2a str. 301
agugaauacagaaca

SEQ ID NO: 1995562 - RNA, 16 nt, Shigella flexneri 2a str. 301
agugaauacagaacag

SEQ ID NO: 1995563 - RNA, 17 nt, Shigella flexneri 2a str. 301
agugauugcuugccccu

SEQ ID NO: 1995564 - RNA, 14 nt, Shigella flexneri 2a str. 301
agugcaaaugccag

SEQ ID NO: 1995565 - RNA, 13 nt, Shigella flexneri 2a str. 301
agugaugcgcagg

SEQ ID NO: 1995566 - RNA, 15 nt, Shigella flexneri 2a str. 301
agugauggugguggg

SEQ ID NO: 1995567 - RNA, 21 nt, Shigella flexneri 2a str. 301
agugaugguggugggggaagg

SEQ ID NO: 1995568 - RNA, 17 nt, Shigella flexneri 2a str. 301
agugcauugagucccau

SEQ ID NO: 1995569 - RNA, 19 nt, Shigella flexneri 2a str. 301
agugccaaaaaaauaagca

SEQ ID NO: 1995570 - RNA, 22 nt, Shigella flexneri 2a str. 301
agugcaucucaccguugccaac

SEQ ID NO: 1995571 - RNA, 22 nt, Shigella flexneri 2a str. 301
agugcaggcaccagccccugga

SEQ ID NO: 1995572 - RNA, 22 nt, Shigella flexneri 2a str. 301
agugccaugccaaucagcagaa

SEQ ID NO: 1995573 - RNA, 14 nt, Shigella flexneri 2a str. 301
agugccgaagaaca

SEQ ID NO: 1995574 - RNA, 18 nt, Shigella flexneri 2a str. 301
agugcccgaccacuucau

SEQ ID NO: 1995575 - RNA, 19 nt, Shigella flexneri 2a str. 301
agugcagcaugcacccuca

SEQ ID NO: 1995576 - RNA, 12 nt, Shigella flexneri 2a str. 301
agugcagcgaag

SEQ ID NO: 1995577 - RNA, 16 nt, Shigella flexneri 2a str. 301
agugcauccagcagcc

SEQ ID NO: 1995578 - RNA, 20 nt, Shigella flexneri 2a str. 301
agugcauaaauaccggcaug

SEQ ID NO: 1995579 - RNA, 23 nt, Shigella flexneri 2a str. 301
agugcaacgugacucaauggcau

SEQ ID NO: 1995580 - RNA, 17 nt, Shigella flexneri 2a str. 301
agugcaaucaguggugu

SEQ ID NO: 1995581 - RNA, 16 nt, Shigella flexneri 2a str. 301
aguggaucagcaaauc

SEQ ID NO: 1995582 - RNA, 19 nt, Shigella flexneri 2a str. 301
aguggaugcgccauaccau

SEQ ID NO: 1995583 - RNA, 14 nt, Shigella flexneri 2a str. 301
aguggauuaucuuc

SEQ ID NO: 1995584 - RNA, 15 nt, Shigella flexneri 2a str. 301
aguggcaaauucuug

SEQ ID NO: 1995585 - RNA, 17 nt, Shigella flexneri 2a str. 301
aguggcagcaaaucaug

SEQ ID NO: 1995586 - RNA, 17 nt, Shigella flexneri 2a str. 301
aguggucaggauuaugu

SEQ ID NO: 1995587 - RNA, 18 nt, Shigella flexneri 2a str. 301
aguggcgacaucuuuacc

SEQ ID NO: 1995588 - RNA, 14 nt, Shigella flexneri 2a str. 301
aguggugcggcuga

SEQ ID NO: 1995589 - RNA, 18 nt, Shigella flexneri 2a str. 301
agugcugcuuuugcuucu

SEQ ID NO: 1995590 - RNA, 13 nt, Shigella flexneri 2a str. 301
agugcugaagguu

SEQ ID NO: 1995591 - RNA, 16 nt, Shigella flexneri 2a str. 301
agugcgguaaauuuuu

SEQ ID NO: 1995592 - RNA, 20 nt, Shigella flexneri 2a str. 301
agugcggcgcaccagcaggc

SEQ ID NO: 1995593 - RNA, 18 nt, Shigella flexneri 2a str. 301
agugcggcagcggcuuca

SEQ ID NO: 1995594 - RNA, 17 nt, Shigella flexneri 2a str. 301
agugcgcucuucaacuu

SEQ ID NO: 1995595 - RNA, 15 nt, Shigella flexneri 2a str. 301
agugcgcaacaaaac

SEQ ID NO: 1995596 - RNA, 18 nt, Shigella flexneri 2a str. 301
agugccucgcuaaucucu

SEQ ID NO: 1995597 - RNA, 14 nt, Shigella flexneri 2a str. 301
agugccgcccacca

SEQ ID NO: 1995598 - RNA, 19 nt, Shigella flexneri 2a str. 301
agugccgcccaccacucga

SEQ ID NO: 1995599 - RNA, 17 nt, Shigella flexneri 2a str. 301
agugccgguggaagggc

SEQ ID NO: 1995600 - RNA, 18 nt, Shigella flexneri 2a str. 301
agugccgguggaagggcu

SEQ ID NO: 1995601 - RNA, 16 nt, Shigella flexneri 2a str. 301
agugccguuccagcca

SEQ ID NO: 1995602 - RNA, 23 nt, Shigella flexneri 2a str. 301
aguuguugauaauuagugcugcu

SEQ ID NO: 1995603 - RNA, 16 nt, Shigella flexneri 2a str. 301
aguuguugcugaauuu

SEQ ID NO: 1995604 - RNA, 16 nt, Shigella flexneri 2a str. 301
aguugugcaccaccaa

SEQ ID NO: 1995605 - RNA, 13 nt, Shigella flexneri 2a str. 301
aguugucugaauc

SEQ ID NO: 1995606 - RNA, 17 nt, Shigella flexneri 2a str. 301
aguuguccaugugcugg

SEQ ID NO: 1995607 - RNA, 22 nt, Shigella flexneri 2a str. 301
aguugccacuaacgucaguaag

SEQ ID NO: 1995608 - RNA, 16 nt, Shigella flexneri 2a str. 301
aguuuacgcagcagau

SEQ ID NO: 1995609 - RNA, 14 nt, Shigella flexneri 2a str. 301
aguuuauccagcca

SEQ ID NO: 1995610 - RNA, 14 nt, Shigella flexneri 2a str. 301
aguuuaccagccaa

SEQ ID NO: 1995611 - RNA, 16 nt, Shigella flexneri 2a str. 301
aguuuaauugccauuu

SEQ ID NO: 1995612 - RNA, 18 nt, Shigella flexneri 2a str. 301
aguuuaauugccauuucu

SEQ ID NO: 1995613 - RNA, 19 nt, Shigella flexneri 2a str. 301
aguuuggugagaacaccaa

SEQ ID NO: 1995614 - RNA, 15 nt, Shigella flexneri 2a str. 301
aguuuguucagcugc

SEQ ID NO: 1995615 - RNA, 18 nt, Shigella flexneri 2a str. 301
aguuuguucagcugcgug

SEQ ID NO: 1995616 - RNA, 19 nt, Shigella flexneri 2a str. 301
aguuugccguugaucucuc

SEQ ID NO: 1995617 - RNA, 16 nt, Shigella flexneri 2a str. 301
aguuugccguugaucu

SEQ ID NO: 1995618 - RNA, 14 nt, Shigella flexneri 2a str. 301
aguuucagaccaau

SEQ ID NO: 1995619 - RNA, 16 nt, Shigella flexneri 2a str. 301
aguuucagccucugcc

SEQ ID NO: 1995620 - RNA, 21 nt, Shigella flexneri 2a str. 301
aguuucauaucugccagauaa

SEQ ID NO: 1995621 - RNA, 15 nt, Shigella flexneri 2a str. 301
aguuucagaaaaagc

SEQ ID NO: 1995622 - RNA, 12 nt, Shigella flexneri 2a str. 301
aguuucagaaua

SEQ ID NO: 1995623 - RNA, 17 nt, Shigella flexneri 2a str. 301
aguuucaccagcaguaa

SEQ ID NO: 1995624 - RNA, 18 nt, Shigella flexneri 2a str. 301
aguuucaccagcaguaaa

SEQ ID NO: 1995625 - RNA, 20 nt, Shigella flexneri 2a str. 301
aguuucaccaaacuucagcc

SEQ ID NO: 1995626 - RNA, 22 nt, Shigella flexneri 2a str. 301
aguuuccgcgccggcucauacu

SEQ ID NO: 1995627 - RNA, 18 nt, Shigella flexneri 2a str. 301
aguuuccgcuucugcuuu

SEQ ID NO: 1995628 - RNA, 14 nt, Shigella flexneri 2a str. 301
aguuucuuaccuac

SEQ ID NO: 1995629 - RNA, 23 nt, Shigella flexneri 2a str. 301
aguucugaacguugcgcuucccg

SEQ ID NO: 1995630 - RNA, 14 nt, Shigella flexneri 2a str. 301
aguucuucaaaaau

SEQ ID NO: 1995631 - RNA, 20 nt, Shigella flexneri 2a str. 301
aguugauucggccaguaacc

SEQ ID NO: 1995632 - RNA, 23 nt, Shigella flexneri 2a str. 301
aguugauuaugaucgccacgcgg

SEQ ID NO: 1995633 - RNA, 17 nt, Shigella flexneri 2a str. 301
aguugaucucuuuccac

SEQ ID NO: 1995634 - RNA, 19 nt, Shigella flexneri 2a str. 301
aguugaucuauaccaccgc

SEQ ID NO: 1995635 - RNA, 18 nt, Shigella flexneri 2a str. 301
aguugauuaauuucauuu

SEQ ID NO: 1995636 - RNA, 19 nt, Shigella flexneri 2a str. 301
aguugauuaauuucauuuu

SEQ ID NO: 1995637 - RNA, 16 nt, Shigella flexneri 2a str. 301
aguugcagcaagccau

SEQ ID NO: 1995638 - RNA, 17 nt, Shigella flexneri 2a str. 301
aguugcacacuuuccau

SEQ ID NO: 1995639 - RNA, 14 nt, Shigella flexneri 2a str. 301
aguugaucaccagu

SEQ ID NO: 1995640 - RNA, 20 nt, Shigella flexneri 2a str. 301
aguucuucgguggucauuuu

SEQ ID NO: 1995641 - RNA, 20 nt, Shigella flexneri 2a str. 301
aguuccagggcagcaguuca

SEQ ID NO: 1995642 - RNA, 13 nt, Shigella flexneri 2a str. 301
aguuccaguucau

SEQ ID NO: 1995643 - RNA, 14 nt, Shigella flexneri 2a str. 301
aguucgcuuuccgu

SEQ ID NO: 1995644 - RNA, 12 nt, Shigella flexneri 2a str. 301
aguucuacaauc

SEQ ID NO: 1995645 - RNA, 18 nt, Shigella flexneri 2a str. 301
aguucuacaaucugcccg

SEQ ID NO: 1995646 - RNA, 19 nt, Shigella flexneri 2a str. 301
aguucguugguguccacgc

SEQ ID NO: 1995647 - RNA, 21 nt, Shigella flexneri 2a str. 301
aguucgguugggaucgccagg

SEQ ID NO: 1995648 - RNA, 14 nt, Shigella flexneri 2a str. 301
aguguccagcggca

SEQ ID NO: 1995649 - RNA, 16 nt, Shigella flexneri 2a str. 301
aguuacgugcugcgca

SEQ ID NO: 1995650 - RNA, 13 nt, Shigella flexneri 2a str. 301
aguuacagcucuc

SEQ ID NO: 1995651 - RNA, 23 nt, Shigella flexneri 2a str. 301
aguuaauucugagagcaugaaau

SEQ ID NO: 1995652 - RNA, 14 nt, Shigella flexneri 2a str. 301
aguuagaggcacau

SEQ ID NO: 1995653 - RNA, 19 nt, Shigella flexneri 2a str. 301
aguuagcaaggauguggcu

SEQ ID NO: 1995654 - RNA, 20 nt, Shigella flexneri 2a str. 301
aguuagcaaggauguggcua

SEQ ID NO: 1995655 - RNA, 13 nt, Shigella flexneri 2a str. 301
aguuaucaagcca

SEQ ID NO: 1995656 - RNA, 21 nt, Shigella flexneri 2a str. 301
aguuaucgcgauacaccagau

SEQ ID NO: 1995657 - RNA, 22 nt, Shigella flexneri 2a str. 301
aguuauuaaaacgauaguggcu

SEQ ID NO: 1995658 - RNA, 18 nt, Shigella flexneri 2a str. 301
aguucacccucauucacc

SEQ ID NO: 1995659 - RNA, 20 nt, Shigella flexneri 2a str. 301
aguucacugccguacaggca

SEQ ID NO: 1995660 - RNA, 23 nt, Shigella flexneri 2a str. 301
aguucacuugugcuguguggccu

SEQ ID NO: 1995661 - RNA, 14 nt, Shigella flexneri 2a str. 301
aguucagaaagcac

SEQ ID NO: 1995662 - RNA, 22 nt, Shigella flexneri 2a str. 301
aguucagaagcugaagcagaaa

SEQ ID NO: 1995663 - RNA, 20 nt, Shigella flexneri 2a str. 301
aucuucguuaucccaggcgu

SEQ ID NO: 1995664 - RNA, 15 nt, Shigella flexneri 2a str. 301
aucuucguuauccca

SEQ ID NO: 1995665 - RNA, 16 nt, Shigella flexneri 2a str. 301
aucuuuaucaaucacc

SEQ ID NO: 1995666 - RNA, 22 nt, Shigella flexneri 2a str. 301
aucuucgauaaacucaaucagg

SEQ ID NO: 1995667 - RNA, 15 nt, Shigella flexneri 2a str. 301
aucuuccucacaccc

SEQ ID NO: 1995668 - RNA, 20 nt, Shigella flexneri 2a str. 301
aucuucgagauucuuaaagu

SEQ ID NO: 1995669 - RNA, 14 nt, Shigella flexneri 2a str. 301
aucuuucauuuccg

SEQ ID NO: 1995670 - RNA, 14 nt, Shigella flexneri 2a str. 301
aucuuuccucacuc

SEQ ID NO: 1995671 - RNA, 13 nt, Shigella flexneri 2a str. 301
aucuuuccagccc

SEQ ID NO: 1995672 - RNA, 18 nt, Shigella flexneri 2a str. 301
aucuuuccggcagaagca

SEQ ID NO: 1995673 - RNA, 14 nt, Shigella flexneri 2a str. 301
aucuuucacgccca

SEQ ID NO: 1995674 - RNA, 16 nt, Shigella flexneri 2a str. 301
aucuuucagaaucagg

SEQ ID NO: 1995675 - RNA, 22 nt, Shigella flexneri 2a str. 301
aucuuuuacaagcaacuugcaa

SEQ ID NO: 1995676 - RNA, 20 nt, Shigella flexneri 2a str. 301
augaaaacgccggagugaaa

SEQ ID NO: 1995677 - RNA, 20 nt, Shigella flexneri 2a str. 301
augaaaauaaccauauauga

SEQ ID NO: 1995678 - RNA, 12 nt, Shigella flexneri 2a str. 301
augaaauaaaaa

SEQ ID NO: 1995679 - RNA, 14 nt, Shigella flexneri 2a str. 301
augaacaaagcgca

SEQ ID NO: 1995680 - RNA, 16 nt, Shigella flexneri 2a str. 301
augaacacgaucucac

SEQ ID NO: 1995681 - RNA, 13 nt, Shigella flexneri 2a str. 301
augaagcccgcug

SEQ ID NO: 1995682 - RNA, 16 nt, Shigella flexneri 2a str. 301
augaaucagcaaggaa

SEQ ID NO: 1995683 - RNA, 20 nt, Shigella flexneri 2a str. 301
augaaguacuuuggaaguau

SEQ ID NO: 1995684 - RNA, 22 nt, Shigella flexneri 2a str. 301
augaaugaugcggcgcuuucag

SEQ ID NO: 1995685 - RNA, 15 nt, Shigella flexneri 2a str. 301
augaaugauaaaauu

SEQ ID NO: 1995686 - RNA, 14 nt, Shigella flexneri 2a str. 301
augaaugcaaggcu

SEQ ID NO: 1995687 - RNA, 23 nt, Shigella flexneri 2a str. 301
augacuagcgccauaauaaucau

SEQ ID NO: 1995688 - RNA, 22 nt, Shigella flexneri 2a str. 301
augacuccaacuuacugauagu

SEQ ID NO: 1995689 - RNA, 14 nt, Shigella flexneri 2a str. 301
augacuuaauaaaa

SEQ ID NO: 1995690 - RNA, 17 nt, Shigella flexneri 2a str. 301
augacguuaauaaaauu

SEQ ID NO: 1995691 - RNA, 15 nt, Shigella flexneri 2a str. 301
augacagccagcaag

SEQ ID NO: 1995692 - RNA, 23 nt, Shigella flexneri 2a str. 301
augagguuugguagcaaaacaau

SEQ ID NO: 1995693 - RNA, 20 nt, Shigella flexneri 2a str. 301
augaggcuuuaauaccugcc

SEQ ID NO: 1995694 - RNA, 12 nt, Shigella flexneri 2a str. 301
augaguacagcg

SEQ ID NO: 1995695 - RNA, 21 nt, Shigella flexneri 2a str. 301
augaguacugaugaauaaaua

SEQ ID NO: 1995696 - RNA, 16 nt, Shigella flexneri 2a str. 301
augagugccaaaaaaa

SEQ ID NO: 1995697 - RNA, 19 nt, Shigella flexneri 2a str. 301
augagugccaaaaaaauaa

SEQ ID NO: 1995698 - RNA, 21 nt, Shigella flexneri 2a str. 301
augagugccaaaaaaauaagc

SEQ ID NO: 1995699 - RNA, 17 nt, Shigella flexneri 2a str. 301
augacuuuaugcugaag

SEQ ID NO: 1995700 - RNA, 20 nt, Shigella flexneri 2a str. 301
augacuuucuggcacgaccu

SEQ ID NO: 1995701 - RNA, 16 nt, Shigella flexneri 2a str. 301
augaguugaaaaccuc

SEQ ID NO: 1995702 - RNA, 15 nt, Shigella flexneri 2a str. 301
augaguugaaaaccu

SEQ ID NO: 1995703 - RNA, 15 nt, Shigella flexneri 2a str. 301
augaguuccacuggu

SEQ ID NO: 1995704 - RNA, 15 nt, Shigella flexneri 2a str. 301
augaguuaagaagau

SEQ ID NO: 1995705 - RNA, 11 nt, Shigella flexneri 2a str. 301
augauaagccu

SEQ ID NO: 1995706 - RNA, 14 nt, Shigella flexneri 2a str. 301
augauaauuauuau

SEQ ID NO: 1995707 - RNA, 14 nt, Shigella flexneri 2a str. 301
augauagccaggcg

SEQ ID NO: 1995708 - RNA, 16 nt, Shigella flexneri 2a str. 301
augauagccauuauca

SEQ ID NO: 1995709 - RNA, 13 nt, Shigella flexneri 2a str. 301
augauauuuuucc

SEQ ID NO: 1995710 - RNA, 15 nt, Shigella flexneri 2a str. 301
augaucaaaaucaua

SEQ ID NO: 1995711 - RNA, 14 nt, Shigella flexneri 2a str. 301
augaucaccugcau

SEQ ID NO: 1995712 - RNA, 15 nt, Shigella flexneri 2a str. 301
augaucaucaaggcu

SEQ ID NO: 1995713 - RNA, 14 nt, Shigella flexneri 2a str. 301
augauaucccugcu

SEQ ID NO: 1995714 - RNA, 21 nt, Shigella flexneri 2a str. 301
augauaucgcuggcaggcaaa

SEQ ID NO: 1995715 - RNA, 14 nt, Shigella flexneri 2a str. 301
aucuccggccugca

SEQ ID NO: 1995716 - RNA, 22 nt, Shigella flexneri 2a str. 301
aucuccggcgguaaaugcucau

SEQ ID NO: 1995717 - RNA, 18 nt, Shigella flexneri 2a str. 301
aucuccggcgguaaaugc

SEQ ID NO: 1995718 - RNA, 13 nt, Shigella flexneri 2a str. 301
aucucaucuucca

SEQ ID NO: 1995719 - RNA, 13 nt, Shigella flexneri 2a str. 301
aucucaucagcgu

SEQ ID NO: 1995720 - RNA, 16 nt, Shigella flexneri 2a str. 301
aucuccacagucaggc

SEQ ID NO: 1995721 - RNA, 20 nt, Shigella flexneri 2a str. 301
aucucugcaacgucuucccg

SEQ ID NO: 1995722 - RNA, 19 nt, Shigella flexneri 2a str. 301
aucucugcaacgucuuccc

SEQ ID NO: 1995723 - RNA, 21 nt, Shigella flexneri 2a str. 301
aucucgccagagagcggagca

SEQ ID NO: 1995724 - RNA, 12 nt, Shigella flexneri 2a str. 301
aucucuccuuuc

SEQ ID NO: 1995725 - RNA, 20 nt, Shigella flexneri 2a str. 301
aucucgccguggaugggacu

SEQ ID NO: 1995726 - RNA, 21 nt, Shigella flexneri 2a str. 301
aucucucuugcuaucacccac

SEQ ID NO: 1995727 - RNA, 21 nt, Shigella flexneri 2a str. 301
aucuacacgcuaccaaaaaau

SEQ ID NO: 1995728 - RNA, 19 nt, Shigella flexneri 2a str. 301
aucgucagcucgcugccau

SEQ ID NO: 1995729 - RNA, 18 nt, Shigella flexneri 2a str. 301
aucgucaggaucagccau

SEQ ID NO: 1995730 - RNA, 13 nt, Shigella flexneri 2a str. 301
aucgucaguucac

SEQ ID NO: 1995731 - RNA, 21 nt, Shigella flexneri 2a str. 301
aucgucauggcuguccuuuac

SEQ ID NO: 1995732 - RNA, 14 nt, Shigella flexneri 2a str. 301
aucguauuucagac

SEQ ID NO: 1995733 - RNA, 19 nt, Shigella flexneri 2a str. 301
aucguauccggcauuauca

SEQ ID NO: 1995734 - RNA, 16 nt, Shigella flexneri 2a str. 301
aucucagauaaaugca

SEQ ID NO: 1995735 - RNA, 22 nt, Shigella flexneri 2a str. 301
aucucagauaaaugcaaacgca

SEQ ID NO: 1995736 - RNA, 13 nt, Shigella flexneri 2a str. 301
aucucaccagauu

SEQ ID NO: 1995737 - RNA, 23 nt, Shigella flexneri 2a str. 301
aucucacccauagauaccuucuu

SEQ ID NO: 1995738 - RNA, 20 nt, Shigella flexneri 2a str. 301
aucucaccgaucaucacgau

SEQ ID NO: 1995739 - RNA, 21 nt, Shigella flexneri 2a str. 301
aucucaauuuucacuuucggc

SEQ ID NO: 1995740 - RNA, 16 nt, Shigella flexneri 2a str. 301
aucuagcgggaucugc

SEQ ID NO: 1995741 - RNA, 21 nt, Shigella flexneri 2a str. 301
aucuucaucgauacugcucug

SEQ ID NO: 1995742 - RNA, 20 nt, Shigella flexneri 2a str. 301
aucuucauugugcgguccau

SEQ ID NO: 1995743 - RNA, 14 nt, Shigella flexneri 2a str. 301
aucuuccagaucac

SEQ ID NO: 1995744 - RNA, 11 nt, Shigella flexneri 2a str. 301
aucuucccagc

SEQ ID NO: 1995745 - RNA, 15 nt, Shigella flexneri 2a str. 301
aucuucccagccaau

SEQ ID NO: 1995746 - RNA, 19 nt, Shigella flexneri 2a str. 301
aucuucccagcccagcgcu

SEQ ID NO: 1995747 - RNA, 20 nt, Shigella flexneri 2a str. 301
aucuuccggcgggcaaacgg

SEQ ID NO: 1995748 - RNA, 15 nt, Shigella flexneri 2a str. 301
aucuuccgucacagg

SEQ ID NO: 1995749 - RNA, 20 nt, Shigella flexneri 2a str. 301
aucuuccgucacaggcacac

SEQ ID NO: 1995750 - RNA, 18 nt, Shigella flexneri 2a str. 301
aucuucaaucagaugugc

SEQ ID NO: 1995751 - RNA, 15 nt, Shigella flexneri 2a str. 301
aucuucacacacauc

SEQ ID NO: 1995752 - RNA, 18 nt, Shigella flexneri 2a str. 301
aucuucacacugaugaca

SEQ ID NO: 1995753 - RNA, 15 nt, Shigella flexneri 2a str. 301
aucuucacaucauca

SEQ ID NO: 1995754 - RNA, 13 nt, Shigella flexneri 2a str. 301
aucuucagcugca

SEQ ID NO: 1995755 - RNA, 21 nt, Shigella flexneri 2a str. 301
aucuucauagauagccagcaa

SEQ ID NO: 1995756 - RNA, 20 nt, Shigella flexneri 2a str. 301
aucuucauccgccccggcuu

SEQ ID NO: 1995757 - RNA, 17 nt, Shigella flexneri 2a str. 301
aucuuagguaaugacuc

SEQ ID NO: 1995758 - RNA, 14 nt, Shigella flexneri 2a str. 301
aucuuagguaauga

SEQ ID NO: 1995759 - RNA, 15 nt, Shigella flexneri 2a str. 301
aucuuagugcgccug

SEQ ID NO: 1995760 - RNA, 23 nt, Shigella flexneri 2a str. 301
aucuuagugcgccugaucccagu

SEQ ID NO: 1995761 - RNA, 19 nt, Shigella flexneri 2a str. 301
aucuuacggcugcggaugu

SEQ ID NO: 1995762 - RNA, 15 nt, Shigella flexneri 2a str. 301
aucuuaugauguaaa

SEQ ID NO: 1995763 - RNA, 13 nt, Shigella flexneri 2a str. 301
aucuuaucacgau

SEQ ID NO: 1995764 - RNA, 23 nt, Shigella flexneri 2a str. 301
aucuuaucacgaugcuaaaaaca

SEQ ID NO: 1995765 - RNA, 16 nt, Shigella flexneri 2a str. 301
aucugcgucgcuuucc

SEQ ID NO: 1995766 - RNA, 16 nt, Shigella flexneri 2a str. 301
aucuggcauuugcacc

SEQ ID NO: 1995767 - RNA, 14 nt, Shigella flexneri 2a str. 301
aucuggauccacga

SEQ ID NO: 1995768 - RNA, 18 nt, Shigella flexneri 2a str. 301
aucugcuccuguugaugu

SEQ ID NO: 1995769 - RNA, 19 nt, Shigella flexneri 2a str. 301
aucugcggguuagucugca

SEQ ID NO: 1995770 - RNA, 14 nt, Shigella flexneri 2a str. 301
aucugcgggaacau

SEQ ID NO: 1995771 - RNA, 21 nt, Shigella flexneri 2a str. 301
aucugcguaucgcccugccaa

SEQ ID NO: 1995772 - RNA, 19 nt, Shigella flexneri 2a str. 301
aucugcguaucgcccugcc

SEQ ID NO: 1995773 - RNA, 21 nt, Shigella flexneri 2a str. 301
aucugcgcccaauauccugag

SEQ ID NO: 1995774 - RNA, 15 nt, Shigella flexneri 2a str. 301
aucugcgcuggaaca

SEQ ID NO: 1995775 - RNA, 17 nt, Shigella flexneri 2a str. 301
aucugaccgaaugcagu

SEQ ID NO: 1995776 - RNA, 18 nt, Shigella flexneri 2a str. 301
aucugaccgaaugcaguc

SEQ ID NO: 1995777 - RNA, 12 nt, Shigella flexneri 2a str. 301
aucugacaacac

SEQ ID NO: 1995778 - RNA, 11 nt, Shigella flexneri 2a str. 301
aucugaauauu

SEQ ID NO: 1995779 - RNA, 12 nt, Shigella flexneri 2a str. 301
aucugaaucagc

SEQ ID NO: 1995780 - RNA, 16 nt, Shigella flexneri 2a str. 301
aucuggcuugccagca

SEQ ID NO: 1995781 - RNA, 15 nt, Shigella flexneri 2a str. 301
aucuggccuacagau

SEQ ID NO: 1995782 - RNA, 23 nt, Shigella flexneri 2a str. 301
aucuggccgauccggacaugcug

SEQ ID NO: 1995783 - RNA, 21 nt, Shigella flexneri 2a str. 301
aucuguauaaccugaauauua

SEQ ID NO: 1995784 - RNA, 21 nt, Shigella flexneri 2a str. 301
aucuguaggccagauaagacg

SEQ ID NO: 1995785 - RNA, 22 nt, Shigella flexneri 2a str. 301
aucugucaguggacgauaagca

SEQ ID NO: 1995786 - RNA, 15 nt, Shigella flexneri 2a str. 301
aucugucagguaaca

SEQ ID NO: 1995787 - RNA, 11 nt, Shigella flexneri 2a str. 301
aucuguuuuag

SEQ ID NO: 1995788 - RNA, 12 nt, Shigella flexneri 2a str. 301
aaaagaaagaag

SEQ ID NO: 1995789 - RNA, 13 nt, Shigella flexneri 2a str. 301
aaaagaaagaagc

SEQ ID NO: 1995790 - RNA, 12 nt, Shigella flexneri 2a str. 301
aaaagaaaaaac

SEQ ID NO: 1995791 - RNA, 12 nt, Shigella flexneri 2a str. 301
aaaagaaaaaau

SEQ ID NO: 1995792 - RNA, 13 nt, Shigella flexneri 2a str. 301
aucauucccauuu

SEQ ID NO: 1995793 - RNA, 20 nt, Shigella flexneri 2a str. 301
aucauuuaaaaagaaaaaac

SEQ ID NO: 1995794 - RNA, 21 nt, Shigella flexneri 2a str. 301
aucauuuaaaaagaaaaaacu

SEQ ID NO: 1995795 - RNA, 11 nt, Shigella flexneri 2a str. 301
aaaagaaaaaa

SEQ ID NO: 1995796 - RNA, 22 nt, Shigella flexneri 2a str. 301
aaaacuuccauguguuuaucua

SEQ ID NO: 1995797 - RNA, 17 nt, Shigella flexneri 2a str. 301
aaaacuucguuagguuc

SEQ ID NO: 1995798 - RNA, 23 nt, Shigella flexneri 2a str. 301
aucauuagcccaauaaucaccgu

SEQ ID NO: 1995799 - RNA, 14 nt, Shigella flexneri 2a str. 301
aucauuacaaccgc

SEQ ID NO: 1995800 - RNA, 13 nt, Shigella flexneri 2a str. 301
aaaacuacaggca

SEQ ID NO: 1995801 - RNA, 15 nt, Shigella flexneri 2a str. 301
auccaccagcaugaa

SEQ ID NO: 1995802 - RNA, 14 nt, Shigella flexneri 2a str. 301
auccaccagcccca

SEQ ID NO: 1995803 - RNA, 21 nt, Shigella flexneri 2a str. 301
auccaagucaacgucauuauc

SEQ ID NO: 1995804 - RNA, 23 nt, Shigella flexneri 2a str. 301
aucauuuuacguugcauuuccau

SEQ ID NO: 1995805 - RNA, 14 nt, Shigella flexneri 2a str. 301
auccagccaaacau

SEQ ID NO: 1995806 - RNA, 15 nt, Shigella flexneri 2a str. 301
auccagcauaccuuc

SEQ ID NO: 1995807 - RNA, 16 nt, Shigella flexneri 2a str. 301
auccagcgcaaaggga

SEQ ID NO: 1995808 - RNA, 18 nt, Shigella flexneri 2a str. 301
auccagccacggcuccag

SEQ ID NO: 1995809 - RNA, 15 nt, Shigella flexneri 2a str. 301
auccagcccugccag

SEQ ID NO: 1995810 - RNA, 17 nt, Shigella flexneri 2a str. 301
auccagccuacaaauuu

SEQ ID NO: 1995811 - RNA, 14 nt, Shigella flexneri 2a str. 301
auccaccagugacu

SEQ ID NO: 1995812 - RNA, 17 nt, Shigella flexneri 2a str. 301
auccacccgcagcaagc

SEQ ID NO: 1995813 - RNA, 19 nt, Shigella flexneri 2a str. 301
auccaccgaaauaaucaga

SEQ ID NO: 1995814 - RNA, 16 nt, Shigella flexneri 2a str. 301
auccaccgccacgccg

SEQ ID NO: 1995815 - RNA, 13 nt, Shigella flexneri 2a str. 301
auccauuuucuau

SEQ ID NO: 1995816 - RNA, 15 nt, Shigella flexneri 2a str. 301
aucccagaagaauau

SEQ ID NO: 1995817 - RNA, 12 nt, Shigella flexneri 2a str. 301
aucccacugcca

SEQ ID NO: 1995818 - RNA, 21 nt, Shigella flexneri 2a str. 301
auccagcgcguaaauaccuuc

SEQ ID NO: 1995819 - RNA, 17 nt, Shigella flexneri 2a str. 301
auccagcgcgcgcagca

SEQ ID NO: 1995820 - RNA, 20 nt, Shigella flexneri 2a str. 301
auccaggaacuccagaucca

SEQ ID NO: 1995821 - RNA, 21 nt, Shigella flexneri 2a str. 301
auccagcgcggcgaaggugcc

SEQ ID NO: 1995822 - RNA, 16 nt, Shigella flexneri 2a str. 301
auccaggagcuccagg

SEQ ID NO: 1995823 - RNA, 17 nt, Shigella flexneri 2a str. 301
auccagguguauuguuc

SEQ ID NO: 1995824 - RNA, 16 nt, Shigella flexneri 2a str. 301
auccagguuucuucca

SEQ ID NO: 1995825 - RNA, 21 nt, Shigella flexneri 2a str. 301
auccaggguuuuauuauucca

SEQ ID NO: 1995826 - RNA, 17 nt, Shigella flexneri 2a str. 301
auccccucuucagccgc

SEQ ID NO: 1995827 - RNA, 13 nt, Shigella flexneri 2a str. 301
auccccucaaccu

SEQ ID NO: 1995828 - RNA, 14 nt, Shigella flexneri 2a str. 301
aucccgccagcacc

SEQ ID NO: 1995829 - RNA, 15 nt, Shigella flexneri 2a str. 301
aucccgcgauaugcc

SEQ ID NO: 1995830 - RNA, 14 nt, Shigella flexneri 2a str. 301
aucccggcacccgc

SEQ ID NO: 1995831 - RNA, 13 nt, Shigella flexneri 2a str. 301
aucccccagcacu

SEQ ID NO: 1995832 - RNA, 15 nt, Shigella flexneri 2a str. 301
auccccgcuuccugc

SEQ ID NO: 1995833 - RNA, 15 nt, Shigella flexneri 2a str. 301
auccccgccagcacg

SEQ ID NO: 1995834 - RNA, 19 nt, Shigella flexneri 2a str. 301
aucccagugcggcaucgcu

SEQ ID NO: 1995835 - RNA, 16 nt, Shigella flexneri 2a str. 301
aucccaguuuucgcca

SEQ ID NO: 1995836 - RNA, 16 nt, Shigella flexneri 2a str. 301
aucccaggccaaaucc

SEQ ID NO: 1995837 - RNA, 19 nt, Shigella flexneri 2a str. 301
aucccagaucgcuuuccca

SEQ ID NO: 1995838 - RNA, 20 nt, Shigella flexneri 2a str. 301
aucccagcaguuuccgcgcc

SEQ ID NO: 1995839 - RNA, 17 nt, Shigella flexneri 2a str. 301
auccgccauuucuccuc

SEQ ID NO: 1995840 - RNA, 13 nt, Shigella flexneri 2a str. 301
auccgcccacacc

SEQ ID NO: 1995841 - RNA, 18 nt, Shigella flexneri 2a str. 301
auccgcccucuuccacau

SEQ ID NO: 1995842 - RNA, 20 nt, Shigella flexneri 2a str. 301
auccgccgcgcggugggcua

SEQ ID NO: 1995843 - RNA, 14 nt, Shigella flexneri 2a str. 301
auccgccacuucuu

SEQ ID NO: 1995844 - RNA, 14 nt, Shigella flexneri 2a str. 301
auccgccauuucuc

SEQ ID NO: 1995845 - RNA, 16 nt, Shigella flexneri 2a str. 301
auccgccauuucuccu

SEQ ID NO: 1995846 - RNA, 19 nt, Shigella flexneri 2a str. 301
auccgcaauuucuggccau

SEQ ID NO: 1995847 - RNA, 12 nt, Shigella flexneri 2a str. 301
auccgacaaaug

SEQ ID NO: 1995848 - RNA, 12 nt, Shigella flexneri 2a str. 301
auccgagaaucg

SEQ ID NO: 1995849 - RNA, 17 nt, Shigella flexneri 2a str. 301
auccgacuuacucugaa

SEQ ID NO: 1995850 - RNA, 21 nt, Shigella flexneri 2a str. 301
auccgacuuaucacugccagu

SEQ ID NO: 1995851 - RNA, 17 nt, Shigella flexneri 2a str. 301
aucccucuuugucuuuu

SEQ ID NO: 1995852 - RNA, 20 nt, Shigella flexneri 2a str. 301
aucccguuacgauucucugc

SEQ ID NO: 1995853 - RNA, 19 nt, Shigella flexneri 2a str. 301
aucccgguuauuaaaacga

SEQ ID NO: 1995854 - RNA, 19 nt, Shigella flexneri 2a str. 301
aucccuuucgcuucaagua

SEQ ID NO: 1995855 - RNA, 14 nt, Shigella flexneri 2a str. 301
aucccuuagcuaau

SEQ ID NO: 1995856 - RNA, 13 nt, Shigella flexneri 2a str. 301
aucccuucuccac

SEQ ID NO: 1995857 - RNA, 20 nt, Shigella flexneri 2a str. 301
aucccugcggaaaaaagaaa

SEQ ID NO: 1995858 - RNA, 21 nt, Shigella flexneri 2a str. 301
aucgcggcgauauccagcgcg

SEQ ID NO: 1995859 - RNA, 20 nt, Shigella flexneri 2a str. 301
aucgcggaucagcuuaucca

SEQ ID NO: 1995860 - RNA, 23 nt, Shigella flexneri 2a str. 301
aucgcgccgccgcccaugaugac

SEQ ID NO: 1995861 - RNA, 14 nt, Shigella flexneri 2a str. 301
aucgcuaaaauacu

SEQ ID NO: 1995862 - RNA, 14 nt, Shigella flexneri 2a str. 301
aucgcggcacagaa

SEQ ID NO: 1995863 - RNA, 14 nt, Shigella flexneri 2a str. 301
aucgcggcacacag

SEQ ID NO: 1995864 - RNA, 19 nt, Shigella flexneri 2a str. 301
aucgcccgcuuccagcgca

SEQ ID NO: 1995865 - RNA, 14 nt, Shigella flexneri 2a str. 301
aucgcgccaaucag

SEQ ID NO: 1995866 - RNA, 22 nt, Shigella flexneri 2a str. 301
aucgccgcacuuucuccucccu

SEQ ID NO: 1995867 - RNA, 13 nt, Shigella flexneri 2a str. 301
aucggaacaacag

SEQ ID NO: 1995868 - RNA, 18 nt, Shigella flexneri 2a str. 301
aucggcauugcucccugc

SEQ ID NO: 1995869 - RNA, 16 nt, Shigella flexneri 2a str. 301
aucggccagcaccugc

SEQ ID NO: 1995870 - RNA, 14 nt, Shigella flexneri 2a str. 301
aucgcuccacgcca

SEQ ID NO: 1995871 - RNA, 18 nt, Shigella flexneri 2a str. 301
aucgcucaucugcugcgu

SEQ ID NO: 1995872 - RNA, 17 nt, Shigella flexneri 2a str. 301
aucgcucagcgcauccu

SEQ ID NO: 1995873 - RNA, 22 nt, Shigella flexneri 2a str. 301
aucgcuuucgcuacuucaaaca

SEQ ID NO: 1995874 - RNA, 15 nt, Shigella flexneri 2a str. 301
aucgcugaaagaugg

SEQ ID NO: 1995875 - RNA, 18 nt, Shigella flexneri 2a str. 301
aucgcuuuuaccagcaua

SEQ ID NO: 1995876 - RNA, 21 nt, Shigella flexneri 2a str. 301
aucguaguuuuugcccaucau

SEQ ID NO: 1995877 - RNA, 13 nt, Shigella flexneri 2a str. 301
aucgggugaaguu

SEQ ID NO: 1995878 - RNA, 15 nt, Shigella flexneri 2a str. 301
aucgggucaccugcc

SEQ ID NO: 1995879 - RNA, 23 nt, Shigella flexneri 2a str. 301
aucggugggcugacauuaucaga

SEQ ID NO: 1995880 - RNA, 20 nt, Shigella flexneri 2a str. 301
aucgguguguccauccauac

SEQ ID NO: 1995881 - RNA, 20 nt, Shigella flexneri 2a str. 301
aucggugguguaaccuucac

SEQ ID NO: 1995882 - RNA, 20 nt, Shigella flexneri 2a str. 301
aucggugaaaguaacaaagc

SEQ ID NO: 1995883 - RNA, 20 nt, Shigella flexneri 2a str. 301
aucgggcgauuuugcuuuug

SEQ ID NO: 1995884 - RNA, 15 nt, Shigella flexneri 2a str. 301
aucgggagagauaag

SEQ ID NO: 1995885 - RNA, 18 nt, Shigella flexneri 2a str. 301
aucgggaccagcauucca

SEQ ID NO: 1995886 - RNA, 20 nt, Shigella flexneri 2a str. 301
aucggcggcgauguccagac

SEQ ID NO: 1995887 - RNA, 17 nt, Shigella flexneri 2a str. 301
aucggccuuccauaaug

SEQ ID NO: 1995888 - RNA, 21 nt, Shigella flexneri 2a str. 301
aucggcgcgccagcgaucuuu

SEQ ID NO: 1995889 - RNA, 13 nt, Shigella flexneri 2a str. 301
aucgaacagcagc

SEQ ID NO: 1995890 - RNA, 14 nt, Shigella flexneri 2a str. 301
aucgaacagcagca

SEQ ID NO: 1995891 - RNA, 23 nt, Shigella flexneri 2a str. 301
aucgaagagacaaaaaaggugcu

SEQ ID NO: 1995892 - RNA, 16 nt, Shigella flexneri 2a str. 301
auccugguuauuucac

SEQ ID NO: 1995893 - RNA, 17 nt, Shigella flexneri 2a str. 301
auccugguuauuucacu

SEQ ID NO: 1995894 - RNA, 13 nt, Shigella flexneri 2a str. 301
auccugucaguuc

SEQ ID NO: 1995895 - RNA, 20 nt, Shigella flexneri 2a str. 301
auccgcuggcccaucagaau

SEQ ID NO: 1995896 - RNA, 22 nt, Shigella flexneri 2a str. 301
auccgcucacugauaagauggu

SEQ ID NO: 1995897 - RNA, 13 nt, Shigella flexneri 2a str. 301
auccugcacuuuc

SEQ ID NO: 1995898 - RNA, 23 nt, Shigella flexneri 2a str. 301
auccgcuucaggaauaagacaau

SEQ ID NO: 1995899 - RNA, 22 nt, Shigella flexneri 2a str. 301
auccggauacagccccaggguu

SEQ ID NO: 1995900 - RNA, 18 nt, Shigella flexneri 2a str. 301
auccgcuuucgguuuuuc

SEQ ID NO: 1995901 - RNA, 18 nt, Shigella flexneri 2a str. 301
auccuggggguucaucac

SEQ ID NO: 1995902 - RNA, 22 nt, Shigella flexneri 2a str. 301
auccuggcgaaaacgcccggca

SEQ ID NO: 1995903 - RNA, 15 nt, Shigella flexneri 2a str. 301
auccuggauuuccuc

SEQ ID NO: 1995904 - RNA, 19 nt, Shigella flexneri 2a str. 301
auccugcccacuccagcua

SEQ ID NO: 1995905 - RNA, 17 nt, Shigella flexneri 2a str. 301
aucgcauugacgccaaa

SEQ ID NO: 1995906 - RNA, 18 nt, Shigella flexneri 2a str. 301
aucgccaacaaucucuuc

SEQ ID NO: 1995907 - RNA, 14 nt, Shigella flexneri 2a str. 301
aucgauaaaccagc

SEQ ID NO: 1995908 - RNA, 20 nt, Shigella flexneri 2a str. 301
aucgccagcaaaaucaccau

SEQ ID NO: 1995909 - RNA, 17 nt, Shigella flexneri 2a str. 301
aucgccagcaucggcag

SEQ ID NO: 1995910 - RNA, 14 nt, Shigella flexneri 2a str. 301
aucgccaccacccu

SEQ ID NO: 1995911 - RNA, 16 nt, Shigella flexneri 2a str. 301
aucgacgcgccagcac

SEQ ID NO: 1995912 - RNA, 21 nt, Shigella flexneri 2a str. 301
aucgacgcguccaggcucgcc

SEQ ID NO: 1995913 - RNA, 21 nt, Shigella flexneri 2a str. 301
aucgacgccagucugaccaua

SEQ ID NO: 1995914 - RNA, 18 nt, Shigella flexneri 2a str. 301
aucgaggccauauuucac

SEQ ID NO: 1995915 - RNA, 13 nt, Shigella flexneri 2a str. 301
aucgacaucaacg

SEQ ID NO: 1995916 - RNA, 19 nt, Shigella flexneri 2a str. 301
aucgacaguuucaccugcu

SEQ ID NO: 1995917 - RNA, 15 nt, Shigella flexneri 2a str. 301
aucgacagacgccag

SEQ ID NO: 1995918 - RNA, 18 nt, Shigella flexneri 2a str. 301
auacgcaccgcuccaucg

SEQ ID NO: 1995919 - RNA, 16 nt, Shigella flexneri 2a str. 301
auacgcaccuuuacca

SEQ ID NO: 1995920 - RNA, 18 nt, Shigella flexneri 2a str. 301
auacgcauaugcaucaga

SEQ ID NO: 1995921 - RNA, 16 nt, Shigella flexneri 2a str. 301
auacgcagcaucauca

SEQ ID NO: 1995922 - RNA, 16 nt, Shigella flexneri 2a str. 301
auacgccaucgccagc

SEQ ID NO: 1995923 - RNA, 18 nt, Shigella flexneri 2a str. 301
auacgcgcauucuuuacu

SEQ ID NO: 1995924 - RNA, 15 nt, Shigella flexneri 2a str. 301
auaccuugcugcucc

SEQ ID NO: 1995925 - RNA, 22 nt, Shigella flexneri 2a str. 301
auaccuucacagaaggccagga

SEQ ID NO: 1995926 - RNA, 17 nt, Shigella flexneri 2a str. 301
auacgaccguuccauuc

SEQ ID NO: 1995927 - RNA, 22 nt, Shigella flexneri 2a str. 301
auaccggagacgguuauauuua

SEQ ID NO: 1995928 - RNA, 14 nt, Shigella flexneri 2a str. 301
auaccuuacacuca

SEQ ID NO: 1995929 - RNA, 14 nt, Shigella flexneri 2a str. 301
auacagcggccagc

SEQ ID NO: 1995930 - RNA, 23 nt, Shigella flexneri 2a str. 301
auacaggaacagccacuggugag

SEQ ID NO: 1995931 - RNA, 15 nt, Shigella flexneri 2a str. 301
auacuuucacaaaaa

SEQ ID NO: 1995932 - RNA, 16 nt, Shigella flexneri 2a str. 301
auacuucaauauaugc

SEQ ID NO: 1995933 - RNA, 13 nt, Shigella flexneri 2a str. 301
auacuuauuauga

SEQ ID NO: 1995934 - RNA, 19 nt, Shigella flexneri 2a str. 301
auacuuccacuaguauuua

SEQ ID NO: 1995935 - RNA, 22 nt, Shigella flexneri 2a str. 301
auacuggauagauauucuccag

SEQ ID NO: 1995936 - RNA, 15 nt, Shigella flexneri 2a str. 301
auacugcuuaaacca

SEQ ID NO: 1995937 - RNA, 17 nt, Shigella flexneri 2a str. 301
auacuuauaagcucaau

SEQ ID NO: 1995938 - RNA, 13 nt, Shigella flexneri 2a str. 301
auacugcccaauc

SEQ ID NO: 1995939 - RNA, 22 nt, Shigella flexneri 2a str. 301
auacugcuccccgaacgauugu

SEQ ID NO: 1995940 - RNA, 21 nt, Shigella flexneri 2a str. 301
auacuccugauggucuauugc

SEQ ID NO: 1995941 - RNA, 18 nt, Shigella flexneri 2a str. 301
auacuccccuuucuuauu

SEQ ID NO: 1995942 - RNA, 14 nt, Shigella flexneri 2a str. 301
auacgcgcuaauca

SEQ ID NO: 1995943 - RNA, 21 nt, Shigella flexneri 2a str. 301
auacgcuggcugaacauuaaa

SEQ ID NO: 1995944 - RNA, 21 nt, Shigella flexneri 2a str. 301
auagcaaucuguaacaaggug

SEQ ID NO: 1995945 - RNA, 13 nt, Shigella flexneri 2a str. 301
auagcaaaguaau

SEQ ID NO: 1995946 - RNA, 19 nt, Shigella flexneri 2a str. 301
auagcaaaguaauaaugau

SEQ ID NO: 1995947 - RNA, 15 nt, Shigella flexneri 2a str. 301
auagcacacuuucgc

SEQ ID NO: 1995948 - RNA, 12 nt, Shigella flexneri 2a str. 301
auagcacacuuu

SEQ ID NO: 1995949 - RNA, 16 nt, Shigella flexneri 2a str. 301
auagcagaaaacucac

SEQ ID NO: 1995950 - RNA, 21 nt, Shigella flexneri 2a str. 301
auagcaguaauugcagcagcu

SEQ ID NO: 1995951 - RNA, 15 nt, Shigella flexneri 2a str. 301
auagccuuucaauaa

SEQ ID NO: 1995952 - RNA, 18 nt, Shigella flexneri 2a str. 301
auagcgacaggcuuucuu

SEQ ID NO: 1995953 - RNA, 15 nt, Shigella flexneri 2a str. 301
auagcgucauuucua

SEQ ID NO: 1995954 - RNA, 17 nt, Shigella flexneri 2a str. 301
auagcguuaaucaucaa

SEQ ID NO: 1995955 - RNA, 15 nt, Shigella flexneri 2a str. 301
auagccagacguugu

SEQ ID NO: 1995956 - RNA, 18 nt, Shigella flexneri 2a str. 301
auagccagccucauccau

SEQ ID NO: 1995957 - RNA, 19 nt, Shigella flexneri 2a str. 301
auagccaccuggcugcguu

SEQ ID NO: 1995958 - RNA, 22 nt, Shigella flexneri 2a str. 301
auagccaccuuauaacccgacu

SEQ ID NO: 1995959 - RNA, 20 nt, Shigella flexneri 2a str. 301
auagccacgcucauaugcuu

SEQ ID NO: 1995960 - RNA, 15 nt, Shigella flexneri 2a str. 301
auagccaaagcacca

SEQ ID NO: 1995961 - RNA, 19 nt, Shigella flexneri 2a str. 301
auagccucaaauuccuuau

SEQ ID NO: 1995962 - RNA, 16 nt, Shigella flexneri 2a str. 301
auagauuuuuaaugcu

SEQ ID NO: 1995963 - RNA, 20 nt, Shigella flexneri 2a str. 301
auagauuuuuaaugcuuuuu

SEQ ID NO: 1995964 - RNA, 13 nt, Shigella flexneri 2a str. 301
auagauccaggaa

SEQ ID NO: 1995965 - RNA, 18 nt, Shigella flexneri 2a str. 301
auagaguguuccucugcc

SEQ ID NO: 1995966 - RNA, 23 nt, Shigella flexneri 2a str. 301
auacuuuuucaagaaucggcuuu

SEQ ID NO: 1995967 - RNA, 16 nt, Shigella flexneri 2a str. 301
auacuuuuucaagaau

SEQ ID NO: 1995968 - RNA, 13 nt, Shigella flexneri 2a str. 301
auacuuuucagga

SEQ ID NO: 1995969 - RNA, 17 nt, Shigella flexneri 2a str. 301
auacuuucacaaaaaua

SEQ ID NO: 1995970 - RNA, 14 nt, Shigella flexneri 2a str. 301
auagacuucccucc

SEQ ID NO: 1995971 - RNA, 18 nt, Shigella flexneri 2a str. 301
auagagaaaguaaaccac

SEQ ID NO: 1995972 - RNA, 13 nt, Shigella flexneri 2a str. 301
auagacuucccuc

SEQ ID NO: 1995973 - RNA, 22 nt, Shigella flexneri 2a str. 301
auaguucuguugcugaaauucc

SEQ ID NO: 1995974 - RNA, 16 nt, Shigella flexneri 2a str. 301
auauaaagcaucaauu

SEQ ID NO: 1995975 - RNA, 11 nt, Shigella flexneri 2a str. 301
auauaaaaaac

SEQ ID NO: 1995976 - RNA, 16 nt, Shigella flexneri 2a str. 301
auagugccuggcugcg

SEQ ID NO: 1995977 - RNA, 12 nt, Shigella flexneri 2a str. 301
auagcuaauccc

SEQ ID NO: 1995978 - RNA, 20 nt, Shigella flexneri 2a str. 301
auagcuaacucuaaucccuu

SEQ ID NO: 1995979 - RNA, 16 nt, Shigella flexneri 2a str. 301
auauaauugaccagau

SEQ ID NO: 1995980 - RNA, 22 nt, Shigella flexneri 2a str. 301
auauaauugaccagaucuucau

SEQ ID NO: 1995981 - RNA, 17 nt, Shigella flexneri 2a str. 301
auauacccgccaaacca

SEQ ID NO: 1995982 - RNA, 15 nt, Shigella flexneri 2a str. 301
auauacccuucucag

SEQ ID NO: 1995983 - RNA, 23 nt, Shigella flexneri 2a str. 301
auauaccgccgccagcaacauca

SEQ ID NO: 1995984 - RNA, 15 nt, Shigella flexneri 2a str. 301
auauaauuaaaaaua

SEQ ID NO: 1995985 - RNA, 14 nt, Shigella flexneri 2a str. 301
auauaaugcaacau

SEQ ID NO: 1995986 - RNA, 15 nt, Shigella flexneri 2a str. 301
auauaaagcaucaau

SEQ ID NO: 1995987 - RNA, 14 nt, Shigella flexneri 2a str. 301
auauaauaaaccug

SEQ ID NO: 1995988 - RNA, 18 nt, Shigella flexneri 2a str. 301
auauauccgaaaaaggau

SEQ ID NO: 1995989 - RNA, 19 nt, Shigella flexneri 2a str. 301
auauauccguggcuuuuua

SEQ ID NO: 1995990 - RNA, 14 nt, Shigella flexneri 2a str. 301
auauagaaaaugga

SEQ ID NO: 1995991 - RNA, 22 nt, Shigella flexneri 2a str. 301
auauacgccaucgccagcagcc

SEQ ID NO: 1995992 - RNA, 20 nt, Shigella flexneri 2a str. 301
auauacgccaucgccagcag

SEQ ID NO: 1995993 - RNA, 18 nt, Shigella flexneri 2a str. 301
auauauuuuuaaauauaa

SEQ ID NO: 1995994 - RNA, 16 nt, Shigella flexneri 2a str. 301
auauauuuuuaaauau

SEQ ID NO: 1995995 - RNA, 15 nt, Shigella flexneri 2a str. 301
auaucaucauuugca

SEQ ID NO: 1995996 - RNA, 14 nt, Shigella flexneri 2a str. 301
auaucaucaaaauu

SEQ ID NO: 1995997 - RNA, 15 nt, Shigella flexneri 2a str. 301
auaucaucaaaauua

SEQ ID NO: 1995998 - RNA, 19 nt, Shigella flexneri 2a str. 301
auaucgacgaaccauuucg

SEQ ID NO: 1995999 - RNA, 21 nt, Shigella flexneri 2a str. 301
auauccccccaugaaauaaaa

SEQ ID NO: 1996000 - RNA, 16 nt, Shigella flexneri 2a str. 301
auaucgcuggcagaaa

SEQ ID NO: 1996001 - RNA, 14 nt, Shigella flexneri 2a str. 301
auaucggcauugcu

SEQ ID NO: 1996002 - RNA, 19 nt, Shigella flexneri 2a str. 301
auaucggccaucuguucug

SEQ ID NO: 1996003 - RNA, 23 nt, Shigella flexneri 2a str. 301
auaucggcaccagcgcagaagag

SEQ ID NO: 1996004 - RNA, 15 nt, Shigella flexneri 2a str. 301
auaucgcgcagaaau

SEQ ID NO: 1996005 - RNA, 19 nt, Shigella flexneri 2a str. 301
auaucgccauuaaacaacc

SEQ ID NO: 1996006 - RNA, 20 nt, Shigella flexneri 2a str. 301
auaucgauuucuacacccag

SEQ ID NO: 1996007 - RNA, 14 nt, Shigella flexneri 2a str. 301
auaucuccuauugu

SEQ ID NO: 1996008 - RNA, 19 nt, Shigella flexneri 2a str. 301
auaucuccuccgaugacgg

SEQ ID NO: 1996009 - RNA, 22 nt, Shigella flexneri 2a str. 301
auaucugcuccguaaaacucag

SEQ ID NO: 1996010 - RNA, 20 nt, Shigella flexneri 2a str. 301
auaucuuuucuuaacaaaaa

SEQ ID NO: 1996011 - RNA, 18 nt, Shigella flexneri 2a str. 301
auaucuucuguugcaggg

SEQ ID NO: 1996012 - RNA, 11 nt, Shigella flexneri 2a str. 301
auaucuucccg

SEQ ID NO: 1996013 - RNA, 22 nt, Shigella flexneri 2a str. 301
auaucuuauagacuaaauuuca

SEQ ID NO: 1996014 - RNA, 15 nt, Shigella flexneri 2a str. 301
auaugagcgcaaaug

SEQ ID NO: 1996015 - RNA, 21 nt, Shigella flexneri 2a str. 301
auaugaccauugguaauggga

SEQ ID NO: 1996016 - RNA, 17 nt, Shigella flexneri 2a str. 301
auaucuuucauauucaa

SEQ ID NO: 1996017 - RNA, 12 nt, Shigella flexneri 2a str. 301
aucaucaucgcg

SEQ ID NO: 1996018 - RNA, 17 nt, Shigella flexneri 2a str. 301
aucaucagugcuuuauc

SEQ ID NO: 1996019 - RNA, 20 nt, Shigella flexneri 2a str. 301
aucaucaggggcagcaccau

SEQ ID NO: 1996020 - RNA, 19 nt, Shigella flexneri 2a str. 301
aucaucaggggcagcacca

SEQ ID NO: 1996021 - RNA, 18 nt, Shigella flexneri 2a str. 301
aucaucaauaccagcccg

SEQ ID NO: 1996022 - RNA, 12 nt, Shigella flexneri 2a str. 301
aucaucaauaug

SEQ ID NO: 1996023 - RNA, 19 nt, Shigella flexneri 2a str. 301
aucaucacgccaauaccgc

SEQ ID NO: 1996024 - RNA, 13 nt, Shigella flexneri 2a str. 301
aucaucagcaaac

SEQ ID NO: 1996025 - RNA, 12 nt, Shigella flexneri 2a str. 301
aucaucacuccc

SEQ ID NO: 1996026 - RNA, 18 nt, Shigella flexneri 2a str. 301
aucaucacugccaggagc

SEQ ID NO: 1996027 - RNA, 15 nt, Shigella flexneri 2a str. 301
aucaucaacuggcaa

SEQ ID NO: 1996028 - RNA, 14 nt, Shigella flexneri 2a str. 301
aucaucaaaauuaa

SEQ ID NO: 1996029 - RNA, 13 nt, Shigella flexneri 2a str. 301
aucauauuaaauu

SEQ ID NO: 1996030 - RNA, 19 nt, Shigella flexneri 2a str. 301
aucauauuuccuuccuugg

SEQ ID NO: 1996031 - RNA, 17 nt, Shigella flexneri 2a str. 301
aucauauugcucuggau

SEQ ID NO: 1996032 - RNA, 23 nt, Shigella flexneri 2a str. 301
aucaucgcccaguugaucaccag

SEQ ID NO: 1996033 - RNA, 22 nt, Shigella flexneri 2a str. 301
aucaucgccccgcucacgcagc

SEQ ID NO: 1996034 - RNA, 20 nt, Shigella flexneri 2a str. 301
aucauccuuuuggcuaaucg

SEQ ID NO: 1996035 - RNA, 22 nt, Shigella flexneri 2a str. 301
aucauccugcggcagcuccagc

SEQ ID NO: 1996036 - RNA, 18 nt, Shigella flexneri 2a str. 301
aucauccgcacaaucccu

SEQ ID NO: 1996037 - RNA, 15 nt, Shigella flexneri 2a str. 301
aucaucauuuuuuca

SEQ ID NO: 1996038 - RNA, 15 nt, Shigella flexneri 2a str. 301
aucaucauuaauauc

SEQ ID NO: 1996039 - RNA, 20 nt, Shigella flexneri 2a str. 301
aucauccacccgcagcaagc

SEQ ID NO: 1996040 - RNA, 20 nt, Shigella flexneri 2a str. 301
aucauccaccuuaaaacaau

SEQ ID NO: 1996041 - RNA, 12 nt, Shigella flexneri 2a str. 301
aucauccagcac

SEQ ID NO: 1996042 - RNA, 20 nt, Shigella flexneri 2a str. 301
aucauccccguaucuucaug

SEQ ID NO: 1996043 - RNA, 17 nt, Shigella flexneri 2a str. 301
aucauccccguaucuuc

SEQ ID NO: 1996044 - RNA, 16 nt, Shigella flexneri 2a str. 301
aucaucccccugcgau

SEQ ID NO: 1996045 - RNA, 23 nt, Shigella flexneri 2a str. 301
aucaucccccugcgauugugaca

SEQ ID NO: 1996046 - RNA, 15 nt, Shigella flexneri 2a str. 301
aucauccgcacaauc

SEQ ID NO: 1996047 - RNA, 23 nt, Shigella flexneri 2a str. 301
aucauccauauuuucagcagugg

SEQ ID NO: 1996048 - RNA, 12 nt, Shigella flexneri 2a str. 301
aucauccauccg

SEQ ID NO: 1996049 - RNA, 19 nt, Shigella flexneri 2a str. 301
aucauccaugauaauuccg

SEQ ID NO: 1996050 - RNA, 14 nt, Shigella flexneri 2a str. 301
aucaggccagccag

SEQ ID NO: 1996051 - RNA, 15 nt, Shigella flexneri 2a str. 301
aucaggaccugcucu

SEQ ID NO: 1996052 - RNA, 23 nt, Shigella flexneri 2a str. 301
aucagcuuuuccauaucaagcau

SEQ ID NO: 1996053 - RNA, 20 nt, Shigella flexneri 2a str. 301
aucaggccuacaaaaugugc

SEQ ID NO: 1996054 - RNA, 22 nt, Shigella flexneri 2a str. 301
aaaacgccggagugaaaauucu

SEQ ID NO: 1996055 - RNA, 11 nt, Shigella flexneri 2a str. 301
aaaacgccugc

SEQ ID NO: 1996056 - RNA, 17 nt, Shigella flexneri 2a str. 301
aaaacgccgccagcuca

SEQ ID NO: 1996057 - RNA, 23 nt, Shigella flexneri 2a str. 301
aaaacgcgcccucagcccacauc

SEQ ID NO: 1996058 - RNA, 14 nt, Shigella flexneri 2a str. 301
aaaacgaucgccca

SEQ ID NO: 1996059 - RNA, 17 nt, Shigella flexneri 2a str. 301
aucagugguguagggca

SEQ ID NO: 1996060 - RNA, 14 nt, Shigella flexneri 2a str. 301
aucauaaaaauuaa

SEQ ID NO: 1996061 - RNA, 13 nt, Shigella flexneri 2a str. 301
aucauaaaaauua

SEQ ID NO: 1996062 - RNA, 23 nt, Shigella flexneri 2a str. 301
aucaguguacuuaucuuuuacaa

SEQ ID NO: 1996063 - RNA, 21 nt, Shigella flexneri 2a str. 301
aucaguuaaggaucaguugac

SEQ ID NO: 1996064 - RNA, 14 nt, Shigella flexneri 2a str. 301
aucauaacccuuuc

SEQ ID NO: 1996065 - RNA, 18 nt, Shigella flexneri 2a str. 301
aucauaacccuuuccuuc

SEQ ID NO: 1996066 - RNA, 21 nt, Shigella flexneri 2a str. 301
aucauagcgaauaaucccggc

SEQ ID NO: 1996067 - RNA, 21 nt, Shigella flexneri 2a str. 301
aucauaauaaagaugccauug

SEQ ID NO: 1996068 - RNA, 20 nt, Shigella flexneri 2a str. 301
aucagcaaacuaucccagcc

SEQ ID NO: 1996069 - RNA, 13 nt, Shigella flexneri 2a str. 301
aucagcaaaucca

SEQ ID NO: 1996070 - RNA, 24 nt, Shigella flexneri 2a str. 301
aucagcaaauuuggcaucgaggau

SEQ ID NO: 1996071 - RNA, 17 nt, Shigella flexneri 2a str. 301
aucagcaacacgcugcu

SEQ ID NO: 1996072 - RNA, 20 nt, Shigella flexneri 2a str. 301
aucagauucgauagagaacg

SEQ ID NO: 1996073 - RNA, 18 nt, Shigella flexneri 2a str. 301
aucagaucguugaacccg

SEQ ID NO: 1996074 - RNA, 13 nt, Shigella flexneri 2a str. 301
aucagauccgcac

SEQ ID NO: 1996075 - RNA, 23 nt, Shigella flexneri 2a str. 301
aucagauaauauuuaucuuccca

SEQ ID NO: 1996076 - RNA, 13 nt, Shigella flexneri 2a str. 301
aucagauaaaaua

SEQ ID NO: 1996077 - RNA, 15 nt, Shigella flexneri 2a str. 301
aucagauaaaauaca

SEQ ID NO: 1996078 - RNA, 23 nt, Shigella flexneri 2a str. 301
aucagagcuggaaguuacucaaa

SEQ ID NO: 1996079 - RNA, 16 nt, Shigella flexneri 2a str. 301
aucagacgacccacga

SEQ ID NO: 1996080 - RNA, 11 nt, Shigella flexneri 2a str. 301
aucagagauuc

SEQ ID NO: 1996081 - RNA, 14 nt, Shigella flexneri 2a str. 301
aucagcuuauccau

SEQ ID NO: 1996082 - RNA, 14 nt, Shigella flexneri 2a str. 301
aucagcggacugca

SEQ ID NO: 1996083 - RNA, 11 nt, Shigella flexneri 2a str. 301
aucagcaugac

SEQ ID NO: 1996084 - RNA, 17 nt, Shigella flexneri 2a str. 301
aucagcaugacaaaaaa

SEQ ID NO: 1996085 - RNA, 22 nt, Shigella flexneri 2a str. 301
aucagcaugacaaaaaagccaa

SEQ ID NO: 1996086 - RNA, 12 nt, Shigella flexneri 2a str. 301
aucagcauucuc

SEQ ID NO: 1996087 - RNA, 19 nt, Shigella flexneri 2a str. 301
aucagccacuuccugcucg

SEQ ID NO: 1996088 - RNA, 14 nt, Shigella flexneri 2a str. 301
aucagccacuuccu

SEQ ID NO: 1996089 - RNA, 19 nt, Shigella flexneri 2a str. 301
aucagcgcagcacccagaa

SEQ ID NO: 1996090 - RNA, 14 nt, Shigella flexneri 2a str. 301
aucagcgcaaagag

SEQ ID NO: 1996091 - RNA, 22 nt, Shigella flexneri 2a str. 301
aucagccauuuugcacauucca

SEQ ID NO: 1996092 - RNA, 13 nt, Shigella flexneri 2a str. 301
aucacuuucagac

SEQ ID NO: 1996093 - RNA, 21 nt, Shigella flexneri 2a str. 301
aucagaccuacaaaaccugca

SEQ ID NO: 1996094 - RNA, 21 nt, Shigella flexneri 2a str. 301
aucagacaccgauugccccug

SEQ ID NO: 1996095 - RNA, 13 nt, Shigella flexneri 2a str. 301
aucagaauuuuuc

SEQ ID NO: 1996096 - RNA, 14 nt, Shigella flexneri 2a str. 301
aucagaauuuuucg

SEQ ID NO: 1996097 - RNA, 17 nt, Shigella flexneri 2a str. 301
aucagaauugcgagccu

SEQ ID NO: 1996098 - RNA, 19 nt, Shigella flexneri 2a str. 301
aucagaaugcgcucuuccg

SEQ ID NO: 1996099 - RNA, 14 nt, Shigella flexneri 2a str. 301
aucacgcccgccag

SEQ ID NO: 1996100 - RNA, 18 nt, Shigella flexneri 2a str. 301
aucacgcuauacaaccac

SEQ ID NO: 1996101 - RNA, 12 nt, Shigella flexneri 2a str. 301
aucacgcagcug

SEQ ID NO: 1996102 - RNA, 14 nt, Shigella flexneri 2a str. 301
aucacgaugcuaaa

SEQ ID NO: 1996103 - RNA, 17 nt, Shigella flexneri 2a str. 301
aucacgcagcaagccgu

SEQ ID NO: 1996104 - RNA, 17 nt, Shigella flexneri 2a str. 301
aucacgcaucgcgaaau

SEQ ID NO: 1996105 - RNA, 17 nt, Shigella flexneri 2a str. 301
aucacgaugcuaaaaac

SEQ ID NO: 1996106 - RNA, 15 nt, Shigella flexneri 2a str. 301
aucaccguaacgaac

SEQ ID NO: 1996107 - RNA, 11 nt, Shigella flexneri 2a str. 301
aucaccucuuc

SEQ ID NO: 1996108 - RNA, 18 nt, Shigella flexneri 2a str. 301
aucaauggcugcaaagca

SEQ ID NO: 1996109 - RNA, 17 nt, Shigella flexneri 2a str. 301
aucaccgcacggcgagu

SEQ ID NO: 1996110 - RNA, 14 nt, Shigella flexneri 2a str. 301
aucaacaagcgaau

SEQ ID NO: 1996111 - RNA, 21 nt, Shigella flexneri 2a str. 301
aucaaacuuuuaaauugaaga

SEQ ID NO: 1996112 - RNA, 19 nt, Shigella flexneri 2a str. 301
aucaaacuuuuaaauugaa

SEQ ID NO: 1996113 - RNA, 20 nt, Shigella flexneri 2a str. 301
aucaaacggugguuguuccu

SEQ ID NO: 1996114 - RNA, 13 nt, Shigella flexneri 2a str. 301
aucaacacaucca

SEQ ID NO: 1996115 - RNA, 14 nt, Shigella flexneri 2a str. 301
aucaacacauccag

SEQ ID NO: 1996116 - RNA, 17 nt, Shigella flexneri 2a str. 301
aucaacaccacugccag

SEQ ID NO: 1996117 - RNA, 15 nt, Shigella flexneri 2a str. 301
aucaaaccacuuaau

SEQ ID NO: 1996118 - RNA, 21 nt, Shigella flexneri 2a str. 301
aucaaacaacggcacuucaau

SEQ ID NO: 1996119 - RNA, 12 nt, Shigella flexneri 2a str. 301
aucaaaaucauc

SEQ ID NO: 1996120 - RNA, 13 nt, Shigella flexneri 2a str. 301
aucaaaaucauca

SEQ ID NO: 1996121 - RNA, 12 nt, Shigella flexneri 2a str. 301
aucaagcaacau

SEQ ID NO: 1996122 - RNA, 15 nt, Shigella flexneri 2a str. 301
aucaagaaugcucgc

SEQ ID NO: 1996123 - RNA, 20 nt, Shigella flexneri 2a str. 301
aucaagacaugauguuuuaa

SEQ ID NO: 1996124 - RNA, 17 nt, Shigella flexneri 2a str. 301
aucaacgccaucgccag

SEQ ID NO: 1996125 - RNA, 23 nt, Shigella flexneri 2a str. 301
aucaacgagauaaaauuaacgac

SEQ ID NO: 1996126 - RNA, 24 nt, Shigella flexneri 2a str. 301
aucaacaguuuguugcauuugcag

SEQ ID NO: 1996127 - RNA, 17 nt, Shigella flexneri 2a str. 301
aucaacaguuuguugca

SEQ ID NO: 1996128 - RNA, 15 nt, Shigella flexneri 2a str. 301
aucaacaguuuguug

SEQ ID NO: 1996129 - RNA, 22 nt, Shigella flexneri 2a str. 301
aucaaucacccguuuucuccau

SEQ ID NO: 1996130 - RNA, 22 nt, Shigella flexneri 2a str. 301
aucaauccaguguaaaacagca

SEQ ID NO: 1996131 - RNA, 13 nt, Shigella flexneri 2a str. 301
aucaauccaaaca

SEQ ID NO: 1996132 - RNA, 18 nt, Shigella flexneri 2a str. 301
aucaauagcaguaauuuu

SEQ ID NO: 1996133 - RNA, 20 nt, Shigella flexneri 2a str. 301
aucaauagcuaacgaaagaa

SEQ ID NO: 1996134 - RNA, 13 nt, Shigella flexneri 2a str. 301
aucaauauauugc

SEQ ID NO: 1996135 - RNA, 12 nt, Shigella flexneri 2a str. 301
aucaauauuaag

SEQ ID NO: 1996136 - RNA, 15 nt, Shigella flexneri 2a str. 301
aucaauauuuucaau

SEQ ID NO: 1996137 - RNA, 17 nt, Shigella flexneri 2a str. 301
aucaauauuuucaaucu

SEQ ID NO: 1996138 - RNA, 16 nt, Shigella flexneri 2a str. 301
aucaaucucagcgaug

SEQ ID NO: 1996139 - RNA, 15 nt, Shigella flexneri 2a str. 301
aucaaucucagcaag

SEQ ID NO: 1996140 - RNA, 15 nt, Shigella flexneri 2a str. 301
aucaaucgcaaucug

SEQ ID NO: 1996141 - RNA, 13 nt, Shigella flexneri 2a str. 301
aucaaugccagca

SEQ ID NO: 1996142 - RNA, 18 nt, Shigella flexneri 2a str. 301
aucaaucuuuacacacaa

SEQ ID NO: 1996143 - RNA, 21 nt, Shigella flexneri 2a str. 301
aucaauggaugaacgagcugc

SEQ ID NO: 1996144 - RNA, 18 nt, Shigella flexneri 2a str. 301
aucaauggaugcaaucac

SEQ ID NO: 1996145 - RNA, 19 nt, Shigella flexneri 2a str. 301
aucaauggaugcaaucaca

SEQ ID NO: 1996146 - RNA, 20 nt, Shigella flexneri 2a str. 301
aucaauggaugcaaucacaa

SEQ ID NO: 1996147 - RNA, 16 nt, Shigella flexneri 2a str. 301
aucaauaccauuauca

SEQ ID NO: 1996148 - RNA, 21 nt, Shigella flexneri 2a str. 301
aucaauaaguuacacaucauu

SEQ ID NO: 1996149 - RNA, 14 nt, Shigella flexneri 2a str. 301
aucaauaccagccc

SEQ ID NO: 1996150 - RNA, 22 nt, Shigella flexneri 2a str. 301
aucaauaccgcguaauacauca

SEQ ID NO: 1996151 - RNA, 20 nt, Shigella flexneri 2a str. 301
aucaauacuuuccagcauau

SEQ ID NO: 1996152 - RNA, 20 nt, Shigella flexneri 2a str. 301
aucaagcgccgaguaaaaaa

SEQ ID NO: 1996153 - RNA, 18 nt, Shigella flexneri 2a str. 301
aucaagcaugauauucac

SEQ ID NO: 1996154 - RNA, 18 nt, Shigella flexneri 2a str. 301
aucaagccccagcaggau

SEQ ID NO: 1996155 - RNA, 19 nt, Shigella flexneri 2a str. 301
aucaaggcauauaccacac

SEQ ID NO: 1996156 - RNA, 23 nt, Shigella flexneri 2a str. 301
auauuguuacgguguucacucau

SEQ ID NO: 1996157 - RNA, 13 nt, Shigella flexneri 2a str. 301
auauuuaaauauu

SEQ ID NO: 1996158 - RNA, 14 nt, Shigella flexneri 2a str. 301
auauuuauuuccuu

SEQ ID NO: 1996159 - RNA, 11 nt, Shigella flexneri 2a str. 301
auauuucacau

SEQ ID NO: 1996160 - RNA, 19 nt, Shigella flexneri 2a str. 301
auauuuccccuguugcaaa

SEQ ID NO: 1996161 - RNA, 16 nt, Shigella flexneri 2a str. 301
auauugguguugugaa

SEQ ID NO: 1996162 - RNA, 13 nt, Shigella flexneri 2a str. 301
auauuggucacca

SEQ ID NO: 1996163 - RNA, 12 nt, Shigella flexneri 2a str. 301
auauugguguug

SEQ ID NO: 1996164 - RNA, 17 nt, Shigella flexneri 2a str. 301
auauuuuuaaauauaaa

SEQ ID NO: 1996165 - RNA, 17 nt, Shigella flexneri 2a str. 301
auauuuuguugcauaau

SEQ ID NO: 1996166 - RNA, 23 nt, Shigella flexneri 2a str. 301
auauuuugaaucggcggcggcag

SEQ ID NO: 1996167 - RNA, 18 nt, Shigella flexneri 2a str. 301
auauuugcgauacaggaa

SEQ ID NO: 1996168 - RNA, 16 nt, Shigella flexneri 2a str. 301
auauucaauuugcaau

SEQ ID NO: 1996169 - RNA, 15 nt, Shigella flexneri 2a str. 301
auauucaacaccgau

SEQ ID NO: 1996170 - RNA, 21 nt, Shigella flexneri 2a str. 301
auauucaggcguugaaaaauc

SEQ ID NO: 1996171 - RNA, 13 nt, Shigella flexneri 2a str. 301
auauucagcagca

SEQ ID NO: 1996172 - RNA, 11 nt, Shigella flexneri 2a str. 301
auauucauuuu

SEQ ID NO: 1996173 - RNA, 18 nt, Shigella flexneri 2a str. 301
auauuccgcaccugccag

SEQ ID NO: 1996174 - RNA, 11 nt, Shigella flexneri 2a str. 301
auauuccccag

SEQ ID NO: 1996175 - RNA, 21 nt, Shigella flexneri 2a str. 301
auauugccccacaccgcgacg

SEQ ID NO: 1996176 - RNA, 12 nt, Shigella flexneri 2a str. 301
auauugccaccu

SEQ ID NO: 1996177 - RNA, 21 nt, Shigella flexneri 2a str. 301
auauuggagaguugcaccagc

SEQ ID NO: 1996178 - RNA, 12 nt, Shigella flexneri 2a str. 301
auauugcgcaug

SEQ ID NO: 1996179 - RNA, 20 nt, Shigella flexneri 2a str. 301
auuacaagaaucaugccaaa

SEQ ID NO: 1996180 - RNA, 22 nt, Shigella flexneri 2a str. 301
auuacaacguauuauauauaau

SEQ ID NO: 1996181 - RNA, 17 nt, Shigella flexneri 2a str. 301
auuacacaaauccagca

SEQ ID NO: 1996182 - RNA, 17 nt, Shigella flexneri 2a str. 301
auuacacccuuaaucaa

SEQ ID NO: 1996183 - RNA, 13 nt, Shigella flexneri 2a str. 301
auuacacagccac

SEQ ID NO: 1996184 - RNA, 14 nt, Shigella flexneri 2a str. 301
auuacacagccaca

SEQ ID NO: 1996185 - RNA, 12 nt, Shigella flexneri 2a str. 301
auuaccauuuca

SEQ ID NO: 1996186 - RNA, 18 nt, Shigella flexneri 2a str. 301
auuacagagguuuuauga

SEQ ID NO: 1996187 - RNA, 14 nt, Shigella flexneri 2a str. 301
auuacagcaccuua

SEQ ID NO: 1996188 - RNA, 22 nt, Shigella flexneri 2a str. 301
auuaauugcaacgcccaucaac

SEQ ID NO: 1996189 - RNA, 23 nt, Shigella flexneri 2a str. 301
auuaauugcaacgcccaucaaca

SEQ ID NO: 1996190 - RNA, 14 nt, Shigella flexneri 2a str. 301
auuaauuucauuuu

SEQ ID NO: 1996191 - RNA, 20 nt, Shigella flexneri 2a str. 301
auuaaucgauaaaccagcaa

SEQ ID NO: 1996192 - RNA, 11 nt, Shigella flexneri 2a str. 301
auuaaugacau

SEQ ID NO: 1996193 - RNA, 15 nt, Shigella flexneri 2a str. 301
aaaagccaaugaaau

SEQ ID NO: 1996194 - RNA, 21 nt, Shigella flexneri 2a str. 301
aaaagcacagaaucuaagauc

SEQ ID NO: 1996195 - RNA, 16 nt, Shigella flexneri 2a str. 301
aaaagcacgccagaca

SEQ ID NO: 1996196 - RNA, 17 nt, Shigella flexneri 2a str. 301
auuaaggguaaaaggau

SEQ ID NO: 1996197 - RNA, 24 nt, Shigella flexneri 2a str. 301
auuaaguaaugcggcaagggcgaa

SEQ ID NO: 1996198 - RNA, 18 nt, Shigella flexneri 2a str. 301
auuaacagucagucucaa

SEQ ID NO: 1996199 - RNA, 22 nt, Shigella flexneri 2a str. 301
auuaacagucagucucaaggga

SEQ ID NO: 1996200 - RNA, 23 nt, Shigella flexneri 2a str. 301
auuaacaccuagugcagauaguu

SEQ ID NO: 1996201 - RNA, 14 nt, Shigella flexneri 2a str. 301
auuaacaacgggcu

SEQ ID NO: 1996202 - RNA, 17 nt, Shigella flexneri 2a str. 301
auguuucuucaacacca

SEQ ID NO: 1996203 - RNA, 19 nt, Shigella flexneri 2a str. 301
auuaaacgcaguaagcgcc

SEQ ID NO: 1996204 - RNA, 17 nt, Shigella flexneri 2a str. 301
auuaaaccgcugacccu

SEQ ID NO: 1996205 - RNA, 17 nt, Shigella flexneri 2a str. 301
auuaaacacgggguuaa

SEQ ID NO: 1996206 - RNA, 12 nt, Shigella flexneri 2a str. 301
auuaaauugucu

SEQ ID NO: 1996207 - RNA, 17 nt, Shigella flexneri 2a str. 301
auguucaggauauuuau

SEQ ID NO: 1996208 - RNA, 21 nt, Shigella flexneri 2a str. 301
auguucagaaagcgccagcaa

SEQ ID NO: 1996209 - RNA, 13 nt, Shigella flexneri 2a str. 301
auguucagauaau

SEQ ID NO: 1996210 - RNA, 17 nt, Shigella flexneri 2a str. 301
auguucagauuguugau

SEQ ID NO: 1996211 - RNA, 19 nt, Shigella flexneri 2a str. 301
auguucagauuguugauua

SEQ ID NO: 1996212 - RNA, 20 nt, Shigella flexneri 2a str. 301
auguugcaaaggccagccag

SEQ ID NO: 1996213 - RNA, 15 nt, Shigella flexneri 2a str. 301
auguucaucaagcug

SEQ ID NO: 1996214 - RNA, 21 nt, Shigella flexneri 2a str. 301
auguucacugccguacagaca

SEQ ID NO: 1996215 - RNA, 11 nt, Shigella flexneri 2a str. 301
auguucacugc

SEQ ID NO: 1996216 - RNA, 17 nt, Shigella flexneri 2a str. 301
auguucaauaaaagcau

SEQ ID NO: 1996217 - RNA, 16 nt, Shigella flexneri 2a str. 301
auguuauuuggugaau

SEQ ID NO: 1996218 - RNA, 14 nt, Shigella flexneri 2a str. 301
auguccuuucaggg

SEQ ID NO: 1996219 - RNA, 22 nt, Shigella flexneri 2a str. 301
auguccugcauccgcuuaaucu

SEQ ID NO: 1996220 - RNA, 15 nt, Shigella flexneri 2a str. 301
auguccggaaauuug

SEQ ID NO: 1996221 - RNA, 23 nt, Shigella flexneri 2a str. 301
auguugcgcagaguuuccaggcu

SEQ ID NO: 1996222 - RNA, 17 nt, Shigella flexneri 2a str. 301
auguugcgccucaagaa

SEQ ID NO: 1996223 - RNA, 20 nt, Shigella flexneri 2a str. 301
auguugucucagcuucagau

SEQ ID NO: 1996224 - RNA, 14 nt, Shigella flexneri 2a str. 301
auguuguuccuuuu

SEQ ID NO: 1996225 - RNA, 18 nt, Shigella flexneri 2a str. 301
auguuuaguauuguuaaa

SEQ ID NO: 1996226 - RNA, 15 nt, Shigella flexneri 2a str. 301
auguuuaugccuggu

SEQ ID NO: 1996227 - RNA, 16 nt, Shigella flexneri 2a str. 301
auguuguugucuauuu

SEQ ID NO: 1996228 - RNA, 22 nt, Shigella flexneri 2a str. 301
aaaagcugcaaggugaaagcaa

SEQ ID NO: 1996229 - RNA, 19 nt, Shigella flexneri 2a str. 301
auuagggcggacaaccagc

SEQ ID NO: 1996230 - RNA, 13 nt, Shigella flexneri 2a str. 301
auuacgcuguuca

SEQ ID NO: 1996231 - RNA, 18 nt, Shigella flexneri 2a str. 301
auuacgcuguucaucccg

SEQ ID NO: 1996232 - RNA, 17 nt, Shigella flexneri 2a str. 301
auuacgacucaacccca

SEQ ID NO: 1996233 - RNA, 16 nt, Shigella flexneri 2a str. 301
auuacccauauccaga

SEQ ID NO: 1996234 - RNA, 14 nt, Shigella flexneri 2a str. 301
auuaccuuuuuucc

SEQ ID NO: 1996235 - RNA, 19 nt, Shigella flexneri 2a str. 301
auuagccugaauauccaga

SEQ ID NO: 1996236 - RNA, 20 nt, Shigella flexneri 2a str. 301
auuagcgaccgaacagauca

SEQ ID NO: 1996237 - RNA, 22 nt, Shigella flexneri 2a str. 301
auuagcgcuaucaaagggcacc

SEQ ID NO: 1996238 - RNA, 22 nt, Shigella flexneri 2a str. 301
auuagcuucgccgaggauuuac

SEQ ID NO: 1996239 - RNA, 22 nt, Shigella flexneri 2a str. 301
auuauccaucaaagguuuuuca

SEQ ID NO: 1996240 - RNA, 13 nt, Shigella flexneri 2a str. 301
auuaucauuuuac

SEQ ID NO: 1996241 - RNA, 20 nt, Shigella flexneri 2a str. 301
auuaucuggcaagccugaaa

SEQ ID NO: 1996242 - RNA, 16 nt, Shigella flexneri 2a str. 301
auuaucuggcaagccu

SEQ ID NO: 1996243 - RNA, 11 nt, Shigella flexneri 2a str. 301
auuaucuggau

SEQ ID NO: 1996244 - RNA, 16 nt, Shigella flexneri 2a str. 301
auuaucugcaauuacu

SEQ ID NO: 1996245 - RNA, 12 nt, Shigella flexneri 2a str. 301
auuauuauaaua

SEQ ID NO: 1996246 - RNA, 17 nt, Shigella flexneri 2a str. 301
auuauucauaaugccca

SEQ ID NO: 1996247 - RNA, 17 nt, Shigella flexneri 2a str. 301
auuauuccauccugcuc

SEQ ID NO: 1996248 - RNA, 16 nt, Shigella flexneri 2a str. 301
auuaugaaacaagaag

SEQ ID NO: 1996249 - RNA, 12 nt, Shigella flexneri 2a str. 301
auuaucuucacc

SEQ ID NO: 1996250 - RNA, 20 nt, Shigella flexneri 2a str. 301
auuaucuucaccguucguga

SEQ ID NO: 1996251 - RNA, 15 nt, Shigella flexneri 2a str. 301
auuaugaucaaaauc

SEQ ID NO: 1996252 - RNA, 22 nt, Shigella flexneri 2a str. 301
auucacaucauccggcaccuuu

SEQ ID NO: 1996253 - RNA, 14 nt, Shigella flexneri 2a str. 301
auucaccagcaaau

SEQ ID NO: 1996254 - RNA, 18 nt, Shigella flexneri 2a str. 301
auucaccagaccugaaac

SEQ ID NO: 1996255 - RNA, 16 nt, Shigella flexneri 2a str. 301
auucacaauucaucau

SEQ ID NO: 1996256 - RNA, 15 nt, Shigella flexneri 2a str. 301
auucaauuaauaaca

SEQ ID NO: 1996257 - RNA, 17 nt, Shigella flexneri 2a str. 301
aaaaggcgcuaaaaaua

SEQ ID NO: 1996258 - RNA, 16 nt, Shigella flexneri 2a str. 301
aaaaggcguucacgcc

SEQ ID NO: 1996259 - RNA, 17 nt, Shigella flexneri 2a str. 301
auucaauuaauaacaca

SEQ ID NO: 1996260 - RNA, 16 nt, Shigella flexneri 2a str. 301
auucaauuauaguauc

SEQ ID NO: 1996261 - RNA, 13 nt, Shigella flexneri 2a str. 301
auuauugagcgca

SEQ ID NO: 1996262 - RNA, 20 nt, Shigella flexneri 2a str. 301
auuauugagcgcaaauugcu

SEQ ID NO: 1996263 - RNA, 22 nt, Shigella flexneri 2a str. 301
auucaaaguguugcaggaaaag

SEQ ID NO: 1996264 - RNA, 21 nt, Shigella flexneri 2a str. 301
auucaauauauugcugaaaua

SEQ ID NO: 1996265 - RNA, 12 nt, Shigella flexneri 2a str. 301
auucaacaguag

SEQ ID NO: 1996266 - RNA, 17 nt, Shigella flexneri 2a str. 301
auucagugcaaaugcca

SEQ ID NO: 1996267 - RNA, 22 nt, Shigella flexneri 2a str. 301
auucagugcaaaugccagauaa

SEQ ID NO: 1996268 - RNA, 18 nt, Shigella flexneri 2a str. 301
auucaggccguagagcac

SEQ ID NO: 1996269 - RNA, 14 nt, Shigella flexneri 2a str. 301
auucaggcgcagca

SEQ ID NO: 1996270 - RNA, 20 nt, Shigella flexneri 2a str. 301
auucagcgucgcgguugcug

SEQ ID NO: 1996271 - RNA, 20 nt, Shigella flexneri 2a str. 301
auucaggaaacggagaucga

SEQ ID NO: 1996272 - RNA, 14 nt, Shigella flexneri 2a str. 301
auucagcccggcaa

SEQ ID NO: 1996273 - RNA, 22 nt, Shigella flexneri 2a str. 301
auucagcgaguuuuucagucca

SEQ ID NO: 1996274 - RNA, 13 nt, Shigella flexneri 2a str. 301
auucagauuaugu

SEQ ID NO: 1996275 - RNA, 23 nt, Shigella flexneri 2a str. 301
auucagauugcagacaaagugag

SEQ ID NO: 1996276 - RNA, 20 nt, Shigella flexneri 2a str. 301
auucagcccgagguuauuuu

SEQ ID NO: 1996277 - RNA, 11 nt, Shigella flexneri 2a str. 301
auucagcagca

SEQ ID NO: 1996278 - RNA, 18 nt, Shigella flexneri 2a str. 301
auucagcagcagacagcc

SEQ ID NO: 1996279 - RNA, 22 nt, Shigella flexneri 2a str. 301
auucacgaaucuauucauuuau

SEQ ID NO: 1996280 - RNA, 19 nt, Shigella flexneri 2a str. 301
auucacgaauauuucccgg

SEQ ID NO: 1996281 - RNA, 14 nt, Shigella flexneri 2a str. 301
auucaccaguuuac

SEQ ID NO: 1996282 - RNA, 20 nt, Shigella flexneri 2a str. 301
auucacgagguuuuuucgga

SEQ ID NO: 1996283 - RNA, 21 nt, Shigella flexneri 2a str. 301
auucaccguaauaguuucuga

SEQ ID NO: 1996284 - RNA, 19 nt, Shigella flexneri 2a str. 301
auucaccgcaucaauauua

SEQ ID NO: 1996285 - RNA, 16 nt, Shigella flexneri 2a str. 301
auucaccucugcggca

SEQ ID NO: 1996286 - RNA, 11 nt, Shigella flexneri 2a str. 301
auucaccucug

SEQ ID NO: 1996287 - RNA, 23 nt, Shigella flexneri 2a str. 301
auucacgccgcauccggcaucaa

SEQ ID NO: 1996288 - RNA, 21 nt, Shigella flexneri 2a str. 301
auucagacacgccgccagacc

SEQ ID NO: 1996289 - RNA, 17 nt, Shigella flexneri 2a str. 301
auucacuuucugaagga

SEQ ID NO: 1996290 - RNA, 13 nt, Shigella flexneri 2a str. 301
auucagaaaguaa

SEQ ID NO: 1996291 - RNA, 17 nt, Shigella flexneri 2a str. 301
auucacuugaaguacga

SEQ ID NO: 1996292 - RNA, 21 nt, Shigella flexneri 2a str. 301
auucagagggcaaauucuuca

SEQ ID NO: 1996293 - RNA, 17 nt, Shigella flexneri 2a str. 301
auucagaucgguuuuuu

SEQ ID NO: 1996294 - RNA, 12 nt, Shigella flexneri 2a str. 301
auucagaucuuu

SEQ ID NO: 1996295 - RNA, 16 nt, Shigella flexneri 2a str. 301
auucagaccauuccuc

SEQ ID NO: 1996296 - RNA, 15 nt, Shigella flexneri 2a str. 301
auggccagccagcag

SEQ ID NO: 1996297 - RNA, 13 nt, Shigella flexneri 2a str. 301
auggcauccuguu

SEQ ID NO: 1996298 - RNA, 23 nt, Shigella flexneri 2a str. 301
auggcauccuguuuucuggaugc

SEQ ID NO: 1996299 - RNA, 15 nt, Shigella flexneri 2a str. 301
auggcauuaauaugc

SEQ ID NO: 1996300 - RNA, 12 nt, Shigella flexneri 2a str. 301
auggcgauacuc

SEQ ID NO: 1996301 - RNA, 20 nt, Shigella flexneri 2a str. 301
auggcgauuucacaagacug

SEQ ID NO: 1996302 - RNA, 19 nt, Shigella flexneri 2a str. 301
auggcgagaagagaggcgu

SEQ ID NO: 1996303 - RNA, 14 nt, Shigella flexneri 2a str. 301
auggcgacaaggcg

SEQ ID NO: 1996304 - RNA, 20 nt, Shigella flexneri 2a str. 301
auggcgcgccaccucuuuca

SEQ ID NO: 1996305 - RNA, 14 nt, Shigella flexneri 2a str. 301
auggcgcgccaccu

SEQ ID NO: 1996306 - RNA, 17 nt, Shigella flexneri 2a str. 301
auggcgcccaucggcgc

SEQ ID NO: 1996307 - RNA, 22 nt, Shigella flexneri 2a str. 301
auggcgcaauccggugauguuu

SEQ ID NO: 1996308 - RNA, 12 nt, Shigella flexneri 2a str. 301
auggcacaaugg

SEQ ID NO: 1996309 - RNA, 19 nt, Shigella flexneri 2a str. 301
augcuguauucuucagcga

SEQ ID NO: 1996310 - RNA, 17 nt, Shigella flexneri 2a str. 301
augcuguaaccagcgca

SEQ ID NO: 1996311 - RNA, 13 nt, Shigella flexneri 2a str. 301
auggauugcugaa

SEQ ID NO: 1996312 - RNA, 16 nt, Shigella flexneri 2a str. 301
auggauugcugaaaua

SEQ ID NO: 1996313 - RNA, 21 nt, Shigella flexneri 2a str. 301
auggauuugaaacgaaaucuu

SEQ ID NO: 1996314 - RNA, 19 nt, Shigella flexneri 2a str. 301
augcugacgcaucuucucc

SEQ ID NO: 1996315 - RNA, 21 nt, Shigella flexneri 2a str. 301
augcugcuuuaucagaucacg

SEQ ID NO: 1996316 - RNA, 22 nt, Shigella flexneri 2a str. 301
augcugcuuuaucagaucacgc

SEQ ID NO: 1996317 - RNA, 16 nt, Shigella flexneri 2a str. 301
augcugguuucggcgu

SEQ ID NO: 1996318 - RNA, 14 nt, Shigella flexneri 2a str. 301
augcugguuuugug

SEQ ID NO: 1996319 - RNA, 14 nt, Shigella flexneri 2a str. 301
augcuguaaacaac

SEQ ID NO: 1996320 - RNA, 17 nt, Shigella flexneri 2a str. 301
augcuggcugcgcucug

SEQ ID NO: 1996321 - RNA, 18 nt, Shigella flexneri 2a str. 301
augcuggccuuuuuggca

SEQ ID NO: 1996322 - RNA, 19 nt, Shigella flexneri 2a str. 301
auggcggaucacgcuguuu

SEQ ID NO: 1996323 - RNA, 18 nt, Shigella flexneri 2a str. 301
auggcgcgcggcaggaag

SEQ ID NO: 1996324 - RNA, 16 nt, Shigella flexneri 2a str. 301
auggcgggauguguaa

SEQ ID NO: 1996325 - RNA, 15 nt, Shigella flexneri 2a str. 301
auggcuucuuccccg

SEQ ID NO: 1996326 - RNA, 16 nt, Shigella flexneri 2a str. 301
auggcuucaucccagu

SEQ ID NO: 1996327 - RNA, 18 nt, Shigella flexneri 2a str. 301
augggaaaugacauucac

SEQ ID NO: 1996328 - RNA, 19 nt, Shigella flexneri 2a str. 301
auggcuuuagggcuggcuu

SEQ ID NO: 1996329 - RNA, 14 nt, Shigella flexneri 2a str. 301
auggcuuugcccuu

SEQ ID NO: 1996330 - RNA, 13 nt, Shigella flexneri 2a str. 301
auggguaugugac

SEQ ID NO: 1996331 - RNA, 18 nt, Shigella flexneri 2a str. 301
augguauuguccugcaag

SEQ ID NO: 1996332 - RNA, 17 nt, Shigella flexneri 2a str. 301
auggguuaacaucaugu

SEQ ID NO: 1996333 - RNA, 17 nt, Shigella flexneri 2a str. 301
auggucaacauucccug

SEQ ID NO: 1996334 - RNA, 22 nt, Shigella flexneri 2a str. 301
auggucaaugauuucugccagc

SEQ ID NO: 1996335 - RNA, 22 nt, Shigella flexneri 2a str. 301
augggauaucgauguccugacg

SEQ ID NO: 1996336 - RNA, 15 nt, Shigella flexneri 2a str. 301
augggcauuucugcg

SEQ ID NO: 1996337 - RNA, 13 nt, Shigella flexneri 2a str. 301
auguaaaaauacu

SEQ ID NO: 1996338 - RNA, 19 nt, Shigella flexneri 2a str. 301
auguaaaaggcgcuaaaaa

SEQ ID NO: 1996339 - RNA, 21 nt, Shigella flexneri 2a str. 301
auguaaaaggcgcuaaaaaua

SEQ ID NO: 1996340 - RNA, 12 nt, Shigella flexneri 2a str. 301
auguaaaaauac

SEQ ID NO: 1996341 - RNA, 11 nt, Shigella flexneri 2a str. 301
augguuuucaa

SEQ ID NO: 1996342 - RNA, 21 nt, Shigella flexneri 2a str. 301
auggucagguauuuugucagc

SEQ ID NO: 1996343 - RNA, 22 nt, Shigella flexneri 2a str. 301
auggucgcaucauuuaaaaaga

SEQ ID NO: 1996344 - RNA, 17 nt, Shigella flexneri 2a str. 301
auggucauuccagucug

SEQ ID NO: 1996345 - RNA, 16 nt, Shigella flexneri 2a str. 301
auggucuguaccacca

SEQ ID NO: 1996346 - RNA, 14 nt, Shigella flexneri 2a str. 301
auguagcgcugcaa

SEQ ID NO: 1996347 - RNA, 19 nt, Shigella flexneri 2a str. 301
auguacucguaauauugcg

SEQ ID NO: 1996348 - RNA, 20 nt, Shigella flexneri 2a str. 301
auguaaucuguugaaauaau

SEQ ID NO: 1996349 - RNA, 18 nt, Shigella flexneri 2a str. 301
auguaagcagaaaagcca

SEQ ID NO: 1996350 - RNA, 13 nt, Shigella flexneri 2a str. 301
auguaugaaguac

SEQ ID NO: 1996351 - RNA, 16 nt, Shigella flexneri 2a str. 301
aaaagauuaaaaaaac

SEQ ID NO: 1996352 - RNA, 15 nt, Shigella flexneri 2a str. 301
aaaagauuaaaaaaa

SEQ ID NO: 1996353 - RNA, 18 nt, Shigella flexneri 2a str. 301
aaaagauggauugcugaa

SEQ ID NO: 1996354 - RNA, 13 nt, Shigella flexneri 2a str. 301
auguauaucggcc

SEQ ID NO: 1996355 - RNA, 16 nt, Shigella flexneri 2a str. 301
auguagucaucugcac

SEQ ID NO: 1996356 - RNA, 16 nt, Shigella flexneri 2a str. 301
aaaagaugagaaaaau

SEQ ID NO: 1996357 - RNA, 20 nt, Shigella flexneri 2a str. 301
augucauaagcaucccuuua

SEQ ID NO: 1996358 - RNA, 15 nt, Shigella flexneri 2a str. 301
augucagcaaucacc

SEQ ID NO: 1996359 - RNA, 19 nt, Shigella flexneri 2a str. 301
auguauggcgauagcccag

SEQ ID NO: 1996360 - RNA, 18 nt, Shigella flexneri 2a str. 301
augucacccacuguggua

SEQ ID NO: 1996361 - RNA, 14 nt, Shigella flexneri 2a str. 301
augucacagccgca

SEQ ID NO: 1996362 - RNA, 17 nt, Shigella flexneri 2a str. 301
augcgguuaaaccgaaa

SEQ ID NO: 1996363 - RNA, 21 nt, Shigella flexneri 2a str. 301
augcgguuaaaccgaaagugu

SEQ ID NO: 1996364 - RNA, 12 nt, Shigella flexneri 2a str. 301
augcggcgagga

SEQ ID NO: 1996365 - RNA, 17 nt, Shigella flexneri 2a str. 301
augcggcguaaaugccu

SEQ ID NO: 1996366 - RNA, 18 nt, Shigella flexneri 2a str. 301
augcgggucaggccagga

SEQ ID NO: 1996367 - RNA, 16 nt, Shigella flexneri 2a str. 301
augcgauggagugaga

SEQ ID NO: 1996368 - RNA, 18 nt, Shigella flexneri 2a str. 301
augcgcaaccguaaacga

SEQ ID NO: 1996369 - RNA, 17 nt, Shigella flexneri 2a str. 301
augcgaugcauccggca

SEQ ID NO: 1996370 - RNA, 24 nt, Shigella flexneri 2a str. 301
augccguuguucuacgugagagau

SEQ ID NO: 1996371 - RNA, 20 nt, Shigella flexneri 2a str. 301
augcgcuuuaucgccgcugg

SEQ ID NO: 1996372 - RNA, 22 nt, Shigella flexneri 2a str. 301
augcgcugaguguaacgcuugc

SEQ ID NO: 1996373 - RNA, 21 nt, Shigella flexneri 2a str. 301
augcgcucuguugguaaaugc

SEQ ID NO: 1996374 - RNA, 20 nt, Shigella flexneri 2a str. 301
augcgcaucaaagccaggca

SEQ ID NO: 1996375 - RNA, 18 nt, Shigella flexneri 2a str. 301
augcgcuaaauguuuagu

SEQ ID NO: 1996376 - RNA, 21 nt, Shigella flexneri 2a str. 301
augcguuuuccggcacgcagg

SEQ ID NO: 1996377 - RNA, 16 nt, Shigella flexneri 2a str. 301
augcguuucagccacg

SEQ ID NO: 1996378 - RNA, 18 nt, Shigella flexneri 2a str. 301
augcguuucagccacgcg

SEQ ID NO: 1996379 - RNA, 14 nt, Shigella flexneri 2a str. 301
augcuacaacaucg

SEQ ID NO: 1996380 - RNA, 13 nt, Shigella flexneri 2a str. 301
aaaagagcgugga

SEQ ID NO: 1996381 - RNA, 22 nt, Shigella flexneri 2a str. 301
augcucacaaccccggcaaaug

SEQ ID NO: 1996382 - RNA, 17 nt, Shigella flexneri 2a str. 301
augcucaacuacuccaa

SEQ ID NO: 1996383 - RNA, 15 nt, Shigella flexneri 2a str. 301
augcucaacaaaccg

SEQ ID NO: 1996384 - RNA, 21 nt, Shigella flexneri 2a str. 301
augcuauuggucggaucauuc

SEQ ID NO: 1996385 - RNA, 17 nt, Shigella flexneri 2a str. 301
augcucuuuucugaagu

SEQ ID NO: 1996386 - RNA, 20 nt, Shigella flexneri 2a str. 301
augcugaaaagaguaguaau

SEQ ID NO: 1996387 - RNA, 20 nt, Shigella flexneri 2a str. 301
augcugaaauuacgcggugc

SEQ ID NO: 1996388 - RNA, 16 nt, Shigella flexneri 2a str. 301
augcugaaucgccaaa

SEQ ID NO: 1996389 - RNA, 18 nt, Shigella flexneri 2a str. 301
augcugaaucgccaaaaa

SEQ ID NO: 1996390 - RNA, 22 nt, Shigella flexneri 2a str. 301
augcugaaucgccaaaaacaua

SEQ ID NO: 1996391 - RNA, 21 nt, Shigella flexneri 2a str. 301
augcucauucuuccuccagcg

SEQ ID NO: 1996392 - RNA, 18 nt, Shigella flexneri 2a str. 301
augcagcuccaccgauuu

SEQ ID NO: 1996393 - RNA, 21 nt, Shigella flexneri 2a str. 301
augcagaaaccaaagcgguug

SEQ ID NO: 1996394 - RNA, 20 nt, Shigella flexneri 2a str. 301
augcacucgcauccucuuua

SEQ ID NO: 1996395 - RNA, 19 nt, Shigella flexneri 2a str. 301
augcagggcaaacucugag

SEQ ID NO: 1996396 - RNA, 20 nt, Shigella flexneri 2a str. 301
augcaggcggugcaauucca

SEQ ID NO: 1996397 - RNA, 14 nt, Shigella flexneri 2a str. 301
augcaggccaccag

SEQ ID NO: 1996398 - RNA, 14 nt, Shigella flexneri 2a str. 301
augcaggaucgcuc

SEQ ID NO: 1996399 - RNA, 21 nt, Shigella flexneri 2a str. 301
augaucgccaucagugccagu

SEQ ID NO: 1996400 - RNA, 23 nt, Shigella flexneri 2a str. 301
augaucgccaucagugccaguac

SEQ ID NO: 1996401 - RNA, 17 nt, Shigella flexneri 2a str. 301
augaucgcgcugauugc

SEQ ID NO: 1996402 - RNA, 22 nt, Shigella flexneri 2a str. 301
augcaccuggggcuugccagag

SEQ ID NO: 1996403 - RNA, 20 nt, Shigella flexneri 2a str. 301
augcacgcaagaacgcauac

SEQ ID NO: 1996404 - RNA, 18 nt, Shigella flexneri 2a str. 301
augcaucaugaaaaccgu

SEQ ID NO: 1996405 - RNA, 11 nt, Shigella flexneri 2a str. 301
augcaucagug

SEQ ID NO: 1996406 - RNA, 12 nt, Shigella flexneri 2a str. 301
augcaucccgcc

SEQ ID NO: 1996407 - RNA, 16 nt, Shigella flexneri 2a str. 301
augcauauccaggcua

SEQ ID NO: 1996408 - RNA, 16 nt, Shigella flexneri 2a str. 301
augcauuguuugcaaa

SEQ ID NO: 1996409 - RNA, 22 nt, Shigella flexneri 2a str. 301
augcauuguuugcaaaaucaaa

SEQ ID NO: 1996410 - RNA, 15 nt, Shigella flexneri 2a str. 301
augcauaaaaaaacg

SEQ ID NO: 1996411 - RNA, 21 nt, Shigella flexneri 2a str. 301
augcauaacagauaaaucaua

SEQ ID NO: 1996412 - RNA, 13 nt, Shigella flexneri 2a str. 301
augcauaaaaaaa

SEQ ID NO: 1996413 - RNA, 18 nt, Shigella flexneri 2a str. 301
augcaguuuuuaauuuuc

SEQ ID NO: 1996414 - RNA, 20 nt, Shigella flexneri 2a str. 301
augcagugcauccagcagcc

SEQ ID NO: 1996415 - RNA, 14 nt, Shigella flexneri 2a str. 301
augcaguaccagau

SEQ ID NO: 1996416 - RNA, 17 nt, Shigella flexneri 2a str. 301
augcagguuaccgguuu

SEQ ID NO: 1996417 - RNA, 22 nt, Shigella flexneri 2a str. 301
augccagaaagcguauccauca

SEQ ID NO: 1996418 - RNA, 18 nt, Shigella flexneri 2a str. 301
augccacugucaacugcu

SEQ ID NO: 1996419 - RNA, 15 nt, Shigella flexneri 2a str. 301
augccagauaagaca

SEQ ID NO: 1996420 - RNA, 21 nt, Shigella flexneri 2a str. 301
augccaaaaauaaucuauuga

SEQ ID NO: 1996421 - RNA, 14 nt, Shigella flexneri 2a str. 301
augccagcuuucac

SEQ ID NO: 1996422 - RNA, 17 nt, Shigella flexneri 2a str. 301
augccaggccaguucuu

SEQ ID NO: 1996423 - RNA, 14 nt, Shigella flexneri 2a str. 301
augccagcgaagaa

SEQ ID NO: 1996424 - RNA, 15 nt, Shigella flexneri 2a str. 301
augcccaucacuauc

SEQ ID NO: 1996425 - RNA, 19 nt, Shigella flexneri 2a str. 301
augcccgccgugcugccag

SEQ ID NO: 1996426 - RNA, 21 nt, Shigella flexneri 2a str. 301
augcccccucacaugaguugc

SEQ ID NO: 1996427 - RNA, 14 nt, Shigella flexneri 2a str. 301
augccggaaucaga

SEQ ID NO: 1996428 - RNA, 16 nt, Shigella flexneri 2a str. 301
augcccgguauuugcc

SEQ ID NO: 1996429 - RNA, 22 nt, Shigella flexneri 2a str. 301
augcccgguauuugccgggcau

SEQ ID NO: 1996430 - RNA, 15 nt, Shigella flexneri 2a str. 301
augcccugcggcugg

SEQ ID NO: 1996431 - RNA, 16 nt, Shigella flexneri 2a str. 301
augccgguuaauacgc

SEQ ID NO: 1996432 - RNA, 21 nt, Shigella flexneri 2a str. 301
augccgucaccagcaucaaca

SEQ ID NO: 1996433 - RNA, 15 nt, Shigella flexneri 2a str. 301
augccguaaaaguac

SEQ ID NO: 1996434 - RNA, 20 nt, Shigella flexneri 2a str. 301
augccggccagcgccaccac

SEQ ID NO: 1996435 - RNA, 15 nt, Shigella flexneri 2a str. 301
auuuagcaaauuuuu

SEQ ID NO: 1996436 - RNA, 23 nt, Shigella flexneri 2a str. 301
auuuagcugucccaagugauuuu

SEQ ID NO: 1996437 - RNA, 21 nt, Shigella flexneri 2a str. 301
auuuacucucaucaauaccug

SEQ ID NO: 1996438 - RNA, 14 nt, Shigella flexneri 2a str. 301
auuuacuucugcug

SEQ ID NO: 1996439 - RNA, 23 nt, Shigella flexneri 2a str. 301
auuuacgcugucuuuugaucaaa

SEQ ID NO: 1996440 - RNA, 20 nt, Shigella flexneri 2a str. 301
auuuacgccgcauccggcaa

SEQ ID NO: 1996441 - RNA, 15 nt, Shigella flexneri 2a str. 301
auuuacuauuauuuu

SEQ ID NO: 1996442 - RNA, 18 nt, Shigella flexneri 2a str. 301
auuuacuauuauuuuuca

SEQ ID NO: 1996443 - RNA, 13 nt, Shigella flexneri 2a str. 301
auuuacuacguaa

SEQ ID NO: 1996444 - RNA, 14 nt, Shigella flexneri 2a str. 301
auuuacacuucauc

SEQ ID NO: 1996445 - RNA, 22 nt, Shigella flexneri 2a str. 301
auuuacagccugccagcaugca

SEQ ID NO: 1996446 - RNA, 21 nt, Shigella flexneri 2a str. 301
auuuacacuucauccuucaca

SEQ ID NO: 1996447 - RNA, 20 nt, Shigella flexneri 2a str. 301
auuuacagucugcucccuuu

SEQ ID NO: 1996448 - RNA, 17 nt, Shigella flexneri 2a str. 301
auuuacacaauuuugua

SEQ ID NO: 1996449 - RNA, 16 nt, Shigella flexneri 2a str. 301
auuuacaauaaccauu

SEQ ID NO: 1996450 - RNA, 22 nt, Shigella flexneri 2a str. 301
auuuacaagcguuuacccaaac

SEQ ID NO: 1996451 - RNA, 15 nt, Shigella flexneri 2a str. 301
auuuacaaaucuuua

SEQ ID NO: 1996452 - RNA, 14 nt, Shigella flexneri 2a str. 301
auuguuugucauga

SEQ ID NO: 1996453 - RNA, 18 nt, Shigella flexneri 2a str. 301
auuguuugucaugacgac

SEQ ID NO: 1996454 - RNA, 12 nt, Shigella flexneri 2a str. 301
auuuaaaaagaa

SEQ ID NO: 1996455 - RNA, 16 nt, Shigella flexneri 2a str. 301
auuuaagguguugcgu

SEQ ID NO: 1996456 - RNA, 18 nt, Shigella flexneri 2a str. 301
auuuaagguuaugcaagu

SEQ ID NO: 1996457 - RNA, 22 nt, Shigella flexneri 2a str. 301
auuuaacucaccgaugaucgcc

SEQ ID NO: 1996458 - RNA, 14 nt, Shigella flexneri 2a str. 301
auuuaaucaguucu

SEQ ID NO: 1996459 - RNA, 22 nt, Shigella flexneri 2a str. 301
auuggagaguugcaccagcaac

SEQ ID NO: 1996460 - RNA, 16 nt, Shigella flexneri 2a str. 301
auuggaguaucaccau

SEQ ID NO: 1996461 - RNA, 19 nt, Shigella flexneri 2a str. 301
auuggcacgccgacaucuu

SEQ ID NO: 1996462 - RNA, 19 nt, Shigella flexneri 2a str. 301
auuggcagagcgaucaacc

SEQ ID NO: 1996463 - RNA, 15 nt, Shigella flexneri 2a str. 301
auugggguuacgacc

SEQ ID NO: 1996464 - RNA, 16 nt, Shigella flexneri 2a str. 301
auuggcauaaauaaua

SEQ ID NO: 1996465 - RNA, 15 nt, Shigella flexneri 2a str. 301
auugguagacgcacc

SEQ ID NO: 1996466 - RNA, 14 nt, Shigella flexneri 2a str. 301
auugguaaugacuc

SEQ ID NO: 1996467 - RNA, 17 nt, Shigella flexneri 2a str. 301
auugguaaacucaaagu

SEQ ID NO: 1996468 - RNA, 15 nt, Shigella flexneri 2a str. 301
auugguccaucuuuu

SEQ ID NO: 1996469 - RNA, 14 nt, Shigella flexneri 2a str. 301
aaaaggucacuccc

SEQ ID NO: 1996470 - RNA, 14 nt, Shigella flexneri 2a str. 301
auuggucuggaacu

SEQ ID NO: 1996471 - RNA, 21 nt, Shigella flexneri 2a str. 301
auugguaguguguuugaucac

SEQ ID NO: 1996472 - RNA, 17 nt, Shigella flexneri 2a str. 301
aaaagguugccugucuu

SEQ ID NO: 1996473 - RNA, 17 nt, Shigella flexneri 2a str. 301
aaaaggugcucaaugag

SEQ ID NO: 1996474 - RNA, 12 nt, Shigella flexneri 2a str. 301
auugcuccaucc

SEQ ID NO: 1996475 - RNA, 13 nt, Shigella flexneri 2a str. 301
auugcuccaucca

SEQ ID NO: 1996476 - RNA, 21 nt, Shigella flexneri 2a str. 301
auugcgccagccuuucaauac

SEQ ID NO: 1996477 - RNA, 14 nt, Shigella flexneri 2a str. 301
auugcgccugcagg

SEQ ID NO: 1996478 - RNA, 18 nt, Shigella flexneri 2a str. 301
auugcgcgacuuuuuccu

SEQ ID NO: 1996479 - RNA, 19 nt, Shigella flexneri 2a str. 301
auugcgcuggcaccgcaga

SEQ ID NO: 1996480 - RNA, 19 nt, Shigella flexneri 2a str. 301
auugcgcuaaaaaguuccu

SEQ ID NO: 1996481 - RNA, 22 nt, Shigella flexneri 2a str. 301
auugcgcuaaaaaguuccugua

SEQ ID NO: 1996482 - RNA, 13 nt, Shigella flexneri 2a str. 301
auugcuucugcuu

SEQ ID NO: 1996483 - RNA, 16 nt, Shigella flexneri 2a str. 301
auugcugaaauacaga

SEQ ID NO: 1996484 - RNA, 15 nt, Shigella flexneri 2a str. 301
auugcugaaauacag

SEQ ID NO: 1996485 - RNA, 21 nt, Shigella flexneri 2a str. 301
auugcuuugguaaauggcuga

SEQ ID NO: 1996486 - RNA, 14 nt, Shigella flexneri 2a str. 301
auugauuaaaggaa

SEQ ID NO: 1996487 - RNA, 17 nt, Shigella flexneri 2a str. 301
auugauuaaaggaaggu

SEQ ID NO: 1996488 - RNA, 22 nt, Shigella flexneri 2a str. 301
auugauaaccguacgcaucacc

SEQ ID NO: 1996489 - RNA, 18 nt, Shigella flexneri 2a str. 301
auugcgcagagaugccca

SEQ ID NO: 1996490 - RNA, 19 nt, Shigella flexneri 2a str. 301
auugcgcagagaugcccau

SEQ ID NO: 1996491 - RNA, 22 nt, Shigella flexneri 2a str. 301
auugcgcaggcgcgcguaaauu

SEQ ID NO: 1996492 - RNA, 15 nt, Shigella flexneri 2a str. 301
auugcgcaaauguuu

SEQ ID NO: 1996493 - RNA, 14 nt, Shigella flexneri 2a str. 301
auugcgccagcaca

SEQ ID NO: 1996494 - RNA, 13 nt, Shigella flexneri 2a str. 301
auugauuuucuug

SEQ ID NO: 1996495 - RNA, 15 nt, Shigella flexneri 2a str. 301
auugauucaucaagc

SEQ ID NO: 1996496 - RNA, 20 nt, Shigella flexneri 2a str. 301
auugacaguuuauuuucugc

SEQ ID NO: 1996497 - RNA, 22 nt, Shigella flexneri 2a str. 301
auugacaaagugcgcuuuguuu

SEQ ID NO: 1996498 - RNA, 14 nt, Shigella flexneri 2a str. 301
auugacggaauauu

SEQ ID NO: 1996499 - RNA, 19 nt, Shigella flexneri 2a str. 301
auugacgccaaaauaacuu

SEQ ID NO: 1996500 - RNA, 15 nt, Shigella flexneri 2a str. 301
auugacguuccuuuc

SEQ ID NO: 1996501 - RNA, 17 nt, Shigella flexneri 2a str. 301
auugacguuccuuucuu

SEQ ID NO: 1996502 - RNA, 20 nt, Shigella flexneri 2a str. 301
auugaagauguugccacacg

SEQ ID NO: 1996503 - RNA, 18 nt, Shigella flexneri 2a str. 301
auugaaugcggcaggcac

SEQ ID NO: 1996504 - RNA, 19 nt, Shigella flexneri 2a str. 301
auugaaugucugucugaca

SEQ ID NO: 1996505 - RNA, 14 nt, Shigella flexneri 2a str. 301
auugaauuuuaugu

SEQ ID NO: 1996506 - RNA, 15 nt, Shigella flexneri 2a str. 301
auugagaaccacaau

SEQ ID NO: 1996507 - RNA, 23 nt, Shigella flexneri 2a str. 301
auugagaaccacaaugaagaaag

SEQ ID NO: 1996508 - RNA, 20 nt, Shigella flexneri 2a str. 301
auugagaucgcuuaacagaa

SEQ ID NO: 1996509 - RNA, 15 nt, Shigella flexneri 2a str. 301
auugagcauuggcau

SEQ ID NO: 1996510 - RNA, 17 nt, Shigella flexneri 2a str. 301
auugagugagcacugaa

SEQ ID NO: 1996511 - RNA, 15 nt, Shigella flexneri 2a str. 301
auugaguuugaugac

SEQ ID NO: 1996512 - RNA, 14 nt, Shigella flexneri 2a str. 301
auugagucagaaau

SEQ ID NO: 1996513 - RNA, 12 nt, Shigella flexneri 2a str. 301
auugagcugccc

SEQ ID NO: 1996514 - RNA, 15 nt, Shigella flexneri 2a str. 301
auucucagugguugu

SEQ ID NO: 1996515 - RNA, 22 nt, Shigella flexneri 2a str. 301
auucucagcugcaagaugaaua

SEQ ID NO: 1996516 - RNA, 16 nt, Shigella flexneri 2a str. 301
auucucacuccagcca

SEQ ID NO: 1996517 - RNA, 22 nt, Shigella flexneri 2a str. 301
auucucagcgguugcaaggcuu

SEQ ID NO: 1996518 - RNA, 18 nt, Shigella flexneri 2a str. 301
auucuguuuuaucagacc

SEQ ID NO: 1996519 - RNA, 23 nt, Shigella flexneri 2a str. 301
auucuuaaagucuuuguauuuau

SEQ ID NO: 1996520 - RNA, 13 nt, Shigella flexneri 2a str. 301
auucuguucagua

SEQ ID NO: 1996521 - RNA, 22 nt, Shigella flexneri 2a str. 301
auucuguucaguacgaaauaac

SEQ ID NO: 1996522 - RNA, 21 nt, Shigella flexneri 2a str. 301
auucuguguaaaugccuuucu

SEQ ID NO: 1996523 - RNA, 21 nt, Shigella flexneri 2a str. 301
auugaaaucacuaacgacaua

SEQ ID NO: 1996524 - RNA, 16 nt, Shigella flexneri 2a str. 301
auucuuugcuguacau

SEQ ID NO: 1996525 - RNA, 12 nt, Shigella flexneri 2a str. 301
auucuucaagug

SEQ ID NO: 1996526 - RNA, 20 nt, Shigella flexneri 2a str. 301
auucuucagcgacagggcca

SEQ ID NO: 1996527 - RNA, 20 nt, Shigella flexneri 2a str. 301
auucuuacguaauuuauaau

SEQ ID NO: 1996528 - RNA, 24 nt, Shigella flexneri 2a str. 301
auucuacuuugcgagucugcucca

SEQ ID NO: 1996529 - RNA, 16 nt, Shigella flexneri 2a str. 301
auucggcaagauaaau

SEQ ID NO: 1996530 - RNA, 19 nt, Shigella flexneri 2a str. 301
auucggauugcuauuuaac

SEQ ID NO: 1996531 - RNA, 19 nt, Shigella flexneri 2a str. 301
auucgccugacgcaauaac

SEQ ID NO: 1996532 - RNA, 14 nt, Shigella flexneri 2a str. 301
auucggcuccagau

SEQ ID NO: 1996533 - RNA, 17 nt, Shigella flexneri 2a str. 301
auucggcuacuacggcg

SEQ ID NO: 1996534 - RNA, 18 nt, Shigella flexneri 2a str. 301
auucguugguaaugacuc

SEQ ID NO: 1996535 - RNA, 17 nt, Shigella flexneri 2a str. 301
auuccugcugacggcac

SEQ ID NO: 1996536 - RNA, 22 nt, Shigella flexneri 2a str. 301
auuccugcuuauuguauuucuu

SEQ ID NO: 1996537 - RNA, 20 nt, Shigella flexneri 2a str. 301
auuccuggggucaucagcau

SEQ ID NO: 1996538 - RNA, 21 nt, Shigella flexneri 2a str. 301
auuccugcgcuuccagcucca

SEQ ID NO: 1996539 - RNA, 16 nt, Shigella flexneri 2a str. 301
auucgauucacauuua

SEQ ID NO: 1996540 - RNA, 20 nt, Shigella flexneri 2a str. 301
auucgaucaaacaauuuuca

SEQ ID NO: 1996541 - RNA, 12 nt, Shigella flexneri 2a str. 301
auucgauauaau

SEQ ID NO: 1996542 - RNA, 19 nt, Shigella flexneri 2a str. 301
auucgauacauucagaauu

SEQ ID NO: 1996543 - RNA, 18 nt, Shigella flexneri 2a str. 301
auuccgcgugaaaugcca

SEQ ID NO: 1996544 - RNA, 17 nt, Shigella flexneri 2a str. 301
auucccccuuugaccag

SEQ ID NO: 1996545 - RNA, 22 nt, Shigella flexneri 2a str. 301
auucccccuuugaccagccagu

SEQ ID NO: 1996546 - RNA, 19 nt, Shigella flexneri 2a str. 301
auucccugcuuugcaagcg

SEQ ID NO: 1996547 - RNA, 23 nt, Shigella flexneri 2a str. 301
auuccugacguaacgaccaccac

SEQ ID NO: 1996548 - RNA, 22 nt, Shigella flexneri 2a str. 301
auuccggugaccaguuauuugg

SEQ ID NO: 1996549 - RNA, 21 nt, Shigella flexneri 2a str. 301
auuccggugcugcgucaguug

SEQ ID NO: 1996550 - RNA, 19 nt, Shigella flexneri 2a str. 301
auuccgggaauucgaagcu

SEQ ID NO: 1996551 - RNA, 22 nt, Shigella flexneri 2a str. 301
auuccggcgugacgaucaccac

SEQ ID NO: 1996552 - RNA, 14 nt, Shigella flexneri 2a str. 301
auucauaaugccca

SEQ ID NO: 1996553 - RNA, 13 nt, Shigella flexneri 2a str. 301
auucauaauugcg

SEQ ID NO: 1996554 - RNA, 21 nt, Shigella flexneri 2a str. 301
auucauaagaagcuuuucuca

SEQ ID NO: 1996555 - RNA, 14 nt, Shigella flexneri 2a str. 301
auuccagaaaagag

SEQ ID NO: 1996556 - RNA, 15 nt, Shigella flexneri 2a str. 301
auucauagaggaaug

SEQ ID NO: 1996557 - RNA, 16 nt, Shigella flexneri 2a str. 301
auuccagcaagccacu

SEQ ID NO: 1996558 - RNA, 19 nt, Shigella flexneri 2a str. 301
auuccagcauacgcugcca

SEQ ID NO: 1996559 - RNA, 13 nt, Shigella flexneri 2a str. 301
auucccauuuauu

SEQ ID NO: 1996560 - RNA, 21 nt, Shigella flexneri 2a str. 301
auuuugacucggcucauuauu

SEQ ID NO: 1996561 - RNA, 19 nt, Shigella flexneri 2a str. 301
auuuugaagucuuuuuuca

SEQ ID NO: 1996562 - RNA, 16 nt, Shigella flexneri 2a str. 301
auuuugauggaagaaa

SEQ ID NO: 1996563 - RNA, 14 nt, Shigella flexneri 2a str. 301
auuuugcaaggcuu

SEQ ID NO: 1996564 - RNA, 18 nt, Shigella flexneri 2a str. 301
auuuugacuuuuacagcu

SEQ ID NO: 1996565 - RNA, 23 nt, Shigella flexneri 2a str. 301
auuuugagggaaacggagcaaaa

SEQ ID NO: 1996566 - RNA, 22 nt, Shigella flexneri 2a str. 301
auuuugccuucauacugcggcg

SEQ ID NO: 1996567 - RNA, 15 nt, Shigella flexneri 2a str. 301
auuuugccagcauga

SEQ ID NO: 1996568 - RNA, 13 nt, Shigella flexneri 2a str. 301
auuuugcgcuucu

SEQ ID NO: 1996569 - RNA, 16 nt, Shigella flexneri 2a str. 301
auuuugcguuucugcu

SEQ ID NO: 1996570 - RNA, 14 nt, Shigella flexneri 2a str. 301
auuuuguaaaagaa

SEQ ID NO: 1996571 - RNA, 15 nt, Shigella flexneri 2a str. 301
auuuuguaaaagaag

SEQ ID NO: 1996572 - RNA, 22 nt, Shigella flexneri 2a str. 301
auuuucagaaggauaauuaauc

SEQ ID NO: 1996573 - RNA, 19 nt, Shigella flexneri 2a str. 301
auuuucuucagcaguucag

SEQ ID NO: 1996574 - RNA, 15 nt, Shigella flexneri 2a str. 301
auuuucugcccauuu

SEQ ID NO: 1996575 - RNA, 22 nt, Shigella flexneri 2a str. 301
auuuuccgugaagaauuugccc

SEQ ID NO: 1996576 - RNA, 14 nt, Shigella flexneri 2a str. 301
auuuucucuuucag

SEQ ID NO: 1996577 - RNA, 17 nt, Shigella flexneri 2a str. 301
auuuucuauuuugcauu

SEQ ID NO: 1996578 - RNA, 13 nt, Shigella flexneri 2a str. 301
auuuucagcgugc

SEQ ID NO: 1996579 - RNA, 17 nt, Shigella flexneri 2a str. 301
auuuucagccaucaucc

SEQ ID NO: 1996580 - RNA, 18 nt, Shigella flexneri 2a str. 301
auuuucagcgugcccacg

SEQ ID NO: 1996581 - RNA, 16 nt, Shigella flexneri 2a str. 301
auuuucaggucugcaa

SEQ ID NO: 1996582 - RNA, 16 nt, Shigella flexneri 2a str. 301
auuuuccaaaauaaaa

SEQ ID NO: 1996583 - RNA, 16 nt, Shigella flexneri 2a str. 301
caaaaacccuucuucc

SEQ ID NO: 1996584 - RNA, 20 nt, Shigella flexneri 2a str. 301
caaaaaccgcugauuccugc

SEQ ID NO: 1996585 - RNA, 21 nt, Shigella flexneri 2a str. 301
caaaaaguaguuccagcauga

SEQ ID NO: 1996586 - RNA, 23 nt, Shigella flexneri 2a str. 301
caaaaauugcgcgacuuuuuccu

SEQ ID NO: 1996587 - RNA, 16 nt, Shigella flexneri 2a str. 301
caaaaaucggcaacau

SEQ ID NO: 1996588 - RNA, 12 nt, Shigella flexneri 2a str. 301
caaaaaucggca

SEQ ID NO: 1996589 - RNA, 12 nt, Shigella flexneri 2a str. 301
caaaaaucgaca

SEQ ID NO: 1996590 - RNA, 17 nt, Shigella flexneri 2a str. 301
caaaaaucgacagcagg

SEQ ID NO: 1996591 - RNA, 21 nt, Shigella flexneri 2a str. 301
caaaaauccagauuuauaaaa

SEQ ID NO: 1996592 - RNA, 14 nt, Shigella flexneri 2a str. 301
caaaacauacccag

SEQ ID NO: 1996593 - RNA, 19 nt, Shigella flexneri 2a str. 301
caaaacagcgacaccagcc

SEQ ID NO: 1996594 - RNA, 20 nt, Shigella flexneri 2a str. 301
caaaacauacccaguuucau

SEQ ID NO: 1996595 - RNA, 15 nt, Shigella flexneri 2a str. 301
caaaacacucuucaa

SEQ ID NO: 1996596 - RNA, 12 nt, Shigella flexneri 2a str. 301
caaaacaacaca

SEQ ID NO: 1996597 - RNA, 22 nt, Shigella flexneri 2a str. 301
auuuuuuuaaucgucaguuuuu

SEQ ID NO: 1996598 - RNA, 21 nt, Shigella flexneri 2a str. 301
caaaaaacaaaccccguacag

SEQ ID NO: 1996599 - RNA, 13 nt, Shigella flexneri 2a str. 301
caaaaaaccaucc

SEQ ID NO: 1996600 - RNA, 14 nt, Shigella flexneri 2a str. 301
caaaaaacggaaag

SEQ ID NO: 1996601 - RNA, 18 nt, Shigella flexneri 2a str. 301
caaaaaacuggaaaaaua

SEQ ID NO: 1996602 - RNA, 19 nt, Shigella flexneri 2a str. 301
caaaaaacuggaaaaauaa

SEQ ID NO: 1996603 - RNA, 12 nt, Shigella flexneri 2a str. 301
caaaaaagaggg

SEQ ID NO: 1996604 - RNA, 23 nt, Shigella flexneri 2a str. 301
caaaaaagccaaucacaaaaagu

SEQ ID NO: 1996605 - RNA, 13 nt, Shigella flexneri 2a str. 301
caaaaacaaagaa

SEQ ID NO: 1996606 - RNA, 18 nt, Shigella flexneri 2a str. 301
auuuuugugaagaauaaa

SEQ ID NO: 1996607 - RNA, 15 nt, Shigella flexneri 2a str. 301
auuuuuugaaguauu

SEQ ID NO: 1996608 - RNA, 20 nt, Shigella flexneri 2a str. 301
auuuuuauauagccagccuc

SEQ ID NO: 1996609 - RNA, 22 nt, Shigella flexneri 2a str. 301
auuuuuaucucaaaaauuacuc

SEQ ID NO: 1996610 - RNA, 17 nt, Shigella flexneri 2a str. 301
auuuguaggccugauaa

SEQ ID NO: 1996611 - RNA, 11 nt, Shigella flexneri 2a str. 301
auuuguaauuu

SEQ ID NO: 1996612 - RNA, 22 nt, Shigella flexneri 2a str. 301
auuuguagcuguugcugaagaa

SEQ ID NO: 1996613 - RNA, 15 nt, Shigella flexneri 2a str. 301
auuuguccacgccgc

SEQ ID NO: 1996614 - RNA, 22 nt, Shigella flexneri 2a str. 301
auuugucgccaacuucaugacc

SEQ ID NO: 1996615 - RNA, 22 nt, Shigella flexneri 2a str. 301
auuuguucucuucugcuuugcc

SEQ ID NO: 1996616 - RNA, 18 nt, Shigella flexneri 2a str. 301
auuuguuggcgaaaaucu

SEQ ID NO: 1996617 - RNA, 17 nt, Shigella flexneri 2a str. 301
auuuguugagcuggaag

SEQ ID NO: 1996618 - RNA, 12 nt, Shigella flexneri 2a str. 301
auuugugucaga

SEQ ID NO: 1996619 - RNA, 17 nt, Shigella flexneri 2a str. 301
auuuguggugaagccac

SEQ ID NO: 1996620 - RNA, 21 nt, Shigella flexneri 2a str. 301
auuugcuuuucauacaaucgg

SEQ ID NO: 1996621 - RNA, 21 nt, Shigella flexneri 2a str. 301
auuuggcauaucgccguacau

SEQ ID NO: 1996622 - RNA, 13 nt, Shigella flexneri 2a str. 301
auuugcuccagaa

SEQ ID NO: 1996623 - RNA, 23 nt, Shigella flexneri 2a str. 301
auuuggguguaucuucagcugca

SEQ ID NO: 1996624 - RNA, 15 nt, Shigella flexneri 2a str. 301
auuucuuugcgcucu

SEQ ID NO: 1996625 - RNA, 16 nt, Shigella flexneri 2a str. 301
auuucuuuucauaauc

SEQ ID NO: 1996626 - RNA, 12 nt, Shigella flexneri 2a str. 301
auuucucccccc

SEQ ID NO: 1996627 - RNA, 17 nt, Shigella flexneri 2a str. 301
auuugauuucacacaua

SEQ ID NO: 1996628 - RNA, 14 nt, Shigella flexneri 2a str. 301
auuugcaaaguucc

SEQ ID NO: 1996629 - RNA, 17 nt, Shigella flexneri 2a str. 301
auuugcauacccagaac

SEQ ID NO: 1996630 - RNA, 15 nt, Shigella flexneri 2a str. 301
auuugccuaauaaau

SEQ ID NO: 1996631 - RNA, 19 nt, Shigella flexneri 2a str. 301
auuugccgcagcaguugcc

SEQ ID NO: 1996632 - RNA, 14 nt, Shigella flexneri 2a str. 301
auuugcccgcuugg

SEQ ID NO: 1996633 - RNA, 23 nt, Shigella flexneri 2a str. 301
auuugcgcgacguugcuucucuu

SEQ ID NO: 1996634 - RNA, 21 nt, Shigella flexneri 2a str. 301
auuugcgcucaauaaucaauc

SEQ ID NO: 1996635 - RNA, 13 nt, Shigella flexneri 2a str. 301
auuucaauaacuc

SEQ ID NO: 1996636 - RNA, 18 nt, Shigella flexneri 2a str. 301
auuucaauaacuccaucu

SEQ ID NO: 1996637 - RNA, 20 nt, Shigella flexneri 2a str. 301
auuucaacagauuacauuaa

SEQ ID NO: 1996638 - RNA, 18 nt, Shigella flexneri 2a str. 301
auuucaacagguuuuguu

SEQ ID NO: 1996639 - RNA, 18 nt, Shigella flexneri 2a str. 301
auuucagaaaguauauaa

SEQ ID NO: 1996640 - RNA, 19 nt, Shigella flexneri 2a str. 301
auuucacuucaaccacauu

SEQ ID NO: 1996641 - RNA, 17 nt, Shigella flexneri 2a str. 301
auuucacuucaaccaca

SEQ ID NO: 1996642 - RNA, 18 nt, Shigella flexneri 2a str. 301
auuucagcaagacaaugu

SEQ ID NO: 1996643 - RNA, 13 nt, Shigella flexneri 2a str. 301
auuucauuauuca

SEQ ID NO: 1996644 - RNA, 22 nt, Shigella flexneri 2a str. 301
auuucauuaagaacuccugaaa

SEQ ID NO: 1996645 - RNA, 23 nt, Shigella flexneri 2a str. 301
auuucauggcggaaaucagagau

SEQ ID NO: 1996646 - RNA, 19 nt, Shigella flexneri 2a str. 301
auuucaucugccuuauuga

SEQ ID NO: 1996647 - RNA, 17 nt, Shigella flexneri 2a str. 301
auuucaugaagcugaca

SEQ ID NO: 1996648 - RNA, 14 nt, Shigella flexneri 2a str. 301
auuucaucaccagc

SEQ ID NO: 1996649 - RNA, 21 nt, Shigella flexneri 2a str. 301
auuucaucgccagcgaauucc

SEQ ID NO: 1996650 - RNA, 20 nt, Shigella flexneri 2a str. 301
auuucaucgcuacaccaauc

SEQ ID NO: 1996651 - RNA, 23 nt, Shigella flexneri 2a str. 301
auuuccauaccuaaaaaauccca

SEQ ID NO: 1996652 - RNA, 13 nt, Shigella flexneri 2a str. 301
auuuccguuugcg

SEQ ID NO: 1996653 - RNA, 15 nt, Shigella flexneri 2a str. 301
auuuccauaccuaaa

SEQ ID NO: 1996654 - RNA, 17 nt, Shigella flexneri 2a str. 301
auuuccauaccuaaaaa

SEQ ID NO: 1996655 - RNA, 16 nt, Shigella flexneri 2a str. 301
auuuccugagcacugg

SEQ ID NO: 1996656 - RNA, 23 nt, Shigella flexneri 2a str. 301
auuuccugcgugacuaaaacccu

SEQ ID NO: 1996657 - RNA, 17 nt, Shigella flexneri 2a str. 301
auuuccuucgcuuuaau

SEQ ID NO: 1996658 - RNA, 15 nt, Shigella flexneri 2a str. 301
auuuccuucagcagc

SEQ ID NO: 1996659 - RNA, 21 nt, Shigella flexneri 2a str. 301
auuuccuuccuuggauauuuu

SEQ ID NO: 1996660 - RNA, 18 nt, Shigella flexneri 2a str. 301
auuuccagcucaaagaua

SEQ ID NO: 1996661 - RNA, 16 nt, Shigella flexneri 2a str. 301
auuuccaggagauuaa

SEQ ID NO: 1996662 - RNA, 19 nt, Shigella flexneri 2a str. 301
auuuccaguccagcugccg

SEQ ID NO: 1996663 - RNA, 13 nt, Shigella flexneri 2a str. 301
auuuccaccgcua

SEQ ID NO: 1996664 - RNA, 23 nt, Shigella flexneri 2a str. 301
auuuccacgccaagcucauaacg

SEQ ID NO: 1996665 - RNA, 15 nt, Shigella flexneri 2a str. 301
auuuccaagauuaaa

SEQ ID NO: 1996666 - RNA, 21 nt, Shigella flexneri 2a str. 301
auuucauuguccgucugaaaa

SEQ ID NO: 1996667 - RNA, 23 nt, Shigella flexneri 2a str. 301
auuucgagaaugucgauaaaguu

SEQ ID NO: 1996668 - RNA, 15 nt, Shigella flexneri 2a str. 301
auuucgaauuuucca

SEQ ID NO: 1996669 - RNA, 21 nt, Shigella flexneri 2a str. 301
auuuccuuugguuauucuuug

SEQ ID NO: 1996670 - RNA, 12 nt, Shigella flexneri 2a str. 301
auuucgccgcac

SEQ ID NO: 1996671 - RNA, 17 nt, Shigella flexneri 2a str. 301
auuucuacacccagccc

SEQ ID NO: 1996672 - RNA, 17 nt, Shigella flexneri 2a str. 301
cacacugcuuaacugcg

SEQ ID NO: 1996673 - RNA, 22 nt, Shigella flexneri 2a str. 301
cacacugguucccaacaacagc

SEQ ID NO: 1996674 - RNA, 13 nt, Shigella flexneri 2a str. 301
cacacugaauaaa

SEQ ID NO: 1996675 - RNA, 20 nt, Shigella flexneri 2a str. 301
cacacuccagucccaguuca

SEQ ID NO: 1996676 - RNA, 20 nt, Shigella flexneri 2a str. 301
cacacccgguaucaaacccu

SEQ ID NO: 1996677 - RNA, 23 nt, Shigella flexneri 2a str. 301
cacacccauguuuaauucacgca

SEQ ID NO: 1996678 - RNA, 18 nt, Shigella flexneri 2a str. 301
cacacccagaugucuuua

SEQ ID NO: 1996679 - RNA, 13 nt, Shigella flexneri 2a str. 301
cacaccggcacca

SEQ ID NO: 1996680 - RNA, 15 nt, Shigella flexneri 2a str. 301
cacaccgcggaacgc

SEQ ID NO: 1996681 - RNA, 18 nt, Shigella flexneri 2a str. 301
cacaaauacgcuuuuucc

SEQ ID NO: 1996682 - RNA, 16 nt, Shigella flexneri 2a str. 301
cacaaauccagcaccg

SEQ ID NO: 1996683 - RNA, 17 nt, Shigella flexneri 2a str. 301
cacaaauggcaaugacu

SEQ ID NO: 1996684 - RNA, 15 nt, Shigella flexneri 2a str. 301
cacaaugccugaugc

SEQ ID NO: 1996685 - RNA, 17 nt, Shigella flexneri 2a str. 301
cacaaugcuguaaccag

SEQ ID NO: 1996686 - RNA, 19 nt, Shigella flexneri 2a str. 301
cacaaugccugaugcgcuu

SEQ ID NO: 1996687 - RNA, 13 nt, Shigella flexneri 2a str. 301
cacaauugccgga

SEQ ID NO: 1996688 - RNA, 13 nt, Shigella flexneri 2a str. 301
cacaccaucaaca

SEQ ID NO: 1996689 - RNA, 21 nt, Shigella flexneri 2a str. 301
cacaccacugcgcauaaucca

SEQ ID NO: 1996690 - RNA, 17 nt, Shigella flexneri 2a str. 301
cacagacaauaaacggc

SEQ ID NO: 1996691 - RNA, 19 nt, Shigella flexneri 2a str. 301
cacagaccggacugacucc

SEQ ID NO: 1996692 - RNA, 13 nt, Shigella flexneri 2a str. 301
cacagacgaaggu

SEQ ID NO: 1996693 - RNA, 18 nt, Shigella flexneri 2a str. 301
cacagaggucuuuucucg

SEQ ID NO: 1996694 - RNA, 14 nt, Shigella flexneri 2a str. 301
cacagaguauuucc

SEQ ID NO: 1996695 - RNA, 16 nt, Shigella flexneri 2a str. 301
cacagaggcagcaucu

SEQ ID NO: 1996696 - RNA, 16 nt, Shigella flexneri 2a str. 301
cacagcgccagacacu

SEQ ID NO: 1996697 - RNA, 15 nt, Shigella flexneri 2a str. 301
cacagccgagcgcca

SEQ ID NO: 1996698 - RNA, 14 nt, Shigella flexneri 2a str. 301
cacagcgacguaaa

SEQ ID NO: 1996699 - RNA, 15 nt, Shigella flexneri 2a str. 301
cacaggccauuuccc

SEQ ID NO: 1996700 - RNA, 22 nt, Shigella flexneri 2a str. 301
cacaggaaaaacuuuuaccugc

SEQ ID NO: 1996701 - RNA, 16 nt, Shigella flexneri 2a str. 301
cacagugcugauuuug

SEQ ID NO: 1996702 - RNA, 21 nt, Shigella flexneri 2a str. 301
cacaguuaaguuaauucugag

SEQ ID NO: 1996703 - RNA, 16 nt, Shigella flexneri 2a str. 301
cacagugaaucucuua

SEQ ID NO: 1996704 - RNA, 12 nt, Shigella flexneri 2a str. 301
cacagugacccg

SEQ ID NO: 1996705 - RNA, 14 nt, Shigella flexneri 2a str. 301
cacaguaaugauuu

SEQ ID NO: 1996706 - RNA, 21 nt, Shigella flexneri 2a str. 301
cacaguaaugauuuaaaacca

SEQ ID NO: 1996707 - RNA, 23 nt, Shigella flexneri 2a str. 301
cacaggccugauaagacgcgcag

SEQ ID NO: 1996708 - RNA, 20 nt, Shigella flexneri 2a str. 301
cacagggcucuuaagcaccg

SEQ ID NO: 1996709 - RNA, 20 nt, Shigella flexneri 2a str. 301
cacaggucagcaggagcagc

SEQ ID NO: 1996710 - RNA, 13 nt, Shigella flexneri 2a str. 301
cacaaaaauaauu

SEQ ID NO: 1996711 - RNA, 16 nt, Shigella flexneri 2a str. 301
cacaaaaaccgcugau

SEQ ID NO: 1996712 - RNA, 19 nt, Shigella flexneri 2a str. 301
cacaaaggcuugcugcauu

SEQ ID NO: 1996713 - RNA, 21 nt, Shigella flexneri 2a str. 301
cacaaagcuguaucccagccc

SEQ ID NO: 1996714 - RNA, 21 nt, Shigella flexneri 2a str. 301
caauuuaccgaccucaacaaa

SEQ ID NO: 1996715 - RNA, 16 nt, Shigella flexneri 2a str. 301
caauuuacgcuuuucu

SEQ ID NO: 1996716 - RNA, 20 nt, Shigella flexneri 2a str. 301
caauuuguagucauuuuuug

SEQ ID NO: 1996717 - RNA, 20 nt, Shigella flexneri 2a str. 301
caauuuugucauuacuuaca

SEQ ID NO: 1996718 - RNA, 16 nt, Shigella flexneri 2a str. 301
caauuuucauugaaaa

SEQ ID NO: 1996719 - RNA, 18 nt, Shigella flexneri 2a str. 301
caauguucguccauuuca

SEQ ID NO: 1996720 - RNA, 22 nt, Shigella flexneri 2a str. 301
caauguucguccauuucagcgc

SEQ ID NO: 1996721 - RNA, 14 nt, Shigella flexneri 2a str. 301
caauguucguccau

SEQ ID NO: 1996722 - RNA, 17 nt, Shigella flexneri 2a str. 301
caauuaaaaaauuagca

SEQ ID NO: 1996723 - RNA, 15 nt, Shigella flexneri 2a str. 301
caauuaacgguaaua

SEQ ID NO: 1996724 - RNA, 17 nt, Shigella flexneri 2a str. 301
caauuaacgguaauaau

SEQ ID NO: 1996725 - RNA, 14 nt, Shigella flexneri 2a str. 301
caauuaacugugcc

SEQ ID NO: 1996726 - RNA, 13 nt, Shigella flexneri 2a str. 301
caauuaacaacac

SEQ ID NO: 1996727 - RNA, 22 nt, Shigella flexneri 2a str. 301
caauuacccaguagacagcaaa

SEQ ID NO: 1996728 - RNA, 15 nt, Shigella flexneri 2a str. 301
caauuacacaucagg

SEQ ID NO: 1996729 - RNA, 14 nt, Shigella flexneri 2a str. 301
caauuaauugugaa

SEQ ID NO: 1996730 - RNA, 19 nt, Shigella flexneri 2a str. 301
caauuacgccgagcgccag

SEQ ID NO: 1996731 - RNA, 19 nt, Shigella flexneri 2a str. 301
caauuacugagagaaaaaa

SEQ ID NO: 1996732 - RNA, 20 nt, Shigella flexneri 2a str. 301
caauuacugcauugaauuuc

SEQ ID NO: 1996733 - RNA, 22 nt, Shigella flexneri 2a str. 301
caauuauuaaccuggucgcuga

SEQ ID NO: 1996734 - RNA, 20 nt, Shigella flexneri 2a str. 301
caauuaucuggaauuccuuu

SEQ ID NO: 1996735 - RNA, 14 nt, Shigella flexneri 2a str. 301
caauuagcuuuaau

SEQ ID NO: 1996736 - RNA, 15 nt, Shigella flexneri 2a str. 301
caauuagcuuuaauc

SEQ ID NO: 1996737 - RNA, 13 nt, Shigella flexneri 2a str. 301
caauucuuucucg

SEQ ID NO: 1996738 - RNA, 20 nt, Shigella flexneri 2a str. 301
caauugaagaauaucuucug

SEQ ID NO: 1996739 - RNA, 14 nt, Shigella flexneri 2a str. 301
caauugacaguuua

SEQ ID NO: 1996740 - RNA, 15 nt, Shigella flexneri 2a str. 301
caauugacaguuuau

SEQ ID NO: 1996741 - RNA, 16 nt, Shigella flexneri 2a str. 301
caauugaccaguaaua

SEQ ID NO: 1996742 - RNA, 21 nt, Shigella flexneri 2a str. 301
cacauaagagcgggacaacaa

SEQ ID NO: 1996743 - RNA, 18 nt, Shigella flexneri 2a str. 301
cacaguuauaaaaugaua

SEQ ID NO: 1996744 - RNA, 22 nt, Shigella flexneri 2a str. 301
cacaguuuuacugcagccagcg

SEQ ID NO: 1996745 - RNA, 20 nt, Shigella flexneri 2a str. 301
cacauaaaguagccaauccc

SEQ ID NO: 1996746 - RNA, 21 nt, Shigella flexneri 2a str. 301
cacauaaacagguaaagacca

SEQ ID NO: 1996747 - RNA, 22 nt, Shigella flexneri 2a str. 301
cacaugaauucgacuuucucug

SEQ ID NO: 1996748 - RNA, 15 nt, Shigella flexneri 2a str. 301
cacaugaguugcugg

SEQ ID NO: 1996749 - RNA, 19 nt, Shigella flexneri 2a str. 301
cacaugcaagucgaacggu

SEQ ID NO: 1996750 - RNA, 22 nt, Shigella flexneri 2a str. 301
cacauuucagaaaguauauaaa

SEQ ID NO: 1996751 - RNA, 13 nt, Shigella flexneri 2a str. 301
cacauuucaauca

SEQ ID NO: 1996752 - RNA, 15 nt, Shigella flexneri 2a str. 301
caccaaggaacugug

SEQ ID NO: 1996753 - RNA, 24 nt, Shigella flexneri 2a str. 301
cacauucugcaucgcgcugaacau

SEQ ID NO: 1996754 - RNA, 23 nt, Shigella flexneri 2a str. 301
cacauugauggcgcuuucguuuu

SEQ ID NO: 1996755 - RNA, 22 nt, Shigella flexneri 2a str. 301
cacauucugcaucgcgcugaac

SEQ ID NO: 1996756 - RNA, 17 nt, Shigella flexneri 2a str. 301
cacauuguuaaagccuu

SEQ ID NO: 1996757 - RNA, 18 nt, Shigella flexneri 2a str. 301
cacaugcuggaaccacag

SEQ ID NO: 1996758 - RNA, 22 nt, Shigella flexneri 2a str. 301
caccacccguacuucugaccag

SEQ ID NO: 1996759 - RNA, 17 nt, Shigella flexneri 2a str. 301
caccacccguaaucacc

SEQ ID NO: 1996760 - RNA, 12 nt, Shigella flexneri 2a str. 301
caccacccagcg

SEQ ID NO: 1996761 - RNA, 14 nt, Shigella flexneri 2a str. 301
caccacccagcgcc

SEQ ID NO: 1996762 - RNA, 17 nt, Shigella flexneri 2a str. 301
caccaccgauccugaag

SEQ ID NO: 1996763 - RNA, 20 nt, Shigella flexneri 2a str. 301
caccaccgauauugccaccu

SEQ ID NO: 1996764 - RNA, 22 nt, Shigella flexneri 2a str. 301
caccaccgacggacccgccggc

SEQ ID NO: 1996765 - RNA, 20 nt, Shigella flexneri 2a str. 301
caccaccgcaguaaucggcg

SEQ ID NO: 1996766 - RNA, 21 nt, Shigella flexneri 2a str. 301
caccaccgcaucggcaucaaa

SEQ ID NO: 1996767 - RNA, 23 nt, Shigella flexneri 2a str. 301
caccaaucgaaaaugcuccuuuu

SEQ ID NO: 1996768 - RNA, 18 nt, Shigella flexneri 2a str. 301
caccaaucgucaaugccg

SEQ ID NO: 1996769 - RNA, 11 nt, Shigella flexneri 2a str. 301
caccaaugacg

SEQ ID NO: 1996770 - RNA, 23 nt, Shigella flexneri 2a str. 301
caccaauaccgcccaccaccagc

SEQ ID NO: 1996771 - RNA, 15 nt, Shigella flexneri 2a str. 301
caccaauagcccaug

SEQ ID NO: 1996772 - RNA, 18 nt, Shigella flexneri 2a str. 301
caccacgguaagcggcgu

SEQ ID NO: 1996773 - RNA, 16 nt, Shigella flexneri 2a str. 301
caccaccugcaucucc

SEQ ID NO: 1996774 - RNA, 17 nt, Shigella flexneri 2a str. 301
caccaccggcauccauu

SEQ ID NO: 1996775 - RNA, 15 nt, Shigella flexneri 2a str. 301
caccaugccgauggc

SEQ ID NO: 1996776 - RNA, 21 nt, Shigella flexneri 2a str. 301
caccaucguugcuaacggcca

SEQ ID NO: 1996777 - RNA, 14 nt, Shigella flexneri 2a str. 301
caccaucuuccuca

SEQ ID NO: 1996778 - RNA, 21 nt, Shigella flexneri 2a str. 301
caccaucgggccucuuuuuau

SEQ ID NO: 1996779 - RNA, 14 nt, Shigella flexneri 2a str. 301
caccaucagcagca

SEQ ID NO: 1996780 - RNA, 22 nt, Shigella flexneri 2a str. 301
caccaguugguaaugacuccaa

SEQ ID NO: 1996781 - RNA, 13 nt, Shigella flexneri 2a str. 301
caccaguucacgc

SEQ ID NO: 1996782 - RNA, 20 nt, Shigella flexneri 2a str. 301
caccaguucacccucauuca

SEQ ID NO: 1996783 - RNA, 16 nt, Shigella flexneri 2a str. 301
caccauauucagcagc

SEQ ID NO: 1996784 - RNA, 23 nt, Shigella flexneri 2a str. 301
caccauauaagccgagaaccggc

SEQ ID NO: 1996785 - RNA, 12 nt, Shigella flexneri 2a str. 301
caccauacugcu

SEQ ID NO: 1996786 - RNA, 16 nt, Shigella flexneri 2a str. 301
caccauacuucgguaa

SEQ ID NO: 1996787 - RNA, 20 nt, Shigella flexneri 2a str. 301
caccaucaaaguuuuuauga

SEQ ID NO: 1996788 - RNA, 19 nt, Shigella flexneri 2a str. 301
caccaucaacaaacgccag

SEQ ID NO: 1996789 - RNA, 21 nt, Shigella flexneri 2a str. 301
caccauaaaucagaucgacgc

SEQ ID NO: 1996790 - RNA, 19 nt, Shigella flexneri 2a str. 301
caccaggaacgcgccaaga

SEQ ID NO: 1996791 - RNA, 19 nt, Shigella flexneri 2a str. 301
caccagcgauuguucaccc

SEQ ID NO: 1996792 - RNA, 20 nt, Shigella flexneri 2a str. 301
caccagcgcaauauguuucc

SEQ ID NO: 1996793 - RNA, 19 nt, Shigella flexneri 2a str. 301
caccagccccagaauucac

SEQ ID NO: 1996794 - RNA, 22 nt, Shigella flexneri 2a str. 301
caccagcgaaaucaccgccacc

SEQ ID NO: 1996795 - RNA, 13 nt, Shigella flexneri 2a str. 301
caccagccugcaa

SEQ ID NO: 1996796 - RNA, 16 nt, Shigella flexneri 2a str. 301
caccagccgaucauug

SEQ ID NO: 1996797 - RNA, 19 nt, Shigella flexneri 2a str. 301
caccacuuuuuucaccgag

SEQ ID NO: 1996798 - RNA, 11 nt, Shigella flexneri 2a str. 301
caccagaauac

SEQ ID NO: 1996799 - RNA, 15 nt, Shigella flexneri 2a str. 301
caccagaaucgccag

SEQ ID NO: 1996800 - RNA, 20 nt, Shigella flexneri 2a str. 301
caccagaaucgccagcaucg

SEQ ID NO: 1996801 - RNA, 19 nt, Shigella flexneri 2a str. 301
cacccuaacccucucccca

SEQ ID NO: 1996802 - RNA, 18 nt, Shigella flexneri 2a str. 301
cacccucgaccaaaugaa

SEQ ID NO: 1996803 - RNA, 21 nt, Shigella flexneri 2a str. 301
cacccgcaagacgaaccggca

SEQ ID NO: 1996804 - RNA, 16 nt, Shigella flexneri 2a str. 301
cacccaaaacaaagcc

SEQ ID NO: 1996805 - RNA, 18 nt, Shigella flexneri 2a str. 301
cacccaacacucaaacag

SEQ ID NO: 1996806 - RNA, 17 nt, Shigella flexneri 2a str. 301
caccauugcugccgcca

SEQ ID NO: 1996807 - RNA, 14 nt, Shigella flexneri 2a str. 301
caccauugcugccg

SEQ ID NO: 1996808 - RNA, 16 nt, Shigella flexneri 2a str. 301
caccauguucacugcc

SEQ ID NO: 1996809 - RNA, 16 nt, Shigella flexneri 2a str. 301
cacccaccagcgccga

SEQ ID NO: 1996810 - RNA, 14 nt, Shigella flexneri 2a str. 301
cacccaccauaagc

SEQ ID NO: 1996811 - RNA, 16 nt, Shigella flexneri 2a str. 301
caccgcgaucuuccac

SEQ ID NO: 1996812 - RNA, 19 nt, Shigella flexneri 2a str. 301
caccgcgaucuuccacgcc

SEQ ID NO: 1996813 - RNA, 15 nt, Shigella flexneri 2a str. 301
caccgcgaucuucca

SEQ ID NO: 1996814 - RNA, 20 nt, Shigella flexneri 2a str. 301
caccgcgaucuuccacgccu

SEQ ID NO: 1996815 - RNA, 15 nt, Shigella flexneri 2a str. 301
caccgccggauagcu

SEQ ID NO: 1996816 - RNA, 15 nt, Shigella flexneri 2a str. 301
caccgccgacuguca

SEQ ID NO: 1996817 - RNA, 15 nt, Shigella flexneri 2a str. 301
caccgccgccgccac

SEQ ID NO: 1996818 - RNA, 17 nt, Shigella flexneri 2a str. 301
caccgccgccgcuucug

SEQ ID NO: 1996819 - RNA, 16 nt, Shigella flexneri 2a str. 301
caccgcccagugcagu

SEQ ID NO: 1996820 - RNA, 14 nt, Shigella flexneri 2a str. 301
caccgcccagugca

SEQ ID NO: 1996821 - RNA, 14 nt, Shigella flexneri 2a str. 301
caccgcccagagaa

SEQ ID NO: 1996822 - RNA, 18 nt, Shigella flexneri 2a str. 301
caccgaagacgugcgcca

SEQ ID NO: 1996823 - RNA, 18 nt, Shigella flexneri 2a str. 301
caccgaaaguggaaacac

SEQ ID NO: 1996824 - RNA, 21 nt, Shigella flexneri 2a str. 301
caccgaacagcucaacgcgug

SEQ ID NO: 1996825 - RNA, 15 nt, Shigella flexneri 2a str. 301
caccgaugcacagca

SEQ ID NO: 1996826 - RNA, 16 nt, Shigella flexneri 2a str. 301
caccgaugcacagcac

SEQ ID NO: 1996827 - RNA, 17 nt, Shigella flexneri 2a str. 301
caccgaugaucaacagc

SEQ ID NO: 1996828 - RNA, 22 nt, Shigella flexneri 2a str. 301
caccgauauugccaccugccgg

SEQ ID NO: 1996829 - RNA, 14 nt, Shigella flexneri 2a str. 301
caccgcaaacugcc

SEQ ID NO: 1996830 - RNA, 17 nt, Shigella flexneri 2a str. 301
caccgcaauaaccauca

SEQ ID NO: 1996831 - RNA, 18 nt, Shigella flexneri 2a str. 301
caccgauuuuguaaaaga

SEQ ID NO: 1996832 - RNA, 15 nt, Shigella flexneri 2a str. 301
caccgauugcaggaa

SEQ ID NO: 1996833 - RNA, 17 nt, Shigella flexneri 2a str. 301
caccgccacgcccuccu

SEQ ID NO: 1996834 - RNA, 15 nt, Shigella flexneri 2a str. 301
caccguuaaauaacu

SEQ ID NO: 1996835 - RNA, 18 nt, Shigella flexneri 2a str. 301
caccguaccaucguaagc

SEQ ID NO: 1996836 - RNA, 22 nt, Shigella flexneri 2a str. 301
caccgugcuucgccuuacucac

SEQ ID NO: 1996837 - RNA, 20 nt, Shigella flexneri 2a str. 301
caccgugcauuucucacuuu

SEQ ID NO: 1996838 - RNA, 23 nt, Shigella flexneri 2a str. 301
caccucuuuuuccacuuccacca

SEQ ID NO: 1996839 - RNA, 19 nt, Shigella flexneri 2a str. 301
caccugaaauggucgcccc

SEQ ID NO: 1996840 - RNA, 15 nt, Shigella flexneri 2a str. 301
caccucuuucaccaa

SEQ ID NO: 1996841 - RNA, 23 nt, Shigella flexneri 2a str. 301
caccugauccagcucuucuucac

SEQ ID NO: 1996842 - RNA, 14 nt, Shigella flexneri 2a str. 301
caccugagcuggca

SEQ ID NO: 1996843 - RNA, 18 nt, Shigella flexneri 2a str. 301
caccugauacgcgccaau

SEQ ID NO: 1996844 - RNA, 22 nt, Shigella flexneri 2a str. 301
caccugcaacgguugauggcag

SEQ ID NO: 1996845 - RNA, 23 nt, Shigella flexneri 2a str. 301
caccugauugaccgccagcgcca

SEQ ID NO: 1996846 - RNA, 19 nt, Shigella flexneri 2a str. 301
caccugauugaccgccagc

SEQ ID NO: 1996847 - RNA, 20 nt, Shigella flexneri 2a str. 301
caccugcacaccaaccgcuu

SEQ ID NO: 1996848 - RNA, 14 nt, Shigella flexneri 2a str. 301
caccggcaccacuu

SEQ ID NO: 1996849 - RNA, 16 nt, Shigella flexneri 2a str. 301
caccgcgccgggcaga

SEQ ID NO: 1996850 - RNA, 13 nt, Shigella flexneri 2a str. 301
caccggacgcaca

SEQ ID NO: 1996851 - RNA, 21 nt, Shigella flexneri 2a str. 301
aaaauaacuuaaugucauaca

SEQ ID NO: 1996852 - RNA, 18 nt, Shigella flexneri 2a str. 301
aaaauaaucuauugauuu

SEQ ID NO: 1996853 - RNA, 15 nt, Shigella flexneri 2a str. 301
aaaauaauacacaca

SEQ ID NO: 1996854 - RNA, 16 nt, Shigella flexneri 2a str. 301
caccggcgacauccca

SEQ ID NO: 1996855 - RNA, 20 nt, Shigella flexneri 2a str. 301
caccggggacaggcgggcca

SEQ ID NO: 1996856 - RNA, 16 nt, Shigella flexneri 2a str. 301
caccggguaccagaau

SEQ ID NO: 1996857 - RNA, 19 nt, Shigella flexneri 2a str. 301
caccgguuuaccggccagc

SEQ ID NO: 1996858 - RNA, 14 nt, Shigella flexneri 2a str. 301
cacgcaggcauuau

SEQ ID NO: 1996859 - RNA, 18 nt, Shigella flexneri 2a str. 301
cacgcagcguuggcaggu

SEQ ID NO: 1996860 - RNA, 15 nt, Shigella flexneri 2a str. 301
cacgcagcgccgcgu

SEQ ID NO: 1996861 - RNA, 14 nt, Shigella flexneri 2a str. 301
cacgcauuaauaag

SEQ ID NO: 1996862 - RNA, 14 nt, Shigella flexneri 2a str. 301
cacgcauucagcaa

SEQ ID NO: 1996863 - RNA, 16 nt, Shigella flexneri 2a str. 301
cacgcauucagcaaau

SEQ ID NO: 1996864 - RNA, 12 nt, Shigella flexneri 2a str. 301
cacgccaacaaa

SEQ ID NO: 1996865 - RNA, 23 nt, Shigella flexneri 2a str. 301
cacgcaucacuuucggugacaga

SEQ ID NO: 1996866 - RNA, 19 nt, Shigella flexneri 2a str. 301
cacgcagggggucgcgggu

SEQ ID NO: 1996867 - RNA, 16 nt, Shigella flexneri 2a str. 301
cacgcagucucucucc

SEQ ID NO: 1996868 - RNA, 20 nt, Shigella flexneri 2a str. 301
cacgcaauuuauacugcgau

SEQ ID NO: 1996869 - RNA, 12 nt, Shigella flexneri 2a str. 301
cacgaucacagc

SEQ ID NO: 1996870 - RNA, 13 nt, Shigella flexneri 2a str. 301
cacgaucacagca

SEQ ID NO: 1996871 - RNA, 19 nt, Shigella flexneri 2a str. 301
cacgccaacaaacaguaca

SEQ ID NO: 1996872 - RNA, 12 nt, Shigella flexneri 2a str. 301
cacgccaccagc

SEQ ID NO: 1996873 - RNA, 17 nt, Shigella flexneri 2a str. 301
cacgccaccagcaacag

SEQ ID NO: 1996874 - RNA, 21 nt, Shigella flexneri 2a str. 301
cacgccaggcaccgcacuggc

SEQ ID NO: 1996875 - RNA, 12 nt, Shigella flexneri 2a str. 301
cacgccaucauc

SEQ ID NO: 1996876 - RNA, 15 nt, Shigella flexneri 2a str. 301
cacgccaucuggcug

SEQ ID NO: 1996877 - RNA, 20 nt, Shigella flexneri 2a str. 301
cacgccgcugucuaccagca

SEQ ID NO: 1996878 - RNA, 13 nt, Shigella flexneri 2a str. 301
cacgccgccgagc

SEQ ID NO: 1996879 - RNA, 14 nt, Shigella flexneri 2a str. 301
caccuuuuuccaga

SEQ ID NO: 1996880 - RNA, 20 nt, Shigella flexneri 2a str. 301
caccugcgcaggcauucaga

SEQ ID NO: 1996881 - RNA, 18 nt, Shigella flexneri 2a str. 301
caccuucucgcugauucu

SEQ ID NO: 1996882 - RNA, 16 nt, Shigella flexneri 2a str. 301
caccuucuguaacugg

SEQ ID NO: 1996883 - RNA, 13 nt, Shigella flexneri 2a str. 301
cacgaauauuucc

SEQ ID NO: 1996884 - RNA, 17 nt, Shigella flexneri 2a str. 301
cacgaccggguuuucaa

SEQ ID NO: 1996885 - RNA, 15 nt, Shigella flexneri 2a str. 301
cacgaaggugcauug

SEQ ID NO: 1996886 - RNA, 15 nt, Shigella flexneri 2a str. 301
cacgaagcucucugc

SEQ ID NO: 1996887 - RNA, 17 nt, Shigella flexneri 2a str. 301
caccuuuuuuuaugcuu

SEQ ID NO: 1996888 - RNA, 16 nt, Shigella flexneri 2a str. 301
cacgacgucuccauca

SEQ ID NO: 1996889 - RNA, 21 nt, Shigella flexneri 2a str. 301
cacgacgucuccaucaauaca

SEQ ID NO: 1996890 - RNA, 14 nt, Shigella flexneri 2a str. 301
cacgaguguuacgc

SEQ ID NO: 1996891 - RNA, 19 nt, Shigella flexneri 2a str. 301
cacgauaaguuugcgcauc

SEQ ID NO: 1996892 - RNA, 16 nt, Shigella flexneri 2a str. 301
cacgaccuacgcgccc

SEQ ID NO: 1996893 - RNA, 20 nt, Shigella flexneri 2a str. 301
cacgaccuguaccuucagcg

SEQ ID NO: 1996894 - RNA, 15 nt, Shigella flexneri 2a str. 301
cacggcauaagccgu

SEQ ID NO: 1996895 - RNA, 14 nt, Shigella flexneri 2a str. 301
cacggcaugaaagc

SEQ ID NO: 1996896 - RNA, 18 nt, Shigella flexneri 2a str. 301
cacggcagcaacuuaauc

SEQ ID NO: 1996897 - RNA, 18 nt, Shigella flexneri 2a str. 301
cacggaaucaccgccacg

SEQ ID NO: 1996898 - RNA, 22 nt, Shigella flexneri 2a str. 301
cacgcuuuacaauauccagcgc

SEQ ID NO: 1996899 - RNA, 17 nt, Shigella flexneri 2a str. 301
cacggaaagcagcauac

SEQ ID NO: 1996900 - RNA, 15 nt, Shigella flexneri 2a str. 301
cacggccacucugcc

SEQ ID NO: 1996901 - RNA, 20 nt, Shigella flexneri 2a str. 301
cacggccacagccagccaac

SEQ ID NO: 1996902 - RNA, 15 nt, Shigella flexneri 2a str. 301
cacggcguggcauca

SEQ ID NO: 1996903 - RNA, 15 nt, Shigella flexneri 2a str. 301
cacggcuccagcaau

SEQ ID NO: 1996904 - RNA, 15 nt, Shigella flexneri 2a str. 301
cacgcugcaucgcca

SEQ ID NO: 1996905 - RNA, 21 nt, Shigella flexneri 2a str. 301
cacgcugucuggcgucuccug

SEQ ID NO: 1996906 - RNA, 13 nt, Shigella flexneri 2a str. 301
cacgcucuguucu

SEQ ID NO: 1996907 - RNA, 14 nt, Shigella flexneri 2a str. 301
cacgcucuguucug

SEQ ID NO: 1996908 - RNA, 15 nt, Shigella flexneri 2a str. 301
cacgucaucagcaau

SEQ ID NO: 1996909 - RNA, 13 nt, Shigella flexneri 2a str. 301
cacgucauccccc

SEQ ID NO: 1996910 - RNA, 18 nt, Shigella flexneri 2a str. 301
cacguccgguggcauccg

SEQ ID NO: 1996911 - RNA, 22 nt, Shigella flexneri 2a str. 301
cacguccccuggggagugaccu

SEQ ID NO: 1996912 - RNA, 17 nt, Shigella flexneri 2a str. 301
cacguauaaacaucuuu

SEQ ID NO: 1996913 - RNA, 17 nt, Shigella flexneri 2a str. 301
cacguaccaaaacacca

SEQ ID NO: 1996914 - RNA, 13 nt, Shigella flexneri 2a str. 301
cacguaccagaug

SEQ ID NO: 1996915 - RNA, 19 nt, Shigella flexneri 2a str. 301
cacggugcuccagugcgcu

SEQ ID NO: 1996916 - RNA, 23 nt, Shigella flexneri 2a str. 301
cacggugaagaagcggaaaucac

SEQ ID NO: 1996917 - RNA, 23 nt, Shigella flexneri 2a str. 301
cacgguauuaggcauauccuaua

SEQ ID NO: 1996918 - RNA, 12 nt, Shigella flexneri 2a str. 301
caaacaucaucc

SEQ ID NO: 1996919 - RNA, 18 nt, Shigella flexneri 2a str. 301
caaacaguucugcagcgu

SEQ ID NO: 1996920 - RNA, 22 nt, Shigella flexneri 2a str. 301
caaacagcgccagauagccgac

SEQ ID NO: 1996921 - RNA, 17 nt, Shigella flexneri 2a str. 301
caaacaggcugcugcug

SEQ ID NO: 1996922 - RNA, 19 nt, Shigella flexneri 2a str. 301
caaacagucgcccgaccau

SEQ ID NO: 1996923 - RNA, 17 nt, Shigella flexneri 2a str. 301
caaacagucgcccgacc

SEQ ID NO: 1996924 - RNA, 23 nt, Shigella flexneri 2a str. 301
caaacaguguuuugacauuggca

SEQ ID NO: 1996925 - RNA, 22 nt, Shigella flexneri 2a str. 301
caaacagugaccaucuuccagc

SEQ ID NO: 1996926 - RNA, 16 nt, Shigella flexneri 2a str. 301
caaacagaauauugug

SEQ ID NO: 1996927 - RNA, 22 nt, Shigella flexneri 2a str. 301
caaacacugaaccgaaauggcu

SEQ ID NO: 1996928 - RNA, 16 nt, Shigella flexneri 2a str. 301
caaacagcagaacgac

SEQ ID NO: 1996929 - RNA, 13 nt, Shigella flexneri 2a str. 301
caaacagcagaac

SEQ ID NO: 1996930 - RNA, 12 nt, Shigella flexneri 2a str. 301
caaacaccagcg

SEQ ID NO: 1996931 - RNA, 18 nt, Shigella flexneri 2a str. 301
caaacaccgaaccagaga

SEQ ID NO: 1996932 - RNA, 16 nt, Shigella flexneri 2a str. 301
caaacauugcugccag

SEQ ID NO: 1996933 - RNA, 18 nt, Shigella flexneri 2a str. 301
caaacauggaaaccauca

SEQ ID NO: 1996934 - RNA, 22 nt, Shigella flexneri 2a str. 301
caaacgacacugcucgcagaaa

SEQ ID NO: 1996935 - RNA, 15 nt, Shigella flexneri 2a str. 301
caaacccugagcggu

SEQ ID NO: 1996936 - RNA, 17 nt, Shigella flexneri 2a str. 301
caaacgcucccugccag

SEQ ID NO: 1996937 - RNA, 18 nt, Shigella flexneri 2a str. 301
caaacgcucccugccagu

SEQ ID NO: 1996938 - RNA, 19 nt, Shigella flexneri 2a str. 301
caaacgcugacauauuuuu

SEQ ID NO: 1996939 - RNA, 18 nt, Shigella flexneri 2a str. 301
caaacgccuagaugcuca

SEQ ID NO: 1996940 - RNA, 15 nt, Shigella flexneri 2a str. 301
caaacgauaaaagug

SEQ ID NO: 1996941 - RNA, 17 nt, Shigella flexneri 2a str. 301
caaacgauucaaaagau

SEQ ID NO: 1996942 - RNA, 17 nt, Shigella flexneri 2a str. 301
caaacgacgagcgcugg

SEQ ID NO: 1996943 - RNA, 15 nt, Shigella flexneri 2a str. 301
caaacgcaaaacugc

SEQ ID NO: 1996944 - RNA, 17 nt, Shigella flexneri 2a str. 301
caaacgccacagcaauu

SEQ ID NO: 1996945 - RNA, 19 nt, Shigella flexneri 2a str. 301
caaacaauuuucauugaaa

SEQ ID NO: 1996946 - RNA, 16 nt, Shigella flexneri 2a str. 301
caaacacaauauucau

SEQ ID NO: 1996947 - RNA, 19 nt, Shigella flexneri 2a str. 301
caaacacaggcaaaacacu

SEQ ID NO: 1996948 - RNA, 22 nt, Shigella flexneri 2a str. 301
caaaauggacgcaacuuccccu

SEQ ID NO: 1996949 - RNA, 22 nt, Shigella flexneri 2a str. 301
caaaaugauugcguuaacugcu

SEQ ID NO: 1996950 - RNA, 21 nt, Shigella flexneri 2a str. 301
caaaaucaggccgaggcacag

SEQ ID NO: 1996951 - RNA, 11 nt, Shigella flexneri 2a str. 301
caaaaucauca

SEQ ID NO: 1996952 - RNA, 20 nt, Shigella flexneri 2a str. 301
caaaaucaucaucuuuauau

SEQ ID NO: 1996953 - RNA, 13 nt, Shigella flexneri 2a str. 301
caaaauaaaaauc

SEQ ID NO: 1996954 - RNA, 14 nt, Shigella flexneri 2a str. 301
caaagugcccccaa

SEQ ID NO: 1996955 - RNA, 13 nt, Shigella flexneri 2a str. 301
caaagugccccca

SEQ ID NO: 1996956 - RNA, 19 nt, Shigella flexneri 2a str. 301
caaagguuuccucaugcau

SEQ ID NO: 1996957 - RNA, 13 nt, Shigella flexneri 2a str. 301
caaauaaaauccc

SEQ ID NO: 1996958 - RNA, 12 nt, Shigella flexneri 2a str. 301
caaauaaaacau

SEQ ID NO: 1996959 - RNA, 21 nt, Shigella flexneri 2a str. 301
caaauaaccgguauuacucca

SEQ ID NO: 1996960 - RNA, 19 nt, Shigella flexneri 2a str. 301
caaauaaauagauccagga

SEQ ID NO: 1996961 - RNA, 14 nt, Shigella flexneri 2a str. 301
caaauacugacugg

SEQ ID NO: 1996962 - RNA, 17 nt, Shigella flexneri 2a str. 301
caaauacccaaaaaaua

SEQ ID NO: 1996963 - RNA, 14 nt, Shigella flexneri 2a str. 301
caaauaauuccugc

SEQ ID NO: 1996964 - RNA, 22 nt, Shigella flexneri 2a str. 301
caaacugcgcgagcgucauaua

SEQ ID NO: 1996965 - RNA, 13 nt, Shigella flexneri 2a str. 301
caaacucuuuucc

SEQ ID NO: 1996966 - RNA, 19 nt, Shigella flexneri 2a str. 301
caaacuccgugaagcucac

SEQ ID NO: 1996967 - RNA, 17 nt, Shigella flexneri 2a str. 301
caaacuaucuguguaau

SEQ ID NO: 1996968 - RNA, 13 nt, Shigella flexneri 2a str. 301
caaacuaucccag

SEQ ID NO: 1996969 - RNA, 19 nt, Shigella flexneri 2a str. 301
caaacugguauugagcgac

SEQ ID NO: 1996970 - RNA, 22 nt, Shigella flexneri 2a str. 301
caaacugguauugagcgaccgc

SEQ ID NO: 1996971 - RNA, 15 nt, Shigella flexneri 2a str. 301
caaagagagaagcca

SEQ ID NO: 1996972 - RNA, 19 nt, Shigella flexneri 2a str. 301
caaacugcucguucagcac

SEQ ID NO: 1996973 - RNA, 17 nt, Shigella flexneri 2a str. 301
caaagcuguaucccagc

SEQ ID NO: 1996974 - RNA, 16 nt, Shigella flexneri 2a str. 301
caaagcagggcuggca

SEQ ID NO: 1996975 - RNA, 17 nt, Shigella flexneri 2a str. 301
caaagcagaaacccauu

SEQ ID NO: 1996976 - RNA, 13 nt, Shigella flexneri 2a str. 301
caaagccaacagc

SEQ ID NO: 1996977 - RNA, 15 nt, Shigella flexneri 2a str. 301
caaagccaacagcag

SEQ ID NO: 1996978 - RNA, 23 nt, Shigella flexneri 2a str. 301
caaagcccacgccaucauaccca

SEQ ID NO: 1996979 - RNA, 16 nt, Shigella flexneri 2a str. 301
caaauagccagcagag

SEQ ID NO: 1996980 - RNA, 15 nt, Shigella flexneri 2a str. 301
caaauagccugccag

SEQ ID NO: 1996981 - RNA, 15 nt, Shigella flexneri 2a str. 301
caaauagacacaaga

SEQ ID NO: 1996982 - RNA, 15 nt, Shigella flexneri 2a str. 301
caaaugcaucaguga

SEQ ID NO: 1996983 - RNA, 21 nt, Shigella flexneri 2a str. 301
caaaugcaucagugacaaauu

SEQ ID NO: 1996984 - RNA, 21 nt, Shigella flexneri 2a str. 301
caaaugcgcuuuauucagacg

SEQ ID NO: 1996985 - RNA, 15 nt, Shigella flexneri 2a str. 301
caaaugcgccgccaa

SEQ ID NO: 1996986 - RNA, 14 nt, Shigella flexneri 2a str. 301
caaaugcgcagcca

SEQ ID NO: 1996987 - RNA, 20 nt, Shigella flexneri 2a str. 301
caaauuacgauccaccaccg

SEQ ID NO: 1996988 - RNA, 18 nt, Shigella flexneri 2a str. 301
caaauugcaccauccauu

SEQ ID NO: 1996989 - RNA, 16 nt, Shigella flexneri 2a str. 301
caaauugacuacacca

SEQ ID NO: 1996990 - RNA, 19 nt, Shigella flexneri 2a str. 301
caaauucuuuaucgauaaa

SEQ ID NO: 1996991 - RNA, 22 nt, Shigella flexneri 2a str. 301
caaauugcaccauccauuuuuc

SEQ ID NO: 1996992 - RNA, 21 nt, Shigella flexneri 2a str. 301
caaauuuggcaucgaggaucu

SEQ ID NO: 1996993 - RNA, 17 nt, Shigella flexneri 2a str. 301
caaauuugugcucuggc

SEQ ID NO: 1996994 - RNA, 18 nt, Shigella flexneri 2a str. 301
caaauuuugaacagaacu

SEQ ID NO: 1996995 - RNA, 15 nt, Shigella flexneri 2a str. 301
caaauuuugaacaga

SEQ ID NO: 1996996 - RNA, 17 nt, Shigella flexneri 2a str. 301
caaauuuugaacagaac

SEQ ID NO: 1996997 - RNA, 18 nt, Shigella flexneri 2a str. 301
caacaacagucucugccg

SEQ ID NO: 1996998 - RNA, 17 nt, Shigella flexneri 2a str. 301
caacaaccagaagguga

SEQ ID NO: 1996999 - RNA, 15 nt, Shigella flexneri 2a str. 301
caacaacugaaaaaa

SEQ ID NO: 1997000 - RNA, 12 nt, Shigella flexneri 2a str. 301
caacaacugaaa

SEQ ID NO: 1997001 - RNA, 15 nt, Shigella flexneri 2a str. 301
caacaauaaaauuga

SEQ ID NO: 1997002 - RNA, 13 nt, Shigella flexneri 2a str. 301
caacaauagugcc

SEQ ID NO: 1997003 - RNA, 22 nt, Shigella flexneri 2a str. 301
caacaauugaagaauaucuucu

SEQ ID NO: 1997004 - RNA, 21 nt, Shigella flexneri 2a str. 301
caacaauucccgcagcuccag

SEQ ID NO: 1997005 - RNA, 15 nt, Shigella flexneri 2a str. 301
caacaaucucuucca

SEQ ID NO: 1997006 - RNA, 15 nt, Shigella flexneri 2a str. 301
caacaaugccacgcc

SEQ ID NO: 1997007 - RNA, 22 nt, Shigella flexneri 2a str. 301
caacaaucucuuccagaauauc

SEQ ID NO: 1997008 - RNA, 16 nt, Shigella flexneri 2a str. 301
caacacaauuuguggc

SEQ ID NO: 1997009 - RNA, 22 nt, Shigella flexneri 2a str. 301
caacacacugaauaaaaaugug

SEQ ID NO: 1997010 - RNA, 12 nt, Shigella flexneri 2a str. 301
caacagaaauaa

SEQ ID NO: 1997011 - RNA, 15 nt, Shigella flexneri 2a str. 301
caacacucucugaag

SEQ ID NO: 1997012 - RNA, 23 nt, Shigella flexneri 2a str. 301
caacacgccagcguuaucccauc

SEQ ID NO: 1997013 - RNA, 19 nt, Shigella flexneri 2a str. 301
caacacauuacugcuugcu

SEQ ID NO: 1997014 - RNA, 20 nt, Shigella flexneri 2a str. 301
caacacaucgauaagguuau

SEQ ID NO: 1997015 - RNA, 23 nt, Shigella flexneri 2a str. 301
caacaccgggugcagacaugacg

SEQ ID NO: 1997016 - RNA, 18 nt, Shigella flexneri 2a str. 301
caacgacauacucagcgc

SEQ ID NO: 1997017 - RNA, 22 nt, Shigella flexneri 2a str. 301
caacgacauacucagcgccugc

SEQ ID NO: 1997018 - RNA, 12 nt, Shigella flexneri 2a str. 301
caacgacggcca

SEQ ID NO: 1997019 - RNA, 16 nt, Shigella flexneri 2a str. 301
caacgauucaagaaac

SEQ ID NO: 1997020 - RNA, 19 nt, Shigella flexneri 2a str. 301
caacgaugacaucgcagca

SEQ ID NO: 1997021 - RNA, 18 nt, Shigella flexneri 2a str. 301
caacgcaaagagagaagc

SEQ ID NO: 1997022 - RNA, 20 nt, Shigella flexneri 2a str. 301
caacgcaaagagagaagcca

SEQ ID NO: 1997023 - RNA, 22 nt, Shigella flexneri 2a str. 301
caacgcaauauccgccacuucu

SEQ ID NO: 1997024 - RNA, 16 nt, Shigella flexneri 2a str. 301
caacgcaauccccucu

SEQ ID NO: 1997025 - RNA, 14 nt, Shigella flexneri 2a str. 301
caacgccagcagca

SEQ ID NO: 1997026 - RNA, 15 nt, Shigella flexneri 2a str. 301
caacgccagcagcag

SEQ ID NO: 1997027 - RNA, 16 nt, Shigella flexneri 2a str. 301
caacgccagcagcagc

SEQ ID NO: 1997028 - RNA, 13 nt, Shigella flexneri 2a str. 301
caacgaagaaaac

SEQ ID NO: 1997029 - RNA, 20 nt, Shigella flexneri 2a str. 301
caaccuuguuucugagcaug

SEQ ID NO: 1997030 - RNA, 13 nt, Shigella flexneri 2a str. 301
caaccugcuggaa

SEQ ID NO: 1997031 - RNA, 19 nt, Shigella flexneri 2a str. 301
caaccugcuuuaaaagcuc

SEQ ID NO: 1997032 - RNA, 20 nt, Shigella flexneri 2a str. 301
caaccuucuucuuucaguac

SEQ ID NO: 1997033 - RNA, 15 nt, Shigella flexneri 2a str. 301
caaccgcaaaugauu

SEQ ID NO: 1997034 - RNA, 14 nt, Shigella flexneri 2a str. 301
caaccgcgacuggg

SEQ ID NO: 1997035 - RNA, 19 nt, Shigella flexneri 2a str. 301
caaccugcacgaaaccacu

SEQ ID NO: 1997036 - RNA, 20 nt, Shigella flexneri 2a str. 301
caaccugcacguuaucagac

SEQ ID NO: 1997037 - RNA, 17 nt, Shigella flexneri 2a str. 301
caaccgcgguacgccau

SEQ ID NO: 1997038 - RNA, 15 nt, Shigella flexneri 2a str. 301
caaccaacggccuug

SEQ ID NO: 1997039 - RNA, 14 nt, Shigella flexneri 2a str. 301
caaccaacggccuu

SEQ ID NO: 1997040 - RNA, 13 nt, Shigella flexneri 2a str. 301
caacauaaccuga

SEQ ID NO: 1997041 - RNA, 18 nt, Shigella flexneri 2a str. 301
caacauacuguaacugcg

SEQ ID NO: 1997042 - RNA, 15 nt, Shigella flexneri 2a str. 301
caacaggcgguaacc

SEQ ID NO: 1997043 - RNA, 20 nt, Shigella flexneri 2a str. 301
caacagggcgauuugcuccc

SEQ ID NO: 1997044 - RNA, 20 nt, Shigella flexneri 2a str. 301
caaccaauucuccaaugccg

SEQ ID NO: 1997045 - RNA, 12 nt, Shigella flexneri 2a str. 301
caaccaaucgcg

SEQ ID NO: 1997046 - RNA, 20 nt, Shigella flexneri 2a str. 301
caaccacaaaacacucuuca

SEQ ID NO: 1997047 - RNA, 12 nt, Shigella flexneri 2a str. 301
caaccacauuca

SEQ ID NO: 1997048 - RNA, 17 nt, Shigella flexneri 2a str. 301
caaccaccggcaccacu

SEQ ID NO: 1997049 - RNA, 15 nt, Shigella flexneri 2a str. 301
caaccagauaaccau

SEQ ID NO: 1997050 - RNA, 17 nt, Shigella flexneri 2a str. 301
caaccgauaucuuuccg

SEQ ID NO: 1997051 - RNA, 18 nt, Shigella flexneri 2a str. 301
caaucccuuaguaacgcc

SEQ ID NO: 1997052 - RNA, 23 nt, Shigella flexneri 2a str. 301
caaucaugauugaaugucugucu

SEQ ID NO: 1997053 - RNA, 16 nt, Shigella flexneri 2a str. 301
caaucauauucaccac

SEQ ID NO: 1997054 - RNA, 12 nt, Shigella flexneri 2a str. 301
caauauuuaaau

SEQ ID NO: 1997055 - RNA, 20 nt, Shigella flexneri 2a str. 301
caaucgguucgccugcacca

SEQ ID NO: 1997056 - RNA, 14 nt, Shigella flexneri 2a str. 301
caaucucagcaaga

SEQ ID NO: 1997057 - RNA, 15 nt, Shigella flexneri 2a str. 301
caaucggcuuuuuau

SEQ ID NO: 1997058 - RNA, 21 nt, Shigella flexneri 2a str. 301
caaucucugguuuguuuucag

SEQ ID NO: 1997059 - RNA, 16 nt, Shigella flexneri 2a str. 301
caaucguagcccagcu

SEQ ID NO: 1997060 - RNA, 20 nt, Shigella flexneri 2a str. 301
caaucucguggucaauauua

SEQ ID NO: 1997061 - RNA, 14 nt, Shigella flexneri 2a str. 301
caauccucuuuucc

SEQ ID NO: 1997062 - RNA, 20 nt, Shigella flexneri 2a str. 301
caaugaguggugaaaaaaag

SEQ ID NO: 1997063 - RNA, 22 nt, Shigella flexneri 2a str. 301
caaugaguggugaaaaaaaggc

SEQ ID NO: 1997064 - RNA, 17 nt, Shigella flexneri 2a str. 301
caaugaguucgcgcgcu

SEQ ID NO: 1997065 - RNA, 18 nt, Shigella flexneri 2a str. 301
caaugaguggugaaaaaa

SEQ ID NO: 1997066 - RNA, 14 nt, Shigella flexneri 2a str. 301
caaugauucaggca

SEQ ID NO: 1997067 - RNA, 20 nt, Shigella flexneri 2a str. 301
caaugaaagccccaccagca

SEQ ID NO: 1997068 - RNA, 15 nt, Shigella flexneri 2a str. 301
caaugaagcccgcug

SEQ ID NO: 1997069 - RNA, 19 nt, Shigella flexneri 2a str. 301
caaugaaauugguacagca

SEQ ID NO: 1997070 - RNA, 21 nt, Shigella flexneri 2a str. 301
caaugagagggcgauaaaucu

SEQ ID NO: 1997071 - RNA, 16 nt, Shigella flexneri 2a str. 301
caaucucuuuuuccac

SEQ ID NO: 1997072 - RNA, 18 nt, Shigella flexneri 2a str. 301
caaucucuuuuuccaccg

SEQ ID NO: 1997073 - RNA, 23 nt, Shigella flexneri 2a str. 301
caaucuuguucucagcacauuga

SEQ ID NO: 1997074 - RNA, 13 nt, Shigella flexneri 2a str. 301
caaugcaguucca

SEQ ID NO: 1997075 - RNA, 17 nt, Shigella flexneri 2a str. 301
caaugcaggcaccugcc

SEQ ID NO: 1997076 - RNA, 13 nt, Shigella flexneri 2a str. 301
caaugccacaaac

SEQ ID NO: 1997077 - RNA, 15 nt, Shigella flexneri 2a str. 301
caaugccacaaacgc

SEQ ID NO: 1997078 - RNA, 18 nt, Shigella flexneri 2a str. 301
caaugccaccaauaauga

SEQ ID NO: 1997079 - RNA, 18 nt, Shigella flexneri 2a str. 301
caaugcgcguaauuugcg

SEQ ID NO: 1997080 - RNA, 22 nt, Shigella flexneri 2a str. 301
caaugcguagcugagcaacaaa

SEQ ID NO: 1997081 - RNA, 19 nt, Shigella flexneri 2a str. 301
caaugcgcaucaaagccag

SEQ ID NO: 1997082 - RNA, 14 nt, Shigella flexneri 2a str. 301
caaugcgcaucaaa

SEQ ID NO: 1997083 - RNA, 16 nt, Shigella flexneri 2a str. 301
caaugcccgguguucc

SEQ ID NO: 1997084 - RNA, 23 nt, Shigella flexneri 2a str. 301
caaugccugaugcgcuucgcuua

SEQ ID NO: 1997085 - RNA, 19 nt, Shigella flexneri 2a str. 301
caaguaauucauucacgcu

SEQ ID NO: 1997086 - RNA, 23 nt, Shigella flexneri 2a str. 301
caaguaauagaacuauaauugcu

SEQ ID NO: 1997087 - RNA, 12 nt, Shigella flexneri 2a str. 301
caaguacggcaa

SEQ ID NO: 1997088 - RNA, 17 nt, Shigella flexneri 2a str. 301
caaguaacugacaccga

SEQ ID NO: 1997089 - RNA, 18 nt, Shigella flexneri 2a str. 301
caaguaaaaggagauaaa

SEQ ID NO: 1997090 - RNA, 12 nt, Shigella flexneri 2a str. 301
caauaaauuccc

SEQ ID NO: 1997091 - RNA, 15 nt, Shigella flexneri 2a str. 301
caauaaauuccccgc

SEQ ID NO: 1997092 - RNA, 16 nt, Shigella flexneri 2a str. 301
caauaaauugcaggaa

SEQ ID NO: 1997093 - RNA, 19 nt, Shigella flexneri 2a str. 301
caaguucuucgaagcacuc

SEQ ID NO: 1997094 - RNA, 18 nt, Shigella flexneri 2a str. 301
caauaacccgcuguaaau

SEQ ID NO: 1997095 - RNA, 21 nt, Shigella flexneri 2a str. 301
caauaacccgcuguaaaugcu

SEQ ID NO: 1997096 - RNA, 13 nt, Shigella flexneri 2a str. 301
caauaaccaucag

SEQ ID NO: 1997097 - RNA, 14 nt, Shigella flexneri 2a str. 301
caauaaccaucagc

SEQ ID NO: 1997098 - RNA, 17 nt, Shigella flexneri 2a str. 301
caauaaccggcacuuca

SEQ ID NO: 1997099 - RNA, 17 nt, Shigella flexneri 2a str. 301
caauaacacgcuaccac

SEQ ID NO: 1997100 - RNA, 12 nt, Shigella flexneri 2a str. 301
caauaacuccau

SEQ ID NO: 1997101 - RNA, 18 nt, Shigella flexneri 2a str. 301
caauaagauaacccugca

SEQ ID NO: 1997102 - RNA, 21 nt, Shigella flexneri 2a str. 301
caauaaucucuacaccaacgc

SEQ ID NO: 1997103 - RNA, 23 nt, Shigella flexneri 2a str. 301
caauaaucucuuuacccagcgga

SEQ ID NO: 1997104 - RNA, 14 nt, Shigella flexneri 2a str. 301
caauaaucugauuu

SEQ ID NO: 1997105 - RNA, 17 nt, Shigella flexneri 2a str. 301
caauaaucgccuuaccc

SEQ ID NO: 1997106 - RNA, 21 nt, Shigella flexneri 2a str. 301
caauaaucaucucuccuuucg

SEQ ID NO: 1997107 - RNA, 17 nt, Shigella flexneri 2a str. 301
caauacaucaauuuucc

SEQ ID NO: 1997108 - RNA, 16 nt, Shigella flexneri 2a str. 301
caauauuaaucccugc

SEQ ID NO: 1997109 - RNA, 15 nt, Shigella flexneri 2a str. 301
caauauuaucgauuu

SEQ ID NO: 1997110 - RNA, 13 nt, Shigella flexneri 2a str. 301
caauaugcauaaa

SEQ ID NO: 1997111 - RNA, 14 nt, Shigella flexneri 2a str. 301
caauagcguuaauu

SEQ ID NO: 1997112 - RNA, 22 nt, Shigella flexneri 2a str. 301
caauagcguuaauucgcuaaca

SEQ ID NO: 1997113 - RNA, 17 nt, Shigella flexneri 2a str. 301
caauagcuaacgaaaga

SEQ ID NO: 1997114 - RNA, 18 nt, Shigella flexneri 2a str. 301
caauagcuaacgaaagaa

SEQ ID NO: 1997115 - RNA, 16 nt, Shigella flexneri 2a str. 301
caauagucguguuauc

SEQ ID NO: 1997116 - RNA, 15 nt, Shigella flexneri 2a str. 301
caauaguaaccagac

SEQ ID NO: 1997117 - RNA, 19 nt, Shigella flexneri 2a str. 301
caauaccgccugcaaauaa

SEQ ID NO: 1997118 - RNA, 20 nt, Shigella flexneri 2a str. 301
caauaccgccugcaaauaaa

SEQ ID NO: 1997119 - RNA, 20 nt, Shigella flexneri 2a str. 301
caauacccguccacacggca

SEQ ID NO: 1997120 - RNA, 21 nt, Shigella flexneri 2a str. 301
caauaccgcccaccaccagcg

SEQ ID NO: 1997121 - RNA, 16 nt, Shigella flexneri 2a str. 301
caauaccgccugcaaa

SEQ ID NO: 1997122 - RNA, 11 nt, Shigella flexneri 2a str. 301
caauacuggca

SEQ ID NO: 1997123 - RNA, 20 nt, Shigella flexneri 2a str. 301
caauacuggcagcagucgca

SEQ ID NO: 1997124 - RNA, 20 nt, Shigella flexneri 2a str. 301
caauacugacaucagcaucc

SEQ ID NO: 1997125 - RNA, 16 nt, Shigella flexneri 2a str. 301
caauacccgcaacaau

SEQ ID NO: 1997126 - RNA, 14 nt, Shigella flexneri 2a str. 301
caauagcaacugau

SEQ ID NO: 1997127 - RNA, 18 nt, Shigella flexneri 2a str. 301
caauagacaguucuuccu

SEQ ID NO: 1997128 - RNA, 23 nt, Shigella flexneri 2a str. 301
caauacuuucacaaaaauaauuu

SEQ ID NO: 1997129 - RNA, 21 nt, Shigella flexneri 2a str. 301
caauacuuucacaaaaauaau

SEQ ID NO: 1997130 - RNA, 23 nt, Shigella flexneri 2a str. 301
caaggugcgcgaugcuuucccac

SEQ ID NO: 1997131 - RNA, 20 nt, Shigella flexneri 2a str. 301
caagguaucgguugcuggau

SEQ ID NO: 1997132 - RNA, 21 nt, Shigella flexneri 2a str. 301
caagguugaagguggcgaagu

SEQ ID NO: 1997133 - RNA, 17 nt, Shigella flexneri 2a str. 301
caagggugagggaggau

SEQ ID NO: 1997134 - RNA, 16 nt, Shigella flexneri 2a str. 301
caaggguaagggagga

SEQ ID NO: 1997135 - RNA, 16 nt, Shigella flexneri 2a str. 301
caaggcuauucagcag

SEQ ID NO: 1997136 - RNA, 22 nt, Shigella flexneri 2a str. 301
caaggcgaggggaccgccccug

SEQ ID NO: 1997137 - RNA, 17 nt, Shigella flexneri 2a str. 301
caaggaagccugacagg

SEQ ID NO: 1997138 - RNA, 22 nt, Shigella flexneri 2a str. 301
caaggaaacuaaacgccgcgcc

SEQ ID NO: 1997139 - RNA, 21 nt, Shigella flexneri 2a str. 301
caaggaagccugacagggaag

SEQ ID NO: 1997140 - RNA, 12 nt, Shigella flexneri 2a str. 301
caaggaaauaau

SEQ ID NO: 1997141 - RNA, 24 nt, Shigella flexneri 2a str. 301
caagcggugcgaugccuggcaaug

SEQ ID NO: 1997142 - RNA, 15 nt, Shigella flexneri 2a str. 301
caagcggugcgaugc

SEQ ID NO: 1997143 - RNA, 19 nt, Shigella flexneri 2a str. 301
caagcgucgcaucaggcau

SEQ ID NO: 1997144 - RNA, 21 nt, Shigella flexneri 2a str. 301
caagcgucgcaucaggcaugg

SEQ ID NO: 1997145 - RNA, 23 nt, Shigella flexneri 2a str. 301
caagcccguguuucugauacagc

SEQ ID NO: 1997146 - RNA, 13 nt, Shigella flexneri 2a str. 301
caagcgcugagac

SEQ ID NO: 1997147 - RNA, 19 nt, Shigella flexneri 2a str. 301
caagcgcugagacgcgcuu

SEQ ID NO: 1997148 - RNA, 18 nt, Shigella flexneri 2a str. 301
caagcccagcacccagua

SEQ ID NO: 1997149 - RNA, 14 nt, Shigella flexneri 2a str. 301
caagcccagccccc

SEQ ID NO: 1997150 - RNA, 13 nt, Shigella flexneri 2a str. 301
caagcaaaugaau

SEQ ID NO: 1997151 - RNA, 15 nt, Shigella flexneri 2a str. 301
caagcaaggccaggu

SEQ ID NO: 1997152 - RNA, 21 nt, Shigella flexneri 2a str. 301
caagcaaacccgaccaccauu

SEQ ID NO: 1997153 - RNA, 23 nt, Shigella flexneri 2a str. 301
caagcaaggccagguuuucuuuc

SEQ ID NO: 1997154 - RNA, 17 nt, Shigella flexneri 2a str. 301
caagauugauccccgcu

SEQ ID NO: 1997155 - RNA, 15 nt, Shigella flexneri 2a str. 301
caagagugaacacgu

SEQ ID NO: 1997156 - RNA, 14 nt, Shigella flexneri 2a str. 301
caagagguaaauuu

SEQ ID NO: 1997157 - RNA, 23 nt, Shigella flexneri 2a str. 301
caagaggguuauuuguucagcaa

SEQ ID NO: 1997158 - RNA, 15 nt, Shigella flexneri 2a str. 301
caacuuuaucuucga

SEQ ID NO: 1997159 - RNA, 19 nt, Shigella flexneri 2a str. 301
caacuucucuuucggcagu

SEQ ID NO: 1997160 - RNA, 21 nt, Shigella flexneri 2a str. 301
caacuuuaucuucgagauucu

SEQ ID NO: 1997161 - RNA, 16 nt, Shigella flexneri 2a str. 301
caacuuucuuggcacc

SEQ ID NO: 1997162 - RNA, 13 nt, Shigella flexneri 2a str. 301
caacuuuguucug

SEQ ID NO: 1997163 - RNA, 17 nt, Shigella flexneri 2a str. 301
caacuuuguucugaauc

SEQ ID NO: 1997164 - RNA, 18 nt, Shigella flexneri 2a str. 301
caacuuuguucugaauca

SEQ ID NO: 1997165 - RNA, 20 nt, Shigella flexneri 2a str. 301
caacuuuguucugaaucacg

SEQ ID NO: 1997166 - RNA, 17 nt, Shigella flexneri 2a str. 301
caagaaaauuauucgcc

SEQ ID NO: 1997167 - RNA, 16 nt, Shigella flexneri 2a str. 301
caagaaacagcaguuc

SEQ ID NO: 1997168 - RNA, 12 nt, Shigella flexneri 2a str. 301
caagaaagagcg

SEQ ID NO: 1997169 - RNA, 20 nt, Shigella flexneri 2a str. 301
caagaaagagcgucuggaag

SEQ ID NO: 1997170 - RNA, 14 nt, Shigella flexneri 2a str. 301
caagaacgaugauu

SEQ ID NO: 1997171 - RNA, 21 nt, Shigella flexneri 2a str. 301
caagaacgcauaccccaucag

SEQ ID NO: 1997172 - RNA, 22 nt, Shigella flexneri 2a str. 301
caagaacgcauaccccaucagc

SEQ ID NO: 1997173 - RNA, 20 nt, Shigella flexneri 2a str. 301
caagacgaauaccuucuucc

SEQ ID NO: 1997174 - RNA, 16 nt, Shigella flexneri 2a str. 301
caagacgaaaaaugaa

SEQ ID NO: 1997175 - RNA, 17 nt, Shigella flexneri 2a str. 301
caagacgaaaaaugaau

SEQ ID NO: 1997176 - RNA, 19 nt, Shigella flexneri 2a str. 301
caagacgucgcgaauggcc

SEQ ID NO: 1997177 - RNA, 14 nt, Shigella flexneri 2a str. 301
caacgccaucgcca

SEQ ID NO: 1997178 - RNA, 17 nt, Shigella flexneri 2a str. 301
caacgccccuucugccg

SEQ ID NO: 1997179 - RNA, 16 nt, Shigella flexneri 2a str. 301
caacgccccuucugcc

SEQ ID NO: 1997180 - RNA, 15 nt, Shigella flexneri 2a str. 301
caacgcccaucaaca

SEQ ID NO: 1997181 - RNA, 15 nt, Shigella flexneri 2a str. 301
caacuacguuuuuau

SEQ ID NO: 1997182 - RNA, 13 nt, Shigella flexneri 2a str. 301
caacuccgccagc

SEQ ID NO: 1997183 - RNA, 16 nt, Shigella flexneri 2a str. 301
caacucccuauaguag

SEQ ID NO: 1997184 - RNA, 19 nt, Shigella flexneri 2a str. 301
caacuccccgcauuuacuc

SEQ ID NO: 1997185 - RNA, 12 nt, Shigella flexneri 2a str. 301
caacugacugac

SEQ ID NO: 1997186 - RNA, 22 nt, Shigella flexneri 2a str. 301
caacuguaacgcagaagguuau

SEQ ID NO: 1997187 - RNA, 19 nt, Shigella flexneri 2a str. 301
caacugggacaugauucau

SEQ ID NO: 1997188 - RNA, 22 nt, Shigella flexneri 2a str. 301
caacuggcuugguaacaugcuc

SEQ ID NO: 1997189 - RNA, 17 nt, Shigella flexneri 2a str. 301
caacuuaagucuccauu

SEQ ID NO: 1997190 - RNA, 21 nt, Shigella flexneri 2a str. 301
caacuucuaauuuuuccagca

SEQ ID NO: 1997191 - RNA, 19 nt, Shigella flexneri 2a str. 301
caacuguugauccaggagc

SEQ ID NO: 1997192 - RNA, 16 nt, Shigella flexneri 2a str. 301
caacugugccgccgcc

SEQ ID NO: 1997193 - RNA, 14 nt, Shigella flexneri 2a str. 301
cagcgccugaugga

SEQ ID NO: 1997194 - RNA, 23 nt, Shigella flexneri 2a str. 301
cagcgcgacgcucggcuguuucu

SEQ ID NO: 1997195 - RNA, 12 nt, Shigella flexneri 2a str. 301
cagcgcgauacg

SEQ ID NO: 1997196 - RNA, 13 nt, Shigella flexneri 2a str. 301
cagcgcgcgcagc

SEQ ID NO: 1997197 - RNA, 19 nt, Shigella flexneri 2a str. 301
cagcgccgacagcagcccu

SEQ ID NO: 1997198 - RNA, 14 nt, Shigella flexneri 2a str. 301
cagcgccgcgccua

SEQ ID NO: 1997199 - RNA, 18 nt, Shigella flexneri 2a str. 301
cagcgccgcgccacuacu

SEQ ID NO: 1997200 - RNA, 14 nt, Shigella flexneri 2a str. 301
cagcgccgcggcgu

SEQ ID NO: 1997201 - RNA, 13 nt, Shigella flexneri 2a str. 301
cagcgcagcaccc

SEQ ID NO: 1997202 - RNA, 20 nt, Shigella flexneri 2a str. 301
cagcgcagaagagcuggggc

SEQ ID NO: 1997203 - RNA, 12 nt, Shigella flexneri 2a str. 301
cagcgccaccac

SEQ ID NO: 1997204 - RNA, 17 nt, Shigella flexneri 2a str. 301
cagcgccaccaccagca

SEQ ID NO: 1997205 - RNA, 18 nt, Shigella flexneri 2a str. 301
cagcgccaccaccagcac

SEQ ID NO: 1997206 - RNA, 16 nt, Shigella flexneri 2a str. 301
cagcgccaccacaaaa

SEQ ID NO: 1997207 - RNA, 22 nt, Shigella flexneri 2a str. 301
cagcgccaacggugaaaaacca

SEQ ID NO: 1997208 - RNA, 13 nt, Shigella flexneri 2a str. 301
cagcgccaaucgc

SEQ ID NO: 1997209 - RNA, 23 nt, Shigella flexneri 2a str. 301
cagcgcaccugugguagcggcuc

SEQ ID NO: 1997210 - RNA, 20 nt, Shigella flexneri 2a str. 301
cagcgagaagucggcuuuua

SEQ ID NO: 1997211 - RNA, 22 nt, Shigella flexneri 2a str. 301
cagcgcaauaccgauaucgcca

SEQ ID NO: 1997212 - RNA, 18 nt, Shigella flexneri 2a str. 301
cagcgacguugauuuugu

SEQ ID NO: 1997213 - RNA, 24 nt, Shigella flexneri 2a str. 301
cagcgacggaugacacgcaggcgu

SEQ ID NO: 1997214 - RNA, 14 nt, Shigella flexneri 2a str. 301
cagcgccaguugcu

SEQ ID NO: 1997215 - RNA, 15 nt, Shigella flexneri 2a str. 301
cagcgcccaacacuu

SEQ ID NO: 1997216 - RNA, 21 nt, Shigella flexneri 2a str. 301
cagcgccauuguguuaucccg

SEQ ID NO: 1997217 - RNA, 13 nt, Shigella flexneri 2a str. 301
cagcgccaucccu

SEQ ID NO: 1997218 - RNA, 23 nt, Shigella flexneri 2a str. 301
cagcgccagcgcgaugcaggcca

SEQ ID NO: 1997219 - RNA, 15 nt, Shigella flexneri 2a str. 301
cagcgccagauagcc

SEQ ID NO: 1997220 - RNA, 18 nt, Shigella flexneri 2a str. 301
cagcgccaccagcgccgc

SEQ ID NO: 1997221 - RNA, 16 nt, Shigella flexneri 2a str. 301
cagccgaacagcgcca

SEQ ID NO: 1997222 - RNA, 20 nt, Shigella flexneri 2a str. 301
cagccgacaaugccacaaac

SEQ ID NO: 1997223 - RNA, 21 nt, Shigella flexneri 2a str. 301
cagcccugccaggucaucauu

SEQ ID NO: 1997224 - RNA, 17 nt, Shigella flexneri 2a str. 301
cagccaugcggcaucuu

SEQ ID NO: 1997225 - RNA, 19 nt, Shigella flexneri 2a str. 301
cagccaucuguuccggcgu

SEQ ID NO: 1997226 - RNA, 15 nt, Shigella flexneri 2a str. 301
cagccaucuuucgca

SEQ ID NO: 1997227 - RNA, 16 nt, Shigella flexneri 2a str. 301
cagccaucuuucgcag

SEQ ID NO: 1997228 - RNA, 14 nt, Shigella flexneri 2a str. 301
cagccauucaaucu

SEQ ID NO: 1997229 - RNA, 14 nt, Shigella flexneri 2a str. 301
cagcccgucucagc

SEQ ID NO: 1997230 - RNA, 20 nt, Shigella flexneri 2a str. 301
cagcccgucucagcgccgcu

SEQ ID NO: 1997231 - RNA, 16 nt, Shigella flexneri 2a str. 301
cagccgaccgcugucc

SEQ ID NO: 1997232 - RNA, 12 nt, Shigella flexneri 2a str. 301
cagccucugccg

SEQ ID NO: 1997233 - RNA, 16 nt, Shigella flexneri 2a str. 301
cagccugaccgcacac

SEQ ID NO: 1997234 - RNA, 15 nt, Shigella flexneri 2a str. 301
cagccugccagcaug

SEQ ID NO: 1997235 - RNA, 20 nt, Shigella flexneri 2a str. 301
cagccugauacaggaaggcc

SEQ ID NO: 1997236 - RNA, 15 nt, Shigella flexneri 2a str. 301
cagccucccauuucc

SEQ ID NO: 1997237 - RNA, 20 nt, Shigella flexneri 2a str. 301
cagccggagguguucauaau

SEQ ID NO: 1997238 - RNA, 15 nt, Shigella flexneri 2a str. 301
cagccggacccacac

SEQ ID NO: 1997239 - RNA, 18 nt, Shigella flexneri 2a str. 301
cagccgcuuuugcgcgua

SEQ ID NO: 1997240 - RNA, 13 nt, Shigella flexneri 2a str. 301
cagccggcaaagu

SEQ ID NO: 1997241 - RNA, 24 nt, Shigella flexneri 2a str. 301
cagcgaagcauucagacacgccgc

SEQ ID NO: 1997242 - RNA, 18 nt, Shigella flexneri 2a str. 301
cagcgaagcccacgccgc

SEQ ID NO: 1997243 - RNA, 15 nt, Shigella flexneri 2a str. 301
cagcgaauccguucu

SEQ ID NO: 1997244 - RNA, 16 nt, Shigella flexneri 2a str. 301
cagcgaauggguugua

SEQ ID NO: 1997245 - RNA, 15 nt, Shigella flexneri 2a str. 301
cagcgaauuccaguu

SEQ ID NO: 1997246 - RNA, 21 nt, Shigella flexneri 2a str. 301
cagcgaaucagcccagcccug

SEQ ID NO: 1997247 - RNA, 14 nt, Shigella flexneri 2a str. 301
cagcgacaccagcc

SEQ ID NO: 1997248 - RNA, 12 nt, Shigella flexneri 2a str. 301
cagccuuuuucu

SEQ ID NO: 1997249 - RNA, 19 nt, Shigella flexneri 2a str. 301
cagcgaaaaucaaccauac

SEQ ID NO: 1997250 - RNA, 18 nt, Shigella flexneri 2a str. 301
cagcgaaauacagguccc

SEQ ID NO: 1997251 - RNA, 15 nt, Shigella flexneri 2a str. 301
cagcagagcaaaaau

SEQ ID NO: 1997252 - RNA, 19 nt, Shigella flexneri 2a str. 301
cagcagaaccgccaucaug

SEQ ID NO: 1997253 - RNA, 14 nt, Shigella flexneri 2a str. 301
cagcagaccagcaa

SEQ ID NO: 1997254 - RNA, 15 nt, Shigella flexneri 2a str. 301
cagcagaccagcaaa

SEQ ID NO: 1997255 - RNA, 17 nt, Shigella flexneri 2a str. 301
cagcagaccuucugcca

SEQ ID NO: 1997256 - RNA, 13 nt, Shigella flexneri 2a str. 301
cagcagcgccgca

SEQ ID NO: 1997257 - RNA, 16 nt, Shigella flexneri 2a str. 301
cagcagcggagaaaug

SEQ ID NO: 1997258 - RNA, 23 nt, Shigella flexneri 2a str. 301
cagcaggauuugcgguagcgggc

SEQ ID NO: 1997259 - RNA, 21 nt, Shigella flexneri 2a str. 301
cagcaguacgccgagaauaaa

SEQ ID NO: 1997260 - RNA, 13 nt, Shigella flexneri 2a str. 301
cagcaggugucca

SEQ ID NO: 1997261 - RNA, 17 nt, Shigella flexneri 2a str. 301
cagcaggugcgccagcg

SEQ ID NO: 1997262 - RNA, 16 nt, Shigella flexneri 2a str. 301
cagcagguccccgagc

SEQ ID NO: 1997263 - RNA, 13 nt, Shigella flexneri 2a str. 301
cagcauaaaaaua

SEQ ID NO: 1997264 - RNA, 15 nt, Shigella flexneri 2a str. 301
cagcauaccuuccag

SEQ ID NO: 1997265 - RNA, 17 nt, Shigella flexneri 2a str. 301
cagcauaccgccgagga

SEQ ID NO: 1997266 - RNA, 16 nt, Shigella flexneri 2a str. 301
cagcauaaucaccauc

SEQ ID NO: 1997267 - RNA, 17 nt, Shigella flexneri 2a str. 301
cagcauaaucaccauca

SEQ ID NO: 1997268 - RNA, 19 nt, Shigella flexneri 2a str. 301
cagcauaaucaccaucagc

SEQ ID NO: 1997269 - RNA, 21 nt, Shigella flexneri 2a str. 301
cagcauauaguuuugcauggc

SEQ ID NO: 1997270 - RNA, 18 nt, Shigella flexneri 2a str. 301
cagcauaccuuccagcgc

SEQ ID NO: 1997271 - RNA, 15 nt, Shigella flexneri 2a str. 301
cagcauaaucaccag

SEQ ID NO: 1997272 - RNA, 18 nt, Shigella flexneri 2a str. 301
cagcauaaucaccaguac

SEQ ID NO: 1997273 - RNA, 21 nt, Shigella flexneri 2a str. 301
cagcauacugauaucauuaaa

SEQ ID NO: 1997274 - RNA, 21 nt, Shigella flexneri 2a str. 301
cagcaguuuuaccgacgcgcu

SEQ ID NO: 1997275 - RNA, 19 nt, Shigella flexneri 2a str. 301
cagcaguuuccgcgccggc

SEQ ID NO: 1997276 - RNA, 22 nt, Shigella flexneri 2a str. 301
cagcaguuuuuccccugccaga

SEQ ID NO: 1997277 - RNA, 20 nt, Shigella flexneri 2a str. 301
cagcaguucacgcagcuucu

SEQ ID NO: 1997278 - RNA, 14 nt, Shigella flexneri 2a str. 301
cagccaccgccagc

SEQ ID NO: 1997279 - RNA, 21 nt, Shigella flexneri 2a str. 301
cagcauucgccgcauugucua

SEQ ID NO: 1997280 - RNA, 19 nt, Shigella flexneri 2a str. 301
cagcauucccgccagcggc

SEQ ID NO: 1997281 - RNA, 15 nt, Shigella flexneri 2a str. 301
cagcauuagcaaugc

SEQ ID NO: 1997282 - RNA, 21 nt, Shigella flexneri 2a str. 301
cagcauugcucaccgccagca

SEQ ID NO: 1997283 - RNA, 16 nt, Shigella flexneri 2a str. 301
cagccacaccaaucaa

SEQ ID NO: 1997284 - RNA, 12 nt, Shigella flexneri 2a str. 301
cagcauuucuuc

SEQ ID NO: 1997285 - RNA, 23 nt, Shigella flexneri 2a str. 301
cagcauuucucuacgcccucgau

SEQ ID NO: 1997286 - RNA, 15 nt, Shigella flexneri 2a str. 301
cagccaggguuauau

SEQ ID NO: 1997287 - RNA, 20 nt, Shigella flexneri 2a str. 301
cagccaggguuauauaaaac

SEQ ID NO: 1997288 - RNA, 16 nt, Shigella flexneri 2a str. 301
cagccacggcuccagc

SEQ ID NO: 1997289 - RNA, 19 nt, Shigella flexneri 2a str. 301
cagccagccgcuaacuucc

SEQ ID NO: 1997290 - RNA, 19 nt, Shigella flexneri 2a str. 301
cagccagcgucgcacccgg

SEQ ID NO: 1997291 - RNA, 18 nt, Shigella flexneri 2a str. 301
cagcauguguaaccgcuu

SEQ ID NO: 1997292 - RNA, 20 nt, Shigella flexneri 2a str. 301
cagcaugugguuaccaucaa

SEQ ID NO: 1997293 - RNA, 18 nt, Shigella flexneri 2a str. 301
cagcauuauuuuuaaaca

SEQ ID NO: 1997294 - RNA, 16 nt, Shigella flexneri 2a str. 301
cagcauuccagauacg

SEQ ID NO: 1997295 - RNA, 13 nt, Shigella flexneri 2a str. 301
cagcaugcacccu

SEQ ID NO: 1997296 - RNA, 15 nt, Shigella flexneri 2a str. 301
cagcaugcacccuca

SEQ ID NO: 1997297 - RNA, 16 nt, Shigella flexneri 2a str. 301
cagcaugaccaccggg

SEQ ID NO: 1997298 - RNA, 17 nt, Shigella flexneri 2a str. 301
cagcaugacguccugua

SEQ ID NO: 1997299 - RNA, 15 nt, Shigella flexneri 2a str. 301
cagcaugaaacgcca

SEQ ID NO: 1997300 - RNA, 12 nt, Shigella flexneri 2a str. 301
cagcauggcaau

SEQ ID NO: 1997301 - RNA, 22 nt, Shigella flexneri 2a str. 301
cagcaucauaccuccgcaauau

SEQ ID NO: 1997302 - RNA, 15 nt, Shigella flexneri 2a str. 301
cagcaucacgcccgc

SEQ ID NO: 1997303 - RNA, 16 nt, Shigella flexneri 2a str. 301
cagcaucccggcagcc

SEQ ID NO: 1997304 - RNA, 13 nt, Shigella flexneri 2a str. 301
cagcaucccaccu

SEQ ID NO: 1997305 - RNA, 15 nt, Shigella flexneri 2a str. 301
cagcaucgucaucag

SEQ ID NO: 1997306 - RNA, 21 nt, Shigella flexneri 2a str. 301
cagcaucucgcgcucuucuuc

SEQ ID NO: 1997307 - RNA, 14 nt, Shigella flexneri 2a str. 301
cagcaucuggauga

SEQ ID NO: 1997308 - RNA, 15 nt, Shigella flexneri 2a str. 301
cagcaucuggaugaa

SEQ ID NO: 1997309 - RNA, 19 nt, Shigella flexneri 2a str. 301
cagcaucuggaugaaaaaa

SEQ ID NO: 1997310 - RNA, 22 nt, Shigella flexneri 2a str. 301
cagcaucugcauggugccgcca

SEQ ID NO: 1997311 - RNA, 22 nt, Shigella flexneri 2a str. 301
cagcaucggugaggaucaccag

SEQ ID NO: 1997312 - RNA, 18 nt, Shigella flexneri 2a str. 301
cagcaucgaccaggauuu

SEQ ID NO: 1997313 - RNA, 14 nt, Shigella flexneri 2a str. 301
cagcaucgaccagg

SEQ ID NO: 1997314 - RNA, 15 nt, Shigella flexneri 2a str. 301
cagcaaggaaaacca

SEQ ID NO: 1997315 - RNA, 19 nt, Shigella flexneri 2a str. 301
cagcaaggcgcuaaaagca

SEQ ID NO: 1997316 - RNA, 17 nt, Shigella flexneri 2a str. 301
cagcaaucccaaaauaa

SEQ ID NO: 1997317 - RNA, 13 nt, Shigella flexneri 2a str. 301
cagcaauccccag

SEQ ID NO: 1997318 - RNA, 19 nt, Shigella flexneri 2a str. 301
cagcaauccccagacaaaa

SEQ ID NO: 1997319 - RNA, 15 nt, Shigella flexneri 2a str. 301
cagcaauccugcaug

SEQ ID NO: 1997320 - RNA, 15 nt, Shigella flexneri 2a str. 301
cagcaaucccaaaau

SEQ ID NO: 1997321 - RNA, 12 nt, Shigella flexneri 2a str. 301
cagcaaucccaa

SEQ ID NO: 1997322 - RNA, 14 nt, Shigella flexneri 2a str. 301
cagcaaucccaaaa

SEQ ID NO: 1997323 - RNA, 18 nt, Shigella flexneri 2a str. 301
cagcaaucucuucaagcu

SEQ ID NO: 1997324 - RNA, 23 nt, Shigella flexneri 2a str. 301
cagcaaucgaccaggccaucagc

SEQ ID NO: 1997325 - RNA, 21 nt, Shigella flexneri 2a str. 301
cagcaaucgcgccagccguuu

SEQ ID NO: 1997326 - RNA, 16 nt, Shigella flexneri 2a str. 301
cagcaauguuucucug

SEQ ID NO: 1997327 - RNA, 17 nt, Shigella flexneri 2a str. 301
cagcaaugcaggcaccu

SEQ ID NO: 1997328 - RNA, 13 nt, Shigella flexneri 2a str. 301
cagcaauggaaaa

SEQ ID NO: 1997329 - RNA, 16 nt, Shigella flexneri 2a str. 301
cagcaauuuaucuuug

SEQ ID NO: 1997330 - RNA, 22 nt, Shigella flexneri 2a str. 301
cagcaauuuaugaggaugcaga

SEQ ID NO: 1997331 - RNA, 13 nt, Shigella flexneri 2a str. 301
cagcaauuuacgc

SEQ ID NO: 1997332 - RNA, 14 nt, Shigella flexneri 2a str. 301
cagcacaacgagcu

SEQ ID NO: 1997333 - RNA, 21 nt, Shigella flexneri 2a str. 301
cagcacaccacaucgccgacc

SEQ ID NO: 1997334 - RNA, 16 nt, Shigella flexneri 2a str. 301
aaaaugcugcaauugc

SEQ ID NO: 1997335 - RNA, 14 nt, Shigella flexneri 2a str. 301
cagcaaccgcuucc

SEQ ID NO: 1997336 - RNA, 18 nt, Shigella flexneri 2a str. 301
cagcaaccuuuugcgcuc

SEQ ID NO: 1997337 - RNA, 13 nt, Shigella flexneri 2a str. 301
cagcaacaugccg

SEQ ID NO: 1997338 - RNA, 21 nt, Shigella flexneri 2a str. 301
cagcaacauuggcucaucaaa

SEQ ID NO: 1997339 - RNA, 14 nt, Shigella flexneri 2a str. 301
cagcaaccagguaa

SEQ ID NO: 1997340 - RNA, 14 nt, Shigella flexneri 2a str. 301
aaaauggccgauac

SEQ ID NO: 1997341 - RNA, 12 nt, Shigella flexneri 2a str. 301
cagcaagccacu

SEQ ID NO: 1997342 - RNA, 16 nt, Shigella flexneri 2a str. 301
cagcaagcgauaauuu

SEQ ID NO: 1997343 - RNA, 21 nt, Shigella flexneri 2a str. 301
cagcacaucaucaaagccaau

SEQ ID NO: 1997344 - RNA, 19 nt, Shigella flexneri 2a str. 301
cagcacauaacucauacug

SEQ ID NO: 1997345 - RNA, 15 nt, Shigella flexneri 2a str. 301
cagcacacuguaagc

SEQ ID NO: 1997346 - RNA, 15 nt, Shigella flexneri 2a str. 301
cagcacccaguaagc

SEQ ID NO: 1997347 - RNA, 14 nt, Shigella flexneri 2a str. 301
cagcagaacaucag

SEQ ID NO: 1997348 - RNA, 17 nt, Shigella flexneri 2a str. 301
cagcacuuccagcuccg

SEQ ID NO: 1997349 - RNA, 22 nt, Shigella flexneri 2a str. 301
cagcacuggugcuguaaaacca

SEQ ID NO: 1997350 - RNA, 22 nt, Shigella flexneri 2a str. 301
cagcacuuaucucuuccgcauu

SEQ ID NO: 1997351 - RNA, 15 nt, Shigella flexneri 2a str. 301
cagcacugcuuaaau

SEQ ID NO: 1997352 - RNA, 15 nt, Shigella flexneri 2a str. 301
cagcacgccccggcg

SEQ ID NO: 1997353 - RNA, 15 nt, Shigella flexneri 2a str. 301
cagcacgcauucgaa

SEQ ID NO: 1997354 - RNA, 17 nt, Shigella flexneri 2a str. 301
cagcacgacuauuauga

SEQ ID NO: 1997355 - RNA, 18 nt, Shigella flexneri 2a str. 301
cagcaccgucuggcagau

SEQ ID NO: 1997356 - RNA, 16 nt, Shigella flexneri 2a str. 301
cagaucgguugccaua

SEQ ID NO: 1997357 - RNA, 15 nt, Shigella flexneri 2a str. 301
cagaucgcggcccac

SEQ ID NO: 1997358 - RNA, 21 nt, Shigella flexneri 2a str. 301
cagaucgaucauauuuccuuc

SEQ ID NO: 1997359 - RNA, 18 nt, Shigella flexneri 2a str. 301
cagaucgaucauauuucc

SEQ ID NO: 1997360 - RNA, 15 nt, Shigella flexneri 2a str. 301
cagaguugaaaaaca

SEQ ID NO: 1997361 - RNA, 20 nt, Shigella flexneri 2a str. 301
cagaguugagcaguccccac

SEQ ID NO: 1997362 - RNA, 18 nt, Shigella flexneri 2a str. 301
cagauaauauuuaucuuc

SEQ ID NO: 1997363 - RNA, 18 nt, Shigella flexneri 2a str. 301
cagauaaggcguuuacgc

SEQ ID NO: 1997364 - RNA, 23 nt, Shigella flexneri 2a str. 301
cagauaaggugccaauccuucuu

SEQ ID NO: 1997365 - RNA, 22 nt, Shigella flexneri 2a str. 301
cagauaauauuuaucuucccag

SEQ ID NO: 1997366 - RNA, 15 nt, Shigella flexneri 2a str. 301
cagauaaucaccugc

SEQ ID NO: 1997367 - RNA, 21 nt, Shigella flexneri 2a str. 301
cagauaauccccaaugaccuu

SEQ ID NO: 1997368 - RNA, 15 nt, Shigella flexneri 2a str. 301
cagaugccaggaaca

SEQ ID NO: 1997369 - RNA, 23 nt, Shigella flexneri 2a str. 301
cagaugcgacggcaccacauucu

SEQ ID NO: 1997370 - RNA, 15 nt, Shigella flexneri 2a str. 301
cagaugccuugccaa

SEQ ID NO: 1997371 - RNA, 14 nt, Shigella flexneri 2a str. 301
cagaugcaucaccg

SEQ ID NO: 1997372 - RNA, 22 nt, Shigella flexneri 2a str. 301
cagaugcaggauuucuucacca

SEQ ID NO: 1997373 - RNA, 21 nt, Shigella flexneri 2a str. 301
cagaugauuagucuuuaucug

SEQ ID NO: 1997374 - RNA, 22 nt, Shigella flexneri 2a str. 301
cagaugacuugccgcaaaaccc

SEQ ID NO: 1997375 - RNA, 23 nt, Shigella flexneri 2a str. 301
cagaugaacgagucaacgcuuca

SEQ ID NO: 1997376 - RNA, 18 nt, Shigella flexneri 2a str. 301
cagaugaagauuuaaaca

SEQ ID NO: 1997377 - RNA, 14 nt, Shigella flexneri 2a str. 301
cagaugaaaacgcu

SEQ ID NO: 1997378 - RNA, 20 nt, Shigella flexneri 2a str. 301
cagaugaacgagucaacgcu

SEQ ID NO: 1997379 - RNA, 22 nt, Shigella flexneri 2a str. 301
cagaucuuccgaggcguuuucu

SEQ ID NO: 1997380 - RNA, 20 nt, Shigella flexneri 2a str. 301
cagaucuggcgauuauuuuc

SEQ ID NO: 1997381 - RNA, 13 nt, Shigella flexneri 2a str. 301
cagaucguuuucc

SEQ ID NO: 1997382 - RNA, 16 nt, Shigella flexneri 2a str. 301
cagaucguugaccuga

SEQ ID NO: 1997383 - RNA, 22 nt, Shigella flexneri 2a str. 301
cagaucuaauguuggugugaca

SEQ ID NO: 1997384 - RNA, 22 nt, Shigella flexneri 2a str. 301
cagaucucaccacgauguggcg

SEQ ID NO: 1997385 - RNA, 17 nt, Shigella flexneri 2a str. 301
cagauucaaauuauguc

SEQ ID NO: 1997386 - RNA, 20 nt, Shigella flexneri 2a str. 301
cagauuguugauuaacaggc

SEQ ID NO: 1997387 - RNA, 23 nt, Shigella flexneri 2a str. 301
cagauuaugccgcuucaguugcg

SEQ ID NO: 1997388 - RNA, 16 nt, Shigella flexneri 2a str. 301
cagauuuauaaaagaa

SEQ ID NO: 1997389 - RNA, 23 nt, Shigella flexneri 2a str. 301
cagauuuauuuacuucugcugca

SEQ ID NO: 1997390 - RNA, 20 nt, Shigella flexneri 2a str. 301
cagauuuaacggcagcaagg

SEQ ID NO: 1997391 - RNA, 20 nt, Shigella flexneri 2a str. 301
cagauuuacagucugcuccc

SEQ ID NO: 1997392 - RNA, 19 nt, Shigella flexneri 2a str. 301
cagaugcucuuuucugaag

SEQ ID NO: 1997393 - RNA, 13 nt, Shigella flexneri 2a str. 301
cagaugcuuuaau

SEQ ID NO: 1997394 - RNA, 18 nt, Shigella flexneri 2a str. 301
cagauguaaacuuuuucg

SEQ ID NO: 1997395 - RNA, 21 nt, Shigella flexneri 2a str. 301
aaaaucuccugccaauacaaa

SEQ ID NO: 1997396 - RNA, 14 nt, Shigella flexneri 2a str. 301
aaaaucugaauugu

SEQ ID NO: 1997397 - RNA, 22 nt, Shigella flexneri 2a str. 301
aaaaucugcgggaacauaugca

SEQ ID NO: 1997398 - RNA, 16 nt, Shigella flexneri 2a str. 301
cagauguuccgccauu

SEQ ID NO: 1997399 - RNA, 17 nt, Shigella flexneri 2a str. 301
cagaugugcuucugcca

SEQ ID NO: 1997400 - RNA, 19 nt, Shigella flexneri 2a str. 301
cagauguugucucagauuc

SEQ ID NO: 1997401 - RNA, 19 nt, Shigella flexneri 2a str. 301
aaaaucauccgcucccugg

SEQ ID NO: 1997402 - RNA, 17 nt, Shigella flexneri 2a str. 301
aaaaucaucaauugcca

SEQ ID NO: 1997403 - RNA, 12 nt, Shigella flexneri 2a str. 301
aaaaucaucauc

SEQ ID NO: 1997404 - RNA, 13 nt, Shigella flexneri 2a str. 301
aaaaucaucaucu

SEQ ID NO: 1997405 - RNA, 18 nt, Shigella flexneri 2a str. 301
cagagacgcacugcuuga

SEQ ID NO: 1997406 - RNA, 22 nt, Shigella flexneri 2a str. 301
cagagagccagccccacagcag

SEQ ID NO: 1997407 - RNA, 13 nt, Shigella flexneri 2a str. 301
aaaaucagcauca

SEQ ID NO: 1997408 - RNA, 22 nt, Shigella flexneri 2a str. 301
aaaaucauucgccgguuccagc

SEQ ID NO: 1997409 - RNA, 18 nt, Shigella flexneri 2a str. 301
cagagagcuuauccagca

SEQ ID NO: 1997410 - RNA, 18 nt, Shigella flexneri 2a str. 301
cagagagcgaauaucauu

SEQ ID NO: 1997411 - RNA, 14 nt, Shigella flexneri 2a str. 301
cagagauacaggcc

SEQ ID NO: 1997412 - RNA, 17 nt, Shigella flexneri 2a str. 301
cagagcaccaucgcuga

SEQ ID NO: 1997413 - RNA, 18 nt, Shigella flexneri 2a str. 301
cagagcaccaucgcugau

SEQ ID NO: 1997414 - RNA, 13 nt, Shigella flexneri 2a str. 301
cagagucauuucu

SEQ ID NO: 1997415 - RNA, 18 nt, Shigella flexneri 2a str. 301
cagaguggauuaucuuca

SEQ ID NO: 1997416 - RNA, 17 nt, Shigella flexneri 2a str. 301
cagagugaaaaugccuc

SEQ ID NO: 1997417 - RNA, 18 nt, Shigella flexneri 2a str. 301
cagagugaaaaugccuca

SEQ ID NO: 1997418 - RNA, 23 nt, Shigella flexneri 2a str. 301
cagagcaucgguaucuucccagc

SEQ ID NO: 1997419 - RNA, 23 nt, Shigella flexneri 2a str. 301
cagagcaucaguuaacggcacca

SEQ ID NO: 1997420 - RNA, 18 nt, Shigella flexneri 2a str. 301
cagagccauccaguuuaa

SEQ ID NO: 1997421 - RNA, 19 nt, Shigella flexneri 2a str. 301
cagaggaaucgcuguugag

SEQ ID NO: 1997422 - RNA, 23 nt, Shigella flexneri 2a str. 301
cagagcugcguuugaaauaccag

SEQ ID NO: 1997423 - RNA, 15 nt, Shigella flexneri 2a str. 301
cagagcugcguuuga

SEQ ID NO: 1997424 - RNA, 13 nt, Shigella flexneri 2a str. 301
cagagcccgggcg

SEQ ID NO: 1997425 - RNA, 13 nt, Shigella flexneri 2a str. 301
aaaauauuucugc

SEQ ID NO: 1997426 - RNA, 14 nt, Shigella flexneri 2a str. 301
cagacucaaaccaa

SEQ ID NO: 1997427 - RNA, 13 nt, Shigella flexneri 2a str. 301
cagacucaacagg

SEQ ID NO: 1997428 - RNA, 14 nt, Shigella flexneri 2a str. 301
cagacuguagauga

SEQ ID NO: 1997429 - RNA, 17 nt, Shigella flexneri 2a str. 301
cagacuauucagcucuu

SEQ ID NO: 1997430 - RNA, 18 nt, Shigella flexneri 2a str. 301
cagagaacuggcggcaaa

SEQ ID NO: 1997431 - RNA, 19 nt, Shigella flexneri 2a str. 301
cagagaacuguagacaaaa

SEQ ID NO: 1997432 - RNA, 22 nt, Shigella flexneri 2a str. 301
cagagaaucgggaaauaacauc

SEQ ID NO: 1997433 - RNA, 14 nt, Shigella flexneri 2a str. 301
aaaaucaaaaaacu

SEQ ID NO: 1997434 - RNA, 18 nt, Shigella flexneri 2a str. 301
cagagaaacgccagcagc

SEQ ID NO: 1997435 - RNA, 20 nt, Shigella flexneri 2a str. 301
cagagaaacgccagcagcag

SEQ ID NO: 1997436 - RNA, 19 nt, Shigella flexneri 2a str. 301
cagagaaagcaaaaauaaa

SEQ ID NO: 1997437 - RNA, 13 nt, Shigella flexneri 2a str. 301
cagagaaagcaaa

SEQ ID NO: 1997438 - RNA, 13 nt, Shigella flexneri 2a str. 301
cagacgcucuuca

SEQ ID NO: 1997439 - RNA, 19 nt, Shigella flexneri 2a str. 301
cagacgcucgccauuuuuc

SEQ ID NO: 1997440 - RNA, 23 nt, Shigella flexneri 2a str. 301
cagacguguugucagcucaucca

SEQ ID NO: 1997441 - RNA, 19 nt, Shigella flexneri 2a str. 301
cagacgcuuacguuuacgc

SEQ ID NO: 1997442 - RNA, 13 nt, Shigella flexneri 2a str. 301
cagacguuuuuuc

SEQ ID NO: 1997443 - RNA, 16 nt, Shigella flexneri 2a str. 301
cagacguuuuuucugc

SEQ ID NO: 1997444 - RNA, 16 nt, Shigella flexneri 2a str. 301
cagacgcaggcgcgcu

SEQ ID NO: 1997445 - RNA, 22 nt, Shigella flexneri 2a str. 301
cagacgauuacucgccuuucac

SEQ ID NO: 1997446 - RNA, 17 nt, Shigella flexneri 2a str. 301
cagaccagcuaccacgc

SEQ ID NO: 1997447 - RNA, 13 nt, Shigella flexneri 2a str. 301
cagaccaauguua

SEQ ID NO: 1997448 - RNA, 20 nt, Shigella flexneri 2a str. 301
cagaccagaaacgccaccau

SEQ ID NO: 1997449 - RNA, 21 nt, Shigella flexneri 2a str. 301
cagaccagaaugcuccgcacc

SEQ ID NO: 1997450 - RNA, 13 nt, Shigella flexneri 2a str. 301
cagaccagcaccg

SEQ ID NO: 1997451 - RNA, 14 nt, Shigella flexneri 2a str. 301
cagacacugcugau

SEQ ID NO: 1997452 - RNA, 20 nt, Shigella flexneri 2a str. 301
cagacacugcugauaaucca

SEQ ID NO: 1997453 - RNA, 19 nt, Shigella flexneri 2a str. 301
cagacaccgauugccccug

SEQ ID NO: 1997454 - RNA, 17 nt, Shigella flexneri 2a str. 301
cagacacggcguauaca

SEQ ID NO: 1997455 - RNA, 22 nt, Shigella flexneri 2a str. 301
cagacacggcguauacaagaac

SEQ ID NO: 1997456 - RNA, 13 nt, Shigella flexneri 2a str. 301
cagacacugcuga

SEQ ID NO: 1997457 - RNA, 12 nt, Shigella flexneri 2a str. 301
cagacaucaagu

SEQ ID NO: 1997458 - RNA, 13 nt, Shigella flexneri 2a str. 301
cagaccaauggcu

SEQ ID NO: 1997459 - RNA, 15 nt, Shigella flexneri 2a str. 301
cagacagcacauuuc

SEQ ID NO: 1997460 - RNA, 14 nt, Shigella flexneri 2a str. 301
cagacaacuucccu

SEQ ID NO: 1997461 - RNA, 13 nt, Shigella flexneri 2a str. 301
cagacaacuuccc

SEQ ID NO: 1997462 - RNA, 17 nt, Shigella flexneri 2a str. 301
cagacaaucgccaguga

SEQ ID NO: 1997463 - RNA, 15 nt, Shigella flexneri 2a str. 301
cagacaauaucggca

SEQ ID NO: 1997464 - RNA, 19 nt, Shigella flexneri 2a str. 301
cagacaaucacaucacugc

SEQ ID NO: 1997465 - RNA, 22 nt, Shigella flexneri 2a str. 301
cagacaauggccugcgcgaccu

SEQ ID NO: 1997466 - RNA, 17 nt, Shigella flexneri 2a str. 301
cagacacccaccauaag

SEQ ID NO: 1997467 - RNA, 23 nt, Shigella flexneri 2a str. 301
cagacaccagaaugguguuaacc

SEQ ID NO: 1997468 - RNA, 18 nt, Shigella flexneri 2a str. 301
cagaacaaacuacauagc

SEQ ID NO: 1997469 - RNA, 12 nt, Shigella flexneri 2a str. 301
cagaacaacccg

SEQ ID NO: 1997470 - RNA, 23 nt, Shigella flexneri 2a str. 301
cagaaauuguggcguccaggaca

SEQ ID NO: 1997471 - RNA, 18 nt, Shigella flexneri 2a str. 301
cagaaaugguaaagaagg

SEQ ID NO: 1997472 - RNA, 16 nt, Shigella flexneri 2a str. 301
cagaaaugguaaagaa

SEQ ID NO: 1997473 - RNA, 14 nt, Shigella flexneri 2a str. 301
cagaacaccauaau

SEQ ID NO: 1997474 - RNA, 17 nt, Shigella flexneri 2a str. 301
cagaagacgcuccagug

SEQ ID NO: 1997475 - RNA, 23 nt, Shigella flexneri 2a str. 301
cagaagcauuuuacauccugaua

SEQ ID NO: 1997476 - RNA, 15 nt, Shigella flexneri 2a str. 301
cagaagcaugaacau

SEQ ID NO: 1997477 - RNA, 23 nt, Shigella flexneri 2a str. 301
cagaagcaugaacauugcugcug

SEQ ID NO: 1997478 - RNA, 15 nt, Shigella flexneri 2a str. 301
cagaagcgacaccag

SEQ ID NO: 1997479 - RNA, 16 nt, Shigella flexneri 2a str. 301
cagaagcacugccaga

SEQ ID NO: 1997480 - RNA, 24 nt, Shigella flexneri 2a str. 301
cagaagcacugccagaaucaaggu

SEQ ID NO: 1997481 - RNA, 14 nt, Shigella flexneri 2a str. 301
cagaagcaguaagu

SEQ ID NO: 1997482 - RNA, 21 nt, Shigella flexneri 2a str. 301
cagaaugguguuaaccgguac

SEQ ID NO: 1997483 - RNA, 19 nt, Shigella flexneri 2a str. 301
cagaauggcgcacucaaaa

SEQ ID NO: 1997484 - RNA, 16 nt, Shigella flexneri 2a str. 301
cagaauggcaucugau

SEQ ID NO: 1997485 - RNA, 13 nt, Shigella flexneri 2a str. 301
cagaaacaaccug

SEQ ID NO: 1997486 - RNA, 17 nt, Shigella flexneri 2a str. 301
cagaaacacacuuucca

SEQ ID NO: 1997487 - RNA, 16 nt, Shigella flexneri 2a str. 301
cagaaacacacuuucc

SEQ ID NO: 1997488 - RNA, 17 nt, Shigella flexneri 2a str. 301
cagaaacaaacgcaaaa

SEQ ID NO: 1997489 - RNA, 15 nt, Shigella flexneri 2a str. 301
cagaaaaagaagccg

SEQ ID NO: 1997490 - RNA, 20 nt, Shigella flexneri 2a str. 301
cagaaaaaaaguagggcuga

SEQ ID NO: 1997491 - RNA, 23 nt, Shigella flexneri 2a str. 301
cagaaaccugauuacgcaccggg

SEQ ID NO: 1997492 - RNA, 18 nt, Shigella flexneri 2a str. 301
cagaaacgccauccagcc

SEQ ID NO: 1997493 - RNA, 16 nt, Shigella flexneri 2a str. 301
cagaaaugaaaaaaua

SEQ ID NO: 1997494 - RNA, 20 nt, Shigella flexneri 2a str. 301
cagaaaugccaguaacucau

SEQ ID NO: 1997495 - RNA, 14 nt, Shigella flexneri 2a str. 301
cagaaauggcccaa

SEQ ID NO: 1997496 - RNA, 18 nt, Shigella flexneri 2a str. 301
cagaaauggcccaaaagg

SEQ ID NO: 1997497 - RNA, 13 nt, Shigella flexneri 2a str. 301
cagaaaugaaaaa

SEQ ID NO: 1997498 - RNA, 23 nt, Shigella flexneri 2a str. 301
cagaaauagaaagugacugcugg

SEQ ID NO: 1997499 - RNA, 17 nt, Shigella flexneri 2a str. 301
cagaaauagaaagugac

SEQ ID NO: 1997500 - RNA, 22 nt, Shigella flexneri 2a str. 301
cacuuuuugcucaacccuuucc

SEQ ID NO: 1997501 - RNA, 18 nt, Shigella flexneri 2a str. 301
cacuuuuuguaauuuuuu

SEQ ID NO: 1997502 - RNA, 14 nt, Shigella flexneri 2a str. 301
cacuuucagcacgu

SEQ ID NO: 1997503 - RNA, 14 nt, Shigella flexneri 2a str. 301
cacuuuccccggca

SEQ ID NO: 1997504 - RNA, 14 nt, Shigella flexneri 2a str. 301
cacgucguucgggc

SEQ ID NO: 1997505 - RNA, 11 nt, Shigella flexneri 2a str. 301
cacgucugaag

SEQ ID NO: 1997506 - RNA, 20 nt, Shigella flexneri 2a str. 301
cacuuucaaauccggccagc

SEQ ID NO: 1997507 - RNA, 22 nt, Shigella flexneri 2a str. 301
cagcucaucaagcuguucuucc

SEQ ID NO: 1997508 - RNA, 17 nt, Shigella flexneri 2a str. 301
cagcucauauuccugca

SEQ ID NO: 1997509 - RNA, 18 nt, Shigella flexneri 2a str. 301
cagcucauauuccugcau

SEQ ID NO: 1997510 - RNA, 15 nt, Shigella flexneri 2a str. 301
cagcucaugggcuuu

SEQ ID NO: 1997511 - RNA, 16 nt, Shigella flexneri 2a str. 301
cagcuccagcagaccc

SEQ ID NO: 1997512 - RNA, 22 nt, Shigella flexneri 2a str. 301
cagcuccgccagcuccgggcug

SEQ ID NO: 1997513 - RNA, 22 nt, Shigella flexneri 2a str. 301
cagcucccccaaaguuaaggug

SEQ ID NO: 1997514 - RNA, 11 nt, Shigella flexneri 2a str. 301
cagcuccagcc

SEQ ID NO: 1997515 - RNA, 19 nt, Shigella flexneri 2a str. 301
cagcuccagcccgcgucgu

SEQ ID NO: 1997516 - RNA, 18 nt, Shigella flexneri 2a str. 301
cagcucucgcguuacuac

SEQ ID NO: 1997517 - RNA, 22 nt, Shigella flexneri 2a str. 301
cagcucucagacgauuacucgc

SEQ ID NO: 1997518 - RNA, 16 nt, Shigella flexneri 2a str. 301
cagcucggcaaucugu

SEQ ID NO: 1997519 - RNA, 17 nt, Shigella flexneri 2a str. 301
cagcucgcgcaguucac

SEQ ID NO: 1997520 - RNA, 19 nt, Shigella flexneri 2a str. 301
cagcuccgguauacguccc

SEQ ID NO: 1997521 - RNA, 21 nt, Shigella flexneri 2a str. 301
cagcuccucuuucaucucccg

SEQ ID NO: 1997522 - RNA, 14 nt, Shigella flexneri 2a str. 301
cagcucgaccgcug

SEQ ID NO: 1997523 - RNA, 18 nt, Shigella flexneri 2a str. 301
cagcucgaugauguguuc

SEQ ID NO: 1997524 - RNA, 21 nt, Shigella flexneri 2a str. 301
aaaauuguguaaauucaauaa

SEQ ID NO: 1997525 - RNA, 13 nt, Shigella flexneri 2a str. 301
cagcucagugacc

SEQ ID NO: 1997526 - RNA, 20 nt, Shigella flexneri 2a str. 301
cagcucaaucaacuccauua

SEQ ID NO: 1997527 - RNA, 17 nt, Shigella flexneri 2a str. 301
cagcucacaaauacgcu

SEQ ID NO: 1997528 - RNA, 22 nt, Shigella flexneri 2a str. 301
cagcuaucguuauccauauggc

SEQ ID NO: 1997529 - RNA, 18 nt, Shigella flexneri 2a str. 301
cagcgcggugacgcacag

SEQ ID NO: 1997530 - RNA, 14 nt, Shigella flexneri 2a str. 301
cagcgcugcgcgcu

SEQ ID NO: 1997531 - RNA, 21 nt, Shigella flexneri 2a str. 301
cagcgcugcggcgcgcaucuu

SEQ ID NO: 1997532 - RNA, 20 nt, Shigella flexneri 2a str. 301
cagcgcuucacuaugacgaa

SEQ ID NO: 1997533 - RNA, 14 nt, Shigella flexneri 2a str. 301
cagcuaauggcugc

SEQ ID NO: 1997534 - RNA, 15 nt, Shigella flexneri 2a str. 301
cagcuaauggcugcg

SEQ ID NO: 1997535 - RNA, 15 nt, Shigella flexneri 2a str. 301
cagcuuaaucaccag

SEQ ID NO: 1997536 - RNA, 16 nt, Shigella flexneri 2a str. 301
cagcuuagaaaucgac

SEQ ID NO: 1997537 - RNA, 18 nt, Shigella flexneri 2a str. 301
cagcuuaguccgcgacgu

SEQ ID NO: 1997538 - RNA, 16 nt, Shigella flexneri 2a str. 301
cagcuuauuucuguga

SEQ ID NO: 1997539 - RNA, 15 nt, Shigella flexneri 2a str. 301
cagcuuaucuuuuuc

SEQ ID NO: 1997540 - RNA, 16 nt, Shigella flexneri 2a str. 301
cagcuucagcgcgucg

SEQ ID NO: 1997541 - RNA, 13 nt, Shigella flexneri 2a str. 301
cagcuucacggaa

SEQ ID NO: 1997542 - RNA, 14 nt, Shigella flexneri 2a str. 301
cagcuucacuuuca

SEQ ID NO: 1997543 - RNA, 13 nt, Shigella flexneri 2a str. 301
cagcuucagauua

SEQ ID NO: 1997544 - RNA, 16 nt, Shigella flexneri 2a str. 301
cagcuucaccuuccag

SEQ ID NO: 1997545 - RNA, 18 nt, Shigella flexneri 2a str. 301
cagcuucaccuuccagua

SEQ ID NO: 1997546 - RNA, 21 nt, Shigella flexneri 2a str. 301
cagcuucaaaucauuacaguu

SEQ ID NO: 1997547 - RNA, 15 nt, Shigella flexneri 2a str. 301
cagcuucaucaucgc

SEQ ID NO: 1997548 - RNA, 16 nt, Shigella flexneri 2a str. 301
cagcuuccaucaacau

SEQ ID NO: 1997549 - RNA, 21 nt, Shigella flexneri 2a str. 301
cagcucuuccuucagcucccg

SEQ ID NO: 1997550 - RNA, 20 nt, Shigella flexneri 2a str. 301
cagcucuuccuucagcuccc

SEQ ID NO: 1997551 - RNA, 15 nt, Shigella flexneri 2a str. 301
cagcucuugcuccac

SEQ ID NO: 1997552 - RNA, 13 nt, Shigella flexneri 2a str. 301
cagcucuucucaa

SEQ ID NO: 1997553 - RNA, 14 nt, Shigella flexneri 2a str. 301
cagcucuucucaac

SEQ ID NO: 1997554 - RNA, 19 nt, Shigella flexneri 2a str. 301
cagcucuucucaacgugga

SEQ ID NO: 1997555 - RNA, 23 nt, Shigella flexneri 2a str. 301
cagcugguguaacugcgccagac

SEQ ID NO: 1997556 - RNA, 16 nt, Shigella flexneri 2a str. 301
cagcugguuauuuucu

SEQ ID NO: 1997557 - RNA, 13 nt, Shigella flexneri 2a str. 301
cagcuuucgcuua

SEQ ID NO: 1997558 - RNA, 16 nt, Shigella flexneri 2a str. 301
cagcuugcgauccugc

SEQ ID NO: 1997559 - RNA, 17 nt, Shigella flexneri 2a str. 301
cagcuugcgauccugca

SEQ ID NO: 1997560 - RNA, 15 nt, Shigella flexneri 2a str. 301
cagcuugccgcgcuc

SEQ ID NO: 1997561 - RNA, 22 nt, Shigella flexneri 2a str. 301
cagcuuccaggcaaucagcaau

SEQ ID NO: 1997562 - RNA, 16 nt, Shigella flexneri 2a str. 301
cagcuucccaaagauc

SEQ ID NO: 1997563 - RNA, 22 nt, Shigella flexneri 2a str. 301
caggaaauuauggaucaccauc

SEQ ID NO: 1997564 - RNA, 23 nt, Shigella flexneri 2a str. 301
caggaaauuaccgcaaagcccac

SEQ ID NO: 1997565 - RNA, 18 nt, Shigella flexneri 2a str. 301
caggaacaccgcacgcag

SEQ ID NO: 1997566 - RNA, 15 nt, Shigella flexneri 2a str. 301
cagcuuuuuccugcg

SEQ ID NO: 1997567 - RNA, 13 nt, Shigella flexneri 2a str. 301
cagcuuuuuccug

SEQ ID NO: 1997568 - RNA, 21 nt, Shigella flexneri 2a str. 301
cagcuuuuccauaucaagcau

SEQ ID NO: 1997569 - RNA, 14 nt, Shigella flexneri 2a str. 301
cagcuuuggugaaa

SEQ ID NO: 1997570 - RNA, 22 nt, Shigella flexneri 2a str. 301
cagcuuuuuagcgaucucgguc

SEQ ID NO: 1997571 - RNA, 17 nt, Shigella flexneri 2a str. 301
caggauaaccuucaacu

SEQ ID NO: 1997572 - RNA, 16 nt, Shigella flexneri 2a str. 301
caggauaagcgccgcu

SEQ ID NO: 1997573 - RNA, 22 nt, Shigella flexneri 2a str. 301
caggagcgauuaugaaacaaga

SEQ ID NO: 1997574 - RNA, 12 nt, Shigella flexneri 2a str. 301
caggauacgcau

SEQ ID NO: 1997575 - RNA, 19 nt, Shigella flexneri 2a str. 301
caggagcgauuaugaaaca

SEQ ID NO: 1997576 - RNA, 12 nt, Shigella flexneri 2a str. 301
caggagcaggcu

SEQ ID NO: 1997577 - RNA, 14 nt, Shigella flexneri 2a str. 301
caggagcaggcugc

SEQ ID NO: 1997578 - RNA, 19 nt, Shigella flexneri 2a str. 301
caggagcaggcugcacugg

SEQ ID NO: 1997579 - RNA, 12 nt, Shigella flexneri 2a str. 301
caggacuauuuu

SEQ ID NO: 1997580 - RNA, 15 nt, Shigella flexneri 2a str. 301
caggaaguccgagga

SEQ ID NO: 1997581 - RNA, 21 nt, Shigella flexneri 2a str. 301
caggaaccugugacagcagcg

SEQ ID NO: 1997582 - RNA, 18 nt, Shigella flexneri 2a str. 301
caggaacgcgccaagaua

SEQ ID NO: 1997583 - RNA, 13 nt, Shigella flexneri 2a str. 301
caggaacagccac

SEQ ID NO: 1997584 - RNA, 21 nt, Shigella flexneri 2a str. 301
caggaauagcggcaagcccag

SEQ ID NO: 1997585 - RNA, 21 nt, Shigella flexneri 2a str. 301
caggaauaaaucuaaaagaug

SEQ ID NO: 1997586 - RNA, 21 nt, Shigella flexneri 2a str. 301
aaaauuucuugguaaugacuc

SEQ ID NO: 1997587 - RNA, 19 nt, Shigella flexneri 2a str. 301
aaaauuucuccuucacucu

SEQ ID NO: 1997588 - RNA, 12 nt, Shigella flexneri 2a str. 301
caggcuguguuu

SEQ ID NO: 1997589 - RNA, 13 nt, Shigella flexneri 2a str. 301
caggcuucaacac

SEQ ID NO: 1997590 - RNA, 15 nt, Shigella flexneri 2a str. 301
cagggaaugaggauc

SEQ ID NO: 1997591 - RNA, 23 nt, Shigella flexneri 2a str. 301
cagggaacauuucuuaugggcca

SEQ ID NO: 1997592 - RNA, 15 nt, Shigella flexneri 2a str. 301
caggcugcuauccag

SEQ ID NO: 1997593 - RNA, 15 nt, Shigella flexneri 2a str. 301
caggcuccuguagcu

SEQ ID NO: 1997594 - RNA, 22 nt, Shigella flexneri 2a str. 301
caggcucauaccuuccacuuuc

SEQ ID NO: 1997595 - RNA, 15 nt, Shigella flexneri 2a str. 301
caggcucauaccuuc

SEQ ID NO: 1997596 - RNA, 17 nt, Shigella flexneri 2a str. 301
caggcuaucgaacaugc

SEQ ID NO: 1997597 - RNA, 18 nt, Shigella flexneri 2a str. 301
caggcgcagauacagccu

SEQ ID NO: 1997598 - RNA, 22 nt, Shigella flexneri 2a str. 301
cagggcaaugcgggugcaauca

SEQ ID NO: 1997599 - RNA, 22 nt, Shigella flexneri 2a str. 301
cagggcaauuaaaaauuucccc

SEQ ID NO: 1997600 - RNA, 23 nt, Shigella flexneri 2a str. 301
cagggcacuuuuauccugucagu

SEQ ID NO: 1997601 - RNA, 21 nt, Shigella flexneri 2a str. 301
cagggccgcgaaucuccagau

SEQ ID NO: 1997602 - RNA, 16 nt, Shigella flexneri 2a str. 301
cagggccuccugcagc

SEQ ID NO: 1997603 - RNA, 14 nt, Shigella flexneri 2a str. 301
cagggcgucaccgg

SEQ ID NO: 1997604 - RNA, 12 nt, Shigella flexneri 2a str. 301
cagggcggcagg

SEQ ID NO: 1997605 - RNA, 16 nt, Shigella flexneri 2a str. 301
caggcaucggugcugg

SEQ ID NO: 1997606 - RNA, 22 nt, Shigella flexneri 2a str. 301
caggcauuaaauccugaaacca

SEQ ID NO: 1997607 - RNA, 18 nt, Shigella flexneri 2a str. 301
caggcaucgugcaccaau

SEQ ID NO: 1997608 - RNA, 21 nt, Shigella flexneri 2a str. 301
caggcaucguguugaugcucc

SEQ ID NO: 1997609 - RNA, 17 nt, Shigella flexneri 2a str. 301
caggauauuuauauuuu

SEQ ID NO: 1997610 - RNA, 18 nt, Shigella flexneri 2a str. 301
caggauauauuucaucaa

SEQ ID NO: 1997611 - RNA, 16 nt, Shigella flexneri 2a str. 301
caggauauagucgaac

SEQ ID NO: 1997612 - RNA, 16 nt, Shigella flexneri 2a str. 301
caggaucugcgcggca

SEQ ID NO: 1997613 - RNA, 17 nt, Shigella flexneri 2a str. 301
caggaucugguguuaaa

SEQ ID NO: 1997614 - RNA, 15 nt, Shigella flexneri 2a str. 301
caggaucugacuggc

SEQ ID NO: 1997615 - RNA, 15 nt, Shigella flexneri 2a str. 301
caggccagauagcca

SEQ ID NO: 1997616 - RNA, 17 nt, Shigella flexneri 2a str. 301
caggccaguucuucuuc

SEQ ID NO: 1997617 - RNA, 17 nt, Shigella flexneri 2a str. 301
caggcccaacuguugau

SEQ ID NO: 1997618 - RNA, 15 nt, Shigella flexneri 2a str. 301
caggcgaucuucccg

SEQ ID NO: 1997619 - RNA, 22 nt, Shigella flexneri 2a str. 301
caggccugauaagacgcgcagc

SEQ ID NO: 1997620 - RNA, 18 nt, Shigella flexneri 2a str. 301
caggccgcguaccgcagc

SEQ ID NO: 1997621 - RNA, 13 nt, Shigella flexneri 2a str. 301
caggccgcgcagu

SEQ ID NO: 1997622 - RNA, 21 nt, Shigella flexneri 2a str. 301
cagugaacaauuaacguauca

SEQ ID NO: 1997623 - RNA, 11 nt, Shigella flexneri 2a str. 301
cagugaaccca

SEQ ID NO: 1997624 - RNA, 21 nt, Shigella flexneri 2a str. 301
cagugacaguguuauucccaa

SEQ ID NO: 1997625 - RNA, 16 nt, Shigella flexneri 2a str. 301
cagugaccaucuucca

SEQ ID NO: 1997626 - RNA, 16 nt, Shigella flexneri 2a str. 301
cagugacauucaccuc

SEQ ID NO: 1997627 - RNA, 21 nt, Shigella flexneri 2a str. 301
cagugacaaauuccgaacaaa

SEQ ID NO: 1997628 - RNA, 23 nt, Shigella flexneri 2a str. 301
cagugaagucgggcagaaugccc

SEQ ID NO: 1997629 - RNA, 14 nt, Shigella flexneri 2a str. 301
cagucuucaucauc

SEQ ID NO: 1997630 - RNA, 15 nt, Shigella flexneri 2a str. 301
cagucuucccagccc

SEQ ID NO: 1997631 - RNA, 15 nt, Shigella flexneri 2a str. 301
cagucuuccugcggc

SEQ ID NO: 1997632 - RNA, 16 nt, Shigella flexneri 2a str. 301
cagucuucccagcccc

SEQ ID NO: 1997633 - RNA, 22 nt, Shigella flexneri 2a str. 301
cagucuuugccguuggcggcgu

SEQ ID NO: 1997634 - RNA, 22 nt, Shigella flexneri 2a str. 301
cagucuuaaaggggugaaaaaa

SEQ ID NO: 1997635 - RNA, 21 nt, Shigella flexneri 2a str. 301
cagucuuaaaggggugaaaaa

SEQ ID NO: 1997636 - RNA, 12 nt, Shigella flexneri 2a str. 301
cagucuggagca

SEQ ID NO: 1997637 - RNA, 13 nt, Shigella flexneri 2a str. 301
cagucugcucccu

SEQ ID NO: 1997638 - RNA, 14 nt, Shigella flexneri 2a str. 301
cagucugcucccuu

SEQ ID NO: 1997639 - RNA, 18 nt, Shigella flexneri 2a str. 301
cagugcagcgccuuuugu

SEQ ID NO: 1997640 - RNA, 18 nt, Shigella flexneri 2a str. 301
cagugcaggcaccagccc

SEQ ID NO: 1997641 - RNA, 18 nt, Shigella flexneri 2a str. 301
cagugcaauaccauggcu

SEQ ID NO: 1997642 - RNA, 17 nt, Shigella flexneri 2a str. 301
cagugauuuuugcugaa

SEQ ID NO: 1997643 - RNA, 14 nt, Shigella flexneri 2a str. 301
cagugauucauagu

SEQ ID NO: 1997644 - RNA, 22 nt, Shigella flexneri 2a str. 301
cagugauauauuuuuaaauaua

SEQ ID NO: 1997645 - RNA, 20 nt, Shigella flexneri 2a str. 301
cagugaucgugugccaccag

SEQ ID NO: 1997646 - RNA, 19 nt, Shigella flexneri 2a str. 301
cagugaguccuguuucgga

SEQ ID NO: 1997647 - RNA, 23 nt, Shigella flexneri 2a str. 301
cagugagauaccaguugaucaaa

SEQ ID NO: 1997648 - RNA, 16 nt, Shigella flexneri 2a str. 301
cagucgcacgccuggc

SEQ ID NO: 1997649 - RNA, 15 nt, Shigella flexneri 2a str. 301
cagucgcacgccugg

SEQ ID NO: 1997650 - RNA, 15 nt, Shigella flexneri 2a str. 301
caguccgccuucaac

SEQ ID NO: 1997651 - RNA, 18 nt, Shigella flexneri 2a str. 301
caguccccucgccccucc

SEQ ID NO: 1997652 - RNA, 17 nt, Shigella flexneri 2a str. 301
caguccccucgccccuc

SEQ ID NO: 1997653 - RNA, 22 nt, Shigella flexneri 2a str. 301
cagucgugcgguaguuucuccc

SEQ ID NO: 1997654 - RNA, 23 nt, Shigella flexneri 2a str. 301
cagucucaaaccggcuccagaua

SEQ ID NO: 1997655 - RNA, 19 nt, Shigella flexneri 2a str. 301
cagucguucaaccacuuca

SEQ ID NO: 1997656 - RNA, 16 nt, Shigella flexneri 2a str. 301
cagucgucaucccagu

SEQ ID NO: 1997657 - RNA, 16 nt, Shigella flexneri 2a str. 301
cagucuagcccgaugg

SEQ ID NO: 1997658 - RNA, 13 nt, Shigella flexneri 2a str. 301
cagucgcugacac

SEQ ID NO: 1997659 - RNA, 21 nt, Shigella flexneri 2a str. 301
cagucgcuauuacgcacacuu

SEQ ID NO: 1997660 - RNA, 17 nt, Shigella flexneri 2a str. 301
cagucgcgcaauugcca

SEQ ID NO: 1997661 - RNA, 16 nt, Shigella flexneri 2a str. 301
cagucgcgacgcugac

SEQ ID NO: 1997662 - RNA, 15 nt, Shigella flexneri 2a str. 301
cagucgccagcgcca

SEQ ID NO: 1997663 - RNA, 20 nt, Shigella flexneri 2a str. 301
cagucgccagcgccagcgcu

SEQ ID NO: 1997664 - RNA, 14 nt, Shigella flexneri 2a str. 301
cagucacuucaaau

SEQ ID NO: 1997665 - RNA, 17 nt, Shigella flexneri 2a str. 301
cagucaccugcccuccg

SEQ ID NO: 1997666 - RNA, 20 nt, Shigella flexneri 2a str. 301
cagucaccugcggugcagcc

SEQ ID NO: 1997667 - RNA, 22 nt, Shigella flexneri 2a str. 301
cagucacgacaaagacaucaaa

SEQ ID NO: 1997668 - RNA, 22 nt, Shigella flexneri 2a str. 301
cagucacaccagcgauguaacc

SEQ ID NO: 1997669 - RNA, 15 nt, Shigella flexneri 2a str. 301
cagucaaucauccau

SEQ ID NO: 1997670 - RNA, 19 nt, Shigella flexneri 2a str. 301
caguauucaggucagcggc

SEQ ID NO: 1997671 - RNA, 15 nt, Shigella flexneri 2a str. 301
caguauugccaugca

SEQ ID NO: 1997672 - RNA, 18 nt, Shigella flexneri 2a str. 301
caguauugggaugccgaa

SEQ ID NO: 1997673 - RNA, 15 nt, Shigella flexneri 2a str. 301
caguaugaucuugcc

SEQ ID NO: 1997674 - RNA, 13 nt, Shigella flexneri 2a str. 301
caguaucugaauc

SEQ ID NO: 1997675 - RNA, 15 nt, Shigella flexneri 2a str. 301
caguaucugaaucaa

SEQ ID NO: 1997676 - RNA, 16 nt, Shigella flexneri 2a str. 301
caguaucugaaucaaa

SEQ ID NO: 1997677 - RNA, 17 nt, Shigella flexneri 2a str. 301
caguauguaacuggguu

SEQ ID NO: 1997678 - RNA, 20 nt, Shigella flexneri 2a str. 301
cagucauaaccaguccauua

SEQ ID NO: 1997679 - RNA, 14 nt, Shigella flexneri 2a str. 301
cagucauauuucug

SEQ ID NO: 1997680 - RNA, 20 nt, Shigella flexneri 2a str. 301
cagucaucacuuucagaccg

SEQ ID NO: 1997681 - RNA, 16 nt, Shigella flexneri 2a str. 301
cagucacuuuuuuccg

SEQ ID NO: 1997682 - RNA, 12 nt, Shigella flexneri 2a str. 301
cagucagucuca

SEQ ID NO: 1997683 - RNA, 17 nt, Shigella flexneri 2a str. 301
cagucagucucaaggga

SEQ ID NO: 1997684 - RNA, 17 nt, Shigella flexneri 2a str. 301
cagucaguggcagcaaa

SEQ ID NO: 1997685 - RNA, 13 nt, Shigella flexneri 2a str. 301
cagucaguugcuu

SEQ ID NO: 1997686 - RNA, 13 nt, Shigella flexneri 2a str. 301
caguccagcgccu

SEQ ID NO: 1997687 - RNA, 15 nt, Shigella flexneri 2a str. 301
caguccagcgccuga

SEQ ID NO: 1997688 - RNA, 18 nt, Shigella flexneri 2a str. 301
caguccauuaccgauaga

SEQ ID NO: 1997689 - RNA, 16 nt, Shigella flexneri 2a str. 301
caguccccacaucacu

SEQ ID NO: 1997690 - RNA, 15 nt, Shigella flexneri 2a str. 301
caguaucggcaaggu

SEQ ID NO: 1997691 - RNA, 15 nt, Shigella flexneri 2a str. 301
caguauacgccacau

SEQ ID NO: 1997692 - RNA, 21 nt, Shigella flexneri 2a str. 301
caguagugguaacgcacacau

SEQ ID NO: 1997693 - RNA, 14 nt, Shigella flexneri 2a str. 301
caguagugguaacg

SEQ ID NO: 1997694 - RNA, 18 nt, Shigella flexneri 2a str. 301
caguagccaugcauaaug

SEQ ID NO: 1997695 - RNA, 16 nt, Shigella flexneri 2a str. 301
caguagccaugcauaa

SEQ ID NO: 1997696 - RNA, 19 nt, Shigella flexneri 2a str. 301
caguagcgcaaucaccacc

SEQ ID NO: 1997697 - RNA, 19 nt, Shigella flexneri 2a str. 301
caguagcauccccggcaac

SEQ ID NO: 1997698 - RNA, 22 nt, Shigella flexneri 2a str. 301
caguagcgucgccagcaguuuc

SEQ ID NO: 1997699 - RNA, 13 nt, Shigella flexneri 2a str. 301
caguagcgggcgu

SEQ ID NO: 1997700 - RNA, 13 nt, Shigella flexneri 2a str. 301
caguacgccgccg

SEQ ID NO: 1997701 - RNA, 19 nt, Shigella flexneri 2a str. 301
caguacgcgcccgccgcug

SEQ ID NO: 1997702 - RNA, 22 nt, Shigella flexneri 2a str. 301
caguacgcccacgccagccugc

SEQ ID NO: 1997703 - RNA, 19 nt, Shigella flexneri 2a str. 301
caguacgccaaucugcaaa

SEQ ID NO: 1997704 - RNA, 21 nt, Shigella flexneri 2a str. 301
caguaccuccuucacaguggc

SEQ ID NO: 1997705 - RNA, 16 nt, Shigella flexneri 2a str. 301
caguaccuccuucaca

SEQ ID NO: 1997706 - RNA, 19 nt, Shigella flexneri 2a str. 301
caguaccgccaccaccaga

SEQ ID NO: 1997707 - RNA, 22 nt, Shigella flexneri 2a str. 301
caguaccgauugcccauacagg

SEQ ID NO: 1997708 - RNA, 23 nt, Shigella flexneri 2a str. 301
caguacggcagcaaucgaccagg

SEQ ID NO: 1997709 - RNA, 23 nt, Shigella flexneri 2a str. 301
caguacggcuucgaucaggaacu

SEQ ID NO: 1997710 - RNA, 21 nt, Shigella flexneri 2a str. 301
caguacggucgugcgguuuca

SEQ ID NO: 1997711 - RNA, 23 nt, Shigella flexneri 2a str. 301
caguagacagcaaagugccccca

SEQ ID NO: 1997712 - RNA, 16 nt, Shigella flexneri 2a str. 301
caguagacucaagcag

SEQ ID NO: 1997713 - RNA, 16 nt, Shigella flexneri 2a str. 301
caguacuggccuccac

SEQ ID NO: 1997714 - RNA, 21 nt, Shigella flexneri 2a str. 301
caggugauacguccaccccag

SEQ ID NO: 1997715 - RNA, 17 nt, Shigella flexneri 2a str. 301
caggugaaaaauaaaag

SEQ ID NO: 1997716 - RNA, 23 nt, Shigella flexneri 2a str. 301
cagguuaacucccccuuucugag

SEQ ID NO: 1997717 - RNA, 18 nt, Shigella flexneri 2a str. 301
cagguuacgcaccagaua

SEQ ID NO: 1997718 - RNA, 22 nt, Shigella flexneri 2a str. 301
cagguuauuaaauaaccagcgc

SEQ ID NO: 1997719 - RNA, 21 nt, Shigella flexneri 2a str. 301
cagguuauugacguuccccug

SEQ ID NO: 1997720 - RNA, 14 nt, Shigella flexneri 2a str. 301
cagguguccagcca

SEQ ID NO: 1997721 - RNA, 19 nt, Shigella flexneri 2a str. 301
caggugggcgcuggcuccu

SEQ ID NO: 1997722 - RNA, 21 nt, Shigella flexneri 2a str. 301
caggugggcgcuggcuccuga

SEQ ID NO: 1997723 - RNA, 18 nt, Shigella flexneri 2a str. 301
cagguggcaaugcccggu

SEQ ID NO: 1997724 - RNA, 14 nt, Shigella flexneri 2a str. 301
caggucaucauugc

SEQ ID NO: 1997725 - RNA, 16 nt, Shigella flexneri 2a str. 301
caggucagcgccuggc

SEQ ID NO: 1997726 - RNA, 13 nt, Shigella flexneri 2a str. 301
caggucagucagu

SEQ ID NO: 1997727 - RNA, 19 nt, Shigella flexneri 2a str. 301
caggucagucaguggcagc

SEQ ID NO: 1997728 - RNA, 18 nt, Shigella flexneri 2a str. 301
caggucagcaggagcagc

SEQ ID NO: 1997729 - RNA, 18 nt, Shigella flexneri 2a str. 301
cagguauuuugucagccc

SEQ ID NO: 1997730 - RNA, 18 nt, Shigella flexneri 2a str. 301
caggggcggggaauucua

SEQ ID NO: 1997731 - RNA, 14 nt, Shigella flexneri 2a str. 301
aaacaacaugcuau

SEQ ID NO: 1997732 - RNA, 14 nt, Shigella flexneri 2a str. 301
aaacaaauccgcuu

SEQ ID NO: 1997733 - RNA, 21 nt, Shigella flexneri 2a str. 301
aaacaacguggaacaaauaga

SEQ ID NO: 1997734 - RNA, 21 nt, Shigella flexneri 2a str. 301
cagguuugacauaaauuccgc

SEQ ID NO: 1997735 - RNA, 14 nt, Shigella flexneri 2a str. 301
cagguuuugaccag

SEQ ID NO: 1997736 - RNA, 16 nt, Shigella flexneri 2a str. 301
cagguuuuguuguuuc

SEQ ID NO: 1997737 - RNA, 22 nt, Shigella flexneri 2a str. 301
cagguuuuguuguuucagaaau

SEQ ID NO: 1997738 - RNA, 17 nt, Shigella flexneri 2a str. 301
cagguuuuucagcugcc

SEQ ID NO: 1997739 - RNA, 19 nt, Shigella flexneri 2a str. 301
cagguugcucauaaaauga

SEQ ID NO: 1997740 - RNA, 14 nt, Shigella flexneri 2a str. 301
cagguucguaagcg

SEQ ID NO: 1997741 - RNA, 21 nt, Shigella flexneri 2a str. 301
cagguugaucccaccgggcaa

SEQ ID NO: 1997742 - RNA, 13 nt, Shigella flexneri 2a str. 301
caguaauucagcc

SEQ ID NO: 1997743 - RNA, 16 nt, Shigella flexneri 2a str. 301
caguaaugauuuaaaa

SEQ ID NO: 1997744 - RNA, 14 nt, Shigella flexneri 2a str. 301
caguaauccuuucu

SEQ ID NO: 1997745 - RNA, 14 nt, Shigella flexneri 2a str. 301
caguaauaccagac

SEQ ID NO: 1997746 - RNA, 16 nt, Shigella flexneri 2a str. 301
caguaauaccagaccu

SEQ ID NO: 1997747 - RNA, 22 nt, Shigella flexneri 2a str. 301
caguacauuguuuuccagacug

SEQ ID NO: 1997748 - RNA, 22 nt, Shigella flexneri 2a str. 301
caguacauugagaauaucggca

SEQ ID NO: 1997749 - RNA, 23 nt, Shigella flexneri 2a str. 301
caguaccagauaaucaccugccu

SEQ ID NO: 1997750 - RNA, 13 nt, Shigella flexneri 2a str. 301
caguaccaccgcg

SEQ ID NO: 1997751 - RNA, 13 nt, Shigella flexneri 2a str. 301
caguaccagcaac

SEQ ID NO: 1997752 - RNA, 13 nt, Shigella flexneri 2a str. 301
caguaccagcagc

SEQ ID NO: 1997753 - RNA, 13 nt, Shigella flexneri 2a str. 301
caguaccagcagu

SEQ ID NO: 1997754 - RNA, 15 nt, Shigella flexneri 2a str. 301
caguaccagcaguac

SEQ ID NO: 1997755 - RNA, 15 nt, Shigella flexneri 2a str. 301
caguacagccgccag

SEQ ID NO: 1997756 - RNA, 19 nt, Shigella flexneri 2a str. 301
caguaaaccacccaccagc

SEQ ID NO: 1997757 - RNA, 21 nt, Shigella flexneri 2a str. 301
caguaaaccacccaccagcgc

SEQ ID NO: 1997758 - RNA, 19 nt, Shigella flexneri 2a str. 301
caguaaauggugauaucac

SEQ ID NO: 1997759 - RNA, 17 nt, Shigella flexneri 2a str. 301
caguaaagaaaucccau

SEQ ID NO: 1997760 - RNA, 17 nt, Shigella flexneri 2a str. 301
caguaaccacgcagcgu

SEQ ID NO: 1997761 - RNA, 22 nt, Shigella flexneri 2a str. 301
caguaacagaacgcauaacagc

SEQ ID NO: 1997762 - RNA, 21 nt, Shigella flexneri 2a str. 301
caguaaggucaucaaucauuu

SEQ ID NO: 1997763 - RNA, 14 nt, Shigella flexneri 2a str. 301
caguaagcgacggg

SEQ ID NO: 1997764 - RNA, 19 nt, Shigella flexneri 2a str. 301
caguaagcaguccagcgcc

SEQ ID NO: 1997765 - RNA, 17 nt, Shigella flexneri 2a str. 301
caguaaccgcuuuuuca

SEQ ID NO: 1997766 - RNA, 24 nt, Shigella flexneri 2a str. 301
caguaacaauauuugcagaggugc

SEQ ID NO: 1997767 - RNA, 14 nt, Shigella flexneri 2a str. 301
caguaacucauugc

SEQ ID NO: 1997768 - RNA, 14 nt, Shigella flexneri 2a str. 301
cauugauaauguua

SEQ ID NO: 1997769 - RNA, 23 nt, Shigella flexneri 2a str. 301
cauugauaauccaucacuucauc

SEQ ID NO: 1997770 - RNA, 20 nt, Shigella flexneri 2a str. 301
cauugagcuggucugaauca

SEQ ID NO: 1997771 - RNA, 16 nt, Shigella flexneri 2a str. 301
cauuuucgucaaccac

SEQ ID NO: 1997772 - RNA, 23 nt, Shigella flexneri 2a str. 301
cauuuucucgcgaaccgccuggc

SEQ ID NO: 1997773 - RNA, 21 nt, Shigella flexneri 2a str. 301
cauuuucucgcggacugccug

SEQ ID NO: 1997774 - RNA, 21 nt, Shigella flexneri 2a str. 301
cauuuucucgcgaaccgccug

SEQ ID NO: 1997775 - RNA, 17 nt, Shigella flexneri 2a str. 301
cauuuucugcccauuua

SEQ ID NO: 1997776 - RNA, 23 nt, Shigella flexneri 2a str. 301
cauuuucucgcggacugccuggc

SEQ ID NO: 1997777 - RNA, 15 nt, Shigella flexneri 2a str. 301
cauuuucuucagcag

SEQ ID NO: 1997778 - RNA, 20 nt, Shigella flexneri 2a str. 301
cauuuugacuuuuacagcuu

SEQ ID NO: 1997779 - RNA, 15 nt, Shigella flexneri 2a str. 301
cauuuugcacauucc

SEQ ID NO: 1997780 - RNA, 22 nt, Shigella flexneri 2a str. 301
cauuuuuacuccuuagcaacag

SEQ ID NO: 1997781 - RNA, 15 nt, Shigella flexneri 2a str. 301
cauuuuucacugcgg

SEQ ID NO: 1997782 - RNA, 16 nt, Shigella flexneri 2a str. 301
cauuuuucagacguuc

SEQ ID NO: 1997783 - RNA, 20 nt, Shigella flexneri 2a str. 301
cauuuuucagcguuccccag

SEQ ID NO: 1997784 - RNA, 20 nt, Shigella flexneri 2a str. 301
cauuuuuuccagguacuuuu

SEQ ID NO: 1997785 - RNA, 18 nt, Shigella flexneri 2a str. 301
cauuuuuuugucugcuau

SEQ ID NO: 1997786 - RNA, 22 nt, Shigella flexneri 2a str. 301
cauuuuuuugcauuacugcuau

SEQ ID NO: 1997787 - RNA, 22 nt, Shigella flexneri 2a str. 301
cauuuuuucacauguucauuua

SEQ ID NO: 1997788 - RNA, 21 nt, Shigella flexneri 2a str. 301
ccaaaauaauaaauuaacugc

SEQ ID NO: 1997789 - RNA, 16 nt, Shigella flexneri 2a str. 301
ccaaaaugccugaugc

SEQ ID NO: 1997790 - RNA, 17 nt, Shigella flexneri 2a str. 301
ccaaaaugacuuaauaa

SEQ ID NO: 1997791 - RNA, 16 nt, Shigella flexneri 2a str. 301
ccaaaagcuaacagag

SEQ ID NO: 1997792 - RNA, 15 nt, Shigella flexneri 2a str. 301
ccaaaagcugggaug

SEQ ID NO: 1997793 - RNA, 11 nt, Shigella flexneri 2a str. 301
ccaaaacugga

SEQ ID NO: 1997794 - RNA, 17 nt, Shigella flexneri 2a str. 301
ccaaaaagauuaaaaaa

SEQ ID NO: 1997795 - RNA, 15 nt, Shigella flexneri 2a str. 301
ccaaaaagauuaaaa

SEQ ID NO: 1997796 - RNA, 23 nt, Shigella flexneri 2a str. 301
ccaaaaaagcgaaucuuuaucgg

SEQ ID NO: 1997797 - RNA, 13 nt, Shigella flexneri 2a str. 301
ccaaaaacgccau

SEQ ID NO: 1997798 - RNA, 14 nt, Shigella flexneri 2a str. 301
ccaaacagcagaac

SEQ ID NO: 1997799 - RNA, 14 nt, Shigella flexneri 2a str. 301
ccaaacagaccaau

SEQ ID NO: 1997800 - RNA, 11 nt, Shigella flexneri 2a str. 301
ccaaacagcag

SEQ ID NO: 1997801 - RNA, 23 nt, Shigella flexneri 2a str. 301
ccaaacgccggaugcaaaaaaaa

SEQ ID NO: 1997802 - RNA, 15 nt, Shigella flexneri 2a str. 301
ccaaacuuaacacug

SEQ ID NO: 1997803 - RNA, 15 nt, Shigella flexneri 2a str. 301
ccaagaaacaccaga

SEQ ID NO: 1997804 - RNA, 15 nt, Shigella flexneri 2a str. 301
ccaagcuccagcauc

SEQ ID NO: 1997805 - RNA, 15 nt, Shigella flexneri 2a str. 301
ccaagggcggcgaga

SEQ ID NO: 1997806 - RNA, 15 nt, Shigella flexneri 2a str. 301
ccaaccggcacaaua

SEQ ID NO: 1997807 - RNA, 16 nt, Shigella flexneri 2a str. 301
ccaaccggcacaauau

SEQ ID NO: 1997808 - RNA, 13 nt, Shigella flexneri 2a str. 301
ccaaccgccaccg

SEQ ID NO: 1997809 - RNA, 16 nt, Shigella flexneri 2a str. 301
ccaaccgcccugcggc

SEQ ID NO: 1997810 - RNA, 19 nt, Shigella flexneri 2a str. 301
ccaacuugcccaggugugu

SEQ ID NO: 1997811 - RNA, 20 nt, Shigella flexneri 2a str. 301
ccaacuuuuggggugcaguu

SEQ ID NO: 1997812 - RNA, 13 nt, Shigella flexneri 2a str. 301
ccaacuucaugac

SEQ ID NO: 1997813 - RNA, 14 nt, Shigella flexneri 2a str. 301
ccaacuccagcggc

SEQ ID NO: 1997814 - RNA, 13 nt, Shigella flexneri 2a str. 301
ccaaagaaaucag

SEQ ID NO: 1997815 - RNA, 17 nt, Shigella flexneri 2a str. 301
ccaaagaaaucaguaaa

SEQ ID NO: 1997816 - RNA, 15 nt, Shigella flexneri 2a str. 301
ccaaaucuuuucugc

SEQ ID NO: 1997817 - RNA, 21 nt, Shigella flexneri 2a str. 301
ccaaccacggaguugaccagc

SEQ ID NO: 1997818 - RNA, 20 nt, Shigella flexneri 2a str. 301
ccaaccacaugaucauucac

SEQ ID NO: 1997819 - RNA, 13 nt, Shigella flexneri 2a str. 301
ccaaccaaggaag

SEQ ID NO: 1997820 - RNA, 13 nt, Shigella flexneri 2a str. 301
ccaaccagcugac

SEQ ID NO: 1997821 - RNA, 21 nt, Shigella flexneri 2a str. 301
ccaaccaugccgcccagaagc

SEQ ID NO: 1997822 - RNA, 14 nt, Shigella flexneri 2a str. 301
ccaaccauccccau

SEQ ID NO: 1997823 - RNA, 16 nt, Shigella flexneri 2a str. 301
ccaaaugucaccagcc

SEQ ID NO: 1997824 - RNA, 18 nt, Shigella flexneri 2a str. 301
ccaaauguugucucagau

SEQ ID NO: 1997825 - RNA, 15 nt, Shigella flexneri 2a str. 301
ccaaauuuaaacgac

SEQ ID NO: 1997826 - RNA, 20 nt, Shigella flexneri 2a str. 301
ccaaauuuaaacgacaauac

SEQ ID NO: 1997827 - RNA, 21 nt, Shigella flexneri 2a str. 301
ccaccgucgggcugacguuaa

SEQ ID NO: 1997828 - RNA, 18 nt, Shigella flexneri 2a str. 301
ccaccguuucuacaagca

SEQ ID NO: 1997829 - RNA, 14 nt, Shigella flexneri 2a str. 301
ccaccguuucuuuu

SEQ ID NO: 1997830 - RNA, 19 nt, Shigella flexneri 2a str. 301
ccaccggacggacuuccag

SEQ ID NO: 1997831 - RNA, 18 nt, Shigella flexneri 2a str. 301
ccaccggcaaucugcugg

SEQ ID NO: 1997832 - RNA, 12 nt, Shigella flexneri 2a str. 301
ccacgaaacugc

SEQ ID NO: 1997833 - RNA, 20 nt, Shigella flexneri 2a str. 301
ccacgaaaccgacugccaug

SEQ ID NO: 1997834 - RNA, 18 nt, Shigella flexneri 2a str. 301
ccacgcagcagccaagca

SEQ ID NO: 1997835 - RNA, 20 nt, Shigella flexneri 2a str. 301
ccaccugcgaacuguaauga

SEQ ID NO: 1997836 - RNA, 21 nt, Shigella flexneri 2a str. 301
ccaccuggccugggaucauca

SEQ ID NO: 1997837 - RNA, 15 nt, Shigella flexneri 2a str. 301
ccaccuuaaaacaau

SEQ ID NO: 1997838 - RNA, 14 nt, Shigella flexneri 2a str. 301
ccaccaaagauguc

SEQ ID NO: 1997839 - RNA, 18 nt, Shigella flexneri 2a str. 301
ccaccaauggcuggccug

SEQ ID NO: 1997840 - RNA, 13 nt, Shigella flexneri 2a str. 301
ccaccaauaauga

SEQ ID NO: 1997841 - RNA, 12 nt, Shigella flexneri 2a str. 301
ccaccacaaaag

SEQ ID NO: 1997842 - RNA, 14 nt, Shigella flexneri 2a str. 301
ccaccaccaccugc

SEQ ID NO: 1997843 - RNA, 23 nt, Shigella flexneri 2a str. 301
ccaccagccccagaauucacgca

SEQ ID NO: 1997844 - RNA, 13 nt, Shigella flexneri 2a str. 301
ccacccagcaucu

SEQ ID NO: 1997845 - RNA, 18 nt, Shigella flexneri 2a str. 301
ccacccaccgcagcccag

SEQ ID NO: 1997846 - RNA, 14 nt, Shigella flexneri 2a str. 301
ccacccauuuuaau

SEQ ID NO: 1997847 - RNA, 19 nt, Shigella flexneri 2a str. 301
ccaccaggaacgcgccaag

SEQ ID NO: 1997848 - RNA, 17 nt, Shigella flexneri 2a str. 301
ccaccgacgcagucaug

SEQ ID NO: 1997849 - RNA, 16 nt, Shigella flexneri 2a str. 301
ccaccgaugaagaacu

SEQ ID NO: 1997850 - RNA, 20 nt, Shigella flexneri 2a str. 301
ccaccgaugcacagcacgcu

SEQ ID NO: 1997851 - RNA, 23 nt, Shigella flexneri 2a str. 301
ccaccgauuuucagccaucaucc

SEQ ID NO: 1997852 - RNA, 14 nt, Shigella flexneri 2a str. 301
ccaccgcaaucgcc

SEQ ID NO: 1997853 - RNA, 17 nt, Shigella flexneri 2a str. 301
ccaccgcaaucgccagu

SEQ ID NO: 1997854 - RNA, 17 nt, Shigella flexneri 2a str. 301
ccacccgcagcaagcgu

SEQ ID NO: 1997855 - RNA, 17 nt, Shigella flexneri 2a str. 301
ccaaucuucucuuccgg

SEQ ID NO: 1997856 - RNA, 14 nt, Shigella flexneri 2a str. 301
ccaauaaacgccag

SEQ ID NO: 1997857 - RNA, 13 nt, Shigella flexneri 2a str. 301
ccaauaaaaauac

SEQ ID NO: 1997858 - RNA, 22 nt, Shigella flexneri 2a str. 301
ccaaugauugggucauuuccca

SEQ ID NO: 1997859 - RNA, 22 nt, Shigella flexneri 2a str. 301
ccaauuaaugcaccaacaaaua

SEQ ID NO: 1997860 - RNA, 17 nt, Shigella flexneri 2a str. 301
ccaaugccguucucugg

SEQ ID NO: 1997861 - RNA, 14 nt, Shigella flexneri 2a str. 301
ccaauuccgcagcg

SEQ ID NO: 1997862 - RNA, 23 nt, Shigella flexneri 2a str. 301
ccacaaaacggauguuucuucaa

SEQ ID NO: 1997863 - RNA, 22 nt, Shigella flexneri 2a str. 301
ccacaaaagcggugauaaaccc

SEQ ID NO: 1997864 - RNA, 21 nt, Shigella flexneri 2a str. 301
ccacaaacccgccagaccagc

SEQ ID NO: 1997865 - RNA, 13 nt, Shigella flexneri 2a str. 301
ccacaaacucuuu

SEQ ID NO: 1997866 - RNA, 16 nt, Shigella flexneri 2a str. 301
ccacaaacucuuuucc

SEQ ID NO: 1997867 - RNA, 20 nt, Shigella flexneri 2a str. 301
ccacaaagcagacaacccac

SEQ ID NO: 1997868 - RNA, 15 nt, Shigella flexneri 2a str. 301
ccacaaagcagggcu

SEQ ID NO: 1997869 - RNA, 20 nt, Shigella flexneri 2a str. 301
ccacaaccgccguugccuuu

SEQ ID NO: 1997870 - RNA, 11 nt, Shigella flexneri 2a str. 301
ccacaacagug

SEQ ID NO: 1997871 - RNA, 13 nt, Shigella flexneri 2a str. 301
ccacaacuucaac

SEQ ID NO: 1997872 - RNA, 20 nt, Shigella flexneri 2a str. 301
ccacaugccugcauaaagga

SEQ ID NO: 1997873 - RNA, 21 nt, Shigella flexneri 2a str. 301
ccacaugaucauucaccagcc

SEQ ID NO: 1997874 - RNA, 16 nt, Shigella flexneri 2a str. 301
ccacauuagauaaaaa

SEQ ID NO: 1997875 - RNA, 21 nt, Shigella flexneri 2a str. 301
ccacauuagauaaaaaugaag

SEQ ID NO: 1997876 - RNA, 15 nt, Shigella flexneri 2a str. 301
ccacauugcaucuga

SEQ ID NO: 1997877 - RNA, 14 nt, Shigella flexneri 2a str. 301
ccacauuuuccauc

SEQ ID NO: 1997878 - RNA, 23 nt, Shigella flexneri 2a str. 301
ccacaucacuccauccagcaaca

SEQ ID NO: 1997879 - RNA, 12 nt, Shigella flexneri 2a str. 301
ccacaucagcgg

SEQ ID NO: 1997880 - RNA, 13 nt, Shigella flexneri 2a str. 301
ccacauccggcuu

SEQ ID NO: 1997881 - RNA, 13 nt, Shigella flexneri 2a str. 301
ccacauccagugg

SEQ ID NO: 1997882 - RNA, 19 nt, Shigella flexneri 2a str. 301
ccacaucggcaucaggcca

SEQ ID NO: 1997883 - RNA, 17 nt, Shigella flexneri 2a str. 301
ccacaucgcaaaaugau

SEQ ID NO: 1997884 - RNA, 23 nt, Shigella flexneri 2a str. 301
ccacaucgguuugcgcagcuuug

SEQ ID NO: 1997885 - RNA, 22 nt, Shigella flexneri 2a str. 301
ccacaucuaccgccagccaggu

SEQ ID NO: 1997886 - RNA, 12 nt, Shigella flexneri 2a str. 301
ccacaaucucac

SEQ ID NO: 1997887 - RNA, 16 nt, Shigella flexneri 2a str. 301
ccacaccggaccagac

SEQ ID NO: 1997888 - RNA, 15 nt, Shigella flexneri 2a str. 301
ccacaauugaccagu

SEQ ID NO: 1997889 - RNA, 18 nt, Shigella flexneri 2a str. 301
ccacacucucgcgcagcg

SEQ ID NO: 1997890 - RNA, 18 nt, Shigella flexneri 2a str. 301
ccacagggugaucaccag

SEQ ID NO: 1997891 - RNA, 14 nt, Shigella flexneri 2a str. 301
ccacaguuucauau

SEQ ID NO: 1997892 - RNA, 15 nt, Shigella flexneri 2a str. 301
ccacaucaaucccuu

SEQ ID NO: 1997893 - RNA, 12 nt, Shigella flexneri 2a str. 301
ccacgccacagc

SEQ ID NO: 1997894 - RNA, 16 nt, Shigella flexneri 2a str. 301
ccacgccacaauacug

SEQ ID NO: 1997895 - RNA, 18 nt, Shigella flexneri 2a str. 301
ccacgccaauguguuuau

SEQ ID NO: 1997896 - RNA, 15 nt, Shigella flexneri 2a str. 301
ccacugccaaucacc

SEQ ID NO: 1997897 - RNA, 17 nt, Shigella flexneri 2a str. 301
ccacugccaaucaccug

SEQ ID NO: 1997898 - RNA, 14 nt, Shigella flexneri 2a str. 301
ccacugcgccgcuc

SEQ ID NO: 1997899 - RNA, 15 nt, Shigella flexneri 2a str. 301
ccacugcgccaucaa

SEQ ID NO: 1997900 - RNA, 20 nt, Shigella flexneri 2a str. 301
ccacuggcugcuuucuuuga

SEQ ID NO: 1997901 - RNA, 22 nt, Shigella flexneri 2a str. 301
ccacuggugagcgguguugccg

SEQ ID NO: 1997902 - RNA, 23 nt, Shigella flexneri 2a str. 301
ccacuuccgcgucaaucugcccg

SEQ ID NO: 1997903 - RNA, 16 nt, Shigella flexneri 2a str. 301
ccacuuccugcucggu

SEQ ID NO: 1997904 - RNA, 13 nt, Shigella flexneri 2a str. 301
ccacuucaugccc

SEQ ID NO: 1997905 - RNA, 16 nt, Shigella flexneri 2a str. 301
ccacuuccaccagcgg

SEQ ID NO: 1997906 - RNA, 21 nt, Shigella flexneri 2a str. 301
ccacuuccaccacuuccugcu

SEQ ID NO: 1997907 - RNA, 22 nt, Shigella flexneri 2a str. 301
ccacuucccaguguucuggcga

SEQ ID NO: 1997908 - RNA, 21 nt, Shigella flexneri 2a str. 301
ccacuucacggcugcuaauau

SEQ ID NO: 1997909 - RNA, 13 nt, Shigella flexneri 2a str. 301
ccacuugcagcuc

SEQ ID NO: 1997910 - RNA, 15 nt, Shigella flexneri 2a str. 301
ccacuugcagcucau

SEQ ID NO: 1997911 - RNA, 20 nt, Shigella flexneri 2a str. 301
ccacuucuuccagcggcagg

SEQ ID NO: 1997912 - RNA, 16 nt, Shigella flexneri 2a str. 301
ccagacaaaugaacac

SEQ ID NO: 1997913 - RNA, 12 nt, Shigella flexneri 2a str. 301
ccagacaaauga

SEQ ID NO: 1997914 - RNA, 21 nt, Shigella flexneri 2a str. 301
ccagacaauugccgccagcuc

SEQ ID NO: 1997915 - RNA, 21 nt, Shigella flexneri 2a str. 301
ccagaaugucggaugcagaac

SEQ ID NO: 1997916 - RNA, 13 nt, Shigella flexneri 2a str. 301
ccagacaaaccac

SEQ ID NO: 1997917 - RNA, 18 nt, Shigella flexneri 2a str. 301
ccagaauaaacaacugug

SEQ ID NO: 1997918 - RNA, 13 nt, Shigella flexneri 2a str. 301
ccagaagggcgag

SEQ ID NO: 1997919 - RNA, 18 nt, Shigella flexneri 2a str. 301
ccagaauagccgcagcca

SEQ ID NO: 1997920 - RNA, 13 nt, Shigella flexneri 2a str. 301
ccagaacugaucc

SEQ ID NO: 1997921 - RNA, 23 nt, Shigella flexneri 2a str. 301
ccagaacugauaacgcauuucau

SEQ ID NO: 1997922 - RNA, 17 nt, Shigella flexneri 2a str. 301
ccagaagaugcguucac

SEQ ID NO: 1997923 - RNA, 14 nt, Shigella flexneri 2a str. 301
ccagaagaauauca

SEQ ID NO: 1997924 - RNA, 12 nt, Shigella flexneri 2a str. 301
ccagaaacaaua

SEQ ID NO: 1997925 - RNA, 15 nt, Shigella flexneri 2a str. 301
ccagaaacaauaagu

SEQ ID NO: 1997926 - RNA, 23 nt, Shigella flexneri 2a str. 301
ccagaaagcguauccaucacuaa

SEQ ID NO: 1997927 - RNA, 22 nt, Shigella flexneri 2a str. 301
ccagaaacgcguugucuuucca

SEQ ID NO: 1997928 - RNA, 12 nt, Shigella flexneri 2a str. 301
ccacuuugcgcu

SEQ ID NO: 1997929 - RNA, 11 nt, Shigella flexneri 2a str. 301
ccagaaaucag

SEQ ID NO: 1997930 - RNA, 17 nt, Shigella flexneri 2a str. 301
ccagaaaucggccuucc

SEQ ID NO: 1997931 - RNA, 18 nt, Shigella flexneri 2a str. 301
ccagaacaaacuacauag

SEQ ID NO: 1997932 - RNA, 19 nt, Shigella flexneri 2a str. 301
ccagaacacuguuaccgcu

SEQ ID NO: 1997933 - RNA, 18 nt, Shigella flexneri 2a str. 301
ccagaacacgcucccagc

SEQ ID NO: 1997934 - RNA, 17 nt, Shigella flexneri 2a str. 301
ccagaacaccauaauga

SEQ ID NO: 1997935 - RNA, 15 nt, Shigella flexneri 2a str. 301
ccagauuaauuauug

SEQ ID NO: 1997936 - RNA, 21 nt, Shigella flexneri 2a str. 301
ccagauggcuuuccaccauca

SEQ ID NO: 1997937 - RNA, 18 nt, Shigella flexneri 2a str. 301
ccagauggcuuugcccuu

SEQ ID NO: 1997938 - RNA, 16 nt, Shigella flexneri 2a str. 301
ccagaugucuuuaccc

SEQ ID NO: 1997939 - RNA, 17 nt, Shigella flexneri 2a str. 301
ccagauggcuuuccacc

SEQ ID NO: 1997940 - RNA, 17 nt, Shigella flexneri 2a str. 301
ccagaucggacuucaug

SEQ ID NO: 1997941 - RNA, 15 nt, Shigella flexneri 2a str. 301
ccagaucggucagug

SEQ ID NO: 1997942 - RNA, 14 nt, Shigella flexneri 2a str. 301
ccagaucgccugcc

SEQ ID NO: 1997943 - RNA, 17 nt, Shigella flexneri 2a str. 301
ccagaucgaucauauuu

SEQ ID NO: 1997944 - RNA, 13 nt, Shigella flexneri 2a str. 301
ccagauagccagg

SEQ ID NO: 1997945 - RNA, 22 nt, Shigella flexneri 2a str. 301
ccagauagaacaucucuuccca

SEQ ID NO: 1997946 - RNA, 16 nt, Shigella flexneri 2a str. 301
ccagagugaccgccaa

SEQ ID NO: 1997947 - RNA, 17 nt, Shigella flexneri 2a str. 301
ccagauaaauauuauug

SEQ ID NO: 1997948 - RNA, 14 nt, Shigella flexneri 2a str. 301
ccagauaagacacu

SEQ ID NO: 1997949 - RNA, 15 nt, Shigella flexneri 2a str. 301
ccagauaagacacug

SEQ ID NO: 1997950 - RNA, 12 nt, Shigella flexneri 2a str. 301
ccagauaagacg

SEQ ID NO: 1997951 - RNA, 17 nt, Shigella flexneri 2a str. 301
ccagauacaaaaaaggc

SEQ ID NO: 1997952 - RNA, 23 nt, Shigella flexneri 2a str. 301
ccagauaauggcuguugaaugcc

SEQ ID NO: 1997953 - RNA, 18 nt, Shigella flexneri 2a str. 301
ccagauaaucaccugccu

SEQ ID NO: 1997954 - RNA, 22 nt, Shigella flexneri 2a str. 301
ccagacgcaacagaaacgccau

SEQ ID NO: 1997955 - RNA, 15 nt, Shigella flexneri 2a str. 301
ccagacgcagcaagg

SEQ ID NO: 1997956 - RNA, 13 nt, Shigella flexneri 2a str. 301
ccagacgccagcc

SEQ ID NO: 1997957 - RNA, 17 nt, Shigella flexneri 2a str. 301
ccagacgcgcagcuuca

SEQ ID NO: 1997958 - RNA, 19 nt, Shigella flexneri 2a str. 301
ccagacgcgcagcuucacu

SEQ ID NO: 1997959 - RNA, 14 nt, Shigella flexneri 2a str. 301
ccagacgaauaaaa

SEQ ID NO: 1997960 - RNA, 17 nt, Shigella flexneri 2a str. 301
ccagacgaauaaaacag

SEQ ID NO: 1997961 - RNA, 16 nt, Shigella flexneri 2a str. 301
ccagaccugagcaucg

SEQ ID NO: 1997962 - RNA, 18 nt, Shigella flexneri 2a str. 301
ccagaccugaaaccgccu

SEQ ID NO: 1997963 - RNA, 19 nt, Shigella flexneri 2a str. 301
ccagaccguggucagaaaa

SEQ ID NO: 1997964 - RNA, 20 nt, Shigella flexneri 2a str. 301
ccagaccguggucagaaaag

SEQ ID NO: 1997965 - RNA, 16 nt, Shigella flexneri 2a str. 301
ccagacaucaccagua

SEQ ID NO: 1997966 - RNA, 22 nt, Shigella flexneri 2a str. 301
ccagacauuauaaauucuggcc

SEQ ID NO: 1997967 - RNA, 17 nt, Shigella flexneri 2a str. 301
ccagaccgcagaagccg

SEQ ID NO: 1997968 - RNA, 16 nt, Shigella flexneri 2a str. 301
ccagaggagccaucac

SEQ ID NO: 1997969 - RNA, 19 nt, Shigella flexneri 2a str. 301
ccagacguccggcgcugca

SEQ ID NO: 1997970 - RNA, 23 nt, Shigella flexneri 2a str. 301
ccagacugaugugauccaucagg

SEQ ID NO: 1997971 - RNA, 20 nt, Shigella flexneri 2a str. 301
ccagacuggagcacugcgcc

SEQ ID NO: 1997972 - RNA, 14 nt, Shigella flexneri 2a str. 301
ccagacugcucagc

SEQ ID NO: 1997973 - RNA, 15 nt, Shigella flexneri 2a str. 301
ccagacugcuccugu

SEQ ID NO: 1997974 - RNA, 14 nt, Shigella flexneri 2a str. 301
ccagagcagcaaca

SEQ ID NO: 1997975 - RNA, 21 nt, Shigella flexneri 2a str. 301
ccagagcagcgaauuucucau

SEQ ID NO: 1997976 - RNA, 15 nt, Shigella flexneri 2a str. 301
ccagagaauauuaac

SEQ ID NO: 1997977 - RNA, 13 nt, Shigella flexneri 2a str. 301
ccagcagcagcgg

SEQ ID NO: 1997978 - RNA, 22 nt, Shigella flexneri 2a str. 301
ccagcagcgaaucagcccagcc

SEQ ID NO: 1997979 - RNA, 21 nt, Shigella flexneri 2a str. 301
ccagcagcugcucccagcgca

SEQ ID NO: 1997980 - RNA, 13 nt, Shigella flexneri 2a str. 301
ccagcagcugcuc

SEQ ID NO: 1997981 - RNA, 14 nt, Shigella flexneri 2a str. 301
ccagcagcugcucc

SEQ ID NO: 1997982 - RNA, 23 nt, Shigella flexneri 2a str. 301
ccagcaccgcagagaucgccccg

SEQ ID NO: 1997983 - RNA, 16 nt, Shigella flexneri 2a str. 301
ccagcaccgcagagau

SEQ ID NO: 1997984 - RNA, 19 nt, Shigella flexneri 2a str. 301
ccagcaccgucaaacacag

SEQ ID NO: 1997985 - RNA, 18 nt, Shigella flexneri 2a str. 301
ccagcacgaucagugccg

SEQ ID NO: 1997986 - RNA, 17 nt, Shigella flexneri 2a str. 301
ccagcagaccuucugcc

SEQ ID NO: 1997987 - RNA, 14 nt, Shigella flexneri 2a str. 301
ccagcagaccagca

SEQ ID NO: 1997988 - RNA, 15 nt, Shigella flexneri 2a str. 301
ccagcacggugaaga

SEQ ID NO: 1997989 - RNA, 20 nt, Shigella flexneri 2a str. 301
ccagcacggauaccgcacgc

SEQ ID NO: 1997990 - RNA, 23 nt, Shigella flexneri 2a str. 301
ccagcaagagcaaauaaaacauc

SEQ ID NO: 1997991 - RNA, 20 nt, Shigella flexneri 2a str. 301
ccagcaagagcaaauaaaac

SEQ ID NO: 1997992 - RNA, 13 nt, Shigella flexneri 2a str. 301
ccagcaagaacca

SEQ ID NO: 1997993 - RNA, 15 nt, Shigella flexneri 2a str. 301
ccagcaacugauaaa

SEQ ID NO: 1997994 - RNA, 13 nt, Shigella flexneri 2a str. 301
ccagcaacaacag

SEQ ID NO: 1997995 - RNA, 17 nt, Shigella flexneri 2a str. 301
ccagcaacaacagcgcg

SEQ ID NO: 1997996 - RNA, 13 nt, Shigella flexneri 2a str. 301
ccagcaacaaaua

SEQ ID NO: 1997997 - RNA, 15 nt, Shigella flexneri 2a str. 301
ccagcaaaaucacca

SEQ ID NO: 1997998 - RNA, 17 nt, Shigella flexneri 2a str. 301
ccagcaaaaucaccauc

SEQ ID NO: 1997999 - RNA, 17 nt, Shigella flexneri 2a str. 301
ccagauuuaacggcagc

SEQ ID NO: 1998000 - RNA, 18 nt, Shigella flexneri 2a str. 301
ccagauuuauaaaagaaa

SEQ ID NO: 1998001 - RNA, 21 nt, Shigella flexneri 2a str. 301
ccagauugugaaucgccugga

SEQ ID NO: 1998002 - RNA, 22 nt, Shigella flexneri 2a str. 301
ccagauugugugauacuucuuc

SEQ ID NO: 1998003 - RNA, 22 nt, Shigella flexneri 2a str. 301
ccagauuuuuauccaguuguuc
